United States Patent 12,031,154 (UNIVERSAL DONOR STEM CELLS AND RELATED METHODS) - sequence listing, part 3

SEQ ID NO: 39993 - DNA, 20 bp, synthetic construct
  misc_feature 1..20: note = CRISPR gRNA sequence
  source 1..20: mol_type = other DNA
cctctctaccctccacagct

SEQ ID NO: 39994 - DNA, 20 bp, synthetic construct
  misc_feature 1..20: note = CRISPR gRNA sequence
  source 1..20: mol_type = other DNA
ctctaccctccacagctggg

SEQ ID NO: 39995 - DNA, 20 bp, synthetic construct
  misc_feature 1..20: note = CRISPR gRNA sequence
  source 1..20: mol_type = other DNA
cctccacagctgggcagtgc

SEQ ID NO: 39996 - DNA, 20 bp, synthetic construct
  misc_feature 1..20: note = CRISPR gRNA sequence
  source 1..20: mol_type = other DNA
cacagctgggcagtgccagt

SEQ ID NO: 39997 - DNA, 20 bp, synthetic construct
  misc_feature 1..20: note = CRISPR gRNA sequence
  source 1..20: mol_type = other DNA
agtgccagtcagtcaactgc

SEQ ID NO: 39998 - DNA, 20 bp, synthetic construct
  misc_feature 1..20: note = CRISPR gRNA sequence
  source 1..20: mol_type = other DNA
gtgccagtcagtcaactgcc

SEQ ID NO: 39999 - DNA, 20 bp, synthetic construct
  misc_feature 1..20: note = CRISPR gRNA sequence
  source 1..20: mol_type = other DNA
tgccagtcagtcaactgcca

SEQ ID NO: 40000 - DNA, 20 bp, synthetic construct
  misc_feature 1..20: note = CRISPR gRNA sequence
  source 1..20: mol_type = other DNA
agtcaactgccagggtgacc

SEQ ID NO: 40001 - DNA, 20 bp, synthetic construct
  misc_feature 1..20: note = CRISPR gRNA sequence
  source 1..20: mol_type = other DNA
gggtgacctggacaaattca

SEQ ID NO: 40002 - DNA, 20 bp, synthetic construct
  misc_feature 1..20: note = CRISPR gRNA sequence
  source 1..20: mol_type = other DNA
tgacctggacaaattcacgg

SEQ ID NO: 40003 - DNA, 20 bp, synthetic construct
  misc_feature 1..20: note = CRISPR gRNA sequence
  source 1..20: mol_type = other DNA
acctggacaaattcacggaa

SEQ ID NO: 40004 - DNA, 20 bp, synthetic construct
  misc_feature 1..20: note = CRISPR gRNA sequence
  source 1..20: mol_type = other DNA
tggacaaattcacggaagag

SEQ ID NO: 40005 - DNA, 20 bp, synthetic construct
  misc_feature 1..20: note = CRISPR gRNA sequence
  source 1..20: mol_type = other DNA
ggacaaattcacggaagagc

SEQ ID NO: 40006 - DNA, 20 bp, synthetic construct
  misc_feature 1..20: note = CRISPR gRNA sequence
  source 1..20: mol_type = other DNA
caaattcacggaagagcggg

SEQ ID NO: 40007 - DNA, 20 bp, synthetic construct
  misc_feature 1..20: note = CRISPR gRNA sequence
  source 1..20: mol_type = other DNA
ttcacggaagagcgggaagt

SEQ ID NO: 40008 - DNA, 20 bp, synthetic construct
  misc_feature 1..20: note = CRISPR gRNA sequence
  source 1..20: mol_type = other DNA
acggaagagcgggaagtgag

SEQ ID NO: 40009 - DNA, 20 bp, synthetic construct
  misc_feature 1..20: note = CRISPR gRNA sequence
  source 1..20: mol_type = other DNA
cggaagagcgggaagtgagc

SEQ ID NO: 40010 - DNA, 20 bp, synthetic construct
  misc_feature 1..20: note = CRISPR gRNA sequence
  source 1..20: mol_type = other DNA
gagcgggaagtgagcaggct

SEQ ID NO: 40011 - DNA, 20 bp, synthetic construct
  misc_feature 1..20: note = CRISPR gRNA sequence
  source 1..20: mol_type = other DNA
ggaagtgagcaggcttggca

SEQ ID NO: 40012 - DNA, 20 bp, synthetic construct
  misc_feature 1..20: note = CRISPR gRNA sequence
  source 1..20: mol_type = other DNA
gaagtgagcaggcttggcaa

SEQ ID NO: 40013 - DNA, 20 bp, synthetic construct
  misc_feature 1..20: note = CRISPR gRNA sequence
  source 1..20: mol_type = other DNA
agcaggcttggcaaaggatg

SEQ ID NO: 40014 - DNA, 20 bp, synthetic construct
  misc_feature 1..20: note = CRISPR gRNA sequence
  source 1..20: mol_type = other DNA
tggcaaaggatgcagcccca

SEQ ID NO: 40015 - DNA, 20 bp, synthetic construct
  misc_feature 1..20: note = CRISPR gRNA sequence
  source 1..20: mol_type = other DNA
ggcaaaggatgcagccccaa

SEQ ID NO: 40016 - DNA, 20 bp, synthetic construct
  misc_feature 1..20: note = CRISPR gRNA sequence
  source 1..20: mol_type = other DNA
gcaaaggatgcagccccaaa

SEQ ID NO: 40017 - DNA, 20 bp, synthetic construct
  misc_feature 1..20: note = CRISPR gRNA sequence
  source 1..20: mol_type = other DNA
caaaggatgcagccccaaag

SEQ ID NO: 40018 - DNA, 20 bp, synthetic construct
  misc_feature 1..20: note = CRISPR gRNA sequence
  source 1..20: mol_type = other DNA
aaaggatgcagccccaaagg

SEQ ID NO: 40019 - DNA, 20 bp, synthetic construct
  misc_feature 1..20: note = CRISPR gRNA sequence
  source 1..20: mol_type = other DNA
aggatgcagccccaaagggg

SEQ ID NO: 40020 - DNA, 20 bp, synthetic construct
  misc_feature 1..20: note = CRISPR gRNA sequence
  source 1..20: mol_type = other DNA
ggatgcagccccaaaggggg

SEQ ID NO: 40021 - DNA, 20 bp, synthetic construct
  misc_feature 1..20: note = CRISPR gRNA sequence
  source 1..20: mol_type = other DNA
gatgcagccccaaaggggga

SEQ ID NO: 40022 - DNA, 20 bp, synthetic construct
  misc_feature 1..20: note = CRISPR gRNA sequence
  source 1..20: mol_type = other DNA
aaagggggagggtccaaatc

SEQ ID NO: 40023 - DNA, 20 bp, synthetic construct
  misc_feature 1..20: note = CRISPR gRNA sequence
  source 1..20: mol_type = other DNA
cagaccacctccgcctctca

SEQ ID NO: 40024 - DNA, 20 bp, synthetic construct
  misc_feature 1..20: note = CRISPR gRNA sequence
  source 1..20: mol_type = other DNA
ccgcctctcatggtgcctga

SEQ ID NO: 40025 - DNA, 20 bp, synthetic construct
  misc_feature 1..20: note = CRISPR gRNA sequence
  source 1..20: mol_type = other DNA
cgcctctcatggtgcctgaa

SEQ ID NO: 40026 - DNA, 20 bp, synthetic construct
  misc_feature 1..20: note = CRISPR gRNA sequence
  source 1..20: mol_type = other DNA
cctctcatggtgcctgaaag

SEQ ID NO: 40027 - DNA, 20 bp, synthetic construct
  misc_feature 1..20: note = CRISPR gRNA sequence
  source 1..20: mol_type = other DNA
atggtgcctgaaaggagccc

SEQ ID NO: 40028 - DNA, 20 bp, synthetic construct
  misc_feature 1..20: note = CRISPR gRNA sequence
  source 1..20: mol_type = other DNA
ctgaaaggagccccagtgtg

SEQ ID NO: 40029 - DNA, 20 bp, synthetic construct
  misc_feature 1..20: note = CRISPR gRNA sequence
  source 1..20: mol_type = other DNA
tgaaaggagccccagtgtgt

SEQ ID NO: 40030 - DNA, 20 bp, synthetic construct
  misc_feature 1..20: note = CRISPR gRNA sequence
  source 1..20: mol_type = other DNA
gagccccagtgtgtaggata

SEQ ID NO: 40031 - DNA, 20 bp, synthetic construct
  misc_feature 1..20: note = CRISPR gRNA sequence
  source 1..20: mol_type = other DNA
cccagtgtgtaggatataga

SEQ ID NO: 40032 - DNA, 20 bp, synthetic construct
  misc_feature 1..20: note = CRISPR gRNA sequence
  source 1..20: mol_type = other DNA
agtgtgtaggatatagacag

SEQ ID NO: 40033 - DNA, 20 bp, synthetic construct
  misc_feature 1..20: note = CRISPR gRNA sequence
  source 1..20: mol_type = other DNA
gtgtgtaggatatagacagc

SEQ ID NO: 40034 - DNA, 20 bp, synthetic construct
  misc_feature 1..20: note = CRISPR gRNA sequence
  source 1..20: mol_type = other DNA
gtaggatatagacagcaggc

SEQ ID NO: 40035 - DNA, 20 bp, synthetic construct
  misc_feature 1..20: note = CRISPR gRNA sequence
  source 1..20: mol_type = other DNA
taggatatagacagcaggcc

SEQ ID NO: 40036 - DNA, 20 bp, synthetic construct
  misc_feature 1..20: note = CRISPR gRNA sequence
  source 1..20: mol_type = other DNA
aggatatagacagcaggcca

SEQ ID NO: 40037 - DNA, 20 bp, synthetic construct
  misc_feature 1..20: note = CRISPR gRNA sequence
  source 1..20: mol_type = other DNA
atatagacagcaggccaggg

SEQ ID NO: 40038 - DNA, 20 bp, synthetic construct
  misc_feature 1..20: note = CRISPR gRNA sequence
  source 1..20: mol_type = other DNA
tatagacagcaggccagggc

SEQ ID NO: 40039 - DNA, 20 bp, synthetic construct
  misc_feature 1..20: note = CRISPR gRNA sequence
  source 1..20: mol_type = other DNA
tagacagcaggccagggcag

SEQ ID NO: 40040 - DNA, 20 bp, synthetic construct
  misc_feature 1..20: note = CRISPR gRNA sequence
  source 1..20: mol_type = other DNA
cagcaggccagggcaggagt

SEQ ID NO: 40041 - DNA, 20 bp, synthetic construct
  misc_feature 1..20: note = CRISPR gRNA sequence
  source 1..20: mol_type = other DNA
agcaggccagggcaggagtt

SEQ ID NO: 40042 - DNA, 20 bp, synthetic construct
  misc_feature 1..20: note = CRISPR gRNA sequence
  source 1..20: mol_type = other DNA
aggccagggcaggagttggg

SEQ ID NO: 40043 - DNA, 20 bp, synthetic construct
  misc_feature 1..20: note = CRISPR gRNA sequence
  source 1..20: mol_type = other DNA
cagggcaggagttgggtagc

SEQ ID NO: 40044 - DNA, 20 bp, synthetic construct
  misc_feature 1..20: note = CRISPR gRNA sequence
  source 1..20: mol_type = other DNA
gggcaggagttgggtagcca

SEQ ID NO: 40045 - DNA, 20 bp, synthetic construct
  misc_feature 1..20: note = CRISPR gRNA sequence
  source 1..20: mol_type = other DNA
ggcaggagttgggtagccag

SEQ ID NO: 40046 - DNA, 20 bp, synthetic construct
  misc_feature 1..20: note = CRISPR gRNA sequence
  source 1..20: mol_type = other DNA
gcaggagttgggtagccaga

SEQ ID NO: 40047 - DNA, 20 bp, synthetic construct
  misc_feature 1..20: note = CRISPR gRNA sequence
  source 1..20: mol_type = other DNA
caggagttgggtagccagag

SEQ ID NO: 40048 - DNA, 20 bp, synthetic construct
  misc_feature 1..20: note = CRISPR gRNA sequence
  source 1..20: mol_type = other DNA
aggagttgggtagccagagg

SEQ ID NO: 40049 - DNA, 20 bp, synthetic construct
  misc_feature 1..20: note = CRISPR gRNA sequence
  source 1..20: mol_type = other DNA
gggtagccagagggggattc

SEQ ID NO: 40050 - DNA, 20 bp, synthetic construct
  misc_feature 1..20: note = CRISPR gRNA sequence
  source 1..20: mol_type = other DNA
ggtagccagagggggattcc

SEQ ID NO: 40051 - DNA, 20 bp, synthetic construct
  misc_feature 1..20: note = CRISPR gRNA sequence
  source 1..20: mol_type = other DNA
tagccagagggggattccgg

SEQ ID NO: 40052 - DNA, 20 bp, synthetic construct
  misc_feature 1..20: note = CRISPR gRNA sequence
  source 1..20: mol_type = other DNA
agagggggattccgggagac

SEQ ID NO: 40053 - DNA, 20 bp, synthetic construct
  misc_feature 1..20: note = CRISPR gRNA sequence
  source 1..20: mol_type = other DNA
agggggattccgggagacta

SEQ ID NO: 40054 - DNA, 20 bp, synthetic construct
  misc_feature 1..20: note = CRISPR gRNA sequence
  source 1..20: mol_type = other DNA
tccgggagactagagccctc

SEQ ID NO: 40055 - DNA, 20 bp, synthetic construct
  misc_feature 1..20: note = CRISPR gRNA sequence
  source 1..20: mol_type = other DNA
agagccctccagcttaaacc

SEQ ID NO: 40056 - DNA, 20 bp, synthetic construct
  misc_feature 1..20: note = CRISPR gRNA sequence
  source 1..20: mol_type = other DNA
gagccctccagcttaaaccc

SEQ ID NO: 40057 - DNA, 20 bp, synthetic construct
  misc_feature 1..20: note = CRISPR gRNA sequence
  source 1..20: mol_type = other DNA
agccctccagcttaaaccca

SEQ ID NO: 40058 - DNA, 20 bp, synthetic construct
  misc_feature 1..20: note = CRISPR gRNA sequence
  source 1..20: mol_type = other DNA
gccctccagcttaaacccag

SEQ ID NO: 40059 - DNA, 20 bp, synthetic construct
  misc_feature 1..20: note = CRISPR gRNA sequence
  source 1..20: mol_type = other DNA
cttaaacccaggggattgcc

SEQ ID NO: 40060 - DNA, 20 bp, synthetic construct
  misc_feature 1..20: note = CRISPR gRNA sequence
  source 1..20: mol_type = other DNA
ccaggggattgcctggcctg

SEQ ID NO: 40061 - DNA, 20 bp, synthetic construct
  misc_feature 1..20: note = CRISPR gRNA sequence
  source 1..20: mol_type = other DNA
gattgcctggcctgtagctc

SEQ ID NO: 40062 - DNA, 20 bp, synthetic construct
  misc_feature 1..20: note = CRISPR gRNA sequence
  source 1..20: mol_type = other DNA
ctggcctgtagctctggtcc

SEQ ID NO: 40063 - DNA, 20 bp, synthetic construct
  misc_feature 1..20: note = CRISPR gRNA sequence
  source 1..20: mol_type = other DNA
cctgtagctctggtcctggt

SEQ ID NO: 40064 - DNA, 20 bp, synthetic construct
  misc_feature 1..20: note = CRISPR gRNA sequence
  source 1..20: mol_type = other DNA
cttctgtatccctttcacac

SEQ ID NO: 40065 - DNA, 20 bp, synthetic construct
  misc_feature 1..20: note = CRISPR gRNA sequence
  source 1..20: mol_type = other DNA
ttctgtatccctttcacaca

SEQ ID NO: 40066 - DNA, 20 bp, synthetic construct
  misc_feature 1..20: note = CRISPR gRNA sequence
  source 1..20: mol_type = other DNA
cctttcacacaaggacccat

SEQ ID NO: 40067 - DNA, 20 bp, synthetic construct
  misc_feature 1..20: note = CRISPR gRNA sequence
  source 1..20: mol_type = other DNA
ctttcacacaaggacccatt

SEQ ID NO: 40068 - DNA, 20 bp, synthetic construct
  misc_feature 1..20: note = CRISPR gRNA sequence
  source 1..20: mol_type = other DNA
tttcacacaaggacccatta

SEQ ID NO: 40069 - DNA, 20 bp, synthetic construct
  misc_feature 1..20: note = CRISPR gRNA sequence
  source 1..20: mol_type = other DNA
acaaggacccattagggtcc

SEQ ID NO: 40070 - DNA, 20 bp, synthetic construct
  misc_feature 1..20: note = CRISPR gRNA sequence
  source 1..20: mol_type = other DNA
attagggtcctggattgccc

SEQ ID NO: 40071 - DNA, 20 bp, synthetic construct
  misc_feature 1..20: note = CRISPR gRNA sequence
  source 1..20: mol_type = other DNA
ggtcctggattgccccagcc

SEQ ID NO: 40072 - DNA, 20 bp, synthetic construct
  misc_feature 1..20: note = CRISPR gRNA sequence
  source 1..20: mol_type = other DNA
gattgccccagcctagcgca

SEQ ID NO: 40073 - DNA, 20 bp, synthetic construct
  misc_feature 1..20: note = CRISPR gRNA sequence
  source 1..20: mol_type = other DNA
attgccccagcctagcgcat

SEQ ID NO: 40074 - DNA, 20 bp, synthetic construct
  misc_feature 1..20: note = CRISPR gRNA sequence
  source 1..20: mol_type = other DNA
gccccagcctagcgcatggg

SEQ ID NO: 40075 - DNA, 20 bp, synthetic construct
  misc_feature 1..20: note = CRISPR gRNA sequence
  source 1..20: mol_type = other DNA
cccagcctagcgcatgggta

SEQ ID NO: 40076 - DNA, 20 bp, synthetic construct
  misc_feature 1..20: note = CRISPR gRNA sequence
  source 1..20: mol_type = other DNA
ctagcgcatgggtagagact

SEQ ID NO: 40077 - DNA, 20 bp, synthetic construct
  misc_feature 1..20: note = CRISPR gRNA sequence
  source 1..20: mol_type = other DNA
gagactcagctctttgctcc

SEQ ID NO: 40078 - DNA, 20 bp, synthetic construct
  misc_feature 1..20: note = CRISPR gRNA sequence
  source 1..20: mol_type = other DNA
gactcagctctttgctcccg

SEQ ID NO: 40079 - DNA, 20 bp, synthetic construct
  misc_feature 1..20: note = CRISPR gRNA sequence
  source 1..20: mol_type = other DNA
cccacccacaatctcttctg

SEQ ID NO: 40080 - DNA, 20 bp, synthetic construct
  misc_feature 1..20: note = CRISPR gRNA sequence
  source 1..20: mol_type = other DNA
cacccacaatctcttctgta

SEQ ID NO: 40081 - DNA, 20 bp, synthetic construct
  misc_feature 1..20: note = CRISPR gRNA sequence
  source 1..20: mol_type = other DNA
acaatctcttctgtagagtc

SEQ ID NO: 40082 - DNA, 20 bp, synthetic construct
  misc_feature 1..20: note = CRISPR gRNA sequence
  source 1..20: mol_type = other DNA
ctgtagagtctggactactg

SEQ ID NO: 40083 - DNA, 20 bp, synthetic construct
  misc_feature 1..20: note = CRISPR gRNA sequence
  source 1..20: mol_type = other DNA
tgtagagtctggactactga

SEQ ID NO: 40084 - DNA, 20 bp, synthetic construct
  misc_feature 1..20: note = CRISPR gRNA sequence
  source 1..20: mol_type = other DNA
gactactgaaggctcgattc

SEQ ID NO: 40085 - DNA, 20 bp, synthetic construct
  misc_feature 1..20: note = CRISPR gRNA sequence
  source 1..20: mol_type = other DNA
actgaaggctcgattccagc

SEQ ID NO: 40086 - DNA, 20 bp, synthetic construct
  misc_feature 1..20: note = CRISPR gRNA sequence
  source 1..20: mol_type = other DNA
ctgaaggctcgattccagct

SEQ ID NO: 40087 - DNA, 20 bp, synthetic construct
  misc_feature 1..20: note = CRISPR gRNA sequence
  source 1..20: mol_type = other DNA
tgaaggctcgattccagctg

SEQ ID NO: 40088 - DNA, 20 bp, synthetic construct
  misc_feature 1..20: note = CRISPR gRNA sequence
  source 1..20: mol_type = other DNA
agctggggctgacatctctg

SEQ ID NO: 40089 - DNA, 20 bp, synthetic construct
  misc_feature 1..20: note = CRISPR gRNA sequence
  source 1..20: mol_type = other DNA
gggctgacatctctgaagca

SEQ ID NO: 40090 - DNA, 20 bp, synthetic construct
  misc_feature 1..20: note = CRISPR gRNA sequence
  source 1..20: mol_type = other DNA
gacatctctgaagcacagat

SEQ ID NO: 40091 - DNA, 20 bp, synthetic construct
  misc_feature 1..20: note = CRISPR gRNA sequence
  source 1..20: mol_type = other DNA
acatctctgaagcacagatg

SEQ ID NO: 40092 - DNA, 20 bp, synthetic construct
  misc_feature 1..20: note = CRISPR gRNA sequence
  source 1..20: mol_type = other DNA
atctctgaagcacagatgag

SEQ ID NO: 40093 - DNA, 20 bp, synthetic construct
  misc_feature 1..20: note = CRISPR gRNA sequence
  source 1..20: mol_type = other DNA
tctctgaagcacagatgagg

SEQ ID NO: 40094 - DNA, 20 bp, synthetic construct
  misc_feature 1..20: note = CRISPR gRNA sequence
  source 1..20: mol_type = other DNA
tctgaagcacagatgaggag

SEQ ID NO: 40095 - DNA, 20 bp, synthetic construct
  misc_feature 1..20: note = CRISPR gRNA sequence
  source 1..20: mol_type = other DNA
ctgaagcacagatgaggagg

SEQ ID NO: 40096 - DNA, 20 bp, synthetic construct
  misc_feature 1..20: note = CRISPR gRNA sequence
  source 1..20: mol_type = other DNA
gcacagatgaggaggaggat

SEQ ID NO: 40097 - DNA, 20 bp, synthetic construct
  misc_feature 1..20: note = CRISPR gRNA sequence
  source 1..20: mol_type = other DNA
gaggatgagattaatgataa

SEQ ID NO: 40098 - DNA, 20 bp, synthetic construct
  misc_feature 1..20: note = CRISPR gRNA sequence
  source 1..20: mol_type = other DNA
gatgagattaatgataatag

SEQ ID NO: 40099 - DNA, 20 bp, synthetic construct
  misc_feature 1..20: note = CRISPR gRNA sequence
  source 1..20: mol_type = other DNA
gattaatgataatagcagtc

SEQ ID NO: 40100 - DNA, 20 bp, synthetic construct
  misc_feature 1..20: note = CRISPR gRNA sequence
  source 1..20: mol_type = other DNA
attaatgataatagcagtca

SEQ ID NO: 40101 - DNA, 20 bp, synthetic construct
  misc_feature 1..20: note = CRISPR gRNA sequence
  source 1..20: mol_type = other DNA
aatagcagtcaaggtcaatt

SEQ ID NO: 40102 - DNA, 20 bp, synthetic construct
  misc_feature 1..20: note = CRISPR gRNA sequence
  source 1..20: mol_type = other DNA
gtacttgccatgtatgcacc

SEQ ID NO: 40103 - DNA, 20 bp, synthetic construct
  misc_feature 1..20: note = CRISPR gRNA sequence
  source 1..20: mol_type = other DNA
tatgcaccaagcaccaaact

SEQ ID NO: 40104 - DNA, 20 bp, synthetic construct
  misc_feature 1..20: note = CRISPR gRNA sequence
  source 1..20: mol_type = other DNA
atgcaccaagcaccaaacta

SEQ ID NO: 40105 - DNA, 20 bp, synthetic construct
  misc_feature 1..20: note = CRISPR gRNA sequence
  source 1..20: mol_type = other DNA
caccaagcaccaaactaagg

SEQ ID NO: 40106 - DNA, 20 bp, synthetic construct
  misc_feature 1..20: note = CRISPR gRNA sequence
  source 1..20: mol_type = other DNA
aaactaaggcagttcacata

SEQ ID NO: 40107 - DNA, 20 bp, synthetic construct
  misc_feature 1..20: note = CRISPR gRNA sequence
  source 1..20: mol_type = other DNA
ttcacatacagtctcccatt

SEQ ID NO: 40108 - DNA, 20 bp, synthetic construct
  misc_feature 1..20: note = CRISPR gRNA sequence
  source 1..20: mol_type = other DNA
cacatacagtctcccattga

SEQ ID NO: 40109 - DNA, 20 bp, synthetic construct
  misc_feature 1..20: note = CRISPR gRNA sequence
  source 1..20: mol_type = other DNA
acatacagtctcccattgag

SEQ ID NO: 40110 - DNA, 20 bp, synthetic construct
  misc_feature 1..20: note = CRISPR gRNA sequence
  source 1..20: mol_type = other DNA
ttgagaggctgtgatttgtc

SEQ ID NO: 40111 - DNA, 20 bp, synthetic construct
  misc_feature 1..20: note = CRISPR gRNA sequence
  source 1..20: mol_type = other DNA
tgagaggctgtgatttgtcc

SEQ ID NO: 40112 - DNA, 20 bp, synthetic construct
  misc_feature 1..20: note = CRISPR gRNA sequence
  source 1..20: mol_type = other DNA
gagaggctgtgatttgtcca

SEQ ID NO: 40113 - DNA, 20 bp, synthetic construct
  misc_feature 1..20: note = CRISPR gRNA sequence
  source 1..20: mol_type = other DNA
tttgtccagggtcacacaac

SEQ ID NO: 40114 - DNA, 20 bp, synthetic construct
  misc_feature 1..20: note = CRISPR gRNA sequence
  source 1..20: mol_type = other DNA
ttgtccagggtcacacaacc

SEQ ID NO: 40115 - DNA, 20 bp, synthetic construct
  misc_feature 1..20: note = CRISPR gRNA sequence
  source 1..20: mol_type = other DNA
tccagggtcacacaaccagg

SEQ ID NO: 40116 - DNA, 20 bp, synthetic construct
  misc_feature 1..20: note = CRISPR gRNA sequence
  source 1..20: mol_type = other DNA
agggtcacacaaccaggaag

SEQ ID NO: 40117 - DNA, 20 bp, synthetic construct
  misc_feature 1..20: note = CRISPR gRNA sequence
  source 1..20: mol_type = other DNA
ggtcacacaaccaggaagtg

SEQ ID NO: 40118 - DNA, 20 bp, synthetic construct
  misc_feature 1..20: note = CRISPR gRNA sequence
  source 1..20: mol_type = other DNA
cacacaaccaggaagtggag

SEQ ID NO: 40119 - DNA, 20 bp, synthetic construct
  misc_feature 1..20: note = CRISPR gRNA sequence
  source 1..20: mol_type = other DNA
aggaagtggagaagccaaat

SEQ ID NO: 40120 - DNA, 20 bp, synthetic construct
  misc_feature 1..20: note = CRISPR gRNA sequence
  source 1..20: mol_type = other DNA
ggagaagccaaattggcacc

SEQ ID NO: 40121 - DNA, 20 bp, synthetic construct
  misc_feature 1..20: note = CRISPR gRNA sequence
  source 1..20: mol_type = other DNA
gagaagccaaattggcacca

SEQ ID NO: 40122 - DNA, 20 bp, synthetic construct
  misc_feature 1..20: note = CRISPR gRNA sequence
  source 1..20: mol_type = other DNA
caccaaggtctgattgactc

SEQ ID NO: 40123 - DNA, 20 bp, synthetic construct
  misc_feature 1..20: note = CRISPR gRNA sequence
  source 1..20: mol_type = other DNA
accaaggtctgattgactct

SEQ ID NO: 40124 - DNA, 20 bp, synthetic construct
  misc_feature 1..20: note = CRISPR gRNA sequence
  source 1..20: mol_type = other DNA
aaggtctgattgactctagg

SEQ ID NO: 40125 - DNA, 20 bp, synthetic construct
  misc_feature 1..20: note = CRISPR gRNA sequence
  source 1..20: mol_type = other DNA
ggtctgattgactctaggtg

SEQ ID NO: 40126 - DNA, 20 bp, synthetic construct
  misc_feature 1..20: note = CRISPR gRNA sequence
  source 1..20: mol_type = other DNA
gtctgattgactctaggtgg

SEQ ID NO: 40127 - DNA, 20 bp, synthetic construct
  misc_feature 1..20: note = CRISPR gRNA sequence
  source 1..20: mol_type = other DNA
gattgactctaggtggagga

SEQ ID NO: 40128 - DNA, 20 bp, synthetic construct
  misc_feature 1..20: note = CRISPR gRNA sequence
  source 1..20: mol_type = other DNA
attgactctaggtggaggat

SEQ ID NO: 40129 - DNA, 20 bp, synthetic construct
  misc_feature 1..20: note = CRISPR gRNA sequence
  source 1..20: mol_type = other DNA
ttgactctaggtggaggata

SEQ ID NO: 40130 - DNA, 20 bp, synthetic construct
  misc_feature 1..20: note = CRISPR gRNA sequence
  source 1..20: mol_type = other DNA
aggtggaggatagggctcga

SEQ ID NO: 40131 - DNA, 20 bp, synthetic construct
  misc_feature 1..20: note = CRISPR gRNA sequence
  source 1..20: mol_type = other DNA
tggaggatagggctcgatgg

SEQ ID NO: 40132 - DNA, 20 bp, synthetic construct
  misc_feature 1..20: note = CRISPR gRNA sequence
  source 1..20: mol_type = other DNA
aggatagggctcgatggtgg

SEQ ID NO: 40133 - DNA, 20 bp, synthetic construct
  misc_feature 1..20: note = CRISPR gRNA sequence
  source 1..20: mol_type = other DNA
ggatagggctcgatggtgga

SEQ ID NO: 40134 - DNA, 20 bp, synthetic construct
  misc_feature 1..20: note = CRISPR gRNA sequence
  source 1..20: mol_type = other DNA
agggctcgatggtggaaggc

SEQ ID NO: 40135 - DNA, 20 bp, synthetic construct
  misc_feature 1..20: note = CRISPR gRNA sequence
  source 1..20: mol_type = other DNA
gggctcgatggtggaaggcc

SEQ ID NO: 40136 - DNA, 20 bp, synthetic construct
  misc_feature 1..20: note = CRISPR gRNA sequence
  source 1..20: mol_type = other DNA
cgatggtggaaggccaggct

SEQ ID NO: 40137 - DNA, 20 bp, synthetic construct
  misc_feature 1..20: note = CRISPR gRNA sequence
  source 1..20: mol_type = other DNA
gatggtggaaggccaggctg

SEQ ID NO: 40138 - DNA, 20 bp, synthetic construct
  misc_feature 1..20: note = CRISPR gRNA sequence
  source 1..20: mol_type = other DNA
gtggaaggccaggctgagga

SEQ ID NO: 40139 - DNA, 20 bp, synthetic construct
  misc_feature 1..20: note = CRISPR gRNA sequence
  source 1..20: mol_type = other DNA
gccaggctgaggatggattc

SEQ ID NO: 40140 - DNA, 20 bp, synthetic construct
  misc_feature 1..20: note = CRISPR gRNA sequence
  source 1..20: mol_type = other DNA
caggctgaggatggattctg

SEQ ID NO: 40141 - DNA, 20 bp, synthetic construct
  misc_feature 1..20: note = CRISPR gRNA sequence
  source 1..20: mol_type = other DNA
ctgaggatggattctggaga

SEQ ID NO: 40142 - DNA, 20 bp, synthetic construct
  misc_feature 1..20: note = CRISPR gRNA sequence
  source 1..20: mol_type = other DNA
aggatggattctggagatgg

SEQ ID NO: 40143 - DNA, 20 bp, synthetic construct
  misc_feature 1..20: note = CRISPR gRNA sequence
  source 1..20: mol_type = other DNA
gattctggagatggcggaca

SEQ ID NO: 40144 - DNA, 20 bp, synthetic construct
  misc_feature 1..20: note = CRISPR gRNA sequence
  source 1..20: mol_type = other DNA
tggcggacatggcctttgct

SEQ ID NO: 40145 - DNA, 20 bp, synthetic construct
  misc_feature 1..20: note = CRISPR gRNA sequence
  source 1..20: mol_type = other DNA
gacatggcctttgctcagcc

SEQ ID NO: 40146 - DNA, 20 bp, synthetic construct
  misc_feature 1..20: note = CRISPR gRNA sequence
  source 1..20: mol_type = other DNA
gcctttgctcagcctggcct

SEQ ID NO: 40147 - DNA, 20 bp, synthetic construct
  misc_feature 1..20: note = CRISPR gRNA sequence
  source 1..20: mol_type = other DNA
tggccttggtgatgtccctc

SEQ ID NO: 40148 - DNA, 20 bp, synthetic construct
  misc_feature 1..20: note = CRISPR gRNA sequence
  source 1..20: mol_type = other DNA
ggccttggtgatgtccctcc

SEQ ID NO: 40149 - DNA, 20 bp, synthetic construct
  misc_feature 1..20: note = CRISPR gRNA sequence
  source 1..20: mol_type = other DNA
gccttggtgatgtccctcca

SEQ ID NO: 40150 - DNA, 20 bp, synthetic construct
  misc_feature 1..20: note = CRISPR gRNA sequence
  source 1..20: mol_type = other DNA
tccagggctgcatttcttga

SEQ ID NO: 40151 - DNA, 20 bp, synthetic construct
  misc_feature 1..20: note = CRISPR gRNA sequence
  source 1..20: mol_type = other DNA
ttcttgacagcctcatgctc

SEQ ID NO: 40152 - DNA, 20 bp, synthetic construct
  misc_feature 1..20: note = CRISPR gRNA sequence
  source 1..20: mol_type = other DNA
tcatgctccagatgccctct

SEQ ID NO: 40153 - DNA, 20 bp, synthetic construct
  misc_feature 1..20: note = CRISPR gRNA sequence
  source 1..20: mol_type = other DNA
atgccctctgagctgcctct

SEQ ID NO: 40154 - DNA, 20 bp, synthetic construct
  misc_feature 1..20: note = CRISPR gRNA sequence
  source 1..20: mol_type = other DNA
gagctgcctctgagctcccg

SEQ ID NO: 40155 - DNA, 20 bp, synthetic construct
  misc_feature 1..20: note = CRISPR gRNA sequence
  source 1..20: mol_type = other DNA
agctgcctctgagctcccga

SEQ ID NO: 40156 - DNA, 20 bp, synthetic construct
  misc_feature 1..20: note = CRISPR gRNA sequence
  source 1..20: mol_type = other DNA
cctctgagctcccgaaggat

SEQ ID NO: 40157 - DNA, 20 bp, synthetic construct
  misc_feature 1..20: note = CRISPR gRNA sequence
  source 1..20: mol_type = other DNA
ctctgagctcccgaaggatg

SEQ ID NO: 40158 - DNA, 20 bp, synthetic construct
  misc_feature 1..20: note = CRISPR gRNA sequence
  source 1..20: mol_type = other DNA
agctcccgaaggatgaggta

SEQ ID NO: 40159 - DNA, 20 bp, synthetic construct
  misc_feature 1..20: note = CRISPR gRNA sequence
  source 1..20: mol_type = other DNA
cgaaggatgaggtacagtga

SEQ ID NO: 40160 - DNA, 20 bp, synthetic construct
  misc_feature 1..20: note = CRISPR gRNA sequence
  source 1..20: mol_type = other DNA
tgaggtacagtgatggcctc

SEQ ID NO: 40161 - DNA, 20 bp, synthetic construct
  misc_feature 1..20: note = CRISPR gRNA sequence
  source 1..20: mol_type = other DNA
tccagccctgtgtgtgattc

SEQ ID NO: 40162 - DNA, 20 bp, synthetic construct
  misc_feature 1..20: note = CRISPR gRNA sequence
  source 1..20: mol_type = other DNA
gccccctcccttcccctgct

SEQ ID NO: 40163 - DNA, 20 bp, synthetic construct
  misc_feature 1..20: note = CRISPR gRNA sequence
  source 1..20: mol_type = other DNA
cccctcccttcccctgctca

SEQ ID NO: 40164 - DNA, 20 bp, synthetic construct
  misc_feature 1..20: note = CRISPR gRNA sequence
  source 1..20: mol_type = other DNA
cctgctcccaaacctgtgcc

SEQ ID NO: 40165 - DNA, 20 bp, synthetic construct
  misc_feature 1..20: note = CRISPR gRNA sequence
  source 1..20: mol_type = other DNA
ctgctcccaaacctgtgccc

SEQ ID NO: 40166 - DNA, 20 bp, synthetic construct
  misc_feature 1..20: note = CRISPR gRNA sequence
  source 1..20: mol_type = other DNA
caggccccacatgctccctg

SEQ ID NO: 40167 - DNA, 20 bp, synthetic construct
  misc_feature 1..20: note = CRISPR gRNA sequence
  source 1..20: mol_type = other DNA
aggccccacatgctccctga

SEQ ID NO: 40168 - DNA, 20 bp, synthetic construct
  misc_feature 1..20: note = CRISPR gRNA sequence
  source 1..20: mol_type = other DNA
gacacctgacctgctgtgtc

SEQ ID NO: 40169 - DNA, 20 bp, synthetic construct
  misc_feature 1..20: note = CRISPR gRNA sequence
  source 1..20: mol_type = other DNA
acacctgacctgctgtgtcc

SEQ ID NO: 40170 - DNA, 20 bp, synthetic construct
  misc_feature 1..20: note = CRISPR gRNA sequence
  source 1..20: mol_type = other DNA
cacctgacctgctgtgtcca

SEQ ID NO: 40171 - DNA, 20 bp, synthetic construct
  misc_feature 1..20: note = CRISPR gRNA sequence
  source 1..20: mol_type = other DNA
acctgacctgctgtgtccag

SEQ ID NO: 40172 - DNA, 20 bp, synthetic construct
  misc_feature 1..20: note = CRISPR gRNA sequence
  source 1..20: mol_type = other DNA
cctgctgtgtccaggggtca

SEQ ID NO: 40173 - DNA, 20 bp, synthetic construct
  misc_feature 1..20: note = CRISPR gRNA sequence
  source 1..20: mol_type = other DNA
tgtgtccaggggtcatggcc

SEQ ID NO: 40174 - DNA, 20 bp, synthetic construct
  misc_feature 1..20: note = CRISPR gRNA sequence
  source 1..20: mol_type = other DNA
tacctcctacctcccctgcc

SEQ ID NO: 40175 - DNA, 20 bp, synthetic construct
  misc_feature 1..20: note = CRISPR gRNA sequence
  source 1..20: mol_type = other DNA
ctcccctgcccagcccaccc

SEQ ID NO: 40176 - DNA, 20 bp, synthetic construct
  misc_feature 1..20: note = CRISPR gRNA sequence
  source 1..20: mol_type = other DNA
cctgcccagcccaccccaga

SEQ ID NO: 40177 - DNA, 20 bp, synthetic construct
  misc_feature 1..20: note = CRISPR gRNA sequence
  source 1..20: mol_type = other DNA
ctgcccagcccaccccagac

SEQ ID NO: 40178 - DNA, 20 bp, synthetic construct
  misc_feature 1..20: note = CRISPR gRNA sequence
  source 1..20: mol_type = other DNA
tgcccagcccaccccagaca

SEQ ID NO: 40179 - DNA, 20 bp, synthetic construct
  misc_feature 1..20: note = CRISPR gRNA sequence
  source 1..20: mol_type = other DNA
ccaccccagacagggctcac

SEQ ID NO: 40180 - DNA, 20 bp, synthetic construct
  misc_feature 1..20: note = CRISPR gRNA sequence
  source 1..20: mol_type = other DNA
caccccagacagggctcaca

SEQ ID NO: 40181 - DNA, 20 bp, synthetic construct
  misc_feature 1..20: note = CRISPR gRNA sequence
  source 1..20: mol_type = other DNA
cccagacagggctcacaagg

SEQ ID NO: 40182 - DNA, 20 bp, synthetic construct
  misc_feature 1..20: note = CRISPR gRNA sequence
  source 1..20: mol_type = other DNA
gccccgtcaaccaccttccc

SEQ ID NO: 40183 - DNA, 20 bp, synthetic construct
  misc_feature 1..20: note = CRISPR gRNA sequence
  source 1..20: mol_type = other DNA
gtcaaccaccttcccaagcc

SEQ ID NO: 40184 - DNA, 20 bp, synthetic construct
  misc_feature 1..20: note = CRISPR gRNA sequence
  source 1..20: mol_type = other DNA
tcaaccaccttcccaagccc

SEQ ID NO: 40185 - DNA, 20 bp, synthetic construct
  misc_feature 1..20: note = CRISPR gRNA sequence
  source 1..20: mol_type = other DNA
aaccaccttcccaagcccag

SEQ ID NO: 40186 - DNA, 20 bp, synthetic construct
  misc_feature 1..20: note = CRISPR gRNA sequence
  source 1..20: mol_type = other DNA
ccaggagaccccactcccct

SEQ ID NO: 40187 - DNA, 20 bp, synthetic construct
  misc_feature 1..20: note = CRISPR gRNA sequence
  source 1..20: mol_type = other DNA
ccccttagctccctgacccc

SEQ ID NO: 40188 - DNA, 20 bp, synthetic construct
  misc_feature 1..20: note = CRISPR gRNA sequence
  source 1..20: mol_type = other DNA
cttagctccctgacccccag

SEQ ID NO: 40189 - DNA, 20 bp, synthetic construct
  misc_feature 1..20: note = CRISPR gRNA sequence
  source 1..20: mol_type = other DNA
ctccctgacccccagcagct

SEQ ID NO: 40190 - DNA, 20 bp, synthetic construct
  misc_feature 1..20: note = CRISPR gRNA sequence
  source 1..20: mol_type = other DNA
tccctgacccccagcagctg

SEQ ID NO: 40191 - DNA, 20 bp, synthetic construct
  misc_feature 1..20: note = CRISPR gRNA sequence
  source 1..20: mol_type = other DNA
ccctgacccccagcagctga

SEQ ID NO: 40192 - DNA, 20 bp, synthetic construct
  misc_feature 1..20: note = CRISPR gRNA sequence
  source 1..20: mol_type = other DNA
cctgacccccagcagctgag

SEQ ID NO: 40193 - DNA, 20 bp, synthetic construct
  misc_feature 1..20: note = CRISPR gRNA sequence
  source 1..20: mol_type = other DNA
ccccagcagctgaggggttg

SEQ ID NO: 40194 - DNA, 20 bp, synthetic construct
  misc_feature 1..20: note = CRISPR gRNA sequence
  source 1..20: mol_type = other DNA
ccagcagctgaggggttgtg

SEQ ID NO: 40195 - DNA, 20 bp, synthetic construct
  misc_feature 1..20: note = CRISPR gRNA sequence
  source 1..20: mol_type = other DNA
ggggttgtggagactctgaa

SEQ ID NO: 40196 - DNA, 20 bp, synthetic construct
  misc_feature 1..20: note = CRISPR gRNA sequence
  source 1..20: mol_type = other DNA
ggttgtggagactctgaaaa

SEQ ID NO: 40197 - DNA, 20 bp, synthetic construct
  misc_feature 1..20: note = CRISPR gRNA sequence
  source 1..20: mol_type = other DNA
gttgtggagactctgaaaag

SEQ ID NO: 40198 - DNA, 20 bp, synthetic construct
  misc_feature 1..20: note = CRISPR gRNA sequence
  source 1..20: mol_type = other DNA
ggagactctgaaaagaggtg

SEQ ID NO: 40199 - DNA, 20 bp, synthetic construct
  misc_feature 1..20: note = CRISPR gRNA sequence
  source 1..20: mol_type = other DNA
gagactctgaaaagaggtga

SEQ ID NO: 40200 - DNA, 20 bp, synthetic construct
  misc_feature 1..20: note = CRISPR gRNA sequence
  source 1..20: mol_type = other DNA
agactctgaaaagaggtgaa

SEQ ID NO: 40201 - DNA, 20 bp, synthetic construct
  misc_feature 1..20: note = CRISPR gRNA sequence
  source 1..20: mol_type = other DNA
gactctgaaaagaggtgaag

SEQ ID NO: 40202 - DNA, 20 bp, synthetic construct
  misc_feature 1..20: note = CRISPR gRNA sequence
  source 1..20: mol_type = other DNA
ctctgaaaagaggtgaaggg

SEQ ID NO: 40203 - DNA, 20 bp, synthetic construct
  misc_feature 1..20: note = CRISPR gRNA sequence
  source 1..20: mol_type = other DNA
aaagaggtgaaggggagcac

SEQ ID NO: 40204 - DNA, 20 bp, synthetic construct
  misc_feature 1..20: note = CRISPR gRNA sequence
  source 1..20: mol_type = other DNA
aagaggtgaaggggagcact

SEQ ID NO: 40205 - DNA, 20 bp, synthetic construct
  misc_feature 1..20: note = CRISPR gRNA sequence
  source 1..20: mol_type = other DNA
ggctccttctgtcatgatcc

SEQ ID NO: 40206 - DNA, 20 bp, synthetic construct
  misc_feature 1..20: note = CRISPR gRNA sequence
  source 1..20: mol_type = other DNA
tctgtcatgatcctggtgcc

SEQ ID NO: 40207 - DNA, 20 bp, synthetic construct
  misc_feature 1..20: note = CRISPR gRNA sequence
  source 1..20: mol_type = other DNA
ctgtcatgatcctggtgcct

SEQ ID NO: 40208 - DNA, 20 bp, synthetic construct
  misc_feature 1..20: note = CRISPR gRNA sequence
  source 1..20: mol_type = other DNA
atgatcctggtgcctgggcc

SEQ ID NO: 40209 - DNA, 20 bp, synthetic construct
  misc_feature 1..20: note = CRISPR gRNA sequence
  source 1..20: mol_type = other DNA
tgatcctggtgcctgggcct

SEQ ID NO: 40210 - DNA, 20 bp, synthetic construct
  misc_feature 1..20: note = CRISPR gRNA sequence
  source 1..20: mol_type = other DNA
gatcctggtgcctgggcctg

SEQ ID NO: 40211 - DNA, 20 bp, synthetic construct
  misc_feature 1..20: note = CRISPR gRNA sequence
  source 1..20: mol_type = other DNA
atcctggtgcctgggcctgg

SEQ ID NO: 40212 - DNA, 20 bp, synthetic construct
  misc_feature 1..20: note = CRISPR gRNA sequence
  source 1..20: mol_type = other DNA
ctgggcctgggggctcccat

SEQ ID NO: 40213 - DNA, 20 bp, synthetic construct
  misc_feature 1..20: note = CRISPR gRNA sequence
  source 1..20: mol_type = other DNA
actcttccccccttctctct

SEQ ID NO: 40214 - DNA, 20 bp, synthetic construct
  misc_feature 1..20: note = CRISPR gRNA sequence
  source 1..20: mol_type = other DNA
atcgtgtatttctgttttat

SEQ ID NO: 40215 - DNA, 20 bp, synthetic construct
  misc_feature 1..20: note = CRISPR gRNA sequence
  source 1..20: mol_type = other DNA
agtttatttaactgttattt

SEQ ID NO: 40216 - DNA, 20 bp, synthetic construct
  misc_feature 1..20: note = CRISPR gRNA sequence
  source 1..20: mol_type = other DNA
ctgatctgctctctctctct

SEQ ID NO: 40217 - DNA, 20 bp, synthetic construct
  misc_feature 1..20: note = CRISPR gRNA sequence
  source 1..20: mol_type = other DNA
tgatctgctctctctctctg

SEQ ID NO: 40218 - DNA, 20 bp, synthetic construct
  misc_feature 1..20: note = CRISPR gRNA sequence
  source 1..20: mol_type = other DNA
tctctgaggtctctgtgcct

SEQ ID NO: 40219 - DNA, 20 bp, synthetic construct
  misc_feature 1..20: note = CRISPR gRNA sequence
  source 1..20: mol_type = other DNA
tgcctatatgtgacatcctg

SEQ ID NO: 40220 - DNA, 20 bp, synthetic construct
  misc_feature 1..20: note = CRISPR gRNA sequence
  source 1..20: mol_type = other DNA
gcctatatgtgacatcctgt

SEQ ID NO: 40221 - DNA, 20 bp, synthetic construct
  misc_feature 1..20: note = CRISPR gRNA sequence
  source 1..20: mol_type = other DNA
cctgtgggtgtcgtgtgtgt

SEQ ID NO: 40222 - DNA, 20 bp, synthetic construct
  misc_feature 1..20: note = CRISPR gRNA sequence
  source 1..20: mol_type = other DNA
tccctctttgtccgtctgtc

SEQ ID NO: 40223 - DNA, 20 bp, synthetic construct
  misc_feature 1..20: note = CRISPR gRNA sequence
  source 1..20: mol_type = other DNA
ccctctttgtccgtctgtct

SEQ ID NO: 40224 - DNA, 20 bp, synthetic construct
  misc_feature 1..20: note = CRISPR gRNA sequence
  source 1..20: mol_type = other DNA
ttgtccgtctgtctaggtgc

SEQ ID NO: 40225 - DNA, 20 bp, synthetic construct
  misc_feature 1..20: note = CRISPR gRNA sequence
  source 1..20: mol_type = other DNA
tctaggtgccagatacatcc

SEQ ID NO: 40226 - DNA, 20 bp, synthetic construct
  misc_feature 1..20: note = CRISPR gRNA sequence
  source 1..20: mol_type = other DNA
cccagtccctcctctcctgc

SEQ ID NO: 40227 - DNA, 20 bp, synthetic construct
  misc_feature 1..20: note = CRISPR gRNA sequence
  source 1..20: mol_type = other DNA
tcattctctgcctctgtgtc

SEQ ID NO: 40228 - DNA, 20 bp, synthetic construct
  misc_feature 1..20: note = CRISPR gRNA sequence
  source 1..20: mol_type = other DNA
cattctctgcctctgtgtct

SEQ ID NO: 40229 - DNA, 20 bp, synthetic construct
  misc_feature 1..20: note = CRISPR gRNA sequence
  source 1..20: mol_type = other DNA
attctctgcctctgtgtctg

SEQ ID NO: 40230 - DNA, 20 bp, synthetic construct
  misc_feature 1..20: note = CRISPR gRNA sequence
  source 1..20: mol_type = other DNA
ttctctgcctctgtgtctgg

SEQ ID NO: 40231 - DNA, 20 bp, synthetic construct
  misc_feature 1..20: note = CRISPR gRNA sequence
  source 1..20: mol_type = other DNA
tctctgcctctgtgtctggg

SEQ ID NO: 40232 - DNA, 20 bp, synthetic construct
  misc_feature 1..20: note = CRISPR gRNA sequence
  source 1..20: mol_type = other DNA
ctgcctctgtgtctgggggg

SEQ ID NO: 40233 - DNA, 20 bp, synthetic construct
  misc_feature 1..20: note = CRISPR gRNA sequence
  source 1..20: mol_type = other DNA
tgcctctgtgtctggggggt

SEQ ID NO: 40234 - DNA, 20 bp, synthetic construct
  misc_feature 1..20: note = CRISPR gRNA sequence
  source 1..20: mol_type = other DNA
tctgtgtctggggggtggga

SEQ ID NO: 40235 - DNA, 20 bp, synthetic construct
  misc_feature 1..20: note = CRISPR gRNA sequence
  source 1..20: mol_type = other DNA
gtgtctggggggtgggaaag

SEQ ID NO: 40236 - DNA, 20 bp, synthetic construct
  misc_feature 1..20: note = CRISPR gRNA sequence
  source 1..20: mol_type = other DNA
ggctccttcccgcctctgtt

SEQ ID NO: 40237 - DNA, 20 bp, synthetic construct
  misc_feature 1..20: note = CRISPR gRNA sequence
  source 1..20: mol_type = other DNA
tccttcccgcctctgttcag

SEQ ID NO: 40238 - DNA, 20 bp, synthetic construct
  misc_feature 1..20: note = CRISPR gRNA sequence
  source 1..20: mol_type = other DNA
ccttcccgcctctgttcagt

SEQ ID NO: 40239 - DNA, 20 bp, synthetic construct
  misc_feature 1..20: note = CRISPR gRNA sequence
  source 1..20: mol_type = other DNA
cttcccgcctctgttcagtg

SEQ ID NO: 40240 - DNA, 20 bp, synthetic construct
  misc_feature 1..20: note = CRISPR gRNA sequence
  source 1..20: mol_type = other DNA
cctctgttcagtggggcatg

SEQ ID NO: 40241 - DNA, 20 bp, synthetic construct
  misc_feature 1..20: note = CRISPR gRNA sequence
  source 1..20: mol_type = other DNA
cagcactgtgtttttgtccc

SEQ ID NO: 40242 - DNA, 20 bp, synthetic construct
  misc_feature 1..20: note = CRISPR gRNA sequence
  source 1..20: mol_type = other DNA
agcactgtgtttttgtccct

SEQ ID NO: 40243 - DNA, 20 bp, synthetic construct
  misc_feature 1..20: note = CRISPR gRNA sequence
  source 1..20: mol_type = other DNA
actgtgtttttgtccctggg

SEQ ID NO: 40244 - DNA, 20 bp, synthetic construct
  misc_feature 1..20: note = CRISPR gRNA sequence
  source 1..20: mol_type = other DNA
ctgtgtttttgtccctgggc

SEQ ID NO: 40245 - DNA, 20 bp, synthetic construct
  misc_feature 1..20: note = CRISPR gRNA sequence
  source 1..20: mol_type = other DNA
ctgggcaggctgacacattg

SEQ ID NO: 40246 - DNA, 20 bp, synthetic construct
  misc_feature 1..20: note = CRISPR gRNA sequence
  source 1..20: mol_type = other DNA
gctgacacattgtggcctcc

SEQ ID NO: 40247 - DNA, 20 bp, synthetic construct
  misc_feature 1..20: note = CRISPR gRNA sequence
  source 1..20: mol_type = other DNA
cacattgtggcctccaagaa

SEQ ID NO: 40248 - DNA, 20 bp, synthetic construct
  misc_feature 1..20: note = CRISPR gRNA sequence
  source 1..20: mol_type = other DNA
tggcctccaagaaaagcacc

SEQ ID NO: 40249 - DNA, 20 bp, synthetic construct
  misc_feature 1..20: note = CRISPR gRNA sequence
  source 1..20: mol_type = other DNA
gcctccaagaaaagcaccta

SEQ ID NO: 40250 - DNA, 20 bp, synthetic construct
  misc_feature 1..20: note = CRISPR gRNA sequence
  source 1..20: mol_type = other DNA
tccaagaaaagcacctagag

SEQ ID NO: 40251 - DNA, 20 bp, synthetic construct
  misc_feature 1..20: note = CRISPR gRNA sequence
  source 1..20: mol_type = other DNA
agcacctagagcagctctgc

SEQ ID NO: 40252 - DNA, 20 bp, synthetic construct
  misc_feature 1..20: note = CRISPR gRNA sequence
  source 1..20: mol_type = other DNA
gcacctagagcagctctgca

SEQ ID NO: 40253 - DNA, 20 bp, synthetic construct
  misc_feature 1..20: note = CRISPR gRNA sequence
  source 1..20: mol_type = other DNA
agagcagctctgcaaggctc

SEQ ID NO: 40254 - DNA, 20 bp, synthetic construct
  misc_feature 1..20: note = CRISPR gRNA sequence
  source 1..20: mol_type = other DNA
gagcagctctgcaaggctct

SEQ ID NO: 40255 - DNA, 20 bp, synthetic construct
  misc_feature 1..20: note = CRISPR gRNA sequence
  source 1..20: mol_type = other DNA
gcagctctgcaaggctctgg

SEQ ID NO: 40256 - DNA, 20 bp, synthetic construct
  misc_feature 1..20: note = CRISPR gRNA sequence
  source 1..20: mol_type = other DNA
cagctctgcaaggctctggg

SEQ ID NO: 40257 - DNA, 20 bp, synthetic construct
  misc_feature 1..20: note = CRISPR gRNA sequence
  source 1..20: mol_type = other DNA
ctctgcaaggctctgggagg

SEQ ID NO: 40258 - DNA, 20 bp, synthetic construct
  misc_feature 1..20: note = CRISPR gRNA sequence
  source 1..20: mol_type = other DNA
ctgggaggaagctgccacct

SEQ ID NO: 40259 - DNA, 20 bp, synthetic construct
  misc_feature 1..20: note = CRISPR gRNA sequence
  source 1..20: mol_type = other DNA
acctcggtcacctccacctc

SEQ ID NO: 40260 - DNA, 20 bp, synthetic construct
  misc_feature 1..20: note = CRISPR gRNA sequence
  source 1..20: mol_type = other DNA
cggtcacctccacctcgagt

SEQ ID NO: 40261 - DNA, 20 bp, synthetic construct
  misc_feature 1..20: note = CRISPR gRNA sequence
  source 1..20: mol_type = other DNA
tcacctccacctcgagtgag

SEQ ID NO: 40262 - DNA, 20 bp, synthetic construct
  misc_feature 1..20: note = CRISPR gRNA sequence
  source 1..20: mol_type = other DNA
cgagtgagtggtttgtgtgt

SEQ ID NO: 40263 - DNA, 20 bp, synthetic construct
  misc_feature 1..20: note = CRISPR gRNA sequence
  source 1..20: mol_type = other DNA
gtgagtggtttgtgtgttgg

SEQ ID NO: 40264 - DNA, 20 bp, synthetic construct
  misc_feature 1..20: note = CRISPR gRNA sequence
  source 1..20: mol_type = other DNA
tgagtggtttgtgtgttgga

SEQ ID NO: 40265 - DNA, 20 bp, synthetic construct
  misc_feature 1..20: note = CRISPR gRNA sequence
  source 1..20: mol_type = other DNA
gtggtttgtgtgttggaagg

SEQ ID NO: 40266 - DNA, 20 bp, synthetic construct
  misc_feature 1..20: note = CRISPR gRNA sequence
  source 1..20: mol_type = other DNA
tggtttgtgtgttggaaggt

SEQ ID NO: 40267 - DNA, 20 bp, synthetic construct
  misc_feature 1..20: note = CRISPR gRNA sequence
  source 1..20: mol_type = other DNA
tttgtgtgttggaaggtggg

SEQ ID NO: 40268 - DNA, 20 bp, synthetic construct
  misc_feature 1..20: note = CRISPR gRNA sequence
  source 1..20: mol_type = other DNA
ttgtgtgttggaaggtgggt

SEQ ID NO: 40269 - DNA, 20 bp, synthetic construct
  misc_feature 1..20: note = CRISPR gRNA sequence
  source 1..20: mol_type = other DNA
tgtgttggaaggtgggtggg

SEQ ID NO: 40270 - DNA, 20 bp, synthetic construct
  misc_feature 1..20: note = CRISPR gRNA sequence
  source 1..20: mol_type = other DNA
gtgttggaaggtgggtgggt

SEQ ID NO: 40271 - DNA, 20 bp, synthetic construct
  misc_feature 1..20: note = CRISPR gRNA sequence
  source 1..20: mol_type = other DNA
tgttggaaggtgggtgggtg

SEQ ID NO: 40272 - DNA, 20 bp, synthetic construct
  misc_feature 1..20: note = CRISPR gRNA sequence
  source 1..20: mol_type = other DNA
tgggtgggtggggccaatta

SEQ ID NO: 40273 - DNA, 20 bp, synthetic construct
  misc_feature 1..20: note = CRISPR gRNA sequence
  source 1..20: mol_type = other DNA
tgggtggggccaattacagt

SEQ ID NO: 40274 - DNA, 20 bp, synthetic construct
  misc_feature 1..20: note = CRISPR gRNA sequence
  source 1..20: mol_type = other DNA
tggggccaattacagtgagt

SEQ ID NO: 40275 - DNA, 20 bp, synthetic construct
  misc_feature 1..20: note = CRISPR gRNA sequence
  source 1..20: mol_type = other DNA
caattacagtgagttagtgt

SEQ ID NO: 40276 - DNA, 20 bp, synthetic construct
  misc_feature 1..20: note = CRISPR gRNA sequence
  source 1..20: mol_type = other DNA
agtgagttagtgttggtgtt

SEQ ID NO: 40277 - DNA, 20 bp, synthetic construct
  misc_feature 1..20: note = CRISPR gRNA sequence
  source 1..20: mol_type = other DNA
gtgagttagtgttggtgttt

SEQ ID NO: 40278 - DNA, 20 bp, synthetic construct
  misc_feature 1..20: note = CRISPR gRNA sequence
  source 1..20: mol_type = other DNA
ttagtgttggtgtttgggtt

SEQ ID NO: 40279 - DNA, 20 bp, synthetic construct
  misc_feature 1..20: note = CRISPR gRNA sequence
  source 1..20: mol_type = other DNA
ggtgtttgggtttggttttt

SEQ ID NO: 40280 - DNA, 20 bp, synthetic construct
  misc_feature 1..20: note = CRISPR gRNA sequence
  source 1..20: mol_type = other DNA
tgggtttggtttttaagatt

SEQ ID NO: 40281 - DNA, 20 bp, synthetic construct
  misc_feature 1..20: note = CRISPR gRNA sequence
  source 1..20: mol_type = other DNA
caactgttctttccctgctg

SEQ ID NO: 40282 - DNA, 20 bp, synthetic construct
  misc_feature 1..20: note = CRISPR gRNA sequence
  source 1..20: mol_type = other DNA
tgttctttccctgctgaagt

SEQ ID NO: 40283 - DNA, 20 bp, synthetic construct
  misc_feature 1..20: note = CRISPR gRNA sequence
  source 1..20: mol_type = other DNA
tgctgaagtcagaaacccct

SEQ ID NO: 40284 - DNA, 20 bp, synthetic construct
  misc_feature 1..20: note = CRISPR gRNA sequence
  source 1..20: mol_type = other DNA
ctgaagtcagaaaccccttg

SEQ ID NO: 40285 - DNA, 20 bp, synthetic construct
  misc_feature 1..20: note = CRISPR gRNA sequence
  source 1..20: mol_type = other DNA
cagaaaccccttggagaatc

SEQ ID NO: 40286 - DNA, 20 bp, synthetic construct
  misc_feature 1..20: note = CRISPR gRNA sequence
  source 1..20: mol_type = other DNA
ccccttggagaatctggtga

SEQ ID NO: 40287 - DNA, 20 bp, synthetic construct
  misc_feature 1..20: note = CRISPR gRNA sequence
  source 1..20: mol_type = other DNA
aagttgtgactcttcctccc

SEQ ID NO: 40288 - DNA, 20 bp, synthetic construct
  misc_feature 1..20: note = CRISPR gRNA sequence
  source 1..20: mol_type = other DNA
tgactcttcctcccaagata

SEQ ID NO: 40289 - DNA, 20 bp, synthetic construct
  misc_feature 1..20: note = CRISPR gRNA sequence
  source 1..20: mol_type = other DNA
tcccccatgtctgacacgct

SEQ ID NO: 40290 - DNA, 20 bp, synthetic construct
  misc_feature 1..20: note = CRISPR gRNA sequence
  source 1..20: mol_type = other DNA
ccccatgtctgacacgctcg

SEQ ID NO: 40291 - DNA, 20 bp, synthetic construct
  misc_feature 1..20: note = CRISPR gRNA sequence
  source 1..20: mol_type = other DNA
cccatgtctgacacgctcgg

SEQ ID NO: 40292 - DNA, 20 bp, synthetic construct
  misc_feature 1..20: note = CRISPR gRNA sequence
  source 1..20: mol_type = other DNA
cacgctcggaggctcacccc

SEQ ID NO: 40293 - DNA, 20 bp, synthetic construct
  misc_feature 1..20: note = CRISPR gRNA sequence
  source 1..20: mol_type = other DNA
gaggctcacccctggtccct

SEQ ID NO: 40294 - DNA, 20 bp, synthetic construct
  misc_feature 1..20: note = CRISPR gRNA sequence
  source 1..20: mol_type = other DNA
ggctcacccctggtccctca

SEQ ID NO: 40295 - DNA, 20 bp, synthetic construct
  misc_feature 1..20: note = CRISPR gRNA sequence
  source 1..20: mol_type = other DNA
gctcacccctggtccctcag

SEQ ID NO: 40296 - DNA, 20 bp, synthetic construct
  misc_feature 1..20: note = CRISPR gRNA sequence
  source 1..20: mol_type = other DNA
cctcagaggtccacgaacct

SEQ ID NO: 40297 - DNA, 20 bp, synthetic construct
  misc_feature 1..20: note = CRISPR gRNA sequence
  source 1..20: mol_type = other DNA
aggtccacgaacctcagaat

SEQ ID NO: 40298 - DNA, 20 bp, synthetic construct
  misc_feature 1..20: note = CRISPR gRNA sequence
  source 1..20: mol_type = other DNA
cgaacctcagaataagaacc

SEQ ID NO: 40299 - DNA, 20 bp, synthetic construct
  misc_feature 1..20: note = CRISPR gRNA sequence
  source 1..20: mol_type = other DNA
gaacctcagaataagaacct

SEQ ID NO: 40300 - DNA, 20 bp, synthetic construct
  misc_feature 1..20: note = CRISPR gRNA sequence
  source 1..20: mol_type = other DNA
aacctcagaataagaacctg

SEQ ID NO: 40301 - DNA, 20 bp, synthetic construct
  misc_feature 1..20: note = CRISPR gRNA sequence
  source 1..20: mol_type = other DNA
acctcagaataagaacctgg

SEQ ID NO: 40302 - DNA, 20 bp, synthetic construct
  misc_feature 1..20: note = CRISPR gRNA sequence
  source 1..20: mol_type = other DNA
ctcagaataagaacctgggg

SEQ ID NO: 40303 - DNA, 20 bp, synthetic construct
  misc_feature 1..20: note = CRISPR gRNA sequence
  source 1..20: mol_type = other DNA
taagaacctgggggagaccc

SEQ ID NO: 40304 - DNA, 20 bp, synthetic construct
  misc_feature 1..20: note = CRISPR gRNA sequence
  source 1..20: mol_type = other DNA
gagaccccagctgcccgtgc

SEQ ID NO: 40305 - DNA, 20 bp, synthetic construct
  misc_feature 1..20: note = CRISPR gRNA sequence
  source 1..20: mol_type = other DNA
ctgcccgtgccagatctgct

SEQ ID NO: 40306 - DNA, 20 bp, synthetic construct
  misc_feature 1..20: note = CRISPR gRNA sequence
  source 1..20: mol_type = other DNA
gtgccagatctgctgagatc

SEQ ID NO: 40307 - DNA, 20 bp, synthetic construct
  misc_feature 1..20: note = CRISPR gRNA sequence
  source 1..20: mol_type = other DNA
agatctgctgagatctggcc

SEQ ID NO: 40308 - DNA, 20 bp, synthetic construct
  misc_feature 1..20: note = CRISPR gRNA sequence
  source 1..20: mol_type = other DNA
tctgctgagatctggcctgg

SEQ ID NO: 40309 - DNA, 20 bp, synthetic construct
  misc_feature 1..20: note = CRISPR gRNA sequence
  source 1..20: mol_type = other DNA
tgagatctggcctggcagcc

SEQ ID NO: 40310 - DNA, 20 bp, synthetic construct
  misc_feature 1..20: note = CRISPR gRNA sequence
  source 1..20: mol_type = other DNA
gagatctggcctggcagccc

SEQ ID NO: 40311 - DNA, 20 bp, synthetic construct
  misc_feature 1..20: note = CRISPR gRNA sequence
  source 1..20: mol_type = other DNA
agatctggcctggcagccca

SEQ ID NO: 40312 - DNA, 20 bp, synthetic construct
  misc_feature 1..20: note = CRISPR gRNA sequence
  source 1..20: mol_type = other DNA
tggcagcccagggctgtgtc

SEQ ID NO: 40313 - DNA, 20 bp, synthetic construct
  misc_feature 1..20: note = CRISPR gRNA sequence
  source 1..20: mol_type = other DNA
cccagggctgtgtccagttt

SEQ ID NO: 40314 - DNA, 20 bp, synthetic construct
  misc_feature 1..20: note = CRISPR gRNA sequence
  source 1..20: mol_type = other DNA
ccagggctgtgtccagtttc

SEQ ID NO: 40315 - DNA, 20 bp, synthetic construct
  misc_feature 1..20: note = CRISPR gRNA sequence
  source 1..20: mol_type = other DNA
gggctgtgtccagtttcagg

SEQ ID NO: 40316 - DNA, 20 bp, synthetic construct
  misc_feature 1..20: note = CRISPR gRNA sequence
  source 1..20: mol_type = other DNA
gtgtccagtttcaggaagtt

SEQ ID NO: 40317 - DNA, 20 bp, synthetic construct
  misc_feature 1..20: note = CRISPR gRNA sequence
  source 1..20: mol_type = other DNA
gtttcaggaagttgagtaac

SEQ ID NO: 40318 - DNA, 20 bp, synthetic construct
  misc_feature 1..20: note = CRISPR gRNA sequence
  source 1..20: mol_type = other DNA
gaagttgagtaactggaatg

SEQ ID NO: 40319 - DNA, 20 bp, synthetic construct
  misc_feature 1..20: note = CRISPR gRNA sequence
  source 1..20: mol_type = other DNA
aagttgagtaactggaatgc

SEQ ID NO: 40320 - DNA, 20 bp, synthetic construct
  misc_feature 1..20: note = CRISPR gRNA sequence
  source 1..20: mol_type = other DNA
agttgagtaactggaatgca

SEQ ID NO: 40321 - DNA, 20 bp, synthetic construct
  misc_feature 1..20: note = CRISPR gRNA sequence
  source 1..20: mol_type = other DNA
gaatgcagggaccatgctgc

SEQ ID NO: 40322 - DNA, 20 bp, synthetic construct
  misc_feature 1..20: note = CRISPR gRNA sequence
  source 1..20: mol_type = other DNA
ccctcccttctccccacccc

SEQ ID NO: 40323 - DNA, 20 bp, synthetic construct
  misc_feature 1..20: note = CRISPR gRNA sequence
  source 1..20: mol_type = other DNA
tctccccacccccagcttct

SEQ ID NO: 40324 - DNA, 20 bp, synthetic construct
  misc_feature 1..20: note = CRISPR gRNA sequence
  source 1..20: mol_type = other DNA
ctccccacccccagcttctc

SEQ ID NO: 40325 - DNA, 20 bp, synthetic construct
  misc_feature 1..20: note = CRISPR gRNA sequence
  source 1..20: mol_type = other DNA
cagcttctcaggcaatgctc

SEQ ID NO: 40326 - DNA, 20 bp, synthetic construct
  misc_feature 1..20: note = CRISPR gRNA sequence
  source 1..20: mol_type = other DNA
agcttctcaggcaatgctct

SEQ ID NO: 40327 - DNA, 20 bp, synthetic construct
  misc_feature 1..20: note = CRISPR gRNA sequence
  source 1..20: mol_type = other DNA
gcttctcaggcaatgctctg

SEQ ID NO: 40328 - DNA, 20 bp, synthetic construct
  misc_feature 1..20: note = CRISPR gRNA sequence
  source 1..20: mol_type = other DNA
cttctcaggcaatgctctgg

SEQ ID NO: 40329 - DNA, 20 bp, synthetic construct
  misc_feature 1..20: note = CRISPR gRNA sequence
  source 1..20: mol_type = other DNA
aggcaatgctctgggggatg

SEQ ID NO: 40330 - DNA, 20 bp, synthetic construct
  misc_feature 1..20: note = CRISPR gRNA sequence
  source 1..20: mol_type = other DNA
ggcaatgctctgggggatga

SEQ ID NO: 40331 - DNA, 20 bp, synthetic construct
  misc_feature 1..20: note = CRISPR gRNA sequence
  source 1..20: mol_type = other DNA
tgctctgggggatgaaggtg

SEQ ID NO: 40332 - DNA, 20 bp, synthetic construct
  misc_feature 1..20: note = CRISPR gRNA sequence
  source 1..20: mol_type = other DNA
tgggggatgaaggtgcagcc

SEQ ID NO: 40333 - DNA, 20 bp, synthetic construct
  misc_feature 1..20: note = CRISPR gRNA sequence
  source 1..20: mol_type = other DNA
ggatgaaggtgcagcccggc

SEQ ID NO: 40334 - DNA, 20 bp, synthetic construct
  misc_feature 1..20: note = CRISPR gRNA sequence
  source 1..20: mol_type = other DNA
aaggtgcagcccggctggct

SEQ ID NO: 40335 - DNA, 20 bp, synthetic construct
  misc_feature 1..20: note = CRISPR gRNA sequence
  source 1..20: mol_type = other DNA
ccggctggctcagctgctcc

SEQ ID NO: 40336 - DNA, 20 bp, synthetic construct
  misc_feature 1..20: note = CRISPR gRNA sequence
  source 1..20: mol_type = other DNA
cggctggctcagctgctccc

SEQ ID NO: 40337 - DNA, 20 bp, synthetic construct
  misc_feature 1..20: note = CRISPR gRNA sequence
  source 1..20: mol_type = other DNA
ggctggctcagctgctccca

SEQ ID NO: 40338 - DNA, 20 bp, synthetic construct
  misc_feature 1..20: note = CRISPR gRNA sequence
  source 1..20: mol_type = other DNA
ggctcagctgctcccagggc

SEQ ID NO: 40339 - DNA, 20 bp, synthetic construct
  misc_feature 1..20: note = CRISPR gRNA sequence
  source 1..20: mol_type = other DNA
gctcagctgctcccagggct

SEQ ID NO: 40340 - DNA, 20 bp, synthetic construct
  misc_feature 1..20: note = CRISPR gRNA sequence
  source 1..20: mol_type = other DNA
tcagctgctcccagggctgg

SEQ ID NO: 40341 - DNA, 20 bp, synthetic construct
  misc_feature 1..20: note = CRISPR gRNA sequence
  source 1..20: mol_type = other DNA
tcccagggctgggagctctg

SEQ ID NO: 40342 - DNA, 20 bp, synthetic construct
  misc_feature 1..20: note = CRISPR gRNA sequence
  source 1..20: mol_type = other DNA
tgggagctctgcagtccttg

SEQ ID NO: 40343 - DNA, 20 bp, synthetic construct
  misc_feature 1..20: note = CRISPR gRNA sequence
  source 1..20: mol_type = other DNA
agctctgcagtccttgaagt

SEQ ID NO: 40344 - DNA, 20 bp, synthetic construct
  misc_feature 1..20: note = CRISPR gRNA sequence
  source 1..20: mol_type = other DNA
tctgcagtccttgaagtgag

SEQ ID NO: 40345 - DNA, 20 bp, synthetic construct
  misc_feature 1..20: note = CRISPR gRNA sequence
  source 1..20: mol_type = other DNA
ccttgaagtgagtagcccgc

SEQ ID NO: 40346 - DNA, 20 bp, synthetic construct
  misc_feature 1..20: note = CRISPR gRNA sequence
  source 1..20: mol_type = other DNA
cttgaagtgagtagcccgct

SEQ ID NO: 40347 - DNA, 20 bp, synthetic construct
  misc_feature 1..20: note = CRISPR gRNA sequence
  source 1..20: mol_type = other DNA
gaagtgagtagcccgctagg

SEQ ID NO: 40348 - DNA, 20 bp, synthetic construct
  misc_feature 1..20: note = CRISPR gRNA sequence
  source 1..20: mol_type = other DNA
agtgagtagcccgctaggca

SEQ ID NO: 40349 - DNA, 20 bp, synthetic construct
  misc_feature 1..20: note = CRISPR gRNA sequence
  source 1..20: mol_type = other DNA
gcccgctaggcagagcctct

SEQ ID NO: 40350 - DNA, 20 bp, synthetic construct
  misc_feature 1..20: note = CRISPR gRNA sequence
  source 1..20: mol_type = other DNA
cccgctaggcagagcctctg

SEQ ID NO: 40351 - DNA, 20 bp, synthetic construct
  misc_feature 1..20: note = CRISPR gRNA sequence
  source 1..20: mol_type = other DNA
ctaggcagagcctctgaggc

SEQ ID NO: 40352 - DNA, 20 bp, synthetic construct
  misc_feature 1..20: note = CRISPR gRNA sequence
  source 1..20: mol_type = other DNA
taggcagagcctctgaggct

SEQ ID NO: 40353 - DNA, 20 bp, synthetic construct
  misc_feature 1..20: note = CRISPR gRNA sequence
  source 1..20: mol_type = other DNA
aggcagagcctctgaggctg

SEQ ID NO: 40354 - DNA, 20 bp, synthetic construct
  misc_feature 1..20: note = CRISPR gRNA sequence
  source 1..20: mol_type = other DNA
cagagcctctgaggctgggg

SEQ ID NO: 40355 - DNA, 20 bp, synthetic construct
  misc_feature 1..20: note = CRISPR gRNA sequence
  source 1..20: mol_type = other DNA
agagcctctgaggctggggc

SEQ ID NO: 40356 - DNA, 20 bp, synthetic construct
  misc_feature 1..20: note = CRISPR gRNA sequence
  source 1..20: mol_type = other DNA
gagcctctgaggctggggca

SEQ ID NO: 40357 - DNA, 20 bp, synthetic construct
  misc_feature 1..20: note = CRISPR gRNA sequence
  source 1..20: mol_type = other DNA
agcctctgaggctggggcag

SEQ ID NO: 40358 - DNA, 20 bp, synthetic construct
  misc_feature 1..20: note = CRISPR gRNA sequence
  source 1..20: mol_type = other DNA
gcctctgaggctggggcagg

SEQ ID NO: 40359 - DNA, 20 bp, synthetic construct
  misc_feature 1..20: note = CRISPR gRNA sequence
  source 1..20: mol_type = other DNA
cctctgaggctggggcaggg

SEQ ID NO: 40360 - DNA, 20 bp, synthetic construct
  misc_feature 1..20: note = CRISPR gRNA sequence
  source 1..20: mol_type = other DNA
ctctgaggctggggcagggg

SEQ ID NO: 40361 - DNA, 20 bp, synthetic construct
  misc_feature 1..20: note = CRISPR gRNA sequence
  source 1..20: mol_type = other DNA
ctgaggctggggcagggggg

SEQ ID NO: 40362 - DNA, 20 bp, synthetic construct
  misc_feature 1..20: note = CRISPR gRNA sequence
  source 1..20: mol_type = other DNA
tgtcccatccccctctttcc

SEQ ID NO: 40363 - DNA, 20 bp, synthetic construct
  misc_feature 1..20: note = CRISPR gRNA sequence
  source 1..20: mol_type = other DNA
gtcccatccccctctttcct

SEQ ID NO: 40364 - DNA, 20 bp, synthetic construct
  misc_feature 1..20: note = CRISPR gRNA sequence
  source 1..20: mol_type = other DNA
tcccatccccctctttcctg

SEQ ID NO: 40365 - DNA, 20 bp, synthetic construct
  misc_feature 1..20: note = CRISPR gRNA sequence
  source 1..20: mol_type = other DNA
tctttcctggggttattgta

SEQ ID NO: 40366 - DNA, 20 bp, synthetic construct
  misc_feature 1..20: note = CRISPR gRNA sequence
  source 1..20: mol_type = other DNA
ggttattgtaaagattaaat

SEQ ID NO: 40367 - DNA, 20 bp, synthetic construct
  misc_feature 1..20: note = CRISPR gRNA sequence
  source 1..20: mol_type = other DNA
aattgcccctaatacaatgt

SEQ ID NO: 40368 - DNA, 20 bp, synthetic construct
  misc_feature 1..20: note = CRISPR gRNA sequence
  source 1..20: mol_type = other DNA
cctaatacaatgtaagttct

SEQ ID NO: 40369 - DNA, 20 bp, synthetic construct
  misc_feature 1..20: note = CRISPR gRNA sequence
  source 1..20: mol_type = other DNA
tacaatgtaagttctcggtg

SEQ ID NO: 40370 - DNA, 20 bp, synthetic construct
  misc_feature 1..20: note = CRISPR gRNA sequence
  source 1..20: mol_type = other DNA
acaatgtaagttctcggtga

SEQ ID NO: 40371 - DNA, 20 bp, synthetic construct
  misc_feature 1..20: note = CRISPR gRNA sequence
  source 1..20: mol_type = other DNA
tgtaagttctcggtgaaggc

SEQ ID NO: 40372 - DNA, 20 bp, synthetic construct
  misc_feature 1..20: note = CRISPR gRNA sequence
  source 1..20: mol_type = other DNA
tctcggtgaaggctagctaa

SEQ ID NO: 40373 - DNA, 20 bp, synthetic construct
  misc_feature 1..20: note = CRISPR gRNA sequence
  source 1..20: mol_type = other DNA
gctaatagatgattcttact

SEQ ID NO: 40374 - DNA, 20 bp, synthetic construct
  misc_feature 1..20: note = CRISPR gRNA sequence
  source 1..20: mol_type = other DNA
taatagatgattcttactca

SEQ ID NO: 40375 - DNA, 20 bp, synthetic construct
  misc_feature 1..20: note = CRISPR gRNA sequence
  source 1..20: mol_type = other DNA
atagatgattcttactcaga

SEQ ID NO: 40376 - DNA, 20 bp, synthetic construct
  misc_feature 1..20: note = CRISPR gRNA sequence
  source 1..20: mol_type = other DNA
aataatcccacttctgattc

SEQ ID NO: 40377 - DNA, 20 bp, synthetic construct
  misc_feature 1..20: note = CRISPR gRNA sequence
  source 1..20: mol_type = other DNA
ataatcccacttctgattca

SEQ ID NO: 40378 - DNA, 20 bp, synthetic construct
  misc_feature 1..20: note = CRISPR gRNA sequence
  source 1..20: mol_type = other DNA
ctgattcaaggtttcacttc

SEQ ID NO: 40379 - DNA, 20 bp, synthetic construct
  misc_feature 1..20: note = CRISPR gRNA sequence
  source 1..20: mol_type = other DNA
cctgtctccgcatctctgaa

SEQ ID NO: 40380 - DNA, 20 bp, synthetic construct
  misc_feature 1..20: note = CRISPR gRNA sequence
  source 1..20: mol_type = other DNA
ctgtctccgcatctctgaac

SEQ ID NO: 40381 - DNA, 20 bp, synthetic construct
  misc_feature 1..20: note = CRISPR gRNA sequence
  source 1..20: mol_type = other DNA
gcatctctgaacaggcttct

SEQ ID NO: 40382 - DNA, 20 bp, synthetic construct
  misc_feature 1..20: note = CRISPR gRNA sequence
  source 1..20: mol_type = other DNA
catctctgaacaggcttctg

SEQ ID NO: 40383 - DNA, 20 bp, synthetic construct
  misc_feature 1..20: note = CRISPR gRNA sequence
  source 1..20: mol_type = other DNA
acaggcttctgaggccaccc

SEQ ID NO: 40384 - DNA, 20 bp, synthetic construct
  misc_feature 1..20: note = CRISPR gRNA sequence
  source 1..20: mol_type = other DNA
caggcttctgaggccaccct

SEQ ID NO: 40385 - DNA, 20 bp, synthetic construct
  misc_feature 1..20: note = CRISPR gRNA sequence
  source 1..20: mol_type = other DNA
aggcttctgaggccaccctg

SEQ ID NO: 40386 - DNA, 20 bp, synthetic construct
  misc_feature 1..20: note = CRISPR gRNA sequence
  source 1..20: mol_type = other DNA
gcttctgaggccaccctggg

SEQ ID NO: 40387 - DNA, 20 bp, synthetic construct
  misc_feature 1..20: note = CRISPR gRNA sequence
  source 1..20: mol_type = other DNA
cttctgaggccaccctgggg

SEQ ID NO: 40388 - DNA, 20 bp, synthetic construct
  misc_feature 1..20: note = CRISPR gRNA sequence
  source 1..20: mol_type = other DNA
ttctgaggccaccctgggga

SEQ ID NO: 40389 - DNA, 20 bp, synthetic construct
  misc_feature 1..20: note = CRISPR gRNA sequence
  source 1..20: mol_type = other DNA
tgaggccaccctggggaggg

SEQ ID NO: 40390 - DNA, 20 bp, synthetic construct
  misc_feature 1..20: note = CRISPR gRNA sequence
  source 1..20: mol_type = other DNA
gaggccaccctggggagggc

SEQ ID NO: 40391 - DNA, 20 bp, synthetic construct
  misc_feature 1..20: note = CRISPR gRNA sequence
  source 1..20: mol_type = other DNA
caccctggggagggcaggtg

SEQ ID NO: 40392 - DNA, 20 bp, synthetic construct
  misc_feature 1..20: note = CRISPR gRNA sequence
  source 1..20: mol_type = other DNA
accctggggagggcaggtgt

SEQ ID NO: 40393 - DNA, 20 bp, synthetic construct
  misc_feature 1..20: note = CRISPR gRNA sequence
  source 1..20: mol_type = other DNA
ggagggcaggtgtgggtgcg

SEQ ID NO: 40394 - DNA, 20 bp, synthetic construct
  misc_feature 1..20: note = CRISPR gRNA sequence
  source 1..20: mol_type = other DNA
tgggtgcgaagtatgactaa

SEQ ID NO: 40395 - DNA, 20 bp, synthetic construct
  misc_feature 1..20: note = CRISPR gRNA sequence
  source 1..20: mol_type = other DNA
tgcgaagtatgactaacggc

SEQ ID NO: 40396 - DNA, 20 bp, synthetic construct
  misc_feature 1..20: note = CRISPR gRNA sequence
  source 1..20: mol_type = other DNA
gaagtatgactaacggctgg

SEQ ID NO: 40397 - DNA, 20 bp, synthetic construct
  misc_feature 1..20: note = CRISPR gRNA sequence
  source 1..20: mol_type = other DNA
acggctggcagttgttattc

SEQ ID NO: 40398 - DNA, 20 bp, synthetic construct
  misc_feature 1..20: note = CRISPR gRNA sequence
  source 1..20: mol_type = other DNA
ggcagttgttattctggccc

SEQ ID NO: 40399 - DNA, 20 bp, synthetic construct
  misc_feature 1..20: note = CRISPR gRNA sequence
  source 1..20: mol_type = other DNA
gcagttgttattctggccct

SEQ ID NO: 40400 - DNA, 20 bp, synthetic construct
  misc_feature 1..20: note = CRISPR gRNA sequence
  source 1..20: mol_type = other DNA
cagttgttattctggccctg

SEQ ID NO: 40401 - DNA, 20 bp, synthetic construct
  misc_feature 1..20: note = CRISPR gRNA sequence
  source 1..20: mol_type = other DNA
ttattctggccctggggtgc

SEQ ID NO: 40402 - DNA, 20 bp, synthetic construct
  misc_feature 1..20: note = CRISPR gRNA sequence
  source 1..20: mol_type = other DNA
tattctggccctggggtgcc

SEQ ID NO: 40403 - DNA, 20 bp, synthetic construct
  misc_feature 1..20: note = CRISPR gRNA sequence
  source 1..20: mol_type = other DNA
ttctggccctggggtgccgg

SEQ ID NO: 40404 - DNA, 20 bp, synthetic construct
  misc_feature 1..20: note = CRISPR gRNA sequence
  source 1..20: mol_type = other DNA
tctggccctggggtgccggg

SEQ ID NO: 40405 - DNA, 20 bp, synthetic construct
  misc_feature 1..20: note = CRISPR gRNA sequence
  source 1..20: mol_type = other DNA
ctggccctggggtgccggga

SEQ ID NO: 40406 - DNA, 20 bp, synthetic construct
  misc_feature 1..20: note = CRISPR gRNA sequence
  source 1..20: mol_type = other DNA
tggccctggggtgccgggag

SEQ ID NO: 40407 - DNA, 20 bp, synthetic construct
  misc_feature 1..20: note = CRISPR gRNA sequence
  source 1..20: mol_type = other DNA
cctggggtgccgggaggggc

SEQ ID NO: 40408 - DNA, 20 bp, synthetic construct
  misc_feature 1..20: note = CRISPR gRNA sequence
  source 1..20: mol_type = other DNA
ctggggtgccgggaggggct

SEQ ID NO: 40409 - DNA, 20 bp, synthetic construct
  misc_feature 1..20: note = CRISPR gRNA sequence
  source 1..20: mol_type = other DNA
tggggtgccgggaggggctg

SEQ ID NO: 40410 - DNA, 20 bp, synthetic construct
  misc_feature 1..20: note = CRISPR gRNA sequence
  source 1..20: mol_type = other DNA
ccgggaggggctggggctgt

SEQ ID NO: 40411 - DNA, 20 bp, synthetic construct
  misc_feature 1..20: note = CRISPR gRNA sequence
  source 1..20: mol_type = other DNA
gaggggctggggctgttagc

SEQ ID NO: 40412 - DNA, 20 bp, synthetic construct
  misc_feature 1..20: note = CRISPR gRNA sequence
  source 1..20: mol_type = other DNA
aggggctggggctgttagct

SEQ ID NO: 40413 - DNA, 20 bp, synthetic construct
  misc_feature 1..20: note = CRISPR gRNA sequence
  source 1..20: mol_type = other DNA
ggggctggggctgttagctg

SEQ ID NO: 40414 - DNA, 20 bp, synthetic construct
  misc_feature 1..20: note = CRISPR gRNA sequence
  source 1..20: mol_type = other DNA
tggggctgttagctggggta

SEQ ID NO: 40415 - DNA, 20 bp, synthetic construct
  misc_feature 1..20: note = CRISPR gRNA sequence
  source 1..20: mol_type = other DNA
gctgttagctggggtatggt

SEQ ID NO: 40416 - DNA, 20 bp, synthetic construct
  misc_feature 1..20: note = CRISPR gRNA sequence
  source 1..20: mol_type = other DNA
ctgttagctggggtatggtc

SEQ ID NO: 40417 - DNA, 20 bp, synthetic construct
  misc_feature 1..20: note = CRISPR gRNA sequence
  source 1..20: mol_type = other DNA
tgttagctggggtatggtca

SEQ ID NO: 40418 - DNA, 20 bp, synthetic construct
  misc_feature 1..20: note = CRISPR gRNA sequence
  source 1..20: mol_type = other DNA
tagctggggtatggtcaggg

SEQ ID NO: 40419 - DNA, 20 bp, synthetic construct
  misc_feature 1..20: note = CRISPR gRNA sequence
  source 1..20: mol_type = other DNA
tggggtatggtcagggtaga

SEQ ID NO: 40420 - DNA, 20 bp, synthetic construct
  misc_feature 1..20: note = CRISPR gRNA sequence
  source 1..20: mol_type = other DNA
ggggtatggtcagggtagac

SEQ ID NO: 40421 - DNA, 20 bp, synthetic construct
  misc_feature 1..20: note = CRISPR gRNA sequence
  source 1..20: mol_type = other DNA
gggtatggtcagggtagaca

SEQ ID NO: 40422 - DNA, 20 bp, synthetic construct
  misc_feature 1..20: note = CRISPR gRNA sequence
  source 1..20: mol_type = other DNA
gtatggtcagggtagacagg

SEQ ID NO: 40423 - DNA, 20 bp, synthetic construct
  misc_feature 1..20: note = CRISPR gRNA sequence
  source 1..20: mol_type = other DNA
tatggtcagggtagacaggg

SEQ ID NO: 40424 - DNA, 20 bp, synthetic construct
  misc_feature 1..20: note = CRISPR gRNA sequence
  source 1..20: mol_type = other DNA
atggtcagggtagacaggga

SEQ ID NO: 40425 - DNA, 20 bp, synthetic construct
  misc_feature 1..20: note = CRISPR gRNA sequence
  source 1..20: mol_type = other DNA
tagacagggagggtttgtac

SEQ ID NO: 40426 - DNA, 20 bp, synthetic construct
  misc_feature 1..20: note = CRISPR gRNA sequence
  source 1..20: mol_type = other DNA
gacagggagggtttgtacca

SEQ ID NO: 40427 - DNA, 20 bp, synthetic construct
  misc_feature 1..20: note = CRISPR gRNA sequence
  source 1..20: mol_type = other DNA
cagggagggtttgtaccaga

SEQ ID NO: 40428 - DNA, 20 bp, synthetic construct
  misc_feature 1..20: note = CRISPR gRNA sequence
  source 1..20: mol_type = other DNA
agggagggtttgtaccagag

SEQ ID NO: 40429 - DNA, 20 bp, synthetic construct
  misc_feature 1..20: note = CRISPR gRNA sequence
  source 1..20: mol_type = other DNA
ttgtaccagagaggacactc

SEQ ID NO: 40430 - DNA, 20 bp, synthetic construct
  misc_feature 1..20: note = CRISPR gRNA sequence
  source 1..20: mol_type = other DNA
taccagagaggacactcaag

SEQ ID NO: 40431 - DNA, 20 bp, synthetic construct
  misc_feature 1..20: note = CRISPR gRNA sequence
  source 1..20: mol_type = other DNA
accagagaggacactcaagc

SEQ ID NO: 40432 - DNA, 20 bp, synthetic construct
  misc_feature 1..20: note = CRISPR gRNA sequence
  source 1..20: mol_type = other DNA
ccagagaggacactcaagca

SEQ ID NO: 40433 - DNA, 20 bp, synthetic construct
  misc_feature 1..20: note = CRISPR gRNA sequence
  source 1..20: mol_type = other DNA
ggacactcaagcagggtgcc

SEQ ID NO: 40434 - DNA, 20 bp, synthetic construct
  misc_feature 1..20: note = CRISPR gRNA sequence
  source 1..20: mol_type = other DNA
gacactcaagcagggtgccc

SEQ ID NO: 40435 - DNA, 20 bp, synthetic construct
  misc_feature 1..20: note = CRISPR gRNA sequence
  source 1..20: mol_type = other DNA
acactcaagcagggtgccca

SEQ ID NO: 40436 - DNA, 20 bp, synthetic construct
  misc_feature 1..20: note = CRISPR gRNA sequence
  source 1..20: mol_type = other DNA
gcagggtgcccagggctgcc

SEQ ID NO: 40437 - DNA, 20 bp, synthetic construct
  misc_feature 1..20: note = CRISPR gRNA sequence
  source 1..20: mol_type = other DNA
cagggtgcccagggctgcca

SEQ ID NO: 40438 - DNA, 20 bp, synthetic construct
  misc_feature 1..20: note = CRISPR gRNA sequence
  source 1..20: mol_type = other DNA
cagggctgccaaggatccct

SEQ ID NO: 40439 - DNA, 20 bp, synthetic construct
  misc_feature 1..20: note = CRISPR gRNA sequence
  source 1..20: mol_type = other DNA
gccaaggatccctgagtacc

SEQ ID NO: 40440 - DNA, 20 bp, synthetic construct
  misc_feature 1..20: note = CRISPR gRNA sequence
  source 1..20: mol_type = other DNA
aaggatccctgagtacctgg

SEQ ID NO: 40441 - DNA, 20 bp, synthetic construct
  misc_feature 1..20: note = CRISPR gRNA sequence
  source 1..20: mol_type = other DNA
ggatccctgagtacctggca

SEQ ID NO: 40442 - DNA, 20 bp, synthetic construct
  misc_feature 1..20: note = CRISPR gRNA sequence
  source 1..20: mol_type = other DNA
atccctgagtacctggcaga

SEQ ID NO: 40443 - DNA, 20 bp, synthetic construct
  misc_feature 1..20: note = CRISPR gRNA sequence
  source 1..20: mol_type = other DNA
agtacctggcagagagtgtg

SEQ ID NO: 40444 - DNA, 20 bp, synthetic construct
  misc_feature 1..20: note = CRISPR gRNA sequence
  source 1..20: mol_type = other DNA
gtacctggcagagagtgtgt

SEQ ID NO: 40445 - DNA, 20 bp, synthetic construct
  misc_feature 1..20: note = CRISPR gRNA sequence
  source 1..20: mol_type = other DNA
acctggcagagagtgtgtag

SEQ ID NO: 40446 - DNA, 20 bp, synthetic construct
  misc_feature 1..20: note = CRISPR gRNA sequence
  source 1..20: mol_type = other DNA
cctggcagagagtgtgtagg

SEQ ID NO: 40447 - DNA, 20 bp, synthetic construct
  misc_feature 1..20: note = CRISPR gRNA sequence
  source 1..20: mol_type = other DNA
gtgtgtaggaggaatcccca

SEQ ID NO: 40448 - DNA, 20 bp, synthetic construct
  misc_feature 1..20: note = CRISPR gRNA sequence
  source 1..20: mol_type = other DNA
tccccaaagtttgcctgcaa

SEQ ID NO: 40449 - DNA, 20 bp, synthetic construct
  misc_feature 1..20: note = CRISPR gRNA sequence
  source 1..20: mol_type = other DNA
aaagtttgcctgcaatggac

SEQ ID NO: 40450 - DNA, 20 bp, synthetic construct
  misc_feature 1..20: note = CRISPR gRNA sequence
  source 1..20: mol_type = other DNA
agtttgcctgcaatggacca

SEQ ID NO: 40451 - DNA, 20 bp, synthetic construct
  misc_feature 1..20: note = CRISPR gRNA sequence
  source 1..20: mol_type = other DNA
tcttgatccctaaatgccct

SEQ ID NO: 40452 - DNA, 20 bp, synthetic construct
  misc_feature 1..20: note = CRISPR gRNA sequence
  source 1..20: mol_type = other DNA
ctaaatgcccttggtgcttt

SEQ ID NO: 40453 - DNA, 20 bp, synthetic construct
  misc_feature 1..20: note = CRISPR gRNA sequence
  source 1..20: mol_type = other DNA
cttggtgcttttggctcaca

SEQ ID NO: 40454 - DNA, 20 bp, synthetic construct
  misc_feature 1..20: note = CRISPR gRNA sequence
  source 1..20: mol_type = other DNA
cacaaagcaccccctcctcc

SEQ ID NO: 40455 - DNA, 20 bp, synthetic construct
  misc_feature 1..20: note = CRISPR gRNA sequence
  source 1..20: mol_type = other DNA
acaaagcaccccctcctccc

SEQ ID NO: 40456 - DNA, 20 bp, synthetic construct
  misc_feature 1..20: note = CRISPR gRNA sequence
  source 1..20: mol_type = other DNA
cccctcctcccaggcacttc

SEQ ID NO: 40457 - DNA, 20 bp, synthetic construct
  misc_feature 1..20: note = CRISPR gRNA sequence
  source 1..20: mol_type = other DNA
ccctcctcccaggcacttct

SEQ ID NO: 40458 - DNA, 20 bp, synthetic construct
  misc_feature 1..20: note = CRISPR gRNA sequence
  source 1..20: mol_type = other DNA
tcccaggcacttctgggcca

SEQ ID NO: 40459 - DNA, 20 bp, synthetic construct
  misc_feature 1..20: note = CRISPR gRNA sequence
  source 1..20: mol_type = other DNA
aggcacttctgggccaaagc

SEQ ID NO: 40460 - DNA, 20 bp, synthetic construct
  misc_feature 1..20: note = CRISPR gRNA sequence
  source 1..20: mol_type = other DNA
gcacttctgggccaaagcca

SEQ ID NO: 40461 - DNA, 20 bp, synthetic construct
  misc_feature 1..20: note = CRISPR gRNA sequence
  source 1..20: mol_type = other DNA
cacttctgggccaaagccag

SEQ ID NO: 40462 - DNA, 20 bp, synthetic construct
  misc_feature 1..20: note = CRISPR gRNA sequence
  source 1..20: mol_type = other DNA
cttctgggccaaagccagag

SEQ ID NO: 40463 - DNA, 20 bp, synthetic construct
  misc_feature 1..20: note = CRISPR gRNA sequence
  source 1..20: mol_type = other DNA
gggccaaagccagaggagcc

SEQ ID NO: 40464 - DNA, 20 bp, synthetic construct
  misc_feature 1..20: note = CRISPR gRNA sequence
  source 1..20: mol_type = other DNA
ggccaaagccagaggagccc

SEQ ID NO: 40465 - DNA, 20 bp, synthetic construct
  misc_feature 1..20: note = CRISPR gRNA sequence
  source 1..20: mol_type = other DNA
gccaaagccagaggagccca

SEQ ID NO: 40466 - DNA, 20 bp, synthetic construct
  misc_feature 1..20: note = CRISPR gRNA sequence
  source 1..20: mol_type = other DNA
ccaaagccagaggagcccag

SEQ ID NO: 40467 - DNA, 20 bp, synthetic construct
  misc_feature 1..20: note = CRISPR gRNA sequence
  source 1..20: mol_type = other DNA
aaagccagaggagcccaggg

SEQ ID NO: 40468 - DNA, 20 bp, synthetic construct
  misc_feature 1..20: note = CRISPR gRNA sequence
  source 1..20: mol_type = other DNA
agccagaggagcccagggga

SEQ ID NO: 40469 - DNA, 20 bp, synthetic construct
  misc_feature 1..20: note = CRISPR gRNA sequence
  source 1..20: mol_type = other DNA
gccagaggagcccaggggag

SEQ ID NO: 40470 - DNA, 20 bp, synthetic construct
  misc_feature 1..20: note = CRISPR gRNA sequence
  source 1..20: mol_type = other DNA
ggagcccaggggagaggtca

SEQ ID NO: 40471 - DNA, 20 bp, synthetic construct
  misc_feature 1..20: note = CRISPR gRNA sequence
  source 1..20: mol_type = other DNA
gagcccaggggagaggtcac

SEQ ID NO: 40472 - DNA, 20 bp, synthetic construct
  misc_feature 1..20: note = CRISPR gRNA sequence
  source 1..20: mol_type = other DNA
aggtcacaggtcctatattc

SEQ ID NO: 40473 - DNA, 20 bp, synthetic construct
  misc_feature 1..20: note = CRISPR gRNA sequence
  source 1..20: mol_type = other DNA
ggtcacaggtcctatattcc

SEQ ID NO: 40474 - DNA, 20 bp, synthetic construct
  misc_feature 1..20: note = CRISPR gRNA sequence
  source 1..20: mol_type = other DNA
cacgctttgctgtgtgattc

SEQ ID NO: 40475 - DNA, 20 bp, synthetic construct
  misc_feature 1..20: note = CRISPR gRNA sequence
  source 1..20: mol_type = other DNA
acgctttgctgtgtgattct

SEQ ID NO: 40476 - DNA, 20 bp, synthetic construct
  misc_feature 1..20: note = CRISPR gRNA sequence
  source 1..20: mol_type = other DNA
tttgctgtgtgattctgggc

SEQ ID NO: 40477 - DNA, 20 bp, synthetic construct
  misc_feature 1..20: note = CRISPR gRNA sequence
  source 1..20: mol_type = other DNA
gcaagttacatcccctctcc

SEQ ID NO: 40478 - DNA, 20 bp, synthetic construct
  misc_feature 1..20: note = CRISPR gRNA sequence
  source 1..20: mol_type = other DNA
acatcccctctccgagtccc

SEQ ID NO: 40479 - DNA, 20 bp, synthetic construct
  misc_feature 1..20: note = CRISPR gRNA sequence
  source 1..20: mol_type = other DNA
ctctccgagtccctggttcc

SEQ ID NO: 40480 - DNA, 20 bp, synthetic construct
  misc_feature 1..20: note = CRISPR gRNA sequence
  source 1..20: mol_type = other DNA
ccgagtccctggttcccagt

SEQ ID NO: 40481 - DNA, 20 bp, synthetic construct
  misc_feature 1..20: note = CRISPR gRNA sequence
  source 1..20: mol_type = other DNA
gtcggtaaatacataaattg

SEQ ID NO: 40482 - DNA, 20 bp, synthetic construct
  misc_feature 1..20: note = CRISPR gRNA sequence
  source 1..20: mol_type = other DNA
tcggtaaatacataaattgc

SEQ ID NO: 40483 - DNA, 20 bp, synthetic construct
  misc_feature 1..20: note = CRISPR gRNA sequence
  source 1..20: mol_type = other DNA
aaatacataaattgcaggcg

SEQ ID NO: 40484 - DNA, 20 bp, synthetic construct
  misc_feature 1..20: note = CRISPR gRNA sequence
  source 1..20: mol_type = other DNA
attgcaggcgtggcctctgt

SEQ ID NO: 40485 - DNA, 20 bp, synthetic construct
  misc_feature 1..20: note = CRISPR gRNA sequence
  source 1..20: mol_type = other DNA
gcaggcgtggcctctgttgg

SEQ ID NO: 40486 - DNA, 20 bp, synthetic construct
  misc_feature 1..20: note = CRISPR gRNA sequence
  source 1..20: mol_type = other DNA
gtggctacgatctctgaaat

SEQ ID NO: 40487 - DNA, 20 bp, synthetic construct
  misc_feature 1..20: note = CRISPR gRNA sequence
  source 1..20: mol_type = other DNA
acgatctctgaaatgagtgc

SEQ ID NO: 40488 - DNA, 20 bp, synthetic construct
  misc_feature 1..20: note = CRISPR gRNA sequence
  source 1..20: mol_type = other DNA
cgatctctgaaatgagtgct

SEQ ID NO: 40489 - DNA, 20 bp, synthetic construct
  misc_feature 1..20: note = CRISPR gRNA sequence
  source 1..20: mol_type = other DNA
gatctctgaaatgagtgctg

SEQ ID NO: 40490 - DNA, 20 bp, synthetic construct
  misc_feature 1..20: note = CRISPR gRNA sequence
  source 1..20: mol_type = other DNA
tgaaatgagtgctggggcct

SEQ ID NO: 40491 - DNA, 20 bp, synthetic construct
  misc_feature 1..20: note = CRISPR gRNA sequence
  source 1..20: mol_type = other DNA
gaaatgagtgctggggccta

SEQ ID NO: 40492 - DNA, 20 bp, synthetic construct
  misc_feature 1..20: note = CRISPR gRNA sequence
  source 1..20: mol_type = other DNA
accctgtttttgtgcaatgc

SEQ ID NO: 40493 - DNA, 20 bp, synthetic construct
  misc_feature 1..20: note = CRISPR gRNA sequence
  source 1..20: mol_type = other DNA
ccctgtttttgtgcaatgct

SEQ ID NO: 40494 - DNA, 20 bp, synthetic construct
  misc_feature 1..20: note = CRISPR gRNA sequence
  source 1..20: mol_type = other DNA
tgtttttgtgcaatgctggg

SEQ ID NO: 40495 - DNA, 20 bp, synthetic construct
  misc_feature 1..20: note = CRISPR gRNA sequence
  source 1..20: mol_type = other DNA
gtttttgtgcaatgctggga

SEQ ID NO: 40496 - DNA, 20 bp, synthetic construct
  misc_feature 1..20: note = CRISPR gRNA sequence
  source 1..20: mol_type = other DNA
tttgtgcaatgctgggaagg

SEQ ID NO: 40497 - DNA, 20 bp, synthetic construct
  misc_feature 1..20: note = CRISPR gRNA sequence
  source 1..20: mol_type = other DNA
ttgtgcaatgctgggaagga

SEQ ID NO: 40498 - DNA, 20 bp, synthetic construct
  misc_feature 1..20: note = CRISPR gRNA sequence
  source 1..20: mol_type = other DNA
tgtgcaatgctgggaaggaa

SEQ ID NO: 40499 - DNA, 20 bp, synthetic construct
  misc_feature 1..20: note = CRISPR gRNA sequence
  source 1..20: mol_type = other DNA
tgcaatgctgggaaggaagg

SEQ ID NO: 40500 - DNA, 20 bp, synthetic construct
  misc_feature 1..20: note = CRISPR gRNA sequence
  source 1..20: mol_type = other DNA
gggaaggaagggagttgcct

SEQ ID NO: 40501 - DNA, 20 bp, synthetic construct
  misc_feature 1..20: note = CRISPR gRNA sequence
  source 1..20: mol_type = other DNA
gagttgccttggttcctgtt

SEQ ID NO: 40502 - DNA, 20 bp, synthetic construct
  misc_feature 1..20: note = CRISPR gRNA sequence
  source 1..20: mol_type = other DNA
agttgccttggttcctgttc

SEQ ID NO: 40503 - DNA, 20 bp, synthetic construct
  misc_feature 1..20: note = CRISPR gRNA sequence
  source 1..20: mol_type = other DNA
gttgccttggttcctgttca

SEQ ID NO: 40504 - DNA, 20 bp, synthetic construct
  misc_feature 1..20: note = CRISPR gRNA sequence
  source 1..20: mol_type = other DNA
tcctgttcagggcctgcacc

SEQ ID NO: 40505 - DNA, 20 bp, synthetic construct
  misc_feature 1..20: note = CRISPR gRNA sequence
  source 1..20: mol_type = other DNA
cctgttcagggcctgcacct

SEQ ID NO: 40506 - DNA, 20 bp, synthetic construct
  misc_feature 1..20: note = CRISPR gRNA sequence
  source 1..20: mol_type = other DNA
gttcagggcctgcacctggg

SEQ ID NO: 40507 - DNA, 20 bp, synthetic construct
  misc_feature 1..20: note = CRISPR gRNA sequence
  source 1..20: mol_type = other DNA
ttcagggcctgcacctggga

SEQ ID NO: 40508 - DNA, 20 bp, synthetic construct
  misc_feature 1..20: note = CRISPR gRNA sequence
  source 1..20: mol_type = other DNA
agggcctgcacctgggaagg

SEQ ID NO: 40509 - DNA, 20 bp, synthetic construct
  misc_feature 1..20: note = CRISPR gRNA sequence
  source 1..20: mol_type = other DNA
gggcctgcacctgggaagga

SEQ ID NO: 40510 - DNA, 20 bp, synthetic construct
  misc_feature 1..20: note = CRISPR gRNA sequence
  source 1..20: mol_type = other DNA
cctgcacctgggaaggaagg

SEQ ID NO: 40511 - DNA, 20 bp, synthetic construct
  misc_feature 1..20: note = CRISPR gRNA sequence
  source 1..20: mol_type = other DNA
ctgcacctgggaaggaagga

SEQ ID NO: 40512 - DNA, 20 bp, synthetic construct
  misc_feature 1..20: note = CRISPR gRNA sequence
  source 1..20: mol_type = other DNA
gaaggaaggtctaaccattg

SEQ ID NO: 40513 - DNA, 20 bp, synthetic construct
  misc_feature 1..20: note = CRISPR gRNA sequence
  source 1..20: mol_type = other DNA
aaggaaggtctaaccattgc

SEQ ID NO: 40514 - DNA, 20 bp, synthetic construct
  misc_feature 1..20: note = CRISPR gRNA sequence
  source 1..20: mol_type = other DNA
cattgcaggcaaattacatg

SEQ ID NO: 40515 - DNA, 20 bp, synthetic construct
  misc_feature 1..20: note = CRISPR gRNA sequence
  source 1..20: mol_type = other DNA
caggcaaattacatgaagac

SEQ ID NO: 40516 - DNA, 20 bp, synthetic construct
  misc_feature 1..20: note = CRISPR gRNA sequence
  source 1..20: mol_type = other DNA
ggcaaattacatgaagactg

SEQ ID NO: 40517 - DNA, 20 bp, synthetic construct
  misc_feature 1..20: note = CRISPR gRNA sequence
  source 1..20: mol_type = other DNA
gcaaattacatgaagactgg

SEQ ID NO: 40518 - DNA, 20 bp, synthetic construct
  misc_feature 1..20: note = CRISPR gRNA sequence
  source 1..20: mol_type = other DNA
tacatgaagactggaggttt

SEQ ID NO: 40519 - DNA, 20 bp, synthetic construct
  misc_feature 1..20: note = CRISPR gRNA sequence
  source 1..20: mol_type = other DNA
tcctcatgtgaccttcttat

SEQ ID NO: 40520 - DNA, 20 bp, synthetic construct
  misc_feature 1..20: note = CRISPR gRNA sequence
  source 1..20: mol_type = other DNA
atgtgaccttcttattagtg

SEQ ID NO: 40521 - DNA, 20 bp, synthetic construct
  misc_feature 1..20: note = CRISPR gRNA sequence
  source 1..20: mol_type = other DNA
attagtgtggactcgtgacc

SEQ ID NO: 40522 - DNA, 20 bp, synthetic construct
  misc_feature 1..20: note = CRISPR gRNA sequence
  source 1..20: mol_type = other DNA
gactcgtgacctggtgctgt

SEQ ID NO: 40523 - DNA, 20 bp, synthetic construct
  misc_feature 1..20: note = CRISPR gRNA sequence
  source 1..20: mol_type = other DNA
actcgtgacctggtgctgtg

SEQ ID NO: 40524 - DNA, 20 bp, synthetic construct
  misc_feature 1..20: note = CRISPR gRNA sequence
  source 1..20: mol_type = other DNA
ctcgtgacctggtgctgtga

SEQ ID NO: 40525 - DNA, 20 bp, synthetic construct
  misc_feature 1..20: note = CRISPR gRNA sequence
  source 1..20: mol_type = other DNA
agggtccacactcgccctac

SEQ ID NO: 40526 - DNA, 20 bp, synthetic construct
  misc_feature 1..20: note = CRISPR gRNA sequence
  source 1..20: mol_type = other DNA
tcgccctaccagtgtccccg

SEQ ID NO: 40527 - DNA, 20 bp, synthetic construct
  misc_feature 1..20: note = CRISPR gRNA sequence
  source 1..20: mol_type = other DNA
cgccctaccagtgtccccgt

SEQ ID NO: 40528 - DNA, 20 bp, synthetic construct
  misc_feature 1..20: note = CRISPR gRNA sequence
  source 1..20: mol_type = other DNA
ccctaccagtgtccccgtgg

SEQ ID NO: 40529 - DNA, 20 bp, synthetic construct
  misc_feature 1..20: note = CRISPR gRNA sequence
  source 1..20: mol_type = other DNA
cctaccagtgtccccgtggg

SEQ ID NO: 40530 - DNA, 20 bp, synthetic construct
  misc_feature 1..20: note = CRISPR gRNA sequence
  source 1..20: mol_type = other DNA
ctaccagtgtccccgtggga

SEQ ID NO: 40531 - DNA, 20 bp, synthetic construct
  misc_feature 1..20: note = CRISPR gRNA sequence
  source 1..20: mol_type = other DNA
taccagtgtccccgtgggag

SEQ ID NO: 40532 - DNA, 20 bp, synthetic construct
  misc_feature 1..20: note = CRISPR gRNA sequence
  source 1..20: mol_type = other DNA
ccagtgtccccgtgggaggg

SEQ ID NO: 40533 - DNA, 20 bp, synthetic construct
  misc_feature 1..20: note = CRISPR gRNA sequence
  source 1..20: mol_type = other DNA
gtccccgtgggaggggagtg

SEQ ID NO: 40534 - DNA, 20 bp, synthetic construct
  misc_feature 1..20: note = CRISPR gRNA sequence
  source 1..20: mol_type = other DNA
gaggggagtgtagcattaaa

SEQ ID NO: 40535 - DNA, 20 bp, synthetic construct
  misc_feature 1..20: note = CRISPR gRNA sequence
  source 1..20: mol_type = other DNA
gtgtagcattaaatagtaaa

SEQ ID NO: 40536 - DNA, 20 bp, synthetic construct
  misc_feature 1..20: note = CRISPR gRNA sequence
  source 1..20: mol_type = other DNA
agtaaatagaaaacaataac

SEQ ID NO: 40537 - DNA, 20 bp, synthetic construct
  misc_feature 1..20: note = CRISPR gRNA sequence
  source 1..20: mol_type = other DNA
agaaaacaataacaagttga

SEQ ID NO: 40538 - DNA, 20 bp, synthetic construct
  misc_feature 1..20: note = CRISPR gRNA sequence
  source 1..20: mol_type = other DNA
gaaaacaataacaagttgac

SEQ ID NO: 40539 - DNA, 20 bp, synthetic construct
  misc_feature 1..20: note = CRISPR gRNA sequence
  source 1..20: mol_type = other DNA
aaacaataacaagttgacag

SEQ ID NO: 40540 - DNA, 20 bp, synthetic construct
  misc_feature 1..20: note = CRISPR gRNA sequence
  source 1..20: mol_type = other DNA
aagttgacaggagaccctga

SEQ ID NO: 40541 - DNA, 20 bp, synthetic construct
  misc_feature 1..20: note = CRISPR gRNA sequence
  source 1..20: mol_type = other DNA
tgacaggagaccctgaaaga

SEQ ID NO: 40542 - DNA, 20 bp, synthetic construct
  misc_feature 1..20: note = CRISPR gRNA sequence
  source 1..20: mol_type = other DNA
gacaggagaccctgaaagaa

SEQ ID NO: 40543 - DNA, 20 bp, synthetic construct
  misc_feature 1..20: note = CRISPR gRNA sequence
  source 1..20: mol_type = other DNA
caggagaccctgaaagaaag

SEQ ID NO: 40544 - DNA, 20 bp, synthetic construct
  misc_feature 1..20: note = CRISPR gRNA sequence
  source 1..20: mol_type = other DNA
tttgttcctgctttctgcac

SEQ ID NO: 40545 - DNA, 20 bp, synthetic construct
  misc_feature 1..20: note = CRISPR gRNA sequence
  source 1..20: mol_type = other DNA
tgttcctgctttctgcacaa

SEQ ID NO: 40546 - DNA, 20 bp, synthetic construct
  misc_feature 1..20: note = CRISPR gRNA sequence
  source 1..20: mol_type = other DNA
cctgcattttcattttgtcc

SEQ ID NO: 40547 - DNA, 20 bp, synthetic construct
  misc_feature 1..20: note = CRISPR gRNA sequence
  source 1..20: mol_type = other DNA
ctgcattttcattttgtcct

SEQ ID NO: 40548 - DNA, 20 bp, synthetic construct
  misc_feature 1..20: note = CRISPR gRNA sequence
  source 1..20: mol_type = other DNA
gggtaccacccctcccttat

SEQ ID NO: 40549 - DNA, 20 bp, synthetic construct
  misc_feature 1..20: note = CRISPR gRNA sequence
  source 1..20: mol_type = other DNA
ggtaccacccctcccttatc

SEQ ID NO: 40550 - DNA, 20 bp, synthetic construct
  misc_feature 1..20: note = CRISPR gRNA sequence
  source 1..20: mol_type = other DNA
accacccctcccttatcagg

SEQ ID NO: 40551 - DNA, 20 bp, synthetic construct
  misc_feature 1..20: note = CRISPR gRNA sequence
  source 1..20: mol_type = other DNA
cacccctcccttatcaggtg

SEQ ID NO: 40552 - DNA, 20 bp, synthetic construct
  misc_feature 1..20: note = CRISPR gRNA sequence
  source 1..20: mol_type = other DNA
ctcccttatcaggtggagaa

SEQ ID NO: 40553 - DNA, 20 bp, synthetic construct
  misc_feature 1..20: note = CRISPR gRNA sequence
  source 1..20: mol_type = other DNA
tcccttatcaggtggagaaa

SEQ ID NO: 40554 - DNA, 20 bp, synthetic construct
  misc_feature 1..20: note = CRISPR gRNA sequence
  source 1..20: mol_type = other DNA
ccttatcaggtggagaaaag

SEQ ID NO: 40555 - DNA, 20 bp, synthetic construct
  misc_feature 1..20: note = CRISPR gRNA sequence
  source 1..20: mol_type = other DNA
cttatcaggtggagaaaagg

SEQ ID NO: 40556 - DNA, 20 bp, synthetic construct
  misc_feature 1..20: note = CRISPR gRNA sequence
  source 1..20: mol_type = other DNA
caggtggagaaaaggaggcc

SEQ ID NO: 40557 - DNA, 20 bp, synthetic construct
  misc_feature 1..20: note = CRISPR gRNA sequence
  source 1..20: mol_type = other DNA
gagaaaaggaggcccagctc

SEQ ID NO: 40558 - DNA, 20 bp, synthetic construct
  misc_feature 1..20: note = CRISPR gRNA sequence
  source 1..20: mol_type = other DNA
aaaggaggcccagctccagc

SEQ ID NO: 40559 - DNA, 20 bp, synthetic construct
  misc_feature 1..20: note = CRISPR gRNA sequence
  source 1..20: mol_type = other DNA
gaggcccagctccagccaga

SEQ ID NO: 40560 - DNA, 20 bp, synthetic construct
  misc_feature 1..20: note = CRISPR gRNA sequence
  source 1..20: mol_type = other DNA
tccagccagaaagcactcct

SEQ ID NO: 40561 - DNA, 20 bp, synthetic construct
  misc_feature 1..20: note = CRISPR gRNA sequence
  source 1..20: mol_type = other DNA
agcactcctcagatccatca

SEQ ID NO: 40562 - DNA, 20 bp, synthetic construct
  misc_feature 1..20: note = CRISPR gRNA sequence
  source 1..20: mol_type = other DNA
cctcagatccatcacagacc

SEQ ID NO: 40563 - DNA, 20 bp, synthetic construct
  misc_feature 1..20: note = CRISPR gRNA sequence
  source 1..20: mol_type = other DNA
ctcagatccatcacagaccg

SEQ ID NO: 40564 - DNA, 20 bp, synthetic construct
  misc_feature 1..20: note = CRISPR gRNA sequence
  source 1..20: mol_type = other DNA
tcagatccatcacagaccga

SEQ ID NO: 40565 - DNA, 20 bp, synthetic construct
  misc_feature 1..20: note = CRISPR gRNA sequence
  source 1..20: mol_type = other DNA
tcacagaccgagggacccac

SEQ ID NO: 40566 - DNA, 20 bp, synthetic construct
  misc_feature 1..20: note = CRISPR gRNA sequence
  source 1..20: mol_type = other DNA
cacagaccgagggacccact

SEQ ID NO: 40567 - DNA, 20 bp, synthetic construct
  misc_feature 1..20: note = CRISPR gRNA sequence
  source 1..20: mol_type = other DNA
gacccactgggtgcccatct

SEQ ID NO: 40568 - DNA, 20 bp, synthetic construct
  misc_feature 1..20: note = CRISPR gRNA sequence
  source 1..20: mol_type = other DNA
accaacatgtctcataacct

SEQ ID NO: 40569 - DNA, 20 bp, synthetic construct
  misc_feature 1..20: note = CRISPR gRNA sequence
  source 1..20: mol_type = other DNA
ccaacatgtctcataacctt

SEQ ID NO: 40570 - DNA, 20 bp, synthetic construct
  misc_feature 1..20: note = CRISPR gRNA sequence
  source 1..20: mol_type = other DNA
catgtctcataaccttgggc

SEQ ID NO: 40571 - DNA, 20 bp, synthetic construct
  misc_feature 1..20: note = CRISPR gRNA sequence
  source 1..20: mol_type = other DNA
ggctagaccttgattctctc

SEQ ID NO: 40572 - DNA, 20 bp, synthetic construct
  misc_feature 1..20: note = CRISPR gRNA sequence
  source 1..20: mol_type = other DNA
gctagaccttgattctctct

SEQ ID NO: 40573 - DNA, 20 bp, synthetic construct
  misc_feature 1..20: note = CRISPR gRNA sequence
  source 1..20: mol_type = other DNA
tgtttccccatctccaccat

SEQ ID NO: 40574 - DNA, 20 bp, synthetic construct
  misc_feature 1..20: note = CRISPR gRNA sequence
  source 1..20: mol_type = other DNA
gtttccccatctccaccatg

SEQ ID NO: 40575 - DNA, 20 bp, synthetic construct
  misc_feature 1..20: note = CRISPR gRNA sequence
  source 1..20: mol_type = other DNA
tctccaccatgaggacttgc

SEQ ID NO: 40576 - DNA, 20 bp, synthetic construct
  misc_feature 1..20: note = CRISPR gRNA sequence
  source 1..20: mol_type = other DNA
ctccaccatgaggacttgca

SEQ ID NO: 40577 - DNA, 20 bp, synthetic construct
  misc_feature 1..20: note = CRISPR gRNA sequence
  source 1..20: mol_type = other DNA
tccaccatgaggacttgcaa

SEQ ID NO: 40578 - DNA, 20 bp, synthetic construct
  misc_feature 1..20: note = CRISPR gRNA sequence
  source 1..20: mol_type = other DNA
ccaccatgaggacttgcaag

SEQ ID NO: 40579 - DNA, 20 bp, synthetic construct
  misc_feature 1..20: note = CRISPR gRNA sequence
  source 1..20: mol_type = other DNA
ggggtgctctctgaccatct

SEQ ID NO: 40580 - DNA, 20 bp, synthetic construct
  misc_feature 1..20: note = CRISPR gRNA sequence
  source 1..20: mol_type = other DNA
gggtgctctctgaccatctt

SEQ ID NO: 40581 - DNA, 20 bp, synthetic construct
  misc_feature 1..20: note = CRISPR gRNA sequence
  source 1..20: mol_type = other DNA
ctctctgaccatcttgggtt

SEQ ID NO: 40582 - DNA, 20 bp, synthetic construct
  misc_feature 1..20: note = CRISPR gRNA sequence
  source 1..20: mol_type = other DNA
tctgaccatcttgggttcag

SEQ ID NO: 40583 - DNA, 20 bp, synthetic construct
  misc_feature 1..20: note = CRISPR gRNA sequence
  source 1..20: mol_type = other DNA
ctgaccatcttgggttcagt

SEQ ID NO: 40584 - DNA, 20 bp, synthetic construct
  misc_feature 1..20: note = CRISPR gRNA sequence
  source 1..20: mol_type = other DNA
gttcagtgggttccgtcatc

SEQ ID NO: 40585 - DNA, 20 bp, synthetic construct
  misc_feature 1..20: note = CRISPR gRNA sequence
  source 1..20: mol_type = other DNA
tgggttccgtcatctggaac

SEQ ID NO: 40586 - DNA, 20 bp, synthetic construct
  misc_feature 1..20: note = CRISPR gRNA sequence
  source 1..20: mol_type = other DNA
gggttccgtcatctggaacc

SEQ ID NO: 40587 - DNA, 20 bp, synthetic construct
  misc_feature 1..20: note = CRISPR gRNA sequence
  source 1..20: mol_type = other DNA
ggttccgtcatctggaacca

SEQ ID NO: 40588 - DNA, 20 bp, synthetic construct
  misc_feature 1..20: note = CRISPR gRNA sequence
  source 1..20: mol_type = other DNA
cgccctgtgccctgaccaca

SEQ ID NO: 40589 - DNA, 20 bp, synthetic construct
  misc_feature 1..20: note = CRISPR gRNA sequence
  source 1..20: mol_type = other DNA
ccctgtgccctgaccacaaa

SEQ ID NO: 40590 - DNA, 20 bp, synthetic construct
  misc_feature 1..20: note = CRISPR gRNA sequence
  source 1..20: mol_type = other DNA
cctgtgccctgaccacaaag

SEQ ID NO: 40591 - DNA, 20 bp, synthetic construct
  misc_feature 1..20: note = CRISPR gRNA sequence
  source 1..20: mol_type = other DNA
gaccacaaagaggatgtgtt

SEQ ID NO: 40592 - DNA, 20 bp, synthetic construct
  misc_feature 1..20: note = CRISPR gRNA sequence
  source 1..20: mol_type = other DNA
accacaaagaggatgtgttt

SEQ ID NO: 40593 - DNA, 20 bp, synthetic construct
  misc_feature 1..20: note = CRISPR gRNA sequence
  source 1..20: mol_type = other DNA
agaggatgtgtttgggtcct

SEQ ID NO: 40594 - DNA, 20 bp, synthetic construct
  misc_feature 1..20: note = CRISPR gRNA sequence
  source 1..20: mol_type = other DNA
tgtgccacccctgtgatctc

SEQ ID NO: 40595 - DNA, 20 bp, synthetic construct
  misc_feature 1..20: note = CRISPR gRNA sequence
  source 1..20: mol_type = other DNA
acccctgtgatctccagcct

SEQ ID NO: 40596 - DNA, 20 bp, synthetic construct
  misc_feature 1..20: note = CRISPR gRNA sequence
  source 1..20: mol_type = other DNA
ctgtgatctccagcctcagt

SEQ ID NO: 40597 - DNA, 20 bp, synthetic construct
  misc_feature 1..20: note = CRISPR gRNA sequence
  source 1..20: mol_type = other DNA
atctccagcctcagtgagaa

SEQ ID NO: 40598 - DNA, 20 bp, synthetic construct
  misc_feature 1..20: note = CRISPR gRNA sequence
  source 1..20: mol_type = other DNA
cagtgagaacggtttgtccc

SEQ ID NO: 40599 - DNA, 20 bp, synthetic construct
  misc_feature 1..20: note = CRISPR gRNA sequence
  source 1..20: mol_type = other DNA
tttgtccctggatgccgtgt

SEQ ID NO: 40600 - DNA, 20 bp, synthetic construct
  misc_feature 1..20: note = CRISPR gRNA sequence
  source 1..20: mol_type = other DNA
ttgtccctggatgccgtgtt

SEQ ID NO: 40601 - DNA, 20 bp, synthetic construct
  misc_feature 1..20: note = CRISPR gRNA sequence
  source 1..20: mol_type = other DNA
cctggatgccgtgttgggtt

SEQ ID NO: 40602 - DNA, 20 bp, synthetic construct
  misc_feature 1..20: note = CRISPR gRNA sequence
  source 1..20: mol_type = other DNA
atgccgtgttgggtttggtt

SEQ ID NO: 40603 - DNA, 20 bp, synthetic construct
  misc_feature 1..20: note = CRISPR gRNA sequence
  source 1..20: mol_type = other DNA
ttcggtgcttctccactctg

SEQ ID NO: 40604 - DNA, 20 bp, synthetic construct
  misc_feature 1..20: note = CRISPR gRNA sequence
  source 1..20: mol_type = other DNA
ggtgcttctccactctgcag

SEQ ID NO: 40605 - DNA, 20 bp, synthetic construct
  misc_feature 1..20: note = CRISPR gRNA sequence
  source 1..20: mol_type = other DNA
tctgcagtggctcttccgct

SEQ ID NO: 40606 - DNA, 20 bp, synthetic construct
  misc_feature 1..20: note = CRISPR gRNA sequence
  source 1..20: mol_type = other DNA
tggctcttccgcttggacat

SEQ ID NO: 40607 - DNA, 20 bp, synthetic construct
  misc_feature 1..20: note = CRISPR gRNA sequence
  source 1..20: mol_type = other DNA
ggctcttccgcttggacatc

SEQ ID NO: 40608 - DNA, 20 bp, synthetic construct
  misc_feature 1..20: note = CRISPR gRNA sequence
  source 1..20: mol_type = other DNA
cttccgcttggacatcaggt

SEQ ID NO: 40609 - DNA, 20 bp, synthetic construct
  misc_feature 1..20: note = CRISPR gRNA sequence
  source 1..20: mol_type = other DNA
tgagcgtgcctctccgcccc

SEQ ID NO: 40610 - DNA, 20 bp, synthetic construct
  misc_feature 1..20: note = CRISPR gRNA sequence
  source 1..20: mol_type = other DNA
tgcccctgtcccccatccca

SEQ ID NO: 40611 - DNA, 20 bp, synthetic construct
  misc_feature 1..20: note = CRISPR gRNA sequence
  source 1..20: mol_type = other DNA
gcccctgtcccccatcccac

SEQ ID NO: 40612 - DNA, 20 bp, synthetic construct
  misc_feature 1..20: note = CRISPR gRNA sequence
  source 1..20: mol_type = other DNA
acaggtcatctgctcccacg

SEQ ID NO: 40613 - DNA, 20 bp, synthetic construct
  misc_feature 1..20: note = CRISPR gRNA sequence
  source 1..20: mol_type = other DNA
caggtcatctgctcccacgt

SEQ ID NO: 40614 - DNA, 20 bp, synthetic construct
  misc_feature 1..20: note = CRISPR gRNA sequence
  source 1..20: mol_type = other DNA
cacgtgggccccttgtccac

SEQ ID NO: 40615 - DNA, 20 bp, synthetic construct
  misc_feature 1..20: note = CRISPR gRNA sequence
  source 1..20: mol_type = other DNA
tcatgccaacctgtcatcct

SEQ ID NO: 40616 - DNA, 20 bp, synthetic construct
  misc_feature 1..20: note = CRISPR gRNA sequence
  source 1..20: mol_type = other DNA
acctgtcatcctcagcacct

SEQ ID NO: 40617 - DNA, 20 bp, synthetic construct
  misc_feature 1..20: note = CRISPR gRNA sequence
  source 1..20: mol_type = other DNA
cctgtcatcctcagcacctt

SEQ ID NO: 40618 - DNA, 20 bp, synthetic construct
  misc_feature 1..20: note = CRISPR gRNA sequence
  source 1..20: mol_type = other DNA
gtcatcctcagcaccttggg

SEQ ID NO: 40619 - DNA, 20 bp, synthetic construct
  misc_feature 1..20: note = CRISPR gRNA sequence
  source 1..20: mol_type = other DNA
ctcagcaccttgggcagtac

SEQ ID NO: 40620 - DNA, 20 bp, synthetic construct
  misc_feature 1..20: note = CRISPR gRNA sequence
  source 1..20: mol_type = other DNA
cttgggcagtaccagatctg

SEQ ID NO: 40621 - DNA, 20 bp, synthetic construct
  misc_feature 1..20: note = CRISPR gRNA sequence
  source 1..20: mol_type = other DNA
tgggcagtaccagatctgca

SEQ ID NO: 40622 - DNA, 20 bp, synthetic construct
  misc_feature 1..20: note = CRISPR gRNA sequence
  source 1..20: mol_type = other DNA
cagatctgcagagcatgtga

SEQ ID NO: 40623 - DNA, 20 bp, synthetic construct
  misc_feature 1..20: note = CRISPR gRNA sequence
  source 1..20: mol_type = other DNA
agatctgcagagcatgtgat

SEQ ID NO: 40624 - DNA, 20 bp, synthetic construct
  misc_feature 1..20: note = CRISPR gRNA sequence
  source 1..20: mol_type = other DNA
gaatgatcaaatgaatgaat

SEQ ID NO: 40625 - DNA, 20 bp, synthetic construct
  misc_feature 1..20: note = CRISPR gRNA sequence
  source 1..20: mol_type = other DNA
atcaaatgaatgaataagta

SEQ ID NO: 40626 - DNA, 20 bp, synthetic construct
  misc_feature 1..20: note = CRISPR gRNA sequence
  source 1..20: mol_type = other DNA
aatgaataagtatggcctca

SEQ ID NO: 40627 - DNA, 20 bp, synthetic construct
  misc_feature 1..20: note = CRISPR gRNA sequence
  source 1..20: mol_type = other DNA
aatttctccaaattcaccat

SEQ ID NO: 40628 - DNA, 20 bp, synthetic construct
  misc_feature 1..20: note = CRISPR gRNA sequence
  source 1..20: mol_type = other DNA
tttctccaaattcaccatta

SEQ ID NO: 40629 - DNA, 20 bp, synthetic construct
  misc_feature 1..20: note = CRISPR gRNA sequence
  source 1..20: mol_type = other DNA
tctccaaattcaccattaga

SEQ ID NO: 40630 - DNA, 20 bp, synthetic construct
  misc_feature 1..20: note = CRISPR gRNA sequence
  source 1..20: mol_type = other DNA
actctgcctcactcgttctt

SEQ ID NO: 40631 - DNA, 20 bp, synthetic construct
  misc_feature 1..20: note = CRISPR gRNA sequence
  source 1..20: mol_type = other DNA
tgcctcactcgttctttgga

SEQ ID NO: 40632 - DNA, 20 bp, synthetic construct
  misc_feature 1..20: note = CRISPR gRNA sequence
  source 1..20: mol_type = other DNA
ctcgttctttggatagtcct

SEQ ID NO: 40633 - DNA, 20 bp, synthetic construct
  misc_feature 1..20: note = CRISPR gRNA sequence
  source 1..20: mol_type = other DNA
cgttctttggatagtcctta

SEQ ID NO: 40634 - DNA, 20 bp, synthetic construct
  misc_feature 1..20: note = CRISPR gRNA sequence
  source 1..20: mol_type = other DNA
tccttagagatttttttttt

SEQ ID NO: 40635 - DNA, 20 bp, synthetic construct
  misc_feature 1..20: note = CRISPR gRNA sequence
  source 1..20: mol_type = other DNA
ccttagagattttttttttt

SEQ ID NO: 40636 - DNA, 20 bp, synthetic construct
  misc_feature 1..20: note = CRISPR gRNA sequence
  source 1..20: mol_type = other DNA
ttttttaattattatacttt

SEQ ID NO: 40637 - DNA, 20 bp, synthetic construct
  misc_feature 1..20: note = CRISPR gRNA sequence
  source 1..20: mol_type = other DNA
aattattatactttaagttc

SEQ ID NO: 40638 - DNA, 20 bp, synthetic construct
  misc_feature 1..20: note = CRISPR gRNA sequence
  source 1..20: mol_type = other DNA
attattatactttaagttct

SEQ ID NO: 40639 - DNA, 20 bp, synthetic construct
  misc_feature 1..20: note = CRISPR gRNA sequence
  source 1..20: mol_type = other DNA
ttattatactttaagttcta

SEQ ID NO: 40640 - DNA, 20 bp, synthetic construct
  misc_feature 1..20: note = CRISPR gRNA sequence
  source 1..20: mol_type = other DNA
gggtacatgtgcacaacata

SEQ ID NO: 40641 - DNA, 20 bp, synthetic construct
  misc_feature 1..20: note = CRISPR gRNA sequence
  source 1..20: mol_type = other DNA
ggtacatgtgcacaacatac

SEQ ID NO: 40642 - DNA, 20 bp, synthetic construct
  misc_feature 1..20: note = CRISPR gRNA sequence
  source 1..20: mol_type = other DNA
tatgtatacatgtgccatgt

SEQ ID NO: 40643 - DNA, 20 bp, synthetic construct
  misc_feature 1..20: note = CRISPR gRNA sequence
  source 1..20: mol_type = other DNA
tgtgccatgttggtatgctg

SEQ ID NO: 40644 - DNA, 20 bp, synthetic construct
  misc_feature 1..20: note = CRISPR gRNA sequence
  source 1..20: mol_type = other DNA
tgccatgttggtatgctgca

SEQ ID NO: 40645 - DNA, 20 bp, synthetic construct
  misc_feature 1..20: note = CRISPR gRNA sequence
  source 1..20: mol_type = other DNA
ggtatgctgcagagactttt

SEQ ID NO: 40646 - DNA, 20 bp, synthetic construct
  misc_feature 1..20: note = CRISPR gRNA sequence
  source 1..20: mol_type = other DNA
gcagagacttttaagaaaac

SEQ ID NO: 40647 - DNA, 20 bp, synthetic construct
  misc_feature 1..20: note = CRISPR gRNA sequence
  source 1..20: mol_type = other DNA
cagagacttttaagaaaact

SEQ ID NO: 40648 - DNA, 20 bp, synthetic construct
  misc_feature 1..20: note = CRISPR gRNA sequence
  source 1..20: mol_type = other DNA
agagacttttaagaaaactg

SEQ ID NO: 40649 - DNA, 20 bp, synthetic construct
  misc_feature 1..20: note = CRISPR gRNA sequence
  source 1..20: mol_type = other DNA
gagacttttaagaaaactgg

SEQ ID NO: 40650 - DNA, 20 bp, synthetic construct
  misc_feature 1..20: note = CRISPR gRNA sequence
  source 1..20: mol_type = other DNA
cttttaagaaaactgggggc

SEQ ID NO: 40651 - DNA, 20 bp, synthetic construct
  misc_feature 1..20: note = CRISPR gRNA sequence
  source 1..20: mol_type = other DNA
ttttaagaaaactgggggcc

SEQ ID NO: 40652 - DNA, 20 bp, synthetic construct
  misc_feature 1..20: note = CRISPR gRNA sequence
  source 1..20: mol_type = other DNA
agaaaactgggggccaggcg

SEQ ID NO: 40653 - DNA, 20 bp, synthetic construct
  misc_feature 1..20: note = CRISPR gRNA sequence
  source 1..20: mol_type = other DNA
aaactgggggccaggcgcgg

SEQ ID NO: 40654 - DNA, 20 bp, synthetic construct
  misc_feature 1..20: note = CRISPR gRNA sequence
  source 1..20: mol_type = other DNA
gtggctcacgcctgtaatcc

SEQ ID NO: 40655 - DNA, 20 bp, synthetic construct
  misc_feature 1..20: note = CRISPR gRNA sequence
  source 1..20: mol_type = other DNA
cgcctgtaatcccagcattt

SEQ ID NO: 40656 - DNA, 20 bp, synthetic construct
  misc_feature 1..20: note = CRISPR gRNA sequence
  source 1..20: mol_type = other DNA
gcctgtaatcccagcatttt

SEQ ID NO: 40657 - DNA, 20 bp, synthetic construct
  misc_feature 1..20: note = CRISPR gRNA sequence
  source 1..20: mol_type = other DNA
ctgtaatcccagcattttgg

SEQ ID NO: 40658 - DNA, 20 bp, synthetic construct
  misc_feature 1..20: note = CRISPR gRNA sequence
  source 1..20: mol_type = other DNA
tgtaatcccagcattttggg

SEQ ID NO: 40659 - DNA, 20 bp, synthetic construct
  misc_feature 1..20: note = CRISPR gRNA sequence
  source 1..20: mol_type = other DNA
tcccagcattttgggaggcc

SEQ ID NO: 40660 - DNA, 20 bp, synthetic construct
  misc_feature 1..20: note = CRISPR gRNA sequence
  source 1..20: mol_type = other DNA
cccagcattttgggaggcca

SEQ ID NO: 40661 - DNA, 20 bp, synthetic construct
  misc_feature 1..20: note = CRISPR gRNA sequence
  source 1..20: mol_type = other DNA
agcattttgggaggccaagg

SEQ ID NO: 40662 - DNA, 20 bp, synthetic construct
  misc_feature 1..20: note = CRISPR gRNA sequence
  source 1..20: mol_type = other DNA
gcattttgggaggccaaggt

SEQ ID NO: 40663 - DNA, 20 bp, synthetic construct
  misc_feature 1..20: note = CRISPR gRNA sequence
  source 1..20: mol_type = other DNA
ttttgggaggccaaggtggg

SEQ ID NO: 40664 - DNA, 20 bp, synthetic construct
  misc_feature 1..20: note = CRISPR gRNA sequence
  source 1..20: mol_type = other DNA
ccaaggtgggcggatcacgt

SEQ ID NO: 40665 - DNA, 20 bp, synthetic construct
  misc_feature 1..20: note = CRISPR gRNA sequence
  source 1..20: mol_type = other DNA
caaggtgggcggatcacgtg

SEQ ID NO: 40666 - DNA, 20 bp, synthetic construct
  misc_feature 1..20: note = CRISPR gRNA sequence
  source 1..20: mol_type = other DNA
gtgggcggatcacgtgaggt

SEQ ID NO: 40667 - DNA, 20 bp, synthetic construct
  misc_feature 1..20: note = CRISPR gRNA sequence
  source 1..20: mol_type = other DNA
tgggcggatcacgtgaggtc

SEQ ID NO: 40668 - DNA, 20 bp, synthetic construct
  misc_feature 1..20: note = CRISPR gRNA sequence
  source 1..20: mol_type = other DNA
ggcggatcacgtgaggtcag

SEQ ID NO: 40669 - DNA, 20 bp, synthetic construct
  misc_feature 1..20: note = CRISPR gRNA sequence
  source 1..20: mol_type = other DNA
tcacgtgaggtcaggagttt

SEQ ID NO: 40670 - DNA, 20 bp, synthetic construct
  misc_feature 1..20: note = CRISPR gRNA sequence
  source 1..20: mol_type = other DNA
tgaggtcaggagtttgagaa

SEQ ID NO: 40671 - DNA, 20 bp, synthetic construct
  misc_feature 1..20: note = CRISPR gRNA sequence
  source 1..20: mol_type = other DNA
tcaggagtttgagaacagcc

SEQ ID NO: 40672 - DNA, 20 bp, synthetic construct
  misc_feature 1..20: note = CRISPR gRNA sequence
  source 1..20: mol_type = other DNA
tttgagaacagcctggccaa

SEQ ID NO: 40673 - DNA, 20 bp, synthetic construct
  misc_feature 1..20: note = CRISPR gRNA sequence
  source 1..20: mol_type = other DNA
ttgagaacagcctggccaac

SEQ ID NO: 40674 - DNA, 20 bp, synthetic construct
  misc_feature 1..20: note = CRISPR gRNA sequence
  source 1..20: mol_type = other DNA
tgagaacagcctggccaaca

SEQ ID NO: 40675 - DNA, 20 bp, synthetic construct
  misc_feature 1..20: note = CRISPR gRNA sequence
  source 1..20: mol_type = other DNA
aataccaaaaaaaaaaaaaa

SEQ ID NO: 40676 - DNA, 20 bp, synthetic construct
  misc_feature 1..20: note = CRISPR gRNA sequence
  source 1..20: mol_type = other DNA
aaaaaaaaaaaaaaagtatc

SEQ ID NO: 40677 - DNA, 20 bp, synthetic construct
  misc_feature 1..20: note = CRISPR gRNA sequence
  source 1..20: mol_type = other DNA
aaaaaaaaaaaaaagtatct

SEQ ID NO: 40678 - DNA, 20 bp, synthetic construct
  misc_feature 1..20: note = CRISPR gRNA sequence
  source 1..20: mol_type = other DNA
aaaaaaaaagtatctgggcg

SEQ ID NO: 40679 - DNA, 20 bp, synthetic construct
  misc_feature 1..20: note = CRISPR gRNA sequence
  source 1..20: mol_type = other DNA
aagtatctgggcgtggttgt

SEQ ID NO: 40680 - DNA, 20 bp, synthetic construct
  misc_feature 1..20: note = CRISPR gRNA sequence
  source 1..20: mol_type = other DNA
ggcgtggttgtgagcccttg

SEQ ID NO: 40681 - DNA, 20 bp, synthetic construct
  misc_feature 1..20: note = CRISPR gRNA sequence
  source 1..20: mol_type = other DNA
gttgtgagcccttgtagtgc

SEQ ID NO: 40682 - DNA, 20 bp, synthetic construct
  misc_feature 1..20: note = CRISPR gRNA sequence
  source 1..20: mol_type = other DNA
cccttgtagtgccagccgct

SEQ ID NO: 40683 - DNA, 20 bp, synthetic construct
  misc_feature 1..20: note = CRISPR gRNA sequence
  source 1..20: mol_type = other DNA
ccttgtagtgccagccgctc

SEQ ID NO: 40684 - DNA, 20 bp, synthetic construct
  misc_feature 1..20: note = CRISPR gRNA sequence
  source 1..20: mol_type = other DNA
ttgtagtgccagccgctcag

SEQ ID NO: 40685 - DNA, 20 bp, synthetic construct
  misc_feature 1..20: note = CRISPR gRNA sequence
  source 1..20: mol_type = other DNA
agtgccagccgctcaggagt

SEQ ID NO: 40686 - DNA, 20 bp, synthetic construct
  misc_feature 1..20: note = CRISPR gRNA sequence
  source 1..20: mol_type = other DNA
gtgccagccgctcaggagtc

SEQ ID NO: 40687 - DNA, 20 bp, synthetic construct
  misc_feature 1..20: note = CRISPR gRNA sequence
  source 1..20: mol_type = other DNA
gccagccgctcaggagtcag

SEQ ID NO: 40688 - DNA, 20 bp, synthetic construct
  misc_feature 1..20: note = CRISPR gRNA sequence
  source 1..20: mol_type = other DNA
tcaggagaatcacttgaacc

SEQ ID NO: 40689 - DNA, 20 bp, synthetic construct
  misc_feature 1..20: note = CRISPR gRNA sequence
  source 1..20: mol_type = other DNA
caggagaatcacttgaaccc

SEQ ID NO: 40690 - DNA, 20 bp, synthetic construct
  misc_feature 1..20: note = CRISPR gRNA sequence
  source 1..20: mol_type = other DNA
ggagaatcacttgaacccag

SEQ ID NO: 40691 - DNA, 20 bp, synthetic construct
  misc_feature 1..20: note = CRISPR gRNA sequence
  source 1..20: mol_type = other DNA
gagaatcacttgaacccagg

SEQ ID NO: 40692 - DNA, 20 bp, synthetic construct
  misc_feature 1..20: note = CRISPR gRNA sequence
  source 1..20: mol_type = other DNA
tcacttgaacccaggaggcg

SEQ ID NO: 40693 - DNA, 20 bp, synthetic construct
  misc_feature 1..20: note = CRISPR gRNA sequence
  source 1..20: mol_type = other DNA
cacttgaacccaggaggcga

SEQ ID NO: 40694 - DNA, 20 bp, synthetic construct
  misc_feature 1..20: note = CRISPR gRNA sequence
  source 1..20: mol_type = other DNA
aacccaggaggcgaaggttg

SEQ ID NO: 40695 - DNA, 20 bp, synthetic construct
  misc_feature 1..20: note = CRISPR gRNA sequence
  source 1..20: mol_type = other DNA
caggaggcgaaggttgcagt

SEQ ID NO: 40696 - DNA, 20 bp, synthetic construct
  misc_feature 1..20: note = CRISPR gRNA sequence
  source 1..20: mol_type = other DNA
ggcgaaggttgcagtgagct

SEQ ID NO: 40697 - DNA, 20 bp, synthetic construct
  misc_feature 1..20: note = CRISPR gRNA sequence
  source 1..20: mol_type = other DNA
gagatcgtgccactgcactc

SEQ ID NO: 40698 - DNA, 20 bp, synthetic construct
  misc_feature 1..20: note = CRISPR gRNA sequence
  source 1..20: mol_type = other DNA
cgtgccactgcactccagcc

SEQ ID NO: 40699 - DNA, 20 bp, synthetic construct
  misc_feature 1..20: note = CRISPR gRNA sequence
  source 1..20: mol_type = other DNA
gtgccactgcactccagcct

SEQ ID NO: 40700 - DNA, 20 bp, synthetic construct
  misc_feature 1..20: note = CRISPR gRNA sequence
  source 1..20: mol_type = other DNA
ctgcactccagcctgggcga

SEQ ID NO: 40701 - DNA, 20 bp, synthetic construct
  misc_feature 1..20: note = CRISPR gRNA sequence
  source 1..20: mol_type = other DNA
gcactccagcctgggcgaca

SEQ ID NO: 40702 - DNA, 20 bp, synthetic construct
  misc_feature 1..20: note = CRISPR gRNA sequence
  source 1..20: mol_type = other DNA
tccagcctgggcgacagagt

SEQ ID NO: 40703 - DNA, 20 bp, synthetic construct
  misc_feature 1..20: note = CRISPR gRNA sequence
  source 1..20: mol_type = other DNA
gactccatctcaaaaaaaaa

SEQ ID NO: 40704 - DNA, 20 bp, synthetic construct
  misc_feature 1..20: note = CRISPR gRNA sequence
  source 1..20: mol_type = other DNA
catctcaaaaaaaaaaagaa

SEQ ID NO: 40705 - DNA, 20 bp, synthetic construct
  misc_feature 1..20: note = CRISPR gRNA sequence
  source 1..20: mol_type = other DNA
caaaaaaaaaaagaaaagaa

SEQ ID NO: 40706 - DNA, 20 bp, synthetic construct
  misc_feature 1..20: note = CRISPR gRNA sequence
  source 1..20: mol_type = other DNA
aaaagaaaagaaaagaaaac

SEQ ID NO: 40707 - DNA, 20 bp, synthetic construct
  misc_feature 1..20: note = CRISPR gRNA sequence
  source 1..20: mol_type = other DNA
aaagaaaagaaaagaaaact

SEQ ID NO: 40708 - DNA, 20 bp, synthetic construct
  misc_feature 1..20: note = CRISPR gRNA sequence
  source 1..20: mol_type = other DNA
agaaaagaaaagaaaactgg

SEQ ID NO: 40709 - DNA, 20 bp, synthetic construct
  misc_feature 1..20: note = CRISPR gRNA sequence
  source 1..20: mol_type = other DNA
aaagaaaactgggagcttcc

SEQ ID NO: 40710 - DNA, 20 bp, synthetic construct
  misc_feature 1..20: note = CRISPR gRNA sequence
  source 1..20: mol_type = other DNA
gggagcttcctagttgccac

SEQ ID NO: 40711 - DNA, 20 bp, synthetic construct
  misc_feature 1..20: note = CRISPR gRNA sequence
  source 1..20: mol_type = other DNA
ggagcttcctagttgccact

SEQ ID NO: 40712 - DNA, 20 bp, synthetic construct
  misc_feature 1..20: note = CRISPR gRNA sequence
  source 1..20: mol_type = other DNA
gagcttcctagttgccactg

SEQ ID NO: 40713 - DNA, 20 bp, synthetic construct
  misc_feature 1..20: note = CRISPR gRNA sequence
  source 1..20: mol_type = other DNA
cctagttgccactggggact

SEQ ID NO: 40714 - DNA, 20 bp, synthetic construct
  misc_feature 1..20: note = CRISPR gRNA sequence
  source 1..20: mol_type = other DNA
ctagttgccactggggactc

SEQ ID NO: 40715 - DNA, 20 bp, synthetic construct
  misc_feature 1..20: note = CRISPR gRNA sequence
  source 1..20: mol_type = other DNA
tagttgccactggggactca

SEQ ID NO: 40716 - DNA, 20 bp, synthetic construct
  misc_feature 1..20: note = CRISPR gRNA sequence
  source 1..20: mol_type = other DNA
tcagggacctgtcttaattg

SEQ ID NO: 40717 - DNA, 20 bp, synthetic construct
  misc_feature 1..20: note = CRISPR gRNA sequence
  source 1..20: mol_type = other DNA
cagggacctgtcttaattgt

SEQ ID NO: 40718 - DNA, 20 bp, synthetic construct
  misc_feature 1..20: note = CRISPR gRNA sequence
  source 1..20: mol_type = other DNA
gggacctgtcttaattgtgg

SEQ ID NO: 40719 - DNA, 20 bp, synthetic construct
  misc_feature 1..20: note = CRISPR gRNA sequence
  source 1..20: mol_type = other DNA
tcttaattgtgggagctgat

SEQ ID NO: 40720 - DNA, 20 bp, synthetic construct
  misc_feature 1..20: note = CRISPR gRNA sequence
  source 1..20: mol_type = other DNA
gggagctgatgagaatataa

SEQ ID NO: 40721 - DNA, 20 bp, synthetic construct
  misc_feature 1..20: note = CRISPR gRNA sequence
  source 1..20: mol_type = other DNA
ggagctgatgagaatataaa

SEQ ID NO: 40722 - DNA, 20 bp, synthetic construct
  misc_feature 1..20: note = CRISPR gRNA sequence
  source 1..20: mol_type = other DNA
gagctgatgagaatataaaa

SEQ ID NO: 40723 - DNA, 20 bp, synthetic construct
  misc_feature 1..20: note = CRISPR gRNA sequence
  source 1..20: mol_type = other DNA
agctgatgagaatataaaag

SEQ ID NO: 40724 - DNA, 20 bp, synthetic construct
  misc_feature 1..20: note = CRISPR gRNA sequence
  source 1..20: mol_type = other DNA
ctgatgagaatataaaaggg

SEQ ID NO: 40725 - DNA, 20 bp, synthetic construct
  misc_feature 1..20: note = CRISPR gRNA sequence
  source 1..20: mol_type = other DNA
tgatgagaatataaaagggg

SEQ ID NO: 40726 - DNA, 20 bp, synthetic construct
  misc_feature 1..20: note = CRISPR gRNA sequence
  source 1..20: mol_type = other DNA
gaatataaaaggggaggcac

SEQ ID NO: 40727 - DNA, 20 bp, synthetic construct
  misc_feature 1..20: note = CRISPR gRNA sequence
  source 1..20: mol_type = other DNA
ataaaaggggaggcaccagc

SEQ ID NO: 40728 - DNA, 20 bp, synthetic construct
  misc_feature 1..20: note = CRISPR gRNA sequence
  source 1..20: mol_type = other DNA
aggggaggcaccagccagcc

SEQ ID NO: 40729 - DNA, 20 bp, synthetic construct
  misc_feature 1..20: note = CRISPR gRNA sequence
  source 1..20: mol_type = other DNA
accagccagccaagccaccc

SEQ ID NO: 40730 - DNA, 20 bp, synthetic construct
  misc_feature 1..20: note = CRISPR gRNA sequence
  source 1..20: mol_type = other DNA
ccagccagccaagccacccc

SEQ ID NO: 40731 - DNA, 20 bp, synthetic construct
  misc_feature 1..20: note = CRISPR gRNA sequence
  source 1..20: mol_type = other DNA
gccaagccaccccaggcact

SEQ ID NO: 40732 - DNA, 20 bp, synthetic construct
  misc_feature 1..20: note = CRISPR gRNA sequence
  source 1..20: mol_type = other DNA
ccaagccaccccaggcactc

SEQ ID NO: 40733 - DNA, 20 bp, synthetic construct
  misc_feature 1..20: note = CRISPR gRNA sequence
  source 1..20: mol_type = other DNA
caagccaccccaggcactca

SEQ ID NO: 40734 - DNA, 20 bp, synthetic construct
  misc_feature 1..20: note = CRISPR gRNA sequence
  source 1..20: mol_type = other DNA
ggcaccgcatccatgatttt

SEQ ID NO: 40735 - DNA, 20 bp, synthetic construct
  misc_feature 1..20: note = CRISPR gRNA sequence
  source 1..20: mol_type = other DNA
gcaccgcatccatgattttc

SEQ ID NO: 40736 - DNA, 20 bp, synthetic construct
  misc_feature 1..20: note = CRISPR gRNA sequence
  source 1..20: mol_type = other DNA
caccgcatccatgattttca

SEQ ID NO: 40737 - DNA, 20 bp, synthetic construct
  misc_feature 1..20: note = CRISPR gRNA sequence
  source 1..20: mol_type = other DNA
accgcatccatgattttcag

SEQ ID NO: 40738 - DNA, 20 bp, synthetic construct
  misc_feature 1..20: note = CRISPR gRNA sequence
  source 1..20: mol_type = other DNA
cgcatccatgattttcaggg

SEQ ID NO: 40739 - DNA, 20 bp, synthetic construct
  misc_feature 1..20: note = CRISPR gRNA sequence
  source 1..20: mol_type = other DNA
gcatccatgattttcagggg

SEQ ID NO: 40740 - DNA, 20 bp, synthetic construct
  misc_feature 1..20: note = CRISPR gRNA sequence
  source 1..20: mol_type = other DNA
tgcttccctttcccttccct

SEQ ID NO: 40741 - DNA, 20 bp, synthetic construct
  misc_feature 1..20: note = CRISPR gRNA sequence
  source 1..20: mol_type = other DNA
gcttccctttcccttcccta

SEQ ID NO: 40742 - DNA, 20 bp, synthetic construct
  misc_feature 1..20: note = CRISPR gRNA sequence
  source 1..20: mol_type = other DNA
tcccttccctaaggaccccc

SEQ ID NO: 40743 - DNA, 20 bp, synthetic construct
  misc_feature 1..20: note = CRISPR gRNA sequence
  source 1..20: mol_type = other DNA
tccctaaggacccccaagaa

SEQ ID NO: 40744 - DNA, 20 bp, synthetic construct
  misc_feature 1..20: note = CRISPR gRNA sequence
  source 1..20: mol_type = other DNA
ccctaaggacccccaagaat

SEQ ID NO: 40745 - DNA, 20 bp, synthetic construct
  misc_feature 1..20: note = CRISPR gRNA sequence
  source 1..20: mol_type = other DNA
ctaaggacccccaagaatgg

SEQ ID NO: 40746 - DNA, 20 bp, synthetic construct
  misc_feature 1..20: note = CRISPR gRNA sequence
  source 1..20: mol_type = other DNA
taaggacccccaagaatggg

SEQ ID NO: 40747 - DNA, 20 bp, synthetic construct
  misc_feature 1..20: note = CRISPR gRNA sequence
  source 1..20: mol_type = other DNA
cccaagaatgggaggtgcca

SEQ ID NO: 40748 - DNA, 20 bp, synthetic construct
  misc_feature 1..20: note = CRISPR gRNA sequence
  source 1..20: mol_type = other DNA
aagaatgggaggtgccacag

SEQ ID NO: 40749 - DNA, 20 bp, synthetic construct
  misc_feature 1..20: note = CRISPR gRNA sequence
  source 1..20: mol_type = other DNA
atgggaggtgccacagcaga

SEQ ID NO: 40750 - DNA, 20 bp, synthetic construct
  misc_feature 1..20: note = CRISPR gRNA sequence
  source 1..20: mol_type = other DNA
aggtgccacagcagatggac

SEQ ID NO: 40751 - DNA, 20 bp, synthetic construct
  misc_feature 1..20: note = CRISPR gRNA sequence
  source 1..20: mol_type = other DNA
ggtgccacagcagatggacc

SEQ ID NO: 40752 - DNA, 20 bp, synthetic construct
  misc_feature 1..20: note = CRISPR gRNA sequence
  source 1..20: mol_type = other DNA
cacagcagatggaccaggct

SEQ ID NO: 40753 - DNA, 20 bp, synthetic construct
  misc_feature 1..20: note = CRISPR gRNA sequence
  source 1..20: mol_type = other DNA
ctcagttacttaactgctgc

SEQ ID NO: 40754 - DNA, 20 bp, synthetic construct
  misc_feature 1..20: note = CRISPR gRNA sequence
  source 1..20: mol_type = other DNA
ttacttaactgctgcgagct

SEQ ID NO: 40755 - DNA, 20 bp, synthetic construct
  misc_feature 1..20: note = CRISPR gRNA sequence
  source 1..20: mol_type = other DNA
acttaactgctgcgagctca

SEQ ID NO: 40756 - DNA, 20 bp, synthetic construct
  misc_feature 1..20: note = CRISPR gRNA sequence
  source 1..20: mol_type = other DNA
taactgctgcgagctcagag

SEQ ID NO: 40757 - DNA, 20 bp, synthetic construct
  misc_feature 1..20: note = CRISPR gRNA sequence
  source 1..20: mol_type = other DNA
aactgctgcgagctcagagc

SEQ ID NO: 40758 - DNA, 20 bp, synthetic construct
  misc_feature 1..20: note = CRISPR gRNA sequence
  source 1..20: mol_type = other DNA
tgcgagctcagagcaggtcc

SEQ ID NO: 40759 - DNA, 20 bp, synthetic construct
  misc_feature 1..20: note = CRISPR gRNA sequence
  source 1..20: mol_type = other DNA
cgagctcagagcaggtccca

SEQ ID NO: 40760 - DNA, 20 bp, synthetic construct
  misc_feature 1..20: note = CRISPR gRNA sequence
  source 1..20: mol_type = other DNA
agcaggtcccagagcctctc

SEQ ID NO: 40761 - DNA, 20 bp, synthetic construct
  misc_feature 1..20: note = CRISPR gRNA sequence
  source 1..20: mol_type = other DNA
gcaggtcccagagcctctcc

SEQ ID NO: 40762 - DNA, 20 bp, synthetic construct
  misc_feature 1..20: note = CRISPR gRNA sequence
  source 1..20: mol_type = other DNA
cccagagcctctccaggcct

SEQ ID NO: 40763 - DNA, 20 bp, synthetic construct
  misc_feature 1..20: note = CRISPR gRNA sequence
  source 1..20: mol_type = other DNA
cagtttcctcatctgtaaaa

SEQ ID NO: 40764 - DNA, 20 bp, synthetic construct
  misc_feature 1..20: note = CRISPR gRNA sequence
  source 1..20: mol_type = other DNA
gtttcctcatctgtaaaatg

SEQ ID NO: 40765 - DNA, 20 bp, synthetic construct
  misc_feature 1..20: note = CRISPR gRNA sequence
  source 1..20: mol_type = other DNA
ctcatctgtaaaatggagat

SEQ ID NO: 40766 - DNA, 20 bp, synthetic construct
  misc_feature 1..20: note = CRISPR gRNA sequence
  source 1..20: mol_type = other DNA
atggagataagaataattac

SEQ ID NO: 40767 - DNA, 20 bp, synthetic construct
  misc_feature 1..20: note = CRISPR gRNA sequence
  source 1..20: mol_type = other DNA
gataagaataattactggcc

SEQ ID NO: 40768 - DNA, 20 bp, synthetic construct
  misc_feature 1..20: note = CRISPR gRNA sequence
  source 1..20: mol_type = other DNA
gaataattactggcctggca

SEQ ID NO: 40769 - DNA, 20 bp, synthetic construct
  misc_feature 1..20: note = CRISPR gRNA sequence
  source 1..20: mol_type = other DNA
taattactggcctggcacag

SEQ ID NO: 40770 - DNA, 20 bp, synthetic construct
  misc_feature 1..20: note = CRISPR gRNA sequence
  source 1..20: mol_type = other DNA
ctggcctggcacagtggctc

SEQ ID NO: 40771 - DNA, 20 bp, synthetic construct
  misc_feature 1..20: note = CRISPR gRNA sequence
  source 1..20: mol_type = other DNA
gtggctcaagcctgtaatcc

SEQ ID NO: 40772 - DNA, 20 bp, synthetic construct
  misc_feature 1..20: note = CRISPR gRNA sequence
  source 1..20: mol_type = other DNA
agcctgtaatcccagcactt

SEQ ID NO: 40773 - DNA, 20 bp, synthetic construct
  misc_feature 1..20: note = CRISPR gRNA sequence
  source 1..20: mol_type = other DNA
gcctgtaatcccagcacttt

SEQ ID NO: 40774 - DNA, 20 bp, synthetic construct
  misc_feature 1..20: note = CRISPR gRNA sequence
  source 1..20: mol_type = other DNA
ctgtaatcccagcactttgg

SEQ ID NO: 40775 - DNA, 20 bp, synthetic construct
  misc_feature 1..20: note = CRISPR gRNA sequence
  source 1..20: mol_type = other DNA
tgtaatcccagcactttggg

SEQ ID NO: 40776 - DNA, 20 bp, synthetic construct
  misc_feature 1..20: note = CRISPR gRNA sequence
  source 1..20: mol_type = other DNA
tcccagcactttgggaggcc

SEQ ID NO: 40777 - DNA, 20 bp, synthetic construct
  misc_feature 1..20: note = CRISPR gRNA sequence
  source 1..20: mol_type = other DNA
agcactttgggaggccaaga

SEQ ID NO: 40778 - DNA, 20 bp, synthetic construct
  misc_feature 1..20: note = CRISPR gRNA sequence
  source 1..20: mol_type = other DNA
gcactttgggaggccaagac

SEQ ID NO: 40779 - DNA, 20 bp, synthetic construct
  misc_feature 1..20: note = CRISPR gRNA sequence
  source 1..20: mol_type = other DNA
actttgggaggccaagacag

SEQ ID NO: 40780 - DNA, 20 bp, synthetic construct
  misc_feature 1..20: note = CRISPR gRNA sequence
  source 1..20: mol_type = other DNA
ctttgggaggccaagacagg

SEQ ID NO: 40781 - DNA, 20 bp, synthetic construct
  misc_feature 1..20: note = CRISPR gRNA sequence
  source 1..20: mol_type = other DNA
ttgggaggccaagacaggag

SEQ ID NO: 40782 - DNA, 20 bp, synthetic construct
  misc_feature 1..20: note = CRISPR gRNA sequence
  source 1..20: mol_type = other DNA
tgggaggccaagacaggagg

SEQ ID NO: 40783 - DNA, 20 bp, synthetic construct
  misc_feature 1..20: note = CRISPR gRNA sequence
  source 1..20: mol_type = other DNA
ggaggccaagacaggaggag

SEQ ID NO: 40784 - DNA, 20 bp, synthetic construct
  misc_feature 1..20: note = CRISPR gRNA sequence
  source 1..20: mol_type = other DNA
gaggccaagacaggaggagg

SEQ ID NO: 40785 - DNA, 20 bp, synthetic construct
  misc_feature 1..20: note = CRISPR gRNA sequence
  source 1..20: mol_type = other DNA
caggaggaggaggatcacct

SEQ ID NO: 40786 - DNA, 20 bp, synthetic construct
  misc_feature 1..20: note = CRISPR gRNA sequence
  source 1..20: mol_type = other DNA
ggaggaggatcacctgagcc

SEQ ID NO: 40787 - DNA, 20 bp, synthetic construct
  misc_feature 1..20: note = CRISPR gRNA sequence
  source 1..20: mol_type = other DNA
gaggaggatcacctgagcct

SEQ ID NO: 40788 - DNA, 20 bp, synthetic construct
  misc_feature 1..20: note = CRISPR gRNA sequence
  source 1..20: mol_type = other DNA
ggaggatcacctgagcctag

SEQ ID NO: 40789 - DNA, 20 bp, synthetic construct
  misc_feature 1..20: note = CRISPR gRNA sequence
  source 1..20: mol_type = other DNA
tcacctgagcctaggagttt

SEQ ID NO: 40790 - DNA, 20 bp, synthetic construct
  misc_feature 1..20: note = CRISPR gRNA sequence
  source 1..20: mol_type = other DNA
tgagcctaggagtttgagac

SEQ ID NO: 40791 - DNA, 20 bp, synthetic construct
  misc_feature 1..20: note = CRISPR gRNA sequence
  source 1..20: mol_type = other DNA
ctaggagtttgagaccagcc

SEQ ID NO: 40792 - DNA, 20 bp, synthetic construct
  misc_feature 1..20: note = CRISPR gRNA sequence
  source 1..20: mol_type = other DNA
tgagaccagcctggacaaca

SEQ ID NO: 40793 - DNA, 20 bp, synthetic construct
  misc_feature 1..20: note = CRISPR gRNA sequence
  source 1..20: mol_type = other DNA
accagcctggacaacatggt

SEQ ID NO: 40794 - DNA, 20 bp, synthetic construct
  misc_feature 1..20: note = CRISPR gRNA sequence
  source 1..20: mol_type = other DNA
gtgagacccccccatctcta

SEQ ID NO: 40795 - DNA, 20 bp, synthetic construct
  misc_feature 1..20: note = CRISPR gRNA sequence
  source 1..20: mol_type = other DNA
tctacagaaactttaaaaat

SEQ ID NO: 40796 - DNA, 20 bp, synthetic construct
  misc_feature 1..20: note = CRISPR gRNA sequence
  source 1..20: mol_type = other DNA
agaaactttaaaaattagcc

SEQ ID NO: 40797 - DNA, 20 bp, synthetic construct
  misc_feature 1..20: note = CRISPR gRNA sequence
  source 1..20: mol_type = other DNA
taaaaattagccaagcgtga

SEQ ID NO: 40798 - DNA, 20 bp, synthetic construct
  misc_feature 1..20: note = CRISPR gRNA sequence
  source 1..20: mol_type = other DNA
cgtgatggcatgcacctact

SEQ ID NO: 40799 - DNA, 20 bp, synthetic construct
  misc_feature 1..20: note = CRISPR gRNA sequence
  source 1..20: mol_type = other DNA
gtgatggcatgcacctactt

SEQ ID NO: 40800 - DNA, 20 bp, synthetic construct
  misc_feature 1..20: note = CRISPR gRNA sequence
  source 1..20: mol_type = other DNA
gatggcatgcacctacttgg

SEQ ID NO: 40801 - DNA, 20 bp, synthetic construct
  misc_feature 1..20: note = CRISPR gRNA sequence
  source 1..20: mol_type = other DNA
atggcatgcacctacttggg

SEQ ID NO: 40802 - DNA, 20 bp, synthetic construct
  misc_feature 1..20: note = CRISPR gRNA sequence
  source 1..20: mol_type = other DNA
atgcacctacttgggaggct

SEQ ID NO: 40803 - DNA, 20 bp, synthetic construct
  misc_feature 1..20: note = CRISPR gRNA sequence
  source 1..20: mol_type = other DNA
tgcacctacttgggaggctg

SEQ ID NO: 40804 - DNA, 20 bp, synthetic construct
  misc_feature 1..20: note = CRISPR gRNA sequence
  source 1..20: mol_type = other DNA
acctacttgggaggctgagg

SEQ ID NO: 40805 - DNA, 20 bp, synthetic construct
  misc_feature 1..20: note = CRISPR gRNA sequence
  source 1..20: mol_type = other DNA
cctacttgggaggctgaggt

SEQ ID NO: 40806 - DNA, 20 bp, synthetic construct
  misc_feature 1..20: note = CRISPR gRNA sequence
  source 1..20: mol_type = other DNA
tacttgggaggctgaggtgg

SEQ ID NO: 40807 - DNA, 20 bp, synthetic construct
  misc_feature 1..20: note = CRISPR gRNA sequence
  source 1..20: mol_type = other DNA
acttgggaggctgaggtggg

SEQ ID NO: 40808 - DNA, 20 bp, synthetic construct
  misc_feature 1..20: note = CRISPR gRNA sequence
  source 1..20: mol_type = other DNA
gctgaggtgggaggattgct

SEQ ID NO: 40809 - DNA, 20 bp, synthetic construct
  misc_feature 1..20: note = CRISPR gRNA sequence
  source 1..20: mol_type = other DNA
gtgggaggattgcttagact

SEQ ID NO: 40810 - DNA, 20 bp, synthetic construct
  misc_feature 1..20: note = CRISPR gRNA sequence
  source 1..20: mol_type = other DNA
tgggaggattgcttagactc

SEQ ID NO: 40811 - DNA, 20 bp, synthetic construct
  misc_feature 1..20: note = CRISPR gRNA sequence
  source 1..20: mol_type = other DNA
ggaggattgcttagactcag

SEQ ID NO: 40812 - DNA, 20 bp, synthetic construct
  misc_feature 1..20: note = CRISPR gRNA sequence
  source 1..20: mol_type = other DNA
ttgcttagactcaggagatc

SEQ ID NO: 40813 - DNA, 20 bp, synthetic construct
  misc_feature 1..20: note = CRISPR gRNA sequence
  source 1..20: mol_type = other DNA
tgcttagactcaggagatcg

SEQ ID NO: 40814 - DNA, 20 bp, synthetic construct
  misc_feature 1..20: note = CRISPR gRNA sequence
  source 1..20: mol_type = other DNA
gactcaggagatcgaggcta

SEQ ID NO: 40815 - DNA, 20 bp, synthetic construct
  misc_feature 1..20: note = CRISPR gRNA sequence
  source 1..20: mol_type = other DNA
caggagatcgaggctacagt

SEQ ID NO: 40816 - DNA, 20 bp, synthetic construct
  misc_feature 1..20: note = CRISPR gRNA sequence
  source 1..20: mol_type = other DNA
gtgatcacaccattgcactc

SEQ ID NO: 40817 - DNA, 20 bp, synthetic construct
  misc_feature 1..20: note = CRISPR gRNA sequence
  source 1..20: mol_type = other DNA
cacaccattgcactccagcc

SEQ ID NO: 40818 - DNA, 20 bp, synthetic construct
  misc_feature 1..20: note = CRISPR gRNA sequence
  source 1..20: mol_type = other DNA
acaccattgcactccagcct

SEQ ID NO: 40819 - DNA, 20 bp, synthetic construct
  misc_feature 1..20: note = CRISPR gRNA sequence
  source 1..20: mol_type = other DNA
ttgcactccagcctgggcaa

SEQ ID NO: 40820 - DNA, 20 bp, synthetic construct
  misc_feature 1..20: note = CRISPR gRNA sequence
  source 1..20: mol_type = other DNA
gcactccagcctgggcaaca

SEQ ID NO: 40821 - DNA, 20 bp, synthetic construct
  misc_feature 1..20: note = CRISPR gRNA sequence
  source 1..20: mol_type = other DNA
tccagcctgggcaacagagc

SEQ ID NO: 40822 - DNA, 20 bp, synthetic construct
  misc_feature 1..20: note = CRISPR gRNA sequence
  source 1..20: mol_type = other DNA
cagagcaagactctgtctca

SEQ ID NO: 40823 - DNA, 20 bp, synthetic construct
  misc_feature 1..20: note = CRISPR gRNA sequence
  source 1..20: mol_type = other DNA
tctcaaagaaaaaaaaatgt

SEQ ID NO: 40824 - DNA, 20 bp, synthetic construct
  misc_feature 1..20: note = CRISPR gRNA sequence
  source 1..20: mol_type = other DNA
ctcaaagaaaaaaaaatgtc

SEQ ID NO: 40825 - DNA, 20 bp, synthetic construct
  misc_feature 1..20: note = CRISPR gRNA sequence
  source 1..20: mol_type = other DNA
aaaaaaaatgtcaggcacaa

SEQ ID NO: 40826 - DNA, 20 bp, synthetic construct
  misc_feature 1..20: note = CRISPR gRNA sequence
  source 1..20: mol_type = other DNA
atggctcacatctgtaattc

SEQ ID NO: 40827 - DNA, 20 bp, synthetic construct
  misc_feature 1..20: note = CRISPR gRNA sequence
  source 1..20: mol_type = other DNA
catctgtaattccagcactt

SEQ ID NO: 40828 - DNA, 20 bp, synthetic construct
  misc_feature 1..20: note = CRISPR gRNA sequence
  source 1..20: mol_type = other DNA
atctgtaattccagcacttt

SEQ ID NO: 40829 - DNA, 20 bp, synthetic construct
  misc_feature 1..20: note = CRISPR gRNA sequence
  source 1..20: mol_type = other DNA
ctgtaattccagcactttgg

SEQ ID NO: 40830 - DNA, 20 bp, synthetic construct
  misc_feature 1..20: note = CRISPR gRNA sequence
  source 1..20: mol_type = other DNA
tgtaattccagcactttggg

SEQ ID NO: 40831 - DNA, 20 bp, synthetic construct
  misc_feature 1..20: note = CRISPR gRNA sequence
  source 1..20: mol_type = other DNA
ttccagcactttgggaggct

SEQ ID NO: 40832 - DNA, 20 bp, synthetic construct
  misc_feature 1..20: note = CRISPR gRNA sequence
  source 1..20: mol_type = other DNA
tccagcactttgggaggcta

SEQ ID NO: 40833 - DNA, 20 bp, synthetic construct
  misc_feature 1..20: note = CRISPR gRNA sequence
  source 1..20: mol_type = other DNA
agcactttgggaggctaagg

SEQ ID NO: 40834 - DNA, 20 bp, synthetic construct
  misc_feature 1..20: note = CRISPR gRNA sequence
  source 1..20: mol_type = other DNA
gcactttgggaggctaaggc

SEQ ID NO: 40835 - DNA, 20 bp, synthetic construct
  misc_feature 1..20: note = CRISPR gRNA sequence
  source 1..20: mol_type = other DNA
actttgggaggctaaggcag

SEQ ID NO: 40836 - DNA, 20 bp, synthetic construct
  misc_feature 1..20: note = CRISPR gRNA sequence
  source 1..20: mol_type = other DNA
ctttgggaggctaaggcagg

SEQ ID NO: 40837 - DNA, 20 bp, synthetic construct
  misc_feature 1..20: note = CRISPR gRNA sequence
  source 1..20: mol_type = other DNA
ctaaggcaggaggatcgttt

SEQ ID NO: 40838 - DNA, 20 bp, synthetic construct
  misc_feature 1..20: note = CRISPR gRNA sequence
  source 1..20: mol_type = other DNA
caggaggatcgtttgagcca

SEQ ID NO: 40839 - DNA, 20 bp, synthetic construct
  misc_feature 1..20: note = CRISPR gRNA sequence
  source 1..20: mol_type = other DNA
ggaggatcgtttgagccatg

SEQ ID NO: 40840 - DNA, 20 bp, synthetic construct
  misc_feature 1..20: note = CRISPR gRNA sequence
  source 1..20: mol_type = other DNA
tcgtttgagccatggagttt

SEQ ID NO: 40841 - DNA, 20 bp, synthetic construct
  misc_feature 1..20: note = CRISPR gRNA sequence
  source 1..20: mol_type = other DNA
tgagccatggagtttgagac

SEQ ID NO: 40842 - DNA, 20 bp, synthetic construct
  misc_feature 1..20: note = CRISPR gRNA sequence
  source 1..20: mol_type = other DNA
tgagaccagcctgctcaaca

SEQ ID NO: 40843 - DNA, 20 bp, synthetic construct
  misc_feature 1..20: note = CRISPR gRNA sequence
  source 1..20: mol_type = other DNA
tctacaaaaaatacaaaaat

SEQ ID NO: 40844 - DNA, 20 bp, synthetic construct
  misc_feature 1..20: note = CRISPR gRNA sequence
  source 1..20: mol_type = other DNA
caaaaaatacaaaaattaga

SEQ ID NO: 40845 - DNA, 20 bp, synthetic construct
  misc_feature 1..20: note = CRISPR gRNA sequence
  source 1..20: mol_type = other DNA
atacaaaaattagacagtca

SEQ ID NO: 40846 - DNA, 20 bp, synthetic construct
  misc_feature 1..20: note = CRISPR gRNA sequence
  source 1..20: mol_type = other DNA
caaaaattagacagtcatgg

SEQ ID NO: 40847 - DNA, 20 bp, synthetic construct
  misc_feature 1..20: note = CRISPR gRNA sequence
  source 1..20: mol_type = other DNA
aaaaattagacagtcatggt

SEQ ID NO: 40848 - DNA, 20 bp, synthetic construct
  misc_feature 1..20: note = CRISPR gRNA sequence
  source 1..20: mol_type = other DNA
aaaattagacagtcatggtg

SEQ ID NO: 40849 - DNA, 20 bp, synthetic construct
  misc_feature 1..20: note = CRISPR gRNA sequence
  source 1..20: mol_type = other DNA
gtcatggtggggcgttcctg

SEQ ID NO: 40850 - DNA, 20 bp, synthetic construct
  misc_feature 1..20: note = CRISPR gRNA sequence
  source 1..20: mol_type = other DNA
gtggggcgttcctgtagtcc

SEQ ID NO: 40851 - DNA, 20 bp, synthetic construct
  misc_feature 1..20: note = CRISPR gRNA sequence
  source 1..20: mol_type = other DNA
ttcctgtagtcccagctact

SEQ ID NO: 40852 - DNA, 20 bp, synthetic construct
  misc_feature 1..20: note = CRISPR gRNA sequence
  source 1..20: mol_type = other DNA
tcctgtagtcccagctactt

SEQ ID NO: 40853 - DNA, 20 bp, synthetic construct
  misc_feature 1..20: note = CRISPR gRNA sequence
  source 1..20: mol_type = other DNA
ctgtagtcccagctacttgg

SEQ ID NO: 40854 - DNA, 20 bp, synthetic construct
  misc_feature 1..20: note = CRISPR gRNA sequence
  source 1..20: mol_type = other DNA
tgtagtcccagctacttggg

SEQ ID NO: 40855 - DNA, 20 bp, synthetic construct
  misc_feature 1..20: note = CRISPR gRNA sequence
  source 1..20: mol_type = other DNA
tcccagctacttgggaggct

SEQ ID NO: 40856 - DNA, 20 bp, synthetic construct
  misc_feature 1..20: note = CRISPR gRNA sequence
  source 1..20: mol_type = other DNA
cccagctacttgggaggctg

SEQ ID NO: 40857 - DNA, 20 bp, synthetic construct
  misc_feature 1..20: note = CRISPR gRNA sequence
  source 1..20: mol_type = other DNA
agctacttgggaggctgagg

SEQ ID NO: 40858 - DNA, 20 bp, synthetic construct
  misc_feature 1..20: note = CRISPR gRNA sequence
  source 1..20: mol_type = other DNA
tacttgggaggctgaggcag

SEQ ID NO: 40859 - DNA, 20 bp, synthetic construct
  misc_feature 1..20: note = CRISPR gRNA sequence
  source 1..20: mol_type = other DNA
acttgggaggctgaggcagt

SEQ ID NO: 40860 - DNA, 20 bp, synthetic construct
  misc_feature 1..20: note = CRISPR gRNA sequence
  source 1..20: mol_type = other DNA
ggaggctgaggcagtaggat

SEQ ID NO: 40861 - DNA, 20 bp, synthetic construct
  misc_feature 1..20: note = CRISPR gRNA sequence
  source 1..20: mol_type = other DNA
ctgaggcagtaggatcagtt

SEQ ID NO: 40862 - DNA, 20 bp, synthetic construct
  misc_feature 1..20: note = CRISPR gRNA sequence
  source 1..20: mol_type = other DNA
gcagtaggatcagttgagcc

SEQ ID NO: 40863 - DNA, 20 bp, synthetic construct
  misc_feature 1..20: note = CRISPR gRNA sequence
  source 1..20: mol_type = other DNA
cagtaggatcagttgagccc

SEQ ID NO: 40864 - DNA, 20 bp, synthetic construct
  misc_feature 1..20: note = CRISPR gRNA sequence
  source 1..20: mol_type = other DNA
agtaggatcagttgagcccg

SEQ ID NO: 40865 - DNA, 20 bp, synthetic construct
  misc_feature 1..20: note = CRISPR gRNA sequence
  source 1..20: mol_type = other DNA
aggatcagttgagcccgggg

SEQ ID NO: 40866 - DNA, 20 bp, synthetic construct
  misc_feature 1..20: note = CRISPR gRNA sequence
  source 1..20: mol_type = other DNA
ggatcagttgagcccgggga

SEQ ID NO: 40867 - DNA, 20 bp, synthetic construct
  misc_feature 1..20: note = CRISPR gRNA sequence
  source 1..20: mol_type = other DNA
agttgagcccggggaaggtt

SEQ ID NO: 40868 - DNA, 20 bp, synthetic construct
  misc_feature 1..20: note = CRISPR gRNA sequence
  source 1..20: mol_type = other DNA
gttgagcccggggaaggttg

SEQ ID NO: 40869 - DNA, 20 bp, synthetic construct
  misc_feature 1..20: note = CRISPR gRNA sequence
  source 1..20: mol_type = other DNA
cccggggaaggttgaggctg

SEQ ID NO: 40870 - DNA, 20 bp, synthetic construct
  misc_feature 1..20: note = CRISPR gRNA sequence
  source 1..20: mol_type = other DNA
gggaaggttgaggctgcagt

SEQ ID NO: 40871 - DNA, 20 bp, synthetic construct
  misc_feature 1..20: note = CRISPR gRNA sequence
  source 1..20: mol_type = other DNA
atgactgcaccactgcacac

SEQ ID NO: 40872 - DNA, 20 bp, synthetic construct
  misc_feature 1..20: note = CRISPR gRNA sequence
  source 1..20: mol_type = other DNA
tgcaccactgcacaccagcc

SEQ ID NO: 40873 - DNA, 20 bp, synthetic construct
  misc_feature 1..20: note = CRISPR gRNA sequence
  source 1..20: mol_type = other DNA
gcaccactgcacaccagcct

SEQ ID NO: 40874 - DNA, 20 bp, synthetic construct
  misc_feature 1..20: note = CRISPR gRNA sequence
  source 1..20: mol_type = other DNA
ctgcacaccagcctgggcga

SEQ ID NO: 40875 - DNA, 20 bp, synthetic construct
  misc_feature 1..20: note = CRISPR gRNA sequence
  source 1..20: mol_type = other DNA
gcacaccagcctgggcgaca

SEQ ID NO: 40876 - DNA, 20 bp, synthetic construct
  misc_feature 1..20: note = CRISPR gRNA sequence
  source 1..20: mol_type = other DNA
accagcctgggcgacagagc

SEQ ID NO: 40877 - DNA, 20 bp, synthetic construct
  misc_feature 1..20: note = CRISPR gRNA sequence
  source 1..20: mol_type = other DNA
ctttcttcgaaacaacaaca

SEQ ID NO: 40878 - DNA, 20 bp, synthetic construct
  misc_feature 1..20: note = CRISPR gRNA sequence
  source 1..20: mol_type = other DNA
tcttcgaaacaacaacaaag

SEQ ID NO: 40879 - DNA, 20 bp, synthetic construct
  misc_feature 1..20: note = CRISPR gRNA sequence
  source 1..20: mol_type = other DNA
cttacctcattgtttattgt

SEQ ID NO: 40880 - DNA, 20 bp, synthetic construct
  misc_feature 1..20: note = CRISPR gRNA sequence
  source 1..20: mol_type = other DNA
gtttattgtgagaatcaaat

SEQ ID NO: 40881 - DNA, 20 bp, synthetic construct
  misc_feature 1..20: note = CRISPR gRNA sequence
  source 1..20: mol_type = other DNA
aatcaaatgagaaatgtcga

SEQ ID NO: 40882 - DNA, 20 bp, synthetic construct
  misc_feature 1..20: note = CRISPR gRNA sequence
  source 1..20: mol_type = other DNA
taatctattccttgtttgct

SEQ ID NO: 40883 - DNA, 20 bp, synthetic construct
  misc_feature 1..20: note = CRISPR gRNA sequence
  source 1..20: mol_type = other DNA
ctattccttgtttgctaaga

SEQ ID NO: 40884 - DNA, 20 bp, synthetic construct
  misc_feature 1..20: note = CRISPR gRNA sequence
  source 1..20: mol_type = other DNA
ttccttgtttgctaagaaag

SEQ ID NO: 40885 - DNA, 20 bp, synthetic construct
  misc_feature 1..20: note = CRISPR gRNA sequence
  source 1..20: mol_type = other DNA
tccttgtttgctaagaaagc

SEQ ID NO: 40886 - DNA, 20 bp, synthetic construct
  misc_feature 1..20: note = CRISPR gRNA sequence
  source 1..20: mol_type = other DNA
gctaagaaagcaggccaccc

SEQ ID NO: 40887 - DNA, 20 bp, synthetic construct
  misc_feature 1..20: note = CRISPR gRNA sequence
  source 1..20: mol_type = other DNA
ctaagaaagcaggccacccc

SEQ ID NO: 40888 - DNA, 20 bp, synthetic construct
  misc_feature 1..20: note = CRISPR gRNA sequence
  source 1..20: mol_type = other DNA
caggccctccttgccctgac

SEQ ID NO: 40889 - DNA, 20 bp, synthetic construct
  misc_feature 1..20: note = CRISPR gRNA sequence
  source 1..20: mol_type = other DNA
cctccttgccctgaccagtc

SEQ ID NO: 40890 - DNA, 20 bp, synthetic construct
  misc_feature 1..20: note = CRISPR gRNA sequence
  source 1..20: mol_type = other DNA
ctccttgccctgaccagtct

SEQ ID NO: 40891 - DNA, 20 bp, synthetic construct
  misc_feature 1..20: note = CRISPR gRNA sequence
  source 1..20: mol_type = other DNA
gtctgggttcttgccactgc

SEQ ID NO: 40892 - DNA, 20 bp, synthetic construct
  misc_feature 1..20: note = CRISPR gRNA sequence
  source 1..20: mol_type = other DNA
tctgggttcttgccactgcc

SEQ ID NO: 40893 - DNA, 20 bp, synthetic construct
  misc_feature 1..20: note = CRISPR gRNA sequence
  source 1..20: mol_type = other DNA
ctgggttcttgccactgcca

SEQ ID NO: 40894 - DNA, 20 bp, synthetic construct
  misc_feature 1..20: note = CRISPR gRNA sequence
  source 1..20: mol_type = other DNA
ggttcttgccactgccaggg

SEQ ID NO: 40895 - DNA, 20 bp, synthetic construct
  misc_feature 1..20: note = CRISPR gRNA sequence
  source 1..20: mol_type = other DNA
cttgccactgccagggaagt

SEQ ID NO: 40896 - DNA, 20 bp, synthetic construct
  misc_feature 1..20: note = CRISPR gRNA sequence
  source 1..20: mol_type = other DNA
tgctgcttcctctctgcttc

SEQ ID NO: 40897 - DNA, 20 bp, synthetic construct
  misc_feature 1..20: note = CRISPR gRNA sequence
  source 1..20: mol_type = other DNA
ctctctgcttccagctttga

SEQ ID NO: 40898 - DNA, 20 bp, synthetic construct
  misc_feature 1..20: note = CRISPR gRNA sequence
  source 1..20: mol_type = other DNA
gaaagccaacacatcctcct

SEQ ID NO: 40899 - DNA, 20 bp, synthetic construct
  misc_feature 1..20: note = CRISPR gRNA sequence
  source 1..20: mol_type = other DNA
aagccaacacatcctcctga

SEQ ID NO: 40900 - DNA, 20 bp, synthetic construct
  misc_feature 1..20: note = CRISPR gRNA sequence
  source 1..20: mol_type = other DNA
agccaacacatcctcctgag

SEQ ID NO: 40901 - DNA, 20 bp, synthetic construct
  misc_feature 1..20: note = CRISPR gRNA sequence
  source 1..20: mol_type = other DNA
gccaacacatcctcctgaga

SEQ ID NO: 40902 - DNA, 20 bp, synthetic construct
  misc_feature 1..20: note = CRISPR gRNA sequence
  source 1..20: mol_type = other DNA
ccaacacatcctcctgagag

SEQ ID NO: 40903 - DNA, 20 bp, synthetic construct
  misc_feature 1..20: note = CRISPR gRNA sequence
  source 1..20: mol_type = other DNA
acatcctcctgagaggggac

SEQ ID NO: 40904 - DNA, 20 bp, synthetic construct
  misc_feature 1..20: note = CRISPR gRNA sequence
  source 1..20: mol_type = other DNA
ctcctgagaggggacaagac

SEQ ID NO: 40905 - DNA, 20 bp, synthetic construct
  misc_feature 1..20: note = CRISPR gRNA sequence
  source 1..20: mol_type = other DNA
ctgagaggggacaagacaag

SEQ ID NO: 40906 - DNA, 20 bp, synthetic construct
  misc_feature 1..20: note = CRISPR gRNA sequence
  source 1..20: mol_type = other DNA
tgagaggggacaagacaagc

SEQ ID NO: 40907 - DNA, 20 bp, synthetic construct
  misc_feature 1..20: note = CRISPR gRNA sequence
  source 1..20: mol_type = other DNA
aggggacaagacaagcaggt

SEQ ID NO: 40908 - DNA, 20 bp, synthetic construct
  misc_feature 1..20: note = CRISPR gRNA sequence
  source 1..20: mol_type = other DNA
ggggacaagacaagcaggtg

SEQ ID NO: 40909 - DNA, 20 bp, synthetic construct
  misc_feature 1..20: note = CRISPR gRNA sequence
  source 1..20: mol_type = other DNA
ggacaagacaagcaggtgag

SEQ ID NO: 40910 - DNA, 20 bp, synthetic construct
  misc_feature 1..20: note = CRISPR gRNA sequence
  source 1..20: mol_type = other DNA
gacaagacaagcaggtgagg

SEQ ID NO: 40911 - DNA, 20 bp, synthetic construct
  misc_feature 1..20: note = CRISPR gRNA sequence
  source 1..20: mol_type = other DNA
acaagacaagcaggtgagga

SEQ ID NO: 40912 - DNA, 20 bp, synthetic construct
  misc_feature 1..20: note = CRISPR gRNA sequence
  source 1..20: mol_type = other DNA
gcaggtgaggagggaacgct

SEQ ID NO: 40913 - DNA, 20 bp, synthetic construct
  misc_feature 1..20: note = CRISPR gRNA sequence
  source 1..20: mol_type = other DNA
caggtgaggagggaacgctc

SEQ ID NO: 40914 - DNA, 20 bp, synthetic construct
  misc_feature 1..20: note = CRISPR gRNA sequence
  source 1..20: mol_type = other DNA
aggtgaggagggaacgctcg

SEQ ID NO: 40915 - DNA, 20 bp, synthetic construct
  misc_feature 1..20: note = CRISPR gRNA sequence
  source 1..20: mol_type = other DNA
tgaggagggaacgctcgggg

SEQ ID NO: 40916 - DNA, 20 bp, synthetic construct
  misc_feature 1..20: note = CRISPR gRNA sequence
  source 1..20: mol_type = other DNA
gaggagggaacgctcggggt

SEQ ID NO: 40917 - DNA, 20 bp, synthetic construct
  misc_feature 1..20: note = CRISPR gRNA sequence
  source 1..20: mol_type = other DNA
aggagggaacgctcggggtg

SEQ ID NO: 40918 - DNA, 20 bp, synthetic construct
  misc_feature 1..20: note = CRISPR gRNA sequence
  source 1..20: mol_type = other DNA
ggagggaacgctcggggtgg

SEQ ID NO: 40919 - DNA, 20 bp, synthetic construct
  misc_feature 1..20: note = CRISPR gRNA sequence
  source 1..20: mol_type = other DNA
agggaacgctcggggtgggg

SEQ ID NO: 40920 - DNA, 20 bp, synthetic construct
  misc_feature 1..20: note = CRISPR gRNA sequence
  source 1..20: mol_type = other DNA
gggggagtcccctcccgctc

SEQ ID NO: 40921 - DNA, 20 bp, synthetic construct
  misc_feature 1..20: note = CRISPR gRNA sequence
  source 1..20: mol_type = other DNA
ccgctctggtccccgtctgt

SEQ ID NO: 40922 - DNA, 20 bp, synthetic construct
  misc_feature 1..20: note = CRISPR gRNA sequence
  source 1..20: mol_type = other DNA
gctctggtccccgtctgttg

SEQ ID NO: 40923 - DNA, 20 bp, synthetic construct
  misc_feature 1..20: note = CRISPR gRNA sequence
  source 1..20: mol_type = other DNA
ctctggtccccgtctgttgg

SEQ ID NO: 40924 - DNA, 20 bp, synthetic construct
  misc_feature 1..20: note = CRISPR gRNA sequence
  source 1..20: mol_type = other DNA
gttggaggtccccccacccc

SEQ ID NO: 40925 - DNA, 20 bp, synthetic construct
  misc_feature 1..20: note = CRISPR gRNA sequence
  source 1..20: mol_type = other DNA
ccagacccatgctgaccact

SEQ ID NO: 40926 - DNA, 20 bp, synthetic construct
  misc_feature 1..20: note = CRISPR gRNA sequence
  source 1..20: mol_type = other DNA
catgctgaccactcagctct

SEQ ID NO: 40927 - DNA, 20 bp, synthetic construct
  misc_feature 1..20: note = CRISPR gRNA sequence
  source 1..20: mol_type = other DNA
agctctcagttaaaccaccc

SEQ ID NO: 40928 - DNA, 20 bp, synthetic construct
  misc_feature 1..20: note = CRISPR gRNA sequence
  source 1..20: mol_type = other DNA
tcagttaaaccacccaagtc

SEQ ID NO: 40929 - DNA, 20 bp, synthetic construct
  misc_feature 1..20: note = CRISPR gRNA sequence
  source 1..20: mol_type = other DNA
accacccaagtccggcacac

SEQ ID NO: 40930 - DNA, 20 bp, synthetic construct
  misc_feature 1..20: note = CRISPR gRNA sequence
  source 1..20: mol_type = other DNA
ccacccaagtccggcacact

SEQ ID NO: 40931 - DNA, 20 bp, synthetic construct
  misc_feature 1..20: note = CRISPR gRNA sequence
  source 1..20: mol_type = other DNA
actaggtttaatcaccactt

SEQ ID NO: 40932 - DNA, 20 bp, synthetic construct
  misc_feature 1..20: note = CRISPR gRNA sequence
  source 1..20: mol_type = other DNA
ccgccccccccataaattgt

SEQ ID NO: 40933 - DNA, 20 bp, synthetic construct
  misc_feature 1..20: note = CRISPR gRNA sequence
  source 1..20: mol_type = other DNA
caactgccctgttttcccct

SEQ ID NO: 40934 - DNA, 20 bp, synthetic construct
  misc_feature 1..20: note = CRISPR gRNA sequence
  source 1..20: mol_type = other DNA
ctgccctgttttccccttgg

SEQ ID NO: 40935 - DNA, 20 bp, synthetic construct
  misc_feature 1..20: note = CRISPR gRNA sequence
  source 1..20: mol_type = other DNA
tgccctgttttccccttgga

SEQ ID NO: 40936 - DNA, 20 bp, synthetic construct
  misc_feature 1..20: note = CRISPR gRNA sequence
  source 1..20: mol_type = other DNA
ccctgttttccccttggaag

SEQ ID NO: 40937 - DNA, 20 bp, synthetic construct
  misc_feature 1..20: note = CRISPR gRNA sequence
  source 1..20: mol_type = other DNA
cctgttttccccttggaagg

SEQ ID NO: 40938 - DNA, 20 bp, synthetic construct
  misc_feature 1..20: note = CRISPR gRNA sequence
  source 1..20: mol_type = other DNA
ccccttggaaggaggcaatg

SEQ ID NO: 40939 - DNA, 20 bp, synthetic construct
  misc_feature 1..20: note = CRISPR gRNA sequence
  source 1..20: mol_type = other DNA
ttggaaggaggcaatgcaga

SEQ ID NO: 40940 - DNA, 20 bp, synthetic construct
  misc_feature 1..20: note = CRISPR gRNA sequence
  source 1..20: mol_type = other DNA
tggaaggaggcaatgcagat

SEQ ID NO: 40941 - DNA, 20 bp, synthetic construct
  misc_feature 1..20: note = CRISPR gRNA sequence
  source 1..20: mol_type = other DNA
gaaggaggcaatgcagatgg

SEQ ID NO: 40942 - DNA, 20 bp, synthetic construct
  misc_feature 1..20: note = CRISPR gRNA sequence
  source 1..20: mol_type = other DNA
aaggaggcaatgcagatggg

SEQ ID NO: 40943 - DNA, 20 bp, synthetic construct
  misc_feature 1..20: note = CRISPR gRNA sequence
  source 1..20: mol_type = other DNA
gaggcaatgcagatgggagg

SEQ ID NO: 40944 - DNA, 20 bp, synthetic construct
  misc_feature 1..20: note = CRISPR gRNA sequence
  source 1..20: mol_type = other DNA
aggcaatgcagatgggagga

SEQ ID NO: 40945 - DNA, 20 bp, synthetic construct
  misc_feature 1..20: note = CRISPR gRNA sequence
  source 1..20: mol_type = other DNA
ggcaatgcagatgggaggaa

SEQ ID NO: 40946 - DNA, 20 bp, synthetic construct
  misc_feature 1..20: note = CRISPR gRNA sequence
  source 1..20: mol_type = other DNA
caatgcagatgggaggaagg

SEQ ID NO: 40947 - DNA, 20 bp, synthetic construct
  misc_feature 1..20: note = CRISPR gRNA sequence
  source 1..20: mol_type = other DNA
aatgcagatgggaggaaggg

SEQ ID NO: 40948 - DNA, 20 bp, synthetic construct
  misc_feature 1..20: note = CRISPR gRNA sequence
  source 1..20: mol_type = other DNA
atgcagatgggaggaaggga

SEQ ID NO: 40949 - DNA, 20 bp, synthetic construct
  misc_feature 1..20: note = CRISPR gRNA sequence
  source 1..20: mol_type = other DNA
atgggaggaagggagggata

SEQ ID NO: 40950 - DNA, 20 bp, synthetic construct
  misc_feature 1..20: note = CRISPR gRNA sequence
  source 1..20: mol_type = other DNA
gaggaagggagggatatggt

SEQ ID NO: 40951 - DNA, 20 bp, synthetic construct
  misc_feature 1..20: note = CRISPR gRNA sequence
  source 1..20: mol_type = other DNA
aggaagggagggatatggtt

SEQ ID NO: 40952 - DNA, 20 bp, synthetic construct
  misc_feature 1..20: note = CRISPR gRNA sequence
  source 1..20: mol_type = other DNA
gaagggagggatatggttgg

SEQ ID NO: 40953 - DNA, 20 bp, synthetic construct
  misc_feature 1..20: note = CRISPR gRNA sequence
  source 1..20: mol_type = other DNA
agggagggatatggttggga

SEQ ID NO: 40954 - DNA, 20 bp, synthetic construct
  misc_feature 1..20: note = CRISPR gRNA sequence
  source 1..20: mol_type = other DNA
gggagggatatggttgggag

SEQ ID NO: 40955 - DNA, 20 bp, synthetic construct
  misc_feature 1..20: note = CRISPR gRNA sequence
  source 1..20: mol_type = other DNA
gatatggttgggagaggtcc

SEQ ID NO: 40956 - DNA, 20 bp, synthetic construct
  misc_feature 1..20: note = CRISPR gRNA sequence
  source 1..20: mol_type = other DNA
tatggttgggagaggtccca

SEQ ID NO: 40957 - DNA, 20 bp, synthetic construct
  misc_feature 1..20: note = CRISPR gRNA sequence
  source 1..20: mol_type = other DNA
ggttgggagaggtcccagag

SEQ ID NO: 40958 - DNA, 20 bp, synthetic construct
  misc_feature 1..20: note = CRISPR gRNA sequence
  source 1..20: mol_type = other DNA
gttgggagaggtcccagagc

SEQ ID NO: 40959 - DNA, 20 bp, synthetic construct
  misc_feature 1..20: note = CRISPR gRNA sequence
  source 1..20: mol_type = other DNA
ttgggagaggtcccagagca

SEQ ID NO: 40960 - DNA, 20 bp, synthetic construct
  misc_feature 1..20: note = CRISPR gRNA sequence
  source 1..20: mol_type = other DNA
ggagaggtcccagagcaggg

SEQ ID NO: 40961 - DNA, 20 bp, synthetic construct
  misc_feature 1..20: note = CRISPR gRNA sequence
  source 1..20: mol_type = other DNA
gagaggtcccagagcagggc

SEQ ID NO: 40962 - DNA, 20 bp, synthetic construct
  misc_feature 1..20: note = CRISPR gRNA sequence
  source 1..20: mol_type = other DNA
cagagcagggcaggtgcccg

SEQ ID NO: 40963 - DNA, 20 bp, synthetic construct
  misc_feature 1..20: note = CRISPR gRNA sequence
  source 1..20: mol_type = other DNA
gcccgcagattgctgctgtg

SEQ ID NO: 40964 - DNA, 20 bp, synthetic construct
  misc_feature 1..20: note = CRISPR gRNA sequence
  source 1..20: mol_type = other DNA
cccgcagattgctgctgtgt

SEQ ID NO: 40965 - DNA, 20 bp, synthetic construct
  misc_feature 1..20: note = CRISPR gRNA sequence
  source 1..20: mol_type = other DNA
cgcagattgctgctgtgtgg

SEQ ID NO: 40966 - DNA, 20 bp, synthetic construct
  misc_feature 1..20: note = CRISPR gRNA sequence
  source 1..20: mol_type = other DNA
gcagattgctgctgtgtggg

SEQ ID NO: 40967 - DNA, 20 bp, synthetic construct
  misc_feature 1..20: note = CRISPR gRNA sequence
  source 1..20: mol_type = other DNA
agattgctgctgtgtgggag

SEQ ID NO: 40968 - DNA, 20 bp, synthetic construct
  misc_feature 1..20: note = CRISPR gRNA sequence
  source 1..20: mol_type = other DNA
tgctgctgtgtgggaggaga

SEQ ID NO: 40969 - DNA, 20 bp, synthetic construct
  misc_feature 1..20: note = CRISPR gRNA sequence
  source 1..20: mol_type = other DNA
gctgctgtgtgggaggagac

SEQ ID NO: 40970 - DNA, 20 bp, synthetic construct
  misc_feature 1..20: note = CRISPR gRNA sequence
  source 1..20: mol_type = other DNA
tgctgtgtgggaggagacag

SEQ ID NO: 40971 - DNA, 20 bp, synthetic construct
  misc_feature 1..20: note = CRISPR gRNA sequence
  source 1..20: mol_type = other DNA
acatttgtgcttctgcgttt

SEQ ID NO: 40972 - DNA, 20 bp, synthetic construct
  misc_feature 1..20: note = CRISPR gRNA sequence
  source 1..20: mol_type = other DNA
catttgtgcttctgcgtttc

SEQ ID NO: 40973 - DNA, 20 bp, synthetic construct
  misc_feature 1..20: note = CRISPR gRNA sequence
  source 1..20: mol_type = other DNA
atttgtgcttctgcgtttcg

SEQ ID NO: 40974 - DNA, 20 bp, synthetic construct
  misc_feature 1..20: note = CRISPR gRNA sequence
  source 1..20: mol_type = other DNA
ctgcgtttcggggaattttg

SEQ ID NO: 40975 - DNA, 20 bp, synthetic construct
  misc_feature 1..20: note = CRISPR gRNA sequence
  source 1..20: mol_type = other DNA
cactgccctttcacgctctg

SEQ ID NO: 40976 - DNA, 20 bp, synthetic construct
  misc_feature 1..20: note = CRISPR gRNA sequence
  source 1..20: mol_type = other DNA
actgccctttcacgctctga

SEQ ID NO: 40977 - DNA, 20 bp, synthetic construct
  misc_feature 1..20: note = CRISPR gRNA sequence
  source 1..20: mol_type = other DNA
gccctttcacgctctgaagg

SEQ ID NO: 40978 - DNA, 20 bp, synthetic construct
  misc_feature 1..20: note = CRISPR gRNA sequence
  source 1..20: mol_type = other DNA
ccctttcacgctctgaaggc

SEQ ID NO: 40979 - DNA, 20 bp, synthetic construct
  misc_feature 1..20: note = CRISPR gRNA sequence
  source 1..20: mol_type = other DNA
cctttcacgctctgaaggca

SEQ ID NO: 40980 - DNA, 20 bp, synthetic construct
  misc_feature 1..20: note = CRISPR gRNA sequence
  source 1..20: mol_type = other DNA
ctttcacgctctgaaggcag

SEQ ID NO: 40981 - DNA, 20 bp, synthetic construct
  misc_feature 1..20: note = CRISPR gRNA sequence
  source 1..20: mol_type = other DNA
cgctctgaaggcaggggccg

SEQ ID NO: 40982 - DNA, 20 bp, synthetic construct
  misc_feature 1..20: note = CRISPR gRNA sequence
  source 1..20: mol_type = other DNA
gctctgaaggcaggggccgt

SEQ ID NO: 40983 - DNA, 20 bp, synthetic construct
  misc_feature 1..20: note = CRISPR gRNA sequence
  source 1..20: mol_type = other DNA
aaacattttccccgtcttcg

SEQ ID NO: 40984 - DNA, 20 bp, synthetic construct
  misc_feature 1..20: note = CRISPR gRNA sequence
  source 1..20: mol_type = other DNA
tcgcagtaaacaaccaatac

SEQ ID NO: 40985 - DNA, 20 bp, synthetic construct
  misc_feature 1..20: note = CRISPR gRNA sequence
  source 1..20: mol_type = other DNA
gtaaacaaccaatactagtt

SEQ ID NO: 40986 - DNA, 20 bp, synthetic construct
  misc_feature 1..20: note = CRISPR gRNA sequence
  source 1..20: mol_type = other DNA
ttagctcttcatgatgttcc

SEQ ID NO: 40987 - DNA, 20 bp, synthetic construct
  misc_feature 1..20: note = CRISPR gRNA sequence
  source 1..20: mol_type = other DNA
tgatgttcccggctgccctc

SEQ ID NO: 40988 - DNA, 20 bp, synthetic construct
  misc_feature 1..20: note = CRISPR gRNA sequence
  source 1..20: mol_type = other DNA
tgttcccggctgccctctag

SEQ ID NO: 40989 - DNA, 20 bp, synthetic construct
  misc_feature 1..20: note = CRISPR gRNA sequence
  source 1..20: mol_type = other DNA
gttcccggctgccctctagt

SEQ ID NO: 40990 - DNA, 20 bp, synthetic construct
  misc_feature 1..20: note = CRISPR gRNA sequence
  source 1..20: mol_type = other DNA
cggctgccctctagtgggac

SEQ ID NO: 40991 - DNA, 20 bp, synthetic construct
  misc_feature 1..20: note = CRISPR gRNA sequence
  source 1..20: mol_type = other DNA
ggctgccctctagtgggacc

SEQ ID NO: 40992 - DNA, 20 bp, synthetic construct
  misc_feature 1..20: note = CRISPR gRNA sequence
  source 1..20: mol_type = other DNA
tctagtgggaccaggcctct

SEQ ID NO: 40993 - DNA, 20 bp, synthetic construct
  misc_feature 1..20: note = CRISPR gRNA sequence
  source 1..20: mol_type = other DNA
ccaggcctcttggcctcact

SEQ ID NO: 40994 - DNA, 20 bp, synthetic construct
  misc_feature 1..20: note = CRISPR gRNA sequence
  source 1..20: mol_type = other DNA
caggcctcttggcctcactt

SEQ ID NO: 40995 - DNA, 20 bp, synthetic construct
  misc_feature 1..20: note = CRISPR gRNA sequence
  source 1..20: mol_type = other DNA
ggcctcttggcctcacttgg

SEQ ID NO: 40996 - DNA, 20 bp, synthetic construct
  misc_feature 1..20: note = CRISPR gRNA sequence
  source 1..20: mol_type = other DNA
ctcttggcctcacttgggag

SEQ ID NO: 40997 - DNA, 20 bp, synthetic construct
  misc_feature 1..20: note = CRISPR gRNA sequence
  source 1..20: mol_type = other DNA
ttggcctcacttgggagcag

SEQ ID NO: 40998 - DNA, 20 bp, synthetic construct
  misc_feature 1..20: note = CRISPR gRNA sequence
  source 1..20: mol_type = other DNA
gcctcacttgggagcagtgg

SEQ ID NO: 40999 - DNA, 20 bp, synthetic construct
  misc_feature 1..20: note = CRISPR gRNA sequence
  source 1..20: mol_type = other DNA
tcacttgggagcagtggcag

SEQ ID NO: 41000 - DNA, 20 bp, synthetic construct
  misc_feature 1..20: note = CRISPR gRNA sequence
  source 1..20: mol_type = other DNA
ttgggagcagtggcagcgga

SEQ ID NO: 41001 - DNA, 20 bp, synthetic construct
  misc_feature 1..20: note = CRISPR gRNA sequence
  source 1..20: mol_type = other DNA
tgggagcagtggcagcggac

SEQ ID NO: 41002 - DNA, 20 bp, synthetic construct
  misc_feature 1..20: note = CRISPR gRNA sequence
  source 1..20: mol_type = other DNA
gggagcagtggcagcggaca

SEQ ID NO: 41003 - DNA, 20 bp, synthetic construct
  misc_feature 1..20: note = CRISPR gRNA sequence
  source 1..20: mol_type = other DNA
agcagtggcagcggacaggg

SEQ ID NO: 41004 - DNA, 20 bp, synthetic construct
  misc_feature 1..20: note = CRISPR gRNA sequence
  source 1..20: mol_type = other DNA
gcagtggcagcggacagggt

SEQ ID NO: 41005 - DNA, 20 bp, synthetic construct
  misc_feature 1..20: note = CRISPR gRNA sequence
  source 1..20: mol_type = other DNA
ggacagggtgggcccatgtg

SEQ ID NO: 41006 - DNA, 20 bp, synthetic construct
  misc_feature 1..20: note = CRISPR gRNA sequence
  source 1..20: mol_type = other DNA
agggtgggcccatgtgcagc

SEQ ID NO: 41007 - DNA, 20 bp, synthetic construct
  misc_feature 1..20: note = CRISPR gRNA sequence
  source 1..20: mol_type = other DNA
tgggcccatgtgcagctggc

SEQ ID NO: 41008 - DNA, 20 bp, synthetic construct
  misc_feature 1..20: note = CRISPR gRNA sequence
  source 1..20: mol_type = other DNA
gggcccatgtgcagctggct

SEQ ID NO: 41009 - DNA, 20 bp, synthetic construct
  misc_feature 1..20: note = CRISPR gRNA sequence
  source 1..20: mol_type = other DNA
cccatgtgcagctggctggg

SEQ ID NO: 41010 - DNA, 20 bp, synthetic construct
  misc_feature 1..20: note = CRISPR gRNA sequence
  source 1..20: mol_type = other DNA
catgtgcagctggctgggtg

SEQ ID NO: 41011 - DNA, 20 bp, synthetic construct
  misc_feature 1..20: note = CRISPR gRNA sequence
  source 1..20: mol_type = other DNA
tgtgcagctggctgggtgga

SEQ ID NO: 41012 - DNA, 20 bp, synthetic construct
  misc_feature 1..20: note = CRISPR gRNA sequence
  source 1..20: mol_type = other DNA
tgcagctggctgggtggaga

SEQ ID NO: 41013 - DNA, 20 bp, synthetic construct
  misc_feature 1..20: note = CRISPR gRNA sequence
  source 1..20: mol_type = other DNA
tggctgggtggagagagtca

SEQ ID NO: 41014 - DNA, 20 bp, synthetic construct
  misc_feature 1..20: note = CRISPR gRNA sequence
  source 1..20: mol_type = other DNA
tgggtggagagagtcacagc

SEQ ID NO: 41015 - DNA, 20 bp, synthetic construct
  misc_feature 1..20: note = CRISPR gRNA sequence
  source 1..20: mol_type = other DNA
agagtcacagctagtgtgtc

SEQ ID NO: 41016 - DNA, 20 bp, synthetic construct
  misc_feature 1..20: note = CRISPR gRNA sequence
  source 1..20: mol_type = other DNA
cacagctagtgtgtcaagaa

SEQ ID NO: 41017 - DNA, 20 bp, synthetic construct
  misc_feature 1..20: note = CRISPR gRNA sequence
  source 1..20: mol_type = other DNA
acagctagtgtgtcaagaaa

SEQ ID NO: 41018 - DNA, 20 bp, synthetic construct
  misc_feature 1..20: note = CRISPR gRNA sequence
  source 1..20: mol_type = other DNA
caagaaaaggcactgccgta

SEQ ID NO: 41019 - DNA, 20 bp, synthetic construct
  misc_feature 1..20: note = CRISPR gRNA sequence
  source 1..20: mol_type = other DNA
aaaaggcactgccgtacaga

SEQ ID NO: 41020 - DNA, 20 bp, synthetic construct
  misc_feature 1..20: note = CRISPR gRNA sequence
  source 1..20: mol_type = other DNA
aaaggcactgccgtacagat

SEQ ID NO: 41021 - DNA, 20 bp, synthetic construct
  misc_feature 1..20: note = CRISPR gRNA sequence
  source 1..20: mol_type = other DNA
ctgccgtacagatgggctgt

SEQ ID NO: 41022 - DNA, 20 bp, synthetic construct
  misc_feature 1..20: note = CRISPR gRNA sequence
  source 1..20: mol_type = other DNA
tgccgtacagatgggctgtc

SEQ ID NO: 41023 - DNA, 20 bp, synthetic construct
  misc_feature 1..20: note = CRISPR gRNA sequence
  source 1..20: mol_type = other DNA
ccgtacagatgggctgtcag

SEQ ID NO: 41024 - DNA, 20 bp, synthetic construct
  misc_feature 1..20: note = CRISPR gRNA sequence
  source 1..20: mol_type = other DNA
acagatgggctgtcaggagt

SEQ ID NO: 41025 - DNA, 20 bp, synthetic construct
  misc_feature 1..20: note = CRISPR gRNA sequence
  source 1..20: mol_type = other DNA
cagatgggctgtcaggagtc

SEQ ID NO: 41026 - DNA, 20 bp, synthetic construct
  misc_feature 1..20: note = CRISPR gRNA sequence
  source 1..20: mol_type = other DNA
agatgggctgtcaggagtca

SEQ ID NO: 41027 - DNA, 20 bp, synthetic construct
  misc_feature 1..20: note = CRISPR gRNA sequence
  source 1..20: mol_type = other DNA
gatgggctgtcaggagtcag

SEQ ID NO: 41028 - DNA, 20 bp, synthetic construct
  misc_feature 1..20: note = CRISPR gRNA sequence
  source 1..20: mol_type = other DNA
gggctgtcaggagtcagggg

SEQ ID NO: 41029 - DNA, 20 bp, synthetic construct
  misc_feature 1..20: note = CRISPR gRNA sequence
  source 1..20: mol_type = other DNA
tcaggagtcaggggtggctc

SEQ ID NO: 41030 - DNA, 20 bp, synthetic construct
  misc_feature 1..20: note = CRISPR gRNA sequence
  source 1..20: mol_type = other DNA
agtcaggggtggctcaagcc

SEQ ID NO: 41031 - DNA, 20 bp, synthetic construct
  misc_feature 1..20: note = CRISPR gRNA sequence
  source 1..20: mol_type = other DNA
gtcaggggtggctcaagcct

SEQ ID NO: 41032 - DNA, 20 bp, synthetic construct
  misc_feature 1..20: note = CRISPR gRNA sequence
  source 1..20: mol_type = other DNA
aggggtggctcaagcctggg

SEQ ID NO: 41033 - DNA, 20 bp, synthetic construct
  misc_feature 1..20: note = CRISPR gRNA sequence
  source 1..20: mol_type = other DNA
gcctgggtggtcttgcttcc

SEQ ID NO: 41034 - DNA, 20 bp, synthetic construct
  misc_feature 1..20: note = CRISPR gRNA sequence
  source 1..20: mol_type = other DNA
cctgggtggtcttgcttccc

SEQ ID NO: 41035 - DNA, 20 bp, synthetic construct
  misc_feature 1..20: note = CRISPR gRNA sequence
  source 1..20: mol_type = other DNA
ggtggtcttgcttcccagga

SEQ ID NO: 41036 - DNA, 20 bp, synthetic construct
  misc_feature 1..20: note = CRISPR gRNA sequence
  source 1..20: mol_type = other DNA
gtggtcttgcttcccaggat

SEQ ID NO: 41037 - DNA, 20 bp, synthetic construct
  misc_feature 1..20: note = CRISPR gRNA sequence
  source 1..20: mol_type = other DNA
caggataggatctctgtttc

SEQ ID NO: 41038 - DNA, 20 bp, synthetic construct
  misc_feature 1..20: note = CRISPR gRNA sequence
  source 1..20: mol_type = other DNA
aggataggatctctgtttct

SEQ ID NO: 41039 - DNA, 20 bp, synthetic construct
  misc_feature 1..20: note = CRISPR gRNA sequence
  source 1..20: mol_type = other DNA
ggataggatctctgtttctg

SEQ ID NO: 41040 - DNA, 20 bp, synthetic construct
  misc_feature 1..20: note = CRISPR gRNA sequence
  source 1..20: mol_type = other DNA
ctctgtttctggggaacccc

SEQ ID NO: 41041 - DNA, 20 bp, synthetic construct
  misc_feature 1..20: note = CRISPR gRNA sequence
  source 1..20: mol_type = other DNA
tctgtttctggggaaccccc

SEQ ID NO: 41042 - DNA, 20 bp, synthetic construct
  misc_feature 1..20: note = CRISPR gRNA sequence
  source 1..20: mol_type = other DNA
tggggaacccccgggttctt

SEQ ID NO: 41043 - DNA, 20 bp, synthetic construct
  misc_feature 1..20: note = CRISPR gRNA sequence
  source 1..20: mol_type = other DNA
ggggaacccccgggttcttg

SEQ ID NO: 41044 - DNA, 20 bp, synthetic construct
  misc_feature 1..20: note = CRISPR gRNA sequence
  source 1..20: mol_type = other DNA
ccccgggttcttgaggccca

SEQ ID NO: 41045 - DNA, 20 bp, synthetic construct
  misc_feature 1..20: note = CRISPR gRNA sequence
  source 1..20: mol_type = other DNA
aggcccaaagaactgacgta

SEQ ID NO: 41046 - DNA, 20 bp, synthetic construct
  misc_feature 1..20: note = CRISPR gRNA sequence
  source 1..20: mol_type = other DNA
ggcccaaagaactgacgtac

SEQ ID NO: 41047 - DNA, 20 bp, synthetic construct
  misc_feature 1..20: note = CRISPR gRNA sequence
  source 1..20: mol_type = other DNA
gcccaaagaactgacgtaca

SEQ ID NO: 41048 - DNA, 20 bp, synthetic construct
  misc_feature 1..20: note = CRISPR gRNA sequence
  source 1..20: mol_type = other DNA
ccaaagaactgacgtacagg

SEQ ID NO: 41049 - DNA, 20 bp, synthetic construct
  misc_feature 1..20: note = CRISPR gRNA sequence
  source 1..20: mol_type = other DNA
caaagaactgacgtacaggg

SEQ ID NO: 41050 - DNA, 20 bp, synthetic construct
  misc_feature 1..20: note = CRISPR gRNA sequence
  source 1..20: mol_type = other DNA
agaactgacgtacagggagg

SEQ ID NO: 41051 - DNA, 20 bp, synthetic construct
  misc_feature 1..20: note = CRISPR gRNA sequence
  source 1..20: mol_type = other DNA
actgacgtacagggaggcag

SEQ ID NO: 41052 - DNA, 20 bp, synthetic construct
  misc_feature 1..20: note = CRISPR gRNA sequence
  source 1..20: mol_type = other DNA
ggcagaagtcatgtgatgcc

SEQ ID NO: 41053 - DNA, 20 bp, synthetic construct
  misc_feature 1..20: note = CRISPR gRNA sequence
  source 1..20: mol_type = other DNA
agaagtcatgtgatgccaag

SEQ ID NO: 41054 - DNA, 20 bp, synthetic construct
  misc_feature 1..20: note = CRISPR gRNA sequence
  source 1..20: mol_type = other DNA
agtcatgtgatgccaagcag

SEQ ID NO: 41055 - DNA, 20 bp, synthetic construct
  misc_feature 1..20: note = CRISPR gRNA sequence
  source 1..20: mol_type = other DNA
atgtgatgccaagcagtggt

SEQ ID NO: 41056 - DNA, 20 bp, synthetic construct
  misc_feature 1..20: note = CRISPR gRNA sequence
  source 1..20: mol_type = other DNA
gtgatgccaagcagtggtca

SEQ ID NO: 41057 - DNA, 20 bp, synthetic construct
  misc_feature 1..20: note = CRISPR gRNA sequence
  source 1..20: mol_type = other DNA
gatgccaagcagtggtcaga

SEQ ID NO: 41058 - DNA, 20 bp, synthetic construct
  misc_feature 1..20: note = CRISPR gRNA sequence
  source 1..20: mol_type = other DNA
atgccaagcagtggtcagag

SEQ ID NO: 41059 - DNA, 20 bp, synthetic construct
  misc_feature 1..20: note = CRISPR gRNA sequence
  source 1..20: mol_type = other DNA
tggtcagagaggctctgtct

SEQ ID NO: 41060 - DNA, 20 bp, synthetic construct
  misc_feature 1..20: note = CRISPR gRNA sequence
  source 1..20: mol_type = other DNA
ggtcagagaggctctgtctt

SEQ ID NO: 41061 - DNA, 20 bp, synthetic construct
  misc_feature 1..20: note = CRISPR gRNA sequence
  source 1..20: mol_type = other DNA
ggtcctcctgcctgctcacc

SEQ ID NO: 41062 - DNA, 20 bp, synthetic construct
  misc_feature 1..20: note = CRISPR gRNA sequence
  source 1..20: mol_type = other DNA
ctcctgcctgctcacctgga

SEQ ID NO: 41063 - DNA, 20 bp, synthetic construct
  misc_feature 1..20: note = CRISPR gRNA sequence
  source 1..20: mol_type = other DNA
tcctgcctgctcacctggac

SEQ ID NO: 41064 - DNA, 20 bp, synthetic construct
  misc_feature 1..20: note = CRISPR gRNA sequence
  source 1..20: mol_type = other DNA
ctgctcacctggacaggaac

SEQ ID NO: 41065 - DNA, 20 bp, synthetic construct
  misc_feature 1..20: note = CRISPR gRNA sequence
  source 1..20: mol_type = other DNA
cctggacaggaacaagctgc

SEQ ID NO: 41066 - DNA, 20 bp, synthetic construct
  misc_feature 1..20: note = CRISPR gRNA sequence
  source 1..20: mol_type = other DNA
agctgctggcttttctaact

SEQ ID NO: 41067 - DNA, 20 bp, synthetic construct
  misc_feature 1..20: note = CRISPR gRNA sequence
  source 1..20: mol_type = other DNA
gctgctggcttttctaactc

SEQ ID NO: 41068 - DNA, 20 bp, synthetic construct
  misc_feature 1..20: note = CRISPR gRNA sequence
  source 1..20: mol_type = other DNA
aactcaggcttcccttccct

SEQ ID NO: 41069 - DNA, 20 bp, synthetic construct
  misc_feature 1..20: note = CRISPR gRNA sequence
  source 1..20: mol_type = other DNA
ggcttcccttccctgagcct

SEQ ID NO: 41070 - DNA, 20 bp, synthetic construct
  misc_feature 1..20: note = CRISPR gRNA sequence
  source 1..20: mol_type = other DNA
agtttccccatctgaacaat

SEQ ID NO: 41071 - DNA, 20 bp, synthetic construct
  misc_feature 1..20: note = CRISPR gRNA sequence
  source 1..20: mol_type = other DNA
gtttccccatctgaacaatg

SEQ ID NO: 41072 - DNA, 20 bp, synthetic construct
  misc_feature 1..20: note = CRISPR gRNA sequence
  source 1..20: mol_type = other DNA
tttccccatctgaacaatga

SEQ ID NO: 41073 - DNA, 20 bp, synthetic construct
  misc_feature 1..20: note = CRISPR gRNA sequence
  source 1..20: mol_type = other DNA
catctgaacaatgagggact

SEQ ID NO: 41074 - DNA, 20 bp, synthetic construct
  misc_feature 1..20: note = CRISPR gRNA sequence
  source 1..20: mol_type = other DNA
tgaacaatgagggactgagc

SEQ ID NO: 41075 - DNA, 20 bp, synthetic construct
  misc_feature 1..20: note = CRISPR gRNA sequence
  source 1..20: mol_type = other DNA
gaacaatgagggactgagct

SEQ ID NO: 41076 - DNA, 20 bp, synthetic construct
  misc_feature 1..20: note = CRISPR gRNA sequence
  source 1..20: mol_type = other DNA
tgagggactgagctaggatc

SEQ ID NO: 41077 - DNA, 20 bp, synthetic construct
  misc_feature 1..20: note = CRISPR gRNA sequence
  source 1..20: mol_type = other DNA
ctagtgactgcattgtctct

SEQ ID NO: 41078 - DNA, 20 bp, synthetic construct
  misc_feature 1..20: note = CRISPR gRNA sequence
  source 1..20: mol_type = other DNA
attgtctctgagatgccttc

SEQ ID NO: 41079 - DNA, 20 bp, synthetic construct
  misc_feature 1..20: note = CRISPR gRNA sequence
  source 1..20: mol_type = other DNA
ccttccagccctgactttcc

SEQ ID NO: 41080 - DNA, 20 bp, synthetic construct
  misc_feature 1..20: note = CRISPR gRNA sequence
  source 1..20: mol_type = other DNA
cagccctgactttccaagtc

SEQ ID NO: 41081 - DNA, 20 bp, synthetic construct
  misc_feature 1..20: note = CRISPR gRNA sequence
  source 1..20: mol_type = other DNA
agccctgactttccaagtct

SEQ ID NO: 41082 - DNA, 20 bp, synthetic construct
  misc_feature 1..20: note = CRISPR gRNA sequence
  source 1..20: mol_type = other DNA
ccctgactttccaagtctgg

SEQ ID NO: 41083 - DNA, 20 bp, synthetic construct
  misc_feature 1..20: note = CRISPR gRNA sequence
  source 1..20: mol_type = other DNA
ccaagtctgggagtccaatg

SEQ ID NO: 41084 - DNA, 20 bp, synthetic construct
  misc_feature 1..20: note = CRISPR gRNA sequence
  source 1..20: mol_type = other DNA
caagtctgggagtccaatgt

SEQ ID NO: 41085 - DNA, 20 bp, synthetic construct
  misc_feature 1..20: note = CRISPR gRNA sequence
  source 1..20: mol_type = other DNA
tttctaaacgatccccctcc

SEQ ID NO: 41086 - DNA, 20 bp, synthetic construct
  misc_feature 1..20: note = CRISPR gRNA sequence
  source 1..20: mol_type = other DNA
ttctaaacgatccccctcct

SEQ ID NO: 41087 - DNA, 20 bp, synthetic construct
  misc_feature 1..20: note = CRISPR gRNA sequence
  source 1..20: mol_type = other DNA
tctaaacgatccccctccta

SEQ ID NO: 41088 - DNA, 20 bp, synthetic construct
  misc_feature 1..20: note = CRISPR gRNA sequence
  source 1..20: mol_type = other DNA
ctaaacgatccccctcctag

SEQ ID NO: 41089 - DNA, 20 bp, synthetic construct
  misc_feature 1..20: note = CRISPR gRNA sequence
  source 1..20: mol_type = other DNA
atccccctcctaggggtata

SEQ ID NO: 41090 - DNA, 20 bp, synthetic construct
  misc_feature 1..20: note = CRISPR gRNA sequence
  source 1..20: mol_type = other DNA
tccccctcctaggggtatat

SEQ ID NO: 41091 - DNA, 20 bp, synthetic construct
  misc_feature 1..20: note = CRISPR gRNA sequence
  source 1..20: mol_type = other DNA
cctcctaggggtatatgggc

SEQ ID NO: 41092 - DNA, 20 bp, synthetic construct
  misc_feature 1..20: note = CRISPR gRNA sequence
  source 1..20: mol_type = other DNA
ctcctaggggtatatgggct

SEQ ID NO: 41093 - DNA, 20 bp, synthetic construct
  misc_feature 1..20: note = CRISPR gRNA sequence
  source 1..20: mol_type = other DNA
taggggtatatgggctgggc

SEQ ID NO: 41094 - DNA, 20 bp, synthetic construct
  misc_feature 1..20: note = CRISPR gRNA sequence
  source 1..20: mol_type = other DNA
aggggtatatgggctgggct

SEQ ID NO: 41095 - DNA, 20 bp, synthetic construct
  misc_feature 1..20: note = CRISPR gRNA sequence
  source 1..20: mol_type = other DNA
gggtatatgggctgggctgg

SEQ ID NO: 41096 - DNA, 20 bp, synthetic construct
  misc_feature 1..20: note = CRISPR gRNA sequence
  source 1..20: mol_type = other DNA
atgggctgggctgggagtcc

SEQ ID NO: 41097 - DNA, 20 bp, synthetic construct
  misc_feature 1..20: note = CRISPR gRNA sequence
  source 1..20: mol_type = other DNA
tgggctgggctgggagtccg

SEQ ID NO: 41098 - DNA, 20 bp, synthetic construct
  misc_feature 1..20: note = CRISPR gRNA sequence
  source 1..20: mol_type = other DNA
gggctgggctgggagtccga

SEQ ID NO: 41099 - DNA, 20 bp, synthetic construct
  misc_feature 1..20: note = CRISPR gRNA sequence
  source 1..20: mol_type = other DNA
ggctgggctgggagtccgag

SEQ ID NO: 41100 - DNA, 20 bp, synthetic construct
  misc_feature 1..20: note = CRISPR gRNA sequence
  source 1..20: mol_type = other DNA
gctgggctgggagtccgagg

SEQ ID NO: 41101 - DNA, 20 bp, synthetic construct
  misc_feature 1..20: note = CRISPR gRNA sequence
  source 1..20: mol_type = other DNA
tttctaaatgatccccctcc

SEQ ID NO: 41102 - DNA, 20 bp, synthetic construct
  misc_feature 1..20: note = CRISPR gRNA sequence
  source 1..20: mol_type = other DNA
ttctaaatgatccccctcct

SEQ ID NO: 41103 - DNA, 20 bp, synthetic construct
  misc_feature 1..20: note = CRISPR gRNA sequence
  source 1..20: mol_type = other DNA
tctaaatgatccccctccta

SEQ ID NO: 41104 - DNA, 20 bp, synthetic construct
  misc_feature 1..20: note = CRISPR gRNA sequence
  source 1..20: mol_type = other DNA
atccccctcctagggatatg

SEQ ID NO: 41105 - DNA, 20 bp, synthetic construct
  misc_feature 1..20: note = CRISPR gRNA sequence
  source 1..20: mol_type = other DNA
tccccctcctagggatatgt

SEQ ID NO: 41106 - DNA, 20 bp, synthetic construct
  misc_feature 1..20: note = CRISPR gRNA sequence
  source 1..20: mol_type = other DNA
cctagggatatgtgggccac

SEQ ID NO: 41107 - DNA, 20 bp, synthetic construct
  misc_feature 1..20: note = CRISPR gRNA sequence
  source 1..20: mol_type = other DNA
gtgggccactggatctttgc

SEQ ID NO: 41108 - DNA, 20 bp, synthetic construct
  misc_feature 1..20: note = CRISPR gRNA sequence
  source 1..20: mol_type = other DNA
tggatctttgccagacttcc

SEQ ID NO: 41109 - DNA, 20 bp, synthetic construct
  misc_feature 1..20: note = CRISPR gRNA sequence
  source 1..20: mol_type = other DNA
tttgccagacttcccagctg

SEQ ID NO: 41110 - DNA, 20 bp, synthetic construct
  misc_feature 1..20: note = CRISPR gRNA sequence
  source 1..20: mol_type = other DNA
cagacttcccagctgcagcc

SEQ ID NO: 41111 - DNA, 20 bp, synthetic construct
  misc_feature 1..20: note = CRISPR gRNA sequence
  source 1..20: mol_type = other DNA
cccagctgcagccaagttct

SEQ ID NO: 41112 - DNA, 20 bp, synthetic construct
  misc_feature 1..20: note = CRISPR gRNA sequence
  source 1..20: mol_type = other DNA
ccagctgcagccaagttctt

SEQ ID NO: 41113 - DNA, 20 bp, synthetic construct
  misc_feature 1..20: note = CRISPR gRNA sequence
  source 1..20: mol_type = other DNA
cagctgcagccaagttctta

SEQ ID NO: 41114 - DNA, 20 bp, synthetic construct
  misc_feature 1..20: note = CRISPR gRNA sequence
  source 1..20: mol_type = other DNA
ccaagttcttagggttccgt

SEQ ID NO: 41115 - DNA, 20 bp, synthetic construct
  misc_feature 1..20: note = CRISPR gRNA sequence
  source 1..20: mol_type = other DNA
ttccgtcagcgctgcatccc

SEQ ID NO: 41116 - DNA, 20 bp, synthetic construct
  misc_feature 1..20: note = CRISPR gRNA sequence
  source 1..20: mol_type = other DNA
tccgtcagcgctgcatcccc

SEQ ID NO: 41117 - DNA, 20 bp, synthetic construct
  misc_feature 1..20: note = CRISPR gRNA sequence
  source 1..20: mol_type = other DNA
cgtcagcgctgcatccccag

SEQ ID NO: 41118 - DNA, 20 bp, synthetic construct
  misc_feature 1..20: note = CRISPR gRNA sequence
  source 1..20: mol_type = other DNA
gctgcatccccaggagcctc

SEQ ID NO: 41119 - DNA, 20 bp, synthetic construct
  misc_feature 1..20: note = CRISPR gRNA sequence
  source 1..20: mol_type = other DNA
aggagcctctggtactgtcc

SEQ ID NO: 41120 - DNA, 20 bp, synthetic construct
  misc_feature 1..20: note = CRISPR gRNA sequence
  source 1..20: mol_type = other DNA
ctgtcccagcccttcttgtt

SEQ ID NO: 41121 - DNA, 20 bp, synthetic construct
  misc_feature 1..20: note = CRISPR gRNA sequence
  source 1..20: mol_type = other DNA
tgtcccagcccttcttgttt

SEQ ID NO: 41122 - DNA, 20 bp, synthetic construct
  misc_feature 1..20: note = CRISPR gRNA sequence
  source 1..20: mol_type = other DNA
gtcccagcccttcttgtttg

SEQ ID NO: 41123 - DNA, 20 bp, synthetic construct
  misc_feature 1..20: note = CRISPR gRNA sequence
  source 1..20: mol_type = other DNA
tcccagcccttcttgtttgg

SEQ ID NO: 41124 - DNA, 20 bp, synthetic construct
  misc_feature 1..20: note = CRISPR gRNA sequence
  source 1..20: mol_type = other DNA
ttgtttgggggtaaccataa

SEQ ID NO: 41125 - DNA, 20 bp, synthetic construct
  misc_feature 1..20: note = CRISPR gRNA sequence
  source 1..20: mol_type = other DNA
tgtttgggggtaaccataat

SEQ ID NO: 41126 - DNA, 20 bp, synthetic construct
  misc_feature 1..20: note = CRISPR gRNA sequence
  source 1..20: mol_type = other DNA
gtttgggggtaaccataata

SEQ ID NO: 41127 - DNA, 20 bp, synthetic construct
  misc_feature 1..20: note = CRISPR gRNA sequence
  source 1..20: mol_type = other DNA
ggggtaaccataatagggat

SEQ ID NO: 41128 - DNA, 20 bp, synthetic construct
  misc_feature 1..20: note = CRISPR gRNA sequence
  source 1..20: mol_type = other DNA
gggtaaccataatagggatg

SEQ ID NO: 41129 - DNA, 20 bp, synthetic construct
  misc_feature 1..20: note = CRISPR gRNA sequence
  source 1..20: mol_type = other DNA
ccataatagggatgaggcgt

SEQ ID NO: 41130 - DNA, 20 bp, synthetic construct
  misc_feature 1..20: note = CRISPR gRNA sequence
  source 1..20: mol_type = other DNA
ataatagggatgaggcgtca

SEQ ID NO: 41131 - DNA, 20 bp, synthetic construct
  misc_feature 1..20: note = CRISPR gRNA sequence
  source 1..20: mol_type = other DNA
taatagggatgaggcgtcag

SEQ ID NO: 41132 - DNA, 20 bp, synthetic construct
  misc_feature 1..20: note = CRISPR gRNA sequence
  source 1..20: mol_type = other DNA
aatagggatgaggcgtcaga

SEQ ID NO: 41133 - DNA, 20 bp, synthetic construct
  misc_feature 1..20: note = CRISPR gRNA sequence
  source 1..20: mol_type = other DNA
atagggatgaggcgtcagag

SEQ ID NO: 41134 - DNA, 20 bp, synthetic construct
  misc_feature 1..20: note = CRISPR gRNA sequence
  source 1..20: mol_type = other DNA
tagggatgaggcgtcagagg

SEQ ID NO: 41135 - DNA, 20 bp, synthetic construct
  misc_feature 1..20: note = CRISPR gRNA sequence
  source 1..20: mol_type = other DNA
ggatgaggcgtcagaggggg

SEQ ID NO: 41136 - DNA, 20 bp, synthetic construct
  misc_feature 1..20: note = CRISPR gRNA sequence
  source 1..20: mol_type = other DNA
atgaggcgtcagagggggca

SEQ ID NO: 41137 - DNA, 20 bp, synthetic construct
  misc_feature 1..20: note = CRISPR gRNA sequence
  source 1..20: mol_type = other DNA
ggcgtcagagggggcagagc

SEQ ID NO: 41138 - DNA, 20 bp, synthetic construct
  misc_feature 1..20: note = CRISPR gRNA sequence
  source 1..20: mol_type = other DNA
gtcagagggggcagagctgg

SEQ ID NO: 41139 - DNA, 20 bp, synthetic construct
  misc_feature 1..20: note = CRISPR gRNA sequence
  source 1..20: mol_type = other DNA
tcagagggggcagagctggc

SEQ ID NO: 41140 - DNA, 20 bp, synthetic construct
  misc_feature 1..20: note = CRISPR gRNA sequence
  source 1..20: mol_type = other DNA
cagagggggcagagctggca

SEQ ID NO: 41141 - DNA, 20 bp, synthetic construct
  misc_feature 1..20: note = CRISPR gRNA sequence
  source 1..20: mol_type = other DNA
agagggggcagagctggcag

SEQ ID NO: 41142 - DNA, 20 bp, synthetic construct
  misc_feature 1..20: note = CRISPR gRNA sequence
  source 1..20: mol_type = other DNA
gagggggcagagctggcagg

SEQ ID NO: 41143 - DNA, 20 bp, synthetic construct
  misc_feature 1..20: note = CRISPR gRNA sequence
  source 1..20: mol_type = other DNA
gggcagagctggcagggggc

SEQ ID NO: 41144 - DNA, 20 bp, synthetic construct
  misc_feature 1..20: note = CRISPR gRNA sequence
  source 1..20: mol_type = other DNA
ggcagagctggcagggggct

SEQ ID NO: 41145 - DNA, 20 bp, synthetic construct
  misc_feature 1..20: note = CRISPR gRNA sequence
  source 1..20: mol_type = other DNA
gcagagctggcagggggcta

SEQ ID NO: 41146 - DNA, 20 bp, synthetic construct
  misc_feature 1..20: note = CRISPR gRNA sequence
  source 1..20: mol_type = other DNA
agctggcagggggctagggc

SEQ ID NO: 41147 - DNA, 20 bp, synthetic construct
  misc_feature 1..20: note = CRISPR gRNA sequence
  source 1..20: mol_type = other DNA
gctggcagggggctagggct

SEQ ID NO: 41148 - DNA, 20 bp, synthetic construct
  misc_feature 1..20: note = CRISPR gRNA sequence
  source 1..20: mol_type = other DNA
ctggcagggggctagggctg

SEQ ID NO: 41149 - DNA, 20 bp, synthetic construct
  misc_feature 1..20: note = CRISPR gRNA sequence
  source 1..20: mol_type = other DNA
agggggctagggctggggat

SEQ ID NO: 41150 - DNA, 20 bp, synthetic construct
  misc_feature 1..20: note = CRISPR gRNA sequence
  source 1..20: mol_type = other DNA
gggggctagggctggggatt

SEQ ID NO: 41151 - DNA, 20 bp, synthetic construct
  misc_feature 1..20: note = CRISPR gRNA sequence
  source 1..20: mol_type = other DNA
gctagggctggggattggga

SEQ ID NO: 41152 - DNA, 20 bp, synthetic construct
  misc_feature 1..20: note = CRISPR gRNA sequence
  source 1..20: mol_type = other DNA
tagggctggggattgggata

SEQ ID NO: 41153 - DNA, 20 bp, synthetic construct
  misc_feature 1..20: note = CRISPR gRNA sequence
  source 1..20: mol_type = other DNA
agggctggggattgggatag

SEQ ID NO: 41154 - DNA, 20 bp, synthetic construct
  misc_feature 1..20: note = CRISPR gRNA sequence
  source 1..20: mol_type = other DNA
gggctggggattgggataga

SEQ ID NO: 41155 - DNA, 20 bp, synthetic construct
  misc_feature 1..20: note = CRISPR gRNA sequence
  source 1..20: mol_type = other DNA
ctggggattgggatagaggg

SEQ ID NO: 41156 - DNA, 20 bp, synthetic construct
  misc_feature 1..20: note = CRISPR gRNA sequence
  source 1..20: mol_type = other DNA
ggggattgggatagagggaa

SEQ ID NO: 41157 - DNA, 20 bp, synthetic construct
  misc_feature 1..20: note = CRISPR gRNA sequence
  source 1..20: mol_type = other DNA
ggattgggatagagggaaga

SEQ ID NO: 41158 - DNA, 20 bp, synthetic construct
  misc_feature 1..20: note = CRISPR gRNA sequence
  source 1..20: mol_type = other DNA
gattgggatagagggaagag

SEQ ID NO: 41159 - DNA, 20 bp, synthetic construct
  misc_feature 1..20: note = CRISPR gRNA sequence
  source 1..20: mol_type = other DNA
attgggatagagggaagaga

SEQ ID NO: 41160 - DNA, 20 bp, synthetic construct
  misc_feature 1..20: note = CRISPR gRNA sequence
  source 1..20: mol_type = other DNA
tgggatagagggaagagagg

SEQ ID NO: 41161 - DNA, 20 bp, synthetic construct
  misc_feature 1..20: note = CRISPR gRNA sequence
  source 1..20: mol_type = other DNA
agagggaagagagggagttt

SEQ ID NO: 41162 - DNA, 20 bp, synthetic construct
  misc_feature 1..20: note = CRISPR gRNA sequence
  source 1..20: mol_type = other DNA
agggaagagagggagtttaa

SEQ ID NO: 41163 - DNA, 20 bp, synthetic construct
  misc_feature 1..20: note = CRISPR gRNA sequence
  source 1..20: mol_type = other DNA
agagagggagtttaagagaa

SEQ ID NO: 41164 - DNA, 20 bp, synthetic construct
  misc_feature 1..20: note = CRISPR gRNA sequence
  source 1..20: mol_type = other DNA
gagagggagtttaagagaaa

SEQ ID NO: 41165 - DNA, 20 bp, synthetic construct
  misc_feature 1..20: note = CRISPR gRNA sequence
  source 1..20: mol_type = other DNA
ggagtttaagagaaaaggaa

SEQ ID NO: 41166 - DNA, 20 bp, synthetic construct
  misc_feature 1..20: note = CRISPR gRNA sequence
  source 1..20: mol_type = other DNA
tttaagagaaaaggaaaaga

SEQ ID NO: 41167 - DNA, 20 bp, synthetic construct
  misc_feature 1..20: note = CRISPR gRNA sequence
  source 1..20: mol_type = other DNA
taagagaaaaggaaaagaaa

SEQ ID NO: 41168 - DNA, 20 bp, synthetic construct
  misc_feature 1..20: note = CRISPR gRNA sequence
  source 1..20: mol_type = other DNA
aagagaaaaggaaaagaaag

SEQ ID NO: 41169 - DNA, 20 bp, synthetic construct
  misc_feature 1..20: note = CRISPR gRNA sequence
  source 1..20: mol_type = other DNA
aaaaggaaaagaaagaggcg

SEQ ID NO: 41170 - DNA, 20 bp, synthetic construct
  misc_feature 1..20: note = CRISPR gRNA sequence
  source 1..20: mol_type = other DNA
aaaggaaaagaaagaggcgt

SEQ ID NO: 41171 - DNA, 20 bp, synthetic construct
  misc_feature 1..20: note = CRISPR gRNA sequence
  source 1..20: mol_type = other DNA
aaagaaagaggcgtgggtgt

SEQ ID NO: 41172 - DNA, 20 bp, synthetic construct
  misc_feature 1..20: note = CRISPR gRNA sequence
  source 1..20: mol_type = other DNA
aagaaagaggcgtgggtgtg

SEQ ID NO: 41173 - DNA, 20 bp, synthetic construct
  misc_feature 1..20: note = CRISPR gRNA sequence
  source 1..20: mol_type = other DNA
agaaagaggcgtgggtgtga

SEQ ID NO: 41174 - DNA, 20 bp, synthetic construct
  misc_feature 1..20: note = CRISPR gRNA sequence
  source 1..20: mol_type = other DNA
gaaagaggcgtgggtgtgag

SEQ ID NO: 41175 - DNA, 20 bp, synthetic construct
  misc_feature 1..20: note = CRISPR gRNA sequence
  source 1..20: mol_type = other DNA
ggcgtgggtgtgaggggtgc

SEQ ID NO: 41176 - DNA, 20 bp, synthetic construct
  misc_feature 1..20: note = CRISPR gRNA sequence
  source 1..20: mol_type = other DNA
gcgtgggtgtgaggggtgct

SEQ ID NO: 41177 - DNA, 20 bp, synthetic construct
  misc_feature 1..20: note = CRISPR gRNA sequence
  source 1..20: mol_type = other DNA
gtgggtgtgaggggtgctgg

SEQ ID NO: 41178 - DNA, 20 bp, synthetic construct
  misc_feature 1..20: note = CRISPR gRNA sequence
  source 1..20: mol_type = other DNA
gtgtgaggggtgctgggagt

SEQ ID NO: 41179 - DNA, 20 bp, synthetic construct
  misc_feature 1..20: note = CRISPR gRNA sequence
  source 1..20: mol_type = other DNA
tgtgaggggtgctgggagtt

SEQ ID NO: 41180 - DNA, 20 bp, synthetic construct
  misc_feature 1..20: note = CRISPR gRNA sequence
  source 1..20: mol_type = other DNA
gtgaggggtgctgggagttg

SEQ ID NO: 41181 - DNA, 20 bp, synthetic construct
  misc_feature 1..20: note = CRISPR gRNA sequence
  source 1..20: mol_type = other DNA
gaggggtgctgggagttggg

SEQ ID NO: 41182 - DNA, 20 bp, synthetic construct
  misc_feature 1..20: note = CRISPR gRNA sequence
  source 1..20: mol_type = other DNA
tgctgggagttggggagctc

SEQ ID NO: 41183 - DNA, 20 bp, synthetic construct
  misc_feature 1..20: note = CRISPR gRNA sequence
  source 1..20: mol_type = other DNA
tggggagctctggcccctga

SEQ ID NO: 41184 - DNA, 20 bp, synthetic construct
  misc_feature 1..20: note = CRISPR gRNA sequence
  source 1..20: mol_type = other DNA
ggggagctctggcccctgac

SEQ ID NO: 41185 - DNA, 20 bp, synthetic construct
  misc_feature 1..20: note = CRISPR gRNA sequence
  source 1..20: mol_type = other DNA
gagctctggcccctgacggg

SEQ ID NO: 41186 - DNA, 20 bp, synthetic construct
  misc_feature 1..20: note = CRISPR gRNA sequence
  source 1..20: mol_type = other DNA
ctggcccctgacgggcagct

SEQ ID NO: 41187 - DNA, 20 bp, synthetic construct
  misc_feature 1..20: note = CRISPR gRNA sequence
  source 1..20: mol_type = other DNA
cccctgacgggcagctcagc

SEQ ID NO: 41188 - DNA, 20 bp, synthetic construct
  misc_feature 1..20: note = CRISPR gRNA sequence
  source 1..20: mol_type = other DNA
cccatgccccgcattctcct

SEQ ID NO: 41189 - DNA, 20 bp, synthetic construct
  misc_feature 1..20: note = CRISPR gRNA sequence
  source 1..20: mol_type = other DNA
catgccccgcattctccttg

SEQ ID NO: 41190 - DNA, 20 bp, synthetic construct
  misc_feature 1..20: note = CRISPR gRNA sequence
  source 1..20: mol_type = other DNA
tgccccgcattctccttgga

SEQ ID NO: 41191 - DNA, 20 bp, synthetic construct
  misc_feature 1..20: note = CRISPR gRNA sequence
  source 1..20: mol_type = other DNA
cccgcattctccttggagag

SEQ ID NO: 41192 - DNA, 20 bp, synthetic construct
  misc_feature 1..20: note = CRISPR gRNA sequence
  source 1..20: mol_type = other DNA
gaagattccacatttctgtg

SEQ ID NO: 41193 - DNA, 20 bp, synthetic construct
  misc_feature 1..20: note = CRISPR gRNA sequence
  source 1..20: mol_type = other DNA
ccacatttctgtgaagcaaa

SEQ ID NO: 41194 - DNA, 20 bp, synthetic construct
  misc_feature 1..20: note = CRISPR gRNA sequence
  source 1..20: mol_type = other DNA
acatttctgtgaagcaaaca

SEQ ID NO: 41195 - DNA, 20 bp, synthetic construct
  misc_feature 1..20: note = CRISPR gRNA sequence
  source 1..20: mol_type = other DNA
tttctgtgaagcaaacagag

SEQ ID NO: 41196 - DNA, 20 bp, synthetic construct
  misc_feature 1..20: note = CRISPR gRNA sequence
  source 1..20: mol_type = other DNA
gtgaagcaaacagagcagct

SEQ ID NO: 41197 - DNA, 20 bp, synthetic construct
  misc_feature 1..20: note = CRISPR gRNA sequence
  source 1..20: mol_type = other DNA
cagctcagccactccctgcc

SEQ ID NO: 41198 - DNA, 20 bp, synthetic construct
  misc_feature 1..20: note = CRISPR gRNA sequence
  source 1..20: mol_type = other DNA
agctcagccactccctgcct

SEQ ID NO: 41199 - DNA, 20 bp, synthetic construct
  misc_feature 1..20: note = CRISPR gRNA sequence
  source 1..20: mol_type = other DNA
gctcagccactccctgcctg

SEQ ID NO: 41200 - DNA, 20 bp, synthetic construct
  misc_feature 1..20: note = CRISPR gRNA sequence
  source 1..20: mol_type = other DNA
cctggggtctccatctgctc

SEQ ID NO: 41201 - DNA, 20 bp, synthetic construct
  misc_feature 1..20: note = CRISPR gRNA sequence
  source 1..20: mol_type = other DNA
ctggggtctccatctgctct

SEQ ID NO: 41202 - DNA, 20 bp, synthetic construct
  misc_feature 1..20: note = CRISPR gRNA sequence
  source 1..20: mol_type = other DNA
tggggtctccatctgctctg

SEQ ID NO: 41203 - DNA, 20 bp, synthetic construct
  misc_feature 1..20: note = CRISPR gRNA sequence
  source 1..20: mol_type = other DNA
ggggtctccatctgctctgg

SEQ ID NO: 41204 - DNA, 20 bp, synthetic construct
  misc_feature 1..20: note = CRISPR gRNA sequence
  source 1..20: mol_type = other DNA
tctgggggacacccactttc

SEQ ID NO: 41205 - DNA, 20 bp, synthetic construct
  misc_feature 1..20: note = CRISPR gRNA sequence
  source 1..20: mol_type = other DNA
ggggacacccactttccaga

SEQ ID NO: 41206 - DNA, 20 bp, synthetic construct
  misc_feature 1..20: note = CRISPR gRNA sequence
  source 1..20: mol_type = other DNA
acacccactttccagaaaga

SEQ ID NO: 41207 - DNA, 20 bp, synthetic construct
  misc_feature 1..20: note = CRISPR gRNA sequence
  source 1..20: mol_type = other DNA
cacccactttccagaaagaa

SEQ ID NO: 41208 - DNA, 20 bp, synthetic construct
  misc_feature 1..20: note = CRISPR gRNA sequence
  source 1..20: mol_type = other DNA
acccactttccagaaagaaa

SEQ ID NO: 41209 - DNA, 20 bp, synthetic construct
  misc_feature 1..20: note = CRISPR gRNA sequence
  source 1..20: mol_type = other DNA
cccactttccagaaagaaag

SEQ ID NO: 41210 - DNA, 20 bp, synthetic construct
  misc_feature 1..20: note = CRISPR gRNA sequence
  source 1..20: mol_type = other DNA
ctttccagaaagaaaggggt

SEQ ID NO: 41211 - DNA, 20 bp, synthetic construct
  misc_feature 1..20: note = CRISPR gRNA sequence
  source 1..20: mol_type = other DNA
ctaatacactccccatctgc

SEQ ID NO: 41212 - DNA, 20 bp, synthetic construct
  misc_feature 1..20: note = CRISPR gRNA sequence
  source 1..20: mol_type = other DNA
ccatctgcaagctctgccat

SEQ ID NO: 41213 - DNA, 20 bp, synthetic construct
  misc_feature 1..20: note = CRISPR gRNA sequence
  source 1..20: mol_type = other DNA
atctgcaagctctgccatga

SEQ ID NO: 41214 - DNA, 20 bp, synthetic construct
  misc_feature 1..20: note = CRISPR gRNA sequence
  source 1..20: mol_type = other DNA
tctgcaagctctgccatgag

SEQ ID NO: 41215 - DNA, 20 bp, synthetic construct
  misc_feature 1..20: note = CRISPR gRNA sequence
  source 1..20: mol_type = other DNA
gctctgccatgagaggctgt

SEQ ID NO: 41216 - DNA, 20 bp, synthetic construct
  misc_feature 1..20: note = CRISPR gRNA sequence
  source 1..20: mol_type = other DNA
gaggctgtgagaccctgact

SEQ ID NO: 41217 - DNA, 20 bp, synthetic construct
  misc_feature 1..20: note = CRISPR gRNA sequence
  source 1..20: mol_type = other DNA
gacttggccccacctctctc

SEQ ID NO: 41218 - DNA, 20 bp, synthetic construct
  misc_feature 1..20: note = CRISPR gRNA sequence
  source 1..20: mol_type = other DNA
acttggccccacctctctct

SEQ ID NO: 41219 - DNA, 20 bp, synthetic construct
  misc_feature 1..20: note = CRISPR gRNA sequence
  source 1..20: mol_type = other DNA
cccacctctctctaggcctc

SEQ ID NO: 41220 - DNA, 20 bp, synthetic construct
  misc_feature 1..20: note = CRISPR gRNA sequence
  source 1..20: mol_type = other DNA
ccacctctctctaggcctcc

SEQ ID NO: 41221 - DNA, 20 bp, synthetic construct
  misc_feature 1..20: note = CRISPR gRNA sequence
  source 1..20: mol_type = other DNA
cacctctctctaggcctcca

SEQ ID NO: 41222 - DNA, 20 bp, synthetic construct
  misc_feature 1..20: note = CRISPR gRNA sequence
  source 1..20: mol_type = other DNA
ctctctctaggcctccaggg

SEQ ID NO: 41223 - DNA, 20 bp, synthetic construct
  misc_feature 1..20: note = CRISPR gRNA sequence
  source 1..20: mol_type = other DNA
tctctaggcctccagggaag

SEQ ID NO: 41224 - DNA, 20 bp, synthetic construct
  misc_feature 1..20: note = CRISPR gRNA sequence
  source 1..20: mol_type = other DNA
tctaggcctccagggaagtg

SEQ ID NO: 41225 - DNA, 20 bp, synthetic construct
  misc_feature 1..20: note = CRISPR gRNA sequence
  source 1..20: mol_type = other DNA
ctaggcctccagggaagtgg

SEQ ID NO: 41226 - DNA, 20 bp, synthetic construct
  misc_feature 1..20: note = CRISPR gRNA sequence
  source 1..20: mol_type = other DNA
gcctccagggaagtggaggc

SEQ ID NO: 41227 - DNA, 20 bp, synthetic construct
  misc_feature 1..20: note = CRISPR gRNA sequence
  source 1..20: mol_type = other DNA
ccagggaagtggaggcaagt

SEQ ID NO: 41228 - DNA, 20 bp, synthetic construct
  misc_feature 1..20: note = CRISPR gRNA sequence
  source 1..20: mol_type = other DNA
cagggaagtggaggcaagtg

SEQ ID NO: 41229 - DNA, 20 bp, synthetic construct
  misc_feature 1..20: note = CRISPR gRNA sequence
  source 1..20: mol_type = other DNA
agtggaggcaagtgaggccc

SEQ ID NO: 41230 - DNA, 20 bp, synthetic construct
  misc_feature 1..20: note = CRISPR gRNA sequence
  source 1..20: mol_type = other DNA
gtggaggcaagtgaggccct

SEQ ID NO: 41231 - DNA, 20 bp, synthetic construct
  misc_feature 1..20: note = CRISPR gRNA sequence
  source 1..20: mol_type = other DNA
gaggcaagtgaggccctggg

SEQ ID NO: 41232 - DNA, 20 bp, synthetic construct
  misc_feature 1..20: note = CRISPR gRNA sequence
  source 1..20: mol_type = other DNA
aggcaagtgaggccctggga

SEQ ID NO: 41233 - DNA, 20 bp, synthetic construct
  misc_feature 1..20: note = CRISPR gRNA sequence
  source 1..20: mol_type = other DNA
ggacatttcaatttcactgt

SEQ ID NO: 41234 - DNA, 20 bp, synthetic construct
  misc_feature 1..20: note = CRISPR gRNA sequence
  source 1..20: mol_type = other DNA
ttcaatttcactgttagccc

SEQ ID NO: 41235 - DNA, 20 bp, synthetic construct
  misc_feature 1..20: note = CRISPR gRNA sequence
  source 1..20: mol_type = other DNA
tcaatttcactgttagcccc

SEQ ID NO: 41236 - DNA, 20 bp, synthetic construct
  misc_feature 1..20: note = CRISPR gRNA sequence
  source 1..20: mol_type = other DNA
caatttcactgttagcccca

SEQ ID NO: 41237 - DNA, 20 bp, synthetic construct
  misc_feature 1..20: note = CRISPR gRNA sequence
  source 1..20: mol_type = other DNA
cactgttagccccagggcaa

SEQ ID NO: 41238 - DNA, 20 bp, synthetic construct
  misc_feature 1..20: note = CRISPR gRNA sequence
  source 1..20: mol_type = other DNA
actgttagccccagggcaat

SEQ ID NO: 41239 - DNA, 20 bp, synthetic construct
  misc_feature 1..20: note = CRISPR gRNA sequence
  source 1..20: mol_type = other DNA
ctgttagccccagggcaatg

SEQ ID NO: 41240 - DNA, 20 bp, synthetic construct
  misc_feature 1..20: note = CRISPR gRNA sequence
  source 1..20: mol_type = other DNA
gttagccccagggcaatggg

SEQ ID NO: 41241 - DNA, 20 bp, synthetic construct
  misc_feature 1..20: note = CRISPR gRNA sequence
  source 1..20: mol_type = other DNA
cccagggcaatggggagcca

SEQ ID NO: 41242 - DNA, 20 bp, synthetic construct
  misc_feature 1..20: note = CRISPR gRNA sequence
  source 1..20: mol_type = other DNA
ccagggcaatggggagccac

SEQ ID NO: 41243 - DNA, 20 bp, synthetic construct
  misc_feature 1..20: note = CRISPR gRNA sequence
  source 1..20: mol_type = other DNA
cagggcaatggggagccacg

SEQ ID NO: 41244 - DNA, 20 bp, synthetic construct
  misc_feature 1..20: note = CRISPR gRNA sequence
  source 1..20: mol_type = other DNA
agggcaatggggagccacgg

SEQ ID NO: 41245 - DNA, 20 bp, synthetic construct
  misc_feature 1..20: note = CRISPR gRNA sequence
  source 1..20: mol_type = other DNA
atggggagccacgggggtaa

SEQ ID NO: 41246 - DNA, 20 bp, synthetic construct
  misc_feature 1..20: note = CRISPR gRNA sequence
  source 1..20: mol_type = other DNA
tggggagccacgggggtaac

SEQ ID NO: 41247 - DNA, 20 bp, synthetic construct
  misc_feature 1..20: note = CRISPR gRNA sequence
  source 1..20: mol_type = other DNA
ggggagccacgggggtaaca

SEQ ID NO: 41248 - DNA, 20 bp, synthetic construct
  misc_feature 1..20: note = CRISPR gRNA sequence
  source 1..20: mol_type = other DNA
ggagccacgggggtaacagg

SEQ ID NO: 41249 - DNA, 20 bp, synthetic construct
  misc_feature 1..20: note = CRISPR gRNA sequence
  source 1..20: mol_type = other DNA
agccacgggggtaacaggga

SEQ ID NO: 41250 - DNA, 20 bp, synthetic construct
  misc_feature 1..20: note = CRISPR gRNA sequence
  source 1..20: mol_type = other DNA
gccacgggggtaacagggag

SEQ ID NO: 41251 - DNA, 20 bp, synthetic construct
  misc_feature 1..20: note = CRISPR gRNA sequence
  source 1..20: mol_type = other DNA
gggggtaacagggagaggcc

SEQ ID NO: 41252 - DNA, 20 bp, synthetic construct
  misc_feature 1..20: note = CRISPR gRNA sequence
  source 1..20: mol_type = other DNA
gtaacagggagaggcctggt

SEQ ID NO: 41253 - DNA, 20 bp, synthetic construct
  misc_feature 1..20: note = CRISPR gRNA sequence
  source 1..20: mol_type = other DNA
gagaggcctggtcagatgtg

SEQ ID NO: 41254 - DNA, 20 bp, synthetic construct
  misc_feature 1..20: note = CRISPR gRNA sequence
  source 1..20: mol_type = other DNA
gatgtgcagtgttaaaatgt

SEQ ID NO: 41255 - DNA, 20 bp, synthetic construct
  misc_feature 1..20: note = CRISPR gRNA sequence
  source 1..20: mol_type = other DNA
gttaaaatgtgagacacttg

SEQ ID NO: 41256 - DNA, 20 bp, synthetic construct
  misc_feature 1..20: note = CRISPR gRNA sequence
  source 1..20: mol_type = other DNA
ttaaaatgtgagacacttgt

SEQ ID NO: 41257 - DNA, 20 bp, synthetic construct
  misc_feature 1..20: note = CRISPR gRNA sequence
  source 1..20: mol_type = other DNA
taaaatgtgagacacttgtg

SEQ ID NO: 41258 - DNA, 20 bp, synthetic construct
  misc_feature 1..20: note = CRISPR gRNA sequence
  source 1..20: mol_type = other DNA
aatgtgagacacttgtgggg

SEQ ID NO: 41259 - DNA, 20 bp, synthetic construct
  misc_feature 1..20: note = CRISPR gRNA sequence
  source 1..20: mol_type = other DNA
tgtgagacacttgtggggca

SEQ ID NO: 41260 - DNA, 20 bp, synthetic construct
  misc_feature 1..20: note = CRISPR gRNA sequence
  source 1..20: mol_type = other DNA
tgagacacttgtggggcaga

SEQ ID NO: 41261 - DNA, 20 bp, synthetic construct
  misc_feature 1..20: note = CRISPR gRNA sequence
  source 1..20: mol_type = other DNA
gagacacttgtggggcagag

SEQ ID NO: 41262 - DNA, 20 bp, synthetic construct
  misc_feature 1..20: note = CRISPR gRNA sequence
  source 1..20: mol_type = other DNA
agacacttgtggggcagaga

SEQ ID NO: 41263 - DNA, 20 bp, synthetic construct
  misc_feature 1..20: note = CRISPR gRNA sequence
  source 1..20: mol_type = other DNA
tgtggggcagagagggatta

SEQ ID NO: 41264 - DNA, 20 bp, synthetic construct
  misc_feature 1..20: note = CRISPR gRNA sequence
  source 1..20: mol_type = other DNA
gtggggcagagagggattaa

SEQ ID NO: 41265 - DNA, 20 bp, synthetic construct
  misc_feature 1..20: note = CRISPR gRNA sequence
  source 1..20: mol_type = other DNA
tggggcagagagggattaaa

SEQ ID NO: 41266 - DNA, 20 bp, synthetic construct
  misc_feature 1..20: note = CRISPR gRNA sequence
  source 1..20: mol_type = other DNA
gggcagagagggattaaagg

SEQ ID NO: 41267 - DNA, 20 bp, synthetic construct
  misc_feature 1..20: note = CRISPR gRNA sequence
  source 1..20: mol_type = other DNA
ggcagagagggattaaaggg

SEQ ID NO: 41268 - DNA, 20 bp, synthetic construct
  misc_feature 1..20: note = CRISPR gRNA sequence
  source 1..20: mol_type = other DNA
gagagggattaaagggaggc

SEQ ID NO: 41269 - DNA, 20 bp, synthetic construct
  misc_feature 1..20: note = CRISPR gRNA sequence
  source 1..20: mol_type = other DNA
gagggattaaagggaggcaa

SEQ ID NO: 41270 - DNA, 20 bp, synthetic construct
  misc_feature 1..20: note = CRISPR gRNA sequence
  source 1..20: mol_type = other DNA
ggattaaagggaggcaagag

SEQ ID NO: 41271 - DNA, 20 bp, synthetic construct
  misc_feature 1..20: note = CRISPR gRNA sequence
  source 1..20: mol_type = other DNA
ttaaagggaggcaagagtgg

SEQ ID NO: 41272 - DNA, 20 bp, synthetic construct
  misc_feature 1..20: note = CRISPR gRNA sequence
  source 1..20: mol_type = other DNA
gggaggcaagagtggaagcc

SEQ ID NO: 41273 - DNA, 20 bp, synthetic construct
  misc_feature 1..20: note = CRISPR gRNA sequence
  source 1..20: mol_type = other DNA
gaggcaagagtggaagccca

SEQ ID NO: 41274 - DNA, 20 bp, synthetic construct
  misc_feature 1..20: note = CRISPR gRNA sequence
  source 1..20: mol_type = other DNA
aggcaagagtggaagcccag

SEQ ID NO: 41275 - DNA, 20 bp, synthetic construct
  misc_feature 1..20: note = CRISPR gRNA sequence
  source 1..20: mol_type = other DNA
ggcaagagtggaagcccaga

SEQ ID NO: 41276 - DNA, 20 bp, synthetic construct
  misc_feature 1..20: note = CRISPR gRNA sequence
  source 1..20: mol_type = other DNA
gaagcccagagggtgttaaa

SEQ ID NO: 41277 - DNA, 20 bp, synthetic construct
  misc_feature 1..20: note = CRISPR gRNA sequence
  source 1..20: mol_type = other DNA
ccagagggtgttaaatggtc

SEQ ID NO: 41278 - DNA, 20 bp, synthetic construct
  misc_feature 1..20: note = CRISPR gRNA sequence
  source 1..20: mol_type = other DNA
cagagggtgttaaatggtca

SEQ ID NO: 41279 - DNA, 20 bp, synthetic construct
  misc_feature 1..20: note = CRISPR gRNA sequence
  source 1..20: mol_type = other DNA
gggtgttaaatggtcaaggt

SEQ ID NO: 41280 - DNA, 20 bp, synthetic construct
  misc_feature 1..20: note = CRISPR gRNA sequence
  source 1..20: mol_type = other DNA
gttaaatggtcaaggtgagt

SEQ ID NO: 41281 - DNA, 20 bp, synthetic construct
  misc_feature 1..20: note = CRISPR gRNA sequence
  source 1..20: mol_type = other DNA
ttaaatggtcaaggtgagtg

SEQ ID NO: 41282 - DNA, 20 bp, synthetic construct
  misc_feature 1..20: note = CRISPR gRNA sequence
  source 1..20: mol_type = other DNA
atggtcaaggtgagtgagga

SEQ ID NO: 41283 - DNA, 20 bp, synthetic construct
  misc_feature 1..20: note = CRISPR gRNA sequence
  source 1..20: mol_type = other DNA
gtcaaggtgagtgaggatgg

SEQ ID NO: 41284 - DNA, 20 bp, synthetic construct
  misc_feature 1..20: note = CRISPR gRNA sequence
  source 1..20: mol_type = other DNA
ggtgagtgaggatggtggcc

SEQ ID NO: 41285 - DNA, 20 bp, synthetic construct
  misc_feature 1..20: note = CRISPR gRNA sequence
  source 1..20: mol_type = other DNA
gtgagtgaggatggtggcct

SEQ ID NO: 41286 - DNA, 20 bp, synthetic construct
  misc_feature 1..20: note = CRISPR gRNA sequence
  source 1..20: mol_type = other DNA
gaggatggtggcctgggctc

SEQ ID NO: 41287 - DNA, 20 bp, synthetic construct
  misc_feature 1..20: note = CRISPR gRNA sequence
  source 1..20: mol_type = other DNA
ggatggtggcctgggctctg

SEQ ID NO: 41288 - DNA, 20 bp, synthetic construct
  misc_feature 1..20: note = CRISPR gRNA sequence
  source 1..20: mol_type = other DNA
gatggtggcctgggctctgg

SEQ ID NO: 41289 - DNA, 20 bp, synthetic construct
  misc_feature 1..20: note = CRISPR gRNA sequence
  source 1..20: mol_type = other DNA
atggtggcctgggctctgga

SEQ ID NO: 41290 - DNA, 20 bp, synthetic construct
  misc_feature 1..20: note = CRISPR gRNA sequence
  source 1..20: mol_type = other DNA
tggtggcctgggctctggag

SEQ ID NO: 41291 - DNA, 20 bp, synthetic construct
  misc_feature 1..20: note = CRISPR gRNA sequence
  source 1..20: mol_type = other DNA
ggtggcctgggctctggagg

SEQ ID NO: 41292 - DNA, 20 bp, synthetic construct
  misc_feature 1..20: note = CRISPR gRNA sequence
  source 1..20: mol_type = other DNA
ggcctgggctctggaggggg

SEQ ID NO: 41293 - DNA, 20 bp, synthetic construct
  misc_feature 1..20: note = CRISPR gRNA sequence
  source 1..20: mol_type = other DNA
ctgggctctggagggggcgg

SEQ ID NO: 41294 - DNA, 20 bp, synthetic construct
  misc_feature 1..20: note = CRISPR gRNA sequence
  source 1..20: mol_type = other DNA
tgggctctggagggggcggt

SEQ ID NO: 41295 - DNA, 20 bp, synthetic construct
  misc_feature 1..20: note = CRISPR gRNA sequence
  source 1..20: mol_type = other DNA
gggctctggagggggcggtg

SEQ ID NO: 41296 - DNA, 20 bp, synthetic construct
  misc_feature 1..20: note = CRISPR gRNA sequence
  source 1..20: mol_type = other DNA
gctctggagggggcggtggg

SEQ ID NO: 41297 - DNA, 20 bp, synthetic construct
  misc_feature 1..20: note = CRISPR gRNA sequence
  source 1..20: mol_type = other DNA
ctctggagggggcggtgggg

SEQ ID NO: 41298 - DNA, 20 bp, synthetic construct
  misc_feature 1..20: note = CRISPR gRNA sequence
  source 1..20: mol_type = other DNA
agggggcggtggggaggact

SEQ ID NO: 41299 - DNA, 20 bp, synthetic construct
  misc_feature 1..20: note = CRISPR gRNA sequence
  source 1..20: mol_type = other DNA
ggggcggtggggaggacttg

SEQ ID NO: 41300 - DNA, 20 bp, synthetic construct
  misc_feature 1..20: note = CRISPR gRNA sequence
  source 1..20: mol_type = other DNA
ggcggtggggaggacttgga

SEQ ID NO: 41301 - DNA, 20 bp, synthetic construct
  misc_feature 1..20: note = CRISPR gRNA sequence
  source 1..20: mol_type = other DNA
ggacttggagagtcactgac

SEQ ID NO: 41302 - DNA, 20 bp, synthetic construct
  misc_feature 1..20: note = CRISPR gRNA sequence
  source 1..20: mol_type = other DNA
gacttggagagtcactgaca

SEQ ID NO: 41303 - DNA, 20 bp, synthetic construct
  misc_feature 1..20: note = CRISPR gRNA sequence
  source 1..20: mol_type = other DNA
acttggagagtcactgacaa

SEQ ID NO: 41304 - DNA, 20 bp, synthetic construct
  misc_feature 1..20: note = CRISPR gRNA sequence
  source 1..20: mol_type = other DNA
tggagagtcactgacaaggg

SEQ ID NO: 41305 - DNA, 20 bp, synthetic construct
  misc_feature 1..20: note = CRISPR gRNA sequence
  source 1..20: mol_type = other DNA
gagtcactgacaagggcagc

SEQ ID NO: 41306 - DNA, 20 bp, synthetic construct
  misc_feature 1..20: note = CRISPR gRNA sequence
  source 1..20: mol_type = other DNA
agtcactgacaagggcagct

SEQ ID NO: 41307 - DNA, 20 bp, synthetic construct
  misc_feature 1..20: note = CRISPR gRNA sequence
  source 1..20: mol_type = other DNA
gacaagggcagctgggaact

SEQ ID NO: 41308 - DNA, 20 bp, synthetic construct
  misc_feature 1..20: note = CRISPR gRNA sequence
  source 1..20: mol_type = other DNA
acaagggcagctgggaactc

SEQ ID NO: 41309 - DNA, 20 bp, synthetic construct
  misc_feature 1..20: note = CRISPR gRNA sequence
  source 1..20: mol_type = other DNA
caagggcagctgggaactca

SEQ ID NO: 41310 - DNA, 20 bp, synthetic construct
  misc_feature 1..20: note = CRISPR gRNA sequence
  source 1..20: mol_type = other DNA
gggtcctgcactgtcactgt

SEQ ID NO: 41311 - DNA, 20 bp, synthetic construct
  misc_feature 1..20: note = CRISPR gRNA sequence
  source 1..20: mol_type = other DNA
ggtcctgcactgtcactgtc

SEQ ID NO: 41312 - DNA, 20 bp, synthetic construct
  misc_feature 1..20: note = CRISPR gRNA sequence
  source 1..20: mol_type = other DNA
gtcctgcactgtcactgtca

SEQ ID NO: 41313 - DNA, 20 bp, synthetic construct
  misc_feature 1..20: note = CRISPR gRNA sequence
  source 1..20: mol_type = other DNA
ctgcactgtcactgtcaggg

SEQ ID NO: 41314 - DNA, 20 bp, synthetic construct
  misc_feature 1..20: note = CRISPR gRNA sequence
  source 1..20: mol_type = other DNA
tgcactgtcactgtcagggc

SEQ ID NO: 41315 - DNA, 20 bp, synthetic construct
  misc_feature 1..20: note = CRISPR gRNA sequence
  source 1..20: mol_type = other DNA
cactgtcactgtcagggcag

SEQ ID NO: 41316 - DNA, 20 bp, synthetic construct
  misc_feature 1..20: note = CRISPR gRNA sequence
  source 1..20: mol_type = other DNA
actgtcactgtcagggcagg

SEQ ID NO: 41317 - DNA, 20 bp, synthetic construct
  misc_feature 1..20: note = CRISPR gRNA sequence
  source 1..20: mol_type = other DNA
cactgtcagggcaggaggat

SEQ ID NO: 41318 - DNA, 20 bp, synthetic construct
  misc_feature 1..20: note = CRISPR gRNA sequence
  source 1..20: mol_type = other DNA
actgtcagggcaggaggatt

SEQ ID NO: 41319 - DNA, 20 bp, synthetic construct
  misc_feature 1..20: note = CRISPR gRNA sequence
  source 1..20: mol_type = other DNA
ctgtcagggcaggaggattg

SEQ ID NO: 41320 - DNA, 20 bp, synthetic construct
  misc_feature 1..20: note = CRISPR gRNA sequence
  source 1..20: mol_type = other DNA
tgtcagggcaggaggattgg

SEQ ID NO: 41321 - DNA, 20 bp, synthetic construct
  misc_feature 1..20: note = CRISPR gRNA sequence
  source 1..20: mol_type = other DNA
ggcaggaggattgggggctg

SEQ ID NO: 41322 - DNA, 20 bp, synthetic construct
  misc_feature 1..20: note = CRISPR gRNA sequence
  source 1..20: mol_type = other DNA
gcaggaggattgggggctgc

SEQ ID NO: 41323 - DNA, 20 bp, synthetic construct
  misc_feature 1..20: note = CRISPR gRNA sequence
  source 1..20: mol_type = other DNA
caggaggattgggggctgca

SEQ ID NO: 41324 - DNA, 20 bp, synthetic construct
  misc_feature 1..20: note = CRISPR gRNA sequence
  source 1..20: mol_type = other DNA
aggaggattgggggctgcag

SEQ ID NO: 41325 - DNA, 20 bp, synthetic construct
  misc_feature 1..20: note = CRISPR gRNA sequence
  source 1..20: mol_type = other DNA
gaggattgggggctgcaggg

SEQ ID NO: 41326 - DNA, 20 bp, synthetic construct
  misc_feature 1..20: note = CRISPR gRNA sequence
  source 1..20: mol_type = other DNA
gggggctgcaggggagactc

SEQ ID NO: 41327 - DNA, 20 bp, synthetic construct
  misc_feature 1..20: note = CRISPR gRNA sequence
  source 1..20: mol_type = other DNA
gggctgcaggggagactcga

SEQ ID NO: 41328 - DNA, 20 bp, synthetic construct
  misc_feature 1..20: note = CRISPR gRNA sequence
  source 1..20: mol_type = other DNA
ggctgcaggggagactcgag

SEQ ID NO: 41329 - DNA, 20 bp, synthetic construct
  misc_feature 1..20: note = CRISPR gRNA sequence
  source 1..20: mol_type = other DNA
gctgcaggggagactcgaga

SEQ ID NO: 41330 - DNA, 20 bp, synthetic construct
  misc_feature 1..20: note = CRISPR gRNA sequence
  source 1..20: mol_type = other DNA
gcaggggagactcgagaggg

SEQ ID NO: 41331 - DNA, 20 bp, synthetic construct
  misc_feature 1..20: note = CRISPR gRNA sequence
  source 1..20: mol_type = other DNA
gggagactcgagagggaagc

SEQ ID NO: 41332 - DNA, 20 bp, synthetic construct
  misc_feature 1..20: note = CRISPR gRNA sequence
  source 1..20: mol_type = other DNA
agagggaagcgagtgcccca

SEQ ID NO: 41333 - DNA, 20 bp, synthetic construct
  misc_feature 1..20: note = CRISPR gRNA sequence
  source 1..20: mol_type = other DNA
gagggaagcgagtgccccac

SEQ ID NO: 41334 - DNA, 20 bp, synthetic construct
  misc_feature 1..20: note = CRISPR gRNA sequence
  source 1..20: mol_type = other DNA
agggaagcgagtgccccaca

SEQ ID NO: 41335 - DNA, 20 bp, synthetic construct
  misc_feature 1..20: note = CRISPR gRNA sequence
  source 1..20: mol_type = other DNA
gggaagcgagtgccccacag

SEQ ID NO: 41336 - DNA, 20 bp, synthetic construct
  misc_feature 1..20: note = CRISPR gRNA sequence
  source 1..20: mol_type = other DNA
aagcgagtgccccacagggg

SEQ ID NO: 41337 - DNA, 20 bp, synthetic construct
  misc_feature 1..20: note = CRISPR gRNA sequence
  source 1..20: mol_type = other DNA
agcgagtgccccacagggga

SEQ ID NO: 41338 - DNA, 20 bp, synthetic construct
  misc_feature 1..20: note = CRISPR gRNA sequence
  source 1..20: mol_type = other DNA
gcgagtgccccacaggggaa

SEQ ID NO: 41339 - DNA, 20 bp, synthetic construct
  misc_feature 1..20: note = CRISPR gRNA sequence
  source 1..20: mol_type = other DNA
cgagtgccccacaggggaag

SEQ ID NO: 41340 - DNA, 20 bp, synthetic construct
  misc_feature 1..20: note = CRISPR gRNA sequence
  source 1..20: mol_type = other DNA
cccacaggggaaggggcctg

SEQ ID NO: 41341 - DNA, 20 bp, synthetic construct
  misc_feature 1..20: note = CRISPR gRNA sequence
  source 1..20: mol_type = other DNA
ggggcctgtggcctcccact

SEQ ID NO: 41342 - DNA, 20 bp, synthetic construct
  misc_feature 1..20: note = CRISPR gRNA sequence
  source 1..20: mol_type = other DNA
ggcctgtggcctcccactta

SEQ ID NO: 41343 - DNA, 20 bp, synthetic construct
  misc_feature 1..20: note = CRISPR gRNA sequence
  source 1..20: mol_type = other DNA
tgtggcctcccacttagagt

SEQ ID NO: 41344 - DNA, 20 bp, synthetic construct
  misc_feature 1..20: note = CRISPR gRNA sequence
  source 1..20: mol_type = other DNA
gtggcctcccacttagagtg

SEQ ID NO: 41345 - DNA, 20 bp, synthetic construct
  misc_feature 1..20: note = CRISPR gRNA sequence
  source 1..20: mol_type = other DNA
tggcctcccacttagagtga

SEQ ID NO: 41346 - DNA, 20 bp, synthetic construct
  misc_feature 1..20: note = CRISPR gRNA sequence
  source 1..20: mol_type = other DNA
ccacttagagtgagggatgc

SEQ ID NO: 41347 - DNA, 20 bp, synthetic construct
  misc_feature 1..20: note = CRISPR gRNA sequence
  source 1..20: mol_type = other DNA
cacttagagtgagggatgct

SEQ ID NO: 41348 - DNA, 20 bp, synthetic construct
  misc_feature 1..20: note = CRISPR gRNA sequence
  source 1..20: mol_type = other DNA
cttagagtgagggatgctgg

SEQ ID NO: 41349 - DNA, 20 bp, synthetic construct
  misc_feature 1..20: note = CRISPR gRNA sequence
  source 1..20: mol_type = other DNA
agagtgagggatgctgggag

SEQ ID NO: 41350 - DNA, 20 bp, synthetic construct
  misc_feature 1..20: note = CRISPR gRNA sequence
  source 1..20: mol_type = other DNA
gagtgagggatgctgggaga

SEQ ID NO: 41351 - DNA, 20 bp, synthetic construct
  misc_feature 1..20: note = CRISPR gRNA sequence
  source 1..20: mol_type = other DNA
gagggatgctgggagaagga

SEQ ID NO: 41352 - DNA, 20 bp, synthetic construct
  misc_feature 1..20: note = CRISPR gRNA sequence
  source 1..20: mol_type = other DNA
gggatgctgggagaaggata

SEQ ID NO: 41353 - DNA, 20 bp, synthetic construct
  misc_feature 1..20: note = CRISPR gRNA sequence
  source 1..20: mol_type = other DNA
tgggagaaggatagagcccc

SEQ ID NO: 41354 - DNA, 20 bp, synthetic construct
  misc_feature 1..20: note = CRISPR gRNA sequence
  source 1..20: mol_type = other DNA
gggagaaggatagagcccct

SEQ ID NO: 41355 - DNA, 20 bp, synthetic construct
  misc_feature 1..20: note = CRISPR gRNA sequence
  source 1..20: mol_type = other DNA
ggagaaggatagagcccctg

SEQ ID NO: 41356 - DNA, 20 bp, synthetic construct
  misc_feature 1..20: note = CRISPR gRNA sequence
  source 1..20: mol_type = other DNA
aaggatagagcccctggggc

SEQ ID NO: 41357 - DNA, 20 bp, synthetic construct
  misc_feature 1..20: note = CRISPR gRNA sequence
  source 1..20: mol_type = other DNA
atagagcccctggggctagc

SEQ ID NO: 41358 - DNA, 20 bp, synthetic construct
  misc_feature 1..20: note = CRISPR gRNA sequence
  source 1..20: mol_type = other DNA
tagagcccctggggctagcc

SEQ ID NO: 41359 - DNA, 20 bp, synthetic construct
  misc_feature 1..20: note = CRISPR gRNA sequence
  source 1..20: mol_type = other DNA
agagcccctggggctagcca

SEQ ID NO: 41360 - DNA, 20 bp, synthetic construct
  misc_feature 1..20: note = CRISPR gRNA sequence
  source 1..20: mol_type = other DNA
ctggggctagccagggaccc

SEQ ID NO: 41361 - DNA, 20 bp, synthetic construct
  misc_feature 1..20: note = CRISPR gRNA sequence
  source 1..20: mol_type = other DNA
tggggctagccagggaccct

SEQ ID NO: 41362 - DNA, 20 bp, synthetic construct
  misc_feature 1..20: note = CRISPR gRNA sequence
  source 1..20: mol_type = other DNA
ccctgcccattgcccctttg

SEQ ID NO: 41363 - DNA, 20 bp, synthetic construct
  misc_feature 1..20: note = CRISPR gRNA sequence
  source 1..20: mol_type = other DNA
ccattgcccctttgcagcct

SEQ ID NO: 41364 - DNA, 20 bp, synthetic construct
  misc_feature 1..20: note = CRISPR gRNA sequence
  source 1..20: mol_type = other DNA
tgcccctttgcagcctcagt

SEQ ID NO: 41365 - DNA, 20 bp, synthetic construct
  misc_feature 1..20: note = CRISPR gRNA sequence
  source 1..20: mol_type = other DNA
cagcctcagtgagtgtcctc

SEQ ID NO: 41366 - DNA, 20 bp, synthetic construct
  misc_feature 1..20: note = CRISPR gRNA sequence
  source 1..20: mol_type = other DNA
gcctcagtgagtgtcctctg

SEQ ID NO: 41367 - DNA, 20 bp, synthetic construct
  misc_feature 1..20: note = CRISPR gRNA sequence
  source 1..20: mol_type = other DNA
gagtgtcctctggagccccc

SEQ ID NO: 41368 - DNA, 20 bp, synthetic construct
  misc_feature 1..20: note = CRISPR gRNA sequence
  source 1..20: mol_type = other DNA
cccgcctctgtgccactctg

SEQ ID NO: 41369 - DNA, 20 bp, synthetic construct
  misc_feature 1..20: note = CRISPR gRNA sequence
  source 1..20: mol_type = other DNA
ccgcctctgtgccactctga

SEQ ID NO: 41370 - DNA, 20 bp, synthetic construct
  misc_feature 1..20: note = CRISPR gRNA sequence
  source 1..20: mol_type = other DNA
tgccactctgaaggactgcc

SEQ ID NO: 41371 - DNA, 20 bp, synthetic construct
  misc_feature 1..20: note = CRISPR gRNA sequence
  source 1..20: mol_type = other DNA
gccactctgaaggactgccc

SEQ ID NO: 41372 - DNA, 20 bp, synthetic construct
  misc_feature 1..20: note = CRISPR gRNA sequence
  source 1..20: mol_type = other DNA
gaaggactgcccgggacccc

SEQ ID NO: 41373 - DNA, 20 bp, synthetic construct
  misc_feature 1..20: note = CRISPR gRNA sequence
  source 1..20: mol_type = other DNA
gcccgggacccctggaactg

SEQ ID NO: 41374 - DNA, 20 bp, synthetic construct
  misc_feature 1..20: note = CRISPR gRNA sequence
  source 1..20: mol_type = other DNA
gggacccctggaactgcagt

SEQ ID NO: 41375 - DNA, 20 bp, synthetic construct
  misc_feature 1..20: note = CRISPR gRNA sequence
  source 1..20: mol_type = other DNA
ctggaactgcagtaagtaac

SEQ ID NO: 41376 - DNA, 20 bp, synthetic construct
  misc_feature 1..20: note = CRISPR gRNA sequence
  source 1..20: mol_type = other DNA
tggaactgcagtaagtaacg

SEQ ID NO: 41377 - DNA, 20 bp, synthetic construct
  misc_feature 1..20: note = CRISPR gRNA sequence
  source 1..20: mol_type = other DNA
tgcagtaagtaacgaggaca

SEQ ID NO: 41378 - DNA, 20 bp, synthetic construct
  misc_feature 1..20: note = CRISPR gRNA sequence
  source 1..20: mol_type = other DNA
aagtaacgaggacacagccc

SEQ ID NO: 41379 - DNA, 20 bp, synthetic construct
  misc_feature 1..20: note = CRISPR gRNA sequence
  source 1..20: mol_type = other DNA
gtaacgaggacacagcccca

SEQ ID NO: 41380 - DNA, 20 bp, synthetic construct
  misc_feature 1..20: note = CRISPR gRNA sequence
  source 1..20: mol_type = other DNA
taacgaggacacagccccag

SEQ ID NO: 41381 - DNA, 20 bp, synthetic construct
  misc_feature 1..20: note = CRISPR gRNA sequence
  source 1..20: mol_type = other DNA
aacgaggacacagccccaga

SEQ ID NO: 41382 - DNA, 20 bp, synthetic construct
  misc_feature 1..20: note = CRISPR gRNA sequence
  source 1..20: mol_type = other DNA
cagccccagagggcaccatg

SEQ ID NO: 41383 - DNA, 20 bp, synthetic construct
  misc_feature 1..20: note = CRISPR gRNA sequence
  source 1..20: mol_type = other DNA
agccccagagggcaccatgt

SEQ ID NO: 41384 - DNA, 20 bp, synthetic construct
  misc_feature 1..20: note = CRISPR gRNA sequence
  source 1..20: mol_type = other DNA
gccccagagggcaccatgtg

SEQ ID NO: 41385 - DNA, 20 bp, synthetic construct
  misc_feature 1..20: note = CRISPR gRNA sequence
  source 1..20: mol_type = other DNA
gcaccatgtggggatctgcc

SEQ ID NO: 41386 - DNA, 20 bp, synthetic construct
  misc_feature 1..20: note = CRISPR gRNA sequence
  source 1..20: mol_type = other DNA
tggggatctgcccagtgacc

SEQ ID NO: 41387 - DNA, 20 bp, synthetic construct
  misc_feature 1..20: note = CRISPR gRNA sequence
  source 1..20: mol_type = other DNA
ggggatctgcccagtgacct

SEQ ID NO: 41388 - DNA, 20 bp, synthetic construct
  misc_feature 1..20: note = CRISPR gRNA sequence
  source 1..20: mol_type = other DNA
ggatctgcccagtgacctgg

SEQ ID NO: 41389 - DNA, 20 bp, synthetic construct
  misc_feature 1..20: note = CRISPR gRNA sequence
  source 1..20: mol_type = other DNA
gatctgcccagtgacctggg

SEQ ID NO: 41390 - DNA, 20 bp, synthetic construct
  misc_feature 1..20: note = CRISPR gRNA sequence
  source 1..20: mol_type = other DNA
atctgcccagtgacctggga

SEQ ID NO: 41391 - DNA, 20 bp, synthetic construct
  misc_feature 1..20: note = CRISPR gRNA sequence
  source 1..20: mol_type = other DNA
tctgcccagtgacctgggag

SEQ ID NO: 41392 - DNA, 20 bp, synthetic construct
  misc_feature 1..20: note = CRISPR gRNA sequence
  source 1..20: mol_type = other DNA
ctgcccagtgacctgggagg

SEQ ID NO: 41393 - DNA, 20 bp, synthetic construct
  misc_feature 1..20: note = CRISPR gRNA sequence
  source 1..20: mol_type = other DNA
tgacctgggagggggcttct

SEQ ID NO: 41394 - DNA, 20 bp, synthetic construct
  misc_feature 1..20: note = CRISPR gRNA sequence
  source 1..20: mol_type = other DNA
ctgggagggggcttcttggt

SEQ ID NO: 41395 - DNA, 20 bp, synthetic construct
  misc_feature 1..20: note = CRISPR gRNA sequence
  source 1..20: mol_type = other DNA
ggagggggcttcttggttag

SEQ ID NO: 41396 - DNA, 20 bp, synthetic construct
  misc_feature 1..20: note = CRISPR gRNA sequence
  source 1..20: mol_type = other DNA
ggggcttcttggttagaaga

SEQ ID NO: 41397 - DNA, 20 bp, synthetic construct
  misc_feature 1..20: note = CRISPR gRNA sequence
  source 1..20: mol_type = other DNA
gggcttcttggttagaagac

SEQ ID NO: 41398 - DNA, 20 bp, synthetic construct
  misc_feature 1..20: note = CRISPR gRNA sequence
  source 1..20: mol_type = other DNA
ttcttggttagaagacaggt

SEQ ID NO: 41399 - DNA, 20 bp, synthetic construct
  misc_feature 1..20: note = CRISPR gRNA sequence
  source 1..20: mol_type = other DNA
ctttctcgatttcttcccac

SEQ ID NO: 41400 - DNA, 20 bp, synthetic construct
  misc_feature 1..20: note = CRISPR gRNA sequence
  source 1..20: mol_type = other DNA
tcccaccagccctgccccat

SEQ ID NO: 41401 - DNA, 20 bp, synthetic construct
  misc_feature 1..20: note = CRISPR gRNA sequence
  source 1..20: mol_type = other DNA
ccaccagccctgccccatga

SEQ ID NO: 41402 - DNA, 20 bp, synthetic construct
  misc_feature 1..20: note = CRISPR gRNA sequence
  source 1..20: mol_type = other DNA
cctgccccatgagagtcccc

SEQ ID NO: 41403 - DNA, 20 bp, synthetic construct
  misc_feature 1..20: note = CRISPR gRNA sequence
  source 1..20: mol_type = other DNA
catgagagtcccctggcctt

SEQ ID NO: 41404 - DNA, 20 bp, synthetic construct
  misc_feature 1..20: note = CRISPR gRNA sequence
  source 1..20: mol_type = other DNA
gagagtcccctggcctttgg

SEQ ID NO: 41405 - DNA, 20 bp, synthetic construct
  misc_feature 1..20: note = CRISPR gRNA sequence
  source 1..20: mol_type = other DNA
cctggcctttggtagaaact

SEQ ID NO: 41406 - DNA, 20 bp, synthetic construct
  misc_feature 1..20: note = CRISPR gRNA sequence
  source 1..20: mol_type = other DNA
gtagaaacttggctgtctct

SEQ ID NO: 41407 - DNA, 20 bp, synthetic construct
  misc_feature 1..20: note = CRISPR gRNA sequence
  source 1..20: mol_type = other DNA
gaaacttggctgtctctcgg

SEQ ID NO: 41408 - DNA, 20 bp, synthetic construct
  misc_feature 1..20: note = CRISPR gRNA sequence
  source 1..20: mol_type = other DNA
ggctgtctctcggcagcccc

SEQ ID NO: 41409 - DNA, 20 bp, synthetic construct
  misc_feature 1..20: note = CRISPR gRNA sequence
  source 1..20: mol_type = other DNA
ctctcggcagcccccagcct

SEQ ID NO: 41410 - DNA, 20 bp, synthetic construct
  misc_feature 1..20: note = CRISPR gRNA sequence
  source 1..20: mol_type = other DNA
tctcggcagcccccagcctt

SEQ ID NO: 41411 - DNA, 20 bp, synthetic construct
  misc_feature 1..20: note = CRISPR gRNA sequence
  source 1..20: mol_type = other DNA
cggcagcccccagccttagg

SEQ ID NO: 41412 - DNA, 20 bp, synthetic construct
  misc_feature 1..20: note = CRISPR gRNA sequence
  source 1..20: mol_type = other DNA
aggcagcgcatgtctcccac

SEQ ID NO: 41413 - DNA, 20 bp, synthetic construct
  misc_feature 1..20: note = CRISPR gRNA sequence
  source 1..20: mol_type = other DNA
ggcagcgcatgtctcccact

SEQ ID NO: 41414 - DNA, 20 bp, synthetic construct
  misc_feature 1..20: note = CRISPR gRNA sequence
  source 1..20: mol_type = other DNA
cagcgcatgtctcccactgg

SEQ ID NO: 41415 - DNA, 20 bp, synthetic construct
  misc_feature 1..20: note = CRISPR gRNA sequence
  source 1..20: mol_type = other DNA
cccactgggagatgctgtgc

SEQ ID NO: 41416 - DNA, 20 bp, synthetic construct
  misc_feature 1..20: note = CRISPR gRNA sequence
  source 1..20: mol_type = other DNA
tgggagatgctgtgctggac

SEQ ID NO: 41417 - DNA, 20 bp, synthetic construct
  misc_feature 1..20: note = CRISPR gRNA sequence
  source 1..20: mol_type = other DNA
gggagatgctgtgctggact

SEQ ID NO: 41418 - DNA, 20 bp, synthetic construct
  misc_feature 1..20: note = CRISPR gRNA sequence
  source 1..20: mol_type = other DNA
ggagatgctgtgctggactg

SEQ ID NO: 41419 - DNA, 20 bp, synthetic construct
  misc_feature 1..20: note = CRISPR gRNA sequence
  source 1..20: mol_type = other DNA
gatgctgtgctggactgggg

SEQ ID NO: 41420 - DNA, 20 bp, synthetic construct
  misc_feature 1..20: note = CRISPR gRNA sequence
  source 1..20: mol_type = other DNA
cctgcaccatccactcaact

SEQ ID NO: 41421 - DNA, 20 bp, synthetic construct
  misc_feature 1..20: note = CRISPR gRNA sequence
  source 1..20: mol_type = other DNA
ctgcaccatccactcaactc

SEQ ID NO: 41422 - DNA, 20 bp, synthetic construct
  misc_feature 1..20: note = CRISPR gRNA sequence
  source 1..20: mol_type = other DNA
tgcaccatccactcaactca

SEQ ID NO: 41423 - DNA, 20 bp, synthetic construct
  misc_feature 1..20: note = CRISPR gRNA sequence
  source 1..20: mol_type = other DNA
tccactcaactcagggcacc

SEQ ID NO: 41424 - DNA, 20 bp, synthetic construct
  misc_feature 1..20: note = CRISPR gRNA sequence
  source 1..20: mol_type = other DNA
ccactcaactcagggcacct

SEQ ID NO: 41425 - DNA, 20 bp, synthetic construct
  misc_feature 1..20: note = CRISPR gRNA sequence
  source 1..20: mol_type = other DNA
actcaactcagggcacctgg

SEQ ID NO: 41426 - DNA, 20 bp, synthetic construct
  misc_feature 1..20: note = CRISPR gRNA sequence
  source 1..20: mol_type = other DNA
tccacctccaaccccacccc

SEQ ID NO: 41427 - DNA, 20 bp, synthetic construct
  misc_feature 1..20: note = CRISPR gRNA sequence
  source 1..20: mol_type = other DNA
cacctccaaccccacccctg

SEQ ID NO: 41428 - DNA, 20 bp, synthetic construct
  misc_feature 1..20: note = CRISPR gRNA sequence
  source 1..20: mol_type = other DNA
ccccacccctggagcctcac

SEQ ID NO: 41429 - DNA, 20 bp, synthetic construct
  misc_feature 1..20: note = CRISPR gRNA sequence
  source 1..20: mol_type = other DNA
cccacccctggagcctcacc

SEQ ID NO: 41430 - DNA, 20 bp, synthetic construct
  misc_feature 1..20: note = CRISPR gRNA sequence
  source 1..20: mol_type = other DNA
ccacccctggagcctcacca

SEQ ID NO: 41431 - DNA, 20 bp, synthetic construct
  misc_feature 1..20: note = CRISPR gRNA sequence
  source 1..20: mol_type = other DNA
cccacttgaacctgcctgca

SEQ ID NO: 41432 - DNA, 20 bp, synthetic construct
  misc_feature 1..20: note = CRISPR gRNA sequence
  source 1..20: mol_type = other DNA
cttgaacctgcctgcatggc

SEQ ID NO: 41433 - DNA, 20 bp, synthetic construct
  misc_feature 1..20: note = CRISPR gRNA sequence
  source 1..20: mol_type = other DNA
tgaacctgcctgcatggctg

SEQ ID NO: 41434 - DNA, 20 bp, synthetic construct
  misc_feature 1..20: note = CRISPR gRNA sequence
  source 1..20: mol_type = other DNA
ctgcctgcatggctggagcg

SEQ ID NO: 41435 - DNA, 20 bp, synthetic construct
  misc_feature 1..20: note = CRISPR gRNA sequence
  source 1..20: mol_type = other DNA
ctggagcgtagcacttctga

SEQ ID NO: 41436 - DNA, 20 bp, synthetic construct
  misc_feature 1..20: note = CRISPR gRNA sequence
  source 1..20: mol_type = other DNA
acttctgaaagcccttcctc

SEQ ID NO: 41437 - DNA, 20 bp, synthetic construct
  misc_feature 1..20: note = CRISPR gRNA sequence
  source 1..20: mol_type = other DNA
cttctgaaagcccttcctca

SEQ ID NO: 41438 - DNA, 20 bp, synthetic construct
  misc_feature 1..20: note = CRISPR gRNA sequence
  source 1..20: mol_type = other DNA
caaggcacccccactctcct

SEQ ID NO: 41439 - DNA, 20 bp, synthetic construct
  misc_feature 1..20: note = CRISPR gRNA sequence
  source 1..20: mol_type = other DNA
aaggcacccccactctcctt

SEQ ID NO: 41440 - DNA, 20 bp, synthetic construct
  misc_feature 1..20: note = CRISPR gRNA sequence
  source 1..20: mol_type = other DNA
aggcacccccactctccttg

SEQ ID NO: 41441 - DNA, 20 bp, synthetic construct
  misc_feature 1..20: note = CRISPR gRNA sequence
  source 1..20: mol_type = other DNA
ggttaccacctcactcgccc

SEQ ID NO: 41442 - DNA, 20 bp, synthetic construct
  misc_feature 1..20: note = CRISPR gRNA sequence
  source 1..20: mol_type = other DNA
ctcactcgccccagaacatc

SEQ ID NO: 41443 - DNA, 20 bp, synthetic construct
  misc_feature 1..20: note = CRISPR gRNA sequence
  source 1..20: mol_type = other DNA
tcactcgccccagaacatct

SEQ ID NO: 41444 - DNA, 20 bp, synthetic construct
  misc_feature 1..20: note = CRISPR gRNA sequence
  source 1..20: mol_type = other DNA
agaacatctgggtctgtaac

SEQ ID NO: 41445 - DNA, 20 bp, synthetic construct
  misc_feature 1..20: note = CRISPR gRNA sequence
  source 1..20: mol_type = other DNA
aacatctgggtctgtaacca

SEQ ID NO: 41446 - DNA, 20 bp, synthetic construct
  misc_feature 1..20: note = CRISPR gRNA sequence
  source 1..20: mol_type = other DNA
ctgggtctgtaaccagagac

SEQ ID NO: 41447 - DNA, 20 bp, synthetic construct
  misc_feature 1..20: note = CRISPR gRNA sequence
  source 1..20: mol_type = other DNA
ctgtaaccagagactggacc

SEQ ID NO: 41448 - DNA, 20 bp, synthetic construct
  misc_feature 1..20: note = CRISPR gRNA sequence
  source 1..20: mol_type = other DNA
ccagagactggacctggaat

SEQ ID NO: 41449 - DNA, 20 bp, synthetic construct
  misc_feature 1..20: note = CRISPR gRNA sequence
  source 1..20: mol_type = other DNA
cagagactggacctggaatc

SEQ ID NO: 41450 - DNA, 20 bp, synthetic construct
  misc_feature 1..20: note = CRISPR gRNA sequence
  source 1..20: mol_type = other DNA
ggacctggaatcaggactct

SEQ ID NO: 41451 - DNA, 20 bp, synthetic construct
  misc_feature 1..20: note = CRISPR gRNA sequence
  source 1..20: mol_type = other DNA
aatcaggactcttggctcaa

SEQ ID NO: 41452 - DNA, 20 bp, synthetic construct
  misc_feature 1..20: note = CRISPR gRNA sequence
  source 1..20: mol_type = other DNA
atcaggactcttggctcaaa

SEQ ID NO: 41453 - DNA, 20 bp, synthetic construct
  misc_feature 1..20: note = CRISPR gRNA sequence
  source 1..20: mol_type = other DNA
tcaggactcttggctcaaaa

SEQ ID NO: 41454 - DNA, 20 bp, synthetic construct
  misc_feature 1..20: note = CRISPR gRNA sequence
  source 1..20: mol_type = other DNA
tcaaaagggatttaactccc

SEQ ID NO: 41455 - DNA, 20 bp, synthetic construct
  misc_feature 1..20: note = CRISPR gRNA sequence
  source 1..20: mol_type = other DNA
caaaagggatttaactcccc

SEQ ID NO: 41456 - DNA, 20 bp, synthetic construct
  misc_feature 1..20: note = CRISPR gRNA sequence
  source 1..20: mol_type = other DNA
ggatttaactccccgggcct

SEQ ID NO: 41457 - DNA, 20 bp, synthetic construct
  misc_feature 1..20: note = CRISPR gRNA sequence
  source 1..20: mol_type = other DNA
cctcagcttcttcatctgca

SEQ ID NO: 41458 - DNA, 20 bp, synthetic construct
  misc_feature 1..20: note = CRISPR gRNA sequence
  source 1..20: mol_type = other DNA
cagcttcttcatctgcacag

SEQ ID NO: 41459 - DNA, 20 bp, synthetic construct
  misc_feature 1..20: note = CRISPR gRNA sequence
  source 1..20: mol_type = other DNA
ttcttcatctgcacagtgga

SEQ ID NO: 41460 - DNA, 20 bp, synthetic construct
  misc_feature 1..20: note = CRISPR gRNA sequence
  source 1..20: mol_type = other DNA
tcatctgcacagtggatggt

SEQ ID NO: 41461 - DNA, 20 bp, synthetic construct
  misc_feature 1..20: note = CRISPR gRNA sequence
  source 1..20: mol_type = other DNA
ctttccttttattgtcattg

SEQ ID NO: 41462 - DNA, 20 bp, synthetic construct
  misc_feature 1..20: note = CRISPR gRNA sequence
  source 1..20: mol_type = other DNA
tcattgtggtgattctatta

SEQ ID NO: 41463 - DNA, 20 bp, synthetic construct
  misc_feature 1..20: note = CRISPR gRNA sequence
  source 1..20: mol_type = other DNA
atagtaattaccttaaaata

SEQ ID NO: 41464 - DNA, 20 bp, synthetic construct
  misc_feature 1..20: note = CRISPR gRNA sequence
  source 1..20: mol_type = other DNA
accttaaaataaagaaatcc

SEQ ID NO: 41465 - DNA, 20 bp, synthetic construct
  misc_feature 1..20: note = CRISPR gRNA sequence
  source 1..20: mol_type = other DNA
tccatgttgtcatgtgtcca

SEQ ID NO: 41466 - DNA, 20 bp, synthetic construct
  misc_feature 1..20: note = CRISPR gRNA sequence
  source 1..20: mol_type = other DNA
ccatgttgtcatgtgtccac

SEQ ID NO: 41467 - DNA, 20 bp, synthetic construct
  misc_feature 1..20: note = CRISPR gRNA sequence
  source 1..20: mol_type = other DNA
tccttgcctatttgcatatt

SEQ ID NO: 41468 - DNA, 20 bp, synthetic construct
  misc_feature 1..20: note = CRISPR gRNA sequence
  source 1..20: mol_type = other DNA
attcagtttctacctgtttg

SEQ ID NO: 41469 - DNA, 20 bp, synthetic construct
  misc_feature 1..20: note = CRISPR gRNA sequence
  source 1..20: mol_type = other DNA
acctgtttgcagtcataaac

SEQ ID NO: 41470 - DNA, 20 bp, synthetic construct
  misc_feature 1..20: note = CRISPR gRNA sequence
  source 1..20: mol_type = other DNA
tttcatgcactgtgttttca

SEQ ID NO: 41471 - DNA, 20 bp, synthetic construct
  misc_feature 1..20: note = CRISPR gRNA sequence
  source 1..20: mol_type = other DNA
ctgtgttttccattttgctt

SEQ ID NO: 41472 - DNA, 20 bp, synthetic construct
  misc_feature 1..20: note = CRISPR gRNA sequence
  source 1..20: mol_type = other DNA
cagtcttttttcttgctttc

SEQ ID NO: 41473 - DNA, 20 bp, synthetic construct
  misc_feature 1..20: note = CRISPR gRNA sequence
  source 1..20: mol_type = other DNA
ccccatctcaaatgcccttc

SEQ ID NO: 41474 - DNA, 20 bp, synthetic construct
  misc_feature 1..20: note = CRISPR gRNA sequence
  source 1..20: mol_type = other DNA
gcccttccagcccttccaac

SEQ ID NO: 41475 - DNA, 20 bp, synthetic construct
  misc_feature 1..20: note = CRISPR gRNA sequence
  source 1..20: mol_type = other DNA
gcccttccaaccagataatc

SEQ ID NO: 41476 - DNA, 20 bp, synthetic construct
  misc_feature 1..20: note = CRISPR gRNA sequence
  source 1..20: mol_type = other DNA
gataatccggtttgaccccc

SEQ ID NO: 41477 - DNA, 20 bp, synthetic construct
  misc_feature 1..20: note = CRISPR gRNA sequence
  source 1..20: mol_type = other DNA
taatccggtttgaccccctg

SEQ ID NO: 41478 - DNA, 20 bp, synthetic construct
  misc_feature 1..20: note = CRISPR gRNA sequence
  source 1..20: mol_type = other DNA
cggtttgaccccctggagtg

SEQ ID NO: 41479 - DNA, 20 bp, synthetic construct
  misc_feature 1..20: note = CRISPR gRNA sequence
  source 1..20: mol_type = other DNA
ggccttcccatgtccttctc

SEQ ID NO: 41480 - DNA, 20 bp, synthetic construct
  misc_feature 1..20: note = CRISPR gRNA sequence
  source 1..20: mol_type = other DNA
gccttcccatgtccttctcc

SEQ ID NO: 41481 - DNA, 20 bp, synthetic construct
  misc_feature 1..20: note = CRISPR gRNA sequence
  source 1..20: mol_type = other DNA
tataaccacaaaaccattat

SEQ ID NO: 41482 - DNA, 20 bp, synthetic construct
  misc_feature 1..20: note = CRISPR gRNA sequence
  source 1..20: mol_type = other DNA
ctacactattttttttttct

SEQ ID NO: 41483 - DNA, 20 bp, synthetic construct
  misc_feature 1..20: note = CRISPR gRNA sequence
  source 1..20: mol_type = other DNA
actattttttttttctgaga

SEQ ID NO: 41484 - DNA, 20 bp, synthetic construct
  misc_feature 1..20: note = CRISPR gRNA sequence
  source 1..20: mol_type = other DNA
tattttttttttctgagaca

SEQ ID NO: 41485 - DNA, 20 bp, synthetic construct
  misc_feature 1..20: note = CRISPR gRNA sequence
  source 1..20: mol_type = other DNA
agagttttgctcttgttgcc

SEQ ID NO: 41486 - DNA, 20 bp, synthetic construct
  misc_feature 1..20: note = CRISPR gRNA sequence
  source 1..20: mol_type = other DNA
gagttttgctcttgttgccc

SEQ ID NO: 41487 - DNA, 20 bp, synthetic construct
  misc_feature 1..20: note = CRISPR gRNA sequence
  source 1..20: mol_type = other DNA
tttgctcttgttgcccaggc

SEQ ID NO: 41488 - DNA, 20 bp, synthetic construct
  misc_feature 1..20: note = CRISPR gRNA sequence
  source 1..20: mol_type = other DNA
tgctcttgttgcccaggctg

SEQ ID NO: 41489 - DNA, 20 bp, synthetic construct
  misc_feature 1..20: note = CRISPR gRNA sequence
  source 1..20: mol_type = other DNA
ttgcccaggctggagtgcaa

SEQ ID NO: 41490 - DNA, 20 bp, synthetic construct
  misc_feature 1..20: note = CRISPR gRNA sequence
  source 1..20: mol_type = other DNA
ggagtgcaatggcgtgatct

SEQ ID NO: 41491 - DNA, 20 bp, synthetic construct
  misc_feature 1..20: note = CRISPR gRNA sequence
  source 1..20: mol_type = other DNA
ttgctgccacctctgcctcc

SEQ ID NO: 41492 - DNA, 20 bp, synthetic construct
  misc_feature 1..20: note = CRISPR gRNA sequence
  source 1..20: mol_type = other DNA
tgctgccacctctgcctcct

SEQ ID NO: 41493 - DNA, 20 bp, synthetic construct
  misc_feature 1..20: note = CRISPR gRNA sequence
  source 1..20: mol_type = other DNA
cacctctgcctcctgggttc

SEQ ID NO: 41494 - DNA, 20 bp, synthetic construct
  misc_feature 1..20: note = CRISPR gRNA sequence
  source 1..20: mol_type = other DNA
ttcaagcaattctcctgcct

SEQ ID NO: 41495 - DNA, 20 bp, synthetic construct
  misc_feature 1..20: note = CRISPR gRNA sequence
  source 1..20: mol_type = other DNA
ttctcctgcctcagcctcct

SEQ ID NO: 41496 - DNA, 20 bp, synthetic construct
  misc_feature 1..20: note = CRISPR gRNA sequence
  source 1..20: mol_type = other DNA
tcctgcctcagcctcctgag

SEQ ID NO: 41497 - DNA, 20 bp, synthetic construct
  misc_feature 1..20: note = CRISPR gRNA sequence
  source 1..20: mol_type = other DNA
gcctcagcctcctgagtagc

SEQ ID NO: 41498 - DNA, 20 bp, synthetic construct
  misc_feature 1..20: note = CRISPR gRNA sequence
  source 1..20: mol_type = other DNA
cctcagcctcctgagtagct

SEQ ID NO: 41499 - DNA, 20 bp, synthetic construct
  misc_feature 1..20: note = CRISPR gRNA sequence
  source 1..20: mol_type = other DNA
ctcctgagtagctgggatta

SEQ ID NO: 41500 - DNA, 20 bp, synthetic construct
  misc_feature 1..20: note = CRISPR gRNA sequence
  source 1..20: mol_type = other DNA
tcctgagtagctgggattac

SEQ ID NO: 41501 - DNA, 20 bp, synthetic construct
  misc_feature 1..20: note = CRISPR gRNA sequence
  source 1..20: mol_type = other DNA
caggcgcccgccatcatgcc

SEQ ID NO: 41502 - DNA, 20 bp, synthetic construct
  misc_feature 1..20: note = CRISPR gRNA sequence
  source 1..20: mol_type = other DNA
ctggctaatttttgtatttt

SEQ ID NO: 41503 - DNA, 20 bp, synthetic construct
  misc_feature 1..20: note = CRISPR gRNA sequence
  source 1..20: mol_type = other DNA
gctaatttttgtatttttag

SEQ ID NO: 41504 - DNA, 20 bp, synthetic construct
  misc_feature 1..20: note = CRISPR gRNA sequence
  source 1..20: mol_type = other DNA
taatttttgtatttttagta

SEQ ID NO: 41505 - DNA, 20 bp, synthetic construct
  misc_feature 1..20: note = CRISPR gRNA sequence
  source 1..20: mol_type = other DNA
aatttttgtatttttagtag

SEQ ID NO: 41506 - DNA, 20 bp, synthetic construct
  misc_feature 1..20: note = CRISPR gRNA sequence
  source 1..20: mol_type = other DNA
ttttgtatttttagtagagg

SEQ ID NO: 41507 - DNA, 20 bp, synthetic construct
  misc_feature 1..20: note = CRISPR gRNA sequence
  source 1..20: mol_type = other DNA
tttgtatttttagtagaggc

SEQ ID NO: 41508 - DNA, 20 bp, synthetic construct
  misc_feature 1..20: note = CRISPR gRNA sequence
  source 1..20: mol_type = other DNA
ttgtatttttagtagaggca

SEQ ID NO: 41509 - DNA, 20 bp, synthetic construct
  misc_feature 1..20: note = CRISPR gRNA sequence
  source 1..20: mol_type = other DNA
gaggcagggtttcaccatgt

SEQ ID NO: 41510 - DNA, 20 bp, synthetic construct
  misc_feature 1..20: note = CRISPR gRNA sequence
  source 1..20: mol_type = other DNA
cagggtttcaccatgttggc

SEQ ID NO: 41511 - DNA, 20 bp, synthetic construct
  misc_feature 1..20: note = CRISPR gRNA sequence
  source 1..20: mol_type = other DNA
agggtttcaccatgttggcc

SEQ ID NO: 41512 - DNA, 20 bp, synthetic construct
  misc_feature 1..20: note = CRISPR gRNA sequence
  source 1..20: mol_type = other DNA
tttcaccatgttggccaggc

SEQ ID NO: 41513 - DNA, 20 bp, synthetic construct
  misc_feature 1..20: note = CRISPR gRNA sequence
  source 1..20: mol_type = other DNA
ggtctcgaactcctgacctc

SEQ ID NO: 41514 - DNA, 20 bp, synthetic construct
  misc_feature 1..20: note = CRISPR gRNA sequence
  source 1..20: mol_type = other DNA
ctcaagtgatccaccttcct

SEQ ID NO: 41515 - DNA, 20 bp, synthetic construct
  misc_feature 1..20: note = CRISPR gRNA sequence
  source 1..20: mol_type = other DNA
ccaccttcctcagcctccca

SEQ ID NO: 41516 - DNA, 20 bp, synthetic construct
  misc_feature 1..20: note = CRISPR gRNA sequence
  source 1..20: mol_type = other DNA
tcctcagcctcccaaagtgt

SEQ ID NO: 41517 - DNA, 20 bp, synthetic construct
  misc_feature 1..20: note = CRISPR gRNA sequence
  source 1..20: mol_type = other DNA
cctcagcctcccaaagtgtt

SEQ ID NO: 41518 - DNA, 20 bp, synthetic construct
  misc_feature 1..20: note = CRISPR gRNA sequence
  source 1..20: mol_type = other DNA
ctcccaaagtgttgggatta

SEQ ID NO: 41519 - DNA, 20 bp, synthetic construct
  misc_feature 1..20: note = CRISPR gRNA sequence
  source 1..20: mol_type = other DNA
tcccaaagtgttgggattac

SEQ ID NO: 41520 - DNA, 20 bp, synthetic construct
  misc_feature 1..20: note = CRISPR gRNA sequence
  source 1..20: mol_type = other DNA
agtgttgggattacaggctt

SEQ ID NO: 41521 - DNA, 20 bp, synthetic construct
  misc_feature 1..20: note = CRISPR gRNA sequence
  source 1..20: mol_type = other DNA
caggcttgagccactgcacc

SEQ ID NO: 41522 - DNA, 20 bp, synthetic construct
  misc_feature 1..20: note = CRISPR gRNA sequence
  source 1..20: mol_type = other DNA
ttgagccactgcacctggcc

SEQ ID NO: 41523 - DNA, 20 bp, synthetic construct
  misc_feature 1..20: note = CRISPR gRNA sequence
  source 1..20: mol_type = other DNA
gcccagacctaccctattaa

SEQ ID NO: 41524 - DNA, 20 bp, synthetic construct
  misc_feature 1..20: note = CRISPR gRNA sequence
  source 1..20: mol_type = other DNA
ctattaatggcaattcctta

SEQ ID NO: 41525 - DNA, 20 bp, synthetic construct
  misc_feature 1..20: note = CRISPR gRNA sequence
  source 1..20: mol_type = other DNA
aattccttaaagtcaaccaa

SEQ ID NO: 41526 - DNA, 20 bp, synthetic construct
  misc_feature 1..20: note = CRISPR gRNA sequence
  source 1..20: mol_type = other DNA
ccttaaagtcaaccaatggt

SEQ ID NO: 41527 - DNA, 20 bp, synthetic construct
  misc_feature 1..20: note = CRISPR gRNA sequence
  source 1..20: mol_type = other DNA
taaagtcaaccaatggtcag

SEQ ID NO: 41528 - DNA, 20 bp, synthetic construct
  misc_feature 1..20: note = CRISPR gRNA sequence
  source 1..20: mol_type = other DNA
ttgtctcttacctgttttca

SEQ ID NO: 41529 - DNA, 20 bp, synthetic construct
  misc_feature 1..20: note = CRISPR gRNA sequence
  source 1..20: mol_type = other DNA
gtctcttacctgttttcaca

SEQ ID NO: 41530 - DNA, 20 bp, synthetic construct
  misc_feature 1..20: note = CRISPR gRNA sequence
  source 1..20: mol_type = other DNA
cttttaatactaaattgcca

SEQ ID NO: 41531 - DNA, 20 bp, synthetic construct
  misc_feature 1..20: note = CRISPR gRNA sequence
  source 1..20: mol_type = other DNA
aatactaaattgccacagta

SEQ ID NO: 41532 - DNA, 20 bp, synthetic construct
  misc_feature 1..20: note = CRISPR gRNA sequence
  source 1..20: mol_type = other DNA
atactaaattgccacagtac

SEQ ID NO: 41533 - DNA, 20 bp, synthetic construct
  misc_feature 1..20: note = CRISPR gRNA sequence
  source 1..20: mol_type = other DNA
aaattgccacagtacgggac

SEQ ID NO: 41534 - DNA, 20 bp, synthetic construct
  misc_feature 1..20: note = CRISPR gRNA sequence
  source 1..20: mol_type = other DNA
cacagtacgggacgagctgc

SEQ ID NO: 41535 - DNA, 20 bp, synthetic construct
  misc_feature 1..20: note = CRISPR gRNA sequence
  source 1..20: mol_type = other DNA
gttactccaccacacccttc

SEQ ID NO: 41536 - DNA, 20 bp, synthetic construct
  misc_feature 1..20: note = CRISPR gRNA sequence
  source 1..20: mol_type = other DNA
tactccaccacacccttcta

SEQ ID NO: 41537 - DNA, 20 bp, synthetic construct
  misc_feature 1..20: note = CRISPR gRNA sequence
  source 1..20: mol_type = other DNA
caccacacccttctagagtc

SEQ ID NO: 41538 - DNA, 20 bp, synthetic construct
  misc_feature 1..20: note = CRISPR gRNA sequence
  source 1..20: mol_type = other DNA
acccttctagagtctagatc

SEQ ID NO: 41539 - DNA, 20 bp, synthetic construct
  misc_feature 1..20: note = CRISPR gRNA sequence
  source 1..20: mol_type = other DNA
cccttctagagtctagatca

SEQ ID NO: 41540 - DNA, 20 bp, synthetic construct
  misc_feature 1..20: note = CRISPR gRNA sequence
  source 1..20: mol_type = other DNA
ccttctagagtctagatcaa

SEQ ID NO: 41541 - DNA, 20 bp, synthetic construct
  misc_feature 1..20: note = CRISPR gRNA sequence
  source 1..20: mol_type = other DNA
atcaagggtgtccaatcttt

SEQ ID NO: 41542 - DNA, 20 bp, synthetic construct
  misc_feature 1..20: note = CRISPR gRNA sequence
  source 1..20: mol_type = other DNA
gtccaatcttttggcttccc

SEQ ID NO: 41543 - DNA, 20 bp, synthetic construct
  misc_feature 1..20: note = CRISPR gRNA sequence
  source 1..20: mol_type = other DNA
tccaatcttttggcttccct

SEQ ID NO: 41544 - DNA, 20 bp, synthetic construct
  misc_feature 1..20: note = CRISPR gRNA sequence
  source 1..20: mol_type = other DNA
ttggcttccctgggccacat

SEQ ID NO: 41545 - DNA, 20 bp, synthetic construct
  misc_feature 1..20: note = CRISPR gRNA sequence
  source 1..20: mol_type = other DNA
gcttccctgggccacattgg

SEQ ID NO: 41546 - DNA, 20 bp, synthetic construct
  misc_feature 1..20: note = CRISPR gRNA sequence
  source 1..20: mol_type = other DNA
tccctgggccacattggaag

SEQ ID NO: 41547 - DNA, 20 bp, synthetic construct
  misc_feature 1..20: note = CRISPR gRNA sequence
  source 1..20: mol_type = other DNA
ggccacattggaagaagaaa

SEQ ID NO: 41548 - DNA, 20 bp, synthetic construct
  misc_feature 1..20: note = CRISPR gRNA sequence
  source 1..20: mol_type = other DNA
aagaagaaaaagaattgtct

SEQ ID NO: 41549 - DNA, 20 bp, synthetic construct
  misc_feature 1..20: note = CRISPR gRNA sequence
  source 1..20: mol_type = other DNA
agaagaaaaagaattgtctt

SEQ ID NO: 41550 - DNA, 20 bp, synthetic construct
  misc_feature 1..20: note = CRISPR gRNA sequence
  source 1..20: mol_type = other DNA
cacataaaatacactaacac

SEQ ID NO: 41551 - DNA, 20 bp, synthetic construct
  misc_feature 1..20: note = CRISPR gRNA sequence
  source 1..20: mol_type = other DNA
aaatacactaacactagcga

SEQ ID NO: 41552 - DNA, 20 bp, synthetic construct
  misc_feature 1..20: note = CRISPR gRNA sequence
  source 1..20: mol_type = other DNA
aaaaaaaaaacaaaactcca

SEQ ID NO: 41553 - DNA, 20 bp, synthetic construct
  misc_feature 1..20: note = CRISPR gRNA sequence
  source 1..20: mol_type = other DNA
aactccaaagaaaaatctca

SEQ ID NO: 41554 - DNA, 20 bp, synthetic construct
  misc_feature 1..20: note = CRISPR gRNA sequence
  source 1..20: mol_type = other DNA
gaaaaatctcatagtgtttt

SEQ ID NO: 41555 - DNA, 20 bp, synthetic construct
  misc_feature 1..20: note = CRISPR gRNA sequence
  source 1..20: mol_type = other DNA
aatctcatagtgttttaaga

SEQ ID NO: 41556 - DNA, 20 bp, synthetic construct
  misc_feature 1..20: note = CRISPR gRNA sequence
  source 1..20: mol_type = other DNA
gaaagtttacgaatttttgt

SEQ ID NO: 41557 - DNA, 20 bp, synthetic construct
  misc_feature 1..20: note = CRISPR gRNA sequence
  source 1..20: mol_type = other DNA
aaagtttacgaatttttgtt

SEQ ID NO: 41558 - DNA, 20 bp, synthetic construct
  misc_feature 1..20: note = CRISPR gRNA sequence
  source 1..20: mol_type = other DNA
tttttgttaggccgtattca

SEQ ID NO: 41559 - DNA, 20 bp, synthetic construct
  misc_feature 1..20: note = CRISPR gRNA sequence
  source 1..20: mol_type = other DNA
ggccgtattcaaagccatcc

SEQ ID NO: 41560 - DNA, 20 bp, synthetic construct
  misc_feature 1..20: note = CRISPR gRNA sequence
  source 1..20: mol_type = other DNA
gccgtattcaaagccatcct

SEQ ID NO: 41561 - DNA, 20 bp, synthetic construct
  misc_feature 1..20: note = CRISPR gRNA sequence
  source 1..20: mol_type = other DNA
aagccatcctaggctgcatg

SEQ ID NO: 41562 - DNA, 20 bp, synthetic construct
  misc_feature 1..20: note = CRISPR gRNA sequence
  source 1..20: mol_type = other DNA
ccatcctaggctgcatgcag

SEQ ID NO: 41563 - DNA, 20 bp, synthetic construct
  misc_feature 1..20: note = CRISPR gRNA sequence
  source 1..20: mol_type = other DNA
catcctaggctgcatgcagc

SEQ ID NO: 41564 - DNA, 20 bp, synthetic construct
  misc_feature 1..20: note = CRISPR gRNA sequence
  source 1..20: mol_type = other DNA
gctgcatgcagcaggccatg

SEQ ID NO: 41565 - DNA, 20 bp, synthetic construct
  misc_feature 1..20: note = CRISPR gRNA sequence
  source 1..20: mol_type = other DNA
atgcagcaggccatgtggct

SEQ ID NO: 41566 - DNA, 20 bp, synthetic construct
  misc_feature 1..20: note = CRISPR gRNA sequence
  source 1..20: mol_type = other DNA
gccatgtggcttggacaact

SEQ ID NO: 41567 - DNA, 20 bp, synthetic construct
  misc_feature 1..20: note = CRISPR gRNA sequence
  source 1..20: mol_type = other DNA
gtggcttggacaacttggtc

SEQ ID NO: 41568 - DNA, 20 bp, synthetic construct
  misc_feature 1..20: note = CRISPR gRNA sequence
  source 1..20: mol_type = other DNA
attgaaatccaaactgcttc

SEQ ID NO: 41569 - DNA, 20 bp, synthetic construct
  misc_feature 1..20: note = CRISPR gRNA sequence
  source 1..20: mol_type = other DNA
ttgaaatccaaactgcttct

SEQ ID NO: 41570 - DNA, 20 bp, synthetic construct
  misc_feature 1..20: note = CRISPR gRNA sequence
  source 1..20: mol_type = other DNA
gtgttgtgttttgttttgtg

SEQ ID NO: 41571 - DNA, 20 bp, synthetic construct
  misc_feature 1..20: note = CRISPR gRNA sequence
  source 1..20: mol_type = other DNA
ttttgttttgtgtagcactg

SEQ ID NO: 41572 - DNA, 20 bp, synthetic construct
  misc_feature 1..20: note = CRISPR gRNA sequence
  source 1..20: mol_type = other DNA
gttttgtgtagcactgcagt

SEQ ID NO: 41573 - DNA, 20 bp, synthetic construct
  misc_feature 1..20: note = CRISPR gRNA sequence
  source 1..20: mol_type = other DNA
actgcagtcagtgctacaaa

SEQ ID NO: 41574 - DNA, 20 bp, synthetic construct
  misc_feature 1..20: note = CRISPR gRNA sequence
  source 1..20: mol_type = other DNA
tcttacgtgatttgactgtt

SEQ ID NO: 41575 - DNA, 20 bp, synthetic construct
  misc_feature 1..20: note = CRISPR gRNA sequence
  source 1..20: mol_type = other DNA
acctattgtataccatgcac

SEQ ID NO: 41576 - DNA, 20 bp, synthetic construct
  misc_feature 1..20: note = CRISPR gRNA sequence
  source 1..20: mol_type = other DNA
cctattgtataccatgcact

SEQ ID NO: 41577 - DNA, 20 bp, synthetic construct
  misc_feature 1..20: note = CRISPR gRNA sequence
  source 1..20: mol_type = other DNA
ttgtataccatgcactgggc

SEQ ID NO: 41578 - DNA, 20 bp, synthetic construct
  misc_feature 1..20: note = CRISPR gRNA sequence
  source 1..20: mol_type = other DNA
ccatgcactgggccagatcc

SEQ ID NO: 41579 - DNA, 20 bp, synthetic construct
  misc_feature 1..20: note = CRISPR gRNA sequence
  source 1..20: mol_type = other DNA
catgcactgggccagatcct

SEQ ID NO: 41580 - DNA, 20 bp, synthetic construct
  misc_feature 1..20: note = CRISPR gRNA sequence
  source 1..20: mol_type = other DNA
gggccagatcctgggaacac

SEQ ID NO: 41581 - DNA, 20 bp, synthetic construct
  misc_feature 1..20: note = CRISPR gRNA sequence
  source 1..20: mol_type = other DNA
ggccagatcctgggaacaca

SEQ ID NO: 41582 - DNA, 20 bp, synthetic construct
  misc_feature 1..20: note = CRISPR gRNA sequence
  source 1..20: mol_type = other DNA
ccagatcctgggaacacaag

SEQ ID NO: 41583 - DNA, 20 bp, synthetic construct
  misc_feature 1..20: note = CRISPR gRNA sequence
  source 1..20: mol_type = other DNA
tcctgggaacacaaggagac

SEQ ID NO: 41584 - DNA, 20 bp, synthetic construct
  misc_feature 1..20: note = CRISPR gRNA sequence
  source 1..20: mol_type = other DNA
cctgggaacacaaggagact

SEQ ID NO: 41585 - DNA, 20 bp, synthetic construct
  misc_feature 1..20: note = CRISPR gRNA sequence
  source 1..20: mol_type = other DNA
aacacaaggagactgggatg

SEQ ID NO: 41586 - DNA, 20 bp, synthetic construct
  misc_feature 1..20: note = CRISPR gRNA sequence
  source 1..20: mol_type = other DNA
acacaaggagactgggatgc

SEQ ID NO: 41587 - DNA, 20 bp, synthetic construct
  misc_feature 1..20: note = CRISPR gRNA sequence
  source 1..20: mol_type = other DNA
gactgggatgcgggctctgc

SEQ ID NO: 41588 - DNA, 20 bp, synthetic construct
  misc_feature 1..20: note = CRISPR gRNA sequence
  source 1..20: mol_type = other DNA
ggatgcgggctctgctggcc

SEQ ID NO: 41589 - DNA, 20 bp, synthetic construct
  misc_feature 1..20: note = CRISPR gRNA sequence
  source 1..20: mol_type = other DNA
gatgcgggctctgctggcca

SEQ ID NO: 41590 - DNA, 20 bp, synthetic construct
  misc_feature 1..20: note = CRISPR gRNA sequence
  source 1..20: mol_type = other DNA
tggccaaggcaaatcatctg

SEQ ID NO: 41591 - DNA, 20 bp, synthetic construct
  misc_feature 1..20: note = CRISPR gRNA sequence
  source 1..20: mol_type = other DNA
gccaaggcaaatcatctgca

SEQ ID NO: 41592 - DNA, 20 bp, synthetic construct
  misc_feature 1..20: note = CRISPR gRNA sequence
  source 1..20: mol_type = other DNA
ccaaggcaaatcatctgcag

SEQ ID NO: 41593 - DNA, 20 bp, synthetic construct
  misc_feature 1..20: note = CRISPR gRNA sequence
  source 1..20: mol_type = other DNA
aggcaaatcatctgcagagg

SEQ ID NO: 41594 - DNA, 20 bp, synthetic construct
  misc_feature 1..20: note = CRISPR gRNA sequence
  source 1..20: mol_type = other DNA
cagaggaagcttaatataaa

SEQ ID NO: 41595 - DNA, 20 bp, synthetic construct
  misc_feature 1..20: note = CRISPR gRNA sequence
  source 1..20: mol_type = other DNA
gcttaatataaaaagcccac

SEQ ID NO: 41596 - DNA, 20 bp, synthetic construct
  misc_feature 1..20: note = CRISPR gRNA sequence
  source 1..20: mol_type = other DNA
taatataaaaagcccactgg

SEQ ID NO: 41597 - DNA, 20 bp, synthetic construct
  misc_feature 1..20: note = CRISPR gRNA sequence
  source 1..20: mol_type = other DNA
taaaaagcccactggcggcc

SEQ ID NO: 41598 - DNA, 20 bp, synthetic construct
  misc_feature 1..20: note = CRISPR gRNA sequence
  source 1..20: mol_type = other DNA
agcccactggcggcccggca

SEQ ID NO: 41599 - DNA, 20 bp, synthetic construct
  misc_feature 1..20: note = CRISPR gRNA sequence
  source 1..20: mol_type = other DNA
gtgactcacgcctataatcc

SEQ ID NO: 41600 - DNA, 20 bp, synthetic construct
  misc_feature 1..20: note = CRISPR gRNA sequence
  source 1..20: mol_type = other DNA
cgcctataatcccagcactt

SEQ ID NO: 41601 - DNA, 20 bp, synthetic construct
  misc_feature 1..20: note = CRISPR gRNA sequence
  source 1..20: mol_type = other DNA
gcctataatcccagcacttt

SEQ ID NO: 41602 - DNA, 20 bp, synthetic construct
  misc_feature 1..20: note = CRISPR gRNA sequence
  source 1..20: mol_type = other DNA
ctataatcccagcactttgg

SEQ ID NO: 41603 - DNA, 20 bp, synthetic construct
  misc_feature 1..20: note = CRISPR gRNA sequence
  source 1..20: mol_type = other DNA
tataatcccagcactttggg

SEQ ID NO: 41604 - DNA, 20 bp, synthetic construct
  misc_feature 1..20: note = CRISPR gRNA sequence
  source 1..20: mol_type = other DNA
tcccagcactttgggaggcc

SEQ ID NO: 41605 - DNA, 20 bp, synthetic construct
  misc_feature 1..20: note = CRISPR gRNA sequence
  source 1..20: mol_type = other DNA
cccagcactttgggaggccg

SEQ ID NO: 41606 - DNA, 20 bp, synthetic construct
  misc_feature 1..20: note = CRISPR gRNA sequence
  source 1..20: mol_type = other DNA
agcactttgggaggccgagg

SEQ ID NO: 41607 - DNA, 20 bp, synthetic construct
  misc_feature 1..20: note = CRISPR gRNA sequence
  source 1..20: mol_type = other DNA
ctttgggaggccgaggtggc

SEQ ID NO: 41608 - DNA, 20 bp, synthetic construct
  misc_feature 1..20: note = CRISPR gRNA sequence
  source 1..20: mol_type = other DNA
ggccgaggtggctggatcat

SEQ ID NO: 41609 - DNA, 20 bp, synthetic construct
  misc_feature 1..20: note = CRISPR gRNA sequence
  source 1..20: mol_type = other DNA
gccgaggtggctggatcatg

SEQ ID NO: 41610 - DNA, 20 bp, synthetic construct
  misc_feature 1..20: note = CRISPR gRNA sequence
  source 1..20: mol_type = other DNA
aggtggctggatcatgaggt

SEQ ID NO: 41611 - DNA, 20 bp, synthetic construct
  misc_feature 1..20: note = CRISPR gRNA sequence
  source 1..20: mol_type = other DNA
ggtggctggatcatgaggtc

SEQ ID NO: 41612 - DNA, 20 bp, synthetic construct
  misc_feature 1..20: note = CRISPR gRNA sequence
  source 1..20: mol_type = other DNA
tggctggatcatgaggtcag

SEQ ID NO: 41613 - DNA, 20 bp, synthetic construct
  misc_feature 1..20: note = CRISPR gRNA sequence
  source 1..20: mol_type = other DNA
gatcatgaggtcaggagttc

SEQ ID NO: 41614 - DNA, 20 bp, synthetic construct
  misc_feature 1..20: note = CRISPR gRNA sequence
  source 1..20: mol_type = other DNA
tgaggtcaggagttcgagac

SEQ ID NO: 41615 - DNA, 20 bp, synthetic construct
  misc_feature 1..20: note = CRISPR gRNA sequence
  source 1..20: mol_type = other DNA
tcaggagttcgagactagcc

SEQ ID NO: 41616 - DNA, 20 bp, synthetic construct
  misc_feature 1..20: note = CRISPR gRNA sequence
  source 1..20: mol_type = other DNA
cgagactagcctggccaaca

SEQ ID NO: 41617 - DNA, 20 bp, synthetic construct
  misc_feature 1..20: note = CRISPR gRNA sequence
  source 1..20: mol_type = other DNA
tctactaaaaatacaaaaat

SEQ ID NO: 41618 - DNA, 20 bp, synthetic construct
  misc_feature 1..20: note = CRISPR gRNA sequence
  source 1..20: mol_type = other DNA
ctaaaaatacaaaaattagc

SEQ ID NO: 41619 - DNA, 20 bp, synthetic construct
  misc_feature 1..20: note = CRISPR gRNA sequence
  source 1..20: mol_type = other DNA
taaaaatacaaaaattagcc

SEQ ID NO: 41620 - DNA, 20 bp, synthetic construct
  misc_feature 1..20: note = CRISPR gRNA sequence
  source 1..20: mol_type = other DNA
atacaaaaattagccaggca

SEQ ID NO: 41621 - DNA, 20 bp, synthetic construct
  misc_feature 1..20: note = CRISPR gRNA sequence
  source 1..20: mol_type = other DNA
caaaaattagccaggcatgg

SEQ ID NO: 41622 - DNA, 20 bp, synthetic construct
  misc_feature 1..20: note = CRISPR gRNA sequence
  source 1..20: mol_type = other DNA
gtggtgcacccctgtaatcc

SEQ ID NO: 41623 - DNA, 20 bp, synthetic construct
  misc_feature 1..20: note = CRISPR gRNA sequence
  source 1..20: mol_type = other DNA
ccctgtaatcccagctactc

SEQ ID NO: 41624 - DNA, 20 bp, synthetic construct
  misc_feature 1..20: note = CRISPR gRNA sequence
  source 1..20: mol_type = other DNA
ctgtaatcccagctactctg

SEQ ID NO: 41625 - DNA, 20 bp, synthetic construct
  misc_feature 1..20: note = CRISPR gRNA sequence
  source 1..20: mol_type = other DNA
tgtaatcccagctactctgg

SEQ ID NO: 41626 - DNA, 20 bp, synthetic construct
  misc_feature 1..20: note = CRISPR gRNA sequence
  source 1..20: mol_type = other DNA
aatcccagctactctggagg

SEQ ID NO: 41627 - DNA, 20 bp, synthetic construct
  misc_feature 1..20: note = CRISPR gRNA sequence
  source 1..20: mol_type = other DNA
atcccagctactctggaggc

SEQ ID NO: 41628 - DNA, 20 bp, synthetic construct
  misc_feature 1..20: note = CRISPR gRNA sequence
  source 1..20: mol_type = other DNA
ccagctactctggaggcagg

SEQ ID NO: 41629 - DNA, 20 bp, synthetic construct
  misc_feature 1..20: note = CRISPR gRNA sequence
  source 1..20: mol_type = other DNA
cagctactctggaggcaggc

SEQ ID NO: 41630 - DNA, 20 bp, synthetic construct
  misc_feature 1..20: note = CRISPR gRNA sequence
  source 1..20: mol_type = other DNA
gctactctggaggcaggcag

SEQ ID NO: 41631 - DNA, 20 bp, synthetic construct
  misc_feature 1..20: note = CRISPR gRNA sequence
  source 1..20: mol_type = other DNA
gcaggagacttgcttgaacc

SEQ ID NO: 41632 - DNA, 20 bp, synthetic construct
  misc_feature 1..20: note = CRISPR gRNA sequence
  source 1..20: mol_type = other DNA
caggagacttgcttgaaccc

SEQ ID NO: 41633 - DNA, 20 bp, synthetic construct
  misc_feature 1..20: note = CRISPR gRNA sequence
  source 1..20: mol_type = other DNA
ggagacttgcttgaacccgg

SEQ ID NO: 41634 - DNA, 20 bp, synthetic construct
  misc_feature 1..20: note = CRISPR gRNA sequence
  source 1..20: mol_type = other DNA
gagacttgcttgaacccggg

SEQ ID NO: 41635 - DNA, 20 bp, synthetic construct
  misc_feature 1..20: note = CRISPR gRNA sequence
  source 1..20: mol_type = other DNA
acttgcttgaacccgggagg

SEQ ID NO: 41636 - DNA, 20 bp, synthetic construct
  misc_feature 1..20: note = CRISPR gRNA sequence
  source 1..20: mol_type = other DNA
ttgcttgaacccgggaggca

SEQ ID NO: 41637 - DNA, 20 bp, synthetic construct
  misc_feature 1..20: note = CRISPR gRNA sequence
  source 1..20: mol_type = other DNA
aacccgggaggcagagattg

SEQ ID NO: 41638 - DNA, 20 bp, synthetic construct
  misc_feature 1..20: note = CRISPR gRNA sequence
  source 1..20: mol_type = other DNA
cgggaggcagagattgtggt

SEQ ID NO: 41639 - DNA, 20 bp, synthetic construct
  misc_feature 1..20: note = CRISPR gRNA sequence
  source 1..20: mol_type = other DNA
ggcagagattgtggtgagcc

SEQ ID NO: 41640 - DNA, 20 bp, synthetic construct
  misc_feature 1..20: note = CRISPR gRNA sequence
  source 1..20: mol_type = other DNA
aagactgcgccactgtcctc

SEQ ID NO: 41641 - DNA, 20 bp, synthetic construct
  misc_feature 1..20: note = CRISPR gRNA sequence
  source 1..20: mol_type = other DNA
tgcgccactgtcctccagcc

SEQ ID NO: 41642 - DNA, 20 bp, synthetic construct
  misc_feature 1..20: note = CRISPR gRNA sequence
  source 1..20: mol_type = other DNA
gcgccactgtcctccagcct

SEQ ID NO: 41643 - DNA, 20 bp, synthetic construct
  misc_feature 1..20: note = CRISPR gRNA sequence
  source 1..20: mol_type = other DNA
ctgtcctccagcctgggcaa

SEQ ID NO: 41644 - DNA, 20 bp, synthetic construct
  misc_feature 1..20: note = CRISPR gRNA sequence
  source 1..20: mol_type = other DNA
gtcctccagcctgggcaaca

SEQ ID NO: 41645 - DNA, 20 bp, synthetic construct
  misc_feature 1..20: note = CRISPR gRNA sequence
  source 1..20: mol_type = other DNA
tccagcctgggcaacagagc

SEQ ID NO: 41646 - DNA, 20 bp, synthetic construct
  misc_feature 1..20: note = CRISPR gRNA sequence
  source 1..20: mol_type = other DNA
aataaataaataaataaata

SEQ ID NO: 41647 - DNA, 20 bp, synthetic construct
  misc_feature 1..20: note = CRISPR gRNA sequence
  source 1..20: mol_type = other DNA
aataaataaataaagcccac

SEQ ID NO: 41648 - DNA, 20 bp, synthetic construct
  misc_feature 1..20: note = CRISPR gRNA sequence
  source 1..20: mol_type = other DNA
aaataaataaagcccactgg

SEQ ID NO: 41649 - DNA, 20 bp, synthetic construct
  misc_feature 1..20: note = CRISPR gRNA sequence
  source 1..20: mol_type = other DNA
ataaagcccactggcagcac

SEQ ID NO: 41650 - DNA, 20 bp, synthetic construct
  misc_feature 1..20: note = CRISPR gRNA sequence
  source 1..20: mol_type = other DNA
taaagcccactggcagcact

SEQ ID NO: 41651 - DNA, 20 bp, synthetic construct
  misc_feature 1..20: note = CRISPR gRNA sequence
  source 1..20: mol_type = other DNA
agcccactggcagcactggg

SEQ ID NO: 41652 - DNA, 20 bp, synthetic construct
  misc_feature 1..20: note = CRISPR gRNA sequence
  source 1..20: mol_type = other DNA
ctggcagcactgggcggtct

SEQ ID NO: 41653 - DNA, 20 bp, synthetic construct
  misc_feature 1..20: note = CRISPR gRNA sequence
  source 1..20: mol_type = other DNA
agcactgggcggtctgagca

SEQ ID NO: 41654 - DNA, 20 bp, synthetic construct
  misc_feature 1..20: note = CRISPR gRNA sequence
  source 1..20: mol_type = other DNA
gcactgggcggtctgagcac

SEQ ID NO: 41655 - DNA, 20 bp, synthetic construct
  misc_feature 1..20: note = CRISPR gRNA sequence
  source 1..20: mol_type = other DNA
ctgggcggtctgagcacagg

SEQ ID NO: 41656 - DNA, 20 bp, synthetic construct
  misc_feature 1..20: note = CRISPR gRNA sequence
  source 1..20: mol_type = other DNA
tgggcggtctgagcacaggt

SEQ ID NO: 41657 - DNA, 20 bp, synthetic construct
  misc_feature 1..20: note = CRISPR gRNA sequence
  source 1..20: mol_type = other DNA
ggcggtctgagcacaggtgg

SEQ ID NO: 41658 - DNA, 20 bp, synthetic construct
  misc_feature 1..20: note = CRISPR gRNA sequence
  source 1..20: mol_type = other DNA
ctgagcacaggtgggagttt

SEQ ID NO: 41659 - DNA, 20 bp, synthetic construct
  misc_feature 1..20: note = CRISPR gRNA sequence
  source 1..20: mol_type = other DNA
tgagcacaggtgggagtttc

SEQ ID NO: 41660 - DNA, 20 bp, synthetic construct
  misc_feature 1..20: note = CRISPR gRNA sequence
  source 1..20: mol_type = other DNA
aggtccccctccattacctg

SEQ ID NO: 41661 - DNA, 20 bp, synthetic construct
  misc_feature 1..20: note = CRISPR gRNA sequence
  source 1..20: mol_type = other DNA
ccccctccattacctgtggt

SEQ ID NO: 41662 - DNA, 20 bp, synthetic construct
  misc_feature 1..20: note = CRISPR gRNA sequence
  source 1..20: mol_type = other DNA
cccctccattacctgtggtt

SEQ ID NO: 41663 - DNA, 20 bp, synthetic construct
  misc_feature 1..20: note = CRISPR gRNA sequence
  source 1..20: mol_type = other DNA
ccctccattacctgtggttg

SEQ ID NO: 41664 - DNA, 20 bp, synthetic construct
  misc_feature 1..20: note = CRISPR gRNA sequence
  source 1..20: mol_type = other DNA
ccattacctgtggttgggga

SEQ ID NO: 41665 - DNA, 20 bp, synthetic construct
  misc_feature 1..20: note = CRISPR gRNA sequence
  source 1..20: mol_type = other DNA
tgtggttggggaaagtgcaa

SEQ ID NO: 41666 - DNA, 20 bp, synthetic construct
  misc_feature 1..20: note = CRISPR gRNA sequence
  source 1..20: mol_type = other DNA
aagtgcaatagtgaatatga

SEQ ID NO: 41667 - DNA, 20 bp, synthetic construct
  misc_feature 1..20: note = CRISPR gRNA sequence
  source 1..20: mol_type = other DNA
tgaaagcactttgtcaactg

SEQ ID NO: 41668 - DNA, 20 bp, synthetic construct
  misc_feature 1..20: note = CRISPR gRNA sequence
  source 1..20: mol_type = other DNA
aaagcactttgtcaactgta

SEQ ID NO: 41669 - DNA, 20 bp, synthetic construct
  misc_feature 1..20: note = CRISPR gRNA sequence
  source 1..20: mol_type = other DNA
tagagtactgtgatcacttg

SEQ ID NO: 41670 - DNA, 20 bp, synthetic construct
  misc_feature 1..20: note = CRISPR gRNA sequence
  source 1..20: mol_type = other DNA
agagtactgtgatcacttgc

SEQ ID NO: 41671 - DNA, 20 bp, synthetic construct
  misc_feature 1..20: note = CRISPR gRNA sequence
  source 1..20: mol_type = other DNA
tgcaggattattgctataaa

SEQ ID NO: 41672 - DNA, 20 bp, synthetic construct
  misc_feature 1..20: note = CRISPR gRNA sequence
  source 1..20: mol_type = other DNA
tattgctataaatagtcatc

SEQ ID NO: 41673 - DNA, 20 bp, synthetic construct
  misc_feature 1..20: note = CRISPR gRNA sequence
  source 1..20: mol_type = other DNA
attgctataaatagtcatca

SEQ ID NO: 41674 - DNA, 20 bp, synthetic construct
  misc_feature 1..20: note = CRISPR gRNA sequence
  source 1..20: mol_type = other DNA
catcaaggtactcaatgctg

SEQ ID NO: 41675 - DNA, 20 bp, synthetic construct
  misc_feature 1..20: note = CRISPR gRNA sequence
  source 1..20: mol_type = other DNA
aggtactcaatgctgaagtc

SEQ ID NO: 41676 - DNA, 20 bp, synthetic construct
  misc_feature 1..20: note = CRISPR gRNA sequence
  source 1..20: mol_type = other DNA
gctgaagtccagtgattccc

SEQ ID NO: 41677 - DNA, 20 bp, synthetic construct
  misc_feature 1..20: note = CRISPR gRNA sequence
  source 1..20: mol_type = other DNA
ctgaagtccagtgattcccc

SEQ ID NO: 41678 - DNA, 20 bp, synthetic construct
  misc_feature 1..20: note = CRISPR gRNA sequence
  source 1..20: mol_type = other DNA
tgaagtccagtgattccccg

SEQ ID NO: 41679 - DNA, 20 bp, synthetic construct
  misc_feature 1..20: note = CRISPR gRNA sequence
  source 1..20: mol_type = other DNA
gtgattccccggggttccac

SEQ ID NO: 41680 - DNA, 20 bp, synthetic construct
  misc_feature 1..20: note = CRISPR gRNA sequence
  source 1..20: mol_type = other DNA
tgattccccggggttccacc

SEQ ID NO: 41681 - DNA, 20 bp, synthetic construct
  misc_feature 1..20: note = CRISPR gRNA sequence
  source 1..20: mol_type = other DNA
gattccccggggttccaccg

SEQ ID NO: 41682 - DNA, 20 bp, synthetic construct
  misc_feature 1..20: note = CRISPR gRNA sequence
  source 1..20: mol_type = other DNA
tccccggggttccaccgggg

SEQ ID NO: 41683 - DNA, 20 bp, synthetic construct
  misc_feature 1..20: note = CRISPR gRNA sequence
  source 1..20: mol_type = other DNA
cggggttccaccggggaagc

SEQ ID NO: 41684 - DNA, 20 bp, synthetic construct
  misc_feature 1..20: note = CRISPR gRNA sequence
  source 1..20: mol_type = other DNA
ggggttccaccggggaagcc

SEQ ID NO: 41685 - DNA, 20 bp, synthetic construct
  misc_feature 1..20: note = CRISPR gRNA sequence
  source 1..20: mol_type = other DNA
gggttccaccggggaagcca

SEQ ID NO: 41686 - DNA, 20 bp, synthetic construct
  misc_feature 1..20: note = CRISPR gRNA sequence
  source 1..20: mol_type = other DNA
ttccaccggggaagccaggg

SEQ ID NO: 41687 - DNA, 20 bp, synthetic construct
  misc_feature 1..20: note = CRISPR gRNA sequence
  source 1..20: mol_type = other DNA
accggggaagccagggaaga

SEQ ID NO: 41688 - DNA, 20 bp, synthetic construct
  misc_feature 1..20: note = CRISPR gRNA sequence
  source 1..20: mol_type = other DNA
aagccagggaagatagattg

SEQ ID NO: 41689 - DNA, 20 bp, synthetic construct
  misc_feature 1..20: note = CRISPR gRNA sequence
  source 1..20: mol_type = other DNA
agccagggaagatagattgt

SEQ ID NO: 41690 - DNA, 20 bp, synthetic construct
  misc_feature 1..20: note = CRISPR gRNA sequence
  source 1..20: mol_type = other DNA
gccagggaagatagattgtg

SEQ ID NO: 41691 - DNA, 20 bp, synthetic construct
  misc_feature 1..20: note = CRISPR gRNA sequence
  source 1..20: mol_type = other DNA
catcccccctccctgaattc

SEQ ID NO: 41692 - DNA, 20 bp, synthetic construct
  misc_feature 1..20: note = CRISPR gRNA sequence
  source 1..20: mol_type = other DNA
ctccctgaattcaagcactg

SEQ ID NO: 41693 - DNA, 20 bp, synthetic construct
  misc_feature 1..20: note = CRISPR gRNA sequence
  source 1..20: mol_type = other DNA
tccctgaattcaagcactgc

SEQ ID NO: 41694 - DNA, 20 bp, synthetic construct
  misc_feature 1..20: note = CRISPR gRNA sequence
  source 1..20: mol_type = other DNA
ctactttgcctgtgtacaca

SEQ ID NO: 41695 - DNA, 20 bp, synthetic construct
  misc_feature 1..20: note = CRISPR gRNA sequence
  source 1..20: mol_type = other DNA
tactttgcctgtgtacacat

SEQ ID NO: 41696 - DNA, 20 bp, synthetic construct
  misc_feature 1..20: note = CRISPR gRNA sequence
  source 1..20: mol_type = other DNA
gtacacatgggcataccatg

SEQ ID NO: 41697 - DNA, 20 bp, synthetic construct
  misc_feature 1..20: note = CRISPR gRNA sequence
  source 1..20: mol_type = other DNA
tacacatgggcataccatgt

SEQ ID NO: 41698 - DNA, 20 bp, synthetic construct
  misc_feature 1..20: note = CRISPR gRNA sequence
  source 1..20: mol_type = other DNA
tgggcataccatgtgggatg

SEQ ID NO: 41699 - DNA, 20 bp, synthetic construct
  misc_feature 1..20: note = CRISPR gRNA sequence
  source 1..20: mol_type = other DNA
ataccatgtgggatgtggta

SEQ ID NO: 41700 - DNA, 20 bp, synthetic construct
  misc_feature 1..20: note = CRISPR gRNA sequence
  source 1..20: mol_type = other DNA
accatgtgggatgtggtaaa

SEQ ID NO: 41701 - DNA, 20 bp, synthetic construct
  misc_feature 1..20: note = CRISPR gRNA sequence
  source 1..20: mol_type = other DNA
gtgggatgtggtaaagagta

SEQ ID NO: 41702 - DNA, 20 bp, synthetic construct
  misc_feature 1..20: note = CRISPR gRNA sequence
  source 1..20: mol_type = other DNA
attgctttaaaaaaaaaaaa

SEQ ID NO: 41703 - DNA, 20 bp, synthetic construct
  misc_feature 1..20: note = CRISPR gRNA sequence
  source 1..20: mol_type = other DNA
ttgctttaaaaaaaaaaaaa

SEQ ID NO: 41704 - DNA, 20 bp, synthetic construct
  misc_feature 1..20: note = CRISPR gRNA sequence
  source 1..20: mol_type = other DNA
gctttaaaaaaaaaaaaaag

SEQ ID NO: 41705 - DNA, 20 bp, synthetic construct
  misc_feature 1..20: note = CRISPR gRNA sequence
  source 1..20: mol_type = other DNA
ctttaaaaaaaaaaaaaagg

SEQ ID NO: 41706 - DNA, 20 bp, synthetic construct
  misc_feature 1..20: note = CRISPR gRNA sequence
  source 1..20: mol_type = other DNA
tttaaaaaaaaaaaaaagga

SEQ ID NO: 41707 - DNA, 20 bp, synthetic construct
  misc_feature 1..20: note = CRISPR gRNA sequence
  source 1..20: mol_type = other DNA
taatcacctcctttgccaac

SEQ ID NO: 41708 - DNA, 20 bp, synthetic construct
  misc_feature 1..20: note = CRISPR gRNA sequence
  source 1..20: mol_type = other DNA
atcacctcctttgccaacca

SEQ ID NO: 41709 - DNA, 20 bp, synthetic construct
  misc_feature 1..20: note = CRISPR gRNA sequence
  source 1..20: mol_type = other DNA
cctttgccaaccagagccca

SEQ ID NO: 41710 - DNA, 20 bp, synthetic construct
  misc_feature 1..20: note = CRISPR gRNA sequence
  source 1..20: mol_type = other DNA
accagagcccatggtgtatt

SEQ ID NO: 41711 - DNA, 20 bp, synthetic construct
  misc_feature 1..20: note = CRISPR gRNA sequence
  source 1..20: mol_type = other DNA
ccagagcccatggtgtattt

SEQ ID NO: 41712 - DNA, 20 bp, synthetic construct
  misc_feature 1..20: note = CRISPR gRNA sequence
  source 1..20: mol_type = other DNA
cagagcccatggtgtatttg

SEQ ID NO: 41713 - DNA, 20 bp, synthetic construct
  misc_feature 1..20: note = CRISPR gRNA sequence
  source 1..20: mol_type = other DNA
agagcccatggtgtatttgg

SEQ ID NO: 41714 - DNA, 20 bp, synthetic construct
  misc_feature 1..20: note = CRISPR gRNA sequence
  source 1..20: mol_type = other DNA
ccatggtgtatttgggggtc

SEQ ID NO: 41715 - DNA, 20 bp, synthetic construct
  misc_feature 1..20: note = CRISPR gRNA sequence
  source 1..20: mol_type = other DNA
tggtgtatttgggggtctgg

SEQ ID NO: 41716 - DNA, 20 bp, synthetic construct
  misc_feature 1..20: note = CRISPR gRNA sequence
  source 1..20: mol_type = other DNA
ggtgtatttgggggtctggt

SEQ ID NO: 41717 - DNA, 20 bp, synthetic construct
  misc_feature 1..20: note = CRISPR gRNA sequence
  source 1..20: mol_type = other DNA
gggtctggtgggacaccata

SEQ ID NO: 41718 - DNA, 20 bp, synthetic construct
  misc_feature 1..20: note = CRISPR gRNA sequence
  source 1..20: mol_type = other DNA
ggtctggtgggacaccatac

SEQ ID NO: 41719 - DNA, 20 bp, synthetic construct
  misc_feature 1..20: note = CRISPR gRNA sequence
  source 1..20: mol_type = other DNA
caccatacgggatgtgtttc

SEQ ID NO: 41720 - DNA, 20 bp, synthetic construct
  misc_feature 1..20: note = CRISPR gRNA sequence
  source 1..20: mol_type = other DNA
atacgggatgtgtttctgga

SEQ ID NO: 41721 - DNA, 20 bp, synthetic construct
  misc_feature 1..20: note = CRISPR gRNA sequence
  source 1..20: mol_type = other DNA
tggaaagaccaccctcaata

SEQ ID NO: 41722 - DNA, 20 bp, synthetic construct
  misc_feature 1..20: note = CRISPR gRNA sequence
  source 1..20: mol_type = other DNA
ggaaagaccaccctcaataa

SEQ ID NO: 41723 - DNA, 20 bp, synthetic construct
  misc_feature 1..20: note = CRISPR gRNA sequence
  source 1..20: mol_type = other DNA
accaccctcaataaaggccc

SEQ ID NO: 41724 - DNA, 20 bp, synthetic construct
  misc_feature 1..20: note = CRISPR gRNA sequence
  source 1..20: mol_type = other DNA
ccccagtcctgactgtgcct

SEQ ID NO: 41725 - DNA, 20 bp, synthetic construct
  misc_feature 1..20: note = CRISPR gRNA sequence
  source 1..20: mol_type = other DNA
cccagtcctgactgtgcctc

SEQ ID NO: 41726 - DNA, 20 bp, synthetic construct
  misc_feature 1..20: note = CRISPR gRNA sequence
  source 1..20: mol_type = other DNA
ccagtcctgactgtgcctca

SEQ ID NO: 41727 - DNA, 20 bp, synthetic construct
  misc_feature 1..20: note = CRISPR gRNA sequence
  source 1..20: mol_type = other DNA
cagtcctgactgtgcctcag

SEQ ID NO: 41728 - DNA, 20 bp, synthetic construct
  misc_feature 1..20: note = CRISPR gRNA sequence
  source 1..20: mol_type = other DNA
gtgcctcaggggcccatgcc

SEQ ID NO: 41729 - DNA, 20 bp, synthetic construct
  misc_feature 1..20: note = CRISPR gRNA sequence
  source 1..20: mol_type = other DNA
aggggcccatgcccagtccc

SEQ ID NO: 41730 - DNA, 20 bp, synthetic construct
  misc_feature 1..20: note = CRISPR gRNA sequence
  source 1..20: mol_type = other DNA
ggggcccatgcccagtccct

SEQ ID NO: 41731 - DNA, 20 bp, synthetic construct
  misc_feature 1..20: note = CRISPR gRNA sequence
  source 1..20: mol_type = other DNA
gggcccatgcccagtccctg

SEQ ID NO: 41732 - DNA, 20 bp, synthetic construct
  misc_feature 1..20: note = CRISPR gRNA sequence
  source 1..20: mol_type = other DNA
cccatgcccagtccctgggg

SEQ ID NO: 41733 - DNA, 20 bp, synthetic construct
  misc_feature 1..20: note = CRISPR gRNA sequence
  source 1..20: mol_type = other DNA
tgcccagtccctggggcaga

SEQ ID NO: 41734 - DNA, 20 bp, synthetic construct
  misc_feature 1..20: note = CRISPR gRNA sequence
  source 1..20: mol_type = other DNA
gcccagtccctggggcagaa

SEQ ID NO: 41735 - DNA, 20 bp, synthetic construct
  misc_feature 1..20: note = CRISPR gRNA sequence
  source 1..20: mol_type = other DNA
cccagtccctggggcagaaa

SEQ ID NO: 41736 - DNA, 20 bp, synthetic construct
  misc_feature 1..20: note = CRISPR gRNA sequence
  source 1..20: mol_type = other DNA
agtccctggggcagaaaggg

SEQ ID NO: 41737 - DNA, 20 bp, synthetic construct
  misc_feature 1..20: note = CRISPR gRNA sequence
  source 1..20: mol_type = other DNA
tccctggggcagaaagggta

SEQ ID NO: 41738 - DNA, 20 bp, synthetic construct
  misc_feature 1..20: note = CRISPR gRNA sequence
  source 1..20: mol_type = other DNA
tggggcagaaagggtagagt

SEQ ID NO: 41739 - DNA, 20 bp, synthetic construct
  misc_feature 1..20: note = CRISPR gRNA sequence
  source 1..20: mol_type = other DNA
ggggcagaaagggtagagtt

SEQ ID NO: 41740 - DNA, 20 bp, synthetic construct
  misc_feature 1..20: note = CRISPR gRNA sequence
  source 1..20: mol_type = other DNA
aaagggtagagttgggcctc

SEQ ID NO: 41741 - DNA, 20 bp, synthetic construct
  misc_feature 1..20: note = CRISPR gRNA sequence
  source 1..20: mol_type = other DNA
gtagagttgggcctccagcc

SEQ ID NO: 41742 - DNA, 20 bp, synthetic construct
  misc_feature 1..20: note = CRISPR gRNA sequence
  source 1..20: mol_type = other DNA
tagagttgggcctccagcct

SEQ ID NO: 41743 - DNA, 20 bp, synthetic construct
  misc_feature 1..20: note = CRISPR gRNA sequence
  source 1..20: mol_type = other DNA
tgggcctccagcctgggccc

SEQ ID NO: 41744 - DNA, 20 bp, synthetic construct
  misc_feature 1..20: note = CRISPR gRNA sequence
  source 1..20: mol_type = other DNA
gcctccagcctgggccctgg

SEQ ID NO: 41745 - DNA, 20 bp, synthetic construct
  misc_feature 1..20: note = CRISPR gRNA sequence
  source 1..20: mol_type = other DNA
ctccagcctgggccctggca

SEQ ID NO: 41746 - DNA, 20 bp, synthetic construct
  misc_feature 1..20: note = CRISPR gRNA sequence
  source 1..20: mol_type = other DNA
tccagcctgggccctggcag

SEQ ID NO: 41747 - DNA, 20 bp, synthetic construct
  misc_feature 1..20: note = CRISPR gRNA sequence
  source 1..20: mol_type = other DNA
cctggcagaggctccaacat

SEQ ID NO: 41748 - DNA, 20 bp, synthetic construct
  misc_feature 1..20: note = CRISPR gRNA sequence
  source 1..20: mol_type = other DNA
ctggcagaggctccaacatg

SEQ ID NO: 41749 - DNA, 20 bp, synthetic construct
  misc_feature 1..20: note = CRISPR gRNA sequence
  source 1..20: mol_type = other DNA
tcccgccctaccctgccccc

SEQ ID NO: 41750 - DNA, 20 bp, synthetic construct
  misc_feature 1..20: note = CRISPR gRNA sequence
  source 1..20: mol_type = other DNA
accctgccccccagctcact

SEQ ID NO: 41751 - DNA, 20 bp, synthetic construct
  misc_feature 1..20: note = CRISPR gRNA sequence
  source 1..20: mol_type = other DNA
tgccccccagctcactgagc

SEQ ID NO: 41752 - DNA, 20 bp, synthetic construct
  misc_feature 1..20: note = CRISPR gRNA sequence
  source 1..20: mol_type = other DNA
gctcactgagccagttgatg

SEQ ID NO: 41753 - DNA, 20 bp, synthetic construct
  misc_feature 1..20: note = CRISPR gRNA sequence
  source 1..20: mol_type = other DNA
ctcactgagccagttgatgt

SEQ ID NO: 41754 - DNA, 20 bp, synthetic construct
  misc_feature 1..20: note = CRISPR gRNA sequence
  source 1..20: mol_type = other DNA
tcactgagccagttgatgta

SEQ ID NO: 41755 - DNA, 20 bp, synthetic construct
  misc_feature 1..20: note = CRISPR gRNA sequence
  source 1..20: mol_type = other DNA
ctccatgcctcccctccaaa

SEQ ID NO: 41756 - DNA, 20 bp, synthetic construct
  misc_feature 1..20: note = CRISPR gRNA sequence
  source 1..20: mol_type = other DNA
atgcctcccctccaaacagc

SEQ ID NO: 41757 - DNA, 20 bp, synthetic construct
  misc_feature 1..20: note = CRISPR gRNA sequence
  source 1..20: mol_type = other DNA
gcctcccctccaaacagcca

SEQ ID NO: 41758 - DNA, 20 bp, synthetic construct
  misc_feature 1..20: note = CRISPR gRNA sequence
  source 1..20: mol_type = other DNA
cctcccctccaaacagccag

SEQ ID NO: 41759 - DNA, 20 bp, synthetic construct
  misc_feature 1..20: note = CRISPR gRNA sequence
  source 1..20: mol_type = other DNA
tcccctccaaacagccagag

SEQ ID NO: 41760 - DNA, 20 bp, synthetic construct
  misc_feature 1..20: note = CRISPR gRNA sequence
  source 1..20: mol_type = other DNA
ctccaaacagccagaggaga

SEQ ID NO: 41761 - DNA, 20 bp, synthetic construct
  misc_feature 1..20: note = CRISPR gRNA sequence
  source 1..20: mol_type = other DNA
caaacagccagaggagaaag

SEQ ID NO: 41762 - DNA, 20 bp, synthetic construct
  misc_feature 1..20: note = CRISPR gRNA sequence
  source 1..20: mol_type = other DNA
acagccagaggagaaagcag

SEQ ID NO: 41763 - DNA, 20 bp, synthetic construct
  misc_feature 1..20: note = CRISPR gRNA sequence
  source 1..20: mol_type = other DNA
agccagaggagaaagcagca

SEQ ID NO: 41764 - DNA, 20 bp, synthetic construct
  misc_feature 1..20: note = CRISPR gRNA sequence
  source 1..20: mol_type = other DNA
agaggagaaagcagcagaga

SEQ ID NO: 41765 - DNA, 20 bp, synthetic construct
  misc_feature 1..20: note = CRISPR gRNA sequence
  source 1..20: mol_type = other DNA
gaggagaaagcagcagagat

SEQ ID NO: 41766 - DNA, 20 bp, synthetic construct
  misc_feature 1..20: note = CRISPR gRNA sequence
  source 1..20: mol_type = other DNA
agaaagcagcagagatgggc

SEQ ID NO: 41767 - DNA, 20 bp, synthetic construct
  misc_feature 1..20: note = CRISPR gRNA sequence
  source 1..20: mol_type = other DNA
gaaagcagcagagatgggcc

SEQ ID NO: 41768 - DNA, 20 bp, synthetic construct
  misc_feature 1..20: note = CRISPR gRNA sequence
  source 1..20: mol_type = other DNA
gcagagatgggccaggccct

SEQ ID NO: 41769 - DNA, 20 bp, synthetic construct
  misc_feature 1..20: note = CRISPR gRNA sequence
  source 1..20: mol_type = other DNA
agagatgggccaggcccttg

SEQ ID NO: 41770 - DNA, 20 bp, synthetic construct
  misc_feature 1..20: note = CRISPR gRNA sequence
  source 1..20: mol_type = other DNA
gagatgggccaggcccttgg

SEQ ID NO: 41771 - DNA, 20 bp, synthetic construct
  misc_feature 1..20: note = CRISPR gRNA sequence
  source 1..20: mol_type = other DNA
ggccaggcccttggaggccc

SEQ ID NO: 41772 - DNA, 20 bp, synthetic construct
  misc_feature 1..20: note = CRISPR gRNA sequence
  source 1..20: mol_type = other DNA
ccaggcccttggaggccccg

SEQ ID NO: 41773 - DNA, 20 bp, synthetic construct
  misc_feature 1..20: note = CRISPR gRNA sequence
  source 1..20: mol_type = other DNA
aggcccttggaggccccgga

SEQ ID NO: 41774 - DNA, 20 bp, synthetic construct
  misc_feature 1..20: note = CRISPR gRNA sequence
  source 1..20: mol_type = other DNA
ggcccttggaggccccggag

SEQ ID NO: 41775 - DNA, 20 bp, synthetic construct
  misc_feature 1..20: note = CRISPR gRNA sequence
  source 1..20: mol_type = other DNA
gcccttggaggccccggaga

SEQ ID NO: 41776 - DNA, 20 bp, synthetic construct
  misc_feature 1..20: note = CRISPR gRNA sequence
  source 1..20: mol_type = other DNA
cccttggaggccccggagag

SEQ ID NO: 41777 - DNA, 20 bp, synthetic construct
  misc_feature 1..20: note = CRISPR gRNA sequence
  source 1..20: mol_type = other DNA
cttggaggccccggagaggg

SEQ ID NO: 41778 - DNA, 20 bp, synthetic construct
  misc_feature 1..20: note = CRISPR gRNA sequence
  source 1..20: mol_type = other DNA
tggaggccccggagagggga

SEQ ID NO: 41779 - DNA, 20 bp, synthetic construct
  misc_feature 1..20: note = CRISPR gRNA sequence
  source 1..20: mol_type = other DNA
ggaggccccggagaggggag

SEQ ID NO: 41780 - DNA, 20 bp, synthetic construct
  misc_feature 1..20: note = CRISPR gRNA sequence
  source 1..20: mol_type = other DNA
gaggccccggagaggggaga

SEQ ID NO: 41781 - DNA, 20 bp, synthetic construct
  misc_feature 1..20: note = CRISPR gRNA sequence
  source 1..20: mol_type = other DNA
gccccggagaggggagaggg

SEQ ID NO: 41782 - DNA, 20 bp, synthetic construct
  misc_feature 1..20: note = CRISPR gRNA sequence
  source 1..20: mol_type = other DNA
agaggggagagggcagcctg

SEQ ID NO: 41783 - DNA, 20 bp, synthetic construct
  misc_feature 1..20: note = CRISPR gRNA sequence
  source 1..20: mol_type = other DNA
aggggagagggcagcctgca

SEQ ID NO: 41784 - DNA, 20 bp, synthetic construct
  misc_feature 1..20: note = CRISPR gRNA sequence
  source 1..20: mol_type = other DNA
ggggagagggcagcctgcag

SEQ ID NO: 41785 - DNA, 20 bp, synthetic construct
  misc_feature 1..20: note = CRISPR gRNA sequence
  source 1..20: mol_type = other DNA
agggcagcctgcagaggatg

SEQ ID NO: 41786 - DNA, 20 bp, synthetic construct
  misc_feature 1..20: note = CRISPR gRNA sequence
  source 1..20: mol_type = other DNA
gggcagcctgcagaggatga

SEQ ID NO: 41787 - DNA, 20 bp, synthetic construct
  misc_feature 1..20: note = CRISPR gRNA sequence
  source 1..20: mol_type = other DNA
gcctgcagaggatgaaggaa

SEQ ID NO: 41788 - DNA, 20 bp, synthetic construct
  misc_feature 1..20: note = CRISPR gRNA sequence
  source 1..20: mol_type = other DNA
gcagaggatgaaggaacaga

SEQ ID NO: 41789 - DNA, 20 bp, synthetic construct
  misc_feature 1..20: note = CRISPR gRNA sequence
  source 1..20: mol_type = other DNA
agaggatgaaggaacagaaa

SEQ ID NO: 41790 - DNA, 20 bp, synthetic construct
  misc_feature 1..20: note = CRISPR gRNA sequence
  source 1..20: mol_type = other DNA
aggatgaaggaacagaaaga

SEQ ID NO: 41791 - DNA, 20 bp, synthetic construct
  misc_feature 1..20: note = CRISPR gRNA sequence
  source 1..20: mol_type = other DNA
ggatgaaggaacagaaagag

SEQ ID NO: 41792 - DNA, 20 bp, synthetic construct
  misc_feature 1..20: note = CRISPR gRNA sequence
  source 1..20: mol_type = other DNA
tgaaggaacagaaagagagg

SEQ ID NO: 41793 - DNA, 20 bp, synthetic construct
  misc_feature 1..20: note = CRISPR gRNA sequence
  source 1..20: mol_type = other DNA
gaaggaacagaaagagagga

SEQ ID NO: 41794 - DNA, 20 bp, synthetic construct
  misc_feature 1..20: note = CRISPR gRNA sequence
  source 1..20: mol_type = other DNA
aaggaacagaaagagaggaa

SEQ ID NO: 41795 - DNA, 20 bp, synthetic construct
  misc_feature 1..20: note = CRISPR gRNA sequence
  source 1..20: mol_type = other DNA
aggaacagaaagagaggaag

SEQ ID NO: 41796 - DNA, 20 bp, synthetic construct
  misc_feature 1..20: note = CRISPR gRNA sequence
  source 1..20: mol_type = other DNA
ggaacagaaagagaggaagg

SEQ ID NO: 41797 - DNA, 20 bp, synthetic construct
  misc_feature 1..20: note = CRISPR gRNA sequence
  source 1..20: mol_type = other DNA
aacagaaagagaggaagggg

SEQ ID NO: 41798 - DNA, 20 bp, synthetic construct
  misc_feature 1..20: note = CRISPR gRNA sequence
  source 1..20: mol_type = other DNA
acagaaagagaggaaggggg

SEQ ID NO: 41799 - DNA, 20 bp, synthetic construct
  misc_feature 1..20: note = CRISPR gRNA sequence
  source 1..20: mol_type = other DNA
gaaagagaggaagggggagg

SEQ ID NO: 41800 - DNA, 20 bp, synthetic construct
  misc_feature 1..20: note = CRISPR gRNA sequence
  source 1..20: mol_type = other DNA
aagagaggaagggggaggtg

SEQ ID NO: 41801 - DNA, 20 bp, synthetic construct
  misc_feature 1..20: note = CRISPR gRNA sequence
  source 1..20: mol_type = other DNA
agaggaagggggaggtggag

SEQ ID NO: 41802 - DNA, 20 bp, synthetic construct
  misc_feature 1..20: note = CRISPR gRNA sequence
  source 1..20: mol_type = other DNA
gaggaagggggaggtggaga

SEQ ID NO: 41803 - DNA, 20 bp, synthetic construct
  misc_feature 1..20: note = CRISPR gRNA sequence
  source 1..20: mol_type = other DNA
gaagggggaggtggagaagg

SEQ ID NO: 41804 - DNA, 20 bp, synthetic construct
  misc_feature 1..20: note = CRISPR gRNA sequence
  source 1..20: mol_type = other DNA
gggggaggtggagaaggcag

SEQ ID NO: 41805 - DNA, 20 bp, synthetic construct
  misc_feature 1..20: note = CRISPR gRNA sequence
  source 1..20: mol_type = other DNA
ggggaggtggagaaggcaga

SEQ ID NO: 41806 - DNA, 20 bp, synthetic construct
  misc_feature 1..20: note = CRISPR gRNA sequence
  source 1..20: mol_type = other DNA
ggaggtggagaaggcagaag

SEQ ID NO: 41807 - DNA, 20 bp, synthetic construct
  misc_feature 1..20: note = CRISPR gRNA sequence
  source 1..20: mol_type = other DNA
gagaaggcagaaggagaaca

SEQ ID NO: 41808 - DNA, 20 bp, synthetic construct
  misc_feature 1..20: note = CRISPR gRNA sequence
  source 1..20: mol_type = other DNA
aaggcagaaggagaacatag

SEQ ID NO: 41809 - DNA, 20 bp, synthetic construct
  misc_feature 1..20: note = CRISPR gRNA sequence
  source 1..20: mol_type = other DNA
ggcagaaggagaacatagta

SEQ ID NO: 41810 - DNA, 20 bp, synthetic construct
  misc_feature 1..20: note = CRISPR gRNA sequence
  source 1..20: mol_type = other DNA
gcagaaggagaacatagtag

SEQ ID NO: 41811 - DNA, 20 bp, synthetic construct
  misc_feature 1..20: note = CRISPR gRNA sequence
  source 1..20: mol_type = other DNA
gagaacatagtagaggtctg

SEQ ID NO: 41812 - DNA, 20 bp, synthetic construct
  misc_feature 1..20: note = CRISPR gRNA sequence
  source 1..20: mol_type = other DNA
agaacatagtagaggtctgc

SEQ ID NO: 41813 - DNA, 20 bp, synthetic construct
  misc_feature 1..20: note = CRISPR gRNA sequence
  source 1..20: mol_type = other DNA
gaacatagtagaggtctgcg

SEQ ID NO: 41814 - DNA, 20 bp, synthetic construct
  misc_feature 1..20: note = CRISPR gRNA sequence
  source 1..20: mol_type = other DNA
aacatagtagaggtctgcgg

SEQ ID NO: 41815 - DNA, 20 bp, synthetic construct
  misc_feature 1..20: note = CRISPR gRNA sequence
  source 1..20: mol_type = other DNA
tagtagaggtctgcgggggt

SEQ ID NO: 41816 - DNA, 20 bp, synthetic construct
  misc_feature 1..20: note = CRISPR gRNA sequence
  source 1..20: mol_type = other DNA
agtagaggtctgcgggggtt

SEQ ID NO: 41817 - DNA, 20 bp, synthetic construct
  misc_feature 1..20: note = CRISPR gRNA sequence
  source 1..20: mol_type = other DNA
agaggtctgcgggggttggg

SEQ ID NO: 41818 - DNA, 20 bp, synthetic construct
  misc_feature 1..20: note = CRISPR gRNA sequence
  source 1..20: mol_type = other DNA
ggtctgcgggggttgggaag

SEQ ID NO: 41819 - DNA, 20 bp, synthetic construct
  misc_feature 1..20: note = CRISPR gRNA sequence
  source 1..20: mol_type = other DNA
cgggggttgggaagtggctc

SEQ ID NO: 41820 - DNA, 20 bp, synthetic construct
  misc_feature 1..20: note = CRISPR gRNA sequence
  source 1..20: mol_type = other DNA
gggggttgggaagtggctcc

SEQ ID NO: 41821 - DNA, 20 bp, synthetic construct
  misc_feature 1..20: note = CRISPR gRNA sequence
  source 1..20: mol_type = other DNA
ggaagtggctccaggccccc

SEQ ID NO: 41822 - DNA, 20 bp, synthetic construct
  misc_feature 1..20: note = CRISPR gRNA sequence
  source 1..20: mol_type = other DNA
gaagtggctccaggcccccc

SEQ ID NO: 41823 - DNA, 20 bp, synthetic construct
  misc_feature 1..20: note = CRISPR gRNA sequence
  source 1..20: mol_type = other DNA
gtggctccaggccccccagg

SEQ ID NO: 41824 - DNA, 20 bp, synthetic construct
  misc_feature 1..20: note = CRISPR gRNA sequence
  source 1..20: mol_type = other DNA
tggctccaggccccccagga

SEQ ID NO: 41825 - DNA, 20 bp, synthetic construct
  misc_feature 1..20: note = CRISPR gRNA sequence
  source 1..20: mol_type = other DNA
ggctccaggccccccaggaa

SEQ ID NO: 41826 - DNA, 20 bp, synthetic construct
  misc_feature 1..20: note = CRISPR gRNA sequence
  source 1..20: mol_type = other DNA
gctccaggccccccaggaag

SEQ ID NO: 41827 - DNA, 20 bp, synthetic construct
  misc_feature 1..20: note = CRISPR gRNA sequence
  source 1..20: mol_type = other DNA
ggccccccaggaaggggctg

SEQ ID NO: 41828 - DNA, 20 bp, synthetic construct
  misc_feature 1..20: note = CRISPR gRNA sequence
  source 1..20: mol_type = other DNA
gccccccaggaaggggctgt

SEQ ID NO: 41829 - DNA, 20 bp, synthetic construct
  misc_feature 1..20: note = CRISPR gRNA sequence
  source 1..20: mol_type = other DNA
aaggggctgtaggtaaaccc

SEQ ID NO: 41830 - DNA, 20 bp, synthetic construct
  misc_feature 1..20: note = CRISPR gRNA sequence
  source 1..20: mol_type = other DNA
aggggctgtaggtaaacccc

SEQ ID NO: 41831 - DNA, 20 bp, synthetic construct
  misc_feature 1..20: note = CRISPR gRNA sequence
  source 1..20: mol_type = other DNA
ggggctgtaggtaaacccca

SEQ ID NO: 41832 - DNA, 20 bp, synthetic construct
  misc_feature 1..20: note = CRISPR gRNA sequence
  source 1..20: mol_type = other DNA
taggtaaaccccagggaact

SEQ ID NO: 41833 - DNA, 20 bp, synthetic construct
  misc_feature 1..20: note = CRISPR gRNA sequence
  source 1..20: mol_type = other DNA
cccagggaactcagtgtctt

SEQ ID NO: 41834 - DNA, 20 bp, synthetic construct
  misc_feature 1..20: note = CRISPR gRNA sequence
  source 1..20: mol_type = other DNA
ctcagtgtcttgagttgtcc

SEQ ID NO: 41835 - DNA, 20 bp, synthetic construct
  misc_feature 1..20: note = CRISPR gRNA sequence
  source 1..20: mol_type = other DNA
agttgtcctggtcctccatc

SEQ ID NO: 41836 - DNA, 20 bp, synthetic construct
  misc_feature 1..20: note = CRISPR gRNA sequence
  source 1..20: mol_type = other DNA
ttgtcctggtcctccatcta

SEQ ID NO: 41837 - DNA, 20 bp, synthetic construct
  misc_feature 1..20: note = CRISPR gRNA sequence
  source 1..20: mol_type = other DNA
tcctggtcctccatctagag

SEQ ID NO: 41838 - DNA, 20 bp, synthetic construct
  misc_feature 1..20: note = CRISPR gRNA sequence
  source 1..20: mol_type = other DNA
ctggtcctccatctagagca

SEQ ID NO: 41839 - DNA, 20 bp, synthetic construct
  misc_feature 1..20: note = CRISPR gRNA sequence
  source 1..20: mol_type = other DNA
tcctccatctagagcagaga

SEQ ID NO: 41840 - DNA, 20 bp, synthetic construct
  misc_feature 1..20: note = CRISPR gRNA sequence
  source 1..20: mol_type = other DNA
ccatctagagcagagacagc

SEQ ID NO: 41841 - DNA, 20 bp, synthetic construct
  misc_feature 1..20: note = CRISPR gRNA sequence
  source 1..20: mol_type = other DNA
catctagagcagagacagca

SEQ ID NO: 41842 - DNA, 20 bp, synthetic construct
  misc_feature 1..20: note = CRISPR gRNA sequence
  source 1..20: mol_type = other DNA
ctagagcagagacagcaagg

SEQ ID NO: 41843 - DNA, 20 bp, synthetic construct
  misc_feature 1..20: note = CRISPR gRNA sequence
  source 1..20: mol_type = other DNA
tagagcagagacagcaaggc

SEQ ID NO: 41844 - DNA, 20 bp, synthetic construct
  misc_feature 1..20: note = CRISPR gRNA sequence
  source 1..20: mol_type = other DNA
gagacagcaaggcaggtatc

SEQ ID NO: 41845 - DNA, 20 bp, synthetic construct
  misc_feature 1..20: note = CRISPR gRNA sequence
  source 1..20: mol_type = other DNA
gacagcaaggcaggtatctg

SEQ ID NO: 41846 - DNA, 20 bp, synthetic construct
  misc_feature 1..20: note = CRISPR gRNA sequence
  source 1..20: mol_type = other DNA
ggagtttctcctaaatgcac

SEQ ID NO: 41847 - DNA, 20 bp, synthetic construct
  misc_feature 1..20: note = CRISPR gRNA sequence
  source 1..20: mol_type = other DNA
gagtttctcctaaatgcact

SEQ ID NO: 41848 - DNA, 20 bp, synthetic construct
  misc_feature 1..20: note = CRISPR gRNA sequence
  source 1..20: mol_type = other DNA
cgaattatctgaacaatgat

SEQ ID NO: 41849 - DNA, 20 bp, synthetic construct
  misc_feature 1..20: note = CRISPR gRNA sequence
  source 1..20: mol_type = other DNA
ttatctgaacaatgatgagc

SEQ ID NO: 41850 - DNA, 20 bp, synthetic construct
  misc_feature 1..20: note = CRISPR gRNA sequence
  source 1..20: mol_type = other DNA
ctgaacaatgatgagctggt

SEQ ID NO: 41851 - DNA, 20 bp, synthetic construct
  misc_feature 1..20: note = CRISPR gRNA sequence
  source 1..20: mol_type = other DNA
caatgatgagctggttggtc

SEQ ID NO: 41852 - DNA, 20 bp, synthetic construct
  misc_feature 1..20: note = CRISPR gRNA sequence
  source 1..20: mol_type = other DNA
gctggttggtctggtgttaa

SEQ ID NO: 41853 - DNA, 20 bp, synthetic construct
  misc_feature 1..20: note = CRISPR gRNA sequence
  source 1..20: mol_type = other DNA
ctggttggtctggtgttaat

SEQ ID NO: 41854 - DNA, 20 bp, synthetic construct
  misc_feature 1..20: note = CRISPR gRNA sequence
  source 1..20: mol_type = other DNA
gtctggtgttaatgggcaac

SEQ ID NO: 41855 - DNA, 20 bp, synthetic construct
  misc_feature 1..20: note = CRISPR gRNA sequence
  source 1..20: mol_type = other DNA
ctggtgttaatgggcaacta

SEQ ID NO: 41856 - DNA, 20 bp, synthetic construct
  misc_feature 1..20: note = CRISPR gRNA sequence
  source 1..20: mol_type = other DNA
taatgggcaactagagaccc

SEQ ID NO: 41857 - DNA, 20 bp, synthetic construct
  misc_feature 1..20: note = CRISPR gRNA sequence
  source 1..20: mol_type = other DNA
gggcaactagagacccaagc

SEQ ID NO: 41858 - DNA, 20 bp, synthetic construct
  misc_feature 1..20: note = CRISPR gRNA sequence
  source 1..20: mol_type = other DNA
cactgtcatatccactcctc

SEQ ID NO: 41859 - DNA, 20 bp, synthetic construct
  misc_feature 1..20: note = CRISPR gRNA sequence
  source 1..20: mol_type = other DNA
actgtcatatccactcctct

SEQ ID NO: 41860 - DNA, 20 bp, synthetic construct
  misc_feature 1..20: note = CRISPR gRNA sequence
  source 1..20: mol_type = other DNA
catatccactcctctgggtt

SEQ ID NO: 41861 - DNA, 20 bp, synthetic construct
  misc_feature 1..20: note = CRISPR gRNA sequence
  source 1..20: mol_type = other DNA
atatccactcctctgggtta

SEQ ID NO: 41862 - DNA, 20 bp, synthetic construct
  misc_feature 1..20: note = CRISPR gRNA sequence
  source 1..20: mol_type = other DNA
tccactcctctgggttaagg

SEQ ID NO: 41863 - DNA, 20 bp, synthetic construct
  misc_feature 1..20: note = CRISPR gRNA sequence
  source 1..20: mol_type = other DNA
cttttcttttttattttttt

SEQ ID NO: 41864 - DNA, 20 bp, synthetic construct
  misc_feature 1..20: note = CRISPR gRNA sequence
  source 1..20: mol_type = other DNA
tcttttttatttttttgaga

SEQ ID NO: 41865 - DNA, 20 bp, synthetic construct
  misc_feature 1..20: note = CRISPR gRNA sequence
  source 1..20: mol_type = other DNA
ttttttatttttttgagata

SEQ ID NO: 41866 - DNA, 20 bp, synthetic construct
  misc_feature 1..20: note = CRISPR gRNA sequence
  source 1..20: mol_type = other DNA
tagagactcgctctgtcacc

SEQ ID NO: 41867 - DNA, 20 bp, synthetic construct
  misc_feature 1..20: note = CRISPR gRNA sequence
  source 1..20: mol_type = other DNA
agagactcgctctgtcaccc

SEQ ID NO: 41868 - DNA, 20 bp, synthetic construct
  misc_feature 1..20: note = CRISPR gRNA sequence
  source 1..20: mol_type = other DNA
actcgctctgtcacccaggc

SEQ ID NO: 41869 - DNA, 20 bp, synthetic construct
  misc_feature 1..20: note = CRISPR gRNA sequence
  source 1..20: mol_type = other DNA
tcgctctgtcacccaggctg

SEQ ID NO: 41870 - DNA, 20 bp, synthetic construct
  misc_feature 1..20: note = CRISPR gRNA sequence
  source 1..20: mol_type = other DNA
ctgtcacccaggctggagtg

SEQ ID NO: 41871 - DNA, 20 bp, synthetic construct
  misc_feature 1..20: note = CRISPR gRNA sequence
  source 1..20: mol_type = other DNA
tcacccaggctggagtgcag

SEQ ID NO: 41872 - DNA, 20 bp, synthetic construct
  misc_feature 1..20: note = CRISPR gRNA sequence
  source 1..20: mol_type = other DNA
ggagtgcagtggtacgatct

SEQ ID NO: 41873 - DNA, 20 bp, synthetic construct
  misc_feature 1..20: note = CRISPR gRNA sequence
  source 1..20: mol_type = other DNA
tcactgcaacctctgcctcc

SEQ ID NO: 41874 - DNA, 20 bp, synthetic construct
  misc_feature 1..20: note = CRISPR gRNA sequence
  source 1..20: mol_type = other DNA
cactgcaacctctgcctccc

SEQ ID NO: 41875 - DNA, 20 bp, synthetic construct
  misc_feature 1..20: note = CRISPR gRNA sequence
  source 1..20: mol_type = other DNA
aacctctgcctcccaggttc

SEQ ID NO: 41876 - DNA, 20 bp, synthetic construct
  misc_feature 1..20: note = CRISPR gRNA sequence
  source 1..20: mol_type = other DNA
ttcaagtgattcccatgcct

SEQ ID NO: 41877 - DNA, 20 bp, synthetic construct
  misc_feature 1..20: note = CRISPR gRNA sequence
  source 1..20: mol_type = other DNA
ttcccatgcctcagcctcct

SEQ ID NO: 41878 - DNA, 20 bp, synthetic construct
  misc_feature 1..20: note = CRISPR gRNA sequence
  source 1..20: mol_type = other DNA
ccatgcctcagcctcctgag

SEQ ID NO: 41879 - DNA, 20 bp, synthetic construct
  misc_feature 1..20: note = CRISPR gRNA sequence
  source 1..20: mol_type = other DNA
ctcctgagtagctattacta

SEQ ID NO: 41880 - DNA, 20 bp, synthetic construct
  misc_feature 1..20: note = CRISPR gRNA sequence
  source 1..20: mol_type = other DNA
tcctgagtagctattactac

SEQ ID NO: 41881 - DNA, 20 bp, synthetic construct
  misc_feature 1..20: note = CRISPR gRNA sequence
  source 1..20: mol_type = other DNA
caggtgtgcaccaccacgcc

SEQ ID NO: 41882 - DNA, 20 bp, synthetic construct
  misc_feature 1..20: note = CRISPR gRNA sequence
  source 1..20: mol_type = other DNA
aatttttttttcgttttttg

SEQ ID NO: 41883 - DNA, 20 bp, synthetic construct
  misc_feature 1..20: note = CRISPR gRNA sequence
  source 1..20: mol_type = other DNA
ttttttttcgttttttgtag

SEQ ID NO: 41884 - DNA, 20 bp, synthetic construct
  misc_feature 1..20: note = CRISPR gRNA sequence
  source 1..20: mol_type = other DNA
ttttttcgttttttgtagta

SEQ ID NO: 41885 - DNA, 20 bp, synthetic construct
  misc_feature 1..20: note = CRISPR gRNA sequence
  source 1..20: mol_type = other DNA
tttttcgttttttgtagtag

SEQ ID NO: 41886 - DNA, 20 bp, synthetic construct
  misc_feature 1..20: note = CRISPR gRNA sequence
  source 1..20: mol_type = other DNA
ttcgttttttgtagtagagg

SEQ ID NO: 41887 - DNA, 20 bp, synthetic construct
  misc_feature 1..20: note = CRISPR gRNA sequence
  source 1..20: mol_type = other DNA
tggaatttcaccatgttgcc

SEQ ID NO: 41888 - DNA, 20 bp, synthetic construct
  misc_feature 1..20: note = CRISPR gRNA sequence
  source 1..20: mol_type = other DNA
ggaatttcaccatgttgccc

SEQ ID NO: 41889 - DNA, 20 bp, synthetic construct
  misc_feature 1..20: note = CRISPR gRNA sequence
  source 1..20: mol_type = other DNA
tttcaccatgttgcccaggc

SEQ ID NO: 41890 - DNA, 20 bp, synthetic construct
  misc_feature 1..20: note = CRISPR gRNA sequence
  source 1..20: mol_type = other DNA
catgttgcccaggctggtcc

SEQ ID NO: 41891 - DNA, 20 bp, synthetic construct
  misc_feature 1..20: note = CRISPR gRNA sequence
  source 1..20: mol_type = other DNA
tggtcccagactcctgacct

SEQ ID NO: 41892 - DNA, 20 bp, synthetic construct
  misc_feature 1..20: note = CRISPR gRNA sequence
  source 1..20: mol_type = other DNA
ctcagatgatccacccacct

SEQ ID NO: 41893 - DNA, 20 bp, synthetic construct
  misc_feature 1..20: note = CRISPR gRNA sequence
  source 1..20: mol_type = other DNA
ccacccacctcagcctccca

SEQ ID NO: 41894 - DNA, 20 bp, synthetic construct
  misc_feature 1..20: note = CRISPR gRNA sequence
  source 1..20: mol_type = other DNA
ctcccaaagtgctgcgatta

SEQ ID NO: 41895 - DNA, 20 bp, synthetic construct
  misc_feature 1..20: note = CRISPR gRNA sequence
  source 1..20: mol_type = other DNA
tcccaaagtgctgcgattac

SEQ ID NO: 41896 - DNA, 20 bp, synthetic construct
  misc_feature 1..20: note = CRISPR gRNA sequence
  source 1..20: mol_type = other DNA
agtgctgcgattacaggcat

SEQ ID NO: 41897 - DNA, 20 bp, synthetic construct
  misc_feature 1..20: note = CRISPR gRNA sequence
  source 1..20: mol_type = other DNA
caggcatgagccaccatgcc

SEQ ID NO: 41898 - DNA, 20 bp, synthetic construct
  misc_feature 1..20: note = CRISPR gRNA sequence
  source 1..20: mol_type = other DNA
ttcttaacaaacatgttttg

SEQ ID NO: 41899 - DNA, 20 bp, synthetic construct
  misc_feature 1..20: note = CRISPR gRNA sequence
  source 1..20: mol_type = other DNA
ttgcggaacactaaccttca

SEQ ID NO: 41900 - DNA, 20 bp, synthetic construct
  misc_feature 1..20: note = CRISPR gRNA sequence
  source 1..20: mol_type = other DNA
cccttaaaaattaattctgc

SEQ ID NO: 41901 - DNA, 20 bp, synthetic construct
  misc_feature 1..20: note = CRISPR gRNA sequence
  source 1..20: mol_type = other DNA
attaattctgctagtccatt

SEQ ID NO: 41902 - DNA, 20 bp, synthetic construct
  misc_feature 1..20: note = CRISPR gRNA sequence
  source 1..20: mol_type = other DNA
ttctgctagtccatttagtt

SEQ ID NO: 41903 - DNA, 20 bp, synthetic construct
  misc_feature 1..20: note = CRISPR gRNA sequence
  source 1..20: mol_type = other DNA
tctgctagtccatttagttt

SEQ ID NO: 41904 - DNA, 20 bp, synthetic construct
  misc_feature 1..20: note = CRISPR gRNA sequence
  source 1..20: mol_type = other DNA
ctgctagtccatttagtttg

SEQ ID NO: 41905 - DNA, 20 bp, synthetic construct
  misc_feature 1..20: note = CRISPR gRNA sequence
  source 1..20: mol_type = other DNA
agtccatttagtttggggaa

SEQ ID NO: 41906 - DNA, 20 bp, synthetic construct
  misc_feature 1..20: note = CRISPR gRNA sequence
  source 1..20: mol_type = other DNA
gtttggggaaaagtctgctg

SEQ ID NO: 41907 - DNA, 20 bp, synthetic construct
  misc_feature 1..20: note = CRISPR gRNA sequence
  source 1..20: mol_type = other DNA
aaaagtctgctgtagctcct

SEQ ID NO: 41908 - DNA, 20 bp, synthetic construct
  misc_feature 1..20: note = CRISPR gRNA sequence
  source 1..20: mol_type = other DNA
ccttggaaattcataatgca

SEQ ID NO: 41909 - DNA, 20 bp, synthetic construct
  misc_feature 1..20: note = CRISPR gRNA sequence
  source 1..20: mol_type = other DNA
tggaaattcataatgcacag

SEQ ID NO: 41910 - DNA, 20 bp, synthetic construct
  misc_feature 1..20: note = CRISPR gRNA sequence
  source 1..20: mol_type = other DNA
taatgcacagcagcctatcg

SEQ ID NO: 41911 - DNA, 20 bp, synthetic construct
  misc_feature 1..20: note = CRISPR gRNA sequence
  source 1..20: mol_type = other DNA
acagcagcctatcgcagcct

SEQ ID NO: 41912 - DNA, 20 bp, synthetic construct
  misc_feature 1..20: note = CRISPR gRNA sequence
  source 1..20: mol_type = other DNA
agcagcctatcgcagcctca

SEQ ID NO: 41913 - DNA, 20 bp, synthetic construct
  misc_feature 1..20: note = CRISPR gRNA sequence
  source 1..20: mol_type = other DNA
agcctatcgcagcctcagag

SEQ ID NO: 41914 - DNA, 20 bp, synthetic construct
  misc_feature 1..20: note = CRISPR gRNA sequence
  source 1..20: mol_type = other DNA
gcagcctcagagaagccctg

SEQ ID NO: 41915 - DNA, 20 bp, synthetic construct
  misc_feature 1..20: note = CRISPR gRNA sequence
  source 1..20: mol_type = other DNA
gcaaacaaaaccatttaatt

SEQ ID NO: 41916 - DNA, 20 bp, synthetic construct
  misc_feature 1..20: note = CRISPR gRNA sequence
  source 1..20: mol_type = other DNA
cccgtatttcccaaacttaa

SEQ ID NO: 41917 - DNA, 20 bp, synthetic construct
  misc_feature 1..20: note = CRISPR gRNA sequence
  source 1..20: mol_type = other DNA
aaaagaccttcctcttcttc

SEQ ID NO: 41918 - DNA, 20 bp, synthetic construct
  misc_feature 1..20: note = CRISPR gRNA sequence
  source 1..20: mol_type = other DNA
ttcctcttcttccagcctca

SEQ ID NO: 41919 - DNA, 20 bp, synthetic construct
  misc_feature 1..20: note = CRISPR gRNA sequence
  source 1..20: mol_type = other DNA
ccagcctcacggataaccca

SEQ ID NO: 41920 - DNA, 20 bp, synthetic construct
  misc_feature 1..20: note = CRISPR gRNA sequence
  source 1..20: mol_type = other DNA
tcacggataacccatggacc

SEQ ID NO: 41921 - DNA, 20 bp, synthetic construct
  misc_feature 1..20: note = CRISPR gRNA sequence
  source 1..20: mol_type = other DNA
ataacccatggacccagtgc

SEQ ID NO: 41922 - DNA, 20 bp, synthetic construct
  misc_feature 1..20: note = CRISPR gRNA sequence
  source 1..20: mol_type = other DNA
taacccatggacccagtgct

SEQ ID NO: 41923 - DNA, 20 bp, synthetic construct
  misc_feature 1..20: note = CRISPR gRNA sequence
  source 1..20: mol_type = other DNA
acccatggacccagtgctgg

SEQ ID NO: 41924 - DNA, 20 bp, synthetic construct
  misc_feature 1..20: note = CRISPR gRNA sequence
  source 1..20: mol_type = other DNA
cccatggacccagtgctggg

SEQ ID NO: 41925 - DNA, 20 bp, synthetic construct
  misc_feature 1..20: note = CRISPR gRNA sequence
  source 1..20: mol_type = other DNA
ccatggacccagtgctggga

SEQ ID NO: 41926 - DNA, 20 bp, synthetic construct
  misc_feature 1..20: note = CRISPR gRNA sequence
  source 1..20: mol_type = other DNA
agtgctgggagggaatgttt

SEQ ID NO: 41927 - DNA, 20 bp, synthetic construct
  misc_feature 1..20: note = CRISPR gRNA sequence
  source 1..20: mol_type = other DNA
gtgctgggagggaatgtttc

SEQ ID NO: 41928 - DNA, 20 bp, synthetic construct
  misc_feature 1..20: note = CRISPR gRNA sequence
  source 1..20: mol_type = other DNA
gggaatgtttcaggtgaccc

SEQ ID NO: 41929 - DNA, 20 bp, synthetic construct
  misc_feature 1..20: note = CRISPR gRNA sequence
  source 1..20: mol_type = other DNA
atgtttcaggtgaccctggt

SEQ ID NO: 41930 - DNA, 20 bp, synthetic construct
  misc_feature 1..20: note = CRISPR gRNA sequence
  source 1..20: mol_type = other DNA
tgtttcaggtgaccctggtt

SEQ ID NO: 41931 - DNA, 20 bp, synthetic construct
  misc_feature 1..20: note = CRISPR gRNA sequence
  source 1..20: mol_type = other DNA
ccctggttaggtcccatctc

SEQ ID NO: 41932 - DNA, 20 bp, synthetic construct
  misc_feature 1..20: note = CRISPR gRNA sequence
  source 1..20: mol_type = other DNA
tggttaggtcccatctccag

SEQ ID NO: 41933 - DNA, 20 bp, synthetic construct
  misc_feature 1..20: note = CRISPR gRNA sequence
  source 1..20: mol_type = other DNA
ggttaggtcccatctccaga

SEQ ID NO: 41934 - DNA, 20 bp, synthetic construct
  misc_feature 1..20: note = CRISPR gRNA sequence
  source 1..20: mol_type = other DNA
gtcccatctccagaaggctc

SEQ ID NO: 41935 - DNA, 20 bp, synthetic construct
  misc_feature 1..20: note = CRISPR gRNA sequence
  source 1..20: mol_type = other DNA
ctccagaaggctctggctat

SEQ ID NO: 41936 - DNA, 20 bp, synthetic construct
  misc_feature 1..20: note = CRISPR gRNA sequence
  source 1..20: mol_type = other DNA
tccagaaggctctggctatg

SEQ ID NO: 41937 - DNA, 20 bp, synthetic construct
  misc_feature 1..20: note = CRISPR gRNA sequence
  source 1..20: mol_type = other DNA
ggccgtgctccctgctttcc

SEQ ID NO: 41938 - DNA, 20 bp, synthetic construct
  misc_feature 1..20: note = CRISPR gRNA sequence
  source 1..20: mol_type = other DNA
cgtgctccctgctttcctgg

SEQ ID NO: 41939 - DNA, 20 bp, synthetic construct
  misc_feature 1..20: note = CRISPR gRNA sequence
  source 1..20: mol_type = other DNA
gtgctccctgctttcctgga

SEQ ID NO: 41940 - DNA, 20 bp, synthetic construct
  misc_feature 1..20: note = CRISPR gRNA sequence
  source 1..20: mol_type = other DNA
catccacctgctttgtttca

SEQ ID NO: 41941 - DNA, 20 bp, synthetic construct
  misc_feature 1..20: note = CRISPR gRNA sequence
  source 1..20: mol_type = other DNA
tgtttcacagattgtcctgt

SEQ ID NO: 41942 - DNA, 20 bp, synthetic construct
  misc_feature 1..20: note = CRISPR gRNA sequence
  source 1..20: mol_type = other DNA
agattgtcctgtgagttcct

SEQ ID NO: 41943 - DNA, 20 bp, synthetic construct
  misc_feature 1..20: note = CRISPR gRNA sequence
  source 1..20: mol_type = other DNA
cctgtgagttcctgagtgac

SEQ ID NO: 41944 - DNA, 20 bp, synthetic construct
  misc_feature 1..20: note = CRISPR gRNA sequence
  source 1..20: mol_type = other DNA
tgtgagttcctgagtgacca

SEQ ID NO: 41945 - DNA, 20 bp, synthetic construct
  misc_feature 1..20: note = CRISPR gRNA sequence
  source 1..20: mol_type = other DNA
gttcctgagtgaccagagcc

SEQ ID NO: 41946 - DNA, 20 bp, synthetic construct
  misc_feature 1..20: note = CRISPR gRNA sequence
  source 1..20: mol_type = other DNA
tcctgagtgaccagagcctg

SEQ ID NO: 41947 - DNA, 20 bp, synthetic construct
  misc_feature 1..20: note = CRISPR gRNA sequence
  source 1..20: mol_type = other DNA
ccagagcctggagactctac

SEQ ID NO: 41948 - DNA, 20 bp, synthetic construct
  misc_feature 1..20: note = CRISPR gRNA sequence
  source 1..20: mol_type = other DNA
actgcttacctcaactccct

SEQ ID NO: 41949 - DNA, 20 bp, synthetic construct
  misc_feature 1..20: note = CRISPR gRNA sequence
  source 1..20: mol_type = other DNA
ttacctcaactccctcagct

SEQ ID NO: 41950 - DNA, 20 bp, synthetic construct
  misc_feature 1..20: note = CRISPR gRNA sequence
  source 1..20: mol_type = other DNA
tccctcagctgagcctgctg

SEQ ID NO: 41951 - DNA, 20 bp, synthetic construct
  misc_feature 1..20: note = CRISPR gRNA sequence
  source 1..20: mol_type = other DNA
tcagctgagcctgctgcagt

SEQ ID NO: 41952 - DNA, 20 bp, synthetic construct
  misc_feature 1..20: note = CRISPR gRNA sequence
  source 1..20: mol_type = other DNA
tgagcctgctgcagtaagac

SEQ ID NO: 41953 - DNA, 20 bp, synthetic construct
  misc_feature 1..20: note = CRISPR gRNA sequence
  source 1..20: mol_type = other DNA
agcctgctgcagtaagacga

SEQ ID NO: 41954 - DNA, 20 bp, synthetic construct
  misc_feature 1..20: note = CRISPR gRNA sequence
  source 1..20: mol_type = other DNA
cgagagtttttcctatttcc

SEQ ID NO: 41955 - DNA, 20 bp, synthetic construct
  misc_feature 1..20: note = CRISPR gRNA sequence
  source 1..20: mol_type = other DNA
ttccttgtgctcgtgtttct

SEQ ID NO: 41956 - DNA, 20 bp, synthetic construct
  misc_feature 1..20: note = CRISPR gRNA sequence
  source 1..20: mol_type = other DNA
tccttgtgctcgtgtttcta

SEQ ID NO: 41957 - DNA, 20 bp, synthetic construct
  misc_feature 1..20: note = CRISPR gRNA sequence
  source 1..20: mol_type = other DNA
gtgtttctaaggctcctcca

SEQ ID NO: 41958 - DNA, 20 bp, synthetic construct
  misc_feature 1..20: note = CRISPR gRNA sequence
  source 1..20: mol_type = other DNA
tctaaggctcctccatggca

SEQ ID NO: 41959 - DNA, 20 bp, synthetic construct
  misc_feature 1..20: note = CRISPR gRNA sequence
  source 1..20: mol_type = other DNA
tacccgctccattctttcct

SEQ ID NO: 41960 - DNA, 20 bp, synthetic construct
  misc_feature 1..20: note = CRISPR gRNA sequence
  source 1..20: mol_type = other DNA
acccgctccattctttcctt

SEQ ID NO: 41961 - DNA, 20 bp, synthetic construct
  misc_feature 1..20: note = CRISPR gRNA sequence
  source 1..20: mol_type = other DNA
ggttgttttatcattttacc

SEQ ID NO: 41962 - DNA, 20 bp, synthetic construct
  misc_feature 1..20: note = CRISPR gRNA sequence
  source 1..20: mol_type = other DNA
atcattttacctggcacaac

SEQ ID NO: 41963 - DNA, 20 bp, synthetic construct
  misc_feature 1..20: note = CRISPR gRNA sequence
  source 1..20: mol_type = other DNA
tcattttacctggcacaact

SEQ ID NO: 41964 - DNA, 20 bp, synthetic construct
  misc_feature 1..20: note = CRISPR gRNA sequence
  source 1..20: mol_type = other DNA
cattttacctggcacaactg

SEQ ID NO: 41965 - DNA, 20 bp, synthetic construct
  misc_feature 1..20: note = CRISPR gRNA sequence
  source 1..20: mol_type = other DNA
tggggactccaatctgcttc

SEQ ID NO: 41966 - DNA, 20 bp, synthetic construct
  misc_feature 1..20: note = CRISPR gRNA sequence
  source 1..20: mol_type = other DNA
ccctaatactttgtcaacct

SEQ ID NO: 41967 - DNA, 20 bp, synthetic construct
  misc_feature 1..20: note = CRISPR gRNA sequence
  source 1..20: mol_type = other DNA
cctaatactttgtcaacctc

SEQ ID NO: 41968 - DNA, 20 bp, synthetic construct
  misc_feature 1..20: note = CRISPR gRNA sequence
  source 1..20: mol_type = other DNA
ctaatactttgtcaacctca

SEQ ID NO: 41969 - DNA, 20 bp, synthetic construct
  misc_feature 1..20: note = CRISPR gRNA sequence
  source 1..20: mol_type = other DNA
taatactttgtcaacctcag

SEQ ID NO: 41970 - DNA, 20 bp, synthetic construct
  misc_feature 1..20: note = CRISPR gRNA sequence
  source 1..20: mol_type = other DNA
aatactttgtcaacctcagg

SEQ ID NO: 41971 - DNA, 20 bp, synthetic construct
  misc_feature 1..20: note = CRISPR gRNA sequence
  source 1..20: mol_type = other DNA
cgtttgcctcctctgcgtct

SEQ ID NO: 41972 - DNA, 20 bp, synthetic construct
  misc_feature 1..20: note = CRISPR gRNA sequence
  source 1..20: mol_type = other DNA
cagtttcctcatctgacaaa

SEQ ID NO: 41973 - DNA, 20 bp, synthetic construct
  misc_feature 1..20: note = CRISPR gRNA sequence
  source 1..20: mol_type = other DNA
agtttcctcatctgacaaat

SEQ ID NO: 41974 - DNA, 20 bp, synthetic construct
  misc_feature 1..20: note = CRISPR gRNA sequence
  source 1..20: mol_type = other DNA
atattccccgcccattcccc

SEQ ID NO: 41975 - DNA, 20 bp, synthetic construct
  misc_feature 1..20: note = CRISPR gRNA sequence
  source 1..20: mol_type = other DNA
attccccgcccattccccca

SEQ ID NO: 41976 - DNA, 20 bp, synthetic construct
  misc_feature 1..20: note = CRISPR gRNA sequence
  source 1..20: mol_type = other DNA
cccgcccattcccccagagt

SEQ ID NO: 41977 - DNA, 20 bp, synthetic construct
  misc_feature 1..20: note = CRISPR gRNA sequence
  source 1..20: mol_type = other DNA
ccgcccattcccccagagtt

SEQ ID NO: 41978 - DNA, 20 bp, synthetic construct
  misc_feature 1..20: note = CRISPR gRNA sequence
  source 1..20: mol_type = other DNA
cccagagttgggactcaaat

SEQ ID NO: 41979 - DNA, 20 bp, synthetic construct
  misc_feature 1..20: note = CRISPR gRNA sequence
  source 1..20: mol_type = other DNA
agttattctaaaatcacctt

SEQ ID NO: 41980 - DNA, 20 bp, synthetic construct
  misc_feature 1..20: note = CRISPR gRNA sequence
  source 1..20: mol_type = other DNA
tctaaaatcaccttaagaaa

SEQ ID NO: 41981 - DNA, 20 bp, synthetic construct
  misc_feature 1..20: note = CRISPR gRNA sequence
  source 1..20: mol_type = other DNA
aaaatcaccttaagaaatgg

SEQ ID NO: 41982 - DNA, 20 bp, synthetic construct
  misc_feature 1..20: note = CRISPR gRNA sequence
  source 1..20: mol_type = other DNA
atggaagatctgtgacaaat

SEQ ID NO: 41983 - DNA, 20 bp, synthetic construct
  misc_feature 1..20: note = CRISPR gRNA sequence
  source 1..20: mol_type = other DNA
gtccaacttctccccaccca

SEQ ID NO: 41984 - DNA, 20 bp, synthetic construct
  misc_feature 1..20: note = CRISPR gRNA sequence
  source 1..20: mol_type = other DNA
ccaacttctccccacccacg

SEQ ID NO: 41985 - DNA, 20 bp, synthetic construct
  misc_feature 1..20: note = CRISPR gRNA sequence
  source 1..20: mol_type = other DNA
caacttctccccacccacgg

SEQ ID NO: 41986 - DNA, 20 bp, synthetic construct
  misc_feature 1..20: note = CRISPR gRNA sequence
  source 1..20: mol_type = other DNA
aacttctccccacccacgga

SEQ ID NO: 41987 - DNA, 20 bp, synthetic construct
  misc_feature 1..20: note = CRISPR gRNA sequence
  source 1..20: mol_type = other DNA
cacggagggtcacccactcg

SEQ ID NO: 41988 - DNA, 20 bp, synthetic construct
  misc_feature 1..20: note = CRISPR gRNA sequence
  source 1..20: mol_type = other DNA
gagggtcacccactcgtaga

SEQ ID NO: 41989 - DNA, 20 bp, synthetic construct
  misc_feature 1..20: note = CRISPR gRNA sequence
  source 1..20: mol_type = other DNA
agggtcacccactcgtagaa

SEQ ID NO: 41990 - DNA, 20 bp, synthetic construct
  misc_feature 1..20: note = CRISPR gRNA sequence
  source 1..20: mol_type = other DNA
gggtcacccactcgtagaaa

SEQ ID NO: 41991 - DNA, 20 bp, synthetic construct
  misc_feature 1..20: note = CRISPR gRNA sequence
  source 1..20: mol_type = other DNA
ggtcacccactcgtagaaag

SEQ ID NO: 41992 - DNA, 20 bp, synthetic construct
  misc_feature 1..20: note = CRISPR gRNA sequence
  source 1..20: mol_type = other DNA
actcgtagaaaggggctgta

SEQ ID NO: 41993 - DNA, 20 bp, synthetic construct
  misc_feature 1..20: note = CRISPR gRNA sequence
  source 1..20: mol_type = other DNA
agaaaggggctgtacagatg

SEQ ID NO: 41994 - DNA, 20 bp, synthetic construct
  misc_feature 1..20: note = CRISPR gRNA sequence
  source 1..20: mol_type = other DNA
gaaaggggctgtacagatgt

SEQ ID NO: 41995 - DNA, 20 bp, synthetic construct
  misc_feature 1..20: note = CRISPR gRNA sequence
  source 1..20: mol_type = other DNA
ttatcacatgctgcttttta

SEQ ID NO: 41996 - DNA, 20 bp, synthetic construct
  misc_feature 1..20: note = CRISPR gRNA sequence
  source 1..20: mol_type = other DNA
tatcacatgctgctttttaa

SEQ ID NO: 41997 - DNA, 20 bp, synthetic construct
  misc_feature 1..20: note = CRISPR gRNA sequence
  source 1..20: mol_type = other DNA
gtcaccgtcaaactcgcaaa

SEQ ID NO: 41998 - DNA, 20 bp, synthetic construct
  misc_feature 1..20: note = CRISPR gRNA sequence
  source 1..20: mol_type = other DNA
tcaccgtcaaactcgcaaaa

SEQ ID NO: 41999 - DNA, 20 bp, synthetic construct
  misc_feature 1..20: note = CRISPR gRNA sequence
  source 1..20: mol_type = other DNA
caccgtcaaactcgcaaaaa

SEQ ID NO: 42000 - DNA, 20 bp, synthetic construct
  misc_feature 1..20: note = CRISPR gRNA sequence
  source 1..20: mol_type = other DNA
aactcgcaaaaagggaattt

SEQ ID NO: 42001 - DNA, 20 bp, synthetic construct
  misc_feature 1..20: note = CRISPR gRNA sequence
  source 1..20: mol_type = other DNA
tcgcaaaaagggaatttaag

SEQ ID NO: 42002 - DNA, 20 bp, synthetic construct
  misc_feature 1..20: note = CRISPR gRNA sequence
  source 1..20: mol_type = other DNA
atttaagcagaattccccca

SEQ ID NO: 42003 - DNA, 20 bp, synthetic construct
  misc_feature 1..20: note = CRISPR gRNA sequence
  source 1..20: mol_type = other DNA
ttaaaactattttctaattt

SEQ ID NO: 42004 - DNA, 20 bp, synthetic construct
  misc_feature 1..20: note = CRISPR gRNA sequence
  source 1..20: mol_type = other DNA
actattttctaatttcagct

SEQ ID NO: 42005 - DNA, 20 bp, synthetic construct
  misc_feature 1..20: note = CRISPR gRNA sequence
  source 1..20: mol_type = other DNA
tttctaatttcagctcagac

SEQ ID NO: 42006 - DNA, 20 bp, synthetic construct
  misc_feature 1..20: note = CRISPR gRNA sequence
  source 1..20: mol_type = other DNA
taatttcagctcagactggt

SEQ ID NO: 42007 - DNA, 20 bp, synthetic construct
  misc_feature 1..20: note = CRISPR gRNA sequence
  source 1..20: mol_type = other DNA
cagactggttagaattttaa

SEQ ID NO: 42008 - DNA, 20 bp, synthetic construct
  misc_feature 1..20: note = CRISPR gRNA sequence
  source 1..20: mol_type = other DNA
gttagaattttaaaagtatt

SEQ ID NO: 42009 - DNA, 20 bp, synthetic construct
  misc_feature 1..20: note = CRISPR gRNA sequence
  source 1..20: mol_type = other DNA
ttagaattttaaaagtattt

SEQ ID NO: 42010 - DNA, 20 bp, synthetic construct
  misc_feature 1..20: note = CRISPR gRNA sequence
  source 1..20: mol_type = other DNA
aaaagtatttaggccatgtg

SEQ ID NO: 42011 - DNA, 20 bp, synthetic construct
  misc_feature 1..20: note = CRISPR gRNA sequence
  source 1..20: mol_type = other DNA
agtatttaggccatgtgtgg

SEQ ID NO: 42012 - DNA, 20 bp, synthetic construct
  misc_feature 1..20: note = CRISPR gRNA sequence
  source 1..20: mol_type = other DNA
gtggctcatgcctgtaatcc

SEQ ID NO: 42013 - DNA, 20 bp, synthetic construct
  misc_feature 1..20: note = CRISPR gRNA sequence
  source 1..20: mol_type = other DNA
tgcctgtaatcccggcactt

SEQ ID NO: 42014 - DNA, 20 bp, synthetic construct
  misc_feature 1..20: note = CRISPR gRNA sequence
  source 1..20: mol_type = other DNA
gcctgtaatcccggcacttt

SEQ ID NO: 42015 - DNA, 20 bp, synthetic construct
  misc_feature 1..20: note = CRISPR gRNA sequence
  source 1..20: mol_type = other DNA
ctgtaatcccggcactttgg

SEQ ID NO: 42016 - DNA, 20 bp, synthetic construct
  misc_feature 1..20: note = CRISPR gRNA sequence
  source 1..20: mol_type = other DNA
tgtaatcccggcactttggg

SEQ ID NO: 42017 - DNA, 20 bp, synthetic construct
  misc_feature 1..20: note = CRISPR gRNA sequence
  source 1..20: mol_type = other DNA
tcccggcactttgggaggcc

SEQ ID NO: 42018 - DNA, 20 bp, synthetic construct
  misc_feature 1..20: note = CRISPR gRNA sequence
  source 1..20: mol_type = other DNA
cccggcactttgggaggccg

SEQ ID NO: 42019 - DNA, 20 bp, synthetic construct
  misc_feature 1..20: note = CRISPR gRNA sequence
  source 1..20: mol_type = other DNA
ggcactttgggaggccgagg

SEQ ID NO: 42020 - DNA, 20 bp, synthetic construct
  misc_feature 1..20: note = CRISPR gRNA sequence
  source 1..20: mol_type = other DNA
gcactttgggaggccgaggc

SEQ ID NO: 42021 - DNA, 20 bp, synthetic construct
  misc_feature 1..20: note = CRISPR gRNA sequence
  source 1..20: mol_type = other DNA
ctttgggaggccgaggcggg

SEQ ID NO: 42022 - DNA, 20 bp, synthetic construct
  misc_feature 1..20: note = CRISPR gRNA sequence
  source 1..20: mol_type = other DNA
ccgaggcgggcagatcacct

SEQ ID NO: 42023 - DNA, 20 bp, synthetic construct
  misc_feature 1..20: note = CRISPR gRNA sequence
  source 1..20: mol_type = other DNA
cgaggcgggcagatcacctg

SEQ ID NO: 42024 - DNA, 20 bp, synthetic construct
  misc_feature 1..20: note = CRISPR gRNA sequence
  source 1..20: mol_type = other DNA
gcgggcagatcacctgaggt

SEQ ID NO: 42025 - DNA, 20 bp, synthetic construct
  misc_feature 1..20: note = CRISPR gRNA sequence
  source 1..20: mol_type = other DNA
cgggcagatcacctgaggtc

SEQ ID NO: 42026 - DNA, 20 bp, synthetic construct
  misc_feature 1..20: note = CRISPR gRNA sequence
  source 1..20: mol_type = other DNA
ggcagatcacctgaggtcag

SEQ ID NO: 42027 - DNA, 20 bp, synthetic construct
  misc_feature 1..20: note = CRISPR gRNA sequence
  source 1..20: mol_type = other DNA
tcacctgaggtcaggagttt

SEQ ID NO: 42028 - DNA, 20 bp, synthetic construct
  misc_feature 1..20: note = CRISPR gRNA sequence
  source 1..20: mol_type = other DNA
tgaggtcaggagtttgagac

SEQ ID NO: 42029 - DNA, 20 bp, synthetic construct
  misc_feature 1..20: note = CRISPR gRNA sequence
  source 1..20: mol_type = other DNA
tcaggagtttgagaccagcc

SEQ ID NO: 42030 - DNA, 20 bp, synthetic construct
  misc_feature 1..20: note = CRISPR gRNA sequence
  source 1..20: mol_type = other DNA
tgagaccagcctggccaatg

SEQ ID NO: 42031 - DNA, 20 bp, synthetic construct
  misc_feature 1..20: note = CRISPR gRNA sequence
  source 1..20: mol_type = other DNA
tctactaaaaatacaaaaat

SEQ ID NO: 42032 - DNA, 20 bp, synthetic construct
  misc_feature 1..20: note = CRISPR gRNA sequence
  source 1..20: mol_type = other DNA
taaaaatacaaaaattagcc

SEQ ID NO: 42033 - DNA, 20 bp, synthetic construct
  misc_feature 1..20: note = CRISPR gRNA sequence
  source 1..20: mol_type = other DNA
atacaaaaattagcccggtg

SEQ ID NO: 42034 - DNA, 20 bp, synthetic construct
  misc_feature 1..20: note = CRISPR gRNA sequence
  source 1..20: mol_type = other DNA
caaaaattagcccggtgtgg

SEQ ID NO: 42035 - DNA, 20 bp, synthetic construct
  misc_feature 1..20: note = CRISPR gRNA sequence
  source 1..20: mol_type = other DNA
aaattagcccggtgtggtgg

SEQ ID NO: 42036 - DNA, 20 bp, synthetic construct
  misc_feature 1..20: note = CRISPR gRNA sequence
  source 1..20: mol_type = other DNA
aattagcccggtgtggtggt

SEQ ID NO: 42037 - DNA, 20 bp, synthetic construct
  misc_feature 1..20: note = CRISPR gRNA sequence
  source 1..20: mol_type = other DNA
gtggtgggtgcctgtaattc

SEQ ID NO: 42038 - DNA, 20 bp, synthetic construct
  misc_feature 1..20: note = CRISPR gRNA sequence
  source 1..20: mol_type = other DNA
tgcctgtaattccagctact

SEQ ID NO: 42039 - DNA, 20 bp, synthetic construct
  misc_feature 1..20: note = CRISPR gRNA sequence
  source 1..20: mol_type = other DNA
gcctgtaattccagctactt

SEQ ID NO: 42040 - DNA, 20 bp, synthetic construct
  misc_feature 1..20: note = CRISPR gRNA sequence
  source 1..20: mol_type = other DNA
ctgtaattccagctacttgg

SEQ ID NO: 42041 - DNA, 20 bp, synthetic construct
  misc_feature 1..20: note = CRISPR gRNA sequence
  source 1..20: mol_type = other DNA
tgtaattccagctacttggg

SEQ ID NO: 42042 - DNA, 20 bp, synthetic construct
  misc_feature 1..20: note = CRISPR gRNA sequence
  source 1..20: mol_type = other DNA
ttccagctacttgggaggct

SEQ ID NO: 42043 - DNA, 20 bp, synthetic construct
  misc_feature 1..20: note = CRISPR gRNA sequence
  source 1..20: mol_type = other DNA
tccagctacttgggaggctg

SEQ ID NO: 42044 - DNA, 20 bp, synthetic construct
  misc_feature 1..20: note = CRISPR gRNA sequence
  source 1..20: mol_type = other DNA
agctacttgggaggctgagg

SEQ ID NO: 42045 - DNA, 20 bp, synthetic construct
  misc_feature 1..20: note = CRISPR gRNA sequence
  source 1..20: mol_type = other DNA
gctacttgggaggctgaggc

SEQ ID NO: 42046 - DNA, 20 bp, synthetic construct
  misc_feature 1..20: note = CRISPR gRNA sequence
  source 1..20: mol_type = other DNA
tacttgggaggctgaggcag

SEQ ID NO: 42047 - DNA, 20 bp, synthetic construct
  misc_feature 1..20: note = CRISPR gRNA sequence
  source 1..20: mol_type = other DNA
gcaggagaattgcttgaact

SEQ ID NO: 42048 - DNA, 20 bp, synthetic construct
  misc_feature 1..20: note = CRISPR gRNA sequence
  source 1..20: mol_type = other DNA
caggagaattgcttgaactt

SEQ ID NO: 42049 - DNA, 20 bp, synthetic construct
  misc_feature 1..20: note = CRISPR gRNA sequence
  source 1..20: mol_type = other DNA
ggagaattgcttgaacttgg

SEQ ID NO: 42050 - DNA, 20 bp, synthetic construct
  misc_feature 1..20: note = CRISPR gRNA sequence
  source 1..20: mol_type = other DNA
gagaattgcttgaacttggg

SEQ ID NO: 42051 - DNA, 20 bp, synthetic construct
  misc_feature 1..20: note = CRISPR gRNA sequence
  source 1..20: mol_type = other DNA
aattgcttgaacttgggagg

SEQ ID NO: 42052 - DNA, 20 bp, synthetic construct
  misc_feature 1..20: note = CRISPR gRNA sequence
  source 1..20: mol_type = other DNA
ttgcttgaacttgggaggcg

SEQ ID NO: 42053 - DNA, 20 bp, synthetic construct
  misc_feature 1..20: note = CRISPR gRNA sequence
  source 1..20: mol_type = other DNA
tgcttgaacttgggaggcgg

SEQ ID NO: 42054 - DNA, 20 bp, synthetic construct
  misc_feature 1..20: note = CRISPR gRNA sequence
  source 1..20: mol_type = other DNA
aacttgggaggcggaggttg

SEQ ID NO: 42055 - DNA, 20 bp, synthetic construct
  misc_feature 1..20: note = CRISPR gRNA sequence
  source 1..20: mol_type = other DNA
tgggaggcggaggttgcagt

SEQ ID NO: 42056 - DNA, 20 bp, synthetic construct
  misc_feature 1..20: note = CRISPR gRNA sequence
  source 1..20: mol_type = other DNA
ggcggaggttgcagtgagcc

SEQ ID NO: 42057 - DNA, 20 bp, synthetic construct
  misc_feature 1..20: note = CRISPR gRNA sequence
  source 1..20: mol_type = other DNA
gagatcgcgccattgcactc

SEQ ID NO: 42058 - DNA, 20 bp, synthetic construct
  misc_feature 1..20: note = CRISPR gRNA sequence
  source 1..20: mol_type = other DNA
cgcgccattgcactccagct

SEQ ID NO: 42059 - DNA, 20 bp, synthetic construct
  misc_feature 1..20: note = CRISPR gRNA sequence
  source 1..20: mol_type = other DNA
gcgccattgcactccagctt

SEQ ID NO: 42060 - DNA, 20 bp, synthetic construct
  misc_feature 1..20: note = CRISPR gRNA sequence
  source 1..20: mol_type = other DNA
tgcactccagcttgggcgac

SEQ ID NO: 42061 - DNA, 20 bp, synthetic construct
  misc_feature 1..20: note = CRISPR gRNA sequence
  source 1..20: mol_type = other DNA
cactccagcttgggcgacaa

SEQ ID NO: 42062 - DNA, 20 bp, synthetic construct
  misc_feature 1..20: note = CRISPR gRNA sequence
  source 1..20: mol_type = other DNA
acaagagtgaaactccatct

SEQ ID NO: 42063 - DNA, 20 bp, synthetic construct
  misc_feature 1..20: note = CRISPR gRNA sequence
  source 1..20: mol_type = other DNA
ctccatctcagaaaaaaaaa

SEQ ID NO: 42064 - DNA, 20 bp, synthetic construct
  misc_feature 1..20: note = CRISPR gRNA sequence
  source 1..20: mol_type = other DNA
cagaaaaaaaaaaagaaaaa

SEQ ID NO: 42065 - DNA, 20 bp, synthetic construct
  misc_feature 1..20: note = CRISPR gRNA sequence
  source 1..20: mol_type = other DNA
aaaaaaaagaaaaaaagaaa

SEQ ID NO: 42066 - DNA, 20 bp, synthetic construct
  misc_feature 1..20: note = CRISPR gRNA sequence
  source 1..20: mol_type = other DNA
aaaagaaaaaaagaaaaaga

SEQ ID NO: 42067 - DNA, 20 bp, synthetic construct
  misc_feature 1..20: note = CRISPR gRNA sequence
  source 1..20: mol_type = other DNA
aaaagaaaaagaaagaattt

SEQ ID NO: 42068 - DNA, 20 bp, synthetic construct
  misc_feature 1..20: note = CRISPR gRNA sequence
  source 1..20: mol_type = other DNA
agaaaaagaaagaattttag

SEQ ID NO: 42069 - DNA, 20 bp, synthetic construct
  misc_feature 1..20: note = CRISPR gRNA sequence
  source 1..20: mol_type = other DNA
gaaaaagaaagaattttaga

SEQ ID NO: 42070 - DNA, 20 bp, synthetic construct
  misc_feature 1..20: note = CRISPR gRNA sequence
  source 1..20: mol_type = other DNA
ttagaaggatttactttaaa

SEQ ID NO: 42071 - DNA, 20 bp, synthetic construct
  misc_feature 1..20: note = CRISPR gRNA sequence
  source 1..20: mol_type = other DNA
atttactttaaacagtcttc

SEQ ID NO: 42072 - DNA, 20 bp, synthetic construct
  misc_feature 1..20: note = CRISPR gRNA sequence
  source 1..20: mol_type = other DNA
tactttaaacagtcttctag

SEQ ID NO: 42073 - DNA, 20 bp, synthetic construct
  misc_feature 1..20: note = CRISPR gRNA sequence
  source 1..20: mol_type = other DNA
tttaaacagtcttctagtgg

SEQ ID NO: 42074 - DNA, 20 bp, synthetic construct
  misc_feature 1..20: note = CRISPR gRNA sequence
  source 1..20: mol_type = other DNA
ttaaacagtcttctagtggt

SEQ ID NO: 42075 - DNA, 20 bp, synthetic construct
  misc_feature 1..20: note = CRISPR gRNA sequence
  source 1..20: mol_type = other DNA
aaacagtcttctagtggtgg

SEQ ID NO: 42076 - DNA, 20 bp, synthetic construct
  misc_feature 1..20: note = CRISPR gRNA sequence
  source 1..20: mol_type = other DNA
aacagtcttctagtggtggg

SEQ ID NO: 42077 - DNA, 20 bp, synthetic construct
  misc_feature 1..20: note = CRISPR gRNA sequence
  source 1..20: mol_type = other DNA
agtcttctagtggtgggagg

SEQ ID NO: 42078 - DNA, 20 bp, synthetic construct
  misc_feature 1..20: note = CRISPR gRNA sequence
  source 1..20: mol_type = other DNA
gtcttctagtggtgggaggc

SEQ ID NO: 42079 - DNA, 20 bp, synthetic construct
  misc_feature 1..20: note = CRISPR gRNA sequence
  source 1..20: mol_type = other DNA
tcttctagtggtgggaggcg

SEQ ID NO: 42080 - DNA, 20 bp, synthetic construct
  misc_feature 1..20: note = CRISPR gRNA sequence
  source 1..20: mol_type = other DNA
tctagtggtgggaggcgggg

SEQ ID NO: 42081 - DNA, 20 bp, synthetic construct
  misc_feature 1..20: note = CRISPR gRNA sequence
  source 1..20: mol_type = other DNA
ctagtggtgggaggcggggt

SEQ ID NO: 42082 - DNA, 20 bp, synthetic construct
  misc_feature 1..20: note = CRISPR gRNA sequence
  source 1..20: mol_type = other DNA
gtggtgggaggcggggtggg

SEQ ID NO: 42083 - DNA, 20 bp, synthetic construct
  misc_feature 1..20: note = CRISPR gRNA sequence
  source 1..20: mol_type = other DNA
gtgggaggcggggtgggaag

SEQ ID NO: 42084 - DNA, 20 bp, synthetic construct
  misc_feature 1..20: note = CRISPR gRNA sequence
  source 1..20: mol_type = other DNA
ggcggggtgggaagcagctg

SEQ ID NO: 42085 - DNA, 20 bp, synthetic construct
  misc_feature 1..20: note = CRISPR gRNA sequence
  source 1..20: mol_type = other DNA
ggtgggaagcagctgcagct

SEQ ID NO: 42086 - DNA, 20 bp, synthetic construct
  misc_feature 1..20: note = CRISPR gRNA sequence
  source 1..20: mol_type = other DNA
gcagctaagatgaaaaaata

SEQ ID NO: 42087 - DNA, 20 bp, synthetic construct
  misc_feature 1..20: note = CRISPR gRNA sequence
  source 1..20: mol_type = other DNA
gctaagatgaaaaaatacag

SEQ ID NO: 42088 - DNA, 20 bp, synthetic construct
  misc_feature 1..20: note = CRISPR gRNA sequence
  source 1..20: mol_type = other DNA
ctaagatgaaaaaatacagc

SEQ ID NO: 42089 - DNA, 20 bp, synthetic construct
  misc_feature 1..20: note = CRISPR gRNA sequence
  source 1..20: mol_type = other DNA
gatgaaaaaatacagcagga

SEQ ID NO: 42090 - DNA, 20 bp, synthetic construct
  misc_feature 1..20: note = CRISPR gRNA sequence
  source 1..20: mol_type = other DNA
aatcataatgttaataacat

SEQ ID NO: 42091 - DNA, 20 bp, synthetic construct
  misc_feature 1..20: note = CRISPR gRNA sequence
  source 1..20: mol_type = other DNA
atgttaataacatcggtgca

SEQ ID NO: 42092 - DNA, 20 bp, synthetic construct
  misc_feature 1..20: note = CRISPR gRNA sequence
  source 1..20: mol_type = other DNA
tgttaataacatcggtgcaa

SEQ ID NO: 42093 - DNA, 20 bp, synthetic construct
  misc_feature 1..20: note = CRISPR gRNA sequence
  source 1..20: mol_type = other DNA
aataacatcggtgcaaaggc

SEQ ID NO: 42094 - DNA, 20 bp, synthetic construct
  misc_feature 1..20: note = CRISPR gRNA sequence
  source 1..20: mol_type = other DNA
ataacatcggtgcaaaggct

SEQ ID NO: 42095 - DNA, 20 bp, synthetic construct
  misc_feature 1..20: note = CRISPR gRNA sequence
  source 1..20: mol_type = other DNA
taacatcggtgcaaaggctg

SEQ ID NO: 42096 - DNA, 20 bp, synthetic construct
  misc_feature 1..20: note = CRISPR gRNA sequence
  source 1..20: mol_type = other DNA
gtgcaaaggctggggctctc

SEQ ID NO: 42097 - DNA, 20 bp, synthetic construct
  misc_feature 1..20: note = CRISPR gRNA sequence
  source 1..20: mol_type = other DNA
tgcaaaggctggggctctct

SEQ ID NO: 42098 - DNA, 20 bp, synthetic construct
  misc_feature 1..20: note = CRISPR gRNA sequence
  source 1..20: mol_type = other DNA
tggggctctctgggatgtct

SEQ ID NO: 42099 - DNA, 20 bp, synthetic construct
  misc_feature 1..20: note = CRISPR gRNA sequence
  source 1..20: mol_type = other DNA
gctctctgggatgtctaaga

SEQ ID NO: 42100 - DNA, 20 bp, synthetic construct
  misc_feature 1..20: note = CRISPR gRNA sequence
  source 1..20: mol_type = other DNA
aagatggctcgcatcacctc

SEQ ID NO: 42101 - DNA, 20 bp, synthetic construct
  misc_feature 1..20: note = CRISPR gRNA sequence
  source 1..20: mol_type = other DNA
agatggctcgcatcacctcc

SEQ ID NO: 42102 - DNA, 20 bp, synthetic construct
  misc_feature 1..20: note = CRISPR gRNA sequence
  source 1..20: mol_type = other DNA
tccaggatctcgcttatgct

SEQ ID NO: 42103 - DNA, 20 bp, synthetic construct
  misc_feature 1..20: note = CRISPR gRNA sequence
  source 1..20: mol_type = other DNA
ccaggatctcgcttatgctt

SEQ ID NO: 42104 - DNA, 20 bp, synthetic construct
  misc_feature 1..20: note = CRISPR gRNA sequence
  source 1..20: mol_type = other DNA
gcttatgcttgggttttatc

SEQ ID NO: 42105 - DNA, 20 bp, synthetic construct
  misc_feature 1..20: note = CRISPR gRNA sequence
  source 1..20: mol_type = other DNA
cttatgcttgggttttatct

SEQ ID NO: 42106 - DNA, 20 bp, synthetic construct
  misc_feature 1..20: note = CRISPR gRNA sequence
  source 1..20: mol_type = other DNA
tatgcttgggttttatctgg

SEQ ID NO: 42107 - DNA, 20 bp, synthetic construct
  misc_feature 1..20: note = CRISPR gRNA sequence
  source 1..20: mol_type = other DNA
atgcttgggttttatctggg

SEQ ID NO: 42108 - DNA, 20 bp, synthetic construct
  misc_feature 1..20: note = CRISPR gRNA sequence
  source 1..20: mol_type = other DNA
tgcttgggttttatctggga

SEQ ID NO: 42109 - DNA, 20 bp, synthetic construct
  misc_feature 1..20: note = CRISPR gRNA sequence
  source 1..20: mol_type = other DNA
cttgggttttatctgggagg

SEQ ID NO: 42110 - DNA, 20 bp, synthetic construct
  misc_feature 1..20: note = CRISPR gRNA sequence
  source 1..20: mol_type = other DNA
ttgggttttatctgggaggg

SEQ ID NO: 42111 - DNA, 20 bp, synthetic construct
  misc_feature 1..20: note = CRISPR gRNA sequence
  source 1..20: mol_type = other DNA
tgggttttatctgggaggga

SEQ ID NO: 42112 - DNA, 20 bp, synthetic construct
  misc_feature 1..20: note = CRISPR gRNA sequence
  source 1..20: mol_type = other DNA
ggttttatctgggagggagg

SEQ ID NO: 42113 - DNA, 20 bp, synthetic construct
  misc_feature 1..20: note = CRISPR gRNA sequence
  source 1..20: mol_type = other DNA
gttttatctgggagggaggg

SEQ ID NO: 42114 - DNA, 20 bp, synthetic construct
  misc_feature 1..20: note = CRISPR gRNA sequence
  source 1..20: mol_type = other DNA
tttatctgggagggagggag

SEQ ID NO: 42115 - DNA, 20 bp, synthetic construct
  misc_feature 1..20: note = CRISPR gRNA sequence
  source 1..20: mol_type = other DNA
gaggagacgtgacaacattc

SEQ ID NO: 42116 - DNA, 20 bp, synthetic construct
  misc_feature 1..20: note = CRISPR gRNA sequence
  source 1..20: mol_type = other DNA
aggagacgtgacaacattcc

SEQ ID NO: 42117 - DNA, 20 bp, synthetic construct
  misc_feature 1..20: note = CRISPR gRNA sequence
  source 1..20: mol_type = other DNA
ggagacgtgacaacattcca

SEQ ID NO: 42118 - DNA, 20 bp, synthetic construct
  misc_feature 1..20: note = CRISPR gRNA sequence
  source 1..20: mol_type = other DNA
gagacgtgacaacattccag

SEQ ID NO: 42119 - DNA, 20 bp, synthetic construct
  misc_feature 1..20: note = CRISPR gRNA sequence
  source 1..20: mol_type = other DNA
cgtgacaacattccaggggc

SEQ ID NO: 42120 - DNA, 20 bp, synthetic construct
  misc_feature 1..20: note = CRISPR gRNA sequence
  source 1..20: mol_type = other DNA
caacattccaggggcaagta

SEQ ID NO: 42121 - DNA, 20 bp, synthetic construct
  misc_feature 1..20: note = CRISPR gRNA sequence
  source 1..20: mol_type = other DNA
ttccaggggcaagtacagcc

SEQ ID NO: 42122 - DNA, 20 bp, synthetic construct
  misc_feature 1..20: note = CRISPR gRNA sequence
  source 1..20: mol_type = other DNA
ggcaagtacagcccagctca

SEQ ID NO: 42123 - DNA, 20 bp, synthetic construct
  misc_feature 1..20: note = CRISPR gRNA sequence
  source 1..20: mol_type = other DNA
gcccagctcacagcacccca

SEQ ID NO: 42124 - DNA, 20 bp, synthetic construct
  misc_feature 1..20: note = CRISPR gRNA sequence
  source 1..20: mol_type = other DNA
caccccatggcaccctgtaa

SEQ ID NO: 42125 - DNA, 20 bp, synthetic construct
  misc_feature 1..20: note = CRISPR gRNA sequence
  source 1..20: mol_type = other DNA
tgtaatagtcccaccctgcc

SEQ ID NO: 42126 - DNA, 20 bp, synthetic construct
  misc_feature 1..20: note = CRISPR gRNA sequence
  source 1..20: mol_type = other DNA
taatagtcccaccctgcccg

SEQ ID NO: 42127 - DNA, 20 bp, synthetic construct
  misc_feature 1..20: note = CRISPR gRNA sequence
  source 1..20: mol_type = other DNA
ccaccctgcccggagataat

SEQ ID NO: 42128 - DNA, 20 bp, synthetic construct
  misc_feature 1..20: note = CRISPR gRNA sequence
  source 1..20: mol_type = other DNA
cctgcccggagataatgagt

SEQ ID NO: 42129 - DNA, 20 bp, synthetic construct
  misc_feature 1..20: note = CRISPR gRNA sequence
  source 1..20: mol_type = other DNA
cccggagataatgagtcaga

SEQ ID NO: 42130 - DNA, 20 bp, synthetic construct
  misc_feature 1..20: note = CRISPR gRNA sequence
  source 1..20: mol_type = other DNA
ccggagataatgagtcagaa

SEQ ID NO: 42131 - DNA, 20 bp, synthetic construct
  misc_feature 1..20: note = CRISPR gRNA sequence
  source 1..20: mol_type = other DNA
tgagtcagaaaggactcctt

SEQ ID NO: 42132 - DNA, 20 bp, synthetic construct
  misc_feature 1..20: note = CRISPR gRNA sequence
  source 1..20: mol_type = other DNA
aaggactcctttggacataa

SEQ ID NO: 42133 - DNA, 20 bp, synthetic construct
  misc_feature 1..20: note = CRISPR gRNA sequence
  source 1..20: mol_type = other DNA
aggactcctttggacataaa

SEQ ID NO: 42134 - DNA, 20 bp, synthetic construct
  misc_feature 1..20: note = CRISPR gRNA sequence
  source 1..20: mol_type = other DNA
actcctttggacataaaagg

SEQ ID NO: 42135 - DNA, 20 bp, synthetic construct
  misc_feature 1..20: note = CRISPR gRNA sequence
  source 1..20: mol_type = other DNA
cctttggacataaaaggtgg

SEQ ID NO: 42136 - DNA, 20 bp, synthetic construct
  misc_feature 1..20: note = CRISPR gRNA sequence
  source 1..20: mol_type = other DNA
ctttggacataaaaggtggc

SEQ ID NO: 42137 - DNA, 20 bp, synthetic construct
  misc_feature 1..20: note = CRISPR gRNA sequence
  source 1..20: mol_type = other DNA
ggtggcaggttaaaattgaa

SEQ ID NO: 42138 - DNA, 20 bp, synthetic construct
  misc_feature 1..20: note = CRISPR gRNA sequence
  source 1..20: mol_type = other DNA
gtggcaggttaaaattgaac

SEQ ID NO: 42139 - DNA, 20 bp, synthetic construct
  misc_feature 1..20: note = CRISPR gRNA sequence
  source 1..20: mol_type = other DNA
caggttaaaattgaacaggt

SEQ ID NO: 42140 - DNA, 20 bp, synthetic construct
  misc_feature 1..20: note = CRISPR gRNA sequence
  source 1..20: mol_type = other DNA
attgaacaggttggaaacct

SEQ ID NO: 42141 - DNA, 20 bp, synthetic construct
  misc_feature 1..20: note = CRISPR gRNA sequence
  source 1..20: mol_type = other DNA
acaggttggaaacctcagac

SEQ ID NO: 42142 - DNA, 20 bp, synthetic construct
  misc_feature 1..20: note = CRISPR gRNA sequence
  source 1..20: mol_type = other DNA
aggttggaaacctcagaccg

SEQ ID NO: 42143 - DNA, 20 bp, synthetic construct
  misc_feature 1..20: note = CRISPR gRNA sequence
  source 1..20: mol_type = other DNA
gttggaaacctcagaccgga

SEQ ID NO: 42144 - DNA, 20 bp, synthetic construct
  misc_feature 1..20: note = CRISPR gRNA sequence
  source 1..20: mol_type = other DNA
ttggaaacctcagaccggag

SEQ ID NO: 42145 - DNA, 20 bp, synthetic construct
  misc_feature 1..20: note = CRISPR gRNA sequence
  source 1..20: mol_type = other DNA
ttctctttgcctaaatcaca

SEQ ID NO: 42146 - DNA, 20 bp, synthetic construct
  misc_feature 1..20: note = CRISPR gRNA sequence
  source 1..20: mol_type = other DNA
cctgactcctcgtccgcctt

SEQ ID NO: 42147 - DNA, 20 bp, synthetic construct
  misc_feature 1..20: note = CRISPR gRNA sequence
  source 1..20: mol_type = other DNA
tgactcctcgtccgcctttg

SEQ ID NO: 42148 - DNA, 20 bp, synthetic construct
  misc_feature 1..20: note = CRISPR gRNA sequence
  source 1..20: mol_type = other DNA
ctcctcgtccgcctttggag

SEQ ID NO: 42149 - DNA, 20 bp, synthetic construct
  misc_feature 1..20: note = CRISPR gRNA sequence
  source 1..20: mol_type = other DNA
cgtccgcctttggagtggcg

SEQ ID NO: 42150 - DNA, 20 bp, synthetic construct
  misc_feature 1..20: note = CRISPR gRNA sequence
  source 1..20: mol_type = other DNA
cgcctttggagtggcgtggc

SEQ ID NO: 42151 - DNA, 20 bp, synthetic construct
  misc_feature 1..20: note = CRISPR gRNA sequence
  source 1..20: mol_type = other DNA
tggccagcctgaccccttgc

SEQ ID NO: 42152 - DNA, 20 bp, synthetic construct
  misc_feature 1..20: note = CRISPR gRNA sequence
  source 1..20: mol_type = other DNA
ggccagcctgaccccttgcc

SEQ ID NO: 42153 - DNA, 20 bp, synthetic construct
  misc_feature 1..20: note = CRISPR gRNA sequence
  source 1..20: mol_type = other DNA
gccagcctgaccccttgcca

SEQ ID NO: 42154 - DNA, 20 bp, synthetic construct
  misc_feature 1..20: note = CRISPR gRNA sequence
  source 1..20: mol_type = other DNA
ttgccagggtttaaactttg

SEQ ID NO: 42155 - DNA, 20 bp, synthetic construct
  misc_feature 1..20: note = CRISPR gRNA sequence
  source 1..20: mol_type = other DNA
actttgtagtactcaacgtg

SEQ ID NO: 42156 - DNA, 20 bp, synthetic construct
  misc_feature 1..20: note = CRISPR gRNA sequence
  source 1..20: mol_type = other DNA
tactcaacgtgtagtgcttg

SEQ ID NO: 42157 - DNA, 20 bp, synthetic construct
  misc_feature 1..20: note = CRISPR gRNA sequence
  source 1..20: mol_type = other DNA
tagtgcttgtggccctactg

SEQ ID NO: 42158 - DNA, 20 bp, synthetic construct
  misc_feature 1..20: note = CRISPR gRNA sequence
  source 1..20: mol_type = other DNA
agtgcttgtggccctactgt

SEQ ID NO: 42159 - DNA, 20 bp, synthetic construct
  misc_feature 1..20: note = CRISPR gRNA sequence
  source 1..20: mol_type = other DNA
cttgtggccctactgtgggc

SEQ ID NO: 42160 - DNA, 20 bp, synthetic construct
  misc_feature 1..20: note = CRISPR gRNA sequence
  source 1..20: mol_type = other DNA
ttgtggccctactgtgggcc

SEQ ID NO: 42161 - DNA, 20 bp, synthetic construct
  misc_feature 1..20: note = CRISPR gRNA sequence
  source 1..20: mol_type = other DNA
ccaggcattgtgtgacgaca

SEQ ID NO: 42162 - DNA, 20 bp, synthetic construct
  misc_feature 1..20: note = CRISPR gRNA sequence
  source 1..20: mol_type = other DNA
ggcattgtgtgacgacacag

SEQ ID NO: 42163 - DNA, 20 bp, synthetic construct
  misc_feature 1..20: note = CRISPR gRNA sequence
  source 1..20: mol_type = other DNA
gtgtgacgacacagcagaaa

SEQ ID NO: 42164 - DNA, 20 bp, synthetic construct
  misc_feature 1..20: note = CRISPR gRNA sequence
  source 1..20: mol_type = other DNA
tgaccatgtccttatcttct

SEQ ID NO: 42165 - DNA, 20 bp, synthetic construct
  misc_feature 1..20: note = CRISPR gRNA sequence
  source 1..20: mol_type = other DNA
accatgtccttatcttcttg

SEQ ID NO: 42166 - DNA, 20 bp, synthetic construct
  misc_feature 1..20: note = CRISPR gRNA sequence
  source 1..20: mol_type = other DNA
tcttggagctcctcttacaa

SEQ ID NO: 42167 - DNA, 20 bp, synthetic construct
  misc_feature 1..20: note = CRISPR gRNA sequence
  source 1..20: mol_type = other DNA
tggagctcctcttacaatag

SEQ ID NO: 42168 - DNA, 20 bp, synthetic construct
  misc_feature 1..20: note = CRISPR gRNA sequence
  source 1..20: mol_type = other DNA
ggagctcctcttacaatagt

SEQ ID NO: 42169 - DNA, 20 bp, synthetic construct
  misc_feature 1..20: note = CRISPR gRNA sequence
  source 1..20: mol_type = other DNA
agctcctcttacaatagtgg

SEQ ID NO: 42170 - DNA, 20 bp, synthetic construct
  misc_feature 1..20: note = CRISPR gRNA sequence
  source 1..20: mol_type = other DNA
aatagtgggagctgaaaaat

SEQ ID NO: 42171 - DNA, 20 bp, synthetic construct
  misc_feature 1..20: note = CRISPR gRNA sequence
  source 1..20: mol_type = other DNA
tgggagctgaaaaataagta

SEQ ID NO: 42172 - DNA, 20 bp, synthetic construct
  misc_feature 1..20: note = CRISPR gRNA sequence
  source 1..20: mol_type = other DNA
taagtaaagtaaaatcaaat

SEQ ID NO: 42173 - DNA, 20 bp, synthetic construct
  misc_feature 1..20: note = CRISPR gRNA sequence
  source 1..20: mol_type = other DNA
aaaatcaaataagatgaact

SEQ ID NO: 42174 - DNA, 20 bp, synthetic construct
  misc_feature 1..20: note = CRISPR gRNA sequence
  source 1..20: mol_type = other DNA
tcaaataagatgaacttagc

SEQ ID NO: 42175 - DNA, 20 bp, synthetic construct
  misc_feature 1..20: note = CRISPR gRNA sequence
  source 1..20: mol_type = other DNA
agatgaacttagccagtgat

SEQ ID NO: 42176 - DNA, 20 bp, synthetic construct
  misc_feature 1..20: note = CRISPR gRNA sequence
  source 1..20: mol_type = other DNA
atgaacttagccagtgataa

SEQ ID NO: 42177 - DNA, 20 bp, synthetic construct
  misc_feature 1..20: note = CRISPR gRNA sequence
  source 1..20: mol_type = other DNA
cagtgataagagaattttct

SEQ ID NO: 42178 - DNA, 20 bp, synthetic construct
  misc_feature 1..20: note = CRISPR gRNA sequence
  source 1..20: mol_type = other DNA
agtgataagagaattttctc

SEQ ID NO: 42179 - DNA, 20 bp, synthetic construct
  misc_feature 1..20: note = CRISPR gRNA sequence
  source 1..20: mol_type = other DNA
aagagaattttctcgggatg

SEQ ID NO: 42180 - DNA, 20 bp, synthetic construct
  misc_feature 1..20: note = CRISPR gRNA sequence
  source 1..20: mol_type = other DNA
aattttctcgggatgtggtg

SEQ ID NO: 42181 - DNA, 20 bp, synthetic construct
  misc_feature 1..20: note = CRISPR gRNA sequence
  source 1..20: mol_type = other DNA
ttttctcgggatgtggtgaa

SEQ ID NO: 42182 - DNA, 20 bp, synthetic construct
  misc_feature 1..20: note = CRISPR gRNA sequence
  source 1..20: mol_type = other DNA
tctcgggatgtggtgaagag

SEQ ID NO: 42183 - DNA, 20 bp, synthetic construct
  misc_feature 1..20: note = CRISPR gRNA sequence
  source 1..20: mol_type = other DNA
gggatgtggtgaagagtggc

SEQ ID NO: 42184 - DNA, 20 bp, synthetic construct
  misc_feature 1..20: note = CRISPR gRNA sequence
  source 1..20: mol_type = other DNA
gatgtggtgaagagtggctg

SEQ ID NO: 42185 - DNA, 20 bp, synthetic construct
  misc_feature 1..20: note = CRISPR gRNA sequence
  source 1..20: mol_type = other DNA
tgtggtgaagagtggctgga

SEQ ID NO: 42186 - DNA, 20 bp, synthetic construct
  misc_feature 1..20: note = CRISPR gRNA sequence
  source 1..20: mol_type = other DNA
gtggtgaagagtggctggag

SEQ ID NO: 42187 - DNA, 20 bp, synthetic construct
  misc_feature 1..20: note = CRISPR gRNA sequence
  source 1..20: mol_type = other DNA
gagtggctggagaggtgatt

SEQ ID NO: 42188 - DNA, 20 bp, synthetic construct
  misc_feature 1..20: note = CRISPR gRNA sequence
  source 1..20: mol_type = other DNA
ctggagaggtgatttagatg

SEQ ID NO: 42189 - DNA, 20 bp, synthetic construct
  misc_feature 1..20: note = CRISPR gRNA sequence
  source 1..20: mol_type = other DNA
gagaggtgatttagatgtgg

SEQ ID NO: 42190 - DNA, 20 bp, synthetic construct
  misc_feature 1..20: note = CRISPR gRNA sequence
  source 1..20: mol_type = other DNA
aggtgatttagatgtggcag

SEQ ID NO: 42191 - DNA, 20 bp, synthetic construct
  misc_feature 1..20: note = CRISPR gRNA sequence
  source 1..20: mol_type = other DNA
ttagatgtggcagaagccat

SEQ ID NO: 42192 - DNA, 20 bp, synthetic construct
  misc_feature 1..20: note = CRISPR gRNA sequence
  source 1..20: mol_type = other DNA
tagatgtggcagaagccatc

SEQ ID NO: 42193 - DNA, 20 bp, synthetic construct
  misc_feature 1..20: note = CRISPR gRNA sequence
  source 1..20: mol_type = other DNA
agatgtggcagaagccatca

SEQ ID NO: 42194 - DNA, 20 bp, synthetic construct
  misc_feature 1..20: note = CRISPR gRNA sequence
  source 1..20: mol_type = other DNA
agccatcagggaacatctct

SEQ ID NO: 42195 - DNA, 20 bp, synthetic construct
  misc_feature 1..20: note = CRISPR gRNA sequence
  source 1..20: mol_type = other DNA
gccatcagggaacatctctg

SEQ ID NO: 42196 - DNA, 20 bp, synthetic construct
  misc_feature 1..20: note = CRISPR gRNA sequence
  source 1..20: mol_type = other DNA
catcagggaacatctctgag

SEQ ID NO: 42197 - DNA, 20 bp, synthetic construct
  misc_feature 1..20: note = CRISPR gRNA sequence
  source 1..20: mol_type = other DNA
atcagggaacatctctgagg

SEQ ID NO: 42198 - DNA, 20 bp, synthetic construct
  misc_feature 1..20: note = CRISPR gRNA sequence
  source 1..20: mol_type = other DNA
tcagggaacatctctgagga

SEQ ID NO: 42199 - DNA, 20 bp, synthetic construct
  misc_feature 1..20: note = CRISPR gRNA sequence
  source 1..20: mol_type = other DNA
catctctgaggagggatgct

SEQ ID NO: 42200 - DNA, 20 bp, synthetic construct
  misc_feature 1..20: note = CRISPR gRNA sequence
  source 1..20: mol_type = other DNA
tctgaggagggatgctgagc

SEQ ID NO: 42201 - DNA, 20 bp, synthetic construct
  misc_feature 1..20: note = CRISPR gRNA sequence
  source 1..20: mol_type = other DNA
ctgaggagggatgctgagct

SEQ ID NO: 42202 - DNA, 20 bp, synthetic construct
  misc_feature 1..20: note = CRISPR gRNA sequence
  source 1..20: mol_type = other DNA
ggatgctgagctgggaccta

SEQ ID NO: 42203 - DNA, 20 bp, synthetic construct
  misc_feature 1..20: note = CRISPR gRNA sequence
  source 1..20: mol_type = other DNA
gatgctgagctgggacctaa

SEQ ID NO: 42204 - DNA, 20 bp, synthetic construct
  misc_feature 1..20: note = CRISPR gRNA sequence
  source 1..20: mol_type = other DNA
gctgagctgggacctaaagg

SEQ ID NO: 42205 - DNA, 20 bp, synthetic construct
  misc_feature 1..20: note = CRISPR gRNA sequence
  source 1..20: mol_type = other DNA
tgagctgggacctaaaggaa

SEQ ID NO: 42206 - DNA, 20 bp, synthetic construct
  misc_feature 1..20: note = CRISPR gRNA sequence
  source 1..20: mol_type = other DNA
agctgggacctaaaggaaga

SEQ ID NO: 42207 - DNA, 20 bp, synthetic construct
  misc_feature 1..20: note = CRISPR gRNA sequence
  source 1..20: mol_type = other DNA
ctgggacctaaaggaagaga

SEQ ID NO: 42208 - DNA, 20 bp, synthetic construct
  misc_feature 1..20: note = CRISPR gRNA sequence
  source 1..20: mol_type = other DNA
gggacctaaaggaagagaga

SEQ ID NO: 42209 - DNA, 20 bp, synthetic construct
  misc_feature 1..20: note = CRISPR gRNA sequence
  source 1..20: mol_type = other DNA
gagagagagctcgccttgtg

SEQ ID NO: 42210 - DNA, 20 bp, synthetic construct
  misc_feature 1..20: note = CRISPR gRNA sequence
  source 1..20: mol_type = other DNA
gagagagctcgccttgtgaa

SEQ ID NO: 42211 - DNA, 20 bp, synthetic construct
  misc_feature 1..20: note = CRISPR gRNA sequence
  source 1..20: mol_type = other DNA
agagctcgccttgtgaagag

SEQ ID NO: 42212 - DNA, 20 bp, synthetic construct
  misc_feature 1..20: note = CRISPR gRNA sequence
  source 1..20: mol_type = other DNA
gagctcgccttgtgaagagc

SEQ ID NO: 42213 - DNA, 20 bp, synthetic construct
  misc_feature 1..20: note = CRISPR gRNA sequence
  source 1..20: mol_type = other DNA
agctcgccttgtgaagagca

SEQ ID NO: 42214 - DNA, 20 bp, synthetic construct
  misc_feature 1..20: note = CRISPR gRNA sequence
  source 1..20: mol_type = other DNA
aagagcagggaactgcattc

SEQ ID NO: 42215 - DNA, 20 bp, synthetic construct
  misc_feature 1..20: note = CRISPR gRNA sequence
  source 1..20: mol_type = other DNA
agagcagggaactgcattcc

SEQ ID NO: 42216 - DNA, 20 bp, synthetic construct
  misc_feature 1..20: note = CRISPR gRNA sequence
  source 1..20: mol_type = other DNA
gcagggaactgcattccagg

SEQ ID NO: 42217 - DNA, 20 bp, synthetic construct
  misc_feature 1..20: note = CRISPR gRNA sequence
  source 1..20: mol_type = other DNA
agggaactgcattccaggca

SEQ ID NO: 42218 - DNA, 20 bp, synthetic construct
  misc_feature 1..20: note = CRISPR gRNA sequence
  source 1..20: mol_type = other DNA
gggaactgcattccaggcag

SEQ ID NO: 42219 - DNA, 20 bp, synthetic construct
  misc_feature 1..20: note = CRISPR gRNA sequence
  source 1..20: mol_type = other DNA
ggaactgcattccaggcaga

SEQ ID NO: 42220 - DNA, 20 bp, synthetic construct
  misc_feature 1..20: note = CRISPR gRNA sequence
  source 1..20: mol_type = other DNA
tgcattccaggcagagggaa

SEQ ID NO: 42221 - DNA, 20 bp, synthetic construct
  misc_feature 1..20: note = CRISPR gRNA sequence
  source 1..20: mol_type = other DNA
gcagagggaacggcatgtgt

SEQ ID NO: 42222 - DNA, 20 bp, synthetic construct
  misc_feature 1..20: note = CRISPR gRNA sequence
  source 1..20: mol_type = other DNA
cagagggaacggcatgtgtg

SEQ ID NO: 42223 - DNA, 20 bp, synthetic construct
  misc_feature 1..20: note = CRISPR gRNA sequence
  source 1..20: mol_type = other DNA
aacggcatgtgtgaggccct

SEQ ID NO: 42224 - DNA, 20 bp, synthetic construct
  misc_feature 1..20: note = CRISPR gRNA sequence
  source 1..20: mol_type = other DNA
acggcatgtgtgaggccctg

SEQ ID NO: 42225 - DNA, 20 bp, synthetic construct
  misc_feature 1..20: note = CRISPR gRNA sequence
  source 1..20: mol_type = other DNA
tgaggccctgaggcatgatt

SEQ ID NO: 42226 - DNA, 20 bp, synthetic construct
  misc_feature 1..20: note = CRISPR gRNA sequence
  source 1..20: mol_type = other DNA
ccctgaggcatgattaagct

SEQ ID NO: 42227 - DNA, 20 bp, synthetic construct
  misc_feature 1..20: note = CRISPR gRNA sequence
  source 1..20: mol_type = other DNA
tgaggcatgattaagcttgg

SEQ ID NO: 42228 - DNA, 20 bp, synthetic construct
  misc_feature 1..20: note = CRISPR gRNA sequence
  source 1..20: mol_type = other DNA
gaggcatgattaagcttggt

SEQ ID NO: 42229 - DNA, 20 bp, synthetic construct
  misc_feature 1..20: note = CRISPR gRNA sequence
  source 1..20: mol_type = other DNA
tgattaagcttggtgggctc

SEQ ID NO: 42230 - DNA, 20 bp, synthetic construct
  misc_feature 1..20: note = CRISPR gRNA sequence
  source 1..20: mol_type = other DNA
gattaagcttggtgggctcc

SEQ ID NO: 42231 - DNA, 20 bp, synthetic construct
  misc_feature 1..20: note = CRISPR gRNA sequence
  source 1..20: mol_type = other DNA
agcttggtgggctccaggaa

SEQ ID NO: 42232 - DNA, 20 bp, synthetic construct
  misc_feature 1..20: note = CRISPR gRNA sequence
  source 1..20: mol_type = other DNA
ggtgggctccaggaacagcg

SEQ ID NO: 42233 - DNA, 20 bp, synthetic construct
  misc_feature 1..20: note = CRISPR gRNA sequence
  source 1..20: mol_type = other DNA
tccaggaacagcgcggaacc

SEQ ID NO: 42234 - DNA, 20 bp, synthetic construct
  misc_feature 1..20: note = CRISPR gRNA sequence
  source 1..20: mol_type = other DNA
ggaacagcgcggaaccgaga

SEQ ID NO: 42235 - DNA, 20 bp, synthetic construct
  misc_feature 1..20: note = CRISPR gRNA sequence
  source 1..20: mol_type = other DNA
cagcgcggaaccgagacagc

SEQ ID NO: 42236 - DNA, 20 bp, synthetic construct
  misc_feature 1..20: note = CRISPR gRNA sequence
  source 1..20: mol_type = other DNA
gcgcggaaccgagacagcca

SEQ ID NO: 42237 - DNA, 20 bp, synthetic construct
  misc_feature 1..20: note = CRISPR gRNA sequence
  source 1..20: mol_type = other DNA
gaaccgagacagccagagca

SEQ ID NO: 42238 - DNA, 20 bp, synthetic construct
  misc_feature 1..20: note = CRISPR gRNA sequence
  source 1..20: mol_type = other DNA
gacagccagagcacagtgac

SEQ ID NO: 42239 - DNA, 20 bp, synthetic construct
  misc_feature 1..20: note = CRISPR gRNA sequence
  source 1..20: mol_type = other DNA
agccagagcacagtgactgg

SEQ ID NO: 42240 - DNA, 20 bp, synthetic construct
  misc_feature 1..20: note = CRISPR gRNA sequence
  source 1..20: mol_type = other DNA
gccagagcacagtgactggc

SEQ ID NO: 42241 - DNA, 20 bp, synthetic construct
  misc_feature 1..20: note = CRISPR gRNA sequence
  source 1..20: mol_type = other DNA
ccagagcacagtgactggca

SEQ ID NO: 42242 - DNA, 20 bp, synthetic construct
  misc_feature 1..20: note = CRISPR gRNA sequence
  source 1..20: mol_type = other DNA
agcacagtgactggcaggga

SEQ ID NO: 42243 - DNA, 20 bp, synthetic construct
  misc_feature 1..20: note = CRISPR gRNA sequence
  source 1..20: mol_type = other DNA
gtgactggcagggacagtcc

SEQ ID NO: 42244 - DNA, 20 bp, synthetic construct
  misc_feature 1..20: note = CRISPR gRNA sequence
  source 1..20: mol_type = other DNA
tgactggcagggacagtcct

SEQ ID NO: 42245 - DNA, 20 bp, synthetic construct
  misc_feature 1..20: note = CRISPR gRNA sequence
  source 1..20: mol_type = other DNA
actggcagggacagtcctag

SEQ ID NO: 42246 - DNA, 20 bp, synthetic construct
  misc_feature 1..20: note = CRISPR gRNA sequence
  source 1..20: mol_type = other DNA
tggcagggacagtcctagga

SEQ ID NO: 42247 - DNA, 20 bp, synthetic construct
  misc_feature 1..20: note = CRISPR gRNA sequence
  source 1..20: mol_type = other DNA
ggcagggacagtcctaggag

SEQ ID NO: 42248 - DNA, 20 bp, synthetic construct
  misc_feature 1..20: note = CRISPR gRNA sequence
  source 1..20: mol_type = other DNA
cagggacagtcctaggagag

SEQ ID NO: 42249 - DNA, 20 bp, synthetic construct
  misc_feature 1..20: note = CRISPR gRNA sequence
  source 1..20: mol_type = other DNA
agggacagtcctaggagagg

SEQ ID NO: 42250 - DNA, 20 bp, synthetic construct
  misc_feature 1..20: note = CRISPR gRNA sequence
  source 1..20: mol_type = other DNA
gacagtcctaggagaggagg

SEQ ID NO: 42251 - DNA, 20 bp, synthetic construct
  misc_feature 1..20: note = CRISPR gRNA sequence
  source 1..20: mol_type = other DNA
cagtcctaggagaggaggaa

SEQ ID NO: 42252 - DNA, 20 bp, synthetic construct
  misc_feature 1..20: note = CRISPR gRNA sequence
  source 1..20: mol_type = other DNA
gtcctaggagaggaggaaga

SEQ ID NO: 42253 - DNA, 20 bp, synthetic construct
  misc_feature 1..20: note = CRISPR gRNA sequence
  source 1..20: mol_type = other DNA
cctaggagaggaggaagaga

SEQ ID NO: 42254 - DNA, 20 bp, synthetic construct
  misc_feature 1..20: note = CRISPR gRNA sequence
  source 1..20: mol_type = other DNA
ggagaggaggaagagagaga

SEQ ID NO: 42255 - DNA, 20 bp, synthetic construct
  misc_feature 1..20: note = CRISPR gRNA sequence
  source 1..20: mol_type = other DNA
gagaggaggaagagagagat

SEQ ID NO: 42256 - DNA, 20 bp, synthetic construct
  misc_feature 1..20: note = CRISPR gRNA sequence
  source 1..20: mol_type = other DNA
gaggaagagagagatgggct

SEQ ID NO: 42257 - DNA, 20 bp, synthetic construct
  misc_feature 1..20: note = CRISPR gRNA sequence
  source 1..20: mol_type = other DNA
aggaagagagagatgggctc

SEQ ID NO: 42258 - DNA, 20 bp, synthetic construct
  misc_feature 1..20: note = CRISPR gRNA sequence
  source 1..20: mol_type = other DNA
agagagagatgggctcgggt

SEQ ID NO: 42259 - DNA, 20 bp, synthetic construct
  misc_feature 1..20: note = CRISPR gRNA sequence
  source 1..20: mol_type = other DNA
gagagagatgggctcgggtt

SEQ ID NO: 42260 - DNA, 20 bp, synthetic construct
  misc_feature 1..20: note = CRISPR gRNA sequence
  source 1..20: mol_type = other DNA
tgggctcgggttgggttgca

SEQ ID NO: 42261 - DNA, 20 bp, synthetic construct
  misc_feature 1..20: note = CRISPR gRNA sequence
  source 1..20: mol_type = other DNA
gggctcgggttgggttgcat

SEQ ID NO: 42262 - DNA, 20 bp, synthetic construct
  misc_feature 1..20: note = CRISPR gRNA sequence
  source 1..20: mol_type = other DNA
ggctcgggttgggttgcatg

SEQ ID NO: 42263 - DNA, 20 bp, synthetic construct
  misc_feature 1..20: note = CRISPR gRNA sequence
  source 1..20: mol_type = other DNA
gggttgggttgcatggggcc

SEQ ID NO: 42264 - DNA, 20 bp, synthetic construct
  misc_feature 1..20: note = CRISPR gRNA sequence
  source 1..20: mol_type = other DNA
tgcatggggcctggcaccca

SEQ ID NO: 42265 - DNA, 20 bp, synthetic construct
  misc_feature 1..20: note = CRISPR gRNA sequence
  source 1..20: mol_type = other DNA
gcatggggcctggcacccat

SEQ ID NO: 42266 - DNA, 20 bp, synthetic construct
  misc_feature 1..20: note = CRISPR gRNA sequence
  source 1..20: mol_type = other DNA
catggggcctggcacccatg

SEQ ID NO: 42267 - DNA, 20 bp, synthetic construct
  misc_feature 1..20: note = CRISPR gRNA sequence
  source 1..20: mol_type = other DNA
tggggcctggcacccatggg

SEQ ID NO: 42268 - DNA, 20 bp, synthetic construct
  misc_feature 1..20: note = CRISPR gRNA sequence
  source 1..20: mol_type = other DNA
gggcctggcacccatgggga

SEQ ID NO: 42269 - DNA, 20 bp, synthetic construct
  misc_feature 1..20: note = CRISPR gRNA sequence
  source 1..20: mol_type = other DNA
tggcacccatggggagagtt

SEQ ID NO: 42270 - DNA, 20 bp, synthetic construct
  misc_feature 1..20: note = CRISPR gRNA sequence
  source 1..20: mol_type = other DNA
agagtttagacttttgttcc

SEQ ID NO: 42271 - DNA, 20 bp, synthetic construct
  misc_feature 1..20: note = CRISPR gRNA sequence
  source 1..20: mol_type = other DNA
gagtttagacttttgttcct

SEQ ID NO: 42272 - DNA, 20 bp, synthetic construct
  misc_feature 1..20: note = CRISPR gRNA sequence
  source 1..20: mol_type = other DNA
ttttgttcctgggaacatga

SEQ ID NO: 42273 - DNA, 20 bp, synthetic construct
  misc_feature 1..20: note = CRISPR gRNA sequence
  source 1..20: mol_type = other DNA
tttgttcctgggaacatgaa

SEQ ID NO: 42274 - DNA, 20 bp, synthetic construct
  misc_feature 1..20: note = CRISPR gRNA sequence
  source 1..20: mol_type = other DNA
ttgttcctgggaacatgaaa

SEQ ID NO: 42275 - DNA, 20 bp, synthetic construct
  misc_feature 1..20: note = CRISPR gRNA sequence
  source 1..20: mol_type = other DNA
gttcctgggaacatgaaagg

SEQ ID NO: 42276 - DNA, 20 bp, synthetic construct
  misc_feature 1..20: note = CRISPR gRNA sequence
  source 1..20: mol_type = other DNA
tcctgggaacatgaaaggga

SEQ ID NO: 42277 - DNA, 20 bp, synthetic construct
  misc_feature 1..20: note = CRISPR gRNA sequence
  source 1..20: mol_type = other DNA
cctgggaacatgaaagggag

SEQ ID NO: 42278 - DNA, 20 bp, synthetic construct
  misc_feature 1..20: note = CRISPR gRNA sequence
  source 1..20: mol_type = other DNA
tgaaagggagaggaataatt

SEQ ID NO: 42279 - DNA, 20 bp, synthetic construct
  misc_feature 1..20: note = CRISPR gRNA sequence
  source 1..20: mol_type = other DNA
gaaagggagaggaataattt

SEQ ID NO: 42280 - DNA, 20 bp, synthetic construct
  misc_feature 1..20: note = CRISPR gRNA sequence
  source 1..20: mol_type = other DNA
ttttctttctttcttttttg

SEQ ID NO: 42281 - DNA, 20 bp, synthetic construct
  misc_feature 1..20: note = CRISPR gRNA sequence
  source 1..20: mol_type = other DNA
tttctttctttcttttttgt

SEQ ID NO: 42282 - DNA, 20 bp, synthetic construct
  misc_feature 1..20: note = CRISPR gRNA sequence
  source 1..20: mol_type = other DNA
ttctttctttcttttttgtg

SEQ ID NO: 42283 - DNA, 20 bp, synthetic construct
  misc_feature 1..20: note = CRISPR gRNA sequence
  source 1..20: mol_type = other DNA
tctttctttcttttttgtgg

SEQ ID NO: 42284 - DNA, 20 bp, synthetic construct
  misc_feature 1..20: note = CRISPR gRNA sequence
  source 1..20: mol_type = other DNA
tttctttcttttttgtgggg

SEQ ID NO: 42285 - DNA, 20 bp, synthetic construct
  misc_feature 1..20: note = CRISPR gRNA sequence
  source 1..20: mol_type = other DNA
ttctttcttttttgtggggg

SEQ ID NO: 42286 - DNA, 20 bp, synthetic construct
  misc_feature 1..20: note = CRISPR gRNA sequence
  source 1..20: mol_type = other DNA
tctttcttttttgtggggga

SEQ ID NO: 42287 - DNA, 20 bp, synthetic construct
  misc_feature 1..20: note = CRISPR gRNA sequence
  source 1..20: mol_type = other DNA
gagggtctcgctctgtcaca

SEQ ID NO: 42288 - DNA, 20 bp, synthetic construct
  misc_feature 1..20: note = CRISPR gRNA sequence
  source 1..20: mol_type = other DNA
agggtctcgctctgtcacac

SEQ ID NO: 42289 - DNA, 20 bp, synthetic construct
  misc_feature 1..20: note = CRISPR gRNA sequence
  source 1..20: mol_type = other DNA
tctcgctctgtcacacaggc

SEQ ID NO: 42290 - DNA, 20 bp, synthetic construct
  misc_feature 1..20: note = CRISPR gRNA sequence
  source 1..20: mol_type = other DNA
tcgctctgtcacacaggctg

SEQ ID NO: 42291 - DNA, 20 bp, synthetic construct
  misc_feature 1..20: note = CRISPR gRNA sequence
  source 1..20: mol_type = other DNA
tcacacaggctggagtgcaa

SEQ ID NO: 42292 - DNA, 20 bp, synthetic construct
  misc_feature 1..20: note = CRISPR gRNA sequence
  source 1..20: mol_type = other DNA
ggagtgcaatggcgcaatct

SEQ ID NO: 42293 - DNA, 20 bp, synthetic construct
  misc_feature 1..20: note = CRISPR gRNA sequence
  source 1..20: mol_type = other DNA
tcactgcaacctccgcctcc

SEQ ID NO: 42294 - DNA, 20 bp, synthetic construct
  misc_feature 1..20: note = CRISPR gRNA sequence
  source 1..20: mol_type = other DNA
cactgcaacctccgcctccc

SEQ ID NO: 42295 - DNA, 20 bp, synthetic construct
  misc_feature 1..20: note = CRISPR gRNA sequence
  source 1..20: mol_type = other DNA
caacctccgcctcccaggtt

SEQ ID NO: 42296 - DNA, 20 bp, synthetic construct
  misc_feature 1..20: note = CRISPR gRNA sequence
  source 1..20: mol_type = other DNA
aacctccgcctcccaggttc

SEQ ID NO: 42297 - DNA, 20 bp, synthetic construct
  misc_feature 1..20: note = CRISPR gRNA sequence
  source 1..20: mol_type = other DNA
ttcaggcaattcttgtgcct

SEQ ID NO: 42298 - DNA, 20 bp, synthetic construct
  misc_feature 1..20: note = CRISPR gRNA sequence
  source 1..20: mol_type = other DNA
ttcttgtgcctcagcctccc

SEQ ID NO: 42299 - DNA, 20 bp, synthetic construct
  misc_feature 1..20: note = CRISPR gRNA sequence
  source 1..20: mol_type = other DNA
ttgtgcctcagcctcccaag

SEQ ID NO: 42300 - DNA, 20 bp, synthetic construct
  misc_feature 1..20: note = CRISPR gRNA sequence
  source 1..20: mol_type = other DNA
gcctcagcctcccaagtagc

SEQ ID NO: 42301 - DNA, 20 bp, synthetic construct
  misc_feature 1..20: note = CRISPR gRNA sequence
  source 1..20: mol_type = other DNA
cctcagcctcccaagtagct

SEQ ID NO: 42302 - DNA, 20 bp, synthetic construct
  misc_feature 1..20: note = CRISPR gRNA sequence
  source 1..20: mol_type = other DNA
ctcccaagtagctgggatta

SEQ ID NO: 42303 - DNA, 20 bp, synthetic construct
  misc_feature 1..20: note = CRISPR gRNA sequence
  source 1..20: mol_type = other DNA
tcccaagtagctgggattac

SEQ ID NO: 42304 - DNA, 20 bp, synthetic construct
  misc_feature 1..20: note = CRISPR gRNA sequence
  source 1..20: mol_type = other DNA
caggcgtgcaccatcatgcc

SEQ ID NO: 42305 - DNA, 20 bp, synthetic construct
  misc_feature 1..20: note = CRISPR gRNA sequence
  source 1..20: mol_type = other DNA
ccagctaatttttgtatttt

SEQ ID NO: 42306 - DNA, 20 bp, synthetic construct
  misc_feature 1..20: note = CRISPR gRNA sequence
  source 1..20: mol_type = other DNA
gctaatttttgtatttttag

SEQ ID NO: 42307 - DNA, 20 bp, synthetic construct
  misc_feature 1..20: note = CRISPR gRNA sequence
  source 1..20: mol_type = other DNA
taatttttgtatttttagta

SEQ ID NO: 42308 - DNA, 20 bp, synthetic construct
  misc_feature 1..20: note = CRISPR gRNA sequence
  source 1..20: mol_type = other DNA
ttttgtatttttagtagaga

SEQ ID NO: 42309 - DNA, 20 bp, synthetic construct
  misc_feature 1..20: note = CRISPR gRNA sequence
  source 1..20: mol_type = other DNA
ttgtatttttagtagagaca

SEQ ID NO: 42310 - DNA, 20 bp, synthetic construct
  misc_feature 1..20: note = CRISPR gRNA sequence
  source 1..20: mol_type = other DNA
tttaaccatgttgaccatgc

SEQ ID NO: 42311 - DNA, 20 bp, synthetic construct
  misc_feature 1..20: note = CRISPR gRNA sequence
  source 1..20: mol_type = other DNA
ggtctcaaactcccgacctc

SEQ ID NO: 42312 - DNA, 20 bp, synthetic construct
  misc_feature 1..20: note = CRISPR gRNA sequence
  source 1..20: mol_type = other DNA
ctcaagtgatccgcccgcct

SEQ ID NO: 42313 - DNA, 20 bp, synthetic construct
  misc_feature 1..20: note = CRISPR gRNA sequence
  source 1..20: mol_type = other DNA
ccgcccgcctcggcttccca

SEQ ID NO: 42314 - DNA, 20 bp, synthetic construct
  misc_feature 1..20: note = CRISPR gRNA sequence
  source 1..20: mol_type = other DNA
cctcggcttcccaaagtact

SEQ ID NO: 42315 - DNA, 20 bp, synthetic construct
  misc_feature 1..20: note = CRISPR gRNA sequence
  source 1..20: mol_type = other DNA
ttcccaaagtactgagatta

SEQ ID NO: 42316 - DNA, 20 bp, synthetic construct
  misc_feature 1..20: note = CRISPR gRNA sequence
  source 1..20: mol_type = other DNA
tcccaaagtactgagattac

SEQ ID NO: 42317 - DNA, 20 bp, synthetic construct
  misc_feature 1..20: note = CRISPR gRNA sequence
  source 1..20: mol_type = other DNA
caaagtactgagattacagg

SEQ ID NO: 42318 - DNA, 20 bp, synthetic construct
  misc_feature 1..20: note = CRISPR gRNA sequence
  source 1..20: mol_type = other DNA
aaagtactgagattacaggc

SEQ ID NO: 42319 - DNA, 20 bp, synthetic construct
  misc_feature 1..20: note = CRISPR gRNA sequence
  source 1..20: mol_type = other DNA
agtactgagattacaggcag

SEQ ID NO: 42320 - DNA, 20 bp, synthetic construct
  misc_feature 1..20: note = CRISPR gRNA sequence
  source 1..20: mol_type = other DNA
cactgcacccgttcctcatt

SEQ ID NO: 42321 - DNA, 20 bp, synthetic construct
  misc_feature 1..20: note = CRISPR gRNA sequence
  source 1..20: mol_type = other DNA
actgcacccgttcctcattt

SEQ ID NO: 42322 - DNA, 20 bp, synthetic construct
  misc_feature 1..20: note = CRISPR gRNA sequence
  source 1..20: mol_type = other DNA
ttcctcatttgggttttcaa

SEQ ID NO: 42323 - DNA, 20 bp, synthetic construct
  misc_feature 1..20: note = CRISPR gRNA sequence
  source 1..20: mol_type = other DNA
catttgggttttcaaaagtt

SEQ ID NO: 42324 - DNA, 20 bp, synthetic construct
  misc_feature 1..20: note = CRISPR gRNA sequence
  source 1..20: mol_type = other DNA
ggttttcaaaagttcagact

SEQ ID NO: 42325 - DNA, 20 bp, synthetic construct
  misc_feature 1..20: note = CRISPR gRNA sequence
  source 1..20: mol_type = other DNA
caaaagttcagactgagtgc

SEQ ID NO: 42326 - DNA, 20 bp, synthetic construct
  misc_feature 1..20: note = CRISPR gRNA sequence
  source 1..20: mol_type = other DNA
aaaagttcagactgagtgct

SEQ ID NO: 42327 - DNA, 20 bp, synthetic construct
  misc_feature 1..20: note = CRISPR gRNA sequence
  source 1..20: mol_type = other DNA
agttcagactgagtgctggg

SEQ ID NO: 42328 - DNA, 20 bp, synthetic construct
  misc_feature 1..20: note = CRISPR gRNA sequence
  source 1..20: mol_type = other DNA
ttcagactgagtgctgggta

SEQ ID NO: 42329 - DNA, 20 bp, synthetic construct
  misc_feature 1..20: note = CRISPR gRNA sequence
  source 1..20: mol_type = other DNA
actgagtgctgggtagagaa

SEQ ID NO: 42330 - DNA, 20 bp, synthetic construct
  misc_feature 1..20: note = CRISPR gRNA sequence
  source 1..20: mol_type = other DNA
gtgctgggtagagaatggat

SEQ ID NO: 42331 - DNA, 20 bp, synthetic construct
  misc_feature 1..20: note = CRISPR gRNA sequence
  source 1..20: mol_type = other DNA
tgctgggtagagaatggatt

SEQ ID NO: 42332 - DNA, 20 bp, synthetic construct
  misc_feature 1..20: note = CRISPR gRNA sequence
  source 1..20: mol_type = other DNA
ctgggtagagaatggattgg

SEQ ID NO: 42333 - DNA, 20 bp, synthetic construct
  misc_feature 1..20: note = CRISPR gRNA sequence
  source 1..20: mol_type = other DNA
gagaatggattgggagatac

SEQ ID NO: 42334 - DNA, 20 bp, synthetic construct
  misc_feature 1..20: note = CRISPR gRNA sequence
  source 1..20: mol_type = other DNA
aatggattgggagatacgag

SEQ ID NO: 42335 - DNA, 20 bp, synthetic construct
  misc_feature 1..20: note = CRISPR gRNA sequence
  source 1..20: mol_type = other DNA
tgggagatacgagtggaaat

SEQ ID NO: 42336 - DNA, 20 bp, synthetic construct
  misc_feature 1..20: note = CRISPR gRNA sequence
  source 1..20: mol_type = other DNA
ggagatacgagtggaaatga

SEQ ID NO: 42337 - DNA, 20 bp, synthetic construct
  misc_feature 1..20: note = CRISPR gRNA sequence
  source 1..20: mol_type = other DNA
gatacgagtggaaatgagag

SEQ ID NO: 42338 - DNA, 20 bp, synthetic construct
  misc_feature 1..20: note = CRISPR gRNA sequence
  source 1..20: mol_type = other DNA
atacgagtggaaatgagagt

SEQ ID NO: 42339 - DNA, 20 bp, synthetic construct
  misc_feature 1..20: note = CRISPR gRNA sequence
  source 1..20: mol_type = other DNA
cgagtggaaatgagagtggg

SEQ ID NO: 42340 - DNA, 20 bp, synthetic construct
  misc_feature 1..20: note = CRISPR gRNA sequence
  source 1..20: mol_type = other DNA
agtggaaatgagagtgggaa

SEQ ID NO: 42341 - DNA, 20 bp, synthetic construct
  misc_feature 1..20: note = CRISPR gRNA sequence
  source 1..20: mol_type = other DNA
agagtgggaagagatgtgtg

SEQ ID NO: 42342 - DNA, 20 bp, synthetic construct
  misc_feature 1..20: note = CRISPR gRNA sequence
  source 1..20: mol_type = other DNA
gtgggaagagatgtgtgcag

SEQ ID NO: 42343 - DNA, 20 bp, synthetic construct
  misc_feature 1..20: note = CRISPR gRNA sequence
  source 1..20: mol_type = other DNA
tgggaagagatgtgtgcagc

SEQ ID NO: 42344 - DNA, 20 bp, synthetic construct
  misc_feature 1..20: note = CRISPR gRNA sequence
  source 1..20: mol_type = other DNA
gggaagagatgtgtgcagca

SEQ ID NO: 42345 - DNA, 20 bp, synthetic construct
  misc_feature 1..20: note = CRISPR gRNA sequence
  source 1..20: mol_type = other DNA
gagatgtgtgcagcagggtg

SEQ ID NO: 42346 - DNA, 20 bp, synthetic construct
  misc_feature 1..20: note = CRISPR gRNA sequence
  source 1..20: mol_type = other DNA
agatgtgtgcagcagggtga

SEQ ID NO: 42347 - DNA, 20 bp, synthetic construct
  misc_feature 1..20: note = CRISPR gRNA sequence
  source 1..20: mol_type = other DNA
gatgtgtgcagcagggtgaa

SEQ ID NO: 42348 - DNA, 20 bp, synthetic construct
  misc_feature 1..20: note = CRISPR gRNA sequence
  source 1..20: mol_type = other DNA
tgcagcagggtgaagggtgc

SEQ ID NO: 42349 - DNA, 20 bp, synthetic construct
  misc_feature 1..20: note = CRISPR gRNA sequence
  source 1..20: mol_type = other DNA
gcagcagggtgaagggtgct

SEQ ID NO: 42350 - DNA, 20 bp, synthetic construct
  misc_feature 1..20: note = CRISPR gRNA sequence
  source 1..20: mol_type = other DNA
cagcagggtgaagggtgctg

SEQ ID NO: 42351 - DNA, 20 bp, synthetic construct
  misc_feature 1..20: note = CRISPR gRNA sequence
  source 1..20: mol_type = other DNA
agcagggtgaagggtgctgg

SEQ ID NO: 42352 - DNA, 20 bp, synthetic construct
  misc_feature 1..20: note = CRISPR gRNA sequence
  source 1..20: mol_type = other DNA
tgctgggggctgatcactgc

SEQ ID NO: 42353 - DNA, 20 bp, synthetic construct
  misc_feature 1..20: note = CRISPR gRNA sequence
  source 1..20: mol_type = other DNA
gctgggggctgatcactgct

SEQ ID NO: 42354 - DNA, 20 bp, synthetic construct
  misc_feature 1..20: note = CRISPR gRNA sequence
  source 1..20: mol_type = other DNA
ctgggggctgatcactgctg

SEQ ID NO: 42355 - DNA, 20 bp, synthetic construct
  misc_feature 1..20: note = CRISPR gRNA sequence
  source 1..20: mol_type = other DNA
ggggctgatcactgctgggg

SEQ ID NO: 42356 - DNA, 20 bp, synthetic construct
  misc_feature 1..20: note = CRISPR gRNA sequence
  source 1..20: mol_type = other DNA
gggctgatcactgctggggt

SEQ ID NO: 42357 - DNA, 20 bp, synthetic construct
  misc_feature 1..20: note = CRISPR gRNA sequence
  source 1..20: mol_type = other DNA
tgatcactgctggggtggga

SEQ ID NO: 42358 - DNA, 20 bp, synthetic construct
  misc_feature 1..20: note = CRISPR gRNA sequence
  source 1..20: mol_type = other DNA
tcactgctggggtgggatag

SEQ ID NO: 42359 - DNA, 20 bp, synthetic construct
  misc_feature 1..20: note = CRISPR gRNA sequence
  source 1..20: mol_type = other DNA
tgctggggtgggatagaagt

SEQ ID NO: 42360 - DNA, 20 bp, synthetic construct
  misc_feature 1..20: note = CRISPR gRNA sequence
  source 1..20: mol_type = other DNA
tggggtgggatagaagttgg

SEQ ID NO: 42361 - DNA, 20 bp, synthetic construct
  misc_feature 1..20: note = CRISPR gRNA sequence
  source 1..20: mol_type = other DNA
gggatagaagttggtagact

SEQ ID NO: 42362 - DNA, 20 bp, synthetic construct
  misc_feature 1..20: note = CRISPR gRNA sequence
  source 1..20: mol_type = other DNA
ggatagaagttggtagactc

SEQ ID NO: 42363 - DNA, 20 bp, synthetic construct
  misc_feature 1..20: note = CRISPR gRNA sequence
  source 1..20: mol_type = other DNA
gatagaagttggtagactca

SEQ ID NO: 42364 - DNA, 20 bp, synthetic construct
  misc_feature 1..20: note = CRISPR gRNA sequence
  source 1..20: mol_type = other DNA
agaagttggtagactcaggg

SEQ ID NO: 42365 - DNA, 20 bp, synthetic construct
  misc_feature 1..20: note = CRISPR gRNA sequence
  source 1..20: mol_type = other DNA
gtagactcagggtggatctt

SEQ ID NO: 42366 - DNA, 20 bp, synthetic construct
  misc_feature 1..20: note = CRISPR gRNA sequence
  source 1..20: mol_type = other DNA
agactcagggtggatcttga

SEQ ID NO: 42367 - DNA, 20 bp, synthetic construct
  misc_feature 1..20: note = CRISPR gRNA sequence
  source 1..20: mol_type = other DNA
ctcagggtggatcttgagag

SEQ ID NO: 42368 - DNA, 20 bp, synthetic construct
  misc_feature 1..20: note = CRISPR gRNA sequence
  source 1..20: mol_type = other DNA
gatcttgagagtggaattta

SEQ ID NO: 42369 - DNA, 20 bp, synthetic construct
  misc_feature 1..20: note = CRISPR gRNA sequence
  source 1..20: mol_type = other DNA
tgagagtggaatttacagac

SEQ ID NO: 42370 - DNA, 20 bp, synthetic construct
  misc_feature 1..20: note = CRISPR gRNA sequence
  source 1..20: mol_type = other DNA
ggaatttacagacaagctga

SEQ ID NO: 42371 - DNA, 20 bp, synthetic construct
  misc_feature 1..20: note = CRISPR gRNA sequence
  source 1..20: mol_type = other DNA
gaatttacagacaagctgat

SEQ ID NO: 42372 - DNA, 20 bp, synthetic construct
  misc_feature 1..20: note = CRISPR gRNA sequence
  source 1..20: mol_type = other DNA
aatttacagacaagctgata

SEQ ID NO: 42373 - DNA, 20 bp, synthetic construct
  misc_feature 1..20: note = CRISPR gRNA sequence
  source 1..20: mol_type = other DNA
atttacagacaagctgatag

SEQ ID NO: 42374 - DNA, 20 bp, synthetic construct
  misc_feature 1..20: note = CRISPR gRNA sequence
  source 1..20: mol_type = other DNA
tttacagacaagctgatagg

SEQ ID NO: 42375 - DNA, 20 bp, synthetic construct
  misc_feature 1..20: note = CRISPR gRNA sequence
  source 1..20: mol_type = other DNA
caagctgatagggggattac

SEQ ID NO: 42376 - DNA, 20 bp, synthetic construct
  misc_feature 1..20: note = CRISPR gRNA sequence
  source 1..20: mol_type = other DNA
tgatagggggattactggat

SEQ ID NO: 42377 - DNA, 20 bp, synthetic construct
  misc_feature 1..20: note = CRISPR gRNA sequence
  source 1..20: mol_type = other DNA
gatagggggattactggatg

SEQ ID NO: 42378 - DNA, 20 bp, synthetic construct
  misc_feature 1..20: note = CRISPR gRNA sequence
  source 1..20: mol_type = other DNA
ggattactggatgaggcaaa

SEQ ID NO: 42379 - DNA, 20 bp, synthetic construct
  misc_feature 1..20: note = CRISPR gRNA sequence
  source 1..20: mol_type = other DNA
attactggatgaggcaaatg

SEQ ID NO: 42380 - DNA, 20 bp, synthetic construct
  misc_feature 1..20: note = CRISPR gRNA sequence
  source 1..20: mol_type = other DNA
ttactggatgaggcaaatgg

SEQ ID NO: 42381 - DNA, 20 bp, synthetic construct
  misc_feature 1..20: note = CRISPR gRNA sequence
  source 1..20: mol_type = other DNA
atgaggcaaatggaggtgct

SEQ ID NO: 42382 - DNA, 20 bp, synthetic construct
  misc_feature 1..20: note = CRISPR gRNA sequence
  source 1..20: mol_type = other DNA
tgaggcaaatggaggtgctg

SEQ ID NO: 42383 - DNA, 20 bp, synthetic construct
  misc_feature 1..20: note = CRISPR gRNA sequence
  source 1..20: mol_type = other DNA
gaggtgctgaggctgcctct

SEQ ID NO: 42384 - DNA, 20 bp, synthetic construct
  misc_feature 1..20: note = CRISPR gRNA sequence
  source 1..20: mol_type = other DNA
aggtgctgaggctgcctctg

SEQ ID NO: 42385 - DNA, 20 bp, synthetic construct
  misc_feature 1..20: note = CRISPR gRNA sequence
  source 1..20: mol_type = other DNA
ggtgctgaggctgcctctga

SEQ ID NO: 42386 - DNA, 20 bp, synthetic construct
  misc_feature 1..20: note = CRISPR gRNA sequence
  source 1..20: mol_type = other DNA
gctgaggctgcctctgaggg

SEQ ID NO: 42387 - DNA, 20 bp, synthetic construct
  misc_feature 1..20: note = CRISPR gRNA sequence
  source 1..20: mol_type = other DNA
tgaggctgcctctgagggca

SEQ ID NO: 42388 - DNA, 20 bp, synthetic construct
  misc_feature 1..20: note = CRISPR gRNA sequence
  source 1..20: mol_type = other DNA
ggctgcctctgagggcagag

SEQ ID NO: 42389 - DNA, 20 bp, synthetic construct
  misc_feature 1..20: note = CRISPR gRNA sequence
  source 1..20: mol_type = other DNA
ggacccatctcactttctct

SEQ ID NO: 42390 - DNA, 20 bp, synthetic construct
  misc_feature 1..20: note = CRISPR gRNA sequence
  source 1..20: mol_type = other DNA
gacccatctcactttctcta

SEQ ID NO: 42391 - DNA, 20 bp, synthetic construct
  misc_feature 1..20: note = CRISPR gRNA sequence
  source 1..20: mol_type = other DNA
ccatctcactttctctaagg

SEQ ID NO: 42392 - DNA, 20 bp, synthetic construct
  misc_feature 1..20: note = CRISPR gRNA sequence
  source 1..20: mol_type = other DNA
tctcactttctctaaggcag

SEQ ID NO: 42393 - DNA, 20 bp, synthetic construct
  misc_feature 1..20: note = CRISPR gRNA sequence
  source 1..20: mol_type = other DNA
ctaaggcagtggtttccaac

SEQ ID NO: 42394 - DNA, 20 bp, synthetic construct
  misc_feature 1..20: note = CRISPR gRNA sequence
  source 1..20: mol_type = other DNA
taaggcagtggtttccaact

SEQ ID NO: 42395 - DNA, 20 bp, synthetic construct
  misc_feature 1..20: note = CRISPR gRNA sequence
  source 1..20: mol_type = other DNA
aaggcagtggtttccaactg

SEQ ID NO: 42396 - DNA, 20 bp, synthetic construct
  misc_feature 1..20: note = CRISPR gRNA sequence
  source 1..20: mol_type = other DNA
aggcagtggtttccaactgg

SEQ ID NO: 42397 - DNA, 20 bp, synthetic construct
  misc_feature 1..20: note = CRISPR gRNA sequence
  source 1..20: mol_type = other DNA
ctgggggtgattttcaccct

SEQ ID NO: 42398 - DNA, 20 bp, synthetic construct
  misc_feature 1..20: note = CRISPR gRNA sequence
  source 1..20: mol_type = other DNA
tgggggtgattttcaccctt

SEQ ID NO: 42399 - DNA, 20 bp, synthetic construct
  misc_feature 1..20: note = CRISPR gRNA sequence
  source 1..20: mol_type = other DNA
ggggtgattttcacccttgg

SEQ ID NO: 42400 - DNA, 20 bp, synthetic construct
  misc_feature 1..20: note = CRISPR gRNA sequence
  source 1..20: mol_type = other DNA
tttcacccttgggagtcatt

SEQ ID NO: 42401 - DNA, 20 bp, synthetic construct
  misc_feature 1..20: note = CRISPR gRNA sequence
  source 1..20: mol_type = other DNA
gggagtcatttggaaatatc

SEQ ID NO: 42402 - DNA, 20 bp, synthetic construct
  misc_feature 1..20: note = CRISPR gRNA sequence
  source 1..20: mol_type = other DNA
gagtcatttggaaatatctg

SEQ ID NO: 42403 - DNA, 20 bp, synthetic construct
  misc_feature 1..20: note = CRISPR gRNA sequence
  source 1..20: mol_type = other DNA
gaaatatctggagatatttt

SEQ ID NO: 42404 - DNA, 20 bp, synthetic construct
  misc_feature 1..20: note = CRISPR gRNA sequence
  source 1..20: mol_type = other DNA
atatctggagatatttttgg

SEQ ID NO: 42405 - DNA, 20 bp, synthetic construct
  misc_feature 1..20: note = CRISPR gRNA sequence
  source 1..20: mol_type = other DNA
atttttggtggtcatgactg

SEQ ID NO: 42406 - DNA, 20 bp, synthetic construct
  misc_feature 1..20: note = CRISPR gRNA sequence
  source 1..20: mol_type = other DNA
tttttggtggtcatgactgc

SEQ ID NO: 42407 - DNA, 20 bp, synthetic construct
  misc_feature 1..20: note = CRISPR gRNA sequence
  source 1..20: mol_type = other DNA
tggtggtcatgactgcgggt

SEQ ID NO: 42408 - DNA, 20 bp, synthetic construct
  misc_feature 1..20: note = CRISPR gRNA sequence
  source 1..20: mol_type = other DNA
ggtggtcatgactgcgggtg

SEQ ID NO: 42409 - DNA, 20 bp, synthetic construct
  misc_feature 1..20: note = CRISPR gRNA sequence
  source 1..20: mol_type = other DNA
gtggtcatgactgcgggtga

SEQ ID NO: 42410 - DNA, 20 bp, synthetic construct
  misc_feature 1..20: note = CRISPR gRNA sequence
  source 1..20: mol_type = other DNA
tggtcatgactgcgggtgag

SEQ ID NO: 42411 - DNA, 20 bp, synthetic construct
  misc_feature 1..20: note = CRISPR gRNA sequence
  source 1..20: mol_type = other DNA
cgggtgaggggtgctgctac

SEQ ID NO: 42412 - DNA, 20 bp, synthetic construct
  misc_feature 1..20: note = CRISPR gRNA sequence
  source 1..20: mol_type = other DNA
tgctactggcatcgaatgaa

SEQ ID NO: 42413 - DNA, 20 bp, synthetic construct
  misc_feature 1..20: note = CRISPR gRNA sequence
  source 1..20: mol_type = other DNA
ctactggcatcgaatgaata

SEQ ID NO: 42414 - DNA, 20 bp, synthetic construct
  misc_feature 1..20: note = CRISPR gRNA sequence
  source 1..20: mol_type = other DNA
gcatcgaatgaatagagatc

SEQ ID NO: 42415 - DNA, 20 bp, synthetic construct
  misc_feature 1..20: note = CRISPR gRNA sequence
  source 1..20: mol_type = other DNA
catcgaatgaatagagatct

SEQ ID NO: 42416 - DNA, 20 bp, synthetic construct
  misc_feature 1..20: note = CRISPR gRNA sequence
  source 1..20: mol_type = other DNA
ggatgctgctgaacatccta

SEQ ID NO: 42417 - DNA, 20 bp, synthetic construct
  misc_feature 1..20: note = CRISPR gRNA sequence
  source 1..20: mol_type = other DNA
gatgctgctgaacatcctat

SEQ ID NO: 42418 - DNA, 20 bp, synthetic construct
  misc_feature 1..20: note = CRISPR gRNA sequence
  source 1..20: mol_type = other DNA
atgctgctgaacatcctata

SEQ ID NO: 42419 - DNA, 20 bp, synthetic construct
  misc_feature 1..20: note = CRISPR gRNA sequence
  source 1..20: mol_type = other DNA
gctgaacatcctatagggca

SEQ ID NO: 42420 - DNA, 20 bp, synthetic construct
  misc_feature 1..20: note = CRISPR gRNA sequence
  source 1..20: mol_type = other DNA
ctgaacatcctatagggcac

SEQ ID NO: 42421 - DNA, 20 bp, synthetic construct
  misc_feature 1..20: note = CRISPR gRNA sequence
  source 1..20: mol_type = other DNA
gaacatcctatagggcacag

SEQ ID NO: 42422 - DNA, 20 bp, synthetic construct
  misc_feature 1..20: note = CRISPR gRNA sequence
  source 1..20: mol_type = other DNA
acatcctatagggcacagga

SEQ ID NO: 42423 - DNA, 20 bp, synthetic construct
  misc_feature 1..20: note = CRISPR gRNA sequence
  source 1..20: mol_type = other DNA
gcacaggagagcccacaaca

SEQ ID NO: 42424 - DNA, 20 bp, synthetic construct
  misc_feature 1..20: note = CRISPR gRNA sequence
  source 1..20: mol_type = other DNA
agcccacaacaaagaattat

SEQ ID NO: 42425 - DNA, 20 bp, synthetic construct
  misc_feature 1..20: note = CRISPR gRNA sequence
  source 1..20: mol_type = other DNA
tattggacctcacatctcaa

SEQ ID NO: 42426 - DNA, 20 bp, synthetic construct
  misc_feature 1..20: note = CRISPR gRNA sequence
  source 1..20: mol_type = other DNA
cctcacatctcaatagtgct

SEQ ID NO: 42427 - DNA, 20 bp, synthetic construct
  misc_feature 1..20: note = CRISPR gRNA sequence
  source 1..20: mol_type = other DNA
ctcacatctcaatagtgcta

SEQ ID NO: 42428 - DNA, 20 bp, synthetic construct
  misc_feature 1..20: note = CRISPR gRNA sequence
  source 1..20: mol_type = other DNA
aggtttaaaaactgtgtctg

SEQ ID NO: 42429 - DNA, 20 bp, synthetic construct
  misc_feature 1..20: note = CRISPR gRNA sequence
  source 1..20: mol_type = other DNA
ggtttaaaaactgtgtctga

SEQ ID NO: 42430 - DNA, 20 bp, synthetic construct
  misc_feature 1..20: note = CRISPR gRNA sequence
  source 1..20: mol_type = other DNA
gtttaaaaactgtgtctgaa

SEQ ID NO: 42431 - DNA, 20 bp, synthetic construct
  misc_feature 1..20: note = CRISPR gRNA sequence
  source 1..20: mol_type = other DNA
aactgtgtctgaagggcctg

SEQ ID NO: 42432 - DNA, 20 bp, synthetic construct
  misc_feature 1..20: note = CRISPR gRNA sequence
  source 1..20: mol_type = other DNA
tgaagcttcccactctctgt

SEQ ID NO: 42433 - DNA, 20 bp, synthetic construct
  misc_feature 1..20: note = CRISPR gRNA sequence
  source 1..20: mol_type = other DNA
gcttcccactctctgtgagc

SEQ ID NO: 42434 - DNA, 20 bp, synthetic construct
  misc_feature 1..20: note = CRISPR gRNA sequence
  source 1..20: mol_type = other DNA
cttcccactctctgtgagca

SEQ ID NO: 42435 - DNA, 20 bp, synthetic construct
  misc_feature 1..20: note = CRISPR gRNA sequence
  source 1..20: mol_type = other DNA
gcctgtgaaatctgtgcttg

SEQ ID NO: 42436 - DNA, 20 bp, synthetic construct
  misc_feature 1..20: note = CRISPR gRNA sequence
  source 1..20: mol_type = other DNA
cctgtgaaatctgtgcttgc

SEQ ID NO: 42437 - DNA, 20 bp, synthetic construct
  misc_feature 1..20: note = CRISPR gRNA sequence
  source 1..20: mol_type = other DNA
gtgcttgcaggtaaaaacaa

SEQ ID NO: 42438 - DNA, 20 bp, synthetic construct
  misc_feature 1..20: note = CRISPR gRNA sequence
  source 1..20: mol_type = other DNA
aaaaacaatagtaataataa

SEQ ID NO: 42439 - DNA, 20 bp, synthetic construct
  misc_feature 1..20: note = CRISPR gRNA sequence
  source 1..20: mol_type = other DNA
acaatagtaataataacagc

SEQ ID NO: 42440 - DNA, 20 bp, synthetic construct
  misc_feature 1..20: note = CRISPR gRNA sequence
  source 1..20: mol_type = other DNA
agtaataataacagcaagca

SEQ ID NO: 42441 - DNA, 20 bp, synthetic construct
  misc_feature 1..20: note = CRISPR gRNA sequence
  source 1..20: mol_type = other DNA
gtaataataacagcaagcac

SEQ ID NO: 42442 - DNA, 20 bp, synthetic construct
  misc_feature 1..20: note = CRISPR gRNA sequence
  source 1..20: mol_type = other DNA
gcaagcacaggtcccatgcc

SEQ ID NO: 42443 - DNA, 20 bp, synthetic construct
  misc_feature 1..20: note = CRISPR gRNA sequence
  source 1..20: mol_type = other DNA
agcacaggtcccatgcccgg

SEQ ID NO: 42444 - DNA, 20 bp, synthetic construct
  misc_feature 1..20: note = CRISPR gRNA sequence
  source 1..20: mol_type = other DNA
attaaatcctcatatacctc

SEQ ID NO: 42445 - DNA, 20 bp, synthetic construct
  misc_feature 1..20: note = CRISPR gRNA sequence
  source 1..20: mol_type = other DNA
taaatcctcatatacctcga

SEQ ID NO: 42446 - DNA, 20 bp, synthetic construct
  misc_feature 1..20: note = CRISPR gRNA sequence
  source 1..20: mol_type = other DNA
cctcgagagtcatacatgac

SEQ ID NO: 42447 - DNA, 20 bp, synthetic construct
  misc_feature 1..20: note = CRISPR gRNA sequence
  source 1..20: mol_type = other DNA
acatgacgagtcttgatttc

SEQ ID NO: 42448 - DNA, 20 bp, synthetic construct
  misc_feature 1..20: note = CRISPR gRNA sequence
  source 1..20: mol_type = other DNA
acgagtcttgatttccagat

SEQ ID NO: 42449 - DNA, 20 bp, synthetic construct
  misc_feature 1..20: note = CRISPR gRNA sequence
  source 1..20: mol_type = other DNA
cgagtcttgatttccagata

SEQ ID NO: 42450 - DNA, 20 bp, synthetic construct
  misc_feature 1..20: note = CRISPR gRNA sequence
  source 1..20: mol_type = other DNA
atttccagataaggaaactg

SEQ ID NO: 42451 - DNA, 20 bp, synthetic construct
  misc_feature 1..20: note = CRISPR gRNA sequence
  source 1..20: mol_type = other DNA
cagataaggaaactgaagct

SEQ ID NO: 42452 - DNA, 20 bp, synthetic construct
  misc_feature 1..20: note = CRISPR gRNA sequence
  source 1..20: mol_type = other DNA
gataaggaaactgaagctca

SEQ ID NO: 42453 - DNA, 20 bp, synthetic construct
  misc_feature 1..20: note = CRISPR gRNA sequence
  source 1..20: mol_type = other DNA
taaggaaactgaagctcaga

SEQ ID NO: 42454 - DNA, 20 bp, synthetic construct
  misc_feature 1..20: note = CRISPR gRNA sequence
  source 1..20: mol_type = other DNA
aaggaaactgaagctcagag

SEQ ID NO: 42455 - DNA, 20 bp, synthetic construct
  misc_feature 1..20: note = CRISPR gRNA sequence
  source 1..20: mol_type = other DNA
aactgaagctcagagaggtg

SEQ ID NO: 42456 - DNA, 20 bp, synthetic construct
  misc_feature 1..20: note = CRISPR gRNA sequence
  source 1..20: mol_type = other DNA
agaggtgaagtcacttctcc

SEQ ID NO: 42457 - DNA, 20 bp, synthetic construct
  misc_feature 1..20: note = CRISPR gRNA sequence
  source 1..20: mol_type = other DNA
gaggtgaagtcacttctcca

SEQ ID NO: 42458 - DNA, 20 bp, synthetic construct
  misc_feature 1..20: note = CRISPR gRNA sequence
  source 1..20: mol_type = other DNA
gtcacttctccaaggtcaca

SEQ ID NO: 42459 - DNA, 20 bp, synthetic construct
  misc_feature 1..20: note = CRISPR gRNA sequence
  source 1..20: mol_type = other DNA
tccaaggtcacacagccaat

SEQ ID NO: 42460 - DNA, 20 bp, synthetic construct
  misc_feature 1..20: note = CRISPR gRNA sequence
  source 1..20: mol_type = other DNA
aaggtcacacagccaataag

SEQ ID NO: 42461 - DNA, 20 bp, synthetic construct
  misc_feature 1..20: note = CRISPR gRNA sequence
  source 1..20: mol_type = other DNA
acacagccaataagcagaac

SEQ ID NO: 42462 - DNA, 20 bp, synthetic construct
  misc_feature 1..20: note = CRISPR gRNA sequence
  source 1..20: mol_type = other DNA
cacagccaataagcagaact

SEQ ID NO: 42463 - DNA, 20 bp, synthetic construct
  misc_feature 1..20: note = CRISPR gRNA sequence
  source 1..20: mol_type = other DNA
atccaaatctgcctgtccct

SEQ ID NO: 42464 - DNA, 20 bp, synthetic construct
  misc_feature 1..20: note = CRISPR gRNA sequence
  source 1..20: mol_type = other DNA
tgcttccctattgccttgct

SEQ ID NO: 42465 - DNA, 20 bp, synthetic construct
  misc_feature 1..20: note = CRISPR gRNA sequence
  source 1..20: mol_type = other DNA
ctattgccttgctgagctgc

SEQ ID NO: 42466 - DNA, 20 bp, synthetic construct
  misc_feature 1..20: note = CRISPR gRNA sequence
  source 1..20: mol_type = other DNA
ccctccctttccttaccctc

SEQ ID NO: 42467 - DNA, 20 bp, synthetic construct
  misc_feature 1..20: note = CRISPR gRNA sequence
  source 1..20: mol_type = other DNA
cctccctttccttaccctcc

SEQ ID NO: 42468 - DNA, 20 bp, synthetic construct
  misc_feature 1..20: note = CRISPR gRNA sequence
  source 1..20: mol_type = other DNA
cctttccttaccctccaggc

SEQ ID NO: 42469 - DNA, 20 bp, synthetic construct
  misc_feature 1..20: note = CRISPR gRNA sequence
  source 1..20: mol_type = other DNA
tccttaccctccaggctagc

SEQ ID NO: 42470 - DNA, 20 bp, synthetic construct
  misc_feature 1..20: note = CRISPR gRNA sequence
  source 1..20: mol_type = other DNA
ccttaccctccaggctagcc

SEQ ID NO: 42471 - DNA, 20 bp, synthetic construct
  misc_feature 1..20: note = CRISPR gRNA sequence
  source 1..20: mol_type = other DNA
tccttgtccactcatcttgc

SEQ ID NO: 42472 - DNA, 20 bp, synthetic construct
  misc_feature 1..20: note = CRISPR gRNA sequence
  source 1..20: mol_type = other DNA
gatctaccccctttcctttt

SEQ ID NO: 42473 - DNA, 20 bp, synthetic construct
  misc_feature 1..20: note = CRISPR gRNA sequence
  source 1..20: mol_type = other DNA
atctaccccctttccttttc

SEQ ID NO: 42474 - DNA, 20 bp, synthetic construct
  misc_feature 1..20: note = CRISPR gRNA sequence
  source 1..20: mol_type = other DNA
ccccctttccttttcaggct

SEQ ID NO: 42475 - DNA, 20 bp, synthetic construct
  misc_feature 1..20: note = CRISPR gRNA sequence
  source 1..20: mol_type = other DNA
ctttccttttcaggctgagc

SEQ ID NO: 42476 - DNA, 20 bp, synthetic construct
  misc_feature 1..20: note = CRISPR gRNA sequence
  source 1..20: mol_type = other DNA
ccttttcaggctgagccaga

SEQ ID NO: 42477 - DNA, 20 bp, synthetic construct
  misc_feature 1..20: note = CRISPR gRNA sequence
  source 1..20: mol_type = other DNA
cttttcaggctgagccagac

SEQ ID NO: 42478 - DNA, 20 bp, synthetic construct
  misc_feature 1..20: note = CRISPR gRNA sequence
  source 1..20: mol_type = other DNA
cagacgggactgtccccgaa

SEQ ID NO: 42479 - DNA, 20 bp, synthetic construct
  misc_feature 1..20: note = CRISPR gRNA sequence
  source 1..20: mol_type = other DNA
cccgaaaagccccttcctgc

SEQ ID NO: 42480 - DNA, 20 bp, synthetic construct
  misc_feature 1..20: note = CRISPR gRNA sequence
  source 1..20: mol_type = other DNA
ttcctgctggccaacacctt

SEQ ID NO: 42481 - DNA, 20 bp, synthetic construct
  misc_feature 1..20: note = CRISPR gRNA sequence
  source 1..20: mol_type = other DNA
acaccttaagcctgtgtcca

SEQ ID NO: 42482 - DNA, 20 bp, synthetic construct
  misc_feature 1..20: note = CRISPR gRNA sequence
  source 1..20: mol_type = other DNA
caccttaagcctgtgtccac

SEQ ID NO: 42483 - DNA, 20 bp, synthetic construct
  misc_feature 1..20: note = CRISPR gRNA sequence
  source 1..20: mol_type = other DNA
gcctgtgtccacgggttaaa

SEQ ID NO: 42484 - DNA, 20 bp, synthetic construct
  misc_feature 1..20: note = CRISPR gRNA sequence
  source 1..20: mol_type = other DNA
cctgtgtccacgggttaaaa

SEQ ID NO: 42485 - DNA, 20 bp, synthetic construct
  misc_feature 1..20: note = CRISPR gRNA sequence
  source 1..20: mol_type = other DNA
gtgtccacgggttaaaaagg

SEQ ID NO: 42486 - DNA, 20 bp, synthetic construct
  misc_feature 1..20: note = CRISPR gRNA sequence
  source 1..20: mol_type = other DNA
cgggttaaaaaggtggatct

SEQ ID NO: 42487 - DNA, 20 bp, synthetic construct
  misc_feature 1..20: note = CRISPR gRNA sequence
  source 1..20: mol_type = other DNA
gggttaaaaaggtggatctc

SEQ ID NO: 42488 - DNA, 20 bp, synthetic construct
  misc_feature 1..20: note = CRISPR gRNA sequence
  source 1..20: mol_type = other DNA
ttaaaaaggtggatctcagg

SEQ ID NO: 42489 - DNA, 20 bp, synthetic construct
  misc_feature 1..20: note = CRISPR gRNA sequence
  source 1..20: mol_type = other DNA
taaaaaggtggatctcaggt

SEQ ID NO: 42490 - DNA, 20 bp, synthetic construct
  misc_feature 1..20: note = CRISPR gRNA sequence
  source 1..20: mol_type = other DNA
atctcaggtgggcattcccc

SEQ ID NO: 42491 - DNA, 20 bp, synthetic construct
  misc_feature 1..20: note = CRISPR gRNA sequence
  source 1..20: mol_type = other DNA
tctcaggtgggcattcccct

SEQ ID NO: 42492 - DNA, 20 bp, synthetic construct
  misc_feature 1..20: note = CRISPR gRNA sequence
  source 1..20: mol_type = other DNA
aggtgggcattcccctggga

SEQ ID NO: 42493 - DNA, 20 bp, synthetic construct
  misc_feature 1..20: note = CRISPR gRNA sequence
  source 1..20: mol_type = other DNA
gggcattcccctgggacagc

SEQ ID NO: 42494 - DNA, 20 bp, synthetic construct
  misc_feature 1..20: note = CRISPR gRNA sequence
  source 1..20: mol_type = other DNA
ggcattcccctgggacagcc

SEQ ID NO: 42495 - DNA, 20 bp, synthetic construct
  misc_feature 1..20: note = CRISPR gRNA sequence
  source 1..20: mol_type = other DNA
gacagccaggactcgtcctg

SEQ ID NO: 42496 - DNA, 20 bp, synthetic construct
  misc_feature 1..20: note = CRISPR gRNA sequence
  source 1..20: mol_type = other DNA
acagccaggactcgtcctga

SEQ ID NO: 42497 - DNA, 20 bp, synthetic construct
  misc_feature 1..20: note = CRISPR gRNA sequence
  source 1..20: mol_type = other DNA
cagccaggactcgtcctgaa

SEQ ID NO: 42498 - DNA, 20 bp, synthetic construct
  misc_feature 1..20: note = CRISPR gRNA sequence
  source 1..20: mol_type = other DNA
tcgtcctgaagggttgtgcc

SEQ ID NO: 42499 - DNA, 20 bp, synthetic construct
  misc_feature 1..20: note = CRISPR gRNA sequence
  source 1..20: mol_type = other DNA
gtcctgaagggttgtgcctg

SEQ ID NO: 42500 - DNA, 20 bp, synthetic construct
  misc_feature 1..20: note = CRISPR gRNA sequence
  source 1..20: mol_type = other DNA
gaagggttgtgcctggagtc

SEQ ID NO: 42501 - DNA, 20 bp, synthetic construct
  misc_feature 1..20: note = CRISPR gRNA sequence
  source 1..20: mol_type = other DNA
gggttgtgcctggagtctgg

SEQ ID NO: 42502 - DNA, 20 bp, synthetic construct
  misc_feature 1..20: note = CRISPR gRNA sequence
  source 1..20: mol_type = other DNA
ggttgtgcctggagtctggt

SEQ ID NO: 42503 - DNA, 20 bp, synthetic construct
  misc_feature 1..20: note = CRISPR gRNA sequence
  source 1..20: mol_type = other DNA
gcctggagtctggtgggtat

SEQ ID NO: 42504 - DNA, 20 bp, synthetic construct
  misc_feature 1..20: note = CRISPR gRNA sequence
  source 1..20: mol_type = other DNA
cctggagtctggtgggtatg

SEQ ID NO: 42505 - DNA, 20 bp, synthetic construct
  misc_feature 1..20: note = CRISPR gRNA sequence
  source 1..20: mol_type = other DNA
ctggagtctggtgggtatga

SEQ ID NO: 42506 - DNA, 20 bp, synthetic construct
  misc_feature 1..20: note = CRISPR gRNA sequence
  source 1..20: mol_type = other DNA
tggagtctggtgggtatgag

SEQ ID NO: 42507 - DNA, 20 bp, synthetic construct
  misc_feature 1..20: note = CRISPR gRNA sequence
  source 1..20: mol_type = other DNA
ggagtctggtgggtatgagg

SEQ ID NO: 42508 - DNA, 20 bp, synthetic construct
  misc_feature 1..20: note = CRISPR gRNA sequence
  source 1..20: mol_type = other DNA
gtctggtgggtatgaggggg

SEQ ID NO: 42509 - DNA, 20 bp, synthetic construct
  misc_feature 1..20: note = CRISPR gRNA sequence
  source 1..20: mol_type = other DNA
tctggtgggtatgagggggt

SEQ ID NO: 42510 - DNA, 20 bp, synthetic construct
  misc_feature 1..20: note = CRISPR gRNA sequence
  source 1..20: mol_type = other DNA
gggtatgagggggtaggatg

SEQ ID NO: 42511 - DNA, 20 bp, synthetic construct
  misc_feature 1..20: note = CRISPR gRNA sequence
  source 1..20: mol_type = other DNA
atgagggggtaggatgaaga

SEQ ID NO: 42512 - DNA, 20 bp, synthetic construct
  misc_feature 1..20: note = CRISPR gRNA sequence
  source 1..20: mol_type = other DNA
agggggtaggatgaagacag

SEQ ID NO: 42513 - DNA, 20 bp, synthetic construct
  misc_feature 1..20: note = CRISPR gRNA sequence
  source 1..20: mol_type = other DNA
gggggtaggatgaagacagt

SEQ ID NO: 42514 - DNA, 20 bp, synthetic construct
  misc_feature 1..20: note = CRISPR gRNA sequence
  source 1..20: mol_type = other DNA
tgaagacagtaggacccaac

SEQ ID NO: 42515 - DNA, 20 bp, synthetic construct
  misc_feature 1..20: note = CRISPR gRNA sequence
  source 1..20: mol_type = other DNA
aagacagtaggacccaacta

SEQ ID NO: 42516 - DNA, 20 bp, synthetic construct
  misc_feature 1..20: note = CRISPR gRNA sequence
  source 1..20: mol_type = other DNA
agacagtaggacccaactag

SEQ ID NO: 42517 - DNA, 20 bp, synthetic construct
  misc_feature 1..20: note = CRISPR gRNA sequence
  source 1..20: mol_type = other DNA
agtaggacccaactagaggc

SEQ ID NO: 42518 - DNA, 20 bp, synthetic construct
  misc_feature 1..20: note = CRISPR gRNA sequence
  source 1..20: mol_type = other DNA
gtaggacccaactagaggct

SEQ ID NO: 42519 - DNA, 20 bp, synthetic construct
  misc_feature 1..20: note = CRISPR gRNA sequence
  source 1..20: mol_type = other DNA
ccaactagaggctgggcttc

SEQ ID NO: 42520 - DNA, 20 bp, synthetic construct
  misc_feature 1..20: note = CRISPR gRNA sequence
  source 1..20: mol_type = other DNA
aactagaggctgggcttccg

SEQ ID NO: 42521 - DNA, 20 bp, synthetic construct
  misc_feature 1..20: note = CRISPR gRNA sequence
  source 1..20: mol_type = other DNA
actagaggctgggcttccgg

SEQ ID NO: 42522 - DNA, 20 bp, synthetic construct
  misc_feature 1..20: note = CRISPR gRNA sequence
  source 1..20: mol_type = other DNA
tagaggctgggcttccggag

SEQ ID NO: 42523 - DNA, 20 bp, synthetic construct
  misc_feature 1..20: note = CRISPR gRNA sequence
  source 1..20: mol_type = other DNA
agaggctgggcttccggagg

SEQ ID NO: 42524 - DNA, 20 bp, synthetic construct
  misc_feature 1..20: note = CRISPR gRNA sequence
  source 1..20: mol_type = other DNA
gaggctgggcttccggagga

SEQ ID NO: 42525 - DNA, 20 bp, synthetic construct
  misc_feature 1..20: note = CRISPR gRNA sequence
  source 1..20: mol_type = other DNA
aggctgggcttccggaggag

SEQ ID NO: 42526 - DNA, 20 bp, synthetic construct
  misc_feature 1..20: note = CRISPR gRNA sequence
  source 1..20: mol_type = other DNA
ggcttccggaggaggggtgc

SEQ ID NO: 42527 - DNA, 20 bp, synthetic construct
  misc_feature 1..20: note = CRISPR gRNA sequence
  source 1..20: mol_type = other DNA
gaggaggggtgctggccccg

SEQ ID NO: 42528 - DNA, 20 bp, synthetic construct
  misc_feature 1..20: note = CRISPR gRNA sequence
  source 1..20: mol_type = other DNA
aggaggggtgctggccccgt

SEQ ID NO: 42529 - DNA, 20 bp, synthetic construct
  misc_feature 1..20: note = CRISPR gRNA sequence
  source 1..20: mol_type = other DNA
ggaggggtgctggccccgtg

SEQ ID NO: 42530 - DNA, 20 bp, synthetic construct
  misc_feature 1..20: note = CRISPR gRNA sequence
  source 1..20: mol_type = other DNA
gaggggtgctggccccgtgg

SEQ ID NO: 42531 - DNA, 20 bp, synthetic construct
  misc_feature 1..20: note = CRISPR gRNA sequence
  source 1..20: mol_type = other DNA
tggccccgtgggggcatcct

SEQ ID NO: 42532 - DNA, 20 bp, synthetic construct
  misc_feature 1..20: note = CRISPR gRNA sequence
  source 1..20: mol_type = other DNA
ggccccgtgggggcatcctg

SEQ ID NO: 42533 - DNA, 20 bp, synthetic construct
  misc_feature 1..20: note = CRISPR gRNA sequence
  source 1..20: mol_type = other DNA
gtgggggcatcctgaggctg

SEQ ID NO: 42534 - DNA, 20 bp, synthetic construct
  misc_feature 1..20: note = CRISPR gRNA sequence
  source 1..20: mol_type = other DNA
gcatcctgaggctgtggcca

SEQ ID NO: 42535 - DNA, 20 bp, synthetic construct
  misc_feature 1..20: note = CRISPR gRNA sequence
  source 1..20: mol_type = other DNA
gtggccacagctgtctgacc

SEQ ID NO: 42536 - DNA, 20 bp, synthetic construct
  misc_feature 1..20: note = CRISPR gRNA sequence
  source 1..20: mol_type = other DNA
tggccacagctgtctgaccc

SEQ ID NO: 42537 - DNA, 20 bp, synthetic construct
  misc_feature 1..20: note = CRISPR gRNA sequence
  source 1..20: mol_type = other DNA
gacccaggtcctgtctgatc

SEQ ID NO: 42538 - DNA, 20 bp, synthetic construct
  misc_feature 1..20: note = CRISPR gRNA sequence
  source 1..20: mol_type = other DNA
acccaggtcctgtctgatcc

SEQ ID NO: 42539 - DNA, 20 bp, synthetic construct
  misc_feature 1..20: note = CRISPR gRNA sequence
  source 1..20: mol_type = other DNA
caccatgcaactttgcactt

SEQ ID NO: 42540 - DNA, 20 bp, synthetic construct
  misc_feature 1..20: note = CRISPR gRNA sequence
  source 1..20: mol_type = other DNA
ctttgcacttcagatccaac

SEQ ID NO: 42541 - DNA, 20 bp, synthetic construct
  misc_feature 1..20: note = CRISPR gRNA sequence
  source 1..20: mol_type = other DNA
tttgcacttcagatccaacg

SEQ ID NO: 42542 - DNA, 20 bp, synthetic construct
  misc_feature 1..20: note = CRISPR gRNA sequence
  source 1..20: mol_type = other DNA
tgcacttcagatccaacgag

SEQ ID NO: 42543 - DNA, 20 bp, synthetic construct
  misc_feature 1..20: note = CRISPR gRNA sequence
  source 1..20: mol_type = other DNA
gcacttcagatccaacgagg

SEQ ID NO: 42544 - DNA, 20 bp, synthetic construct
  misc_feature 1..20: note = CRISPR gRNA sequence
  source 1..20: mol_type = other DNA
acttcagatccaacgaggag

SEQ ID NO: 42545 - DNA, 20 bp, synthetic construct
  misc_feature 1..20: note = CRISPR gRNA sequence
  source 1..20: mol_type = other DNA
cttcagatccaacgaggagg

SEQ ID NO: 42546 - DNA, 20 bp, synthetic construct
  misc_feature 1..20: note = CRISPR gRNA sequence
  source 1..20: mol_type = other DNA
cagatccaacgaggaggagg

SEQ ID NO: 42547 - DNA, 20 bp, synthetic construct
  misc_feature 1..20: note = CRISPR gRNA sequence
  source 1..20: mol_type = other DNA
agatccaacgaggaggagga

SEQ ID NO: 42548 - DNA, 20 bp, synthetic construct
  misc_feature 1..20: note = CRISPR gRNA sequence
  source 1..20: mol_type = other DNA
gaggaggaaggcgtgtgctg

SEQ ID NO: 42549 - DNA, 20 bp, synthetic construct
  misc_feature 1..20: note = CRISPR gRNA sequence
  source 1..20: mol_type = other DNA
aggaggaaggcgtgtgctgt

SEQ ID NO: 42550 - DNA, 20 bp, synthetic construct
  misc_feature 1..20: note = CRISPR gRNA sequence
  source 1..20: mol_type = other DNA
ggaaggcgtgtgctgtgggt

SEQ ID NO: 42551 - DNA, 20 bp, synthetic construct
  misc_feature 1..20: note = CRISPR gRNA sequence
  source 1..20: mol_type = other DNA
aagcccccttgaaccatgcc

SEQ ID NO: 42552 - DNA, 20 bp, synthetic construct
  misc_feature 1..20: note = CRISPR gRNA sequence
  source 1..20: mol_type = other DNA
agcccccttgaaccatgcct

SEQ ID NO: 42553 - DNA, 20 bp, synthetic construct
  misc_feature 1..20: note = CRISPR gRNA sequence
  source 1..20: mol_type = other DNA
ccccttgaaccatgcctagg

SEQ ID NO: 42554 - DNA, 20 bp, synthetic construct
  misc_feature 1..20: note = CRISPR gRNA sequence
  source 1..20: mol_type = other DNA
ttgaaccatgcctaggcagc

SEQ ID NO: 42555 - DNA, 20 bp, synthetic construct
  misc_feature 1..20: note = CRISPR gRNA sequence
  source 1..20: mol_type = other DNA
cctaggcagctagttgatgt

SEQ ID NO: 42556 - DNA, 20 bp, synthetic construct
  misc_feature 1..20: note = CRISPR gRNA sequence
  source 1..20: mol_type = other DNA
ctaggcagctagttgatgtt

SEQ ID NO: 42557 - DNA, 20 bp, synthetic construct
  misc_feature 1..20: note = CRISPR gRNA sequence
  source 1..20: mol_type = other DNA
taggcagctagttgatgttg

SEQ ID NO: 42558 - DNA, 20 bp, synthetic construct
  misc_feature 1..20: note = CRISPR gRNA sequence
  source 1..20: mol_type = other DNA
agctagttgatgttggggac

SEQ ID NO: 42559 - DNA, 20 bp, synthetic construct
  misc_feature 1..20: note = CRISPR gRNA sequence
  source 1..20: mol_type = other DNA
tagttgatgttggggaccag

SEQ ID NO: 42560 - DNA, 20 bp, synthetic construct
  misc_feature 1..20: note = CRISPR gRNA sequence
  source 1..20: mol_type = other DNA
ggaccagtagatctgcctcc

SEQ ID NO: 42561 - DNA, 20 bp, synthetic construct
  misc_feature 1..20: note = CRISPR gRNA sequence
  source 1..20: mol_type = other DNA
gaccagtagatctgcctcct

SEQ ID NO: 42562 - DNA, 20 bp, synthetic construct
  misc_feature 1..20: note = CRISPR gRNA sequence
  source 1..20: mol_type = other DNA
cagtagatctgcctcctggg

SEQ ID NO: 42563 - DNA, 20 bp, synthetic construct
  misc_feature 1..20: note = CRISPR gRNA sequence
  source 1..20: mol_type = other DNA
agatctgcctcctgggtggc

SEQ ID NO: 42564 - DNA, 20 bp, synthetic construct
  misc_feature 1..20: note = CRISPR gRNA sequence
  source 1..20: mol_type = other DNA
atctgcctcctgggtggcca

SEQ ID NO: 42565 - DNA, 20 bp, synthetic construct
  misc_feature 1..20: note = CRISPR gRNA sequence
  source 1..20: mol_type = other DNA
tgcctcctgggtggccagag

SEQ ID NO: 42566 - DNA, 20 bp, synthetic construct
  misc_feature 1..20: note = CRISPR gRNA sequence
  source 1..20: mol_type = other DNA
tgggtggccagagcagtatg

SEQ ID NO: 42567 - DNA, 20 bp, synthetic construct
  misc_feature 1..20: note = CRISPR gRNA sequence
  source 1..20: mol_type = other DNA
cctaccacaaaacattcccc

SEQ ID NO: 42568 - DNA, 20 bp, synthetic construct
  misc_feature 1..20: note = CRISPR gRNA sequence
  source 1..20: mol_type = other DNA
attcccctggaacaaccctg

SEQ ID NO: 42569 - DNA, 20 bp, synthetic construct
  misc_feature 1..20: note = CRISPR gRNA sequence
  source 1..20: mol_type = other DNA
tcccctggaacaaccctgca

SEQ ID NO: 42570 - DNA, 20 bp, synthetic construct
  misc_feature 1..20: note = CRISPR gRNA sequence
  source 1..20: mol_type = other DNA
cccctggaacaaccctgcag

SEQ ID NO: 42571 - DNA, 20 bp, synthetic construct
  misc_feature 1..20: note = CRISPR gRNA sequence
  source 1..20: mol_type = other DNA
ccctggaacaaccctgcaga

SEQ ID NO: 42572 - DNA, 20 bp, synthetic construct
  misc_feature 1..20: note = CRISPR gRNA sequence
  source 1..20: mol_type = other DNA
gcagagggacttgtttcacc

SEQ ID NO: 42573 - DNA, 20 bp, synthetic construct
  misc_feature 1..20: note = CRISPR gRNA sequence
  source 1..20: mol_type = other DNA
gacttgtttcacccagcatg

SEQ ID NO: 42574 - DNA, 20 bp, synthetic construct
  misc_feature 1..20: note = CRISPR gRNA sequence
  source 1..20: mol_type = other DNA
tcacccagcatgaagaaaca

SEQ ID NO: 42575 - DNA, 20 bp, synthetic construct
  misc_feature 1..20: note = CRISPR gRNA sequence
  source 1..20: mol_type = other DNA
cacccagcatgaagaaacac

SEQ ID NO: 42576 - DNA, 20 bp, synthetic construct
  misc_feature 1..20: note = CRISPR gRNA sequence
  source 1..20: mol_type = other DNA
agcatgaagaaacacaggtc

SEQ ID NO: 42577 - DNA, 20 bp, synthetic construct
  misc_feature 1..20: note = CRISPR gRNA sequence
  source 1..20: mol_type = other DNA
gcatgaagaaacacaggtcc

SEQ ID NO: 42578 - DNA, 20 bp, synthetic construct
  misc_feature 1..20: note = CRISPR gRNA sequence
  source 1..20: mol_type = other DNA
tgaagaaacacaggtccggg

SEQ ID NO: 42579 - DNA, 20 bp, synthetic construct
  misc_feature 1..20: note = CRISPR gRNA sequence
  source 1..20: mol_type = other DNA
gaagaaacacaggtccgggt

SEQ ID NO: 42580 - DNA, 20 bp, synthetic construct
  misc_feature 1..20: note = CRISPR gRNA sequence
  source 1..20: mol_type = other DNA
ggtccgggtgggatctactg

SEQ ID NO: 42581 - DNA, 20 bp, synthetic construct
  misc_feature 1..20: note = CRISPR gRNA sequence
  source 1..20: mol_type = other DNA
gtccgggtgggatctactgt

SEQ ID NO: 42582 - DNA, 20 bp, synthetic construct
  misc_feature 1..20: note = CRISPR gRNA sequence
  source 1..20: mol_type = other DNA
tccgggtgggatctactgtg

SEQ ID NO: 42583 - DNA, 20 bp, synthetic construct
  misc_feature 1..20: note = CRISPR gRNA sequence
  source 1..20: mol_type = other DNA
ccgggtgggatctactgtgg

SEQ ID NO: 42584 - DNA, 20 bp, synthetic construct
  misc_feature 1..20: note = CRISPR gRNA sequence
  source 1..20: mol_type = other DNA
ggtgggatctactgtggggg

SEQ ID NO: 42585 - DNA, 20 bp, synthetic construct
  misc_feature 1..20: note = CRISPR gRNA sequence
  source 1..20: mol_type = other DNA
gtgggatctactgtgggggt

SEQ ID NO: 42586 - DNA, 20 bp, synthetic construct
  misc_feature 1..20: note = CRISPR gRNA sequence
  source 1..20: mol_type = other DNA
gggatctactgtgggggtgg

SEQ ID NO: 42587 - DNA, 20 bp, synthetic construct
  misc_feature 1..20: note = CRISPR gRNA sequence
  source 1..20: mol_type = other DNA
atctactgtgggggtgggag

SEQ ID NO: 42588 - DNA, 20 bp, synthetic construct
  misc_feature 1..20: note = CRISPR gRNA sequence
  source 1..20: mol_type = other DNA
tactgtgggggtgggagcag

SEQ ID NO: 42589 - DNA, 20 bp, synthetic construct
  misc_feature 1..20: note = CRISPR gRNA sequence
  source 1..20: mol_type = other DNA
ggggtgggagcagtggattc

SEQ ID NO: 42590 - DNA, 20 bp, synthetic construct
  misc_feature 1..20: note = CRISPR gRNA sequence
  source 1..20: mol_type = other DNA
cagtggattctggacacttc

SEQ ID NO: 42591 - DNA, 20 bp, synthetic construct
  misc_feature 1..20: note = CRISPR gRNA sequence
  source 1..20: mol_type = other DNA
gtggattctggacacttcca

SEQ ID NO: 42592 - DNA, 20 bp, synthetic construct
  misc_feature 1..20: note = CRISPR gRNA sequence
  source 1..20: mol_type = other DNA
tggattctggacacttccag

SEQ ID NO: 42593 - DNA, 20 bp, synthetic construct
  misc_feature 1..20: note = CRISPR gRNA sequence
  source 1..20: mol_type = other DNA
ggattctggacacttccaga

SEQ ID NO: 42594 - DNA, 20 bp, synthetic construct
  misc_feature 1..20: note = CRISPR gRNA sequence
  source 1..20: mol_type = other DNA
tggacacttccagagggtcc

SEQ ID NO: 42595 - DNA, 20 bp, synthetic construct
  misc_feature 1..20: note = CRISPR gRNA sequence
  source 1..20: mol_type = other DNA
cttccagagggtccaagctt

SEQ ID NO: 42596 - DNA, 20 bp, synthetic construct
  misc_feature 1..20: note = CRISPR gRNA sequence
  source 1..20: mol_type = other DNA
ccagagggtccaagcttgag

SEQ ID NO: 42597 - DNA, 20 bp, synthetic construct
  misc_feature 1..20: note = CRISPR gRNA sequence
  source 1..20: mol_type = other DNA
agagggtccaagcttgagtg

SEQ ID NO: 42598 - DNA, 20 bp, synthetic construct
  misc_feature 1..20: note = CRISPR gRNA sequence
  source 1..20: mol_type = other DNA
agcttgagtggagacccacc

SEQ ID NO: 42599 - DNA, 20 bp, synthetic construct
  misc_feature 1..20: note = CRISPR gRNA sequence
  source 1..20: mol_type = other DNA
cttgagtggagacccacctg

SEQ ID NO: 42600 - DNA, 20 bp, synthetic construct
  misc_feature 1..20: note = CRISPR gRNA sequence
  source 1..20: mol_type = other DNA
gtggagacccacctggagcc

SEQ ID NO: 42601 - DNA, 20 bp, synthetic construct
  misc_feature 1..20: note = CRISPR gRNA sequence
  source 1..20: mol_type = other DNA
ggagacccacctggagccca

SEQ ID NO: 42602 - DNA, 20 bp, synthetic construct
  misc_feature 1..20: note = CRISPR gRNA sequence
  source 1..20: mol_type = other DNA
gagacccacctggagcccag

SEQ ID NO: 42603 - DNA, 20 bp, synthetic construct
  misc_feature 1..20: note = CRISPR gRNA sequence
  source 1..20: mol_type = other DNA
ggagcccagaggctgtgccc

SEQ ID NO: 42604 - DNA, 20 bp, synthetic construct
  misc_feature 1..20: note = CRISPR gRNA sequence
  source 1..20: mol_type = other DNA
gagcccagaggctgtgccct

SEQ ID NO: 42605 - DNA, 20 bp, synthetic construct
  misc_feature 1..20: note = CRISPR gRNA sequence
  source 1..20: mol_type = other DNA
ccagaggctgtgccctgggc

SEQ ID NO: 42606 - DNA, 20 bp, synthetic construct
  misc_feature 1..20: note = CRISPR gRNA sequence
  source 1..20: mol_type = other DNA
aggctgtgccctgggctagc

SEQ ID NO: 42607 - DNA, 20 bp, synthetic construct
  misc_feature 1..20: note = CRISPR gRNA sequence
  source 1..20: mol_type = other DNA
ggctgtgccctgggctagcc

SEQ ID NO: 42608 - DNA, 20 bp, synthetic construct
  misc_feature 1..20: note = CRISPR gRNA sequence
  source 1..20: mol_type = other DNA
gtgccctgggctagccaggc

SEQ ID NO: 42609 - DNA, 20 bp, synthetic construct
  misc_feature 1..20: note = CRISPR gRNA sequence
  source 1..20: mol_type = other DNA
gccctgggctagccaggccg

SEQ ID NO: 42610 - DNA, 20 bp, synthetic construct
  misc_feature 1..20: note = CRISPR gRNA sequence
  source 1..20: mol_type = other DNA
ccctgggctagccaggccgg

SEQ ID NO: 42611 - DNA, 20 bp, synthetic construct
  misc_feature 1..20: note = CRISPR gRNA sequence
  source 1..20: mol_type = other DNA
cctgggctagccaggccgga

SEQ ID NO: 42612 - DNA, 20 bp, synthetic construct
  misc_feature 1..20: note = CRISPR gRNA sequence
  source 1..20: mol_type = other DNA
ctgggctagccaggccggag

SEQ ID NO: 42613 - DNA, 20 bp, synthetic construct
  misc_feature 1..20: note = CRISPR gRNA sequence
  source 1..20: mol_type = other DNA
tgggctagccaggccggagg

SEQ ID NO: 42614 - DNA, 20 bp, synthetic construct
  misc_feature 1..20: note = CRISPR gRNA sequence
  source 1..20: mol_type = other DNA
agccaggccggagggggtct

SEQ ID NO: 42615 - DNA, 20 bp, synthetic construct
  misc_feature 1..20: note = CRISPR gRNA sequence
  source 1..20: mol_type = other DNA
caggccggagggggtctcag

SEQ ID NO: 42616 - DNA, 20 bp, synthetic construct
  misc_feature 1..20: note = CRISPR gRNA sequence
  source 1..20: mol_type = other DNA
ttgtcccctttacctccgtc

SEQ ID NO: 42617 - DNA, 20 bp, synthetic construct
  misc_feature 1..20: note = CRISPR gRNA sequence
  source 1..20: mol_type = other DNA
tcccctttacctccgtccag

SEQ ID NO: 42618 - DNA, 20 bp, synthetic construct
  misc_feature 1..20: note = CRISPR gRNA sequence
  source 1..20: mol_type = other DNA
cccctttacctccgtccagc

SEQ ID NO: 42619 - DNA, 20 bp, synthetic construct
  misc_feature 1..20: note = CRISPR gRNA sequence
  source 1..20: mol_type = other DNA
acctccgtccagcaggttca

SEQ ID NO: 42620 - DNA, 20 bp, synthetic construct
  misc_feature 1..20: note = CRISPR gRNA sequence
  source 1..20: mol_type = other DNA
cctccgtccagcaggttcac

SEQ ID NO: 42621 - DNA, 20 bp, synthetic construct
  misc_feature 1..20: note = CRISPR gRNA sequence
  source 1..20: mol_type = other DNA
tccagcaggttcacaggctg

SEQ ID NO: 42622 - DNA, 20 bp, synthetic construct
  misc_feature 1..20: note = CRISPR gRNA sequence
  source 1..20: mol_type = other DNA
aggttcacaggctgcagcct

SEQ ID NO: 42623 - DNA, 20 bp, synthetic construct
  misc_feature 1..20: note = CRISPR gRNA sequence
  source 1..20: mol_type = other DNA
tcacaggctgcagcctcagc

SEQ ID NO: 42624 - DNA, 20 bp, synthetic construct
  misc_feature 1..20: note = CRISPR gRNA sequence
  source 1..20: mol_type = other DNA
cacaggctgcagcctcagcc

SEQ ID NO: 42625 - DNA, 20 bp, synthetic construct
  misc_feature 1..20: note = CRISPR gRNA sequence
  source 1..20: mol_type = other DNA
caggctgcagcctcagccag

SEQ ID NO: 42626 - DNA, 20 bp, synthetic construct
  misc_feature 1..20: note = CRISPR gRNA sequence
  source 1..20: mol_type = other DNA
cagcctcagccaggagcacg

SEQ ID NO: 42627 - DNA, 20 bp, synthetic construct
  misc_feature 1..20: note = CRISPR gRNA sequence
  source 1..20: mol_type = other DNA
gcctcagccaggagcacgta

SEQ ID NO: 42628 - DNA, 20 bp, synthetic construct
  misc_feature 1..20: note = CRISPR gRNA sequence
  source 1..20: mol_type = other DNA
agcacgtagagtcactctgc

SEQ ID NO: 42629 - DNA, 20 bp, synthetic construct
  misc_feature 1..20: note = CRISPR gRNA sequence
  source 1..20: mol_type = other DNA
gagtcactctgctggttgct

SEQ ID NO: 42630 - DNA, 20 bp, synthetic construct
  misc_feature 1..20: note = CRISPR gRNA sequence
  source 1..20: mol_type = other DNA
cactctgctggttgctgagc

SEQ ID NO: 42631 - DNA, 20 bp, synthetic construct
  misc_feature 1..20: note = CRISPR gRNA sequence
  source 1..20: mol_type = other DNA
ctggttgctgagcaagtgta

SEQ ID NO: 42632 - DNA, 20 bp, synthetic construct
  misc_feature 1..20: note = CRISPR gRNA sequence
  source 1..20: mol_type = other DNA
ctgagcaagtgtaaagacct

SEQ ID NO: 42633 - DNA, 20 bp, synthetic construct
  misc_feature 1..20: note = CRISPR gRNA sequence
  source 1..20: mol_type = other DNA
gcaagtgtaaagacctcagc

SEQ ID NO: 42634 - DNA, 20 bp, synthetic construct
  misc_feature 1..20: note = CRISPR gRNA sequence
  source 1..20: mol_type = other DNA
caagtgtaaagacctcagcc

SEQ ID NO: 42635 - DNA, 20 bp, synthetic construct
  misc_feature 1..20: note = CRISPR gRNA sequence
  source 1..20: mol_type = other DNA
gtgtaaagacctcagccagg

SEQ ID NO: 42636 - DNA, 20 bp, synthetic construct
  misc_feature 1..20: note = CRISPR gRNA sequence
  source 1..20: mol_type = other DNA
gtaaagacctcagccaggtg

SEQ ID NO: 42637 - DNA, 20 bp, synthetic construct
  misc_feature 1..20: note = CRISPR gRNA sequence
  source 1..20: mol_type = other DNA
agacctcagccaggtggagt

SEQ ID NO: 42638 - DNA, 20 bp, synthetic construct
  misc_feature 1..20: note = CRISPR gRNA sequence
  source 1..20: mol_type = other DNA
tcagccaggtggagtaagtt

SEQ ID NO: 42639 - DNA, 20 bp, synthetic construct
  misc_feature 1..20: note = CRISPR gRNA sequence
  source 1..20: mol_type = other DNA
cagccaggtggagtaagttg

SEQ ID NO: 42640 - DNA, 20 bp, synthetic construct
  misc_feature 1..20: note = CRISPR gRNA sequence
  source 1..20: mol_type = other DNA
agccaggtggagtaagttga

SEQ ID NO: 42641 - DNA, 20 bp, synthetic construct
  misc_feature 1..20: note = CRISPR gRNA sequence
  source 1..20: mol_type = other DNA
ccaggtggagtaagttgagg

SEQ ID NO: 42642 - DNA, 20 bp, synthetic construct
  misc_feature 1..20: note = CRISPR gRNA sequence
  source 1..20: mol_type = other DNA
caggtggagtaagttgaggg

SEQ ID NO: 42643 - DNA, 20 bp, synthetic construct
  misc_feature 1..20: note = CRISPR gRNA sequence
  source 1..20: mol_type = other DNA
ggtggagtaagttgagggag

SEQ ID NO: 42644 - DNA, 20 bp, synthetic construct
  misc_feature 1..20: note = CRISPR gRNA sequence
  source 1..20: mol_type = other DNA
gtggagtaagttgagggagg

SEQ ID NO: 42645 - DNA, 20 bp, synthetic construct
  misc_feature 1..20: note = CRISPR gRNA sequence
  source 1..20: mol_type = other DNA
ggagtaagttgagggaggag

SEQ ID NO: 42646 - DNA, 20 bp, synthetic construct
  misc_feature 1..20: note = CRISPR gRNA sequence
  source 1..20: mol_type = other DNA
gagtaagttgagggaggagg

SEQ ID NO: 42647 - DNA, 20 bp, synthetic construct
  misc_feature 1..20: note = CRISPR gRNA sequence
  source 1..20: mol_type = other DNA
taagttgagggaggaggagg

SEQ ID NO: 42648 - DNA, 20 bp, synthetic construct
  misc_feature 1..20: note = CRISPR gRNA sequence
  source 1..20: mol_type = other DNA
aagttgagggaggaggagga

SEQ ID NO: 42649 - DNA, 20 bp, synthetic construct
  misc_feature 1..20: note = CRISPR gRNA sequence
  source 1..20: mol_type = other DNA
gttgagggaggaggaggaag

SEQ ID NO: 42650 - DNA, 20 bp, synthetic construct
  misc_feature 1..20: note = CRISPR gRNA sequence
  source 1..20: mol_type = other DNA
tgagggaggaggaggaagga

SEQ ID NO: 42651 - DNA, 20 bp, synthetic construct
  misc_feature 1..20: note = CRISPR gRNA sequence
  source 1..20: mol_type = other DNA
gagggaggaggaggaaggag

SEQ ID NO: 42652 - DNA, 20 bp, synthetic construct
  misc_feature 1..20: note = CRISPR gRNA sequence
  source 1..20: mol_type = other DNA
gggaggaggaggaaggagag

SEQ ID NO: 42653 - DNA, 20 bp, synthetic construct
  misc_feature 1..20: note = CRISPR gRNA sequence
  source 1..20: mol_type = other DNA
gaggaggaaggagaggagca

SEQ ID NO: 42654 - DNA, 20 bp, synthetic construct
  misc_feature 1..20: note = CRISPR gRNA sequence
  source 1..20: mol_type = other DNA
aggagcatggacgcatgcct

SEQ ID NO: 42655 - DNA, 20 bp, synthetic construct
  misc_feature 1..20: note = CRISPR gRNA sequence
  source 1..20: mol_type = other DNA
ggagcatggacgcatgcctg

SEQ ID NO: 42656 - DNA, 20 bp, synthetic construct
  misc_feature 1..20: note = CRISPR gRNA sequence
  source 1..20: mol_type = other DNA
gagcatggacgcatgcctga

SEQ ID NO: 42657 - DNA, 20 bp, synthetic construct
  misc_feature 1..20: note = CRISPR gRNA sequence
  source 1..20: mol_type = other DNA
agcatggacgcatgcctgag

SEQ ID NO: 42658 - DNA, 20 bp, synthetic construct
  misc_feature 1..20: note = CRISPR gRNA sequence
  source 1..20: mol_type = other DNA
cgcatgcctgaggggcactg

SEQ ID NO: 42659 - DNA, 20 bp, synthetic construct
  misc_feature 1..20: note = CRISPR gRNA sequence
  source 1..20: mol_type = other DNA
gcatgcctgaggggcactga

SEQ ID NO: 42660 - DNA, 20 bp, synthetic construct
  misc_feature 1..20: note = CRISPR gRNA sequence
  source 1..20: mol_type = other DNA
catgcctgaggggcactgaa

SEQ ID NO: 42661 - DNA, 20 bp, synthetic construct
  misc_feature 1..20: note = CRISPR gRNA sequence
  source 1..20: mol_type = other DNA
atgcctgaggggcactgaag

SEQ ID NO: 42662 - DNA, 20 bp, synthetic construct
  misc_feature 1..20: note = CRISPR gRNA sequence
  source 1..20: mol_type = other DNA
tgcctgaggggcactgaagg

SEQ ID NO: 42663 - DNA, 20 bp, synthetic construct
  misc_feature 1..20: note = CRISPR gRNA sequence
  source 1..20: mol_type = other DNA
aggggcactgaagggggtat

SEQ ID NO: 42664 - DNA, 20 bp, synthetic construct
  misc_feature 1..20: note = CRISPR gRNA sequence
  source 1..20: mol_type = other DNA
ggggcactgaagggggtatg

SEQ ID NO: 42665 - DNA, 20 bp, synthetic construct
  misc_feature 1..20: note = CRISPR gRNA sequence
  source 1..20: mol_type = other DNA
gggcactgaagggggtatga

SEQ ID NO: 42666 - DNA, 20 bp, synthetic construct
  misc_feature 1..20: note = CRISPR gRNA sequence
  source 1..20: mol_type = other DNA
gtgtgcctgcctacacctct

SEQ ID NO: 42667 - DNA, 20 bp, synthetic construct
  misc_feature 1..20: note = CRISPR gRNA sequence
  source 1..20: mol_type = other DNA
tgtgcctgcctacacctctc

SEQ ID NO: 42668 - DNA, 20 bp, synthetic construct
  misc_feature 1..20: note = CRISPR gRNA sequence
  source 1..20: mol_type = other DNA
ctgcctacacctctcaggac

SEQ ID NO: 42669 - DNA, 20 bp, synthetic construct
  misc_feature 1..20: note = CRISPR gRNA sequence
  source 1..20: mol_type = other DNA
cacctctcaggaccagctgt

SEQ ID NO: 42670 - DNA, 20 bp, synthetic construct
  misc_feature 1..20: note = CRISPR gRNA sequence
  source 1..20: mol_type = other DNA
acctctcaggaccagctgtc

SEQ ID NO: 42671 - DNA, 20 bp, synthetic construct
  misc_feature 1..20: note = CRISPR gRNA sequence
  source 1..20: mol_type = other DNA
cctctcaggaccagctgtca

SEQ ID NO: 42672 - DNA, 20 bp, synthetic construct
  misc_feature 1..20: note = CRISPR gRNA sequence
  source 1..20: mol_type = other DNA
gaccagctgtcagggatgcc

SEQ ID NO: 42673 - DNA, 20 bp, synthetic construct
  misc_feature 1..20: note = CRISPR gRNA sequence
  source 1..20: mol_type = other DNA
accagctgtcagggatgcct

SEQ ID NO: 42674 - DNA, 20 bp, synthetic construct
  misc_feature 1..20: note = CRISPR gRNA sequence
  source 1..20: mol_type = other DNA
atgcctgggtcacataccca

SEQ ID NO: 42675 - DNA, 20 bp, synthetic construct
  misc_feature 1..20: note = CRISPR gRNA sequence
  source 1..20: mol_type = other DNA
tcccgcccccactctcgcca

SEQ ID NO: 42676 - DNA, 20 bp, synthetic construct
  misc_feature 1..20: note = CRISPR gRNA sequence
  source 1..20: mol_type = other DNA
cgcccccactctcgccatgg

SEQ ID NO: 42677 - DNA, 20 bp, synthetic construct
  misc_feature 1..20: note = CRISPR gRNA sequence
  source 1..20: mol_type = other DNA
cccccactctcgccatggtg

SEQ ID NO: 42678 - DNA, 20 bp, synthetic construct
  misc_feature 1..20: note = CRISPR gRNA sequence
  source 1..20: mol_type = other DNA
cactctcgccatggtggagc

SEQ ID NO: 42679 - DNA, 20 bp, synthetic construct
  misc_feature 1..20: note = CRISPR gRNA sequence
  source 1..20: mol_type = other DNA
ccatggtggagctagttcca

SEQ ID NO: 42680 - DNA, 20 bp, synthetic construct
  misc_feature 1..20: note = CRISPR gRNA sequence
  source 1..20: mol_type = other DNA
ccatggtgtgccctctgact

SEQ ID NO: 42681 - DNA, 20 bp, synthetic construct
  misc_feature 1..20: note = CRISPR gRNA sequence
  source 1..20: mol_type = other DNA
catggtgtgccctctgactt

SEQ ID NO: 42682 - DNA, 20 bp, synthetic construct
  misc_feature 1..20: note = CRISPR gRNA sequence
  source 1..20: mol_type = other DNA
ggtgtgccctctgacttggg

SEQ ID NO: 42683 - DNA, 20 bp, synthetic construct
  misc_feature 1..20: note = CRISPR gRNA sequence
  source 1..20: mol_type = other DNA
cctctgacttgggcagccct

SEQ ID NO: 42684 - DNA, 20 bp, synthetic construct
  misc_feature 1..20: note = CRISPR gRNA sequence
  source 1..20: mol_type = other DNA
cttgggcagccctcagcctc

SEQ ID NO: 42685 - DNA, 20 bp, synthetic construct
  misc_feature 1..20: note = CRISPR gRNA sequence
  source 1..20: mol_type = other DNA
cctcagcctcaagtatgtgc

SEQ ID NO: 42686 - DNA, 20 bp, synthetic construct
  misc_feature 1..20: note = CRISPR gRNA sequence
  source 1..20: mol_type = other DNA
caagtatgtgcaagctctgc

SEQ ID NO: 42687 - DNA, 20 bp, synthetic construct
  misc_feature 1..20: note = CRISPR gRNA sequence
  source 1..20: mol_type = other DNA
gtatgtgcaagctctgctgg

SEQ ID NO: 42688 - DNA, 20 bp, synthetic construct
  misc_feature 1..20: note = CRISPR gRNA sequence
  source 1..20: mol_type = other DNA
gtgcaagctctgctggcaga

SEQ ID NO: 42689 - DNA, 20 bp, synthetic construct
  misc_feature 1..20: note = CRISPR gRNA sequence
  source 1..20: mol_type = other DNA
tgcaagctctgctggcagat

SEQ ID NO: 42690 - DNA, 20 bp, synthetic construct
  misc_feature 1..20: note = CRISPR gRNA sequence
  source 1..20: mol_type = other DNA
gcaagctctgctggcagatg

SEQ ID NO: 42691 - DNA, 20 bp, synthetic construct
  misc_feature 1..20: note = CRISPR gRNA sequence
  source 1..20: mol_type = other DNA
caagctctgctggcagatgg

SEQ ID NO: 42692 - DNA, 20 bp, synthetic construct
  misc_feature 1..20: note = CRISPR gRNA sequence
  source 1..20: mol_type = other DNA
ggcagatgggggctaaaacg

SEQ ID NO: 42693 - DNA, 20 bp, synthetic construct
  misc_feature 1..20: note = CRISPR gRNA sequence
  source 1..20: mol_type = other DNA
gcagatgggggctaaaacgc

SEQ ID NO: 42694 - DNA, 20 bp, synthetic construct
  misc_feature 1..20: note = CRISPR gRNA sequence
  source 1..20: mol_type = other DNA
taaaacgcaggattcattgt

SEQ ID NO: 42695 - DNA, 20 bp, synthetic construct
  misc_feature 1..20: note = CRISPR gRNA sequence
  source 1..20: mol_type = other DNA
cgcaggattcattgttggcc

SEQ ID NO: 42696 - DNA, 20 bp, synthetic construct
  misc_feature 1..20: note = CRISPR gRNA sequence
  source 1..20: mol_type = other DNA
aggattcattgttggcccag

SEQ ID NO: 42697 - DNA, 20 bp, synthetic construct
  misc_feature 1..20: note = CRISPR gRNA sequence
  source 1..20: mol_type = other DNA
ggattcattgttggcccagc

SEQ ID NO: 42698 - DNA, 20 bp, synthetic construct
  misc_feature 1..20: note = CRISPR gRNA sequence
  source 1..20: mol_type = other DNA
ttcattgttggcccagcagg

SEQ ID NO: 42699 - DNA, 20 bp, synthetic construct
  misc_feature 1..20: note = CRISPR gRNA sequence
  source 1..20: mol_type = other DNA
ttggcccagcaggtggttaa

SEQ ID NO: 42700 - DNA, 20 bp, synthetic construct
  misc_feature 1..20: note = CRISPR gRNA sequence
  source 1..20: mol_type = other DNA
cagcaggtggttaaaagtac

SEQ ID NO: 42701 - DNA, 20 bp, synthetic construct
  misc_feature 1..20: note = CRISPR gRNA sequence
  source 1..20: mol_type = other DNA
agtaccggatgactctgcct

SEQ ID NO: 42702 - DNA, 20 bp, synthetic construct
  misc_feature 1..20: note = CRISPR gRNA sequence
  source 1..20: mol_type = other DNA
gtaccggatgactctgcctg

SEQ ID NO: 42703 - DNA, 20 bp, synthetic construct
  misc_feature 1..20: note = CRISPR gRNA sequence
  source 1..20: mol_type = other DNA
accggatgactctgcctgag

SEQ ID NO: 42704 - DNA, 20 bp, synthetic construct
  misc_feature 1..20: note = CRISPR gRNA sequence
  source 1..20: mol_type = other DNA
ccggatgactctgcctgagg

SEQ ID NO: 42705 - DNA, 20 bp, synthetic construct
  misc_feature 1..20: note = CRISPR gRNA sequence
  source 1..20: mol_type = other DNA
cggatgactctgcctgagga

SEQ ID NO: 42706 - DNA, 20 bp, synthetic construct
  misc_feature 1..20: note = CRISPR gRNA sequence
  source 1..20: mol_type = other DNA
actctgcctgaggagggacg

SEQ ID NO: 42707 - DNA, 20 bp, synthetic construct
  misc_feature 1..20: note = CRISPR gRNA sequence
  source 1..20: mol_type = other DNA
tctgcctgaggagggacgca

SEQ ID NO: 42708 - DNA, 20 bp, synthetic construct
  misc_feature 1..20: note = CRISPR gRNA sequence
  source 1..20: mol_type = other DNA
cctgaggagggacgcagagc

SEQ ID NO: 42709 - DNA, 20 bp, synthetic construct
  misc_feature 1..20: note = CRISPR gRNA sequence
  source 1..20: mol_type = other DNA
aggagggacgcagagccagc

SEQ ID NO: 42710 - DNA, 20 bp, synthetic construct
  misc_feature 1..20: note = CRISPR gRNA sequence
  source 1..20: mol_type = other DNA
ggagggacgcagagccagcc

SEQ ID NO: 42711 - DNA, 20 bp, synthetic construct
  misc_feature 1..20: note = CRISPR gRNA sequence
  source 1..20: mol_type = other DNA
gagggacgcagagccagcca

SEQ ID NO: 42712 - DNA, 20 bp, synthetic construct
  misc_feature 1..20: note = CRISPR gRNA sequence
  source 1..20: mol_type = other DNA
ggacgcagagccagccaggg

SEQ ID NO: 42713 - DNA, 20 bp, synthetic construct
  misc_feature 1..20: note = CRISPR gRNA sequence
  source 1..20: mol_type = other DNA
gacgcagagccagccagggt

SEQ ID NO: 42714 - DNA, 20 bp, synthetic construct
  misc_feature 1..20: note = CRISPR gRNA sequence
  source 1..20: mol_type = other DNA
acgcagagccagccagggtg

SEQ ID NO: 42715 - DNA, 20 bp, synthetic construct
  misc_feature 1..20: note = CRISPR gRNA sequence
  source 1..20: mol_type = other DNA
ccagccagggtggggtcttg

SEQ ID NO: 42716 - DNA, 20 bp, synthetic construct
  misc_feature 1..20: note = CRISPR gRNA sequence
  source 1..20: mol_type = other DNA
ttgcagtctcttgtattgtt

SEQ ID NO: 42717 - DNA, 20 bp, synthetic construct
  misc_feature 1..20: note = CRISPR gRNA sequence
  source 1..20: mol_type = other DNA
tctcttgtattgttgagatg

SEQ ID NO: 42718 - DNA, 20 bp, synthetic construct
  misc_feature 1..20: note = CRISPR gRNA sequence
  source 1..20: mol_type = other DNA
gttgagatgtggtatctgcg

SEQ ID NO: 42719 - DNA, 20 bp, synthetic construct
  misc_feature 1..20: note = CRISPR gRNA sequence
  source 1..20: mol_type = other DNA
ggtatctgcgtggcctgtct

SEQ ID NO: 42720 - DNA, 20 bp, synthetic construct
  misc_feature 1..20: note = CRISPR gRNA sequence
  source 1..20: mol_type = other DNA
gcctgtcttggatattcaaa

SEQ ID NO: 42721 - DNA, 20 bp, synthetic construct
  misc_feature 1..20: note = CRISPR gRNA sequence
  source 1..20: mol_type = other DNA
gtcttggatattcaaatagt

SEQ ID NO: 42722 - DNA, 20 bp, synthetic construct
  misc_feature 1..20: note = CRISPR gRNA sequence
  source 1..20: mol_type = other DNA
tcaaatagtcagcccctgca

SEQ ID NO: 42723 - DNA, 20 bp, synthetic construct
  misc_feature 1..20: note = CRISPR gRNA sequence
  source 1..20: mol_type = other DNA
caaatagtcagcccctgcat

SEQ ID NO: 42724 - DNA, 20 bp, synthetic construct
  misc_feature 1..20: note = CRISPR gRNA sequence
  source 1..20: mol_type = other DNA
atagtcagcccctgcatggg

SEQ ID NO: 42725 - DNA, 20 bp, synthetic construct
  misc_feature 1..20: note = CRISPR gRNA sequence
  source 1..20: mol_type = other DNA
ctgcatgggtggaataataa

SEQ ID NO: 42726 - DNA, 20 bp, synthetic construct
  misc_feature 1..20: note = CRISPR gRNA sequence
  source 1..20: mol_type = other DNA
ggtggaataataatagctaa

SEQ ID NO: 42727 - DNA, 20 bp, synthetic construct
  misc_feature 1..20: note = CRISPR gRNA sequence
  source 1..20: mol_type = other DNA
aataatagctaacagctact

SEQ ID NO: 42728 - DNA, 20 bp, synthetic construct
  misc_feature 1..20: note = CRISPR gRNA sequence
  source 1..20: mol_type = other DNA
agcactttctccactgttct

SEQ ID NO: 42729 - DNA, 20 bp, synthetic construct
  misc_feature 1..20: note = CRISPR gRNA sequence
  source 1..20: mol_type = other DNA
ttttatgtttcccatatccc

SEQ ID NO: 42730 - DNA, 20 bp, synthetic construct
  misc_feature 1..20: note = CRISPR gRNA sequence
  source 1..20: mol_type = other DNA
tttcccatatccctggatac

SEQ ID NO: 42731 - DNA, 20 bp, synthetic construct
  misc_feature 1..20: note = CRISPR gRNA sequence
  source 1..20: mol_type = other DNA
ctagtattgttctcatttta

SEQ ID NO: 42732 - DNA, 20 bp, synthetic construct
  misc_feature 1..20: note = CRISPR gRNA sequence
  source 1..20: mol_type = other DNA
attgttctcattttacagat

SEQ ID NO: 42733 - DNA, 20 bp, synthetic construct
  misc_feature 1..20: note = CRISPR gRNA sequence
  source 1..20: mol_type = other DNA
ttgttctcattttacagatg

SEQ ID NO: 42734 - DNA, 20 bp, synthetic construct
  misc_feature 1..20: note = CRISPR gRNA sequence
  source 1..20: mol_type = other DNA
tgttctcattttacagatga

SEQ ID NO: 42735 - DNA, 20 bp, synthetic construct
  misc_feature 1..20: note = CRISPR gRNA sequence
  source 1..20: mol_type = other DNA
attttacagatgagggaact

SEQ ID NO: 42736 - DNA, 20 bp, synthetic construct
  misc_feature 1..20: note = CRISPR gRNA sequence
  source 1..20: mol_type = other DNA
cagatgagggaactgagaca

SEQ ID NO: 42737 - DNA, 20 bp, synthetic construct
  misc_feature 1..20: note = CRISPR gRNA sequence
  source 1..20: mol_type = other DNA
gatgagggaactgagacaca

SEQ ID NO: 42738 - DNA, 20 bp, synthetic construct
  misc_feature 1..20: note = CRISPR gRNA sequence
  source 1..20: mol_type = other DNA
atgagggaactgagacacag

SEQ ID NO: 42739 - DNA, 20 bp, synthetic construct
  misc_feature 1..20: note = CRISPR gRNA sequence
  source 1..20: mol_type = other DNA
tgagggaactgagacacaga

SEQ ID NO: 42740 - DNA, 20 bp, synthetic construct
  misc_feature 1..20: note = CRISPR gRNA sequence
  source 1..20: mol_type = other DNA
aactgagacacagagggtgt

SEQ ID NO: 42741 - DNA, 20 bp, synthetic construct
  misc_feature 1..20: note = CRISPR gRNA sequence
  source 1..20: mol_type = other DNA
gagggtgtaagaacttgccc

SEQ ID NO: 42742 - DNA, 20 bp, synthetic construct
  misc_feature 1..20: note = CRISPR gRNA sequence
  source 1..20: mol_type = other DNA
agggtgtaagaacttgccca

SEQ ID NO: 42743 - DNA, 20 bp, synthetic construct
  misc_feature 1..20: note = CRISPR gRNA sequence
  source 1..20: mol_type = other DNA
agaacttgcccaaggtcaca

SEQ ID NO: 42744 - DNA, 20 bp, synthetic construct
  misc_feature 1..20: note = CRISPR gRNA sequence
  source 1..20: mol_type = other DNA
cttgcccaaggtcacacagc

SEQ ID NO: 42745 - DNA, 20 bp, synthetic construct
  misc_feature 1..20: note = CRISPR gRNA sequence
  source 1..20: mol_type = other DNA
gtcacacagctagtaaaatg

SEQ ID NO: 42746 - DNA, 20 bp, synthetic construct
  misc_feature 1..20: note = CRISPR gRNA sequence
  source 1..20: mol_type = other DNA
cacacagctagtaaaatgca

SEQ ID NO: 42747 - DNA, 20 bp, synthetic construct
  misc_feature 1..20: note = CRISPR gRNA sequence
  source 1..20: mol_type = other DNA
taaaatgcagagtccctgct

SEQ ID NO: 42748 - DNA, 20 bp, synthetic construct
  misc_feature 1..20: note = CRISPR gRNA sequence
  source 1..20: mol_type = other DNA
gagtccctgctcagacgcat

SEQ ID NO: 42749 - DNA, 20 bp, synthetic construct
  misc_feature 1..20: note = CRISPR gRNA sequence
  source 1..20: mol_type = other DNA
agtccctgctcagacgcatt

SEQ ID NO: 42750 - DNA, 20 bp, synthetic construct
  misc_feature 1..20: note = CRISPR gRNA sequence
  source 1..20: mol_type = other DNA
gctcagacgcattgggaatc

SEQ ID NO: 42751 - DNA, 20 bp, synthetic construct
  misc_feature 1..20: note = CRISPR gRNA sequence
  source 1..20: mol_type = other DNA
gacgcattgggaatccagcc

SEQ ID NO: 42752 - DNA, 20 bp, synthetic construct
  misc_feature 1..20: note = CRISPR gRNA sequence
  source 1..20: mol_type = other DNA
acgcattgggaatccagcct

SEQ ID NO: 42753 - DNA, 20 bp, synthetic construct
  misc_feature 1..20: note = CRISPR gRNA sequence
  source 1..20: mol_type = other DNA
ttgggaatccagcctaggac

SEQ ID NO: 42754 - DNA, 20 bp, synthetic construct
  misc_feature 1..20: note = CRISPR gRNA sequence
  source 1..20: mol_type = other DNA
ggaatccagcctaggaccag

SEQ ID NO: 42755 - DNA, 20 bp, synthetic construct
  misc_feature 1..20: note = CRISPR gRNA sequence
  source 1..20: mol_type = other DNA
gaatccagcctaggaccagt

SEQ ID NO: 42756 - DNA, 20 bp, synthetic construct
  misc_feature 1..20: note = CRISPR gRNA sequence
  source 1..20: mol_type = other DNA
agcctaggaccagtgggaaa

SEQ ID NO: 42757 - DNA, 20 bp, synthetic construct
  misc_feature 1..20: note = CRISPR gRNA sequence
  source 1..20: mol_type = other DNA
cctaggaccagtgggaaata

SEQ ID NO: 42758 - DNA, 20 bp, synthetic construct
  misc_feature 1..20: note = CRISPR gRNA sequence
  source 1..20: mol_type = other DNA
taggaccagtgggaaataga

SEQ ID NO: 42759 - DNA, 20 bp, synthetic construct
  misc_feature 1..20: note = CRISPR gRNA sequence
  source 1..20: mol_type = other DNA
ggaccagtgggaaatagaga

SEQ ID NO: 42760 - DNA, 20 bp, synthetic construct
  misc_feature 1..20: note = CRISPR gRNA sequence
  source 1..20: mol_type = other DNA
ccagtgggaaatagagagag

SEQ ID NO: 42761 - DNA, 20 bp, synthetic construct
  misc_feature 1..20: note = CRISPR gRNA sequence
  source 1..20: mol_type = other DNA
ttttcatttctgttgtgatg

SEQ ID NO: 42762 - DNA, 20 bp, synthetic construct
  misc_feature 1..20: note = CRISPR gRNA sequence
  source 1..20: mol_type = other DNA
tcatttctgttgtgatgtgg

SEQ ID NO: 42763 - DNA, 20 bp, synthetic construct
  misc_feature 1..20: note = CRISPR gRNA sequence
  source 1..20: mol_type = other DNA
atttctgttgtgatgtggca

SEQ ID NO: 42764 - DNA, 20 bp, synthetic construct
  misc_feature 1..20: note = CRISPR gRNA sequence
  source 1..20: mol_type = other DNA
tctgttgtgatgtggcagag

SEQ ID NO: 42765 - DNA, 20 bp, synthetic construct
  misc_feature 1..20: note = CRISPR gRNA sequence
  source 1..20: mol_type = other DNA
aaatgtgactgataaaatca

SEQ ID NO: 42766 - DNA, 20 bp, synthetic construct
  misc_feature 1..20: note = CRISPR gRNA sequence
  source 1..20: mol_type = other DNA
catggatttctttttttttt

SEQ ID NO: 42767 - DNA, 20 bp, synthetic construct
  misc_feature 1..20: note = CRISPR gRNA sequence
  source 1..20: mol_type = other DNA
tttcttttttttttaagacc

SEQ ID NO: 42768 - DNA, 20 bp, synthetic construct
  misc_feature 1..20: note = CRISPR gRNA sequence
  source 1..20: mol_type = other DNA
ttcttttttttttaagacct

SEQ ID NO: 42769 - DNA, 20 bp, synthetic construct
  misc_feature 1..20: note = CRISPR gRNA sequence
  source 1..20: mol_type = other DNA
tcttttttttttaagacctg

SEQ ID NO: 42770 - DNA, 20 bp, synthetic construct
  misc_feature 1..20: note = CRISPR gRNA sequence
  source 1..20: mol_type = other DNA
tggggtctcactctgttgcc

SEQ ID NO: 42771 - DNA, 20 bp, synthetic construct
  misc_feature 1..20: note = CRISPR gRNA sequence
  source 1..20: mol_type = other DNA
ggggtctcactctgttgccc

SEQ ID NO: 42772 - DNA, 20 bp, synthetic construct
  misc_feature 1..20: note = CRISPR gRNA sequence
  source 1..20: mol_type = other DNA
tctcactctgttgcccaggc

SEQ ID NO: 42773 - DNA, 20 bp, synthetic construct
  misc_feature 1..20: note = CRISPR gRNA sequence
  source 1..20: mol_type = other DNA
tcactctgttgcccaggctg

SEQ ID NO: 42774 - DNA, 20 bp, synthetic construct
  misc_feature 1..20: note = CRISPR gRNA sequence
  source 1..20: mol_type = other DNA
ctgttgcccaggctggagtg

SEQ ID NO: 42775 - DNA, 20 bp, synthetic construct
  misc_feature 1..20: note = CRISPR gRNA sequence
  source 1..20: mol_type = other DNA
ttgcccaggctggagtgcag

SEQ ID NO: 42776 - DNA, 20 bp, synthetic construct
  misc_feature 1..20: note = CRISPR gRNA sequence
  source 1..20: mol_type = other DNA
ggagtgcagtggtgcaatga

SEQ ID NO: 42777 - DNA, 20 bp, synthetic construct
  misc_feature 1..20: note = CRISPR gRNA sequence
  source 1..20: mol_type = other DNA
gagtgcagtggtgcaatgat

SEQ ID NO: 42778 - DNA, 20 bp, synthetic construct
  misc_feature 1..20: note = CRISPR gRNA sequence
  source 1..20: mol_type = other DNA
ggtgcaatgataggtcactg

SEQ ID NO: 42779 - DNA, 20 bp, synthetic construct
  misc_feature 1..20: note = CRISPR gRNA sequence
  source 1..20: mol_type = other DNA
tcactgcagcctccaactcc

SEQ ID NO: 42780 - DNA, 20 bp, synthetic construct
  misc_feature 1..20: note = CRISPR gRNA sequence
  source 1..20: mol_type = other DNA
cactgcagcctccaactcct

SEQ ID NO: 42781 - DNA, 20 bp, synthetic construct
  misc_feature 1..20: note = CRISPR gRNA sequence
  source 1..20: mol_type = other DNA
agcctccaactcctgggctc

SEQ ID NO: 42782 - DNA, 20 bp, synthetic construct
  misc_feature 1..20: note = CRISPR gRNA sequence
  source 1..20: mol_type = other DNA
ctcaagcgatcctcccacct

SEQ ID NO: 42783 - DNA, 20 bp, synthetic construct
  misc_feature 1..20: note = CRISPR gRNA sequence
  source 1..20: mol_type = other DNA
gatcctcccacctcagcctc

SEQ ID NO: 42784 - DNA, 20 bp, synthetic construct
  misc_feature 1..20: note = CRISPR gRNA sequence
  source 1..20: mol_type = other DNA
tcctcccacctcagcctctg

SEQ ID NO: 42785 - DNA, 20 bp, synthetic construct
  misc_feature 1..20: note = CRISPR gRNA sequence
  source 1..20: mol_type = other DNA
tcccacctcagcctctggag

SEQ ID NO: 42786 - DNA, 20 bp, synthetic construct
  misc_feature 1..20: note = CRISPR gRNA sequence
  source 1..20: mol_type = other DNA
acctcagcctctggagtagc

SEQ ID NO: 42787 - DNA, 20 bp, synthetic construct
  misc_feature 1..20: note = CRISPR gRNA sequence
  source 1..20: mol_type = other DNA
cctcagcctctggagtagct

SEQ ID NO: 42788 - DNA, 20 bp, synthetic construct
  misc_feature 1..20: note = CRISPR gRNA sequence
  source 1..20: mol_type = other DNA
ctctggagtagctgggacta

SEQ ID NO: 42789 - DNA, 20 bp, synthetic construct
  misc_feature 1..20: note = CRISPR gRNA sequence
  source 1..20: mol_type = other DNA
tctggagtagctgggactac

SEQ ID NO: 42790 - DNA, 20 bp, synthetic construct
  misc_feature 1..20: note = CRISPR gRNA sequence
  source 1..20: mol_type = other DNA
caggcacacaccaacatgcc

SEQ ID NO: 42791 - DNA, 20 bp, synthetic construct
  misc_feature 1..20: note = CRISPR gRNA sequence
  source 1..20: mol_type = other DNA
acaccaacatgcctggctaa

SEQ ID NO: 42792 - DNA, 20 bp, synthetic construct
  misc_feature 1..20: note = CRISPR gRNA sequence
  source 1..20: mol_type = other DNA
aacatgcctggctaatagtt

SEQ ID NO: 42793 - DNA, 20 bp, synthetic construct
  misc_feature 1..20: note = CRISPR gRNA sequence
  source 1..20: mol_type = other DNA
ggctaatagtttagttttgt

SEQ ID NO: 42794 - DNA, 20 bp, synthetic construct
  misc_feature 1..20: note = CRISPR gRNA sequence
  source 1..20: mol_type = other DNA
ctaatagtttagttttgtaa

SEQ ID NO: 42795 - DNA, 20 bp, synthetic construct
  misc_feature 1..20: note = CRISPR gRNA sequence
  source 1..20: mol_type = other DNA
gtttagttttgtaagagatg

SEQ ID NO: 42796 - DNA, 20 bp, synthetic construct
  misc_feature 1..20: note = CRISPR gRNA sequence
  source 1..20: mol_type = other DNA
tgaagtctcaccatgttccc

SEQ ID NO: 42797 - DNA, 20 bp, synthetic construct
  misc_feature 1..20: note = CRISPR gRNA sequence
  source 1..20: mol_type = other DNA
gaagtctcaccatgttcccc

SEQ ID NO: 42798 - DNA, 20 bp, synthetic construct
  misc_feature 1..20: note = CRISPR gRNA sequence
  source 1..20: mol_type = other DNA
tctcaccatgttccccaggt

SEQ ID NO: 42799 - DNA, 20 bp, synthetic construct
  misc_feature 1..20: note = CRISPR gRNA sequence
  source 1..20: mol_type = other DNA
caggttggtctcaaacttct

SEQ ID NO: 42800 - DNA, 20 bp, synthetic construct
  misc_feature 1..20: note = CRISPR gRNA sequence
  source 1..20: mol_type = other DNA
tggtctcaaacttctgagct

SEQ ID NO: 42801 - DNA, 20 bp, synthetic construct
  misc_feature 1..20: note = CRISPR gRNA sequence
  source 1..20: mol_type = other DNA
ggtctcaaacttctgagctc

SEQ ID NO: 42802 - DNA, 20 bp, synthetic construct
  misc_feature 1..20: note = CRISPR gRNA sequence
  source 1..20: mol_type = other DNA
ttctgagctcaggtgatcct

SEQ ID NO: 42803 - DNA, 20 bp, synthetic construct
  misc_feature 1..20: note = CRISPR gRNA sequence
  source 1..20: mol_type = other DNA
tcaggtgatcctcagcctcc

SEQ ID NO: 42804 - DNA, 20 bp, synthetic construct
  misc_feature 1..20: note = CRISPR gRNA sequence
  source 1..20: mol_type = other DNA
caggtgatcctcagcctccc

SEQ ID NO: 42805 - DNA, 20 bp, synthetic construct
  misc_feature 1..20: note = CRISPR gRNA sequence
  source 1..20: mol_type = other DNA
cctcagcctcccaggttgct

SEQ ID NO: 42806 - DNA, 20 bp, synthetic construct
  misc_feature 1..20: note = CRISPR gRNA sequence
  source 1..20: mol_type = other DNA
ctcccaggttgctgagatta

SEQ ID NO: 42807 - DNA, 20 bp, synthetic construct
  misc_feature 1..20: note = CRISPR gRNA sequence
  source 1..20: mol_type = other DNA
tcccaggttgctgagattac

SEQ ID NO: 42808 - DNA, 20 bp, synthetic construct
  misc_feature 1..20: note = CRISPR gRNA sequence
  source 1..20: mol_type = other DNA
gttgctgagattacaggcat

SEQ ID NO: 42809 - DNA, 20 bp, synthetic construct
  misc_feature 1..20: note = CRISPR gRNA sequence
  source 1..20: mol_type = other DNA
caggcatgagccgctgtgct

SEQ ID NO: 42810 - DNA, 20 bp, synthetic construct
  misc_feature 1..20: note = CRISPR gRNA sequence
  source 1..20: mol_type = other DNA
tgcttggaatgtattttaaa

SEQ ID NO: 42811 - DNA, 20 bp, synthetic construct
  misc_feature 1..20: note = CRISPR gRNA sequence
  source 1..20: mol_type = other DNA
tattttaaacagatatgaat

SEQ ID NO: 42812 - DNA, 20 bp, synthetic construct
  misc_feature 1..20: note = CRISPR gRNA sequence
  source 1..20: mol_type = other DNA
tgaataagaaatatgtcttt

SEQ ID NO: 42813 - DNA, 20 bp, synthetic construct
  misc_feature 1..20: note = CRISPR gRNA sequence
  source 1..20: mol_type = other DNA
gagttttttgtttttcatta

SEQ ID NO: 42814 - DNA, 20 bp, synthetic construct
  misc_feature 1..20: note = CRISPR gRNA sequence
  source 1..20: mol_type = other DNA
gttttttgtttttcattata

SEQ ID NO: 42815 - DNA, 20 bp, synthetic construct
  misc_feature 1..20: note = CRISPR gRNA sequence
  source 1..20: mol_type = other DNA
ttttttgtttttcattatag

SEQ ID NO: 42816 - DNA, 20 bp, synthetic construct
  misc_feature 1..20: note = CRISPR gRNA sequence
  source 1..20: mol_type = other DNA
tttttgtttttcattataga

SEQ ID NO: 42817 - DNA, 20 bp, synthetic construct
  misc_feature 1..20: note = CRISPR gRNA sequence
  source 1..20: mol_type = other DNA
tttctttctttctttttttt

SEQ ID NO: 42818 - DNA, 20 bp, synthetic construct
  misc_feature 1..20: note = CRISPR gRNA sequence
  source 1..20: mol_type = other DNA
tttctttctttttttttaga

SEQ ID NO: 42819 - DNA, 20 bp, synthetic construct
  misc_feature 1..20: note = CRISPR gRNA sequence
  source 1..20: mol_type = other DNA
tctttctttttttttagatg

SEQ ID NO: 42820 - DNA, 20 bp, synthetic construct
  misc_feature 1..20: note = CRISPR gRNA sequence
  source 1..20: mol_type = other DNA
tggagtctttctctgctgcc

SEQ ID NO: 42821 - DNA, 20 bp, synthetic construct
  misc_feature 1..20: note = CRISPR gRNA sequence
  source 1..20: mol_type = other DNA
ggagtctttctctgctgccc

SEQ ID NO: 42822 - DNA, 20 bp, synthetic construct
  misc_feature 1..20: note = CRISPR gRNA sequence
  source 1..20: mol_type = other DNA
tctttctctgctgcccaggc

SEQ ID NO: 42823 - DNA, 20 bp, synthetic construct
  misc_feature 1..20: note = CRISPR gRNA sequence
  source 1..20: mol_type = other DNA
ctgctgcccaggctggaatg

SEQ ID NO: 42824 - DNA, 20 bp, synthetic construct
  misc_feature 1..20: note = CRISPR gRNA sequence
  source 1..20: mol_type = other DNA
ctgcccaggctggaatgcag

SEQ ID NO: 42825 - DNA, 20 bp, synthetic construct
  misc_feature 1..20: note = CRISPR gRNA sequence
  source 1..20: mol_type = other DNA
ggaatgcagtggcgcaattt

SEQ ID NO: 42826 - DNA, 20 bp, synthetic construct
  misc_feature 1..20: note = CRISPR gRNA sequence
  source 1..20: mol_type = other DNA
tcactgcaacttccgcctcc

SEQ ID NO: 42827 - DNA, 20 bp, synthetic construct
  misc_feature 1..20: note = CRISPR gRNA sequence
  source 1..20: mol_type = other DNA
cactgcaacttccgcctccc

SEQ ID NO: 42828 - DNA, 20 bp, synthetic construct
  misc_feature 1..20: note = CRISPR gRNA sequence
  source 1..20: mol_type = other DNA
aacttccgcctcccaggttc

SEQ ID NO: 42829 - DNA, 20 bp, synthetic construct
  misc_feature 1..20: note = CRISPR gRNA sequence
  source 1..20: mol_type = other DNA
ttcaagcaattctcctgcct

SEQ ID NO: 42830 - DNA, 20 bp, synthetic construct
  misc_feature 1..20: note = CRISPR gRNA sequence
  source 1..20: mol_type = other DNA
ttctcctgcctcagcctccc

SEQ ID NO: 42831 - DNA, 20 bp, synthetic construct
  misc_feature 1..20: note = CRISPR gRNA sequence
  source 1..20: mol_type = other DNA
tctcctgcctcagcctccca

SEQ ID NO: 42832 - DNA, 20 bp, synthetic construct
  misc_feature 1..20: note = CRISPR gRNA sequence
  source 1..20: mol_type = other DNA
tcctgcctcagcctcccaag

SEQ ID NO: 42833 - DNA, 20 bp, synthetic construct
  misc_feature 1..20: note = CRISPR gRNA sequence
  source 1..20: mol_type = other DNA
cctcagcctcccaaggagct

SEQ ID NO: 42834 - DNA, 20 bp, synthetic construct
  misc_feature 1..20: note = CRISPR gRNA sequence
  source 1..20: mol_type = other DNA
ctcccaaggagctgagatta

SEQ ID NO: 42835 - DNA, 20 bp, synthetic construct
  misc_feature 1..20: note = CRISPR gRNA sequence
  source 1..20: mol_type = other DNA
tcccaaggagctgagattac

SEQ ID NO: 42836 - DNA, 20 bp, synthetic construct
  misc_feature 1..20: note = CRISPR gRNA sequence
  source 1..20: mol_type = other DNA
ggagctgagattacaggcat

SEQ ID NO: 42837 - DNA, 20 bp, synthetic construct
  misc_feature 1..20: note = CRISPR gRNA sequence
  source 1..20: mol_type = other DNA
caggcatgagccaccatgcc

SEQ ID NO: 42838 - DNA, 20 bp, synthetic construct
  misc_feature 1..20: note = CRISPR gRNA sequence
  source 1..20: mol_type = other DNA
ccaccatgcctggctaattt

SEQ ID NO: 42839 - DNA, 20 bp, synthetic construct
  misc_feature 1..20: note = CRISPR gRNA sequence
  source 1..20: mol_type = other DNA
ctggctaattttggtatttt

SEQ ID NO: 42840 - DNA, 20 bp, synthetic construct
  misc_feature 1..20: note = CRISPR gRNA sequence
  source 1..20: mol_type = other DNA
gctaattttggtatttttag

SEQ ID NO: 42841 - DNA, 20 bp, synthetic construct
  misc_feature 1..20: note = CRISPR gRNA sequence
  source 1..20: mol_type = other DNA
taattttggtatttttagta

SEQ ID NO: 42842 - DNA, 20 bp, synthetic construct
  misc_feature 1..20: note = CRISPR gRNA sequence
  source 1..20: mol_type = other DNA
tttggtatttttagtagaga

SEQ ID NO: 42843 - DNA, 20 bp, synthetic construct
  misc_feature 1..20: note = CRISPR gRNA sequence
  source 1..20: mol_type = other DNA
ttggtatttttagtagagac

SEQ ID NO: 42844 - DNA, 20 bp, synthetic construct
  misc_feature 1..20: note = CRISPR gRNA sequence
  source 1..20: mol_type = other DNA
tggtatttttagtagagacg

SEQ ID NO: 42845 - DNA, 20 bp, synthetic construct
  misc_feature 1..20: note = CRISPR gRNA sequence
  source 1..20: mol_type = other DNA
gagacggggtttcaccatgt

SEQ ID NO: 42846 - DNA, 20 bp, synthetic construct
  misc_feature 1..20: note = CRISPR gRNA sequence
  source 1..20: mol_type = other DNA
cggggtttcaccatgttggc

SEQ ID NO: 42847 - DNA, 20 bp, synthetic construct
  misc_feature 1..20: note = CRISPR gRNA sequence
  source 1..20: mol_type = other DNA
ggggtttcaccatgttggcc

SEQ ID NO: 42848 - DNA, 20 bp, synthetic construct
  misc_feature 1..20: note = CRISPR gRNA sequence
  source 1..20: mol_type = other DNA
tttcaccatgttggccaggc

SEQ ID NO: 42849 - DNA, 20 bp, synthetic construct
  misc_feature 1..20: note = CRISPR gRNA sequence
  source 1..20: mol_type = other DNA
tggtcttgaactcctgacct

SEQ ID NO: 42850 - DNA, 20 bp, synthetic construct
  misc_feature 1..20: note = CRISPR gRNA sequence
  source 1..20: mol_type = other DNA
ggtcttgaactcctgacctc

SEQ ID NO: 42851 - DNA, 20 bp, synthetic construct
  misc_feature 1..20: note = CRISPR gRNA sequence
  source 1..20: mol_type = other DNA
ccgcctgcctcgccctccca

SEQ ID NO: 42852 - DNA, 20 bp, synthetic construct
  misc_feature 1..20: note = CRISPR gRNA sequence
  source 1..20: mol_type = other DNA
gcctcgccctcccaaagtgc

SEQ ID NO: 42853 - DNA, 20 bp, synthetic construct
  misc_feature 1..20: note = CRISPR gRNA sequence
  source 1..20: mol_type = other DNA
cctcgccctcccaaagtgct

SEQ ID NO: 42854 - DNA, 20 bp, synthetic construct
  misc_feature 1..20: note = CRISPR gRNA sequence
  source 1..20: mol_type = other DNA
ctcccaaagtgctgggatta

SEQ ID NO: 42855 - DNA, 20 bp, synthetic construct
  misc_feature 1..20: note = CRISPR gRNA sequence
  source 1..20: mol_type = other DNA
agtgctgggattacagcctt

SEQ ID NO: 42856 - DNA, 20 bp, synthetic construct
  misc_feature 1..20: note = CRISPR gRNA sequence
  source 1..20: mol_type = other DNA
cagccttgagccaccgcacc

SEQ ID NO: 42857 - DNA, 20 bp, synthetic construct
  misc_feature 1..20: note = CRISPR gRNA sequence
  source 1..20: mol_type = other DNA
agccaatttttcttatttta

SEQ ID NO: 42858 - DNA, 20 bp, synthetic construct
  misc_feature 1..20: note = CRISPR gRNA sequence
  source 1..20: mol_type = other DNA
attttaaagactattttatt

SEQ ID NO: 42859 - DNA, 20 bp, synthetic construct
  misc_feature 1..20: note = CRISPR gRNA sequence
  source 1..20: mol_type = other DNA
ttaaagactattttattaag

SEQ ID NO: 42860 - DNA, 20 bp, synthetic construct
  misc_feature 1..20: note = CRISPR gRNA sequence
  source 1..20: mol_type = other DNA
attttattaagtggcttcat

SEQ ID NO: 42861 - DNA, 20 bp, synthetic construct
  misc_feature 1..20: note = CRISPR gRNA sequence
  source 1..20: mol_type = other DNA
tattaagtggcttcataaga

SEQ ID NO: 42862 - DNA, 20 bp, synthetic construct
  misc_feature 1..20: note = CRISPR gRNA sequence
  source 1..20: mol_type = other DNA
aatttttaaatgacgtttct

SEQ ID NO: 42863 - DNA, 20 bp, synthetic construct
  misc_feature 1..20: note = CRISPR gRNA sequence
  source 1..20: mol_type = other DNA
atttttaaatgacgtttctc

SEQ ID NO: 42864 - DNA, 20 bp, synthetic construct
  misc_feature 1..20: note = CRISPR gRNA sequence
  source 1..20: mol_type = other DNA
taaatgacgtttctcaggaa

SEQ ID NO: 42865 - DNA, 20 bp, synthetic construct
  misc_feature 1..20: note = CRISPR gRNA sequence
  source 1..20: mol_type = other DNA
aacaaacatcaaaaatgtca

SEQ ID NO: 42866 - DNA, 20 bp, synthetic construct
  misc_feature 1..20: note = CRISPR gRNA sequence
  source 1..20: mol_type = other DNA
catcaaaaatgtcacagacc

SEQ ID NO: 42867 - DNA, 20 bp, synthetic construct
  misc_feature 1..20: note = CRISPR gRNA sequence
  source 1..20: mol_type = other DNA
atcaaaaatgtcacagacct

SEQ ID NO: 42868 - DNA, 20 bp, synthetic construct
  misc_feature 1..20: note = CRISPR gRNA sequence
  source 1..20: mol_type = other DNA
caaaaatgtcacagacctag

SEQ ID NO: 42869 - DNA, 20 bp, synthetic construct
  misc_feature 1..20: note = CRISPR gRNA sequence
  source 1..20: mol_type = other DNA
aaaaatgtcacagacctagg

SEQ ID NO: 42870 - DNA, 20 bp, synthetic construct
  misc_feature 1..20: note = CRISPR gRNA sequence
  source 1..20: mol_type = other DNA
cacagacctaggaggaaaat

SEQ ID NO: 42871 - DNA, 20 bp, synthetic construct
  misc_feature 1..20: note = CRISPR gRNA sequence
  source 1..20: mol_type = other DNA
aggaggaaaatcagatgttc

SEQ ID NO: 42872 - DNA, 20 bp, synthetic construct
  misc_feature 1..20: note = CRISPR gRNA sequence
  source 1..20: mol_type = other DNA
ggaggaaaatcagatgttcc

SEQ ID NO: 42873 - DNA, 20 bp, synthetic construct
  misc_feature 1..20: note = CRISPR gRNA sequence
  source 1..20: mol_type = other DNA
tcagatgttccgggacacac

SEQ ID NO: 42874 - DNA, 20 bp, synthetic construct
  misc_feature 1..20: note = CRISPR gRNA sequence
  source 1..20: mol_type = other DNA
ttatattatttctgaaactg

SEQ ID NO: 42875 - DNA, 20 bp, synthetic construct
  misc_feature 1..20: note = CRISPR gRNA sequence
  source 1..20: mol_type = other DNA
tctgaaactgtagttaaaac

SEQ ID NO: 42876 - DNA, 20 bp, synthetic construct
  misc_feature 1..20: note = CRISPR gRNA sequence
  source 1..20: mol_type = other DNA
aaactgtagttaaaactagc

SEQ ID NO: 42877 - DNA, 20 bp, synthetic construct
  misc_feature 1..20: note = CRISPR gRNA sequence
  source 1..20: mol_type = other DNA
aactgtagttaaaactagct

SEQ ID NO: 42878 - DNA, 20 bp, synthetic construct
  misc_feature 1..20: note = CRISPR gRNA sequence
  source 1..20: mol_type = other DNA
tagttaaaactagctgggcg

SEQ ID NO: 42879 - DNA, 20 bp, synthetic construct
  misc_feature 1..20: note = CRISPR gRNA sequence
  source 1..20: mol_type = other DNA
ttaaaactagctgggcgtgg

SEQ ID NO: 42880 - DNA, 20 bp, synthetic construct
  misc_feature 1..20: note = CRISPR gRNA sequence
  source 1..20: mol_type = other DNA
gtggctcacgcctgtaatcc

SEQ ID NO: 42881 - DNA, 20 bp, synthetic construct
  misc_feature 1..20: note = CRISPR gRNA sequence
  source 1..20: mol_type = other DNA
cgcctgtaatcccagcactt

SEQ ID NO: 42882 - DNA, 20 bp, synthetic construct
  misc_feature 1..20: note = CRISPR gRNA sequence
  source 1..20: mol_type = other DNA
gcctgtaatcccagcacttt

SEQ ID NO: 42883 - DNA, 20 bp, synthetic construct
  misc_feature 1..20: note = CRISPR gRNA sequence
  source 1..20: mol_type = other DNA
ctgtaatcccagcactttgg

SEQ ID NO: 42884 - DNA, 20 bp, synthetic construct
  misc_feature 1..20: note = CRISPR gRNA sequence
  source 1..20: mol_type = other DNA
tgtaatcccagcactttggg

SEQ ID NO: 42885 - DNA, 20 bp, synthetic construct
  misc_feature 1..20: note = CRISPR gRNA sequence
  source 1..20: mol_type = other DNA
cccagcactttgggaggcca

SEQ ID NO: 42886 - DNA, 20 bp, synthetic construct
  misc_feature 1..20: note = CRISPR gRNA sequence
  source 1..20: mol_type = other DNA
agcactttgggaggccaaag

SEQ ID NO: 42887 - DNA, 20 bp, synthetic construct
  misc_feature 1..20: note = CRISPR gRNA sequence
  source 1..20: mol_type = other DNA
gcactttgggaggccaaagc

SEQ ID NO: 42888 - DNA, 20 bp, synthetic construct
  misc_feature 1..20: note = CRISPR gRNA sequence
  source 1..20: mol_type = other DNA
ctttgggaggccaaagcggg

SEQ ID NO: 42889 - DNA, 20 bp, synthetic construct
  misc_feature 1..20: note = CRISPR gRNA sequence
  source 1..20: mol_type = other DNA
ccaaagcgggtggatcacct

SEQ ID NO: 42890 - DNA, 20 bp, synthetic construct
  misc_feature 1..20: note = CRISPR gRNA sequence
  source 1..20: mol_type = other DNA
caaagcgggtggatcacctg

SEQ ID NO: 42891 - DNA, 20 bp, synthetic construct
  misc_feature 1..20: note = CRISPR gRNA sequence
  source 1..20: mol_type = other DNA
gcgggtggatcacctgaggt

SEQ ID NO: 42892 - DNA, 20 bp, synthetic construct
  misc_feature 1..20: note = CRISPR gRNA sequence
  source 1..20: mol_type = other DNA
cgggtggatcacctgaggtc

SEQ ID NO: 42893 - DNA, 20 bp, synthetic construct
  misc_feature 1..20: note = CRISPR gRNA sequence
  source 1..20: mol_type = other DNA
ggtggatcacctgaggtcag

SEQ ID NO: 42894 - DNA, 20 bp, synthetic construct
  misc_feature 1..20: note = CRISPR gRNA sequence
  source 1..20: mol_type = other DNA
tcacctgaggtcaggagttt

SEQ ID NO: 42895 - DNA, 20 bp, synthetic construct
  misc_feature 1..20: note = CRISPR gRNA sequence
  source 1..20: mol_type = other DNA
tgaggtcaggagtttgagac

SEQ ID NO: 42896 - DNA, 20 bp, synthetic construct
  misc_feature 1..20: note = CRISPR gRNA sequence
  source 1..20: mol_type = other DNA
tgagaccagcctgatcaaca

SEQ ID NO: 42897 - DNA, 20 bp, synthetic construct
  misc_feature 1..20: note = CRISPR gRNA sequence
  source 1..20: mol_type = other DNA
actaaaaatacaaaaataat

SEQ ID NO: 42898 - DNA, 20 bp, synthetic construct
  misc_feature 1..20: note = CRISPR gRNA sequence
  source 1..20: mol_type = other DNA
aaaatacaaaaataattagc

SEQ ID NO: 42899 - DNA, 20 bp, synthetic construct
  misc_feature 1..20: note = CRISPR gRNA sequence
  source 1..20: mol_type = other DNA
aaatacaaaaataattagcc

SEQ ID NO: 42900 - DNA, 20 bp, synthetic construct
  misc_feature 1..20: note = CRISPR gRNA sequence
  source 1..20: mol_type = other DNA
caaaaataattagccaggca

SEQ ID NO: 42901 - DNA, 20 bp, synthetic construct
  misc_feature 1..20: note = CRISPR gRNA sequence
  source 1..20: mol_type = other DNA
aaataattagccaggcatag

SEQ ID NO: 42902 - DNA, 20 bp, synthetic construct
  misc_feature 1..20: note = CRISPR gRNA sequence
  source 1..20: mol_type = other DNA
gtggcacatgcctgtaatcc

SEQ ID NO: 42903 - DNA, 20 bp, synthetic construct
  misc_feature 1..20: note = CRISPR gRNA sequence
  source 1..20: mol_type = other DNA
tgcctgtaatcccagctact

SEQ ID NO: 42904 - DNA, 20 bp, synthetic construct
  misc_feature 1..20: note = CRISPR gRNA sequence
  source 1..20: mol_type = other DNA
gcctgtaatcccagctactt

SEQ ID NO: 42905 - DNA, 20 bp, synthetic construct
  misc_feature 1..20: note = CRISPR gRNA sequence
  source 1..20: mol_type = other DNA
ctgtaatcccagctacttgg

SEQ ID NO: 42906 - DNA, 20 bp, synthetic construct
  misc_feature 1..20: note = CRISPR gRNA sequence
  source 1..20: mol_type = other DNA
tgtaatcccagctacttggg

SEQ ID NO: 42907 - DNA, 20 bp, synthetic construct
  misc_feature 1..20: note = CRISPR gRNA sequence
  source 1..20: mol_type = other DNA
tcccagctacttgggaggct

SEQ ID NO: 42908 - DNA, 20 bp, synthetic construct
  misc_feature 1..20: note = CRISPR gRNA sequence
  source 1..20: mol_type = other DNA
cccagctacttgggaggctg

SEQ ID NO: 42909 - DNA, 20 bp, synthetic construct
  misc_feature 1..20: note = CRISPR gRNA sequence
  source 1..20: mol_type = other DNA
agctacttgggaggctgagg

SEQ ID NO: 42910 - DNA, 20 bp, synthetic construct
  misc_feature 1..20: note = CRISPR gRNA sequence
  source 1..20: mol_type = other DNA
gctacttgggaggctgaggc

SEQ ID NO: 42911 - DNA, 20 bp, synthetic construct
  misc_feature 1..20: note = CRISPR gRNA sequence
  source 1..20: mol_type = other DNA
tacttgggaggctgaggcag

SEQ ID NO: 42912 - DNA, 20 bp, synthetic construct
  misc_feature 1..20: note = CRISPR gRNA sequence
  source 1..20: mol_type = other DNA
gcaggagaatctcttgaacc

SEQ ID NO: 42913 - DNA, 20 bp, synthetic construct
  misc_feature 1..20: note = CRISPR gRNA sequence
  source 1..20: mol_type = other DNA
caggagaatctcttgaacct

SEQ ID NO: 42914 - DNA, 20 bp, synthetic construct
  misc_feature 1..20: note = CRISPR gRNA sequence
  source 1..20: mol_type = other DNA
ggagaatctcttgaacctgg

SEQ ID NO: 42915 - DNA, 20 bp, synthetic construct
  misc_feature 1..20: note = CRISPR gRNA sequence
  source 1..20: mol_type = other DNA
aatctcttgaacctgggaga

SEQ ID NO: 42916 - DNA, 20 bp, synthetic construct
  misc_feature 1..20: note = CRISPR gRNA sequence
  source 1..20: mol_type = other DNA
tctcttgaacctgggagaca

SEQ ID NO: 42917 - DNA, 20 bp, synthetic construct
  misc_feature 1..20: note = CRISPR gRNA sequence
  source 1..20: mol_type = other DNA
ctcttgaacctgggagacag

SEQ ID NO: 42918 - DNA, 20 bp, synthetic construct
  misc_feature 1..20: note = CRISPR gRNA sequence
  source 1..20: mol_type = other DNA
aacctgggagacagaggtcg

SEQ ID NO: 42919 - DNA, 20 bp, synthetic construct
  misc_feature 1..20: note = CRISPR gRNA sequence
  source 1..20: mol_type = other DNA
tgggagacagaggtcgcagt

SEQ ID NO: 42920 - DNA, 20 bp, synthetic construct
  misc_feature 1..20: note = CRISPR gRNA sequence
  source 1..20: mol_type = other DNA
gacagaggtcgcagtgagcc

SEQ ID NO: 42921 - DNA, 20 bp, synthetic construct
  misc_feature 1..20: note = CRISPR gRNA sequence
  source 1..20: mol_type = other DNA
aagatcgtgccattgcactc

SEQ ID NO: 42922 - DNA, 20 bp, synthetic construct
  misc_feature 1..20: note = CRISPR gRNA sequence
  source 1..20: mol_type = other DNA
cgtgccattgcactccagcc

SEQ ID NO: 42923 - DNA, 20 bp, synthetic construct
  misc_feature 1..20: note = CRISPR gRNA sequence
  source 1..20: mol_type = other DNA
gtgccattgcactccagcct

SEQ ID NO: 42924 - DNA, 20 bp, synthetic construct
  misc_feature 1..20: note = CRISPR gRNA sequence
  source 1..20: mol_type = other DNA
ttgcactccagcctgggcaa

SEQ ID NO: 42925 - DNA, 20 bp, synthetic construct
  misc_feature 1..20: note = CRISPR gRNA sequence
  source 1..20: mol_type = other DNA
gcactccagcctgggcaaca

SEQ ID NO: 42926 - DNA, 20 bp, synthetic construct
  misc_feature 1..20: note = CRISPR gRNA sequence
  source 1..20: mol_type = other DNA
tccagcctgggcaacagagc

SEQ ID NO: 42927 - DNA, 20 bp, synthetic construct
  misc_feature 1..20: note = CRISPR gRNA sequence
  source 1..20: mol_type = other DNA
taaataaataaataaaacca

SEQ ID NO: 42928 - DNA, 20 bp, synthetic construct
  misc_feature 1..20: note = CRISPR gRNA sequence
  source 1..20: mol_type = other DNA
aaccacagaatgctgcaatg

SEQ ID NO: 42929 - DNA, 20 bp, synthetic construct
  misc_feature 1..20: note = CRISPR gRNA sequence
  source 1..20: mol_type = other DNA
accacagaatgctgcaatga

SEQ ID NO: 42930 - DNA, 20 bp, synthetic construct
  misc_feature 1..20: note = CRISPR gRNA sequence
  source 1..20: mol_type = other DNA
ccacagaatgctgcaatgaa

SEQ ID NO: 42931 - DNA, 20 bp, synthetic construct
  misc_feature 1..20: note = CRISPR gRNA sequence
  source 1..20: mol_type = other DNA
cagaatgctgcaatgaaggg

SEQ ID NO: 42932 - DNA, 20 bp, synthetic construct
  misc_feature 1..20: note = CRISPR gRNA sequence
  source 1..20: mol_type = other DNA
atgctgcaatgaagggaagt

SEQ ID NO: 42933 - DNA, 20 bp, synthetic construct
  misc_feature 1..20: note = CRISPR gRNA sequence
  source 1..20: mol_type = other DNA
tgaagggaagtaagaaactt

SEQ ID NO: 42934 - DNA, 20 bp, synthetic construct
  misc_feature 1..20: note = CRISPR gRNA sequence
  source 1..20: mol_type = other DNA
gaagggaagtaagaaacttc

SEQ ID NO: 42935 - DNA, 20 bp, synthetic construct
  misc_feature 1..20: note = CRISPR gRNA sequence
  source 1..20: mol_type = other DNA
ggaagtaagaaacttcaggt

SEQ ID NO: 42936 - DNA, 20 bp, synthetic construct
  misc_feature 1..20: note = CRISPR gRNA sequence
  source 1..20: mol_type = other DNA
gaagtaagaaacttcaggtg

SEQ ID NO: 42937 - DNA, 20 bp, synthetic construct
  misc_feature 1..20: note = CRISPR gRNA sequence
  source 1..20: mol_type = other DNA
caatattgatattgcattcc

SEQ ID NO: 42938 - DNA, 20 bp, synthetic construct
  misc_feature 1..20: note = CRISPR gRNA sequence
  source 1..20: mol_type = other DNA
atattgcattcccagattaa

SEQ ID NO: 42939 - DNA, 20 bp, synthetic construct
  misc_feature 1..20: note = CRISPR gRNA sequence
  source 1..20: mol_type = other DNA
ttgcattcccagattaaaag

SEQ ID NO: 42940 - DNA, 20 bp, synthetic construct
  misc_feature 1..20: note = CRISPR gRNA sequence
  source 1..20: mol_type = other DNA
agattaaaagaagaaatcta

SEQ ID NO: 42941 - DNA, 20 bp, synthetic construct
  misc_feature 1..20: note = CRISPR gRNA sequence
  source 1..20: mol_type = other DNA
gattaaaagaagaaatctat

SEQ ID NO: 42942 - DNA, 20 bp, synthetic construct
  misc_feature 1..20: note = CRISPR gRNA sequence
  source 1..20: mol_type = other DNA
ttcctctcattcaaaaactg

SEQ ID NO: 42943 - DNA, 20 bp, synthetic construct
  misc_feature 1..20: note = CRISPR gRNA sequence
  source 1..20: mol_type = other DNA
ctgtggatcccaaatgatgc

SEQ ID NO: 42944 - DNA, 20 bp, synthetic construct
  misc_feature 1..20: note = CRISPR gRNA sequence
  source 1..20: mol_type = other DNA
gatcccaaatgatgccggcc

SEQ ID NO: 42945 - DNA, 20 bp, synthetic construct
  misc_feature 1..20: note = CRISPR gRNA sequence
  source 1..20: mol_type = other DNA
atcccaaatgatgccggcca

SEQ ID NO: 42946 - DNA, 20 bp, synthetic construct
  misc_feature 1..20: note = CRISPR gRNA sequence
  source 1..20: mol_type = other DNA
tcccaaatgatgccggccaa

SEQ ID NO: 42947 - DNA, 20 bp, synthetic construct
  misc_feature 1..20: note = CRISPR gRNA sequence
  source 1..20: mol_type = other DNA
aatgatgccggccaagggcg

SEQ ID NO: 42948 - DNA, 20 bp, synthetic construct
  misc_feature 1..20: note = CRISPR gRNA sequence
  source 1..20: mol_type = other DNA
tgccggccaagggcgtggtg

SEQ ID NO: 42949 - DNA, 20 bp, synthetic construct
  misc_feature 1..20: note = CRISPR gRNA sequence
  source 1..20: mol_type = other DNA
gccggccaagggcgtggtga

SEQ ID NO: 42950 - DNA, 20 bp, synthetic construct
  misc_feature 1..20: note = CRISPR gRNA sequence
  source 1..20: mol_type = other DNA
agggcgtggtgaaggcaaat

SEQ ID NO: 42951 - DNA, 20 bp, synthetic construct
  misc_feature 1..20: note = CRISPR gRNA sequence
  source 1..20: mol_type = other DNA
ggtttttctttaacccttga

SEQ ID NO: 42952 - DNA, 20 bp, synthetic construct
  misc_feature 1..20: note = CRISPR gRNA sequence
  source 1..20: mol_type = other DNA
tttaacccttgaaagcctgc

SEQ ID NO: 42953 - DNA, 20 bp, synthetic construct
  misc_feature 1..20: note = CRISPR gRNA sequence
  source 1..20: mol_type = other DNA
taacccttgaaagcctgctg

SEQ ID NO: 42954 - DNA, 20 bp, synthetic construct
  misc_feature 1..20: note = CRISPR gRNA sequence
  source 1..20: mol_type = other DNA
aacccttgaaagcctgctgg

SEQ ID NO: 42955 - DNA, 20 bp, synthetic construct
  misc_feature 1..20: note = CRISPR gRNA sequence
  source 1..20: mol_type = other DNA
aaagcctgctggaggcacct

SEQ ID NO: 42956 - DNA, 20 bp, synthetic construct
  misc_feature 1..20: note = CRISPR gRNA sequence
  source 1..20: mol_type = other DNA
gctggaggcacctgagctat

SEQ ID NO: 42957 - DNA, 20 bp, synthetic construct
  misc_feature 1..20: note = CRISPR gRNA sequence
  source 1..20: mol_type = other DNA
ggaggcacctgagctatgag

SEQ ID NO: 42958 - DNA, 20 bp, synthetic construct
  misc_feature 1..20: note = CRISPR gRNA sequence
  source 1..20: mol_type = other DNA
ctatgagtggtcacccgata

SEQ ID NO: 42959 - DNA, 20 bp, synthetic construct
  misc_feature 1..20: note = CRISPR gRNA sequence
  source 1..20: mol_type = other DNA
tgagtggtcacccgatatgg

SEQ ID NO: 42960 - DNA, 20 bp, synthetic construct
  misc_feature 1..20: note = CRISPR gRNA sequence
  source 1..20: mol_type = other DNA
agtggtcacccgatatggaa

SEQ ID NO: 42961 - DNA, 20 bp, synthetic construct
  misc_feature 1..20: note = CRISPR gRNA sequence
  source 1..20: mol_type = other DNA
gtggtcacccgatatggaag

SEQ ID NO: 42962 - DNA, 20 bp, synthetic construct
  misc_feature 1..20: note = CRISPR gRNA sequence
  source 1..20: mol_type = other DNA
acccgatatggaagaggacc

SEQ ID NO: 42963 - DNA, 20 bp, synthetic construct
  misc_feature 1..20: note = CRISPR gRNA sequence
  source 1..20: mol_type = other DNA
ccgatatggaagaggaccaa

SEQ ID NO: 42964 - DNA, 20 bp, synthetic construct
  misc_feature 1..20: note = CRISPR gRNA sequence
  source 1..20: mol_type = other DNA
cgatatggaagaggaccaag

SEQ ID NO: 42965 - DNA, 20 bp, synthetic construct
  misc_feature 1..20: note = CRISPR gRNA sequence
  source 1..20: mol_type = other DNA
atggaagaggaccaagagga

SEQ ID NO: 42966 - DNA, 20 bp, synthetic construct
  misc_feature 1..20: note = CRISPR gRNA sequence
  source 1..20: mol_type = other DNA
tggaagaggaccaagaggat

SEQ ID NO: 42967 - DNA, 20 bp, synthetic construct
  misc_feature 1..20: note = CRISPR gRNA sequence
  source 1..20: mol_type = other DNA
ccaagaggatgggtttactg

SEQ ID NO: 42968 - DNA, 20 bp, synthetic construct
  misc_feature 1..20: note = CRISPR gRNA sequence
  source 1..20: mol_type = other DNA
ggatgggtttactgtggtgc

SEQ ID NO: 42969 - DNA, 20 bp, synthetic construct
  misc_feature 1..20: note = CRISPR gRNA sequence
  source 1..20: mol_type = other DNA
gatgggtttactgtggtgct

SEQ ID NO: 42970 - DNA, 20 bp, synthetic construct
  misc_feature 1..20: note = CRISPR gRNA sequence
  source 1..20: mol_type = other DNA
atgggtttactgtggtgctg

SEQ ID NO: 42971 - DNA, 20 bp, synthetic construct
  misc_feature 1..20: note = CRISPR gRNA sequence
  source 1..20: mol_type = other DNA
gggtttactgtggtgctggg

SEQ ID NO: 42972 - DNA, 20 bp, synthetic construct
  misc_feature 1..20: note = CRISPR gRNA sequence
  source 1..20: mol_type = other DNA
ggtttactgtggtgctgggg

SEQ ID NO: 42973 - DNA, 20 bp, synthetic construct
  misc_feature 1..20: note = CRISPR gRNA sequence
  source 1..20: mol_type = other DNA
gtttactgtggtgctgggga

SEQ ID NO: 42974 - DNA, 20 bp, synthetic construct
  misc_feature 1..20: note = CRISPR gRNA sequence
  source 1..20: mol_type = other DNA
tttactgtggtgctggggag

SEQ ID NO: 42975 - DNA, 20 bp, synthetic construct
  misc_feature 1..20: note = CRISPR gRNA sequence
  source 1..20: mol_type = other DNA
ctgtggtgctggggagggga

SEQ ID NO: 42976 - DNA, 20 bp, synthetic construct
  misc_feature 1..20: note = CRISPR gRNA sequence
  source 1..20: mol_type = other DNA
tggtgctggggaggggatag

SEQ ID NO: 42977 - DNA, 20 bp, synthetic construct
  misc_feature 1..20: note = CRISPR gRNA sequence
  source 1..20: mol_type = other DNA
tgctggggaggggatagtag

SEQ ID NO: 42978 - DNA, 20 bp, synthetic construct
  misc_feature 1..20: note = CRISPR gRNA sequence
  source 1..20: mol_type = other DNA
ctggggaggggatagtagca

SEQ ID NO: 42979 - DNA, 20 bp, synthetic construct
  misc_feature 1..20: note = CRISPR gRNA sequence
  source 1..20: mol_type = other DNA
ggggatagtagcagagaacg

SEQ ID NO: 42980 - DNA, 20 bp, synthetic construct
  misc_feature 1..20: note = CRISPR gRNA sequence
  source 1..20: mol_type = other DNA
gggatagtagcagagaacgt

SEQ ID NO: 42981 - DNA, 20 bp, synthetic construct
  misc_feature 1..20: note = CRISPR gRNA sequence
  source 1..20: mol_type = other DNA
gatagtagcagagaacgtag

SEQ ID NO: 42982 - DNA, 20 bp, synthetic construct
  misc_feature 1..20: note = CRISPR gRNA sequence
  source 1..20: mol_type = other DNA
gcagagaacgtaggagttgc

SEQ ID NO: 42983 - DNA, 20 bp, synthetic construct
  misc_feature 1..20: note = CRISPR gRNA sequence
  source 1..20: mol_type = other DNA
gtaggagttgctggtcattc

SEQ ID NO: 42984 - DNA, 20 bp, synthetic construct
  misc_feature 1..20: note = CRISPR gRNA sequence
  source 1..20: mol_type = other DNA
ggagttgctggtcattctag

SEQ ID NO: 42985 - DNA, 20 bp, synthetic construct
  misc_feature 1..20: note = CRISPR gRNA sequence
  source 1..20: mol_type = other DNA
gctggtcattctagtggtga

SEQ ID NO: 42986 - DNA, 20 bp, synthetic construct
  misc_feature 1..20: note = CRISPR gRNA sequence
  source 1..20: mol_type = other DNA
ggtcattctagtggtgatgg

SEQ ID NO: 42987 - DNA, 20 bp, synthetic construct
  misc_feature 1..20: note = CRISPR gRNA sequence
  source 1..20: mol_type = other DNA
gtcattctagtggtgatgga

SEQ ID NO: 42988 - DNA, 20 bp, synthetic construct
  misc_feature 1..20: note = CRISPR gRNA sequence
  source 1..20: mol_type = other DNA
tcattctagtggtgatggaa

SEQ ID NO: 42989 - DNA, 20 bp, synthetic construct
  misc_feature 1..20: note = CRISPR gRNA sequence
  source 1..20: mol_type = other DNA
tctagtggtgatggaaggga

SEQ ID NO: 42990 - DNA, 20 bp, synthetic construct
  misc_feature 1..20: note = CRISPR gRNA sequence
  source 1..20: mol_type = other DNA
ggtgatggaagggatggtga

SEQ ID NO: 42991 - DNA, 20 bp, synthetic construct
  misc_feature 1..20: note = CRISPR gRNA sequence
  source 1..20: mol_type = other DNA
gatggaagggatggtgatgg

SEQ ID NO: 42992 - DNA, 20 bp, synthetic construct
  misc_feature 1..20: note = CRISPR gRNA sequence
  source 1..20: mol_type = other DNA
agggatggtgatggtggtac

SEQ ID NO: 42993 - DNA, 20 bp, synthetic construct
  misc_feature 1..20: note = CRISPR gRNA sequence
  source 1..20: mol_type = other DNA
gggatggtgatggtggtact

SEQ ID NO: 42994 - DNA, 20 bp, synthetic construct
  misc_feature 1..20: note = CRISPR gRNA sequence
  source 1..20: mol_type = other DNA
ggtgatggtggtactgggct

SEQ ID NO: 42995 - DNA, 20 bp, synthetic construct
  misc_feature 1..20: note = CRISPR gRNA sequence
  source 1..20: mol_type = other DNA
gatggtggtactgggcttgg

SEQ ID NO: 42996 - DNA, 20 bp, synthetic construct
  misc_feature 1..20: note = CRISPR gRNA sequence
  source 1..20: mol_type = other DNA
tggtactgggcttggtggtg

SEQ ID NO: 42997 - DNA, 20 bp, synthetic construct
  misc_feature 1..20: note = CRISPR gRNA sequence
  source 1..20: mol_type = other DNA
ggcttggtggtgtagaattg

SEQ ID NO: 42998 - DNA, 20 bp, synthetic construct
  misc_feature 1..20: note = CRISPR gRNA sequence
  source 1..20: mol_type = other DNA
tagaattgtggtgataatga

SEQ ID NO: 42999 - DNA, 20 bp, synthetic construct
  misc_feature 1..20: note = CRISPR gRNA sequence
  source 1..20: mol_type = other DNA
aattgtggtgataatgaaag

SEQ ID NO: 43000 - DNA, 20 bp, synthetic construct
  misc_feature 1..20: note = CRISPR gRNA sequence
  source 1..20: mol_type = other DNA
tgtggtgataatgaaagtgg

SEQ ID NO: 43001 - DNA, 20 bp, synthetic construct
  misc_feature 1..20: note = CRISPR gRNA sequence
  source 1..20: mol_type = other DNA
ggtgataatgaaagtggtgg

SEQ ID NO: 43002 - DNA, 20 bp, synthetic construct
  misc_feature 1..20: note = CRISPR gRNA sequence
  source 1..20: mol_type = other DNA
aatgaaagtggtggtggtga

SEQ ID NO: 43003 - DNA, 20 bp, synthetic construct
  misc_feature 1..20: note = CRISPR gRNA sequence
  source 1..20: mol_type = other DNA
gaaagtggtggtggtgatgg

SEQ ID NO: 43004 - DNA, 20 bp, synthetic construct
  misc_feature 1..20: note = CRISPR gRNA sequence
  source 1..20: mol_type = other DNA
ggtggtgatggtggtaatac

SEQ ID NO: 43005 - DNA, 20 bp, synthetic construct
  misc_feature 1..20: note = CRISPR gRNA sequence
  source 1..20: mol_type = other DNA
ggtgatggtggtaatactgg

SEQ ID NO: 43006 - DNA, 20 bp, synthetic construct
  misc_feature 1..20: note = CRISPR gRNA sequence
  source 1..20: mol_type = other DNA
gatggtggtaatactggtgg

SEQ ID NO: 43007 - DNA, 20 bp, synthetic construct
  misc_feature 1..20: note = CRISPR gRNA sequence
  source 1..20: mol_type = other DNA
aatactggtggtggtgacat

SEQ ID NO: 43008 - DNA, 20 bp, synthetic construct
  misc_feature 1..20: note = CRISPR gRNA sequence
  source 1..20: mol_type = other DNA
actggtggtggtgacattgg

SEQ ID NO: 43009 - DNA, 20 bp, synthetic construct
  misc_feature 1..20: note = CRISPR gRNA sequence
  source 1..20: mol_type = other DNA
ggtggtggtgacattggtgg

SEQ ID NO: 43010 - DNA, 20 bp, synthetic construct
  misc_feature 1..20: note = CRISPR gRNA sequence
  source 1..20: mol_type = other DNA
ggtggtgacattggtggtgg

SEQ ID NO: 43011 - DNA, 20 bp, synthetic construct
  misc_feature 1..20: note = CRISPR gRNA sequence
  source 1..20: mol_type = other DNA
gacattggtggtggtggtga

SEQ ID NO: 43012 - DNA, 20 bp, synthetic construct
  misc_feature 1..20: note = CRISPR gRNA sequence
  source 1..20: mol_type = other DNA
attggtggtggtggtgatgg

SEQ ID NO: 43013 - DNA, 20 bp, synthetic construct
  misc_feature 1..20: note = CRISPR gRNA sequence
  source 1..20: mol_type = other DNA
ggtggtgatggtggtgatac

SEQ ID NO: 43014 - DNA, 20 bp, synthetic construct
  misc_feature 1..20: note = CRISPR gRNA sequence
  source 1..20: mol_type = other DNA
gatggtggtgatactggtga

SEQ ID NO: 43015 - DNA, 20 bp, synthetic construct
  misc_feature 1..20: note = CRISPR gRNA sequence
  source 1..20: mol_type = other DNA
ggtggtgatactggtgatgg

SEQ ID NO: 43016 - DNA, 20 bp, synthetic construct
  misc_feature 1..20: note = CRISPR gRNA sequence
  source 1..20: mol_type = other DNA
gatactggtgatggtggtga

SEQ ID NO: 43017 - DNA, 20 bp, synthetic construct
  misc_feature 1..20: note = CRISPR gRNA sequence
  source 1..20: mol_type = other DNA
actggtgatggtggtgatgg

SEQ ID NO: 43018 - DNA, 20 bp, synthetic construct
  misc_feature 1..20: note = CRISPR gRNA sequence
  source 1..20: mol_type = other DNA
ggtgatggtggtgatggtgg

SEQ ID NO: 43019 - DNA, 20 bp, synthetic construct
  misc_feature 1..20: note = CRISPR gRNA sequence
  source 1..20: mol_type = other DNA
ggtggtgatggtggtggcgc

SEQ ID NO: 43020 - DNA, 20 bp, synthetic construct
  misc_feature 1..20: note = CRISPR gRNA sequence
  source 1..20: mol_type = other DNA
tggcgctggtgaccctgaca

SEQ ID NO: 43021 - DNA, 20 bp, synthetic construct
  misc_feature 1..20: note = CRISPR gRNA sequence
  source 1..20: mol_type = other DNA
ggcgctggtgaccctgacat

SEQ ID NO: 43022 - DNA, 20 bp, synthetic construct
  misc_feature 1..20: note = CRISPR gRNA sequence
  source 1..20: mol_type = other DNA
gcgctggtgaccctgacatg

SEQ ID NO: 43023 - DNA, 20 bp, synthetic construct
  misc_feature 1..20: note = CRISPR gRNA sequence
  source 1..20: mol_type = other DNA
ggtgaccctgacatggggtc

SEQ ID NO: 43024 - DNA, 20 bp, synthetic construct
  misc_feature 1..20: note = CRISPR gRNA sequence
  source 1..20: mol_type = other DNA
gaccctgacatggggtccag

SEQ ID NO: 43025 - DNA, 20 bp, synthetic construct
  misc_feature 1..20: note = CRISPR gRNA sequence
  source 1..20: mol_type = other DNA
cctgacatggggtccagtag

SEQ ID NO: 43026 - DNA, 20 bp, synthetic construct
  misc_feature 1..20: note = CRISPR gRNA sequence
  source 1..20: mol_type = other DNA
atggggtccagtagcagtga

SEQ ID NO: 43027 - DNA, 20 bp, synthetic construct
  misc_feature 1..20: note = CRISPR gRNA sequence
  source 1..20: mol_type = other DNA
gggtccagtagcagtgacag

SEQ ID NO: 43028 - DNA, 20 bp, synthetic construct
  misc_feature 1..20: note = CRISPR gRNA sequence
  source 1..20: mol_type = other DNA
agtagcagtgacagtggatg

SEQ ID NO: 43029 - DNA, 20 bp, synthetic construct
  misc_feature 1..20: note = CRISPR gRNA sequence
  source 1..20: mol_type = other DNA
gtagcagtgacagtggatgc

SEQ ID NO: 43030 - DNA, 20 bp, synthetic construct
  misc_feature 1..20: note = CRISPR gRNA sequence
  source 1..20: mol_type = other DNA
tgacagtggatgcaggctcc

SEQ ID NO: 43031 - DNA, 20 bp, synthetic construct
  misc_feature 1..20: note = CRISPR gRNA sequence
  source 1..20: mol_type = other DNA
gatgcaggctcctggtgact

SEQ ID NO: 43032 - DNA, 20 bp, synthetic construct
  misc_feature 1..20: note = CRISPR gRNA sequence
  source 1..20: mol_type = other DNA
atgcaggctcctggtgactg

SEQ ID NO: 43033 - DNA, 20 bp, synthetic construct
  misc_feature 1..20: note = CRISPR gRNA sequence
  source 1..20: mol_type = other DNA
gcaggctcctggtgactgag

SEQ ID NO: 43034 - DNA, 20 bp, synthetic construct
  misc_feature 1..20: note = CRISPR gRNA sequence
  source 1..20: mol_type = other DNA
ctggtgactgaggagcatct

SEQ ID NO: 43035 - DNA, 20 bp, synthetic construct
  misc_feature 1..20: note = CRISPR gRNA sequence
  source 1..20: mol_type = other DNA
tggtgactgaggagcatctc

SEQ ID NO: 43036 - DNA, 20 bp, synthetic construct
  misc_feature 1..20: note = CRISPR gRNA sequence
  source 1..20: mol_type = other DNA
actgaggagcatctcaggct

SEQ ID NO: 43037 - DNA, 20 bp, synthetic construct
  misc_feature 1..20: note = CRISPR gRNA sequence
  source 1..20: mol_type = other DNA
ctgaggagcatctcaggctg

SEQ ID NO: 43038 - DNA, 20 bp, synthetic construct
  misc_feature 1..20: note = CRISPR gRNA sequence
  source 1..20: mol_type = other DNA
gaggagcatctcaggctgag

SEQ ID NO: 43039 - DNA, 20 bp, synthetic construct
  misc_feature 1..20: note = CRISPR gRNA sequence
  source 1..20: mol_type = other DNA
aggagcatctcaggctgagg

SEQ ID NO: 43040 - DNA, 20 bp, synthetic construct
  misc_feature 1..20: note = CRISPR gRNA sequence
  source 1..20: mol_type = other DNA
ccactgctccttacccccta

SEQ ID NO: 43041 - DNA, 20 bp, synthetic construct
  misc_feature 1..20: note = CRISPR gRNA sequence
  source 1..20: mol_type = other DNA
ccttaccccctacagtctct

SEQ ID NO: 43042 - DNA, 20 bp, synthetic construct
  misc_feature 1..20: note = CRISPR gRNA sequence
  source 1..20: mol_type = other DNA
cagtctctcagcaaacctgc

SEQ ID NO: 43043 - DNA, 20 bp, synthetic construct
  misc_feature 1..20: note = CRISPR gRNA sequence
  source 1..20: mol_type = other DNA
agtctctcagcaaacctgct

SEQ ID NO: 43044 - DNA, 20 bp, synthetic construct
  misc_feature 1..20: note = CRISPR gRNA sequence
  source 1..20: mol_type = other DNA
tcagcaaacctgctgggcga

SEQ ID NO: 43045 - DNA, 20 bp, synthetic construct
  misc_feature 1..20: note = CRISPR gRNA sequence
  source 1..20: mol_type = other DNA
gcaaacctgctgggcgacag

SEQ ID NO: 43046 - DNA, 20 bp, synthetic construct
  misc_feature 1..20: note = CRISPR gRNA sequence
  source 1..20: mol_type = other DNA
ctgctgggcgacagcggact

SEQ ID NO: 43047 - DNA, 20 bp, synthetic construct
  misc_feature 1..20: note = CRISPR gRNA sequence
  source 1..20: mol_type = other DNA
cagcggactcagatgccttc

SEQ ID NO: 43048 - DNA, 20 bp, synthetic construct
  misc_feature 1..20: note = CRISPR gRNA sequence
  source 1..20: mol_type = other DNA
gccttctggaatgtctgccg

SEQ ID NO: 43049 - DNA, 20 bp, synthetic construct
  misc_feature 1..20: note = CRISPR gRNA sequence
  source 1..20: mol_type = other DNA
ccttctggaatgtctgccgc

SEQ ID NO: 43050 - DNA, 20 bp, synthetic construct
  misc_feature 1..20: note = CRISPR gRNA sequence
  source 1..20: mol_type = other DNA
ctgccgcaggtgcccatctc

SEQ ID NO: 43051 - DNA, 20 bp, synthetic construct
  misc_feature 1..20: note = CRISPR gRNA sequence
  source 1..20: mol_type = other DNA
tgcccatctccggtttgctt

SEQ ID NO: 43052 - DNA, 20 bp, synthetic construct
  misc_feature 1..20: note = CRISPR gRNA sequence
  source 1..20: mol_type = other DNA
catctccggtttgcttgagt

SEQ ID NO: 43053 - DNA, 20 bp, synthetic construct
  misc_feature 1..20: note = CRISPR gRNA sequence
  source 1..20: mol_type = other DNA
ctccggtttgcttgagtaag

SEQ ID NO: 43054 - DNA, 20 bp, synthetic construct
  misc_feature 1..20: note = CRISPR gRNA sequence
  source 1..20: mol_type = other DNA
ggtttgcttgagtaagtgga

SEQ ID NO: 43055 - DNA, 20 bp, synthetic construct
  misc_feature 1..20: note = CRISPR gRNA sequence
  source 1..20: mol_type = other DNA
ttgcttgagtaagtggaaag

SEQ ID NO: 43056 - DNA, 20 bp, synthetic construct
  misc_feature 1..20: note = CRISPR gRNA sequence
  source 1..20: mol_type = other DNA
agtaagtggaaagcagcata

SEQ ID NO: 43057 - DNA, 20 bp, synthetic construct
  misc_feature 1..20: note = CRISPR gRNA sequence
  source 1..20: mol_type = other DNA
gtaagtggaaagcagcataa

SEQ ID NO: 43058 - DNA, 20 bp, synthetic construct
  misc_feature 1..20: note = CRISPR gRNA sequence
  source 1..20: mol_type = other DNA
gtggaaagcagcataaagga

SEQ ID NO: 43059 - DNA, 20 bp, synthetic construct
  misc_feature 1..20: note = CRISPR gRNA sequence
  source 1..20: mol_type = other DNA
aaagcagcataaaggacaga

SEQ ID NO: 43060 - DNA, 20 bp, synthetic construct
  misc_feature 1..20: note = CRISPR gRNA sequence
  source 1..20: mol_type = other DNA
cagcataaaggacagatagc

SEQ ID NO: 43061 - DNA, 20 bp, synthetic construct
  misc_feature 1..20: note = CRISPR gRNA sequence
  source 1..20: mol_type = other DNA
agcataaaggacagatagca

SEQ ID NO: 43062 - DNA, 20 bp, synthetic construct
  misc_feature 1..20: note = CRISPR gRNA sequence
  source 1..20: mol_type = other DNA
cataaaggacagatagcaag

SEQ ID NO: 43063 - DNA, 20 bp, synthetic construct
  misc_feature 1..20: note = CRISPR gRNA sequence
  source 1..20: mol_type = other DNA
ataaaggacagatagcaagg

SEQ ID NO: 43064 - DNA, 20 bp, synthetic construct
  misc_feature 1..20: note = CRISPR gRNA sequence
  source 1..20: mol_type = other DNA
aaggacagatagcaaggagg

SEQ ID NO: 43065 - DNA, 20 bp, synthetic construct
  misc_feature 1..20: note = CRISPR gRNA sequence
  source 1..20: mol_type = other DNA
aggacagatagcaaggagga

SEQ ID NO: 43066 - DNA, 20 bp, synthetic construct
  misc_feature 1..20: note = CRISPR gRNA sequence
  source 1..20: mol_type = other DNA
agcaaggaggaaggctcccc

SEQ ID NO: 43067 - DNA, 20 bp, synthetic construct
  misc_feature 1..20: note = CRISPR gRNA sequence
  source 1..20: mol_type = other DNA
gcaaggaggaaggctcccct

SEQ ID NO: 43068 - DNA, 20 bp, synthetic construct
  misc_feature 1..20: note = CRISPR gRNA sequence
  source 1..20: mol_type = other DNA
ggaaggctcccctaggccaa

SEQ ID NO: 43069 - DNA, 20 bp, synthetic construct
  misc_feature 1..20: note = CRISPR gRNA sequence
  source 1..20: mol_type = other DNA
cccctaggccaaaagcatga

SEQ ID NO: 43070 - DNA, 20 bp, synthetic construct
  misc_feature 1..20: note = CRISPR gRNA sequence
  source 1..20: mol_type = other DNA
ccctaggccaaaagcatgat

SEQ ID NO: 43071 - DNA, 20 bp, synthetic construct
  misc_feature 1..20: note = CRISPR gRNA sequence
  source 1..20: mol_type = other DNA
cctaggccaaaagcatgatg

SEQ ID NO: 43072 - DNA, 20 bp, synthetic construct
  misc_feature 1..20: note = CRISPR gRNA sequence
  source 1..20: mol_type = other DNA
ctaggccaaaagcatgatgg

SEQ ID NO: 43073 - DNA, 20 bp, synthetic construct
  misc_feature 1..20: note = CRISPR gRNA sequence
  source 1..20: mol_type = other DNA
gcatgatgggggctccttct

SEQ ID NO: 43074 - DNA, 20 bp, synthetic construct
  misc_feature 1..20: note = CRISPR gRNA sequence
  source 1..20: mol_type = other DNA
catgatgggggctccttctg

SEQ ID NO: 43075 - DNA, 20 bp, synthetic construct
  misc_feature 1..20: note = CRISPR gRNA sequence
  source 1..20: mol_type = other DNA
atgatgggggctccttctga

SEQ ID NO: 43076 - DNA, 20 bp, synthetic construct
  misc_feature 1..20: note = CRISPR gRNA sequence
  source 1..20: mol_type = other DNA
ctccttctgagggcatcccc

SEQ ID NO: 43077 - DNA, 20 bp, synthetic construct
  misc_feature 1..20: note = CRISPR gRNA sequence
  source 1..20: mol_type = other DNA
ccttctgagggcatccccca

SEQ ID NO: 43078 - DNA, 20 bp, synthetic construct
  misc_feature 1..20: note = CRISPR gRNA sequence
  source 1..20: mol_type = other DNA
gagggcatcccccagagcac

SEQ ID NO: 43079 - DNA, 20 bp, synthetic construct
  misc_feature 1..20: note = CRISPR gRNA sequence
  source 1..20: mol_type = other DNA
gggcatcccccagagcacca

SEQ ID NO: 43080 - DNA, 20 bp, synthetic construct
  misc_feature 1..20: note = CRISPR gRNA sequence
  source 1..20: mol_type = other DNA
ggcatcccccagagcaccag

SEQ ID NO: 43081 - DNA, 20 bp, synthetic construct
  misc_feature 1..20: note = CRISPR gRNA sequence
  source 1..20: mol_type = other DNA
cccccagagcaccagaggac

SEQ ID NO: 43082 - DNA, 20 bp, synthetic construct
  misc_feature 1..20: note = CRISPR gRNA sequence
  source 1..20: mol_type = other DNA
ccccagagcaccagaggaca

SEQ ID NO: 43083 - DNA, 20 bp, synthetic construct
  misc_feature 1..20: note = CRISPR gRNA sequence
  source 1..20: mol_type = other DNA
gcaccagaggacaaggactg

SEQ ID NO: 43084 - DNA, 20 bp, synthetic construct
  misc_feature 1..20: note = CRISPR gRNA sequence
  source 1..20: mol_type = other DNA
accagaggacaaggactgtg

SEQ ID NO: 43085 - DNA, 20 bp, synthetic construct
  misc_feature 1..20: note = CRISPR gRNA sequence
  source 1..20: mol_type = other DNA
ccagaggacaaggactgtgg

SEQ ID NO: 43086 - DNA, 20 bp, synthetic construct
  misc_feature 1..20: note = CRISPR gRNA sequence
  source 1..20: mol_type = other DNA
cagaggacaaggactgtgga

SEQ ID NO: 43087 - DNA, 20 bp, synthetic construct
  misc_feature 1..20: note = CRISPR gRNA sequence
  source 1..20: mol_type = other DNA
ggacaaggactgtggagggc

SEQ ID NO: 43088 - DNA, 20 bp, synthetic construct
  misc_feature 1..20: note = CRISPR gRNA sequence
  source 1..20: mol_type = other DNA
gacaaggactgtggagggca

SEQ ID NO: 43089 - DNA, 20 bp, synthetic construct
  misc_feature 1..20: note = CRISPR gRNA sequence
  source 1..20: mol_type = other DNA
acaaggactgtggagggcaa

SEQ ID NO: 43090 - DNA, 20 bp, synthetic construct
  misc_feature 1..20: note = CRISPR gRNA sequence
  source 1..20: mol_type = other DNA
caaggactgtggagggcaag

SEQ ID NO: 43091 - DNA, 20 bp, synthetic construct
  misc_feature 1..20: note = CRISPR gRNA sequence
  source 1..20: mol_type = other DNA
ttcccttgccttcactcccc

SEQ ID NO: 43092 - DNA, 20 bp, synthetic construct
  misc_feature 1..20: note = CRISPR gRNA sequence
  source 1..20: mol_type = other DNA
tgccttcactcccctggcct

SEQ ID NO: 43093 - DNA, 20 bp, synthetic construct
  misc_feature 1..20: note = CRISPR gRNA sequence
  source 1..20: mol_type = other DNA
gccttcactcccctggcctt

SEQ ID NO: 43094 - DNA, 20 bp, synthetic construct
  misc_feature 1..20: note = CRISPR gRNA sequence
  source 1..20: mol_type = other DNA
tctgtccctcacacccacca

SEQ ID NO: 43095 - DNA, 20 bp, synthetic construct
  misc_feature 1..20: note = CRISPR gRNA sequence
  source 1..20: mol_type = other DNA
ctgtccctcacacccaccat

SEQ ID NO: 43096 - DNA, 20 bp, synthetic construct
  misc_feature 1..20: note = CRISPR gRNA sequence
  source 1..20: mol_type = other DNA
tccctcacacccaccatggg

SEQ ID NO: 43097 - DNA, 20 bp, synthetic construct
  misc_feature 1..20: note = CRISPR gRNA sequence
  source 1..20: mol_type = other DNA
agatcctccaccaaacaccc

SEQ ID NO: 43098 - DNA, 20 bp, synthetic construct
  misc_feature 1..20: note = CRISPR gRNA sequence
  source 1..20: mol_type = other DNA
atcctccaccaaacacccaa

SEQ ID NO: 43099 - DNA, 20 bp, synthetic construct
  misc_feature 1..20: note = CRISPR gRNA sequence
  source 1..20: mol_type = other DNA
cctccaccaaacacccaaga

SEQ ID NO: 43100 - DNA, 20 bp, synthetic construct
  misc_feature 1..20: note = CRISPR gRNA sequence
  source 1..20: mol_type = other DNA
ctccaccaaacacccaagag

SEQ ID NO: 43101 - DNA, 20 bp, synthetic construct
  misc_feature 1..20: note = CRISPR gRNA sequence
  source 1..20: mol_type = other DNA
ccaagagaggctgtgattcg

SEQ ID NO: 43102 - DNA, 20 bp, synthetic construct
  misc_feature 1..20: note = CRISPR gRNA sequence
  source 1..20: mol_type = other DNA
agagaggctgtgattcgtgg

SEQ ID NO: 43103 - DNA, 20 bp, synthetic construct
  misc_feature 1..20: note = CRISPR gRNA sequence
  source 1..20: mol_type = other DNA
gagaggctgtgattcgtggc

SEQ ID NO: 43104 - DNA, 20 bp, synthetic construct
  misc_feature 1..20: note = CRISPR gRNA sequence
  source 1..20: mol_type = other DNA
agaggctgtgattcgtggca

SEQ ID NO: 43105 - DNA, 20 bp, synthetic construct
  misc_feature 1..20: note = CRISPR gRNA sequence
  source 1..20: mol_type = other DNA
ggcagggtgacacaccccta

SEQ ID NO: 43106 - DNA, 20 bp, synthetic construct
  misc_feature 1..20: note = CRISPR gRNA sequence
  source 1..20: mol_type = other DNA
cccctacagccaaactgacc

SEQ ID NO: 43107 - DNA, 20 bp, synthetic construct
  misc_feature 1..20: note = CRISPR gRNA sequence
  source 1..20: mol_type = other DNA
ccctacagccaaactgacct

SEQ ID NO: 43108 - DNA, 20 bp, synthetic construct
  misc_feature 1..20: note = CRISPR gRNA sequence
  source 1..20: mol_type = other DNA
cctacagccaaactgacctg

SEQ ID NO: 43109 - DNA, 20 bp, synthetic construct
  misc_feature 1..20: note = CRISPR gRNA sequence
  source 1..20: mol_type = other DNA
cagccaaactgacctgggga

SEQ ID NO: 43110 - DNA, 20 bp, synthetic construct
  misc_feature 1..20: note = CRISPR gRNA sequence
  source 1..20: mol_type = other DNA
agccaaactgacctggggac

SEQ ID NO: 43111 - DNA, 20 bp, synthetic construct
  misc_feature 1..20: note = CRISPR gRNA sequence
  source 1..20: mol_type = other DNA
gccaaactgacctggggaca

SEQ ID NO: 43112 - DNA, 20 bp, synthetic construct
  misc_feature 1..20: note = CRISPR gRNA sequence
  source 1..20: mol_type = other DNA
aaactgacctggggacaggg

SEQ ID NO: 43113 - DNA, 20 bp, synthetic construct
  misc_feature 1..20: note = CRISPR gRNA sequence
  source 1..20: mol_type = other DNA
agcaacattccatccccaac

SEQ ID NO: 43114 - DNA, 20 bp, synthetic construct
  misc_feature 1..20: note = CRISPR gRNA sequence
  source 1..20: mol_type = other DNA
ccatccccaaccagctgatg

SEQ ID NO: 43115 - DNA, 20 bp, synthetic construct
  misc_feature 1..20: note = CRISPR gRNA sequence
  source 1..20: mol_type = other DNA
catccccaaccagctgatgc

SEQ ID NO: 43116 - DNA, 20 bp, synthetic construct
  misc_feature 1..20: note = CRISPR gRNA sequence
  source 1..20: mol_type = other DNA
aaccagctgatgcgggattg

SEQ ID NO: 43117 - DNA, 20 bp, synthetic construct
  misc_feature 1..20: note = CRISPR gRNA sequence
  source 1..20: mol_type = other DNA
gatgcgggattgcagctgcc

SEQ ID NO: 43118 - DNA, 20 bp, synthetic construct
  misc_feature 1..20: note = CRISPR gRNA sequence
  source 1..20: mol_type = other DNA
gattgcagctgcctggctcc

SEQ ID NO: 43119 - DNA, 20 bp, synthetic construct
  misc_feature 1..20: note = CRISPR gRNA sequence
  source 1..20: mol_type = other DNA
aattcttctgacccaatctg

SEQ ID NO: 43120 - DNA, 20 bp, synthetic construct
  misc_feature 1..20: note = CRISPR gRNA sequence
  source 1..20: mol_type = other DNA
caatctgtggaacataaatg

SEQ ID NO: 43121 - DNA, 20 bp, synthetic construct
  misc_feature 1..20: note = CRISPR gRNA sequence
  source 1..20: mol_type = other DNA
atctgtggaacataaatgtg

SEQ ID NO: 43122 - DNA, 20 bp, synthetic construct
  misc_feature 1..20: note = CRISPR gRNA sequence
  source 1..20: mol_type = other DNA
taaatgtggagatgtccctg

SEQ ID NO: 43123 - DNA, 20 bp, synthetic construct
  misc_feature 1..20: note = CRISPR gRNA sequence
  source 1..20: mol_type = other DNA
atgtggagatgtccctgtgg

SEQ ID NO: 43124 - DNA, 20 bp, synthetic construct
  misc_feature 1..20: note = CRISPR gRNA sequence
  source 1..20: mol_type = other DNA
tgtggagatgtccctgtggc

SEQ ID NO: 43125 - DNA, 20 bp, synthetic construct
  misc_feature 1..20: note = CRISPR gRNA sequence
  source 1..20: mol_type = other DNA
gagatgtccctgtggcaggc

SEQ ID NO: 43126 - DNA, 20 bp, synthetic construct
  misc_feature 1..20: note = CRISPR gRNA sequence
  source 1..20: mol_type = other DNA
agatgtccctgtggcaggca

SEQ ID NO: 43127 - DNA, 20 bp, synthetic construct
  misc_feature 1..20: note = CRISPR gRNA sequence
  source 1..20: mol_type = other DNA
gatgtccctgtggcaggcaa

SEQ ID NO: 43128 - DNA, 20 bp, synthetic construct
  misc_feature 1..20: note = CRISPR gRNA sequence
  source 1..20: mol_type = other DNA
atgtccctgtggcaggcaag

SEQ ID NO: 43129 - DNA, 20 bp, synthetic construct
  misc_feature 1..20: note = CRISPR gRNA sequence
  source 1..20: mol_type = other DNA
ctgtggcaggcaaggggcct

SEQ ID NO: 43130 - DNA, 20 bp, synthetic construct
  misc_feature 1..20: note = CRISPR gRNA sequence
  source 1..20: mol_type = other DNA
tgtggcaggcaaggggcctt

SEQ ID NO: 43131 - DNA, 20 bp, synthetic construct
  misc_feature 1..20: note = CRISPR gRNA sequence
  source 1..20: mol_type = other DNA
ggcaggcaaggggccttagg

SEQ ID NO: 43132 - DNA, 20 bp, synthetic construct
  misc_feature 1..20: note = CRISPR gRNA sequence
  source 1..20: mol_type = other DNA
gccttaggaagtcatccaca

SEQ ID NO: 43133 - DNA, 20 bp, synthetic construct
  misc_feature 1..20: note = CRISPR gRNA sequence
  source 1..20: mol_type = other DNA
ccatctctcccgtgacctgc

SEQ ID NO: 43134 - DNA, 20 bp, synthetic construct
  misc_feature 1..20: note = CRISPR gRNA sequence
  source 1..20: mol_type = other DNA
atctctcccgtgacctgctg

SEQ ID NO: 43135 - DNA, 20 bp, synthetic construct
  misc_feature 1..20: note = CRISPR gRNA sequence
  source 1..20: mol_type = other DNA
cccgtgacctgctggagtga

SEQ ID NO: 43136 - DNA, 20 bp, synthetic construct
  misc_feature 1..20: note = CRISPR gRNA sequence
  source 1..20: mol_type = other DNA
tgacctgctggagtgacagc

SEQ ID NO: 43137 - DNA, 20 bp, synthetic construct
  misc_feature 1..20: note = CRISPR gRNA sequence
  source 1..20: mol_type = other DNA
gctggagtgacagccagctc

SEQ ID NO: 43138 - DNA, 20 bp, synthetic construct
  misc_feature 1..20: note = CRISPR gRNA sequence
  source 1..20: mol_type = other DNA
ctggagtgacagccagctcc

SEQ ID NO: 43139 - DNA, 20 bp, synthetic construct
  misc_feature 1..20: note = CRISPR gRNA sequence
  source 1..20: mol_type = other DNA
tccaggacaccacttgttgc

SEQ ID NO: 43140 - DNA, 20 bp, synthetic construct
  misc_feature 1..20: note = CRISPR gRNA sequence
  source 1..20: mol_type = other DNA
ccaggacaccacttgttgct

SEQ ID NO: 43141 - DNA, 20 bp, synthetic construct
  misc_feature 1..20: note = CRISPR gRNA sequence
  source 1..20: mol_type = other DNA
ccacttgttgctaggcaact

SEQ ID NO: 43142 - DNA, 20 bp, synthetic construct
  misc_feature 1..20: note = CRISPR gRNA sequence
  source 1..20: mol_type = other DNA
aggcaactgagcttcgtgct

SEQ ID NO: 43143 - DNA, 20 bp, synthetic construct
  misc_feature 1..20: note = CRISPR gRNA sequence
  source 1..20: mol_type = other DNA
ggcaactgagcttcgtgctc

SEQ ID NO: 43144 - DNA, 20 bp, synthetic construct
  misc_feature 1..20: note = CRISPR gRNA sequence
  source 1..20: mol_type = other DNA
caactgagcttcgtgctcgg

SEQ ID NO: 43145 - DNA, 20 bp, synthetic construct
  misc_feature 1..20: note = CRISPR gRNA sequence
  source 1..20: mol_type = other DNA
tcgggagtccttgacccatg

SEQ ID NO: 43146 - DNA, 20 bp, synthetic construct
  misc_feature 1..20: note = CRISPR gRNA sequence
  source 1..20: mol_type = other DNA
cgggagtccttgacccatgc

SEQ ID NO: 43147 - DNA, 20 bp, synthetic construct
  misc_feature 1..20: note = CRISPR gRNA sequence
  source 1..20: mol_type = other DNA
gggagtccttgacccatgcg

SEQ ID NO: 43148 - DNA, 20 bp, synthetic construct
  misc_feature 1..20: note = CRISPR gRNA sequence
  source 1..20: mol_type = other DNA
gtccttgacccatgcggggc

SEQ ID NO: 43149 - DNA, 20 bp, synthetic construct
  misc_feature 1..20: note = CRISPR gRNA sequence
  source 1..20: mol_type = other DNA
ccttgacccatgcggggcta

SEQ ID NO: 43150 - DNA, 20 bp, synthetic construct
  misc_feature 1..20: note = CRISPR gRNA sequence
  source 1..20: mol_type = other DNA
ccatgcggggctagagctgc

SEQ ID NO: 43151 - DNA, 20 bp, synthetic construct
  misc_feature 1..20: note = CRISPR gRNA sequence
  source 1..20: mol_type = other DNA
cggggctagagctgccagcc

SEQ ID NO: 43152 - DNA, 20 bp, synthetic construct
  misc_feature 1..20: note = CRISPR gRNA sequence
  source 1..20: mol_type = other DNA
agctgccagcctggccttgc

SEQ ID NO: 43153 - DNA, 20 bp, synthetic construct
  misc_feature 1..20: note = CRISPR gRNA sequence
  source 1..20: mol_type = other DNA
agcctggccttgccagtgcc

SEQ ID NO: 43154 - DNA, 20 bp, synthetic construct
  misc_feature 1..20: note = CRISPR gRNA sequence
  source 1..20: mol_type = other DNA
ccttgccagtgcccagaccc

SEQ ID NO: 43155 - DNA, 20 bp, synthetic construct
  misc_feature 1..20: note = CRISPR gRNA sequence
  source 1..20: mol_type = other DNA
agtgcccagaccccagacca

SEQ ID NO: 43156 - DNA, 20 bp, synthetic construct
  misc_feature 1..20: note = CRISPR gRNA sequence
  source 1..20: mol_type = other DNA
gtgcccagaccccagaccac

SEQ ID NO: 43157 - DNA, 20 bp, synthetic construct
  misc_feature 1..20: note = CRISPR gRNA sequence
  source 1..20: mol_type = other DNA
tgcccagaccccagaccaca

SEQ ID NO: 43158 - DNA, 20 bp, synthetic construct
  misc_feature 1..20: note = CRISPR gRNA sequence
  source 1..20: mol_type = other DNA
gcccagaccccagaccacag

SEQ ID NO: 43159 - DNA, 20 bp, synthetic construct
  misc_feature 1..20: note = CRISPR gRNA sequence
  source 1..20: mol_type = other DNA
cagaccccagaccacagggg

SEQ ID NO: 43160 - DNA, 20 bp, synthetic construct
  misc_feature 1..20: note = CRISPR gRNA sequence
  source 1..20: mol_type = other DNA
accccagaccacaggggcag

SEQ ID NO: 43161 - DNA, 20 bp, synthetic construct
  misc_feature 1..20: note = CRISPR gRNA sequence
  source 1..20: mol_type = other DNA
ccccagaccacaggggcagc

SEQ ID NO: 43162 - DNA, 20 bp, synthetic construct
  misc_feature 1..20: note = CRISPR gRNA sequence
  source 1..20: mol_type = other DNA
cagaccacaggggcagcggg

SEQ ID NO: 43163 - DNA, 20 bp, synthetic construct
  misc_feature 1..20: note = CRISPR gRNA sequence
  source 1..20: mol_type = other DNA
agaccacaggggcagcgggc

SEQ ID NO: 43164 - DNA, 20 bp, synthetic construct
  misc_feature 1..20: note = CRISPR gRNA sequence
  source 1..20: mol_type = other DNA
gaccacaggggcagcgggca

SEQ ID NO: 43165 - DNA, 20 bp, synthetic construct
  misc_feature 1..20: note = CRISPR gRNA sequence
  source 1..20: mol_type = other DNA
acaggggcagcgggcagggt

SEQ ID NO: 43166 - DNA, 20 bp, synthetic construct
  misc_feature 1..20: note = CRISPR gRNA sequence
  source 1..20: mol_type = other DNA
ggcagcgggcagggtgagtg

SEQ ID NO: 43167 - DNA, 20 bp, synthetic construct
  misc_feature 1..20: note = CRISPR gRNA sequence
  source 1..20: mol_type = other DNA
gcagggtgagtgcagcgctc

SEQ ID NO: 43168 - DNA, 20 bp, synthetic construct
  misc_feature 1..20: note = CRISPR gRNA sequence
  source 1..20: mol_type = other DNA
cagggtgagtgcagcgctca

SEQ ID NO: 43169 - DNA, 20 bp, synthetic construct
  misc_feature 1..20: note = CRISPR gRNA sequence
  source 1..20: mol_type = other DNA
gagtgcagcgctcaaggact

SEQ ID NO: 43170 - DNA, 20 bp, synthetic construct
  misc_feature 1..20: note = CRISPR gRNA sequence
  source 1..20: mol_type = other DNA
agtgcagcgctcaaggactc

SEQ ID NO: 43171 - DNA, 20 bp, synthetic construct
  misc_feature 1..20: note = CRISPR gRNA sequence
  source 1..20: mol_type = other DNA
gtgcagcgctcaaggactca

SEQ ID NO: 43172 - DNA, 20 bp, synthetic construct
  misc_feature 1..20: note = CRISPR gRNA sequence
  source 1..20: mol_type = other DNA
gcgctcaaggactcagggtc

SEQ ID NO: 43173 - DNA, 20 bp, synthetic construct
  misc_feature 1..20: note = CRISPR gRNA sequence
  source 1..20: mol_type = other DNA
aaggactcagggtctggtgc

SEQ ID NO: 43174 - DNA, 20 bp, synthetic construct
  misc_feature 1..20: note = CRISPR gRNA sequence
  source 1..20: mol_type = other DNA
tggtgccagttctgcctgtg

SEQ ID NO: 43175 - DNA, 20 bp, synthetic construct
  misc_feature 1..20: note = CRISPR gRNA sequence
  source 1..20: mol_type = other DNA
ggtgccagttctgcctgtgt

SEQ ID NO: 43176 - DNA, 20 bp, synthetic construct
  misc_feature 1..20: note = CRISPR gRNA sequence
  source 1..20: mol_type = other DNA
gtgccagttctgcctgtgtg

SEQ ID NO: 43177 - DNA, 20 bp, synthetic construct
  misc_feature 1..20: note = CRISPR gRNA sequence
  source 1..20: mol_type = other DNA
cagttctgcctgtgtgggga

SEQ ID NO: 43178 - DNA, 20 bp, synthetic construct
  misc_feature 1..20: note = CRISPR gRNA sequence
  source 1..20: mol_type = other DNA
gtgtggggatggtatccttc

SEQ ID NO: 43179 - DNA, 20 bp, synthetic construct
  misc_feature 1..20: note = CRISPR gRNA sequence
  source 1..20: mol_type = other DNA
tgtggggatggtatccttct

SEQ ID NO: 43180 - DNA, 20 bp, synthetic construct
  misc_feature 1..20: note = CRISPR gRNA sequence
  source 1..20: mol_type = other DNA
gatggtatccttctgggcct

SEQ ID NO: 43181 - DNA, 20 bp, synthetic construct
  misc_feature 1..20: note = CRISPR gRNA sequence
  source 1..20: mol_type = other DNA
tgggcctcagtgtgtccatc

SEQ ID NO: 43182 - DNA, 20 bp, synthetic construct
  misc_feature 1..20: note = CRISPR gRNA sequence
  source 1..20: mol_type = other DNA
ggcctcagtgtgtccatctg

SEQ ID NO: 43183 - DNA, 20 bp, synthetic construct
  misc_feature 1..20: note = CRISPR gRNA sequence
  source 1..20: mol_type = other DNA
cagtgtgtccatctggagaa

SEQ ID NO: 43184 - DNA, 20 bp, synthetic construct
  misc_feature 1..20: note = CRISPR gRNA sequence
  source 1..20: mol_type = other DNA
ccatctggagaatagatgct

SEQ ID NO: 43185 - DNA, 20 bp, synthetic construct
  misc_feature 1..20: note = CRISPR gRNA sequence
  source 1..20: mol_type = other DNA
ggagaatagatgcttagaca

SEQ ID NO: 43186 - DNA, 20 bp, synthetic construct
  misc_feature 1..20: note = CRISPR gRNA sequence
  source 1..20: mol_type = other DNA
agaatagatgcttagacatg

SEQ ID NO: 43187 - DNA, 20 bp, synthetic construct
  misc_feature 1..20: note = CRISPR gRNA sequence
  source 1..20: mol_type = other DNA
gaatagatgcttagacatgg

SEQ ID NO: 43188 - DNA, 20 bp, synthetic construct
  misc_feature 1..20: note = CRISPR gRNA sequence
  source 1..20: mol_type = other DNA
gacatggaggcttctcttct

SEQ ID NO: 43189 - DNA, 20 bp, synthetic construct
  misc_feature 1..20: note = CRISPR gRNA sequence
  source 1..20: mol_type = other DNA
gcttctcttcttggaaatga

SEQ ID NO: 43190 - DNA, 20 bp, synthetic construct
  misc_feature 1..20: note = CRISPR gRNA sequence
  source 1..20: mol_type = other DNA
ctcttcttggaaatgacagc

SEQ ID NO: 43191 - DNA, 20 bp, synthetic construct
  misc_feature 1..20: note = CRISPR gRNA sequence
  source 1..20: mol_type = other DNA
ttcttggaaatgacagctgg

SEQ ID NO: 43192 - DNA, 20 bp, synthetic construct
  misc_feature 1..20: note = CRISPR gRNA sequence
  source 1..20: mol_type = other DNA
tcttggaaatgacagctgga

SEQ ID NO: 43193 - DNA, 20 bp, synthetic construct
  misc_feature 1..20: note = CRISPR gRNA sequence
  source 1..20: mol_type = other DNA
cttggaaatgacagctggaa

SEQ ID NO: 43194 - DNA, 20 bp, synthetic construct
  misc_feature 1..20: note = CRISPR gRNA sequence
  source 1..20: mol_type = other DNA
tggaaatgacagctggaagg

SEQ ID NO: 43195 - DNA, 20 bp, synthetic construct
  misc_feature 1..20: note = CRISPR gRNA sequence
  source 1..20: mol_type = other DNA
aatgacagctggaagggaga

SEQ ID NO: 43196 - DNA, 20 bp, synthetic construct
  misc_feature 1..20: note = CRISPR gRNA sequence
  source 1..20: mol_type = other DNA
tgacagctggaagggagatg

SEQ ID NO: 43197 - DNA, 20 bp, synthetic construct
  misc_feature 1..20: note = CRISPR gRNA sequence
  source 1..20: mol_type = other DNA
gacagctggaagggagatgg

SEQ ID NO: 43198 - DNA, 20 bp, synthetic construct
  misc_feature 1..20: note = CRISPR gRNA sequence
  source 1..20: mol_type = other DNA
acagctggaagggagatgga

SEQ ID NO: 43199 - DNA, 20 bp, synthetic construct
  misc_feature 1..20: note = CRISPR gRNA sequence
  source 1..20: mol_type = other DNA
cagctggaagggagatggag

SEQ ID NO: 43200 - DNA, 20 bp, synthetic construct
  misc_feature 1..20: note = CRISPR gRNA sequence
  source 1..20: mol_type = other DNA
agctggaagggagatggagg

SEQ ID NO: 43201 - DNA, 20 bp, synthetic construct
  misc_feature 1..20: note = CRISPR gRNA sequence
  source 1..20: mol_type = other DNA
ggaagggagatggagggggc

SEQ ID NO: 43202 - DNA, 20 bp, synthetic construct
  misc_feature 1..20: note = CRISPR gRNA sequence
  source 1..20: mol_type = other DNA
gaagggagatggagggggct

SEQ ID NO: 43203 - DNA, 20 bp, synthetic construct
  misc_feature 1..20: note = CRISPR gRNA sequence
  source 1..20: mol_type = other DNA
gggagatggagggggctggg

SEQ ID NO: 43204 - DNA, 20 bp, synthetic construct
  misc_feature 1..20: note = CRISPR gRNA sequence
  source 1..20: mol_type = other DNA
ggagatggagggggctgggc

SEQ ID NO: 43205 - DNA, 20 bp, synthetic construct
  misc_feature 1..20: note = CRISPR gRNA sequence
  source 1..20: mol_type = other DNA
gagatggagggggctgggca

SEQ ID NO: 43206 - DNA, 20 bp, synthetic construct
  misc_feature 1..20: note = CRISPR gRNA sequence
  source 1..20: mol_type = other DNA
agggggctgggcagggctcc

SEQ ID NO: 43207 - DNA, 20 bp, synthetic construct
  misc_feature 1..20: note = CRISPR gRNA sequence
  source 1..20: mol_type = other DNA
gggggctgggcagggctcca

SEQ ID NO: 43208 - DNA, 20 bp, synthetic construct
  misc_feature 1..20: note = CRISPR gRNA sequence
  source 1..20: mol_type = other DNA
gggctgggcagggctccaag

SEQ ID NO: 43209 - DNA, 20 bp, synthetic construct
  misc_feature 1..20: note = CRISPR gRNA sequence
  source 1..20: mol_type = other DNA
ggctgggcagggctccaagg

SEQ ID NO: 43210 - DNA, 20 bp, synthetic construct
  misc_feature 1..20: note = CRISPR gRNA sequence
  source 1..20: mol_type = other DNA
tctcatctccatttcccttc

SEQ ID NO: 43211 - DNA, 20 bp, synthetic construct
  misc_feature 1..20: note = CRISPR gRNA sequence
  source 1..20: mol_type = other DNA
ctccatttcccttctagtct

SEQ ID NO: 43212 - DNA, 20 bp, synthetic construct
  misc_feature 1..20: note = CRISPR gRNA sequence
  source 1..20: mol_type = other DNA
ccttctagtctgagtcacaa

SEQ ID NO: 43213 - DNA, 20 bp, synthetic construct
  misc_feature 1..20: note = CRISPR gRNA sequence
  source 1..20: mol_type = other DNA
tgagtcacaacagcatttct

SEQ ID NO: 43214 - DNA, 20 bp, synthetic construct
  misc_feature 1..20: note = CRISPR gRNA sequence
  source 1..20: mol_type = other DNA
gagtcacaacagcatttctc

SEQ ID NO: 43215 - DNA, 20 bp, synthetic construct
  misc_feature 1..20: note = CRISPR gRNA sequence
  source 1..20: mol_type = other DNA
cacaacagcatttctcagga

SEQ ID NO: 43216 - DNA, 20 bp, synthetic construct
  misc_feature 1..20: note = CRISPR gRNA sequence
  source 1..20: mol_type = other DNA
ggaaagtgccctgtacctgc

SEQ ID NO: 43217 - DNA, 20 bp, synthetic construct
  misc_feature 1..20: note = CRISPR gRNA sequence
  source 1..20: mol_type = other DNA
aaagtgccctgtacctgctg

SEQ ID NO: 43218 - DNA, 20 bp, synthetic construct
  misc_feature 1..20: note = CRISPR gRNA sequence
  source 1..20: mol_type = other DNA
tgccctcctgcccacgtgtc

SEQ ID NO: 43219 - DNA, 20 bp, synthetic construct
  misc_feature 1..20: note = CRISPR gRNA sequence
  source 1..20: mol_type = other DNA
gccctcctgcccacgtgtcc

SEQ ID NO: 43220 - DNA, 20 bp, synthetic construct
  misc_feature 1..20: note = CRISPR gRNA sequence
  source 1..20: mol_type = other DNA
cctcctgcccacgtgtccgg

SEQ ID NO: 43221 - DNA, 20 bp, synthetic construct
  misc_feature 1..20: note = CRISPR gRNA sequence
  source 1..20: mol_type = other DNA
ctcctgcccacgtgtccggg

SEQ ID NO: 43222 - DNA, 20 bp, synthetic construct
  misc_feature 1..20: note = CRISPR gRNA sequence
  source 1..20: mol_type = other DNA
cccacgtgtccgggaggcct

SEQ ID NO: 43223 - DNA, 20 bp, synthetic construct
  misc_feature 1..20: note = CRISPR gRNA sequence
  source 1..20: mol_type = other DNA
gtgtccgggaggcctcagtg

SEQ ID NO: 43224 - DNA, 20 bp, synthetic construct
  misc_feature 1..20: note = CRISPR gRNA sequence
  source 1..20: mol_type = other DNA
ccgggaggcctcagtgaagt

SEQ ID NO: 43225 - DNA, 20 bp, synthetic construct
  misc_feature 1..20: note = CRISPR gRNA sequence
  source 1..20: mol_type = other DNA
cgggaggcctcagtgaagta

SEQ ID NO: 43226 - DNA, 20 bp, synthetic construct
  misc_feature 1..20: note = CRISPR gRNA sequence
  source 1..20: mol_type = other DNA
gggaggcctcagtgaagtaa

SEQ ID NO: 43227 - DNA, 20 bp, synthetic construct
  misc_feature 1..20: note = CRISPR gRNA sequence
  source 1..20: mol_type = other DNA
ggaggcctcagtgaagtaag

SEQ ID NO: 43228 - DNA, 20 bp, synthetic construct
  misc_feature 1..20: note = CRISPR gRNA sequence
  source 1..20: mol_type = other DNA
tcagtgaagtaaggggatgt

SEQ ID NO: 43229 - DNA, 20 bp, synthetic construct
  misc_feature 1..20: note = CRISPR gRNA sequence
  source 1..20: mol_type = other DNA
aggggatgttggtccccgaa

SEQ ID NO: 43230 - DNA, 20 bp, synthetic construct
  misc_feature 1..20: note = CRISPR gRNA sequence
  source 1..20: mol_type = other DNA
cccgaaaagcccctttctgc

SEQ ID NO: 43231 - DNA, 20 bp, synthetic construct
  misc_feature 1..20: note = CRISPR gRNA sequence
  source 1..20: mol_type = other DNA
agcccctttctgctggccaa

SEQ ID NO: 43232 - DNA, 20 bp, synthetic construct
  misc_feature 1..20: note = CRISPR gRNA sequence
  source 1..20: mol_type = other DNA
gcccctttctgctggccaac

SEQ ID NO: 43233 - DNA, 20 bp, synthetic construct
  misc_feature 1..20: note = CRISPR gRNA sequence
  source 1..20: mol_type = other DNA
tgctggccaacaggtgcccc

SEQ ID NO: 43234 - DNA, 20 bp, synthetic construct
  misc_feature 1..20: note = CRISPR gRNA sequence
  source 1..20: mol_type = other DNA
caggtgcccctggctgatga

SEQ ID NO: 43235 - DNA, 20 bp, synthetic construct
  misc_feature 1..20: note = CRISPR gRNA sequence
  source 1..20: mol_type = other DNA
aggtgcccctggctgatgat

SEQ ID NO: 43236 - DNA, 20 bp, synthetic construct
  misc_feature 1..20: note = CRISPR gRNA sequence
  source 1..20: mol_type = other DNA
gtgcccctggctgatgatgg

SEQ ID NO: 43237 - DNA, 20 bp, synthetic construct
  misc_feature 1..20: note = CRISPR gRNA sequence
  source 1..20: mol_type = other DNA
cccctggctgatgatgggag

SEQ ID NO: 43238 - DNA, 20 bp, synthetic construct
  misc_feature 1..20: note = CRISPR gRNA sequence
  source 1..20: mol_type = other DNA
tggctgatgatgggagaagc

SEQ ID NO: 43239 - DNA, 20 bp, synthetic construct
  misc_feature 1..20: note = CRISPR gRNA sequence
  source 1..20: mol_type = other DNA
ggctgatgatgggagaagca

SEQ ID NO: 43240 - DNA, 20 bp, synthetic construct
  misc_feature 1..20: note = CRISPR gRNA sequence
  source 1..20: mol_type = other DNA
agcaaggcacccacactttg

SEQ ID NO: 43241 - DNA, 20 bp, synthetic construct
  misc_feature 1..20: note = CRISPR gRNA sequence
  source 1..20: mol_type = other DNA
acactttgtggccttccatc

SEQ ID NO: 43242 - DNA, 20 bp, synthetic construct
  misc_feature 1..20: note = CRISPR gRNA sequence
  source 1..20: mol_type = other DNA
cactttgtggccttccatct

SEQ ID NO: 43243 - DNA, 20 bp, synthetic construct
  misc_feature 1..20: note = CRISPR gRNA sequence
  source 1..20: mol_type = other DNA
tttgtggccttccatctggg

SEQ ID NO: 43244 - DNA, 20 bp, synthetic construct
  misc_feature 1..20: note = CRISPR gRNA sequence
  source 1..20: mol_type = other DNA
ggccttccatctgggtggct

SEQ ID NO: 43245 - DNA, 20 bp, synthetic construct
  misc_feature 1..20: note = CRISPR gRNA sequence
  source 1..20: mol_type = other DNA
ccttccatctgggtggcttg

SEQ ID NO: 43246 - DNA, 20 bp, synthetic construct
  misc_feature 1..20: note = CRISPR gRNA sequence
  source 1..20: mol_type = other DNA
ctctgcctttctctgaatct

SEQ ID NO: 43247 - DNA, 20 bp, synthetic construct
  misc_feature 1..20: note = CRISPR gRNA sequence
  source 1..20: mol_type = other DNA
tctgcctttctctgaatctc

SEQ ID NO: 43248 - DNA, 20 bp, synthetic construct
  misc_feature 1..20: note = CRISPR gRNA sequence
  source 1..20: mol_type = other DNA
ctgcctttctctgaatctca

SEQ ID NO: 43249 - DNA, 20 bp, synthetic construct
  misc_feature 1..20: note = CRISPR gRNA sequence
  source 1..20: mol_type = other DNA
ctctgaatctcagggtttcc

SEQ ID NO: 43250 - DNA, 20 bp, synthetic construct
  misc_feature 1..20: note = CRISPR gRNA sequence
  source 1..20: mol_type = other DNA
tctgaatctcagggtttcct

SEQ ID NO: 43251 - DNA, 20 bp, synthetic construct
  misc_feature 1..20: note = CRISPR gRNA sequence
  source 1..20: mol_type = other DNA
atctcagggtttcctgggca

SEQ ID NO: 43252 - DNA, 20 bp, synthetic construct
  misc_feature 1..20: note = CRISPR gRNA sequence
  source 1..20: mol_type = other DNA
tctcagggtttcctgggcat

SEQ ID NO: 43253 - DNA, 20 bp, synthetic construct
  misc_feature 1..20: note = CRISPR gRNA sequence
  source 1..20: mol_type = other DNA
aatttctatcccctgatgcc

SEQ ID NO: 43254 - DNA, 20 bp, synthetic construct
  misc_feature 1..20: note = CRISPR gRNA sequence
  source 1..20: mol_type = other DNA
atttctatcccctgatgccc

SEQ ID NO: 43255 - DNA, 20 bp, synthetic construct
  misc_feature 1..20: note = CRISPR gRNA sequence
  source 1..20: mol_type = other DNA
cccctgatgcccgggtgcca

SEQ ID NO: 43256 - DNA, 20 bp, synthetic construct
  misc_feature 1..20: note = CRISPR gRNA sequence
  source 1..20: mol_type = other DNA
ccctgatgcccgggtgccat

SEQ ID NO: 43257 - DNA, 20 bp, synthetic construct
  misc_feature 1..20: note = CRISPR gRNA sequence
  source 1..20: mol_type = other DNA
cctgatgcccgggtgccatg

SEQ ID NO: 43258 - DNA, 20 bp, synthetic construct
  misc_feature 1..20: note = CRISPR gRNA sequence
  source 1..20: mol_type = other DNA
cccgggtgccatggggacca

SEQ ID NO: 43259 - DNA, 20 bp, synthetic construct
  misc_feature 1..20: note = CRISPR gRNA sequence
  source 1..20: mol_type = other DNA
cgggtgccatggggaccatg

SEQ ID NO: 43260 - DNA, 20 bp, synthetic construct
  misc_feature 1..20: note = CRISPR gRNA sequence
  source 1..20: mol_type = other DNA
gggtgccatggggaccatgg

SEQ ID NO: 43261 - DNA, 20 bp, synthetic construct
  misc_feature 1..20: note = CRISPR gRNA sequence
  source 1..20: mol_type = other DNA
catggggaccatggaggcca

SEQ ID NO: 43262 - DNA, 20 bp, synthetic construct
  misc_feature 1..20: note = CRISPR gRNA sequence
  source 1..20: mol_type = other DNA
atggggaccatggaggccat

SEQ ID NO: 43263 - DNA, 20 bp, synthetic construct
  misc_feature 1..20: note = CRISPR gRNA sequence
  source 1..20: mol_type = other DNA
tggggaccatggaggccatg

SEQ ID NO: 43264 - DNA, 20 bp, synthetic construct
  misc_feature 1..20: note = CRISPR gRNA sequence
  source 1..20: mol_type = other DNA
ggaccatggaggccatgggg

SEQ ID NO: 43265 - DNA, 20 bp, synthetic construct
  misc_feature 1..20: note = CRISPR gRNA sequence
  source 1..20: mol_type = other DNA
gaccatggaggccatggggt

SEQ ID NO: 43266 - DNA, 20 bp, synthetic construct
  misc_feature 1..20: note = CRISPR gRNA sequence
  source 1..20: mol_type = other DNA
catggaggccatggggtggg

SEQ ID NO: 43267 - DNA, 20 bp, synthetic construct
  misc_feature 1..20: note = CRISPR gRNA sequence
  source 1..20: mol_type = other DNA
atggaggccatggggtggga

SEQ ID NO: 43268 - DNA, 20 bp, synthetic construct
  misc_feature 1..20: note = CRISPR gRNA sequence
  source 1..20: mol_type = other DNA
aggccatggggtgggaaggc

SEQ ID NO: 43269 - DNA, 20 bp, synthetic construct
  misc_feature 1..20: note = CRISPR gRNA sequence
  source 1..20: mol_type = other DNA
ggccatggggtgggaaggcc

SEQ ID NO: 43270 - DNA, 20 bp, synthetic construct
  misc_feature 1..20: note = CRISPR gRNA sequence
  source 1..20: mol_type = other DNA
gccaggtattgccatgctca

SEQ ID NO: 43271 - DNA, 20 bp, synthetic construct
  misc_feature 1..20: note = CRISPR gRNA sequence
  source 1..20: mol_type = other DNA
tattgccatgctcacagaat

SEQ ID NO: 43272 - DNA, 20 bp, synthetic construct
  misc_feature 1..20: note = CRISPR gRNA sequence
  source 1..20: mol_type = other DNA
ccatgctcacagaatgagtt

SEQ ID NO: 43273 - DNA, 20 bp, synthetic construct
  misc_feature 1..20: note = CRISPR gRNA sequence
  source 1..20: mol_type = other DNA
catgctcacagaatgagttt

SEQ ID NO: 43274 - DNA, 20 bp, synthetic construct
  misc_feature 1..20: note = CRISPR gRNA sequence
  source 1..20: mol_type = other DNA
atgctcacagaatgagtttg

SEQ ID NO: 43275 - DNA, 20 bp, synthetic construct
  misc_feature 1..20: note = CRISPR gRNA sequence
  source 1..20: mol_type = other DNA
tgctcacagaatgagtttgg

SEQ ID NO: 43276 - DNA, 20 bp, synthetic construct
  misc_feature 1..20: note = CRISPR gRNA sequence
  source 1..20: mol_type = other DNA
atgagtttgggggtctcctc

SEQ ID NO: 43277 - DNA, 20 bp, synthetic construct
  misc_feature 1..20: note = CRISPR gRNA sequence
  source 1..20: mol_type = other DNA
tgggggtctcctctggttct

SEQ ID NO: 43278 - DNA, 20 bp, synthetic construct
  misc_feature 1..20: note = CRISPR gRNA sequence
  source 1..20: mol_type = other DNA
gggggtctcctctggttctg

SEQ ID NO: 43279 - DNA, 20 bp, synthetic construct
  misc_feature 1..20: note = CRISPR gRNA sequence
  source 1..20: mol_type = other DNA
tccatcctcccttgtccttg

SEQ ID NO: 43280 - DNA, 20 bp, synthetic construct
  misc_feature 1..20: note = CRISPR gRNA sequence
  source 1..20: mol_type = other DNA
ccatcctcccttgtccttgt

SEQ ID NO: 43281 - DNA, 20 bp, synthetic construct
  misc_feature 1..20: note = CRISPR gRNA sequence
  source 1..20: mol_type = other DNA
ctcccttgtccttgtgggtg

SEQ ID NO: 43282 - DNA, 20 bp, synthetic construct
  misc_feature 1..20: note = CRISPR gRNA sequence
  source 1..20: mol_type = other DNA
gcttccctctctgtgccctg

SEQ ID NO: 43283 - DNA, 20 bp, synthetic construct
  misc_feature 1..20: note = CRISPR gRNA sequence
  source 1..20: mol_type = other DNA
cttccctctctgtgccctgt

SEQ ID NO: 43284 - DNA, 20 bp, synthetic construct
  misc_feature 1..20: note = CRISPR gRNA sequence
  source 1..20: mol_type = other DNA
tctgtgccctgtgggtgccc

SEQ ID NO: 43285 - DNA, 20 bp, synthetic construct
  misc_feature 1..20: note = CRISPR gRNA sequence
  source 1..20: mol_type = other DNA
ctgtgccctgtgggtgccct

SEQ ID NO: 43286 - DNA, 20 bp, synthetic construct
  misc_feature 1..20: note = CRISPR gRNA sequence
  source 1..20: mol_type = other DNA
ctgtgggtgccctaggtgcc

SEQ ID NO: 43287 - DNA, 20 bp, synthetic construct
  misc_feature 1..20: note = CRISPR gRNA sequence
  source 1..20: mol_type = other DNA
tgtgggtgccctaggtgcct

SEQ ID NO: 43288 - DNA, 20 bp, synthetic construct
  misc_feature 1..20: note = CRISPR gRNA sequence
  source 1..20: mol_type = other DNA
gggtgccctaggtgcctagg

SEQ ID NO: 43289 - DNA, 20 bp, synthetic construct
  misc_feature 1..20: note = CRISPR gRNA sequence
  source 1..20: mol_type = other DNA
gccctaggtgcctaggaagc

SEQ ID NO: 43290 - DNA, 20 bp, synthetic construct
  misc_feature 1..20: note = CRISPR gRNA sequence
  source 1..20: mol_type = other DNA
gcctaggaagctggcatgtc

SEQ ID NO: 43291 - DNA, 20 bp, synthetic construct
  misc_feature 1..20: note = CRISPR gRNA sequence
  source 1..20: mol_type = other DNA
cctaggaagctggcatgtct

SEQ ID NO: 43292 - DNA, 20 bp, synthetic construct
  misc_feature 1..20: note = CRISPR gRNA sequence
  source 1..20: mol_type = other DNA
gtctgggcaccgtgcttccc

SEQ ID NO: 43293 - DNA, 20 bp, synthetic construct
  misc_feature 1..20: note = CRISPR gRNA sequence
  source 1..20: mol_type = other DNA
tctgggcaccgtgcttcccc

SEQ ID NO: 43294 - DNA, 20 bp, synthetic construct
  misc_feature 1..20: note = CRISPR gRNA sequence
  source 1..20: mol_type = other DNA
tccccaggcccttctctctg

SEQ ID NO: 43295 - DNA, 20 bp, synthetic construct
  misc_feature 1..20: note = CRISPR gRNA sequence
  source 1..20: mol_type = other DNA
aggcccttctctctgcagcc

SEQ ID NO: 43296 - DNA, 20 bp, synthetic construct
  misc_feature 1..20: note = CRISPR gRNA sequence
  source 1..20: mol_type = other DNA
ggcccttctctctgcagcct

SEQ ID NO: 43297 - DNA, 20 bp, synthetic construct
  misc_feature 1..20: note = CRISPR gRNA sequence
  source 1..20: mol_type = other DNA
ctctctgcagcctgggctct

SEQ ID NO: 43298 - DNA, 20 bp, synthetic construct
  misc_feature 1..20: note = CRISPR gRNA sequence
  source 1..20: mol_type = other DNA
tctgcagcctgggctctgag

SEQ ID NO: 43299 - DNA, 20 bp, synthetic construct
  misc_feature 1..20: note = CRISPR gRNA sequence
  source 1..20: mol_type = other DNA
tgcagcctgggctctgagca

SEQ ID NO: 43300 - DNA, 20 bp, synthetic construct
  misc_feature 1..20: note = CRISPR gRNA sequence
  source 1..20: mol_type = other DNA
tgggctctgagcagagcttc

SEQ ID NO: 43301 - DNA, 20 bp, synthetic construct
  misc_feature 1..20: note = CRISPR gRNA sequence
  source 1..20: mol_type = other DNA
agcttccggattcacttctc

SEQ ID NO: 43302 - DNA, 20 bp, synthetic construct
  misc_feature 1..20: note = CRISPR gRNA sequence
  source 1..20: mol_type = other DNA
cttccggattcacttctcca

SEQ ID NO: 43303 - DNA, 20 bp, synthetic construct
  misc_feature 1..20: note = CRISPR gRNA sequence
  source 1..20: mol_type = other DNA
tccggattcacttctccaga

SEQ ID NO: 43304 - DNA, 20 bp, synthetic construct
  misc_feature 1..20: note = CRISPR gRNA sequence
  source 1..20: mol_type = other DNA
ccggattcacttctccagag

SEQ ID NO: 43305 - DNA, 20 bp, synthetic construct
  misc_feature 1..20: note = CRISPR gRNA sequence
  source 1..20: mol_type = other DNA
ttcacttctccagagaggac

SEQ ID NO: 43306 - DNA, 20 bp, synthetic construct
  misc_feature 1..20: note = CRISPR gRNA sequence
  source 1..20: mol_type = other DNA
tcacttctccagagaggacc

SEQ ID NO: 43307 - DNA, 20 bp, synthetic construct
  misc_feature 1..20: note = CRISPR gRNA sequence
  source 1..20: mol_type = other DNA
ttctccagagaggaccaggc

SEQ ID NO: 43308 - DNA, 20 bp, synthetic construct
  misc_feature 1..20: note = CRISPR gRNA sequence
  source 1..20: mol_type = other DNA
tctccagagaggaccaggct

SEQ ID NO: 43309 - DNA, 20 bp, synthetic construct
  misc_feature 1..20: note = CRISPR gRNA sequence
  source 1..20: mol_type = other DNA
ccagagaggaccaggctggg

SEQ ID NO: 43310 - DNA, 20 bp, synthetic construct
  misc_feature 1..20: note = CRISPR gRNA sequence
  source 1..20: mol_type = other DNA
gaccaggctgggaagacact

SEQ ID NO: 43311 - DNA, 20 bp, synthetic construct
  misc_feature 1..20: note = CRISPR gRNA sequence
  source 1..20: mol_type = other DNA
accaggctgggaagacactc

SEQ ID NO: 43312 - DNA, 20 bp, synthetic construct
  misc_feature 1..20: note = CRISPR gRNA sequence
  source 1..20: mol_type = other DNA
agacactcaggtaatccctg

SEQ ID NO: 43313 - DNA, 20 bp, synthetic construct
  misc_feature 1..20: note = CRISPR gRNA sequence
  source 1..20: mol_type = other DNA
gacactcaggtaatccctgc

SEQ ID NO: 43314 - DNA, 20 bp, synthetic construct
  misc_feature 1..20: note = CRISPR gRNA sequence
  source 1..20: mol_type = other DNA
acactcaggtaatccctgca

SEQ ID NO: 43315 - DNA, 20 bp, synthetic construct
  misc_feature 1..20: note = CRISPR gRNA sequence
  source 1..20: mol_type = other DNA
aggtaatccctgcagggtga

SEQ ID NO: 43316 - DNA, 20 bp, synthetic construct
  misc_feature 1..20: note = CRISPR gRNA sequence
  source 1..20: mol_type = other DNA
ggtaatccctgcagggtgat

SEQ ID NO: 43317 - DNA, 20 bp, synthetic construct
  misc_feature 1..20: note = CRISPR gRNA sequence
  source 1..20: mol_type = other DNA
atccctgcagggtgatggga

SEQ ID NO: 43318 - DNA, 20 bp, synthetic construct
  misc_feature 1..20: note = CRISPR gRNA sequence
  source 1..20: mol_type = other DNA
tccctgcagggtgatgggac

SEQ ID NO: 43319 - DNA, 20 bp, synthetic construct
  misc_feature 1..20: note = CRISPR gRNA sequence
  source 1..20: mol_type = other DNA
ccctgcagggtgatgggaca

SEQ ID NO: 43320 - DNA, 20 bp, synthetic construct
  misc_feature 1..20: note = CRISPR gRNA sequence
  source 1..20: mol_type = other DNA
cctgcagggtgatgggacag

SEQ ID NO: 43321 - DNA, 20 bp, synthetic construct
  misc_feature 1..20: note = CRISPR gRNA sequence
  source 1..20: mol_type = other DNA
cagggtgatgggacagggga

SEQ ID NO: 43322 - DNA, 20 bp, synthetic construct
  misc_feature 1..20: note = CRISPR gRNA sequence
  source 1..20: mol_type = other DNA
gggtgatgggacaggggaca

SEQ ID NO: 43323 - DNA, 20 bp, synthetic construct
  misc_feature 1..20: note = CRISPR gRNA sequence
  source 1..20: mol_type = other DNA
gtgatgggacaggggacaga

SEQ ID NO: 43324 - DNA, 20 bp, synthetic construct
  misc_feature 1..20: note = CRISPR gRNA sequence
  source 1..20: mol_type = other DNA
tgatgggacaggggacagag

SEQ ID NO: 43325 - DNA, 20 bp, synthetic construct
  misc_feature 1..20: note = CRISPR gRNA sequence
  source 1..20: mol_type = other DNA
gatgggacaggggacagaga

SEQ ID NO: 43326 - DNA, 20 bp, synthetic construct
  misc_feature 1..20: note = CRISPR gRNA sequence
  source 1..20: mol_type = other DNA
atgggacaggggacagagag

SEQ ID NO: 43327 - DNA, 20 bp, synthetic construct
  misc_feature 1..20: note = CRISPR gRNA sequence
  source 1..20: mol_type = other DNA
gggacaggggacagagaggg

SEQ ID NO: 43328 - DNA, 20 bp, synthetic construct
  misc_feature 1..20: note = CRISPR gRNA sequence
  source 1..20: mol_type = other DNA
gacaggggacagagagggga

SEQ ID NO: 43329 - DNA, 20 bp, synthetic construct
  misc_feature 1..20: note = CRISPR gRNA sequence
  source 1..20: mol_type = other DNA
acaggggacagagaggggag

SEQ ID NO: 43330 - DNA, 20 bp, synthetic construct
  misc_feature 1..20: note = CRISPR gRNA sequence
  source 1..20: mol_type = other DNA
aggggacagagaggggagag

SEQ ID NO: 43331 - DNA, 20 bp, synthetic construct
  misc_feature 1..20: note = CRISPR gRNA sequence
  source 1..20: mol_type = other DNA
ggggacagagaggggagagg

SEQ ID NO: 43332 - DNA, 20 bp, synthetic construct
  misc_feature 1..20: note = CRISPR gRNA sequence
  source 1..20: mol_type = other DNA
gggagaggaggctgacccta

SEQ ID NO: 43333 - DNA, 20 bp, synthetic construct
  misc_feature 1..20: note = CRISPR gRNA sequence
  source 1..20: mol_type = other DNA
agaggaggctgaccctatgg

SEQ ID NO: 43334 - DNA, 20 bp, synthetic construct
  misc_feature 1..20: note = CRISPR gRNA sequence
  source 1..20: mol_type = other DNA
tgaccctatggcggcctcca

SEQ ID NO: 43335 - DNA, 20 bp, synthetic construct
  misc_feature 1..20: note = CRISPR gRNA sequence
  source 1..20: mol_type = other DNA
ctccatggccccctcttccc

SEQ ID NO: 43336 - DNA, 20 bp, synthetic construct
  misc_feature 1..20: note = CRISPR gRNA sequence
  source 1..20: mol_type = other DNA
tccatggccccctcttccct

SEQ ID NO: 43337 - DNA, 20 bp, synthetic construct
  misc_feature 1..20: note = CRISPR gRNA sequence
  source 1..20: mol_type = other DNA
ccctgggccctctcctcctt

SEQ ID NO: 43338 - DNA, 20 bp, synthetic construct
  misc_feature 1..20: note = CRISPR gRNA sequence
  source 1..20: mol_type = other DNA
ctgggccctctcctccttta

SEQ ID NO: 43339 - DNA, 20 bp, synthetic construct
  misc_feature 1..20: note = CRISPR gRNA sequence
  source 1..20: mol_type = other DNA
gggccctctcctcctttaga

SEQ ID NO: 43340 - DNA, 20 bp, synthetic construct
  misc_feature 1..20: note = CRISPR gRNA sequence
  source 1..20: mol_type = other DNA
ccctctcctcctttagagag

SEQ ID NO: 43341 - DNA, 20 bp, synthetic construct
  misc_feature 1..20: note = CRISPR gRNA sequence
  source 1..20: mol_type = other DNA
ctcctttagagagcagcttc

SEQ ID NO: 43342 - DNA, 20 bp, synthetic construct
  misc_feature 1..20: note = CRISPR gRNA sequence
  source 1..20: mol_type = other DNA
gcagcttcaagctcactgcc

SEQ ID NO: 43343 - DNA, 20 bp, synthetic construct
  misc_feature 1..20: note = CRISPR gRNA sequence
  source 1..20: mol_type = other DNA
cagcttcaagctcactgcct

SEQ ID NO: 43344 - DNA, 20 bp, synthetic construct
  misc_feature 1..20: note = CRISPR gRNA sequence
  source 1..20: mol_type = other DNA
actgcctgggtctgttcctc

SEQ ID NO: 43345 - DNA, 20 bp, synthetic construct
  misc_feature 1..20: note = CRISPR gRNA sequence
  source 1..20: mol_type = other DNA
cagatctgcccccgatgccc

SEQ ID NO: 43346 - DNA, 20 bp, synthetic construct
  misc_feature 1..20: note = CRISPR gRNA sequence
  source 1..20: mol_type = other DNA
ccccgatgccctggtaactc

SEQ ID NO: 43347 - DNA, 20 bp, synthetic construct
  misc_feature 1..20: note = CRISPR gRNA sequence
  source 1..20: mol_type = other DNA
tgccctggtaactccagtct

SEQ ID NO: 43348 - DNA, 20 bp, synthetic construct
  misc_feature 1..20: note = CRISPR gRNA sequence
  source 1..20: mol_type = other DNA
ctggtaactccagtctcagc

SEQ ID NO: 43349 - DNA, 20 bp, synthetic construct
  misc_feature 1..20: note = CRISPR gRNA sequence
  source 1..20: mol_type = other DNA
tggtaactccagtctcagcc

SEQ ID NO: 43350 - DNA, 20 bp, synthetic construct
  misc_feature 1..20: note = CRISPR gRNA sequence
  source 1..20: mol_type = other DNA
ggtaactccagtctcagcca

SEQ ID NO: 43351 - DNA, 20 bp, synthetic construct
  misc_feature 1..20: note = CRISPR gRNA sequence
  source 1..20: mol_type = other DNA
tccagtctcagccagggcct

SEQ ID NO: 43352 - DNA, 20 bp, synthetic construct
  misc_feature 1..20: note = CRISPR gRNA sequence
  source 1..20: mol_type = other DNA
ggcattgaacttgtgcctct

SEQ ID NO: 43353 - DNA, 20 bp, synthetic construct
  misc_feature 1..20: note = CRISPR gRNA sequence
  source 1..20: mol_type = other DNA
gcctcttagcccaccatcct

SEQ ID NO: 43354 - DNA, 20 bp, synthetic construct
  misc_feature 1..20: note = CRISPR gRNA sequence
  source 1..20: mol_type = other DNA
ccaccatcctaagcccaact

SEQ ID NO: 43355 - DNA, 20 bp, synthetic construct
  misc_feature 1..20: note = CRISPR gRNA sequence
  source 1..20: mol_type = other DNA
tccttgccatgtcctgacta

SEQ ID NO: 43356 - DNA, 20 bp, synthetic construct
  misc_feature 1..20: note = CRISPR gRNA sequence
  source 1..20: mol_type = other DNA
ccttgccatgtcctgactac

SEQ ID NO: 43357 - DNA, 20 bp, synthetic construct
  misc_feature 1..20: note = CRISPR gRNA sequence
  source 1..20: mol_type = other DNA
atgtcctgactacaggcctt

SEQ ID NO: 43358 - DNA, 20 bp, synthetic construct
  misc_feature 1..20: note = CRISPR gRNA sequence
  source 1..20: mol_type = other DNA
tgtcctgactacaggccttg

SEQ ID NO: 43359 - DNA, 20 bp, synthetic construct
  misc_feature 1..20: note = CRISPR gRNA sequence
  source 1..20: mol_type = other DNA
ctacaggccttgaggcttct

SEQ ID NO: 43360 - DNA, 20 bp, synthetic construct
  misc_feature 1..20: note = CRISPR gRNA sequence
  source 1..20: mol_type = other DNA
cttgaggcttctgagtgtca

SEQ ID NO: 43361 - DNA, 20 bp, synthetic construct
  misc_feature 1..20: note = CRISPR gRNA sequence
  source 1..20: mol_type = other DNA
gcttctgagtgtcacggtta

SEQ ID NO: 43362 - DNA, 20 bp, synthetic construct
  misc_feature 1..20: note = CRISPR gRNA sequence
  source 1..20: mol_type = other DNA
tgtcacggttaaagattttg

SEQ ID NO: 43363 - DNA, 20 bp, synthetic construct
  misc_feature 1..20: note = CRISPR gRNA sequence
  source 1..20: mol_type = other DNA
atccctgatctgccacttac

SEQ ID NO: 43364 - DNA, 20 bp, synthetic construct
  misc_feature 1..20: note = CRISPR gRNA sequence
  source 1..20: mol_type = other DNA
tctgccacttaccagctatg

SEQ ID NO: 43365 - DNA, 20 bp, synthetic construct
  misc_feature 1..20: note = CRISPR gRNA sequence
  source 1..20: mol_type = other DNA
acttaccagctatgtggccc

SEQ ID NO: 43366 - DNA, 20 bp, synthetic construct
  misc_feature 1..20: note = CRISPR gRNA sequence
  source 1..20: mol_type = other DNA
ccagctatgtggccctggac

SEQ ID NO: 43367 - DNA, 20 bp, synthetic construct
  misc_feature 1..20: note = CRISPR gRNA sequence
  source 1..20: mol_type = other DNA
gtggccctggacaagtaaaa

SEQ ID NO: 43368 - DNA, 20 bp, synthetic construct
  misc_feature 1..20: note = CRISPR gRNA sequence
  source 1..20: mol_type = other DNA
tggccctggacaagtaaaat

SEQ ID NO: 43369 - DNA, 20 bp, synthetic construct
  misc_feature 1..20: note = CRISPR gRNA sequence
  source 1..20: mol_type = other DNA
ggccctggacaagtaaaatg

SEQ ID NO: 43370 - DNA, 20 bp, synthetic construct
  misc_feature 1..20: note = CRISPR gRNA sequence
  source 1..20: mol_type = other DNA
taataacacaacctacccct

SEQ ID NO: 43371 - DNA, 20 bp, synthetic construct
  misc_feature 1..20: note = CRISPR gRNA sequence
  source 1..20: mol_type = other DNA
aataacacaacctacccctt

SEQ ID NO: 43372 - DNA, 20 bp, synthetic construct
  misc_feature 1..20: note = CRISPR gRNA sequence
  source 1..20: mol_type = other DNA
ataacacaacctacccctta

SEQ ID NO: 43373 - DNA, 20 bp, synthetic construct
  misc_feature 1..20: note = CRISPR gRNA sequence
  source 1..20: mol_type = other DNA
ctaccccttagggttattgt

SEQ ID NO: 43374 - DNA, 20 bp, synthetic construct
  misc_feature 1..20: note = CRISPR gRNA sequence
  source 1..20: mol_type = other DNA
taccccttagggttattgtg

SEQ ID NO: 43375 - DNA, 20 bp, synthetic construct
  misc_feature 1..20: note = CRISPR gRNA sequence
  source 1..20: mol_type = other DNA
ggttattgtgaggattaaat

SEQ ID NO: 43376 - DNA, 20 bp, synthetic construct
  misc_feature 1..20: note = CRISPR gRNA sequence
  source 1..20: mol_type = other DNA
tgaggattaaatgagttaat

SEQ ID NO: 43377 - DNA, 20 bp, synthetic construct
  misc_feature 1..20: note = CRISPR gRNA sequence
  source 1..20: mol_type = other DNA
taaatgagttaataagtata

SEQ ID NO: 43378 - DNA, 20 bp, synthetic construct
  misc_feature 1..20: note = CRISPR gRNA sequence
  source 1..20: mol_type = other DNA
agttaataagtataaagtgc

SEQ ID NO: 43379 - DNA, 20 bp, synthetic construct
  misc_feature 1..20: note = CRISPR gRNA sequence
  source 1..20: mol_type = other DNA
gttaataagtataaagtgcc

SEQ ID NO: 43380 - DNA, 20 bp, synthetic construct
  misc_feature 1..20: note = CRISPR gRNA sequence
  source 1..20: mol_type = other DNA
taagtataaagtgccaggaa

SEQ ID NO: 43381 - DNA, 20 bp, synthetic construct
  misc_feature 1..20: note = CRISPR gRNA sequence
  source 1..20: mol_type = other DNA
aagtataaagtgccaggaaa

SEQ ID NO: 43382 - DNA, 20 bp, synthetic construct
  misc_feature 1..20: note = CRISPR gRNA sequence
  source 1..20: mol_type = other DNA
taaagtgccaggaaaaggtc

SEQ ID NO: 43383 - DNA, 20 bp, synthetic construct
  misc_feature 1..20: note = CRISPR gRNA sequence
  source 1..20: mol_type = other DNA
ccaggaaaaggtctggctca

SEQ ID NO: 43384 - DNA, 20 bp, synthetic construct
  misc_feature 1..20: note = CRISPR gRNA sequence
  source 1..20: mol_type = other DNA
caggaaaaggtctggctcat

SEQ ID NO: 43385 - DNA, 20 bp, synthetic construct
  misc_feature 1..20: note = CRISPR gRNA sequence
  source 1..20: mol_type = other DNA
ggaaaaggtctggctcatgg

SEQ ID NO: 43386 - DNA, 20 bp, synthetic construct
  misc_feature 1..20: note = CRISPR gRNA sequence
  source 1..20: mol_type = other DNA
ctggctcatgggagtgctgt

SEQ ID NO: 43387 - DNA, 20 bp, synthetic construct
  misc_feature 1..20: note = CRISPR gRNA sequence
  source 1..20: mol_type = other DNA
gctcatgggagtgctgtcag

SEQ ID NO: 43388 - DNA, 20 bp, synthetic construct
  misc_feature 1..20: note = CRISPR gRNA sequence
  source 1..20: mol_type = other DNA
attatcattatcattacccc

SEQ ID NO: 43389 - DNA, 20 bp, synthetic construct
  misc_feature 1..20: note = CRISPR gRNA sequence
  source 1..20: mol_type = other DNA
atcattatcattacccctgg

SEQ ID NO: 43390 - DNA, 20 bp, synthetic construct
  misc_feature 1..20: note = CRISPR gRNA sequence
  source 1..20: mol_type = other DNA
gtagccctgactcactgcca

SEQ ID NO: 43391 - DNA, 20 bp, synthetic construct
  misc_feature 1..20: note = CRISPR gRNA sequence
  source 1..20: mol_type = other DNA
ccctgactcactgccacggc

SEQ ID NO: 43392 - DNA, 20 bp, synthetic construct
  misc_feature 1..20: note = CRISPR gRNA sequence
  source 1..20: mol_type = other DNA
ttcctttacatgtcttactt

SEQ ID NO: 43393 - DNA, 20 bp, synthetic construct
  misc_feature 1..20: note = CRISPR gRNA sequence
  source 1..20: mol_type = other DNA
tgtcttacttcagctgtgaa

SEQ ID NO: 43394 - DNA, 20 bp, synthetic construct
  misc_feature 1..20: note = CRISPR gRNA sequence
  source 1..20: mol_type = other DNA
gtcttacttcagctgtgaac

SEQ ID NO: 43395 - DNA, 20 bp, synthetic construct
  misc_feature 1..20: note = CRISPR gRNA sequence
  source 1..20: mol_type = other DNA
tcttacttcagctgtgaaca

SEQ ID NO: 43396 - DNA, 20 bp, synthetic construct
  misc_feature 1..20: note = CRISPR gRNA sequence
  source 1..20: mol_type = other DNA
aactgatccctgcatcttat

SEQ ID NO: 43397 - DNA, 20 bp, synthetic construct
  misc_feature 1..20: note = CRISPR gRNA sequence
  source 1..20: mol_type = other DNA
actgatccctgcatcttatc

SEQ ID NO: 43398 - DNA, 20 bp, synthetic construct
  misc_feature 1..20: note = CRISPR gRNA sequence
  source 1..20: mol_type = other DNA
cctcccctccattcactcca

SEQ ID NO: 43399 - DNA, 20 bp, synthetic construct
  misc_feature 1..20: note = CRISPR gRNA sequence
  source 1..20: mol_type = other DNA
tccattcactccacagcccc

SEQ ID NO: 43400 - DNA, 20 bp, synthetic construct
  misc_feature 1..20: note = CRISPR gRNA sequence
  source 1..20: mol_type = other DNA
cattcactccacagccccca

SEQ ID NO: 43401 - DNA, 20 bp, synthetic construct
  misc_feature 1..20: note = CRISPR gRNA sequence
  source 1..20: mol_type = other DNA
attcactccacagcccccag

SEQ ID NO: 43402 - DNA, 20 bp, synthetic construct
  misc_feature 1..20: note = CRISPR gRNA sequence
  source 1..20: mol_type = other DNA
ttcactccacagcccccaga

SEQ ID NO: 43403 - DNA, 20 bp, synthetic construct
  misc_feature 1..20: note = CRISPR gRNA sequence
  source 1..20: mol_type = other DNA
tcttcacaacacacatctga

SEQ ID NO: 43404 - DNA, 20 bp, synthetic construct
  misc_feature 1..20: note = CRISPR gRNA sequence
  source 1..20: mol_type = other DNA
ctctgctactctgtgcccct

SEQ ID NO: 43405 - DNA, 20 bp, synthetic construct
  misc_feature 1..20: note = CRISPR gRNA sequence
  source 1..20: mol_type = other DNA
tgctactctgtgcccctcag

SEQ ID NO: 43406 - DNA, 20 bp, synthetic construct
  misc_feature 1..20: note = CRISPR gRNA sequence
  source 1..20: mol_type = other DNA
cagtggctccccattaaccc

SEQ ID NO: 43407 - DNA, 20 bp, synthetic construct
  misc_feature 1..20: note = CRISPR gRNA sequence
  source 1..20: mol_type = other DNA
agtggctccccattaacccc

SEQ ID NO: 43408 - DNA, 20 bp, synthetic construct
  misc_feature 1..20: note = CRISPR gRNA sequence
  source 1..20: mol_type = other DNA
gtggctccccattaacccca

SEQ ID NO: 43409 - DNA, 20 bp, synthetic construct
  misc_feature 1..20: note = CRISPR gRNA sequence
  source 1..20: mol_type = other DNA
tccccattaaccccagggtg

SEQ ID NO: 43410 - DNA, 20 bp, synthetic construct
  misc_feature 1..20: note = CRISPR gRNA sequence
  source 1..20: mol_type = other DNA
taaccccagggtgaagttca

SEQ ID NO: 43411 - DNA, 20 bp, synthetic construct
  misc_feature 1..20: note = CRISPR gRNA sequence
  source 1..20: mol_type = other DNA
agggtgaagttcaaagtccc

SEQ ID NO: 43412 - DNA, 20 bp, synthetic construct
  misc_feature 1..20: note = CRISPR gRNA sequence
  source 1..20: mol_type = other DNA
ccctagcatcttctccctca

SEQ ID NO: 43413 - DNA, 20 bp, synthetic construct
  misc_feature 1..20: note = CRISPR gRNA sequence
  source 1..20: mol_type = other DNA
acacaccaacccatatacca

SEQ ID NO: 43414 - DNA, 20 bp, synthetic construct
  misc_feature 1..20: note = CRISPR gRNA sequence
  source 1..20: mol_type = other DNA
ccatataccacagatacacc

SEQ ID NO: 43415 - DNA, 20 bp, synthetic construct
  misc_feature 1..20: note = CRISPR gRNA sequence
  source 1..20: mol_type = other DNA
gcacacccaaacacaccaca

SEQ ID NO: 43416 - DNA, 20 bp, synthetic construct
  misc_feature 1..20: note = CRISPR gRNA sequence
  source 1..20: mol_type = other DNA
caaacacaccacacagcacg

SEQ ID NO: 43417 - DNA, 20 bp, synthetic construct
  misc_feature 1..20: note = CRISPR gRNA sequence
  source 1..20: mol_type = other DNA
cacaacacacgcacaccaca

SEQ ID NO: 43418 - DNA, 20 bp, synthetic construct
  misc_feature 1..20: note = CRISPR gRNA sequence
  source 1..20: mol_type = other DNA
aaaccccccacatacatacc

SEQ ID NO: 43419 - DNA, 20 bp, synthetic construct
  misc_feature 1..20: note = CRISPR gRNA sequence
  source 1..20: mol_type = other DNA
tacctggcacattacaaata

SEQ ID NO: 43420 - DNA, 20 bp, synthetic construct
  misc_feature 1..20: note = CRISPR gRNA sequence
  source 1..20: mol_type = other DNA
acaacacacacacacacaca

SEQ ID NO: 43421 - DNA, 20 bp, synthetic construct
  misc_feature 1..20: note = CRISPR gRNA sequence
  source 1..20: mol_type = other DNA
acacacacacacacacagtt

SEQ ID NO: 43422 - DNA, 20 bp, synthetic construct
  misc_feature 1..20: note = CRISPR gRNA sequence
  source 1..20: mol_type = other DNA
taaccttcactatttgctcc

SEQ ID NO: 43423 - DNA, 20 bp, synthetic construct
  misc_feature 1..20: note = CRISPR gRNA sequence
  source 1..20: mol_type = other DNA
tcactatttgctcctagatc

SEQ ID NO: 43424 - DNA, 20 bp, synthetic construct
  misc_feature 1..20: note = CRISPR gRNA sequence
  source 1..20: mol_type = other DNA
cctagatcaagccctgcctg

SEQ ID NO: 43425 - DNA, 20 bp, synthetic construct
  misc_feature 1..20: note = CRISPR gRNA sequence
  source 1..20: mol_type = other DNA
gcctctgctcacaccgcact

SEQ ID NO: 43426 - DNA, 20 bp, synthetic construct
  misc_feature 1..20: note = CRISPR gRNA sequence
  source 1..20: mol_type = other DNA
ttctcttccttgccttttct

SEQ ID NO: 43427 - DNA, 20 bp, synthetic construct
  misc_feature 1..20: note = CRISPR gRNA sequence
  source 1..20: mol_type = other DNA
tctcccaatcctttaacacc

SEQ ID NO: 43428 - DNA, 20 bp, synthetic construct
  misc_feature 1..20: note = CRISPR gRNA sequence
  source 1..20: mol_type = other DNA
ttaacacccagctcaaacat

SEQ ID NO: 43429 - DNA, 20 bp, synthetic construct
  misc_feature 1..20: note = CRISPR gRNA sequence
  source 1..20: mol_type = other DNA
gctcaaacatcagcccctcc

SEQ ID NO: 43430 - DNA, 20 bp, synthetic construct
  misc_feature 1..20: note = CRISPR gRNA sequence
  source 1..20: mol_type = other DNA
caaacatcagcccctcctgg

SEQ ID NO: 43431 - DNA, 20 bp, synthetic construct
  misc_feature 1..20: note = CRISPR gRNA sequence
  source 1..20: mol_type = other DNA
agcccctcctggaagtatcc

SEQ ID NO: 43432 - DNA, 20 bp, synthetic construct
  misc_feature 1..20: note = CRISPR gRNA sequence
  source 1..20: mol_type = other DNA
ccctcctggaagtatcccag

SEQ ID NO: 43433 - DNA, 20 bp, synthetic construct
  misc_feature 1..20: note = CRISPR gRNA sequence
  source 1..20: mol_type = other DNA
tcccagcagccctgcctcat

SEQ ID NO: 43434 - DNA, 20 bp, synthetic construct
  misc_feature 1..20: note = CRISPR gRNA sequence
  source 1..20: mol_type = other DNA
ccagcagccctgcctcatca

SEQ ID NO: 43435 - DNA, 20 bp, synthetic construct
  misc_feature 1..20: note = CRISPR gRNA sequence
  source 1..20: mol_type = other DNA
tcatcagagtgaactgcccc

SEQ ID NO: 43436 - DNA, 20 bp, synthetic construct
  misc_feature 1..20: note = CRISPR gRNA sequence
  source 1..20: mol_type = other DNA
catcagagtgaactgccccg

SEQ ID NO: 43437 - DNA, 20 bp, synthetic construct
  misc_feature 1..20: note = CRISPR gRNA sequence
  source 1..20: mol_type = other DNA
tgaactgccccgaggttcac

SEQ ID NO: 43438 - DNA, 20 bp, synthetic construct
  misc_feature 1..20: note = CRISPR gRNA sequence
  source 1..20: mol_type = other DNA
gaactgccccgaggttcact

SEQ ID NO: 43439 - DNA, 20 bp, synthetic construct
  misc_feature 1..20: note = CRISPR gRNA sequence
  source 1..20: mol_type = other DNA
gttcactgggccctttcact

SEQ ID NO: 43440 - DNA, 20 bp, synthetic construct
  misc_feature 1..20: note = CRISPR gRNA sequence
  source 1..20: mol_type = other DNA
actgggccctttcacttggc

SEQ ID NO: 43441 - DNA, 20 bp, synthetic construct
  misc_feature 1..20: note = CRISPR gRNA sequence
  source 1..20: mol_type = other DNA
ctgggccctttcacttggct

SEQ ID NO: 43442 - DNA, 20 bp, synthetic construct
  misc_feature 1..20: note = CRISPR gRNA sequence
  source 1..20: mol_type = other DNA
acttggctgggcccgtctgc

SEQ ID NO: 43443 - DNA, 20 bp, synthetic construct
  misc_feature 1..20: note = CRISPR gRNA sequence
  source 1..20: mol_type = other DNA
gggcccgtctgctggccacc

SEQ ID NO: 43444 - DNA, 20 bp, synthetic construct
  misc_feature 1..20: note = CRISPR gRNA sequence
  source 1..20: mol_type = other DNA
ggcccgtctgctggccaccc

SEQ ID NO: 43445 - DNA, 20 bp, synthetic construct
  misc_feature 1..20: note = CRISPR gRNA sequence
  source 1..20: mol_type = other DNA
gcccgtctgctggccaccca

SEQ ID NO: 43446 - DNA, 20 bp, synthetic construct
  misc_feature 1..20: note = CRISPR gRNA sequence
  source 1..20: mol_type = other DNA
tctgctggccacccagggct

SEQ ID NO: 43447 - DNA, 20 bp, synthetic construct
  misc_feature 1..20: note = CRISPR gRNA sequence
  source 1..20: mol_type = other DNA
ccacccagggctgagatgcc

SEQ ID NO: 43448 - DNA, 20 bp, synthetic construct
  misc_feature 1..20: note = CRISPR gRNA sequence
  source 1..20: mol_type = other DNA
ccagggctgagatgcctgga

SEQ ID NO: 43449 - DNA, 20 bp, synthetic construct
  misc_feature 1..20: note = CRISPR gRNA sequence
  source 1..20: mol_type = other DNA
gggctgagatgcctggacag

SEQ ID NO: 43450 - DNA, 20 bp, synthetic construct
  misc_feature 1..20: note = CRISPR gRNA sequence
  source 1..20: mol_type = other DNA
gctgagatgcctggacagca

SEQ ID NO: 43451 - DNA, 20 bp, synthetic construct
  misc_feature 1..20: note = CRISPR gRNA sequence
  source 1..20: mol_type = other DNA
gcctggacagcagagcccca

SEQ ID NO: 43452 - DNA, 20 bp, synthetic construct
  misc_feature 1..20: note = CRISPR gRNA sequence
  source 1..20: mol_type = other DNA
ctggacagcagagccccacg

SEQ ID NO: 43453 - DNA, 20 bp, synthetic construct
  misc_feature 1..20: note = CRISPR gRNA sequence
  source 1..20: mol_type = other DNA
cagagccccacggagaatcc

SEQ ID NO: 43454 - DNA, 20 bp, synthetic construct
  misc_feature 1..20: note = CRISPR gRNA sequence
  source 1..20: mol_type = other DNA
agagccccacggagaatccc

SEQ ID NO: 43455 - DNA, 20 bp, synthetic construct
  misc_feature 1..20: note = CRISPR gRNA sequence
  source 1..20: mol_type = other DNA
cccaggcacacctccctccc

SEQ ID NO: 43456 - DNA, 20 bp, synthetic construct
  misc_feature 1..20: note = CRISPR gRNA sequence
  source 1..20: mol_type = other DNA
ccaggcacacctccctcccc

SEQ ID NO: 43457 - DNA, 20 bp, synthetic construct
  misc_feature 1..20: note = CRISPR gRNA sequence
  source 1..20: mol_type = other DNA
caggcacacctccctcccca

SEQ ID NO: 43458 - DNA, 20 bp, synthetic construct
  misc_feature 1..20: note = CRISPR gRNA sequence
  source 1..20: mol_type = other DNA
ggcacacctccctccccagg

SEQ ID NO: 43459 - DNA, 20 bp, synthetic construct
  misc_feature 1..20: note = CRISPR gRNA sequence
  source 1..20: mol_type = other DNA
acctccctccccagggagct

SEQ ID NO: 43460 - DNA, 20 bp, synthetic construct
  misc_feature 1..20: note = CRISPR gRNA sequence
  source 1..20: mol_type = other DNA
ccctccccagggagctcagc

SEQ ID NO: 43461 - DNA, 20 bp, synthetic construct
  misc_feature 1..20: note = CRISPR gRNA sequence
  source 1..20: mol_type = other DNA
ccagggagctcagccagtgc

SEQ ID NO: 43462 - DNA, 20 bp, synthetic construct
  misc_feature 1..20: note = CRISPR gRNA sequence
  source 1..20: mol_type = other DNA
gagctcagccagtgctggtc

SEQ ID NO: 43463 - DNA, 20 bp, synthetic construct
  misc_feature 1..20: note = CRISPR gRNA sequence
  source 1..20: mol_type = other DNA
agctcagccagtgctggtcc

SEQ ID NO: 43464 - DNA, 20 bp, synthetic construct
  misc_feature 1..20: note = CRISPR gRNA sequence
  source 1..20: mol_type = other DNA
ctcagccagtgctggtccgg

SEQ ID NO: 43465 - DNA, 20 bp, synthetic construct
  misc_feature 1..20: note = CRISPR gRNA sequence
  source 1..20: mol_type = other DNA
cagccagtgctggtccggga

SEQ ID NO: 43466 - DNA, 20 bp, synthetic construct
  misc_feature 1..20: note = CRISPR gRNA sequence
  source 1..20: mol_type = other DNA
cagtgctggtccgggagagt

SEQ ID NO: 43467 - DNA, 20 bp, synthetic construct
  misc_feature 1..20: note = CRISPR gRNA sequence
  source 1..20: mol_type = other DNA
agtgctggtccgggagagta

SEQ ID NO: 43468 - DNA, 20 bp, synthetic construct
  misc_feature 1..20: note = CRISPR gRNA sequence
  source 1..20: mol_type = other DNA
gctggtccgggagagtaagg

SEQ ID NO: 43469 - DNA, 20 bp, synthetic construct
  misc_feature 1..20: note = CRISPR gRNA sequence
  source 1..20: mol_type = other DNA
ggtccgggagagtaaggcag

SEQ ID NO: 43470 - DNA, 20 bp, synthetic construct
  misc_feature 1..20: note = CRISPR gRNA sequence
  source 1..20: mol_type = other DNA
gggagagtaaggcagtggtt

SEQ ID NO: 43471 - DNA, 20 bp, synthetic construct
  misc_feature 1..20: note = CRISPR gRNA sequence
  source 1..20: mol_type = other DNA
gagagtaaggcagtggttaa

SEQ ID NO: 43472 - DNA, 20 bp, synthetic construct
  misc_feature 1..20: note = CRISPR gRNA sequence
  source 1..20: mol_type = other DNA
taaggcagtggttaagagct

SEQ ID NO: 43473 - DNA, 20 bp, synthetic construct
  misc_feature 1..20: note = CRISPR gRNA sequence
  source 1..20: mol_type = other DNA
aaggcagtggttaagagctt

SEQ ID NO: 43474 - DNA, 20 bp, synthetic construct
  misc_feature 1..20: note = CRISPR gRNA sequence
  source 1..20: mol_type = other DNA
aggcagtggttaagagcttg

SEQ ID NO: 43475 - DNA, 20 bp, synthetic construct
  misc_feature 1..20: note = CRISPR gRNA sequence
  source 1..20: mol_type = other DNA
ggttaagagcttggggtctg

SEQ ID NO: 43476 - DNA, 20 bp, synthetic construct
  misc_feature 1..20: note = CRISPR gRNA sequence
  source 1..20: mol_type = other DNA
aagagcttggggtctgcagt

SEQ ID NO: 43477 - DNA, 20 bp, synthetic construct
  misc_feature 1..20: note = CRISPR gRNA sequence
  source 1..20: mol_type = other DNA
ggtctgcagtcagactgacc

SEQ ID NO: 43478 - DNA, 20 bp, synthetic construct
  misc_feature 1..20: note = CRISPR gRNA sequence
  source 1..20: mol_type = other DNA
tgcagtcagactgacctgga

SEQ ID NO: 43479 - DNA, 20 bp, synthetic construct
  misc_feature 1..20: note = CRISPR gRNA sequence
  source 1..20: mol_type = other DNA
agactgacctggatggaaac

SEQ ID NO: 43480 - DNA, 20 bp, synthetic construct
  misc_feature 1..20: note = CRISPR gRNA sequence
  source 1..20: mol_type = other DNA
tcttatctgctgtgtgtcct

SEQ ID NO: 43481 - DNA, 20 bp, synthetic construct
  misc_feature 1..20: note = CRISPR gRNA sequence
  source 1..20: mol_type = other DNA
cttatctgctgtgtgtcctt

SEQ ID NO: 43482 - DNA, 20 bp, synthetic construct
  misc_feature 1..20: note = CRISPR gRNA sequence
  source 1..20: mol_type = other DNA
tctgctgtgtgtccttgggt

SEQ ID NO: 43483 - DNA, 20 bp, synthetic construct
  misc_feature 1..20: note = CRISPR gRNA sequence
  source 1..20: mol_type = other DNA
ctgtgtgtccttgggttagt

SEQ ID NO: 43484 - DNA, 20 bp, synthetic construct
  misc_feature 1..20: note = CRISPR gRNA sequence
  source 1..20: mol_type = other DNA
tcagtttccccacctctaat

SEQ ID NO: 43485 - DNA, 20 bp, synthetic construct
  misc_feature 1..20: note = CRISPR gRNA sequence
  source 1..20: mol_type = other DNA
ccacctctaattggtgctat

SEQ ID NO: 43486 - DNA, 20 bp, synthetic construct
  misc_feature 1..20: note = CRISPR gRNA sequence
  source 1..20: mol_type = other DNA
aattggtgctatgagaatta

SEQ ID NO: 43487 - DNA, 20 bp, synthetic construct
  misc_feature 1..20: note = CRISPR gRNA sequence
  source 1..20: mol_type = other DNA
attggtgctatgagaattaa

SEQ ID NO: 43488 - DNA, 20 bp, synthetic construct
  misc_feature 1..20: note = CRISPR gRNA sequence
  source 1..20: mol_type = other DNA
tggtgctatgagaattaaag

SEQ ID NO: 43489 - DNA, 20 bp, synthetic construct
  misc_feature 1..20: note = CRISPR gRNA sequence
  source 1..20: mol_type = other DNA
gagaattaaaggagaccctg

SEQ ID NO: 43490 - DNA, 20 bp, synthetic construct
  misc_feature 1..20: note = CRISPR gRNA sequence
  source 1..20: mol_type = other DNA
agaattaaaggagaccctgc

SEQ ID NO: 43491 - DNA, 20 bp, synthetic construct
  misc_feature 1..20: note = CRISPR gRNA sequence
  source 1..20: mol_type = other DNA
ttaaaggagaccctgcgggt

SEQ ID NO: 43492 - DNA, 20 bp, synthetic construct
  misc_feature 1..20: note = CRISPR gRNA sequence
  source 1..20: mol_type = other DNA
taaaggagaccctgcgggta

SEQ ID NO: 43493 - DNA, 20 bp, synthetic construct
  misc_feature 1..20: note = CRISPR gRNA sequence
  source 1..20: mol_type = other DNA
aggagaccctgcgggtaagg

SEQ ID NO: 43494 - DNA, 20 bp, synthetic construct
  misc_feature 1..20: note = CRISPR gRNA sequence
  source 1..20: mol_type = other DNA
ggagaccctgcgggtaaggc

SEQ ID NO: 43495 - DNA, 20 bp, synthetic construct
  misc_feature 1..20: note = CRISPR gRNA sequence
  source 1..20: mol_type = other DNA
gaccctgcgggtaaggcagg

SEQ ID NO: 43496 - DNA, 20 bp, synthetic construct
  misc_feature 1..20: note = CRISPR gRNA sequence
  source 1..20: mol_type = other DNA
ggcaggaagtcccatgcacc

SEQ ID NO: 43497 - DNA, 20 bp, synthetic construct
  misc_feature 1..20: note = CRISPR gRNA sequence
  source 1..20: mol_type = other DNA
caggaagtcccatgcaccca

SEQ ID NO: 43498 - DNA, 20 bp, synthetic construct
  misc_feature 1..20: note = CRISPR gRNA sequence
  source 1..20: mol_type = other DNA
aggaagtcccatgcacccag

SEQ ID NO: 43499 - DNA, 20 bp, synthetic construct
  misc_feature 1..20: note = CRISPR gRNA sequence
  source 1..20: mol_type = other DNA
agtcccatgcacccagaggc

SEQ ID NO: 43500 - DNA, 20 bp, synthetic construct
  misc_feature 1..20: note = CRISPR gRNA sequence
  source 1..20: mol_type = other DNA
catgcacccagaggctggca

SEQ ID NO: 43501 - DNA, 20 bp, synthetic construct
  misc_feature 1..20: note = CRISPR gRNA sequence
  source 1..20: mol_type = other DNA
ggctggcacagtgcctgacc

SEQ ID NO: 43502 - DNA, 20 bp, synthetic construct
  misc_feature 1..20: note = CRISPR gRNA sequence
  source 1..20: mol_type = other DNA
ctggcacagtgcctgaccta

SEQ ID NO: 43503 - DNA, 20 bp, synthetic construct
  misc_feature 1..20: note = CRISPR gRNA sequence
  source 1..20: mol_type = other DNA
cacagtgcctgacctagagt

SEQ ID NO: 43504 - DNA, 20 bp, synthetic construct
  misc_feature 1..20: note = CRISPR gRNA sequence
  source 1..20: mol_type = other DNA
ttactcctaatactttctta

SEQ ID NO: 43505 - DNA, 20 bp, synthetic construct
  misc_feature 1..20: note = CRISPR gRNA sequence
  source 1..20: mol_type = other DNA
tactcctaatactttcttac

SEQ ID NO: 43506 - DNA, 20 bp, synthetic construct
  misc_feature 1..20: note = CRISPR gRNA sequence
  source 1..20: mol_type = other DNA
actcctaatactttcttaca

SEQ ID NO: 43507 - DNA, 20 bp, synthetic construct
  misc_feature 1..20: note = CRISPR gRNA sequence
  source 1..20: mol_type = other DNA
ctcctaatactttcttacag

SEQ ID NO: 43508 - DNA, 20 bp, synthetic construct
  misc_feature 1..20: note = CRISPR gRNA sequence
  source 1..20: mol_type = other DNA
tcctaatactttcttacagg

SEQ ID NO: 43509 - DNA, 20 bp, synthetic construct
  misc_feature 1..20: note = CRISPR gRNA sequence
  source 1..20: mol_type = other DNA
atactttcttacagggggtg

SEQ ID NO: 43510 - DNA, 20 bp, synthetic construct
  misc_feature 1..20: note = CRISPR gRNA sequence
  source 1..20: mol_type = other DNA
tactttcttacagggggtgt

SEQ ID NO: 43511 - DNA, 20 bp, synthetic construct
  misc_feature 1..20: note = CRISPR gRNA sequence
  source 1..20: mol_type = other DNA
ctttcttacagggggtgtgg

SEQ ID NO: 43512 - DNA, 20 bp, synthetic construct
  misc_feature 1..20: note = CRISPR gRNA sequence
  source 1..20: mol_type = other DNA
tttcttacagggggtgtggg

SEQ ID NO: 43513 - DNA, 20 bp, synthetic construct
  misc_feature 1..20: note = CRISPR gRNA sequence
  source 1..20: mol_type = other DNA
gtgtgggaggttcctcccca

SEQ ID NO: 43514 - DNA, 20 bp, synthetic construct
  misc_feature 1..20: note = CRISPR gRNA sequence
  source 1..20: mol_type = other DNA
gtgggaggttcctccccaaa

SEQ ID NO: 43515 - DNA, 20 bp, synthetic construct
  misc_feature 1..20: note = CRISPR gRNA sequence
  source 1..20: mol_type = other DNA
gaggttcctccccaaagaga

SEQ ID NO: 43516 - DNA, 20 bp, synthetic construct
  misc_feature 1..20: note = CRISPR gRNA sequence
  source 1..20: mol_type = other DNA
aggttcctccccaaagagac

SEQ ID NO: 43517 - DNA, 20 bp, synthetic construct
  misc_feature 1..20: note = CRISPR gRNA sequence
  source 1..20: mol_type = other DNA
ttcctccccaaagagacagg

SEQ ID NO: 43518 - DNA, 20 bp, synthetic construct
  misc_feature 1..20: note = CRISPR gRNA sequence
  source 1..20: mol_type = other DNA
ccaaagagacaggaagctcc

SEQ ID NO: 43519 - DNA, 20 bp, synthetic construct
  misc_feature 1..20: note = CRISPR gRNA sequence
  source 1..20: mol_type = other DNA
aaagagacaggaagctccca

SEQ ID NO: 43520 - DNA, 20 bp, synthetic construct
  misc_feature 1..20: note = CRISPR gRNA sequence
  source 1..20: mol_type = other DNA
gagacaggaagctcccagag

SEQ ID NO: 43521 - DNA, 20 bp, synthetic construct
  misc_feature 1..20: note = CRISPR gRNA sequence
  source 1..20: mol_type = other DNA
agacaggaagctcccagagc

SEQ ID NO: 43522 - DNA, 20 bp, synthetic construct
  misc_feature 1..20: note = CRISPR gRNA sequence
  source 1..20: mol_type = other DNA
acaggaagctcccagagcag

SEQ ID NO: 43523 - DNA, 20 bp, synthetic construct
  misc_feature 1..20: note = CRISPR gRNA sequence
  source 1..20: mol_type = other DNA
cagagcaggagctgcatatt

SEQ ID NO: 43524 - DNA, 20 bp, synthetic construct
  misc_feature 1..20: note = CRISPR gRNA sequence
  source 1..20: mol_type = other DNA
gagctgcatatttggcctct

SEQ ID NO: 43525 - DNA, 20 bp, synthetic construct
  misc_feature 1..20: note = CRISPR gRNA sequence
  source 1..20: mol_type = other DNA
agctgcatatttggcctctc

SEQ ID NO: 43526 - DNA, 20 bp, synthetic construct
  misc_feature 1..20: note = CRISPR gRNA sequence
  source 1..20: mol_type = other DNA
tggcctctcaggccctgctc

SEQ ID NO: 43527 - DNA, 20 bp, synthetic construct
  misc_feature 1..20: note = CRISPR gRNA sequence
  source 1..20: mol_type = other DNA
ggcctctcaggccctgctcc

SEQ ID NO: 43528 - DNA, 20 bp, synthetic construct
  misc_feature 1..20: note = CRISPR gRNA sequence
  source 1..20: mol_type = other DNA
ctgctccaggcctttgccct

SEQ ID NO: 43529 - DNA, 20 bp, synthetic construct
  misc_feature 1..20: note = CRISPR gRNA sequence
  source 1..20: mol_type = other DNA
gctccaggcctttgccctca

SEQ ID NO: 43530 - DNA, 20 bp, synthetic construct
  misc_feature 1..20: note = CRISPR gRNA sequence
  source 1..20: mol_type = other DNA
ctccaggcctttgccctcag

SEQ ID NO: 43531 - DNA, 20 bp, synthetic construct
  misc_feature 1..20: note = CRISPR gRNA sequence
  source 1..20: mol_type = other DNA
caggcctttgccctcagagg

SEQ ID NO: 43532 - DNA, 20 bp, synthetic construct
  misc_feature 1..20: note = CRISPR gRNA sequence
  source 1..20: mol_type = other DNA
aggcctttgccctcagaggt

SEQ ID NO: 43533 - DNA, 20 bp, synthetic construct
  misc_feature 1..20: note = CRISPR gRNA sequence
  source 1..20: mol_type = other DNA
gaggtgggatgctcccccaa

SEQ ID NO: 43534 - DNA, 20 bp, synthetic construct
  misc_feature 1..20: note = CRISPR gRNA sequence
  source 1..20: mol_type = other DNA
aggtgggatgctcccccaat

SEQ ID NO: 43535 - DNA, 20 bp, synthetic construct
  misc_feature 1..20: note = CRISPR gRNA sequence
  source 1..20: mol_type = other DNA
atgctcccccaataggccct

SEQ ID NO: 43536 - DNA, 20 bp, synthetic construct
  misc_feature 1..20: note = CRISPR gRNA sequence
  source 1..20: mol_type = other DNA
tgctcccccaataggccctc

SEQ ID NO: 43537 - DNA, 20 bp, synthetic construct
  misc_feature 1..20: note = CRISPR gRNA sequence
  source 1..20: mol_type = other DNA
gctcccccaataggccctca

SEQ ID NO: 43538 - DNA, 20 bp, synthetic construct
  misc_feature 1..20: note = CRISPR gRNA sequence
  source 1..20: mol_type = other DNA
tcccccaataggccctcagg

SEQ ID NO: 43539 - DNA, 20 bp, synthetic construct
  misc_feature 1..20: note = CRISPR gRNA sequence
  source 1..20: mol_type = other DNA
cccccaataggccctcaggg

SEQ ID NO: 43540 - DNA, 20 bp, synthetic construct
  misc_feature 1..20: note = CRISPR gRNA sequence
  source 1..20: mol_type = other DNA
aataggccctcagggaggct

SEQ ID NO: 43541 - DNA, 20 bp, synthetic construct
  misc_feature 1..20: note = CRISPR gRNA sequence
  source 1..20: mol_type = other DNA
ccctcagggaggctgagatg

SEQ ID NO: 43542 - DNA, 20 bp, synthetic construct
  misc_feature 1..20: note = CRISPR gRNA sequence
  source 1..20: mol_type = other DNA
agggaggctgagatgaagct

SEQ ID NO: 43543 - DNA, 20 bp, synthetic construct
  misc_feature 1..20: note = CRISPR gRNA sequence
  source 1..20: mol_type = other DNA
gaggctgagatgaagctgag

SEQ ID NO: 43544 - DNA, 20 bp, synthetic construct
  misc_feature 1..20: note = CRISPR gRNA sequence
  source 1..20: mol_type = other DNA
gctgagatgaagctgagcag

SEQ ID NO: 43545 - DNA, 20 bp, synthetic construct
  misc_feature 1..20: note = CRISPR gRNA sequence
  source 1..20: mol_type = other DNA
aagctgagcagcagtgccca

SEQ ID NO: 43546 - DNA, 20 bp, synthetic construct
  misc_feature 1..20: note = CRISPR gRNA sequence
  source 1..20: mol_type = other DNA
agctgagcagcagtgcccac

SEQ ID NO: 43547 - DNA, 20 bp, synthetic construct
  misc_feature 1..20: note = CRISPR gRNA sequence
  source 1..20: mol_type = other DNA
cagtgcccacaggcctcacc

SEQ ID NO: 43548 - DNA, 20 bp, synthetic construct
  misc_feature 1..20: note = CRISPR gRNA sequence
  source 1..20: mol_type = other DNA
agtgcccacaggcctcaccc

SEQ ID NO: 43549 - DNA, 20 bp, synthetic construct
  misc_feature 1..20: note = CRISPR gRNA sequence
  source 1..20: mol_type = other DNA
gcctcacccaggctctgccc

SEQ ID NO: 43550 - DNA, 20 bp, synthetic construct
  misc_feature 1..20: note = CRISPR gRNA sequence
  source 1..20: mol_type = other DNA
ctgccctggctttctgccct

SEQ ID NO: 43551 - DNA, 20 bp, synthetic construct
  misc_feature 1..20: note = CRISPR gRNA sequence
  source 1..20: mol_type = other DNA
tgccctggctttctgccctc

SEQ ID NO: 43552 - DNA, 20 bp, synthetic construct
  misc_feature 1..20: note = CRISPR gRNA sequence
  source 1..20: mol_type = other DNA
tggctttctgccctcaggct

SEQ ID NO: 43553 - DNA, 20 bp, synthetic construct
  misc_feature 1..20: note = CRISPR gRNA sequence
  source 1..20: mol_type = other DNA
tttctgccctcaggctaagt

SEQ ID NO: 43554 - DNA, 20 bp, synthetic construct
  misc_feature 1..20: note = CRISPR gRNA sequence
  source 1..20: mol_type = other DNA
gccctcaggctaagtgagtg

SEQ ID NO: 43555 - DNA, 20 bp, synthetic construct
  misc_feature 1..20: note = CRISPR gRNA sequence
  source 1..20: mol_type = other DNA
ggctaagtgagtgcagcttc

SEQ ID NO: 43556 - DNA, 20 bp, synthetic construct
  misc_feature 1..20: note = CRISPR gRNA sequence
  source 1..20: mol_type = other DNA
aagtgagtgcagcttccggc

SEQ ID NO: 43557 - DNA, 20 bp, synthetic construct
  misc_feature 1..20: note = CRISPR gRNA sequence
  source 1..20: mol_type = other DNA
gtgagtgcagcttccggcca

SEQ ID NO: 43558 - DNA, 20 bp, synthetic construct
  misc_feature 1..20: note = CRISPR gRNA sequence
  source 1..20: mol_type = other DNA
ttccggccagagcacgtgtc

SEQ ID NO: 43559 - DNA, 20 bp, synthetic construct
  misc_feature 1..20: note = CRISPR gRNA sequence
  source 1..20: mol_type = other DNA
tccggccagagcacgtgtcc

SEQ ID NO: 43560 - DNA, 20 bp, synthetic construct
  misc_feature 1..20: note = CRISPR gRNA sequence
  source 1..20: mol_type = other DNA
gccagagcacgtgtccaggc

SEQ ID NO: 43561 - DNA, 20 bp, synthetic construct
  misc_feature 1..20: note = CRISPR gRNA sequence
  source 1..20: mol_type = other DNA
cacgtgtccaggctggccac

SEQ ID NO: 43562 - DNA, 20 bp, synthetic construct
  misc_feature 1..20: note = CRISPR gRNA sequence
  source 1..20: mol_type = other DNA
tccaggctggccaccggctt

SEQ ID NO: 43563 - DNA, 20 bp, synthetic construct
  misc_feature 1..20: note = CRISPR gRNA sequence
  source 1..20: mol_type = other DNA
ggctggccaccggcttgagc

SEQ ID NO: 43564 - DNA, 20 bp, synthetic construct
  misc_feature 1..20: note = CRISPR gRNA sequence
  source 1..20: mol_type = other DNA
ccggcttgagcaagtccctg

SEQ ID NO: 43565 - DNA, 20 bp, synthetic construct
  misc_feature 1..20: note = CRISPR gRNA sequence
  source 1..20: mol_type = other DNA
gagcaagtccctgcagctga

SEQ ID NO: 43566 - DNA, 20 bp, synthetic construct
  misc_feature 1..20: note = CRISPR gRNA sequence
  source 1..20: mol_type = other DNA
gcaagtccctgcagctgacg

SEQ ID NO: 43567 - DNA, 20 bp, synthetic construct
  misc_feature 1..20: note = CRISPR gRNA sequence
  source 1..20: mol_type = other DNA
gcagctgacggagctcacgt

SEQ ID NO: 43568 - DNA, 20 bp, synthetic construct
  misc_feature 1..20: note = CRISPR gRNA sequence
  source 1..20: mol_type = other DNA
gctcacgtgagtgacccacc

SEQ ID NO: 43569 - DNA, 20 bp, synthetic construct
  misc_feature 1..20: note = CRISPR gRNA sequence
  source 1..20: mol_type = other DNA
gagtgacccacccagcccgt

SEQ ID NO: 43570 - DNA, 20 bp, synthetic construct
  misc_feature 1..20: note = CRISPR gRNA sequence
  source 1..20: mol_type = other DNA
agtgacccacccagcccgtg

SEQ ID NO: 43571 - DNA, 20 bp, synthetic construct
  misc_feature 1..20: note = CRISPR gRNA sequence
  source 1..20: mol_type = other DNA
acccacccagcccgtgagga

SEQ ID NO: 43572 - DNA, 20 bp, synthetic construct
  misc_feature 1..20: note = CRISPR gRNA sequence
  source 1..20: mol_type = other DNA
cacccagcccgtgaggacag

SEQ ID NO: 43573 - DNA, 20 bp, synthetic construct
  misc_feature 1..20: note = CRISPR gRNA sequence
  source 1..20: mol_type = other DNA
cccagcccgtgaggacagca

SEQ ID NO: 43574 - DNA, 20 bp, synthetic construct
  misc_feature 1..20: note = CRISPR gRNA sequence
  source 1..20: mol_type = other DNA
ccagcccgtgaggacagcag

SEQ ID NO: 43575 - DNA, 20 bp, synthetic construct
  misc_feature 1..20: note = CRISPR gRNA sequence
  source 1..20: mol_type = other DNA
cagcccgtgaggacagcaga

SEQ ID NO: 43576 - DNA, 20 bp, synthetic construct
  misc_feature 1..20: note = CRISPR gRNA sequence
  source 1..20: mol_type = other DNA
agcccgtgaggacagcagag

SEQ ID NO: 43577 - DNA, 20 bp, synthetic construct
  misc_feature 1..20: note = CRISPR gRNA sequence
  source 1..20: mol_type = other DNA
ccgtgaggacagcagagggg

SEQ ID NO: 43578 - DNA, 20 bp, synthetic construct
  misc_feature 1..20: note = CRISPR gRNA sequence
  source 1..20: mol_type = other DNA
cgtgaggacagcagaggggt

SEQ ID NO: 43579 - DNA, 20 bp, synthetic construct
  misc_feature 1..20: note = CRISPR gRNA sequence
  source 1..20: mol_type = other DNA
gtgaggacagcagaggggtg

SEQ ID NO: 43580 - DNA, 20 bp, synthetic construct
  misc_feature 1..20: note = CRISPR gRNA sequence
  source 1..20: mol_type = other DNA
tgaggacagcagaggggtgg

SEQ ID NO: 43581 - DNA, 20 bp, synthetic construct
  misc_feature 1..20: note = CRISPR gRNA sequence
  source 1..20: mol_type = other DNA
gaggggtgggggcaccctgc

SEQ ID NO: 43582 - DNA, 20 bp, synthetic construct
  misc_feature 1..20: note = CRISPR gRNA sequence
  source 1..20: mol_type = other DNA
ggggtgggggcaccctgcca

SEQ ID NO: 43583 - DNA, 20 bp, synthetic construct
  misc_feature 1..20: note = CRISPR gRNA sequence
  source 1..20: mol_type = other DNA
gcaccctgccagagccacct

SEQ ID NO: 43584 - DNA, 20 bp, synthetic construct
  misc_feature 1..20: note = CRISPR gRNA sequence
  source 1..20: mol_type = other DNA
cagtgactgacctctgtctc

SEQ ID NO: 43585 - DNA, 20 bp, synthetic construct
  misc_feature 1..20: note = CRISPR gRNA sequence
  source 1..20: mol_type = other DNA
agtgactgacctctgtctcc

SEQ ID NO: 43586 - DNA, 20 bp, synthetic construct
  misc_feature 1..20: note = CRISPR gRNA sequence
  source 1..20: mol_type = other DNA
cctctgtctccaggctgacc

SEQ ID NO: 43587 - DNA, 20 bp, synthetic construct
  misc_feature 1..20: note = CRISPR gRNA sequence
  source 1..20: mol_type = other DNA
caggctgacccagtgctgcc

SEQ ID NO: 43588 - DNA, 20 bp, synthetic construct
  misc_feature 1..20: note = CRISPR gRNA sequence
  source 1..20: mol_type = other DNA
aggctgacccagtgctgcct

SEQ ID NO: 43589 - DNA, 20 bp, synthetic construct
  misc_feature 1..20: note = CRISPR gRNA sequence
  source 1..20: mol_type = other DNA
tgacccagtgctgcctgggc

SEQ ID NO: 43590 - DNA, 20 bp, synthetic construct
  misc_feature 1..20: note = CRISPR gRNA sequence
  source 1..20: mol_type = other DNA
cccagtgctgcctgggccag

SEQ ID NO: 43591 - DNA, 20 bp, synthetic construct
  misc_feature 1..20: note = CRISPR gRNA sequence
  source 1..20: mol_type = other DNA
agtgctgcctgggccagaag

SEQ ID NO: 43592 - DNA, 20 bp, synthetic construct
  misc_feature 1..20: note = CRISPR gRNA sequence
  source 1..20: mol_type = other DNA
ctgcctgggccagaagcagc

SEQ ID NO: 43593 - DNA, 20 bp, synthetic construct
  misc_feature 1..20: note = CRISPR gRNA sequence
  source 1..20: mol_type = other DNA
aagcagctggccatcctcct

SEQ ID NO: 43594 - DNA, 20 bp, synthetic construct
  misc_feature 1..20: note = CRISPR gRNA sequence
  source 1..20: mol_type = other DNA
gctggccatcctcctgagct

SEQ ID NO: 43595 - DNA, 20 bp, synthetic construct
  misc_feature 1..20: note = CRISPR gRNA sequence
  source 1..20: mol_type = other DNA
ggccatcctcctgagcttgg

SEQ ID NO: 43596 - DNA, 20 bp, synthetic construct
  misc_feature 1..20: note = CRISPR gRNA sequence
  source 1..20: mol_type = other DNA
gccatcctcctgagcttggt

SEQ ID NO: 43597 - DNA, 20 bp, synthetic construct
  misc_feature 1..20: note = CRISPR gRNA sequence
  source 1..20: mol_type = other DNA
ccatcctcctgagcttggtg

SEQ ID NO: 43598 - DNA, 20 bp, synthetic construct
  misc_feature 1..20: note = CRISPR gRNA sequence
  source 1..20: mol_type = other DNA
gagcttggtggggcgacccg

SEQ ID NO: 43599 - DNA, 20 bp, synthetic construct
  misc_feature 1..20: note = CRISPR gRNA sequence
  source 1..20: mol_type = other DNA
agcttggtggggcgacccgc

SEQ ID NO: 43600 - DNA, 20 bp, synthetic construct
  misc_feature 1..20: note = CRISPR gRNA sequence
  source 1..20: mol_type = other DNA
gcttggtggggcgacccgca

SEQ ID NO: 43601 - DNA, 20 bp, synthetic construct
  misc_feature 1..20: note = CRISPR gRNA sequence
  source 1..20: mol_type = other DNA
gggcgacccgcagggctgtt

SEQ ID NO: 43602 - DNA, 20 bp, synthetic construct
  misc_feature 1..20: note = CRISPR gRNA sequence
  source 1..20: mol_type = other DNA
cccgcagggctgttcagcct

SEQ ID NO: 43603 - DNA, 20 bp, synthetic construct
  misc_feature 1..20: note = CRISPR gRNA sequence
  source 1..20: mol_type = other DNA
ccgcagggctgttcagcctc

SEQ ID NO: 43604 - DNA, 20 bp, synthetic construct
  misc_feature 1..20: note = CRISPR gRNA sequence
  source 1..20: mol_type = other DNA
acctcctcccccgctgcctc

SEQ ID NO: 43605 - DNA, 20 bp, synthetic construct
  misc_feature 1..20: note = CRISPR gRNA sequence
  source 1..20: mol_type = other DNA
cctcctcccccgctgcctcc

SEQ ID NO: 43606 - DNA, 20 bp, synthetic construct
  misc_feature 1..20: note = CRISPR gRNA sequence
  source 1..20: mol_type = other DNA
tcctcccccgctgcctccgg

SEQ ID NO: 43607 - DNA, 20 bp, synthetic construct
  misc_feature 1..20: note = CRISPR gRNA sequence
  source 1..20: mol_type = other DNA
cctcccccgctgcctccggg

SEQ ID NO: 43608 - DNA, 20 bp, synthetic construct
  misc_feature 1..20: note = CRISPR gRNA sequence
  source 1..20: mol_type = other DNA
ctcccccgctgcctccggga

SEQ ID NO: 43609 - DNA, 20 bp, synthetic construct
  misc_feature 1..20: note = CRISPR gRNA sequence
  source 1..20: mol_type = other DNA
tcccccgctgcctccgggag

SEQ ID NO: 43610 - DNA, 20 bp, synthetic construct
  misc_feature 1..20: note = CRISPR gRNA sequence
  source 1..20: mol_type = other DNA
gctgcctccgggaggggcca

SEQ ID NO: 43611 - DNA, 20 bp, synthetic construct
  misc_feature 1..20: note = CRISPR gRNA sequence
  source 1..20: mol_type = other DNA
gggaggggccatggcatgaa

SEQ ID NO: 43612 - DNA, 20 bp, synthetic construct
  misc_feature 1..20: note = CRISPR gRNA sequence
  source 1..20: mol_type = other DNA
ggaggggccatggcatgaat

SEQ ID NO: 43613 - DNA, 20 bp, synthetic construct
  misc_feature 1..20: note = CRISPR gRNA sequence
  source 1..20: mol_type = other DNA
aggggccatggcatgaatgg

SEQ ID NO: 43614 - DNA, 20 bp, synthetic construct
  misc_feature 1..20: note = CRISPR gRNA sequence
  source 1..20: mol_type = other DNA
ggccatggcatgaatgggag

SEQ ID NO: 43615 - DNA, 20 bp, synthetic construct
  misc_feature 1..20: note = CRISPR gRNA sequence
  source 1..20: mol_type = other DNA
gccatggcatgaatgggagc

SEQ ID NO: 43616 - DNA, 20 bp, synthetic construct
  misc_feature 1..20: note = CRISPR gRNA sequence
  source 1..20: mol_type = other DNA
ccatggcatgaatgggagca

SEQ ID NO: 43617 - DNA, 20 bp, synthetic construct
  misc_feature 1..20: note = CRISPR gRNA sequence
  source 1..20: mol_type = other DNA
catggcatgaatgggagcag

SEQ ID NO: 43618 - DNA, 20 bp, synthetic construct
  misc_feature 1..20: note = CRISPR gRNA sequence
  source 1..20: mol_type = other DNA
ggcatgaatgggagcagggg

SEQ ID NO: 43619 - DNA, 20 bp, synthetic construct
  misc_feature 1..20: note = CRISPR gRNA sequence
  source 1..20: mol_type = other DNA
gcatgaatgggagcaggggt

SEQ ID NO: 43620 - DNA, 20 bp, synthetic construct
  misc_feature 1..20: note = CRISPR gRNA sequence
  source 1..20: mol_type = other DNA
atgggagcaggggtgggcac

SEQ ID NO: 43621 - DNA, 20 bp, synthetic construct
  misc_feature 1..20: note = CRISPR gRNA sequence
  source 1..20: mol_type = other DNA
gggagcaggggtgggcactg

SEQ ID NO: 43622 - DNA, 20 bp, synthetic construct
  misc_feature 1..20: note = CRISPR gRNA sequence
  source 1..20: mol_type = other DNA
gcaggggtgggcactggagt

SEQ ID NO: 43623 - DNA, 20 bp, synthetic construct
  misc_feature 1..20: note = CRISPR gRNA sequence
  source 1..20: mol_type = other DNA
aggggtgggcactggagtaa

SEQ ID NO: 43624 - DNA, 20 bp, synthetic construct
  misc_feature 1..20: note = CRISPR gRNA sequence
  source 1..20: mol_type = other DNA
ggggtgggcactggagtaag

SEQ ID NO: 43625 - DNA, 20 bp, synthetic construct
  misc_feature 1..20: note = CRISPR gRNA sequence
  source 1..20: mol_type = other DNA
gcactggagtaagaggcccc

SEQ ID NO: 43626 - DNA, 20 bp, synthetic construct
  misc_feature 1..20: note = CRISPR gRNA sequence
  source 1..20: mol_type = other DNA
cactggagtaagaggccccc

SEQ ID NO: 43627 - DNA, 20 bp, synthetic construct
  misc_feature 1..20: note = CRISPR gRNA sequence
  source 1..20: mol_type = other DNA
gtaagaggcccccaggatca

SEQ ID NO: 43628 - DNA, 20 bp, synthetic construct
  misc_feature 1..20: note = CRISPR gRNA sequence
  source 1..20: mol_type = other DNA
ggcccccaggatcatggccc

SEQ ID NO: 43629 - DNA, 20 bp, synthetic construct
  misc_feature 1..20: note = CRISPR gRNA sequence
  source 1..20: mol_type = other DNA
gtacccacaaccctgccatc

SEQ ID NO: 43630 - DNA, 20 bp, synthetic construct
  misc_feature 1..20: note = CRISPR gRNA sequence
  source 1..20: mol_type = other DNA
aaccctgccatctggaccct

SEQ ID NO: 43631 - DNA, 20 bp, synthetic construct
  misc_feature 1..20: note = CRISPR gRNA sequence
  source 1..20: mol_type = other DNA
caaaccctgtccatctgtcc

SEQ ID NO: 43632 - DNA, 20 bp, synthetic construct
  misc_feature 1..20: note = CRISPR gRNA sequence
  source 1..20: mol_type = other DNA
aaccctgtccatctgtccca

SEQ ID NO: 43633 - DNA, 20 bp, synthetic construct
  misc_feature 1..20: note = CRISPR gRNA sequence
  source 1..20: mol_type = other DNA
atctgtcccagagactccac

SEQ ID NO: 43634 - DNA, 20 bp, synthetic construct
  misc_feature 1..20: note = CRISPR gRNA sequence
  source 1..20: mol_type = other DNA
tctgtcccagagactccaca

SEQ ID NO: 43635 - DNA, 20 bp, synthetic construct
  misc_feature 1..20: note = CRISPR gRNA sequence
  source 1..20: mol_type = other DNA
cagagactccacaaggcaca

SEQ ID NO: 43636 - DNA, 20 bp, synthetic construct
  misc_feature 1..20: note = CRISPR gRNA sequence
  source 1..20: mol_type = other DNA
gagactccacaaggcacaca

SEQ ID NO: 43637 - DNA, 20 bp, synthetic construct
  misc_feature 1..20: note = CRISPR gRNA sequence
  source 1..20: mol_type = other DNA
gaaactgtccttccccacac

SEQ ID NO: 43638 - DNA, 20 bp, synthetic construct
  misc_feature 1..20: note = CRISPR gRNA sequence
  source 1..20: mol_type = other DNA
aactgtccttccccacactg

SEQ ID NO: 43639 - DNA, 20 bp, synthetic construct
  misc_feature 1..20: note = CRISPR gRNA sequence
  source 1..20: mol_type = other DNA
actgtccttccccacactgg

SEQ ID NO: 43640 - DNA, 20 bp, synthetic construct
  misc_feature 1..20: note = CRISPR gRNA sequence
  source 1..20: mol_type = other DNA
cacactggaggcctgtgctt

SEQ ID NO: 43641 - DNA, 20 bp, synthetic construct
  misc_feature 1..20: note = CRISPR gRNA sequence
  source 1..20: mol_type = other DNA
acactggaggcctgtgcttt

SEQ ID NO: 43642 - DNA, 20 bp, synthetic construct
  misc_feature 1..20: note = CRISPR gRNA sequence
  source 1..20: mol_type = other DNA
aggcctgtgctttgggattt

SEQ ID NO: 43643 - DNA, 20 bp, synthetic construct
  misc_feature 1..20: note = CRISPR gRNA sequence
  source 1..20: mol_type = other DNA
gctttgggatttaagaaaaa

SEQ ID NO: 43644 - DNA, 20 bp, synthetic construct
  misc_feature 1..20: note = CRISPR gRNA sequence
  source 1..20: mol_type = other DNA
tgggatttaagaaaaaaaga

SEQ ID NO: 43645 - DNA, 20 bp, synthetic construct
  misc_feature 1..20: note = CRISPR gRNA sequence
  source 1..20: mol_type = other DNA
atttaagaaaaaaagaaaga

SEQ ID NO: 43646 - DNA, 20 bp, synthetic construct
  misc_feature 1..20: note = CRISPR gRNA sequence
  source 1..20: mol_type = other DNA
aagaaaaaaagaaagaaaga

SEQ ID NO: 43647 - DNA, 20 bp, synthetic construct
  misc_feature 1..20: note = CRISPR gRNA sequence
  source 1..20: mol_type = other DNA
aaaaaagaaagaaagaaaga

SEQ ID NO: 43648 - DNA, 20 bp, synthetic construct
  misc_feature 1..20: note = CRISPR gRNA sequence
  source 1..20: mol_type = other DNA
aaagaaagaaagaaagaaag

SEQ ID NO: 43649 - DNA, 20 bp, synthetic construct
  misc_feature 1..20: note = CRISPR gRNA sequence
  source 1..20: mol_type = other DNA
aagaaagaaagaaagaaaga

SEQ ID NO: 43650 - DNA, 20 bp, synthetic construct
  misc_feature 1..20: note = CRISPR gRNA sequence
  source 1..20: mol_type = other DNA
gaaagaaagaaagaaggttt

SEQ ID NO: 43651 - DNA, 20 bp, synthetic construct
  misc_feature 1..20: note = CRISPR gRNA sequence
  source 1..20: mol_type = other DNA
aagaaagaaagaaggtttca

SEQ ID NO: 43652 - DNA, 20 bp, synthetic construct
  misc_feature 1..20: note = CRISPR gRNA sequence
  source 1..20: mol_type = other DNA
agaaagaaagaaggtttcag

SEQ ID NO: 43653 - DNA, 20 bp, synthetic construct
  misc_feature 1..20: note = CRISPR gRNA sequence
  source 1..20: mol_type = other DNA
gtttcagaggatactgaact

SEQ ID NO: 43654 - DNA, 20 bp, synthetic construct
  misc_feature 1..20: note = CRISPR gRNA sequence
  source 1..20: mol_type = other DNA
tttcagaggatactgaactg

SEQ ID NO: 43655 - DNA, 20 bp, synthetic construct
  misc_feature 1..20: note = CRISPR gRNA sequence
  source 1..20: mol_type = other DNA
gacaaaaataaactgaaacg

SEQ ID NO: 43656 - DNA, 20 bp, synthetic construct
  misc_feature 1..20: note = CRISPR gRNA sequence
  source 1..20: mol_type = other DNA
tatgatcattttaaaacact

SEQ ID NO: 43657 - DNA, 20 bp, synthetic construct
  misc_feature 1..20: note = CRISPR gRNA sequence
  source 1..20: mol_type = other DNA
cattttaaaacactcagaaa

SEQ ID NO: 43658 - DNA, 20 bp, synthetic construct
  misc_feature 1..20: note = CRISPR gRNA sequence
  source 1..20: mol_type = other DNA
tttaaaacactcagaaaaag

SEQ ID NO: 43659 - DNA, 20 bp, synthetic construct
  misc_feature 1..20: note = CRISPR gRNA sequence
  source 1..20: mol_type = other DNA
ctcagaaaaagaagataccg

SEQ ID NO: 43660 - DNA, 20 bp, synthetic construct
  misc_feature 1..20: note = CRISPR gRNA sequence
  source 1..20: mol_type = other DNA
agaaaaagaagataccgaag

SEQ ID NO: 43661 - DNA, 20 bp, synthetic construct
  misc_feature 1..20: note = CRISPR gRNA sequence
  source 1..20: mol_type = other DNA
aaagaagataccgaagtaga

SEQ ID NO: 43662 - DNA, 20 bp, synthetic construct
  misc_feature 1..20: note = CRISPR gRNA sequence
  source 1..20: mol_type = other DNA
ttttttaaaactcctattcc

SEQ ID NO: 43663 - DNA, 20 bp, synthetic construct
  misc_feature 1..20: note = CRISPR gRNA sequence
  source 1..20: mol_type = other DNA
aaactcctattcccagaacc

SEQ ID NO: 43664 - DNA, 20 bp, synthetic construct
  misc_feature 1..20: note = CRISPR gRNA sequence
  source 1..20: mol_type = other DNA
aactcctattcccagaacct

SEQ ID NO: 43665 - DNA, 20 bp, synthetic construct
  misc_feature 1..20: note = CRISPR gRNA sequence
  source 1..20: mol_type = other DNA
ttcccagaacctaggtttga

SEQ ID NO: 43666 - DNA, 20 bp, synthetic construct
  misc_feature 1..20: note = CRISPR gRNA sequence
  source 1..20: mol_type = other DNA
ttctatttttatttttattt

SEQ ID NO: 43667 - DNA, 20 bp, synthetic construct
  misc_feature 1..20: note = CRISPR gRNA sequence
  source 1..20: mol_type = other DNA
ttttatttttatttcagctg

SEQ ID NO: 43668 - DNA, 20 bp, synthetic construct
  misc_feature 1..20: note = CRISPR gRNA sequence
  source 1..20: mol_type = other DNA
tatttttatttcagctgaag

SEQ ID NO: 43669 - DNA, 20 bp, synthetic construct
  misc_feature 1..20: note = CRISPR gRNA sequence
  source 1..20: mol_type = other DNA
atttcagctgaagcggtttc

SEQ ID NO: 43670 - DNA, 20 bp, synthetic construct
  misc_feature 1..20: note = CRISPR gRNA sequence
  source 1..20: mol_type = other DNA
cagctgaagcggtttcaagt

SEQ ID NO: 43671 - DNA, 20 bp, synthetic construct
  misc_feature 1..20: note = CRISPR gRNA sequence
  source 1..20: mol_type = other DNA
aagcggtttcaagtaagtta

SEQ ID NO: 43672 - DNA, 20 bp, synthetic construct
  misc_feature 1..20: note = CRISPR gRNA sequence
  source 1..20: mol_type = other DNA
ctcctaaatatttcaccgtg

SEQ ID NO: 43673 - DNA, 20 bp, synthetic construct
  misc_feature 1..20: note = CRISPR gRNA sequence
  source 1..20: mol_type = other DNA
accgtgaagctccaaaaaat

SEQ ID NO: 43674 - DNA, 20 bp, synthetic construct
  misc_feature 1..20: note = CRISPR gRNA sequence
  source 1..20: mol_type = other DNA
ccgtgaagctccaaaaaata

SEQ ID NO: 43675 - DNA, 20 bp, synthetic construct
  misc_feature 1..20: note = CRISPR gRNA sequence
  source 1..20: mol_type = other DNA
aaaaataaggacattttttt

SEQ ID NO: 43676 - DNA, 20 bp, synthetic construct
  misc_feature 1..20: note = CRISPR gRNA sequence
  source 1..20: mol_type = other DNA
gacatttttttcagtaatca

SEQ ID NO: 43677 - DNA, 20 bp, synthetic construct
  misc_feature 1..20: note = CRISPR gRNA sequence
  source 1..20: mol_type = other DNA
ttcagtaatcacagttccat

SEQ ID NO: 43678 - DNA, 20 bp, synthetic construct
  misc_feature 1..20: note = CRISPR gRNA sequence
  source 1..20: mol_type = other DNA
tcagtaatcacagttccatc

SEQ ID NO: 43679 - DNA, 20 bp, synthetic construct
  misc_feature 1..20: note = CRISPR gRNA sequence
  source 1..20: mol_type = other DNA
acagttccatcaggacacct

SEQ ID NO: 43680 - DNA, 20 bp, synthetic construct
  misc_feature 1..20: note = CRISPR gRNA sequence
  source 1..20: mol_type = other DNA
atcaggacacctaagaaact

SEQ ID NO: 43681 - DNA, 20 bp, synthetic construct
  misc_feature 1..20: note = CRISPR gRNA sequence
  source 1..20: mol_type = other DNA
ggacacctaagaaactcagt

SEQ ID NO: 43682 - DNA, 20 bp, synthetic construct
  misc_feature 1..20: note = CRISPR gRNA sequence
  source 1..20: mol_type = other DNA
aaactcagttagcgattcct

SEQ ID NO: 43683 - DNA, 20 bp, synthetic construct
  misc_feature 1..20: note = CRISPR gRNA sequence
  source 1..20: mol_type = other DNA
agttagcgattccttagtgt

SEQ ID NO: 43684 - DNA, 20 bp, synthetic construct
  misc_feature 1..20: note = CRISPR gRNA sequence
  source 1..20: mol_type = other DNA
gttagcgattccttagtgtc

SEQ ID NO: 43685 - DNA, 20 bp, synthetic construct
  misc_feature 1..20: note = CRISPR gRNA sequence
  source 1..20: mol_type = other DNA
ccttagtgtcgggtactacc

SEQ ID NO: 43686 - DNA, 20 bp, synthetic construct
  misc_feature 1..20: note = CRISPR gRNA sequence
  source 1..20: mol_type = other DNA
aaaatgtccccattgtcccc

SEQ ID NO: 43687 - DNA, 20 bp, synthetic construct
  misc_feature 1..20: note = CRISPR gRNA sequence
  source 1..20: mol_type = other DNA
gtccccattgtcccccagat

SEQ ID NO: 43688 - DNA, 20 bp, synthetic construct
  misc_feature 1..20: note = CRISPR gRNA sequence
  source 1..20: mol_type = other DNA
ccattgtcccccagataaga

SEQ ID NO: 43689 - DNA, 20 bp, synthetic construct
  misc_feature 1..20: note = CRISPR gRNA sequence
  source 1..20: mol_type = other DNA
tgtcccccagataagacagc

SEQ ID NO: 43690 - DNA, 20 bp, synthetic construct
  misc_feature 1..20: note = CRISPR gRNA sequence
  source 1..20: mol_type = other DNA
cagataagacagctggcttt

SEQ ID NO: 43691 - DNA, 20 bp, synthetic construct
  misc_feature 1..20: note = CRISPR gRNA sequence
  source 1..20: mol_type = other DNA
agataagacagctggctttt

SEQ ID NO: 43692 - DNA, 20 bp, synthetic construct
  misc_feature 1..20: note = CRISPR gRNA sequence
  source 1..20: mol_type = other DNA
gacagctggcttttgggatc

SEQ ID NO: 43693 - DNA, 20 bp, synthetic construct
  misc_feature 1..20: note = CRISPR gRNA sequence
  source 1..20: mol_type = other DNA
acagctggcttttgggatcc

SEQ ID NO: 43694 - DNA, 20 bp, synthetic construct
  misc_feature 1..20: note = CRISPR gRNA sequence
  source 1..20: mol_type = other DNA
gatccaggatctgtcacatc

SEQ ID NO: 43695 - DNA, 20 bp, synthetic construct
  misc_feature 1..20: note = CRISPR gRNA sequence
  source 1..20: mol_type = other DNA
acatctggtctgcatttgca

SEQ ID NO: 43696 - DNA, 20 bp, synthetic construct
  misc_feature 1..20: note = CRISPR gRNA sequence
  source 1..20: mol_type = other DNA
catctggtctgcatttgcac

SEQ ID NO: 43697 - DNA, 20 bp, synthetic construct
  misc_feature 1..20: note = CRISPR gRNA sequence
  source 1..20: mol_type = other DNA
tggtctgcatttgcacggga

SEQ ID NO: 43698 - DNA, 20 bp, synthetic construct
  misc_feature 1..20: note = CRISPR gRNA sequence
  source 1..20: mol_type = other DNA
gcatttgcacgggatggcga

SEQ ID NO: 43699 - DNA, 20 bp, synthetic construct
  misc_feature 1..20: note = CRISPR gRNA sequence
  source 1..20: mol_type = other DNA
cttctgactcttctaacctg

SEQ ID NO: 43700 - DNA, 20 bp, synthetic construct
  misc_feature 1..20: note = CRISPR gRNA sequence
  source 1..20: mol_type = other DNA
ctgcccccatcccctcacca

SEQ ID NO: 43701 - DNA, 20 bp, synthetic construct
  misc_feature 1..20: note = CRISPR gRNA sequence
  source 1..20: mol_type = other DNA
cacagctttctgtttcatgt

SEQ ID NO: 43702 - DNA, 20 bp, synthetic construct
  misc_feature 1..20: note = CRISPR gRNA sequence
  source 1..20: mol_type = other DNA
tcagtgtctgttgacaaaat

SEQ ID NO: 43703 - DNA, 20 bp, synthetic construct
  misc_feature 1..20: note = CRISPR gRNA sequence
  source 1..20: mol_type = other DNA
atcagcaactgtgtgtactg

SEQ ID NO: 43704 - DNA, 20 bp, synthetic construct
  misc_feature 1..20: note = CRISPR gRNA sequence
  source 1..20: mol_type = other DNA
gactgtcctgctcctgactc

SEQ ID NO: 43705 - DNA, 20 bp, synthetic construct
  misc_feature 1..20: note = CRISPR gRNA sequence
  source 1..20: mol_type = other DNA
tgtcctgctcctgactctgg

SEQ ID NO: 43706 - DNA, 20 bp, synthetic construct
  misc_feature 1..20: note = CRISPR gRNA sequence
  source 1..20: mol_type = other DNA
gtggctttctcatgatgtca

SEQ ID NO: 43707 - DNA, 20 bp, synthetic construct
  misc_feature 1..20: note = CRISPR gRNA sequence
  source 1..20: mol_type = other DNA
tcctctaaccccgactttcc

SEQ ID NO: 43708 - DNA, 20 bp, synthetic construct
  misc_feature 1..20: note = CRISPR gRNA sequence
  source 1..20: mol_type = other DNA
accccgactttcctggaaac

SEQ ID NO: 43709 - DNA, 20 bp, synthetic construct
  misc_feature 1..20: note = CRISPR gRNA sequence
  source 1..20: mol_type = other DNA
ctttcctggaaactggacgt

SEQ ID NO: 43710 - DNA, 20 bp, synthetic construct
  misc_feature 1..20: note = CRISPR gRNA sequence
  source 1..20: mol_type = other DNA
gaaactggacgttagatcaa

SEQ ID NO: 43711 - DNA, 20 bp, synthetic construct
  misc_feature 1..20: note = CRISPR gRNA sequence
  source 1..20: mol_type = other DNA
aaactggacgttagatcaaa

SEQ ID NO: 43712 - DNA, 20 bp, synthetic construct
  misc_feature 1..20: note = CRISPR gRNA sequence
  source 1..20: mol_type = other DNA
tcaaaaggctccatgacatt

SEQ ID NO: 43713 - DNA, 20 bp, synthetic construct
  misc_feature 1..20: note = CRISPR gRNA sequence
  source 1..20: mol_type = other DNA
caaaaaacttacgtcaccga

SEQ ID NO: 43714 - DNA, 20 bp, synthetic construct
  misc_feature 1..20: note = CRISPR gRNA sequence
  source 1..20: mol_type = other DNA
aaaaacttacgtcaccgaca

SEQ ID NO: 43715 - DNA, 20 bp, synthetic construct
  misc_feature 1..20: note = CRISPR gRNA sequence
  source 1..20: mol_type = other DNA
gagctgtgcacttctcattg

SEQ ID NO: 43716 - DNA, 20 bp, synthetic construct
  misc_feature 1..20: note = CRISPR gRNA sequence
  source 1..20: mol_type = other DNA
ttctcattgcagcctgtgac

SEQ ID NO: 43717 - DNA, 20 bp, synthetic construct
  misc_feature 1..20: note = CRISPR gRNA sequence
  source 1..20: mol_type = other DNA
tctcattgcagcctgtgaca

SEQ ID NO: 43718 - DNA, 20 bp, synthetic construct
  misc_feature 1..20: note = CRISPR gRNA sequence
  source 1..20: mol_type = other DNA
cagcctgtgacaaggcacct

SEQ ID NO: 43719 - DNA, 20 bp, synthetic construct
  misc_feature 1..20: note = CRISPR gRNA sequence
  source 1..20: mol_type = other DNA
ttgccatcttaatcatttct

SEQ ID NO: 43720 - DNA, 20 bp, synthetic construct
  misc_feature 1..20: note = CRISPR gRNA sequence
  source 1..20: mol_type = other DNA
tcatttctaagtgtaccatt

SEQ ID NO: 43721 - DNA, 20 bp, synthetic construct
  misc_feature 1..20: note = CRISPR gRNA sequence
  source 1..20: mol_type = other DNA
catttctaagtgtaccattc

SEQ ID NO: 43722 - DNA, 20 bp, synthetic construct
  misc_feature 1..20: note = CRISPR gRNA sequence
  source 1..20: mol_type = other DNA
tttctaagtgtaccattcag

SEQ ID NO: 43723 - DNA, 20 bp, synthetic construct
  misc_feature 1..20: note = CRISPR gRNA sequence
  source 1..20: mol_type = other DNA
gtgtaccattcaggagtgtt

SEQ ID NO: 43724 - DNA, 20 bp, synthetic construct
  misc_feature 1..20: note = CRISPR gRNA sequence
  source 1..20: mol_type = other DNA
agtacatccacttttttgta

SEQ ID NO: 43725 - DNA, 20 bp, synthetic construct
  misc_feature 1..20: note = CRISPR gRNA sequence
  source 1..20: mol_type = other DNA
ttttttgtacggccaatctc

SEQ ID NO: 43726 - DNA, 20 bp, synthetic construct
  misc_feature 1..20: note = CRISPR gRNA sequence
  source 1..20: mol_type = other DNA
accccatttcccccctaccc

SEQ ID NO: 43727 - DNA, 20 bp, synthetic construct
  misc_feature 1..20: note = CRISPR gRNA sequence
  source 1..20: mol_type = other DNA
ttcccccctaccccagcccc

SEQ ID NO: 43728 - DNA, 20 bp, synthetic construct
  misc_feature 1..20: note = CRISPR gRNA sequence
  source 1..20: mol_type = other DNA
tgctttctgtctctatgaat

SEQ ID NO: 43729 - DNA, 20 bp, synthetic construct
  misc_feature 1..20: note = CRISPR gRNA sequence
  source 1..20: mol_type = other DNA
atgaattggactgctctaaa

SEQ ID NO: 43730 - DNA, 20 bp, synthetic construct
  misc_feature 1..20: note = CRISPR gRNA sequence
  source 1..20: mol_type = other DNA
ctgctctaaatagtttatat

SEQ ID NO: 43731 - DNA, 20 bp, synthetic construct
  misc_feature 1..20: note = CRISPR gRNA sequence
  source 1..20: mol_type = other DNA
ctctaaatagtttatatgag

SEQ ID NO: 43732 - DNA, 20 bp, synthetic construct
  misc_feature 1..20: note = CRISPR gRNA sequence
  source 1..20: mol_type = other DNA
ctaaatagtttatatgagtg

SEQ ID NO: 43733 - DNA, 20 bp, synthetic construct
  misc_feature 1..20: note = CRISPR gRNA sequence
  source 1..20: mol_type = other DNA
tgtatttgtctttttgtgac

SEQ ID NO: 43734 - DNA, 20 bp, synthetic construct
  misc_feature 1..20: note = CRISPR gRNA sequence
  source 1..20: mol_type = other DNA
ttgtgactggctcatttcat

SEQ ID NO: 43735 - DNA, 20 bp, synthetic construct
  misc_feature 1..20: note = CRISPR gRNA sequence
  source 1..20: mol_type = other DNA
tgtgactggctcatttcatt

SEQ ID NO: 43736 - DNA, 20 bp, synthetic construct
  misc_feature 1..20: note = CRISPR gRNA sequence
  source 1..20: mol_type = other DNA
tcattgggcataatgtcctc

SEQ ID NO: 43737 - DNA, 20 bp, synthetic construct
  misc_feature 1..20: note = CRISPR gRNA sequence
  source 1..20: mol_type = other DNA
cctctggttcattcatgttg

SEQ ID NO: 43738 - DNA, 20 bp, synthetic construct
  misc_feature 1..20: note = CRISPR gRNA sequence
  source 1..20: mol_type = other DNA
tgcagcgtgtgtcactgtgt

SEQ ID NO: 43739 - DNA, 20 bp, synthetic construct
  misc_feature 1..20: note = CRISPR gRNA sequence
  source 1..20: mol_type = other DNA
tttttttttttttttttttt

SEQ ID NO: 43740 - DNA, 20 bp, synthetic construct
  misc_feature 1..20: note = CRISPR gRNA sequence
  source 1..20: mol_type = other DNA
ttttttttttttttttgaga

SEQ ID NO: 43741 - DNA, 20 bp, synthetic construct
  misc_feature 1..20: note = CRISPR gRNA sequence
  source 1..20: mol_type = other DNA
ttttttttttttttgagaca

SEQ ID NO: 43742 - DNA, 20 bp, synthetic construct
  misc_feature 1..20: note = CRISPR gRNA sequence
  source 1..20: mol_type = other DNA
agagtctcactcttgtcacc

SEQ ID NO: 43743 - DNA, 20 bp, synthetic construct
  misc_feature 1..20: note = CRISPR gRNA sequence
  source 1..20: mol_type = other DNA
gagtctcactcttgtcacct

SEQ ID NO: 43744 - DNA, 20 bp, synthetic construct
  misc_feature 1..20: note = CRISPR gRNA sequence
  source 1..20: mol_type = other DNA
ctcactcttgtcacctgggc

SEQ ID NO: 43745 - DNA, 20 bp, synthetic construct
  misc_feature 1..20: note = CRISPR gRNA sequence
  source 1..20: mol_type = other DNA
cactcttgtcacctgggctg

SEQ ID NO: 43746 - DNA, 20 bp, synthetic construct
  misc_feature 1..20: note = CRISPR gRNA sequence
  source 1..20: mol_type = other DNA
tcacctgggctggagtgcac

SEQ ID NO: 43747 - DNA, 20 bp, synthetic construct
  misc_feature 1..20: note = CRISPR gRNA sequence
  source 1..20: mol_type = other DNA
ggagtgcactggctcgatct

SEQ ID NO: 43748 - DNA, 20 bp, synthetic construct
  misc_feature 1..20: note = CRISPR gRNA sequence
  source 1..20: mol_type = other DNA
tcactgcaccctccacctct

SEQ ID NO: 43749 - DNA, 20 bp, synthetic construct
  misc_feature 1..20: note = CRISPR gRNA sequence
  source 1..20: mol_type = other DNA
cactgcaccctccacctctt

SEQ ID NO: 43750 - DNA, 20 bp, synthetic construct
  misc_feature 1..20: note = CRISPR gRNA sequence
  source 1..20: mol_type = other DNA
accctccacctcttgggttc

SEQ ID NO: 43751 - DNA, 20 bp, synthetic construct
  misc_feature 1..20: note = CRISPR gRNA sequence
  source 1..20: mol_type = other DNA
ttcaagcgattctcctgcct

SEQ ID NO: 43752 - DNA, 20 bp, synthetic construct
  misc_feature 1..20: note = CRISPR gRNA sequence
  source 1..20: mol_type = other DNA
gattctcctgcctcagcctc

SEQ ID NO: 43753 - DNA, 20 bp, synthetic construct
  misc_feature 1..20: note = CRISPR gRNA sequence
  source 1..20: mol_type = other DNA
ttctcctgcctcagcctccg

SEQ ID NO: 43754 - DNA, 20 bp, synthetic construct
  misc_feature 1..20: note = CRISPR gRNA sequence
  source 1..20: mol_type = other DNA
tcctgcctcagcctccggag

SEQ ID NO: 43755 - DNA, 20 bp, synthetic construct
  misc_feature 1..20: note = CRISPR gRNA sequence
  source 1..20: mol_type = other DNA
gcctcagcctccggagtagc

SEQ ID NO: 43756 - DNA, 20 bp, synthetic construct
  misc_feature 1..20: note = CRISPR gRNA sequence
  source 1..20: mol_type = other DNA
cctcagcctccggagtagct

SEQ ID NO: 43757 - DNA, 20 bp, synthetic construct
  misc_feature 1..20: note = CRISPR gRNA sequence
  source 1..20: mol_type = other DNA
ctccggagtagctgggatta

SEQ ID NO: 43758 - DNA, 20 bp, synthetic construct
  misc_feature 1..20: note = CRISPR gRNA sequence
  source 1..20: mol_type = other DNA
tccggagtagctgggattac

SEQ ID NO: 43759 - DNA, 20 bp, synthetic construct
  misc_feature 1..20: note = CRISPR gRNA sequence
  source 1..20: mol_type = other DNA
caggcgcccgccaccacacc

SEQ ID NO: 43760 - DNA, 20 bp, synthetic construct
  misc_feature 1..20: note = CRISPR gRNA sequence
  source 1..20: mol_type = other DNA
aatttttttttgtatttttg

SEQ ID NO: 43761 - DNA, 20 bp, synthetic construct
  misc_feature 1..20: note = CRISPR gRNA sequence
  source 1..20: mol_type = other DNA
tttttttttgtatttttgta

SEQ ID NO: 43762 - DNA, 20 bp, synthetic construct
  misc_feature 1..20: note = CRISPR gRNA sequence
  source 1..20: mol_type = other DNA
tttttgtatttttgtagaga

SEQ ID NO: 43763 - DNA, 20 bp, synthetic construct
  misc_feature 1..20: note = CRISPR gRNA sequence
  source 1..20: mol_type = other DNA
ttttgtatttttgtagagac

SEQ ID NO: 43764 - DNA, 20 bp, synthetic construct
  misc_feature 1..20: note = CRISPR gRNA sequence
  source 1..20: mol_type = other DNA
tttgtatttttgtagagaca

SEQ ID NO: 43765 - DNA, 20 bp, synthetic construct
  misc_feature 1..20: note = CRISPR gRNA sequence
  source 1..20: mol_type = other DNA
gagacagggtttcaccatgt

SEQ ID NO: 43766 - DNA, 20 bp, synthetic construct
  misc_feature 1..20: note = CRISPR gRNA sequence
  source 1..20: mol_type = other DNA
cagggtttcaccatgttggc

SEQ ID NO: 43767 - DNA, 20 bp, synthetic construct
  misc_feature 1..20: note = CRISPR gRNA sequence
  source 1..20: mol_type = other DNA
agggtttcaccatgttggcg

SEQ ID NO: 43768 - DNA, 20 bp, synthetic construct
  misc_feature 1..20: note = CRISPR gRNA sequence
  source 1..20: mol_type = other DNA
tttcaccatgttggcgaggc

SEQ ID NO: 43769 - DNA, 20 bp, synthetic construct
  misc_feature 1..20: note = CRISPR gRNA sequence
  source 1..20: mol_type = other DNA
tggtctcgaactcctgacct

SEQ ID NO: 43770 - DNA, 20 bp, synthetic construct
  misc_feature 1..20: note = CRISPR gRNA sequence
  source 1..20: mol_type = other DNA
ctcagatgatctgcccgttt

SEQ ID NO: 43771 - DNA, 20 bp, synthetic construct
  misc_feature 1..20: note = CRISPR gRNA sequence
  source 1..20: mol_type = other DNA
ctgcccgtttcggccttcca

SEQ ID NO: 43772 - DNA, 20 bp, synthetic construct
  misc_feature 1..20: note = CRISPR gRNA sequence
  source 1..20: mol_type = other DNA
gtttcggccttccaaagtgc

SEQ ID NO: 43773 - DNA, 20 bp, synthetic construct
  misc_feature 1..20: note = CRISPR gRNA sequence
  source 1..20: mol_type = other DNA
tttcggccttccaaagtgct

SEQ ID NO: 43774 - DNA, 20 bp, synthetic construct
  misc_feature 1..20: note = CRISPR gRNA sequence
  source 1..20: mol_type = other DNA
cttccaaagtgctgggatta

SEQ ID NO: 43775 - DNA, 20 bp, synthetic construct
  misc_feature 1..20: note = CRISPR gRNA sequence
  source 1..20: mol_type = other DNA
ttccaaagtgctgggattac

SEQ ID NO: 43776 - DNA, 20 bp, synthetic construct
  misc_feature 1..20: note = CRISPR gRNA sequence
  source 1..20: mol_type = other DNA
agtgctgggattacaggcat

SEQ ID NO: 43777 - DNA, 20 bp, synthetic construct
  misc_feature 1..20: note = CRISPR gRNA sequence
  source 1..20: mol_type = other DNA
caggcatgagccaccacacc

SEQ ID NO: 43778 - DNA, 20 bp, synthetic construct
  misc_feature 1..20: note = CRISPR gRNA sequence
  source 1..20: mol_type = other DNA
acccagccctttcctttttt

SEQ ID NO: 43779 - DNA, 20 bp, synthetic construct
  misc_feature 1..20: note = CRISPR gRNA sequence
  source 1..20: mol_type = other DNA
cccagccctttcctttttta

SEQ ID NO: 43780 - DNA, 20 bp, synthetic construct
  misc_feature 1..20: note = CRISPR gRNA sequence
  source 1..20: mol_type = other DNA
ctgcataatattccattgtg

SEQ ID NO: 43781 - DNA, 20 bp, synthetic construct
  misc_feature 1..20: note = CRISPR gRNA sequence
  source 1..20: mol_type = other DNA
ataatattccattgtgtgga

SEQ ID NO: 43782 - DNA, 20 bp, synthetic construct
  misc_feature 1..20: note = CRISPR gRNA sequence
  source 1..20: mol_type = other DNA
cttatccatcaattgacact

SEQ ID NO: 43783 - DNA, 20 bp, synthetic construct
  misc_feature 1..20: note = CRISPR gRNA sequence
  source 1..20: mol_type = other DNA
ttatccatcaattgacactt

SEQ ID NO: 43784 - DNA, 20 bp, synthetic construct
  misc_feature 1..20: note = CRISPR gRNA sequence
  source 1..20: mol_type = other DNA
gacacttgggttgtccattc

SEQ ID NO: 43785 - DNA, 20 bp, synthetic construct
  misc_feature 1..20: note = CRISPR gRNA sequence
  source 1..20: mol_type = other DNA
ccattcaagtgcccaattga

SEQ ID NO: 43786 - DNA, 20 bp, synthetic construct
  misc_feature 1..20: note = CRISPR gRNA sequence
  source 1..20: mol_type = other DNA
ttattttatttcaaaaacaa

SEQ ID NO: 43787 - DNA, 20 bp, synthetic construct
  misc_feature 1..20: note = CRISPR gRNA sequence
  source 1..20: mol_type = other DNA
attttatttcaaaaacaata

SEQ ID NO: 43788 - DNA, 20 bp, synthetic construct
  misc_feature 1..20: note = CRISPR gRNA sequence
  source 1..20: mol_type = other DNA
atttcaaaaacaatagagat

SEQ ID NO: 43789 - DNA, 20 bp, synthetic construct
  misc_feature 1..20: note = CRISPR gRNA sequence
  source 1..20: mol_type = other DNA
tttcaaaaacaatagagatg

SEQ ID NO: 43790 - DNA, 20 bp, synthetic construct
  misc_feature 1..20: note = CRISPR gRNA sequence
  source 1..20: mol_type = other DNA
tgaggtctcactgttttgcc

SEQ ID NO: 43791 - DNA, 20 bp, synthetic construct
  misc_feature 1..20: note = CRISPR gRNA sequence
  source 1..20: mol_type = other DNA
gaggtctcactgttttgccc

SEQ ID NO: 43792 - DNA, 20 bp, synthetic construct
  misc_feature 1..20: note = CRISPR gRNA sequence
  source 1..20: mol_type = other DNA
caggatgatcttgatctcct

SEQ ID NO: 43793 - DNA, 20 bp, synthetic construct
  misc_feature 1..20: note = CRISPR gRNA sequence
  source 1..20: mol_type = other DNA
gatcttgatctcctgagctc

SEQ ID NO: 43794 - DNA, 20 bp, synthetic construct
  misc_feature 1..20: note = CRISPR gRNA sequence
  source 1..20: mol_type = other DNA
ctcaagtgatcctcccacct

SEQ ID NO: 43795 - DNA, 20 bp, synthetic construct
  misc_feature 1..20: note = CRISPR gRNA sequence
  source 1..20: mol_type = other DNA
cctcccacctcagcctccca

SEQ ID NO: 43796 - DNA, 20 bp, synthetic construct
  misc_feature 1..20: note = CRISPR gRNA sequence
  source 1..20: mol_type = other DNA
acctcagcctcccaaagtgc

SEQ ID NO: 43797 - DNA, 20 bp, synthetic construct
  misc_feature 1..20: note = CRISPR gRNA sequence
  source 1..20: mol_type = other DNA
cctcagcctcccaaagtgct

SEQ ID NO: 43798 - DNA, 20 bp, synthetic construct
  misc_feature 1..20: note = CRISPR gRNA sequence
  source 1..20: mol_type = other DNA
cctcccaaagtgctaggcgt

SEQ ID NO: 43799 - DNA, 20 bp, synthetic construct
  misc_feature 1..20: note = CRISPR gRNA sequence
  source 1..20: mol_type = other DNA
taggcgtgagccaccatgcc

SEQ ID NO: 43800 - DNA, 20 bp, synthetic construct
  misc_feature 1..20: note = CRISPR gRNA sequence
  source 1..20: mol_type = other DNA
cgtgagccaccatgcccagc

SEQ ID NO: 43801 - DNA, 20 bp, synthetic construct
  misc_feature 1..20: note = CRISPR gRNA sequence
  source 1..20: mol_type = other DNA
agccaccatgcccagccaga

SEQ ID NO: 43802 - DNA, 20 bp, synthetic construct
  misc_feature 1..20: note = CRISPR gRNA sequence
  source 1..20: mol_type = other DNA
catgcccagccagaaagtcc

SEQ ID NO: 43803 - DNA, 20 bp, synthetic construct
  misc_feature 1..20: note = CRISPR gRNA sequence
  source 1..20: mol_type = other DNA
gtcccagctttcaattattt

SEQ ID NO: 43804 - DNA, 20 bp, synthetic construct
  misc_feature 1..20: note = CRISPR gRNA sequence
  source 1..20: mol_type = other DNA
aattattttggttatatatc

SEQ ID NO: 43805 - DNA, 20 bp, synthetic construct
  misc_feature 1..20: note = CRISPR gRNA sequence
  source 1..20: mol_type = other DNA
ggttatatatccagaattgc

SEQ ID NO: 43806 - DNA, 20 bp, synthetic construct
  misc_feature 1..20: note = CRISPR gRNA sequence
  source 1..20: mol_type = other DNA
ttatatatccagaattgcta

SEQ ID NO: 43807 - DNA, 20 bp, synthetic construct
  misc_feature 1..20: note = CRISPR gRNA sequence
  source 1..20: mol_type = other DNA
caaaataacttttttttttt

SEQ ID NO: 43808 - DNA, 20 bp, synthetic construct
  misc_feature 1..20: note = CRISPR gRNA sequence
  source 1..20: mol_type = other DNA
ataactttttttttttgaga

SEQ ID NO: 43809 - DNA, 20 bp, synthetic construct
  misc_feature 1..20: note = CRISPR gRNA sequence
  source 1..20: mol_type = other DNA
aactttttttttttgagacg

SEQ ID NO: 43810 - DNA, 20 bp, synthetic construct
  misc_feature 1..20: note = CRISPR gRNA sequence
  source 1..20: mol_type = other DNA
cggagtctcgctctgttgcc

SEQ ID NO: 43811 - DNA, 20 bp, synthetic construct
  misc_feature 1..20: note = CRISPR gRNA sequence
  source 1..20: mol_type = other DNA
ggagtctcgctctgttgccc

SEQ ID NO: 43812 - DNA, 20 bp, synthetic construct
  misc_feature 1..20: note = CRISPR gRNA sequence
  source 1..20: mol_type = other DNA
tctcgctctgttgcccaggt

SEQ ID NO: 43813 - DNA, 20 bp, synthetic construct
  misc_feature 1..20: note = CRISPR gRNA sequence
  source 1..20: mol_type = other DNA
tcgctctgttgcccaggttg

SEQ ID NO: 43814 - DNA, 20 bp, synthetic construct
  misc_feature 1..20: note = CRISPR gRNA sequence
  source 1..20: mol_type = other DNA
ctgttgcccaggttggagtg

SEQ ID NO: 43815 - DNA, 20 bp, synthetic construct
  misc_feature 1..20: note = CRISPR gRNA sequence
  source 1..20: mol_type = other DNA
ttgcccaggttggagtgcag

SEQ ID NO: 43816 - DNA, 20 bp, synthetic construct
  misc_feature 1..20: note = CRISPR gRNA sequence
  source 1..20: mol_type = other DNA
ggagtgcagtggtgcgatct

SEQ ID NO: 43817 - DNA, 20 bp, synthetic construct
  misc_feature 1..20: note = CRISPR gRNA sequence
  source 1..20: mol_type = other DNA
gtgcgatctcggctcactgc

SEQ ID NO: 43818 - DNA, 20 bp, synthetic construct
  misc_feature 1..20: note = CRISPR gRNA sequence
  source 1..20: mol_type = other DNA
tcactgcaagctccgcctcc

SEQ ID NO: 43819 - DNA, 20 bp, synthetic construct
  misc_feature 1..20: note = CRISPR gRNA sequence
  source 1..20: mol_type = other DNA
cactgcaagctccgcctcct

SEQ ID NO: 43820 - DNA, 20 bp, synthetic construct
  misc_feature 1..20: note = CRISPR gRNA sequence
  source 1..20: mol_type = other DNA
ttcacgccattctcctgcct

SEQ ID NO: 43821 - DNA, 20 bp, synthetic construct
  misc_feature 1..20: note = CRISPR gRNA sequence
  source 1..20: mol_type = other DNA
cattctcctgcctcagcctc

SEQ ID NO: 43822 - DNA, 20 bp, synthetic construct
  misc_feature 1..20: note = CRISPR gRNA sequence
  source 1..20: mol_type = other DNA
ttctcctgcctcagcctcca

SEQ ID NO: 43823 - DNA, 20 bp, synthetic construct
  misc_feature 1..20: note = CRISPR gRNA sequence
  source 1..20: mol_type = other DNA
tcctgcctcagcctccagag

SEQ ID NO: 43824 - DNA, 20 bp, synthetic construct
  misc_feature 1..20: note = CRISPR gRNA sequence
  source 1..20: mol_type = other DNA
gcctcagcctccagagtagc

SEQ ID NO: 43825 - DNA, 20 bp, synthetic construct
  misc_feature 1..20: note = CRISPR gRNA sequence
  source 1..20: mol_type = other DNA
cctcagcctccagagtagct

SEQ ID NO: 43826 - DNA, 20 bp, synthetic construct
  misc_feature 1..20: note = CRISPR gRNA sequence
  source 1..20: mol_type = other DNA
ctccagagtagctgggacta

SEQ ID NO: 43827 - DNA, 20 bp, synthetic construct
  misc_feature 1..20: note = CRISPR gRNA sequence
  source 1..20: mol_type = other DNA
tccagagtagctgggactac

SEQ ID NO: 43828 - DNA, 20 bp, synthetic construct
  misc_feature 1..20: note = CRISPR gRNA sequence
  source 1..20: mol_type = other DNA
tgactaatgttttgtatttt

SEQ ID NO: 43829 - DNA, 20 bp, synthetic construct
  misc_feature 1..20: note = CRISPR gRNA sequence
  source 1..20: mol_type = other DNA
ctaatgttttgtatttttag

SEQ ID NO: 43830 - DNA, 20 bp, synthetic construct
  misc_feature 1..20: note = CRISPR gRNA sequence
  source 1..20: mol_type = other DNA
aatgttttgtatttttagta

SEQ ID NO: 43831 - DNA, 20 bp, synthetic construct
  misc_feature 1..20: note = CRISPR gRNA sequence
  source 1..20: mol_type = other DNA
ttttgtatttttagtagaga

SEQ ID NO: 43832 - DNA, 20 bp, synthetic construct
  misc_feature 1..20: note = CRISPR gRNA sequence
  source 1..20: mol_type = other DNA
tttgtatttttagtagagac

SEQ ID NO: 43833 - DNA, 20 bp, synthetic construct
  misc_feature 1..20: note = CRISPR gRNA sequence
  source 1..20: mol_type = other DNA
ttgtatttttagtagagacg

SEQ ID NO: 43834 - DNA, 20 bp, synthetic construct
  misc_feature 1..20: note = CRISPR gRNA sequence
  source 1..20: mol_type = other DNA
gagacggggtttcaccatgt

SEQ ID NO: 43835 - DNA, 20 bp, synthetic construct
  misc_feature 1..20: note = CRISPR gRNA sequence
  source 1..20: mol_type = other DNA
cggggtttcaccatgttagc

SEQ ID NO: 43836 - DNA, 20 bp, synthetic construct
  misc_feature 1..20: note = CRISPR gRNA sequence
  source 1..20: mol_type = other DNA
ggggtttcaccatgttagcc

SEQ ID NO: 43837 - DNA, 20 bp, synthetic construct
  misc_feature 1..20: note = CRISPR gRNA sequence
  source 1..20: mol_type = other DNA
tttcaccatgttagccagga

SEQ ID NO: 43838 - DNA, 20 bp, synthetic construct
  misc_feature 1..20: note = CRISPR gRNA sequence
  source 1..20: mol_type = other DNA
acctcgtgatccccccacct

SEQ ID NO: 43839 - DNA, 20 bp, synthetic construct
  misc_feature 1..20: note = CRISPR gRNA sequence
  source 1..20: mol_type = other DNA
ccccccacctcagcctccca

SEQ ID NO: 43840 - DNA, 20 bp, synthetic construct
  misc_feature 1..20: note = CRISPR gRNA sequence
  source 1..20: mol_type = other DNA
acctcagcctcccaaagtgc

SEQ ID NO: 43841 - DNA, 20 bp, synthetic construct
  misc_feature 1..20: note = CRISPR gRNA sequence
  source 1..20: mol_type = other DNA
cctcagcctcccaaagtgct

SEQ ID NO: 43842 - DNA, 20 bp, synthetic construct
  misc_feature 1..20: note = CRISPR gRNA sequence
  source 1..20: mol_type = other DNA
ctcccaaagtgctgggatta

SEQ ID NO: 43843 - DNA, 20 bp, synthetic construct
  misc_feature 1..20: note = CRISPR gRNA sequence
  source 1..20: mol_type = other DNA
tcccaaagtgctgggattac

SEQ ID NO: 43844 - DNA, 20 bp, synthetic construct
  misc_feature 1..20: note = CRISPR gRNA sequence
  source 1..20: mol_type = other DNA
agtgctgggattacaggtgt

SEQ ID NO: 43845 - DNA, 20 bp, synthetic construct
  misc_feature 1..20: note = CRISPR gRNA sequence
  source 1..20: mol_type = other DNA
caggtgtgagccactgcacc

SEQ ID NO: 43846 - DNA, 20 bp, synthetic construct
  misc_feature 1..20: note = CRISPR gRNA sequence
  source 1..20: mol_type = other DNA
ttttcaaataaaacttttct

SEQ ID NO: 43847 - DNA, 20 bp, synthetic construct
  misc_feature 1..20: note = CRISPR gRNA sequence
  source 1..20: mol_type = other DNA
tcttagtctaaaaataatat

SEQ ID NO: 43848 - DNA, 20 bp, synthetic construct
  misc_feature 1..20: note = CRISPR gRNA sequence
  source 1..20: mol_type = other DNA
agtctaaaaataatattggt

SEQ ID NO: 43849 - DNA, 20 bp, synthetic construct
  misc_feature 1..20: note = CRISPR gRNA sequence
  source 1..20: mol_type = other DNA
gtctaaaaataatattggtt

SEQ ID NO: 43850 - DNA, 20 bp, synthetic construct
  misc_feature 1..20: note = CRISPR gRNA sequence
  source 1..20: mol_type = other DNA
tctaaaaataatattggttg

SEQ ID NO: 43851 - DNA, 20 bp, synthetic construct
  misc_feature 1..20: note = CRISPR gRNA sequence
  source 1..20: mol_type = other DNA
ctaaaaataatattggttgg

SEQ ID NO: 43852 - DNA, 20 bp, synthetic construct
  misc_feature 1..20: note = CRISPR gRNA sequence
  source 1..20: mol_type = other DNA
aaaataatattggttggggg

SEQ ID NO: 43853 - DNA, 20 bp, synthetic construct
  misc_feature 1..20: note = CRISPR gRNA sequence
  source 1..20: mol_type = other DNA
ataatattggttgggggaag

SEQ ID NO: 43854 - DNA, 20 bp, synthetic construct
  misc_feature 1..20: note = CRISPR gRNA sequence
  source 1..20: mol_type = other DNA
cgcctgtaatcccaacactt

SEQ ID NO: 43855 - DNA, 20 bp, synthetic construct
  misc_feature 1..20: note = CRISPR gRNA sequence
  source 1..20: mol_type = other DNA
gcctgtaatcccaacacttt

SEQ ID NO: 43856 - DNA, 20 bp, synthetic construct
  misc_feature 1..20: note = CRISPR gRNA sequence
  source 1..20: mol_type = other DNA
ctgtaatcccaacactttgg

SEQ ID NO: 43857 - DNA, 20 bp, synthetic construct
  misc_feature 1..20: note = CRISPR gRNA sequence
  source 1..20: mol_type = other DNA
tgtaatcccaacactttggg

SEQ ID NO: 43858 - DNA, 20 bp, synthetic construct
  misc_feature 1..20: note = CRISPR gRNA sequence
  source 1..20: mol_type = other DNA
tcccaacactttgggaggct

SEQ ID NO: 43859 - DNA, 20 bp, synthetic construct
  misc_feature 1..20: note = CRISPR gRNA sequence
  source 1..20: mol_type = other DNA
cccaacactttgggaggctg

SEQ ID NO: 43860 - DNA, 20 bp, synthetic construct
  misc_feature 1..20: note = CRISPR gRNA sequence
  source 1..20: mol_type = other DNA
aacactttgggaggctgagg

SEQ ID NO: 43861 - DNA, 20 bp, synthetic construct
  misc_feature 1..20: note = CRISPR gRNA sequence
  source 1..20: mol_type = other DNA
acactttgggaggctgaggt

SEQ ID NO: 43862 - DNA, 20 bp, synthetic construct
  misc_feature 1..20: note = CRISPR gRNA sequence
  source 1..20: mol_type = other DNA
ctttgggaggctgaggtggg

SEQ ID NO: 43863 - DNA, 20 bp, synthetic construct
  misc_feature 1..20: note = CRISPR gRNA sequence
  source 1..20: mol_type = other DNA
ctgaggtgggcagattgttt

SEQ ID NO: 43864 - DNA, 20 bp, synthetic construct
  misc_feature 1..20: note = CRISPR gRNA sequence
  source 1..20: mol_type = other DNA
gtgggcagattgtttgagct

SEQ ID NO: 43865 - DNA, 20 bp, synthetic construct
  misc_feature 1..20: note = CRISPR gRNA sequence
  source 1..20: mol_type = other DNA
tgggcagattgtttgagctc

SEQ ID NO: 43866 - DNA, 20 bp, synthetic construct
  misc_feature 1..20: note = CRISPR gRNA sequence
  source 1..20: mol_type = other DNA
ttgtttgagctcaggcgttc

SEQ ID NO: 43867 - DNA, 20 bp, synthetic construct
  misc_feature 1..20: note = CRISPR gRNA sequence
  source 1..20: mol_type = other DNA
tgagctcaggcgttcaagac

SEQ ID NO: 43868 - DNA, 20 bp, synthetic construct
  misc_feature 1..20: note = CRISPR gRNA sequence
  source 1..20: mol_type = other DNA
tcaggcgttcaagaccagcc

SEQ ID NO: 43869 - DNA, 20 bp, synthetic construct
  misc_feature 1..20: note = CRISPR gRNA sequence
  source 1..20: mol_type = other DNA
caagaccagcctggacaaca

SEQ ID NO: 43870 - DNA, 20 bp, synthetic construct
  misc_feature 1..20: note = CRISPR gRNA sequence
  source 1..20: mol_type = other DNA
ttaatcattgttgaaatgtg

SEQ ID NO: 43871 - DNA, 20 bp, synthetic construct
  misc_feature 1..20: note = CRISPR gRNA sequence
  source 1..20: mol_type = other DNA
gttgaaatgtgcagaaaatc

SEQ ID NO: 43872 - DNA, 20 bp, synthetic construct
  misc_feature 1..20: note = CRISPR gRNA sequence
  source 1..20: mol_type = other DNA
agaaaatccagaaatacata

SEQ ID NO: 43873 - DNA, 20 bp, synthetic construct
  misc_feature 1..20: note = CRISPR gRNA sequence
  source 1..20: mol_type = other DNA
ccagaaatacataaagaaaa

SEQ ID NO: 43874 - DNA, 20 bp, synthetic construct
  misc_feature 1..20: note = CRISPR gRNA sequence
  source 1..20: mol_type = other DNA
aaaatagtgctttaaaaatt

SEQ ID NO: 43875 - DNA, 20 bp, synthetic construct
  misc_feature 1..20: note = CRISPR gRNA sequence
  source 1..20: mol_type = other DNA
aaaaattcagcataacttta

SEQ ID NO: 43876 - DNA, 20 bp, synthetic construct
  misc_feature 1..20: note = CRISPR gRNA sequence
  source 1..20: mol_type = other DNA
aattcagcataactttaaag

SEQ ID NO: 43877 - DNA, 20 bp, synthetic construct
  misc_feature 1..20: note = CRISPR gRNA sequence
  source 1..20: mol_type = other DNA
aaattaatgcacatgcattg

SEQ ID NO: 43878 - DNA, 20 bp, synthetic construct
  misc_feature 1..20: note = CRISPR gRNA sequence
  source 1..20: mol_type = other DNA
taatgcacatgcattgtaga

SEQ ID NO: 43879 - DNA, 20 bp, synthetic construct
  misc_feature 1..20: note = CRISPR gRNA sequence
  source 1..20: mol_type = other DNA
cacatgcattgtagaaagtt

SEQ ID NO: 43880 - DNA, 20 bp, synthetic construct
  misc_feature 1..20: note = CRISPR gRNA sequence
  source 1..20: mol_type = other DNA
tgtagaaagtttagaaaata

SEQ ID NO: 43881 - DNA, 20 bp, synthetic construct
  misc_feature 1..20: note = CRISPR gRNA sequence
  source 1..20: mol_type = other DNA
ttagaaaatatagaaaatta

SEQ ID NO: 43882 - DNA, 20 bp, synthetic construct
  misc_feature 1..20: note = CRISPR gRNA sequence
  source 1..20: mol_type = other DNA
gaaaatatagaaaattaaag

SEQ ID NO: 43883 - DNA, 20 bp, synthetic construct
  misc_feature 1..20: note = CRISPR gRNA sequence
  source 1..20: mol_type = other DNA
ataaaataaaaatcactcat

SEQ ID NO: 43884 - DNA, 20 bp, synthetic construct
  misc_feature 1..20: note = CRISPR gRNA sequence
  source 1..20: mol_type = other DNA
ctttttttgaaatgcaaaat

SEQ ID NO: 43885 - DNA, 20 bp, synthetic construct
  misc_feature 1..20: note = CRISPR gRNA sequence
  source 1..20: mol_type = other DNA
tttttttgaaatgcaaaatt

SEQ ID NO: 43886 - DNA, 20 bp, synthetic construct
  misc_feature 1..20: note = CRISPR gRNA sequence
  source 1..20: mol_type = other DNA
ttgggatcatgttttatata

SEQ ID NO: 43887 - DNA, 20 bp, synthetic construct
  misc_feature 1..20: note = CRISPR gRNA sequence
  source 1..20: mol_type = other DNA
atcatgttttatatacagtt

SEQ ID NO: 43888 - DNA, 20 bp, synthetic construct
  misc_feature 1..20: note = CRISPR gRNA sequence
  source 1..20: mol_type = other DNA
tttcttaaatctaaaaatat

SEQ ID NO: 43889 - DNA, 20 bp, synthetic construct
  misc_feature 1..20: note = CRISPR gRNA sequence
  source 1..20: mol_type = other DNA
cttaaatctaaaaatatcag

SEQ ID NO: 43890 - DNA, 20 bp, synthetic construct
  misc_feature 1..20: note = CRISPR gRNA sequence
  source 1..20: mol_type = other DNA
atctaaaaatatcagtggcc

SEQ ID NO: 43891 - DNA, 20 bp, synthetic construct
  misc_feature 1..20: note = CRISPR gRNA sequence
  source 1..20: mol_type = other DNA
aaaatatcagtggcccagtg

SEQ ID NO: 43892 - DNA, 20 bp, synthetic construct
  misc_feature 1..20: note = CRISPR gRNA sequence
  source 1..20: mol_type = other DNA
atatcagtggcccagtgcag

SEQ ID NO: 43893 - DNA, 20 bp, synthetic construct
  misc_feature 1..20: note = CRISPR gRNA sequence
  source 1..20: mol_type = other DNA
gtggctcacgcctgtaatcc

SEQ ID NO: 43894 - DNA, 20 bp, synthetic construct
  misc_feature 1..20: note = CRISPR gRNA sequence
  source 1..20: mol_type = other DNA
cgcctgtaatcccagcactt

SEQ ID NO: 43895 - DNA, 20 bp, synthetic construct
  misc_feature 1..20: note = CRISPR gRNA sequence
  source 1..20: mol_type = other DNA
gcctgtaatcccagcacttt

SEQ ID NO: 43896 - DNA, 20 bp, synthetic construct
  misc_feature 1..20: note = CRISPR gRNA sequence
  source 1..20: mol_type = other DNA
ctgtaatcccagcactttgg

SEQ ID NO: 43897 - DNA, 20 bp, synthetic construct
  misc_feature 1..20: note = CRISPR gRNA sequence
  source 1..20: mol_type = other DNA
tgtaatcccagcactttggg

SEQ ID NO: 43898 - DNA, 20 bp, synthetic construct
  misc_feature 1..20: note = CRISPR gRNA sequence
  source 1..20: mol_type = other DNA
tcccagcactttgggaggcc

SEQ ID NO: 43899 - DNA, 20 bp, synthetic construct
  misc_feature 1..20: note = CRISPR gRNA sequence
  source 1..20: mol_type = other DNA
cccagcactttgggaggccg

SEQ ID NO: 43900 - DNA, 20 bp, synthetic construct
  misc_feature 1..20: note = CRISPR gRNA sequence
  source 1..20: mol_type = other DNA
agcactttgggaggccgagg

SEQ ID NO: 43901 - DNA, 20 bp, synthetic construct
  misc_feature 1..20: note = CRISPR gRNA sequence
  source 1..20: mol_type = other DNA
gcactttgggaggccgaggc

SEQ ID NO: 43902 - DNA, 20 bp, synthetic construct
  misc_feature 1..20: note = CRISPR gRNA sequence
  source 1..20: mol_type = other DNA
ctttgggaggccgaggcagg

SEQ ID NO: 43903 - DNA, 20 bp, synthetic construct
  misc_feature 1..20: note = CRISPR gRNA sequence
  source 1..20: mol_type = other DNA
ccgaggcaggtggatcactt

SEQ ID NO: 43904 - DNA, 20 bp, synthetic construct
  misc_feature 1..20: note = CRISPR gRNA sequence
  source 1..20: mol_type = other DNA
cgaggcaggtggatcacttg

SEQ ID NO: 43905 - DNA, 20 bp, synthetic construct
  misc_feature 1..20: note = CRISPR gRNA sequence
  source 1..20: mol_type = other DNA
gcaggtggatcacttgaggt

SEQ ID NO: 43906 - DNA, 20 bp, synthetic construct
  misc_feature 1..20: note = CRISPR gRNA sequence
  source 1..20: mol_type = other DNA
caggtggatcacttgaggtc

SEQ ID NO: 43907 - DNA, 20 bp, synthetic construct
  misc_feature 1..20: note = CRISPR gRNA sequence
  source 1..20: mol_type = other DNA
ggtggatcacttgaggtcag

SEQ ID NO: 43908 - DNA, 20 bp, synthetic construct
  misc_feature 1..20: note = CRISPR gRNA sequence
  source 1..20: mol_type = other DNA
tcacttgaggtcaggagttc

SEQ ID NO: 43909 - DNA, 20 bp, synthetic construct
  misc_feature 1..20: note = CRISPR gRNA sequence
  source 1..20: mol_type = other DNA
tgaggtcaggagttcaagac

SEQ ID NO: 43910 - DNA, 20 bp, synthetic construct
  misc_feature 1..20: note = CRISPR gRNA sequence
  source 1..20: mol_type = other DNA
caagaccagcctgaccaaca

SEQ ID NO: 43911 - DNA, 20 bp, synthetic construct
  misc_feature 1..20: note = CRISPR gRNA sequence
  source 1..20: mol_type = other DNA
tctactaaaaatacaaaaat

SEQ ID NO: 43912 - DNA, 20 bp, synthetic construct
  misc_feature 1..20: note = CRISPR gRNA sequence
  source 1..20: mol_type = other DNA
ctaaaaatacaaaaattagc

SEQ ID NO: 43913 - DNA, 20 bp, synthetic construct
  misc_feature 1..20: note = CRISPR gRNA sequence
  source 1..20: mol_type = other DNA
taaaaatacaaaaattagcc

SEQ ID NO: 43914 - DNA, 20 bp, synthetic construct
  misc_feature 1..20: note = CRISPR gRNA sequence
  source 1..20: mol_type = other DNA
atacaaaaattagccaggcg

SEQ ID NO: 43915 - DNA, 20 bp, synthetic construct
  misc_feature 1..20: note = CRISPR gRNA sequence
  source 1..20: mol_type = other DNA
caaaaattagccaggcgtgg

SEQ ID NO: 43916 - DNA, 20 bp, synthetic construct
  misc_feature 1..20: note = CRISPR gRNA sequence
  source 1..20: mol_type = other DNA
gtggcgcatgcctgtaatcc

SEQ ID NO: 43917 - DNA, 20 bp, synthetic construct
  misc_feature 1..20: note = CRISPR gRNA sequence
  source 1..20: mol_type = other DNA
tgcctgtaatcccagctact

SEQ ID NO: 43918 - DNA, 20 bp, synthetic construct
  misc_feature 1..20: note = CRISPR gRNA sequence
  source 1..20: mol_type = other DNA
gcctgtaatcccagctactt

SEQ ID NO: 43919 - DNA, 20 bp, synthetic construct
  misc_feature 1..20: note = CRISPR gRNA sequence
  source 1..20: mol_type = other DNA
ctgtaatcccagctacttgg

SEQ ID NO: 43920 - DNA, 20 bp, synthetic construct
  misc_feature 1..20: note = CRISPR gRNA sequence
  source 1..20: mol_type = other DNA
tgtaatcccagctacttggg

SEQ ID NO: 43921 - DNA, 20 bp, synthetic construct
  misc_feature 1..20: note = CRISPR gRNA sequence
  source 1..20: mol_type = other DNA
tcccagctacttgggaggct

SEQ ID NO: 43922 - DNA, 20 bp, synthetic construct
  misc_feature 1..20: note = CRISPR gRNA sequence
  source 1..20: mol_type = other DNA
cccagctacttgggaggctg

SEQ ID NO: 43923 - DNA, 20 bp, synthetic construct
  misc_feature 1..20: note = CRISPR gRNA sequence
  source 1..20: mol_type = other DNA
agctacttgggaggctgagg

SEQ ID NO: 43924 - DNA, 20 bp, synthetic construct
  misc_feature 1..20: note = CRISPR gRNA sequence
  source 1..20: mol_type = other DNA
gctacttgggaggctgaggc

SEQ ID NO: 43925 - DNA, 20 bp, synthetic construct
  misc_feature 1..20: note = CRISPR gRNA sequence
  source 1..20: mol_type = other DNA
tacttgggaggctgaggcag

SEQ ID NO: 43926 - DNA, 20 bp, synthetic construct
  misc_feature 1..20: note = CRISPR gRNA sequence
  source 1..20: mol_type = other DNA
gcaggagaatcgcttgaacc

SEQ ID NO: 43927 - DNA, 20 bp, synthetic construct
  misc_feature 1..20: note = CRISPR gRNA sequence
  source 1..20: mol_type = other DNA
caggagaatcgcttgaaccc

SEQ ID NO: 43928 - DNA, 20 bp, synthetic construct
  misc_feature 1..20: note = CRISPR gRNA sequence
  source 1..20: mol_type = other DNA
ggagaatcgcttgaacccag

SEQ ID NO: 43929 - DNA, 20 bp, synthetic construct
  misc_feature 1..20: note = CRISPR gRNA sequence
  source 1..20: mol_type = other DNA
gagaatcgcttgaacccagg

SEQ ID NO: 43930 - DNA, 20 bp, synthetic construct
  misc_feature 1..20: note = CRISPR gRNA sequence
  source 1..20: mol_type = other DNA
aatcgcttgaacccaggagg

SEQ ID NO: 43931 - DNA, 20 bp, synthetic construct
  misc_feature 1..20: note = CRISPR gRNA sequence
  source 1..20: mol_type = other DNA
tcgcttgaacccaggaggca

SEQ ID NO: 43932 - DNA, 20 bp, synthetic construct
  misc_feature 1..20: note = CRISPR gRNA sequence
  source 1..20: mol_type = other DNA
cgcttgaacccaggaggcag

SEQ ID NO: 43933 - DNA, 20 bp, synthetic construct
  misc_feature 1..20: note = CRISPR gRNA sequence
  source 1..20: mol_type = other DNA
aacccaggaggcagaggttg

SEQ ID NO: 43934 - DNA, 20 bp, synthetic construct
  misc_feature 1..20: note = CRISPR gRNA sequence
  source 1..20: mol_type = other DNA
ggcagaggttgcagtgatct

SEQ ID NO: 43935 - DNA, 20 bp, synthetic construct
  misc_feature 1..20: note = CRISPR gRNA sequence
  source 1..20: mol_type = other DNA
gagatcatgccattgcactc

SEQ ID NO: 43936 - DNA, 20 bp, synthetic construct
  misc_feature 1..20: note = CRISPR gRNA sequence
  source 1..20: mol_type = other DNA
catgccattgcactccagtc

SEQ ID NO: 43937 - DNA, 20 bp, synthetic construct
  misc_feature 1..20: note = CRISPR gRNA sequence
  source 1..20: mol_type = other DNA
atgccattgcactccagtct

SEQ ID NO: 43938 - DNA, 20 bp, synthetic construct
  misc_feature 1..20: note = CRISPR gRNA sequence
  source 1..20: mol_type = other DNA
tgcactccagtctgggcaac

SEQ ID NO: 43939 - DNA, 20 bp, synthetic construct
  misc_feature 1..20: note = CRISPR gRNA sequence
  source 1..20: mol_type = other DNA
cactccagtctgggcaacaa

SEQ ID NO: 43940 - DNA, 20 bp, synthetic construct
  misc_feature 1..20: note = CRISPR gRNA sequence
  source 1..20: mol_type = other DNA
ctctgtctcaaaaataaaat

SEQ ID NO: 43941 - DNA, 20 bp, synthetic construct
  misc_feature 1..20: note = CRISPR gRNA sequence
  source 1..20: mol_type = other DNA
tctcaaaaataaaataagat

SEQ ID NO: 43942 - DNA, 20 bp, synthetic construct
  misc_feature 1..20: note = CRISPR gRNA sequence
  source 1..20: mol_type = other DNA
aaaaaataatattttctgtt

SEQ ID NO: 43943 - DNA, 20 bp, synthetic construct
  misc_feature 1..20: note = CRISPR gRNA sequence
  source 1..20: mol_type = other DNA
tgtttggattgtcacaacaa

SEQ ID NO: 43944 - DNA, 20 bp, synthetic construct
  misc_feature 1..20: note = CRISPR gRNA sequence
  source 1..20: mol_type = other DNA
attgtcacaacaatagttgt

SEQ ID NO: 43945 - DNA, 20 bp, synthetic construct
  misc_feature 1..20: note = CRISPR gRNA sequence
  source 1..20: mol_type = other DNA
acaacaatagttgttggaat

SEQ ID NO: 43946 - DNA, 20 bp, synthetic construct
  misc_feature 1..20: note = CRISPR gRNA sequence
  source 1..20: mol_type = other DNA
caacaatagttgttggaata

SEQ ID NO: 43947 - DNA, 20 bp, synthetic construct
  misc_feature 1..20: note = CRISPR gRNA sequence
  source 1..20: mol_type = other DNA
aacaatagttgttggaataa

SEQ ID NO: 43948 - DNA, 20 bp, synthetic construct
  misc_feature 1..20: note = CRISPR gRNA sequence
  source 1..20: mol_type = other DNA
gtgatgttaatttccttttt

SEQ ID NO: 43949 - DNA, 20 bp, synthetic construct
  misc_feature 1..20: note = CRISPR gRNA sequence
  source 1..20: mol_type = other DNA
tgcctacttgtataatttta

SEQ ID NO: 43950 - DNA, 20 bp, synthetic construct
  misc_feature 1..20: note = CRISPR gRNA sequence
  source 1..20: mol_type = other DNA
taattttatagttttaaaat

SEQ ID NO: 43951 - DNA, 20 bp, synthetic construct
  misc_feature 1..20: note = CRISPR gRNA sequence
  source 1..20: mol_type = other DNA
atgagcaaaaaaaactcaaa

SEQ ID NO: 43952 - DNA, 20 bp, synthetic construct
  misc_feature 1..20: note = CRISPR gRNA sequence
  source 1..20: mol_type = other DNA
aaaaaaactcaaaaagcctc

SEQ ID NO: 43953 - DNA, 20 bp, synthetic construct
  misc_feature 1..20: note = CRISPR gRNA sequence
  source 1..20: mol_type = other DNA
aaaaaactcaaaaagcctct

SEQ ID NO: 43954 - DNA, 20 bp, synthetic construct
  misc_feature 1..20: note = CRISPR gRNA sequence
  source 1..20: mol_type = other DNA
cccccttgacactcctcccc

SEQ ID NO: 43955 - DNA, 20 bp, synthetic construct
  misc_feature 1..20: note = CRISPR gRNA sequence
  source 1..20: mol_type = other DNA
tgattgtctgctgctcacct

SEQ ID NO: 43956 - DNA, 20 bp, synthetic construct
  misc_feature 1..20: note = CRISPR gRNA sequence
  source 1..20: mol_type = other DNA
gattgtctgctgctcacctt

SEQ ID NO: 43957 - DNA, 20 bp, synthetic construct
  misc_feature 1..20: note = CRISPR gRNA sequence
  source 1..20: mol_type = other DNA
attgtctgctgctcaccttg

SEQ ID NO: 43958 - DNA, 20 bp, synthetic construct
  misc_feature 1..20: note = CRISPR gRNA sequence
  source 1..20: mol_type = other DNA
ttgtctgctgctcaccttgg

SEQ ID NO: 43959 - DNA, 20 bp, synthetic construct
  misc_feature 1..20: note = CRISPR gRNA sequence
  source 1..20: mol_type = other DNA
tgtctgctgctcaccttggg

SEQ ID NO: 43960 - DNA, 20 bp, synthetic construct
  misc_feature 1..20: note = CRISPR gRNA sequence
  source 1..20: mol_type = other DNA
gtctgctgctcaccttgggg

SEQ ID NO: 43961 - DNA, 20 bp, synthetic construct
  misc_feature 1..20: note = CRISPR gRNA sequence
  source 1..20: mol_type = other DNA
atctgtgtccccttctgtga

SEQ ID NO: 43962 - DNA, 20 bp, synthetic construct
  misc_feature 1..20: note = CRISPR gRNA sequence
  source 1..20: mol_type = other DNA
tctgtgtccccttctgtgac

SEQ ID NO: 43963 - DNA, 20 bp, synthetic construct
  misc_feature 1..20: note = CRISPR gRNA sequence
  source 1..20: mol_type = other DNA
ctgtgtccccttctgtgaca

SEQ ID NO: 43964 - DNA, 20 bp, synthetic construct
  misc_feature 1..20: note = CRISPR gRNA sequence
  source 1..20: mol_type = other DNA
tccccttctgtgacagggtg

SEQ ID NO: 43965 - DNA, 20 bp, synthetic construct
  misc_feature 1..20: note = CRISPR gRNA sequence
  source 1..20: mol_type = other DNA
ccccttctgtgacagggtgc

SEQ ID NO: 43966 - DNA, 20 bp, synthetic construct
  misc_feature 1..20: note = CRISPR gRNA sequence
  source 1..20: mol_type = other DNA
ccttctgtgacagggtgcag

SEQ ID NO: 43967 - DNA, 20 bp, synthetic construct
  misc_feature 1..20: note = CRISPR gRNA sequence
  source 1..20: mol_type = other DNA
gtgacagggtgcaggagccg

SEQ ID NO: 43968 - DNA, 20 bp, synthetic construct
  misc_feature 1..20: note = CRISPR gRNA sequence
  source 1..20: mol_type = other DNA
tgacagggtgcaggagccgt

SEQ ID NO: 43969 - DNA, 20 bp, synthetic construct
  misc_feature 1..20: note = CRISPR gRNA sequence
  source 1..20: mol_type = other DNA
cagggtgcaggagccgtggg

SEQ ID NO: 43970 - DNA, 20 bp, synthetic construct
  misc_feature 1..20: note = CRISPR gRNA sequence
  source 1..20: mol_type = other DNA
gtgcaggagccgtgggcgga

SEQ ID NO: 43971 - DNA, 20 bp, synthetic construct
  misc_feature 1..20: note = CRISPR gRNA sequence
  source 1..20: mol_type = other DNA
gcaggagccgtgggcggaca

SEQ ID NO: 43972 - DNA, 20 bp, synthetic construct
  misc_feature 1..20: note = CRISPR gRNA sequence
  source 1..20: mol_type = other DNA
gagccgtgggcggacagagc

SEQ ID NO: 43973 - DNA, 20 bp, synthetic construct
  misc_feature 1..20: note = CRISPR gRNA sequence
  source 1..20: mol_type = other DNA
agccgtgggcggacagagcc

SEQ ID NO: 43974 - DNA, 20 bp, synthetic construct
  misc_feature 1..20: note = CRISPR gRNA sequence
  source 1..20: mol_type = other DNA
gccgtgggcggacagagcca

SEQ ID NO: 43975 - DNA, 20 bp, synthetic construct
  misc_feature 1..20: note = CRISPR gRNA sequence
  source 1..20: mol_type = other DNA
agccagggttctctccctgt

SEQ ID NO: 43976 - DNA, 20 bp, synthetic construct
  misc_feature 1..20: note = CRISPR gRNA sequence
  source 1..20: mol_type = other DNA
cagggttctctccctgttag

SEQ ID NO: 43977 - DNA, 20 bp, synthetic construct
  misc_feature 1..20: note = CRISPR gRNA sequence
  source 1..20: mol_type = other DNA
ccctgttagaagtctgcgcc

SEQ ID NO: 43978 - DNA, 20 bp, synthetic construct
  misc_feature 1..20: note = CRISPR gRNA sequence
  source 1..20: mol_type = other DNA
cctgttagaagtctgcgccc

SEQ ID NO: 43979 - DNA, 20 bp, synthetic construct
  misc_feature 1..20: note = CRISPR gRNA sequence
  source 1..20: mol_type = other DNA
agaagtctgcgcccaggcct

SEQ ID NO: 43980 - DNA, 20 bp, synthetic construct
  misc_feature 1..20: note = CRISPR gRNA sequence
  source 1..20: mol_type = other DNA
gaagtctgcgcccaggcctc

SEQ ID NO: 43981 - DNA, 20 bp, synthetic construct
  misc_feature 1..20: note = CRISPR gRNA sequence
  source 1..20: mol_type = other DNA
gtctgcgcccaggcctcagg

SEQ ID NO: 43982 - DNA, 20 bp, synthetic construct
  misc_feature 1..20: note = CRISPR gRNA sequence
  source 1..20: mol_type = other DNA
tcaggcagtgtcactgaaat

SEQ ID NO: 43983 - DNA, 20 bp, synthetic construct
  misc_feature 1..20: note = CRISPR gRNA sequence
  source 1..20: mol_type = other DNA
caggcagtgtcactgaaatc

SEQ ID NO: 43984 - DNA, 20 bp, synthetic construct
  misc_feature 1..20: note = CRISPR gRNA sequence
  source 1..20: mol_type = other DNA
cagtgtcactgaaatcaggt

SEQ ID NO: 43985 - DNA, 20 bp, synthetic construct
  misc_feature 1..20: note = CRISPR gRNA sequence
  source 1..20: mol_type = other DNA
tcactgaaatcaggtgagtc

SEQ ID NO: 43986 - DNA, 20 bp, synthetic construct
  misc_feature 1..20: note = CRISPR gRNA sequence
  source 1..20: mol_type = other DNA
actgaaatcaggtgagtcca

SEQ ID NO: 43987 - DNA, 20 bp, synthetic construct
  misc_feature 1..20: note = CRISPR gRNA sequence
  source 1..20: mol_type = other DNA
gaaatcaggtgagtccagag

SEQ ID NO: 43988 - DNA, 20 bp, synthetic construct
  misc_feature 1..20: note = CRISPR gRNA sequence
  source 1..20: mol_type = other DNA
aatcaggtgagtccagagaa

SEQ ID NO: 43989 - DNA, 20 bp, synthetic construct
  misc_feature 1..20: note = CRISPR gRNA sequence
  source 1..20: mol_type = other DNA
atcaggtgagtccagagaag

SEQ ID NO: 43990 - DNA, 20 bp, synthetic construct
  misc_feature 1..20: note = CRISPR gRNA sequence
  source 1..20: mol_type = other DNA
gtccagagaagaggcccctt

SEQ ID NO: 43991 - DNA, 20 bp, synthetic construct
  misc_feature 1..20: note = CRISPR gRNA sequence
  source 1..20: mol_type = other DNA
tggaattcttcatctttcat

SEQ ID NO: 43992 - DNA, 20 bp, synthetic construct
  misc_feature 1..20: note = CRISPR gRNA sequence
  source 1..20: mol_type = other DNA
tcttcatctttcataagcat

SEQ ID NO: 43993 - DNA, 20 bp, synthetic construct
  misc_feature 1..20: note = CRISPR gRNA sequence
  source 1..20: mol_type = other DNA
cttcatctttcataagcatt

SEQ ID NO: 43994 - DNA, 20 bp, synthetic construct
  misc_feature 1..20: note = CRISPR gRNA sequence
  source 1..20: mol_type = other DNA
cttgaccttccctcatcctg

SEQ ID NO: 43995 - DNA, 20 bp, synthetic construct
  misc_feature 1..20: note = CRISPR gRNA sequence
  source 1..20: mol_type = other DNA
ttgaccttccctcatcctgt

SEQ ID NO: 43996 - DNA, 20 bp, synthetic construct
  misc_feature 1..20: note = CRISPR gRNA sequence
  source 1..20: mol_type = other DNA
tgaccttccctcatcctgtg

SEQ ID NO: 43997 - DNA, 20 bp, synthetic construct
  misc_feature 1..20: note = CRISPR gRNA sequence
  source 1..20: mol_type = other DNA
tccctcatcctgtggggtaa

SEQ ID NO: 43998 - DNA, 20 bp, synthetic construct
  misc_feature 1..20: note = CRISPR gRNA sequence
  source 1..20: mol_type = other DNA
tggggtaatagctgtgtcac

SEQ ID NO: 43999 - DNA, 20 bp, synthetic construct
  misc_feature 1..20: note = CRISPR gRNA sequence
  source 1..20: mol_type = other DNA
gtaatagctgtgtcaccagc

SEQ ID NO: 44000 - DNA, 20 bp, synthetic construct
  misc_feature 1..20: note = CRISPR gRNA sequence
  source 1..20: mol_type = other DNA
cagctagttttccatgtccc

SEQ ID NO: 44001 - DNA, 20 bp, synthetic construct
  misc_feature 1..20: note = CRISPR gRNA sequence
  source 1..20: mol_type = other DNA
agctagttttccatgtcccc

SEQ ID NO: 44002 - DNA, 20 bp, synthetic construct
  misc_feature 1..20: note = CRISPR gRNA sequence
  source 1..20: mol_type = other DNA
gctagttttccatgtcccca

SEQ ID NO: 44003 - DNA, 20 bp, synthetic construct
  misc_feature 1..20: note = CRISPR gRNA sequence
  source 1..20: mol_type = other DNA
agttttccatgtccccaggg

SEQ ID NO: 44004 - DNA, 20 bp, synthetic construct
  misc_feature 1..20: note = CRISPR gRNA sequence
  source 1..20: mol_type = other DNA
tttccatgtccccagggtag

SEQ ID NO: 44005 - DNA, 20 bp, synthetic construct
  misc_feature 1..20: note = CRISPR gRNA sequence
  source 1..20: mol_type = other DNA
ttccatgtccccagggtagc

SEQ ID NO: 44006 - DNA, 20 bp, synthetic construct
  misc_feature 1..20: note = CRISPR gRNA sequence
  source 1..20: mol_type = other DNA
ccatgtccccagggtagcag

SEQ ID NO: 44007 - DNA, 20 bp, synthetic construct
  misc_feature 1..20: note = CRISPR gRNA sequence
  source 1..20: mol_type = other DNA
cccagggtagcaggagctcc

SEQ ID NO: 44008 - DNA, 20 bp, synthetic construct
  misc_feature 1..20: note = CRISPR gRNA sequence
  source 1..20: mol_type = other DNA
ccagggtagcaggagctcct

SEQ ID NO: 44009 - DNA, 20 bp, synthetic construct
  misc_feature 1..20: note = CRISPR gRNA sequence
  source 1..20: mol_type = other DNA
cagggtagcaggagctcctg

SEQ ID NO: 44010 - DNA, 20 bp, synthetic construct
  misc_feature 1..20: note = CRISPR gRNA sequence
  source 1..20: mol_type = other DNA
ggagctcctggggcatatgt

SEQ ID NO: 44011 - DNA, 20 bp, synthetic construct
  misc_feature 1..20: note = CRISPR gRNA sequence
  source 1..20: mol_type = other DNA
gagctcctggggcatatgtg

SEQ ID NO: 44012 - DNA, 20 bp, synthetic construct
  misc_feature 1..20: note = CRISPR gRNA sequence
  source 1..20: mol_type = other DNA
agctcctggggcatatgtga

SEQ ID NO: 44013 - DNA, 20 bp, synthetic construct
  misc_feature 1..20: note = CRISPR gRNA sequence
  source 1..20: mol_type = other DNA
gctcctggggcatatgtgag

SEQ ID NO: 44014 - DNA, 20 bp, synthetic construct
  misc_feature 1..20: note = CRISPR gRNA sequence
  source 1..20: mol_type = other DNA
gtgaggggctacacatttgt

SEQ ID NO: 44015 - DNA, 20 bp, synthetic construct
  misc_feature 1..20: note = CRISPR gRNA sequence
  source 1..20: mol_type = other DNA
tgaggggctacacatttgtt

SEQ ID NO: 44016 - DNA, 20 bp, synthetic construct
  misc_feature 1..20: note = CRISPR gRNA sequence
  source 1..20: mol_type = other DNA
ggctacacatttgttgggac

SEQ ID NO: 44017 - DNA, 20 bp, synthetic construct
  misc_feature 1..20: note = CRISPR gRNA sequence
  source 1..20: mol_type = other DNA
cacatttgttgggactagtg

SEQ ID NO: 44018 - DNA, 20 bp, synthetic construct
  misc_feature 1..20: note = CRISPR gRNA sequence
  source 1..20: mol_type = other DNA
atttgttgggactagtgcag

SEQ ID NO: 44019 - DNA, 20 bp, synthetic construct
  misc_feature 1..20: note = CRISPR gRNA sequence
  source 1..20: mol_type = other DNA
ttgggactagtgcagtagtc

SEQ ID NO: 44020 - DNA, 20 bp, synthetic construct
  misc_feature 1..20: note = CRISPR gRNA sequence
  source 1..20: mol_type = other DNA
ctagtgcagtagtcaagcca

SEQ ID NO: 44021 - DNA, 20 bp, synthetic construct
  misc_feature 1..20: note = CRISPR gRNA sequence
  source 1..20: mol_type = other DNA
cagtagtcaagccacagtgt

SEQ ID NO: 44022 - DNA, 20 bp, synthetic construct
  misc_feature 1..20: note = CRISPR gRNA sequence
  source 1..20: mol_type = other DNA
gtagtcaagccacagtgtca

SEQ ID NO: 44023 - DNA, 20 bp, synthetic construct
  misc_feature 1..20: note = CRISPR gRNA sequence
  source 1..20: mol_type = other DNA
tagtcaagccacagtgtcag

SEQ ID NO: 44024 - DNA, 20 bp, synthetic construct
  misc_feature 1..20: note = CRISPR gRNA sequence
  source 1..20: mol_type = other DNA
tcaagccacagtgtcagagg

SEQ ID NO: 44025 - DNA, 20 bp, synthetic construct
  misc_feature 1..20: note = CRISPR gRNA sequence
  source 1..20: mol_type = other DNA
gtgtcagaggaagacatccc

SEQ ID NO: 44026 - DNA, 20 bp, synthetic construct
  misc_feature 1..20: note = CRISPR gRNA sequence
  source 1..20: mol_type = other DNA
acatccccagaatcaaaaca

SEQ ID NO: 44027 - DNA, 20 bp, synthetic construct
  misc_feature 1..20: note = CRISPR gRNA sequence
  source 1..20: mol_type = other DNA
catccccagaatcaaaacaa

SEQ ID NO: 44028 - DNA, 20 bp, synthetic construct
  misc_feature 1..20: note = CRISPR gRNA sequence
  source 1..20: mol_type = other DNA
atccccagaatcaaaacaaa

SEQ ID NO: 44029 - DNA, 20 bp, synthetic construct
  misc_feature 1..20: note = CRISPR gRNA sequence
  source 1..20: mol_type = other DNA
gaatcaaaacaaagggctat

SEQ ID NO: 44030 - DNA, 20 bp, synthetic construct
  misc_feature 1..20: note = CRISPR gRNA sequence
  source 1..20: mol_type = other DNA
aaacaaagggctattggatc

SEQ ID NO: 44031 - DNA, 20 bp, synthetic construct
  misc_feature 1..20: note = CRISPR gRNA sequence
  source 1..20: mol_type = other DNA
aacaaagggctattggatcc

SEQ ID NO: 44032 - DNA, 20 bp, synthetic construct
  misc_feature 1..20: note = CRISPR gRNA sequence
  source 1..20: mol_type = other DNA
aaagggctattggatccagg

SEQ ID NO: 44033 - DNA, 20 bp, synthetic construct
  misc_feature 1..20: note = CRISPR gRNA sequence
  source 1..20: mol_type = other DNA
ctattggatccaggcagaca

SEQ ID NO: 44034 - DNA, 20 bp, synthetic construct
  misc_feature 1..20: note = CRISPR gRNA sequence
  source 1..20: mol_type = other DNA
tggatccaggcagacatggc

SEQ ID NO: 44035 - DNA, 20 bp, synthetic construct
  misc_feature 1..20: note = CRISPR gRNA sequence
  source 1..20: mol_type = other DNA
ggatccaggcagacatggct

SEQ ID NO: 44036 - DNA, 20 bp, synthetic construct
  misc_feature 1..20: note = CRISPR gRNA sequence
  source 1..20: mol_type = other DNA
atccaggcagacatggctgg

SEQ ID NO: 44037 - DNA, 20 bp, synthetic construct
  misc_feature 1..20: note = CRISPR gRNA sequence
  source 1..20: mol_type = other DNA
acatggctgggagtccacgc

SEQ ID NO: 44038 - DNA, 20 bp, synthetic construct
  misc_feature 1..20: note = CRISPR gRNA sequence
  source 1..20: mol_type = other DNA
gggagtccacgctggttgct

SEQ ID NO: 44039 - DNA, 20 bp, synthetic construct
  misc_feature 1..20: note = CRISPR gRNA sequence
  source 1..20: mol_type = other DNA
agtccacgctggttgcttgg

SEQ ID NO: 44040 - DNA, 20 bp, synthetic construct
  misc_feature 1..20: note = CRISPR gRNA sequence
  source 1..20: mol_type = other DNA
ccacgctggttgcttggaag

SEQ ID NO: 44041 - DNA, 20 bp, synthetic construct
  misc_feature 1..20: note = CRISPR gRNA sequence
  source 1..20: mol_type = other DNA
gttgcttggaagtggccccc

SEQ ID NO: 44042 - DNA, 20 bp, synthetic construct
  misc_feature 1..20: note = CRISPR gRNA sequence
  source 1..20: mol_type = other DNA
tggaagtggccccccagatg

SEQ ID NO: 44043 - DNA, 20 bp, synthetic construct
  misc_feature 1..20: note = CRISPR gRNA sequence
  source 1..20: mol_type = other DNA
agatgcagtaacacacatta

SEQ ID NO: 44044 - DNA, 20 bp, synthetic construct
  misc_feature 1..20: note = CRISPR gRNA sequence
  source 1..20: mol_type = other DNA
acacattatggctcttcaac

SEQ ID NO: 44045 - DNA, 20 bp, synthetic construct
  misc_feature 1..20: note = CRISPR gRNA sequence
  source 1..20: mol_type = other DNA
agaaataacacaatgacaca

SEQ ID NO: 44046 - DNA, 20 bp, synthetic construct
  misc_feature 1..20: note = CRISPR gRNA sequence
  source 1..20: mol_type = other DNA
aaataacacaatgacacaca

SEQ ID NO: 44047 - DNA, 20 bp, synthetic construct
  misc_feature 1..20: note = CRISPR gRNA sequence
  source 1..20: mol_type = other DNA
taacacaatgacacacagag

SEQ ID NO: 44048 - DNA, 20 bp, synthetic construct
  misc_feature 1..20: note = CRISPR gRNA sequence
  source 1..20: mol_type = other DNA
atgacacacagagtagctta

SEQ ID NO: 44049 - DNA, 20 bp, synthetic construct
  misc_feature 1..20: note = CRISPR gRNA sequence
  source 1..20: mol_type = other DNA
acacagagtagcttatagca

SEQ ID NO: 44050 - DNA, 20 bp, synthetic construct
  misc_feature 1..20: note = CRISPR gRNA sequence
  source 1..20: mol_type = other DNA
cacagagtagcttatagcaa

SEQ ID NO: 44051 - DNA, 20 bp, synthetic construct
  misc_feature 1..20: note = CRISPR gRNA sequence
  source 1..20: mol_type = other DNA
gtagcttatagcaaaggttt

SEQ ID NO: 44052 - DNA, 20 bp, synthetic construct
  misc_feature 1..20: note = CRISPR gRNA sequence
  source 1..20: mol_type = other DNA
aaaggttttagcatcccact

SEQ ID NO: 44053 - DNA, 20 bp, synthetic construct
  misc_feature 1..20: note = CRISPR gRNA sequence
  source 1..20: mol_type = other DNA
gcatcccactcagctatgtt

SEQ ID NO: 44054 - DNA, 20 bp, synthetic construct
  misc_feature 1..20: note = CRISPR gRNA sequence
  source 1..20: mol_type = other DNA
gctatgttcagatcccaact

SEQ ID NO: 44055 - DNA, 20 bp, synthetic construct
  misc_feature 1..20: note = CRISPR gRNA sequence
  source 1..20: mol_type = other DNA
atcccaactcagtcacttac

SEQ ID NO: 44056 - DNA, 20 bp, synthetic construct
  misc_feature 1..20: note = CRISPR gRNA sequence
  source 1..20: mol_type = other DNA
caactcagtcacttactggt

SEQ ID NO: 44057 - DNA, 20 bp, synthetic construct
  misc_feature 1..20: note = CRISPR gRNA sequence
  source 1..20: mol_type = other DNA
actcagtcacttactggttg

SEQ ID NO: 44058 - DNA, 20 bp, synthetic construct
  misc_feature 1..20: note = CRISPR gRNA sequence
  source 1..20: mol_type = other DNA
cctcaacctcctgctcttaa

SEQ ID NO: 44059 - DNA, 20 bp, synthetic construct
  misc_feature 1..20: note = CRISPR gRNA sequence
  source 1..20: mol_type = other DNA
tcaacctcctgctcttaaaa

SEQ ID NO: 44060 - DNA, 20 bp, synthetic construct
  misc_feature 1..20: note = CRISPR gRNA sequence
  source 1..20: mol_type = other DNA
ctcttaaaagagtctaatta

SEQ ID NO: 44061 - DNA, 20 bp, synthetic construct
  misc_feature 1..20: note = CRISPR gRNA sequence
  source 1..20: mol_type = other DNA
agtctaattacggccctttg

SEQ ID NO: 44062 - DNA, 20 bp, synthetic construct
  misc_feature 1..20: note = CRISPR gRNA sequence
  source 1..20: mol_type = other DNA
gtctaattacggccctttgc

SEQ ID NO: 44063 - DNA, 20 bp, synthetic construct
  misc_feature 1..20: note = CRISPR gRNA sequence
  source 1..20: mol_type = other DNA
tctaattacggccctttgca

SEQ ID NO: 44064 - DNA, 20 bp, synthetic construct
  misc_feature 1..20: note = CRISPR gRNA sequence
  source 1..20: mol_type = other DNA
attacggccctttgcagggc

SEQ ID NO: 44065 - DNA, 20 bp, synthetic construct
  misc_feature 1..20: note = CRISPR gRNA sequence
  source 1..20: mol_type = other DNA
ttacggccctttgcagggct

SEQ ID NO: 44066 - DNA, 20 bp, synthetic construct
  misc_feature 1..20: note = CRISPR gRNA sequence
  source 1..20: mol_type = other DNA
acggccctttgcagggctgg

SEQ ID NO: 44067 - DNA, 20 bp, synthetic construct
  misc_feature 1..20: note = CRISPR gRNA sequence
  source 1..20: mol_type = other DNA
cggccctttgcagggctggg

SEQ ID NO: 44068 - DNA, 20 bp, synthetic construct
  misc_feature 1..20: note = CRISPR gRNA sequence
  source 1..20: mol_type = other DNA
tgcagggctgggaggattac

SEQ ID NO: 44069 - DNA, 20 bp, synthetic construct
  misc_feature 1..20: note = CRISPR gRNA sequence
  source 1..20: mol_type = other DNA
gctgggaggattacaagaac

SEQ ID NO: 44070 - DNA, 20 bp, synthetic construct
  misc_feature 1..20: note = CRISPR gRNA sequence
  source 1..20: mol_type = other DNA
tgggaggattacaagaactg

SEQ ID NO: 44071 - DNA, 20 bp, synthetic construct
  misc_feature 1..20: note = CRISPR gRNA sequence
  source 1..20: mol_type = other DNA
tacaagaactggagcctgta

SEQ ID NO: 44072 - DNA, 20 bp, synthetic construct
  misc_feature 1..20: note = CRISPR gRNA sequence
  source 1..20: mol_type = other DNA
gatgtctgctgtactgtcac

SEQ ID NO: 44073 - DNA, 20 bp, synthetic construct
  misc_feature 1..20: note = CRISPR gRNA sequence
  source 1..20: mol_type = other DNA
ctgtactgtcaccagccaca

SEQ ID NO: 44074 - DNA, 20 bp, synthetic construct
  misc_feature 1..20: note = CRISPR gRNA sequence
  source 1..20: mol_type = other DNA
tgcttcttccttctctcctc

SEQ ID NO: 44075 - DNA, 20 bp, synthetic construct
  misc_feature 1..20: note = CRISPR gRNA sequence
  source 1..20: mol_type = other DNA
gcttcttccttctctcctcc

SEQ ID NO: 44076 - DNA, 20 bp, synthetic construct
  misc_feature 1..20: note = CRISPR gRNA sequence
  source 1..20: mol_type = other DNA
ttcttccttctctcctccag

SEQ ID NO: 44077 - DNA, 20 bp, synthetic construct
  misc_feature 1..20: note = CRISPR gRNA sequence
  source 1..20: mol_type = other DNA
tccttctctcctccaggagt

SEQ ID NO: 44078 - DNA, 20 bp, synthetic construct
  misc_feature 1..20: note = CRISPR gRNA sequence
  source 1..20: mol_type = other DNA
tctctcctccaggagtgagc

SEQ ID NO: 44079 - DNA, 20 bp, synthetic construct
  misc_feature 1..20: note = CRISPR gRNA sequence
  source 1..20: mol_type = other DNA
ctctcctccaggagtgagca

SEQ ID NO: 44080 - DNA, 20 bp, synthetic construct
  misc_feature 1..20: note = CRISPR gRNA sequence
  source 1..20: mol_type = other DNA
tctcctccaggagtgagcaa

SEQ ID NO: 44081 - DNA, 20 bp, synthetic construct
  misc_feature 1..20: note = CRISPR gRNA sequence
  source 1..20: mol_type = other DNA
ctcctccaggagtgagcaag

SEQ ID NO: 44082 - DNA, 20 bp, synthetic construct
  misc_feature 1..20: note = CRISPR gRNA sequence
  source 1..20: mol_type = other DNA
gagtgagcaaggggatgctc

SEQ ID NO: 44083 - DNA, 20 bp, synthetic construct
  misc_feature 1..20: note = CRISPR gRNA sequence
  source 1..20: mol_type = other DNA
agtgagcaaggggatgctct

SEQ ID NO: 44084 - DNA, 20 bp, synthetic construct
  misc_feature 1..20: note = CRISPR gRNA sequence
  source 1..20: mol_type = other DNA
gtgagcaaggggatgctctg

SEQ ID NO: 44085 - DNA, 20 bp, synthetic construct
  misc_feature 1..20: note = CRISPR gRNA sequence
  source 1..20: mol_type = other DNA
ggggactttataatctccca

SEQ ID NO: 44086 - DNA, 20 bp, synthetic construct
  misc_feature 1..20: note = CRISPR gRNA sequence
  source 1..20: mol_type = other DNA
tcccatagccctctccccat

SEQ ID NO: 44087 - DNA, 20 bp, synthetic construct
  misc_feature 1..20: note = CRISPR gRNA sequence
  source 1..20: mol_type = other DNA
accccatgaacataacattc

SEQ ID NO: 44088 - DNA, 20 bp, synthetic construct
  misc_feature 1..20: note = CRISPR gRNA sequence
  source 1..20: mol_type = other DNA
atgaacataacattcaagtg

SEQ ID NO: 44089 - DNA, 20 bp, synthetic construct
  misc_feature 1..20: note = CRISPR gRNA sequence
  source 1..20: mol_type = other DNA
tgaacataacattcaagtga

SEQ ID NO: 44090 - DNA, 20 bp, synthetic construct
  misc_feature 1..20: note = CRISPR gRNA sequence
  source 1..20: mol_type = other DNA
acataacattcaagtgaagg

SEQ ID NO: 44091 - DNA, 20 bp, synthetic construct
  misc_feature 1..20: note = CRISPR gRNA sequence
  source 1..20: mol_type = other DNA
aacattcaagtgaaggcagt

SEQ ID NO: 44092 - DNA, 20 bp, synthetic construct
  misc_feature 1..20: note = CRISPR gRNA sequence
  source 1..20: mol_type = other DNA
tcaagtgaaggcagtgagct

SEQ ID NO: 44093 - DNA, 20 bp, synthetic construct
  misc_feature 1..20: note = CRISPR gRNA sequence
  source 1..20: mol_type = other DNA
aagtgaaggcagtgagctta

SEQ ID NO: 44094 - DNA, 20 bp, synthetic construct
  misc_feature 1..20: note = CRISPR gRNA sequence
  source 1..20: mol_type = other DNA
gtgagcttagagcgcaaatg

SEQ ID NO: 44095 - DNA, 20 bp, synthetic construct
  misc_feature 1..20: note = CRISPR gRNA sequence
  source 1..20: mol_type = other DNA
tagagcgcaaatgcagactc

SEQ ID NO: 44096 - DNA, 20 bp, synthetic construct
  misc_feature 1..20: note = CRISPR gRNA sequence
  source 1..20: mol_type = other DNA
cccacccttccaccacactg

SEQ ID NO: 44097 - DNA, 20 bp, synthetic construct
  misc_feature 1..20: note = CRISPR gRNA sequence
  source 1..20: mol_type = other DNA
tggtccttgtgcccctccct

SEQ ID NO: 44098 - DNA, 20 bp, synthetic construct
  misc_feature 1..20: note = CRISPR gRNA sequence
  source 1..20: mol_type = other DNA
gcccctccctcagaaaattc

SEQ ID NO: 44099 - DNA, 20 bp, synthetic construct
  misc_feature 1..20: note = CRISPR gRNA sequence
  source 1..20: mol_type = other DNA
gaaaattctggaactgccct

SEQ ID NO: 44100 - DNA, 20 bp, synthetic construct
  misc_feature 1..20: note = CRISPR gRNA sequence
  source 1..20: mol_type = other DNA
ctgcccttggatccctctaa

SEQ ID NO: 44101 - DNA, 20 bp, synthetic construct
  misc_feature 1..20: note = CRISPR gRNA sequence
  source 1..20: mol_type = other DNA
cctctaatggctttctgtca

SEQ ID NO: 44102 - DNA, 20 bp, synthetic construct
  misc_feature 1..20: note = CRISPR gRNA sequence
  source 1..20: mol_type = other DNA
gctttctgtcatggtctgaa

SEQ ID NO: 44103 - DNA, 20 bp, synthetic construct
  misc_feature 1..20: note = CRISPR gRNA sequence
  source 1..20: mol_type = other DNA
ctttctgtcatggtctgaaa

SEQ ID NO: 44104 - DNA, 20 bp, synthetic construct
  misc_feature 1..20: note = CRISPR gRNA sequence
  source 1..20: mol_type = other DNA
attaactttaaattgttgaa

SEQ ID NO: 44105 - DNA, 20 bp, synthetic construct
  misc_feature 1..20: note = CRISPR gRNA sequence
  source 1..20: mol_type = other DNA
ttaactttaaattgttgaaa

SEQ ID NO: 44106 - DNA, 20 bp, synthetic construct
  misc_feature 1..20: note = CRISPR gRNA sequence
  source 1..20: mol_type = other DNA
taactttaaattgttgaaaa

SEQ ID NO: 44107 - DNA, 20 bp, synthetic construct
  misc_feature 1..20: note = CRISPR gRNA sequence
  source 1..20: mol_type = other DNA
tttaaattgttgaaaagggc

SEQ ID NO: 44108 - DNA, 20 bp, synthetic construct
  misc_feature 1..20: note = CRISPR gRNA sequence
  source 1..20: mol_type = other DNA
ttaaattgttgaaaagggcc

SEQ ID NO: 44109 - DNA, 20 bp, synthetic construct
  misc_feature 1..20: note = CRISPR gRNA sequence
  source 1..20: mol_type = other DNA
ttgttgaaaagggccaggcg

SEQ ID NO: 44110 - DNA, 20 bp, synthetic construct
  misc_feature 1..20: note = CRISPR gRNA sequence
  source 1..20: mol_type = other DNA
ttgaaaagggccaggcgcgg

SEQ ID NO: 44111 - DNA, 20 bp, synthetic construct
  misc_feature 1..20: note = CRISPR gRNA sequence
  source 1..20: mol_type = other DNA
gtggctcacgcctgtaaccc

SEQ ID NO: 44112 - DNA, 20 bp, synthetic construct
  misc_feature 1..20: note = CRISPR gRNA sequence
  source 1..20: mol_type = other DNA
cgcctgtaaccccagcactt

SEQ ID NO: 44113 - DNA, 20 bp, synthetic construct
  misc_feature 1..20: note = CRISPR gRNA sequence
  source 1..20: mol_type = other DNA
gcctgtaaccccagcacttt

SEQ ID NO: 44114 - DNA, 20 bp, synthetic construct
  misc_feature 1..20: note = CRISPR gRNA sequence
  source 1..20: mol_type = other DNA
ctgtaaccccagcactttgg

SEQ ID NO: 44115 - DNA, 20 bp, synthetic construct
  misc_feature 1..20: note = CRISPR gRNA sequence
  source 1..20: mol_type = other DNA
tgtaaccccagcactttggg

SEQ ID NO: 44116 - DNA, 20 bp, synthetic construct
  misc_feature 1..20: note = CRISPR gRNA sequence
  source 1..20: mol_type = other DNA
ccccagcactttgggaggcc

SEQ ID NO: 44117 - DNA, 20 bp, synthetic construct
  misc_feature 1..20: note = CRISPR gRNA sequence
  source 1..20: mol_type = other DNA
cccagcactttgggaggccg

SEQ ID NO: 44118 - DNA, 20 bp, synthetic construct
  misc_feature 1..20: note = CRISPR gRNA sequence
  source 1..20: mol_type = other DNA
agcactttgggaggccgagg

SEQ ID NO: 44119 - DNA, 20 bp, synthetic construct
  misc_feature 1..20: note = CRISPR gRNA sequence
  source 1..20: mol_type = other DNA
gcactttgggaggccgaggc

SEQ ID NO: 44120 - DNA, 20 bp, synthetic construct
  misc_feature 1..20: note = CRISPR gRNA sequence
  source 1..20: mol_type = other DNA
actttgggaggccgaggcag

SEQ ID NO: 44121 - DNA, 20 bp, synthetic construct
  misc_feature 1..20: note = CRISPR gRNA sequence
  source 1..20: mol_type = other DNA
ctttgggaggccgaggcagg

SEQ ID NO: 44122 - DNA, 20 bp, synthetic construct
  misc_feature 1..20: note = CRISPR gRNA sequence
  source 1..20: mol_type = other DNA
ccgaggcaggaggatcactg

SEQ ID NO: 44123 - DNA, 20 bp, synthetic construct
  misc_feature 1..20: note = CRISPR gRNA sequence
  source 1..20: mol_type = other DNA
gcaggaggatcactgaagcc

SEQ ID NO: 44124 - DNA, 20 bp, synthetic construct
  misc_feature 1..20: note = CRISPR gRNA sequence
  source 1..20: mol_type = other DNA
aggaggatcactgaagccca

SEQ ID NO: 44125 - DNA, 20 bp, synthetic construct
  misc_feature 1..20: note = CRISPR gRNA sequence
  source 1..20: mol_type = other DNA
atcactgaagcccagagttc

SEQ ID NO: 44126 - DNA, 20 bp, synthetic construct
  misc_feature 1..20: note = CRISPR gRNA sequence
  source 1..20: mol_type = other DNA
tcactgaagcccagagttca

SEQ ID NO: 44127 - DNA, 20 bp, synthetic construct
  misc_feature 1..20: note = CRISPR gRNA sequence
  source 1..20: mol_type = other DNA
aagcccagagttcaaggctg

SEQ ID NO: 44128 - DNA, 20 bp, synthetic construct
  misc_feature 1..20: note = CRISPR gRNA sequence
  source 1..20: mol_type = other DNA
ccagagttcaaggctgcagt

SEQ ID NO: 44129 - DNA, 20 bp, synthetic construct
  misc_feature 1..20: note = CRISPR gRNA sequence
  source 1..20: mol_type = other DNA
tcgtgcccaccactgcactt

SEQ ID NO: 44130 - DNA, 20 bp, synthetic construct
  misc_feature 1..20: note = CRISPR gRNA sequence
  source 1..20: mol_type = other DNA
cccaccactgcacttcagcc

SEQ ID NO: 44131 - DNA, 20 bp, synthetic construct
  misc_feature 1..20: note = CRISPR gRNA sequence
  source 1..20: mol_type = other DNA
ccaccactgcacttcagcct

SEQ ID NO: 44132 - DNA, 20 bp, synthetic construct
  misc_feature 1..20: note = CRISPR gRNA sequence
  source 1..20: mol_type = other DNA
ctgcacttcagcctgggcta

SEQ ID NO: 44133 - DNA, 20 bp, synthetic construct
  misc_feature 1..20: note = CRISPR gRNA sequence
  source 1..20: mol_type = other DNA
gcacttcagcctgggctaca

SEQ ID NO: 44134 - DNA, 20 bp, synthetic construct
  misc_feature 1..20: note = CRISPR gRNA sequence
  source 1..20: mol_type = other DNA
ttcagcctgggctacagagc

SEQ ID NO: 44135 - DNA, 20 bp, synthetic construct
  misc_feature 1..20: note = CRISPR gRNA sequence
  source 1..20: mol_type = other DNA
tctctttaaaaaaaaaaaaa

SEQ ID NO: 44136 - DNA, 20 bp, synthetic construct
  misc_feature 1..20: note = CRISPR gRNA sequence
  source 1..20: mol_type = other DNA
tttaaaaaaaaaaaaaaaga

SEQ ID NO: 44137 - DNA, 20 bp, synthetic construct
  misc_feature 1..20: note = CRISPR gRNA sequence
  source 1..20: mol_type = other DNA
taaaaaaaaaaaaaaagaaa

SEQ ID NO: 44138 - DNA, 20 bp, synthetic construct
  misc_feature 1..20: note = CRISPR gRNA sequence
  source 1..20: mol_type = other DNA
gaaagagaaaaattgttgaa

SEQ ID NO: 44139 - DNA, 20 bp, synthetic construct
  misc_feature 1..20: note = CRISPR gRNA sequence
  source 1..20: mol_type = other DNA
aaagagaaaaattgttgaaa

SEQ ID NO: 44140 - DNA, 20 bp, synthetic construct
  misc_feature 1..20: note = CRISPR gRNA sequence
  source 1..20: mol_type = other DNA
attgttgaaaaggcactact

SEQ ID NO: 44141 - DNA, 20 bp, synthetic construct
  misc_feature 1..20: note = CRISPR gRNA sequence
  source 1..20: mol_type = other DNA
ttgttgaaaaggcactactt

SEQ ID NO: 44142 - DNA, 20 bp, synthetic construct
  misc_feature 1..20: note = CRISPR gRNA sequence
  source 1..20: mol_type = other DNA
tgttgaaaaggcactacttg

SEQ ID NO: 44143 - DNA, 20 bp, synthetic construct
  misc_feature 1..20: note = CRISPR gRNA sequence
  source 1..20: mol_type = other DNA
ggggtattgtgtgtgactca

SEQ ID NO: 44144 - DNA, 20 bp, synthetic construct
  misc_feature 1..20: note = CRISPR gRNA sequence
  source 1..20: mol_type = other DNA
gtattgtgtgtgactcacgg

SEQ ID NO: 44145 - DNA, 20 bp, synthetic construct
  misc_feature 1..20: note = CRISPR gRNA sequence
  source 1..20: mol_type = other DNA
tcacggaagcacctactttc

SEQ ID NO: 44146 - DNA, 20 bp, synthetic construct
  misc_feature 1..20: note = CRISPR gRNA sequence
  source 1..20: mol_type = other DNA
agcacctactttccagtcct

SEQ ID NO: 44147 - DNA, 20 bp, synthetic construct
  misc_feature 1..20: note = CRISPR gRNA sequence
  source 1..20: mol_type = other DNA
cctactttccagtcctaagc

SEQ ID NO: 44148 - DNA, 20 bp, synthetic construct
  misc_feature 1..20: note = CRISPR gRNA sequence
  source 1..20: mol_type = other DNA
tccagtcctaagctggtccc

SEQ ID NO: 44149 - DNA, 20 bp, synthetic construct
  misc_feature 1..20: note = CRISPR gRNA sequence
  source 1..20: mol_type = other DNA
agtcctaagctggtccctgg

SEQ ID NO: 44150 - DNA, 20 bp, synthetic construct
  misc_feature 1..20: note = CRISPR gRNA sequence
  source 1..20: mol_type = other DNA
gtcctaagctggtccctggc

SEQ ID NO: 44151 - DNA, 20 bp, synthetic construct
  misc_feature 1..20: note = CRISPR gRNA sequence
  source 1..20: mol_type = other DNA
tcctaagctggtccctggca

SEQ ID NO: 44152 - DNA, 20 bp, synthetic construct
  misc_feature 1..20: note = CRISPR gRNA sequence
  source 1..20: mol_type = other DNA
cctaagctggtccctggcag

SEQ ID NO: 44153 - DNA, 20 bp, synthetic construct
  misc_feature 1..20: note = CRISPR gRNA sequence
  source 1..20: mol_type = other DNA
taagctggtccctggcaggg

SEQ ID NO: 44154 - DNA, 20 bp, synthetic construct
  misc_feature 1..20: note = CRISPR gRNA sequence
  source 1..20: mol_type = other DNA
gctggtccctggcaggggag

SEQ ID NO: 44155 - DNA, 20 bp, synthetic construct
  misc_feature 1..20: note = CRISPR gRNA sequence
  source 1..20: mol_type = other DNA
ctggtccctggcaggggaga

SEQ ID NO: 44156 - DNA, 20 bp, synthetic construct
  misc_feature 1..20: note = CRISPR gRNA sequence
  source 1..20: mol_type = other DNA
tggtccctggcaggggagaa

SEQ ID NO: 44157 - DNA, 20 bp, synthetic construct
  misc_feature 1..20: note = CRISPR gRNA sequence
  source 1..20: mol_type = other DNA
ggtccctggcaggggagaag

SEQ ID NO: 44158 - DNA, 20 bp, synthetic construct
  misc_feature 1..20: note = CRISPR gRNA sequence
  source 1..20: mol_type = other DNA
tggcaggggagaaggggacc

SEQ ID NO: 44159 - DNA, 20 bp, synthetic construct
  misc_feature 1..20: note = CRISPR gRNA sequence
  source 1..20: mol_type = other DNA
ggcaggggagaaggggaccc

SEQ ID NO: 44160 - DNA, 20 bp, synthetic construct
  misc_feature 1..20: note = CRISPR gRNA sequence
  source 1..20: mol_type = other DNA
gggagaaggggacccaggca

SEQ ID NO: 44161 - DNA, 20 bp, synthetic construct
  misc_feature 1..20: note = CRISPR gRNA sequence
  source 1..20: mol_type = other DNA
gaaggggacccaggcaaagt

SEQ ID NO: 44162 - DNA, 20 bp, synthetic construct
  misc_feature 1..20: note = CRISPR gRNA sequence
  source 1..20: mol_type = other DNA
aggggacccaggcaaagtga

SEQ ID NO: 44163 - DNA, 20 bp, synthetic construct
  misc_feature 1..20: note = CRISPR gRNA sequence
  source 1..20: mol_type = other DNA
acccaggcaaagtgagagtt

SEQ ID NO: 44164 - DNA, 20 bp, synthetic construct
  misc_feature 1..20: note = CRISPR gRNA sequence
  source 1..20: mol_type = other DNA
ccaggcaaagtgagagttca

SEQ ID NO: 44165 - DNA, 20 bp, synthetic construct
  misc_feature 1..20: note = CRISPR gRNA sequence
  source 1..20: mol_type = other DNA
gcaaagtgagagttcagagt

SEQ ID NO: 44166 - DNA, 20 bp, synthetic construct
  misc_feature 1..20: note = CRISPR gRNA sequence
  source 1..20: mol_type = other DNA
aaagtgagagttcagagttg

SEQ ID NO: 44167 - DNA, 20 bp, synthetic construct
  misc_feature 1..20: note = CRISPR gRNA sequence
  source 1..20: mol_type = other DNA
tgagagttcagagttggagc

SEQ ID NO: 44168 - DNA, 20 bp, synthetic construct
  misc_feature 1..20: note = CRISPR gRNA sequence
  source 1..20: mol_type = other DNA
gagagttcagagttggagcc

SEQ ID NO: 44169 - DNA, 20 bp, synthetic construct
  misc_feature 1..20: note = CRISPR gRNA sequence
  source 1..20: mol_type = other DNA
agttcagagttggagccggg

SEQ ID NO: 44170 - DNA, 20 bp, synthetic construct
  misc_feature 1..20: note = CRISPR gRNA sequence
  source 1..20: mol_type = other DNA
agagttggagccgggcagcc

SEQ ID NO: 44171 - DNA, 20 bp, synthetic construct
  misc_feature 1..20: note = CRISPR gRNA sequence
  source 1..20: mol_type = other DNA
gagttggagccgggcagccc

SEQ ID NO: 44172 - DNA, 20 bp, synthetic construct
  misc_feature 1..20: note = CRISPR gRNA sequence
  source 1..20: mol_type = other DNA
gagccgggcagcccaggtgc

SEQ ID NO: 44173 - DNA, 20 bp, synthetic construct
  misc_feature 1..20: note = CRISPR gRNA sequence
  source 1..20: mol_type = other DNA
cgggcagcccaggtgccagc

SEQ ID NO: 44174 - DNA, 20 bp, synthetic construct
  misc_feature 1..20: note = CRISPR gRNA sequence
  source 1..20: mol_type = other DNA
gggcagcccaggtgccagct

SEQ ID NO: 44175 - DNA, 20 bp, synthetic construct
  misc_feature 1..20: note = CRISPR gRNA sequence
  source 1..20: mol_type = other DNA
caggtgccagctaggccctc

SEQ ID NO: 44176 - DNA, 20 bp, synthetic construct
  misc_feature 1..20: note = CRISPR gRNA sequence
  source 1..20: mol_type = other DNA
aggtgccagctaggccctcc

SEQ ID NO: 44177 - DNA, 20 bp, synthetic construct
  misc_feature 1..20: note = CRISPR gRNA sequence
  source 1..20: mol_type = other DNA
ggtgccagctaggccctccg

SEQ ID NO: 44178 - DNA, 20 bp, synthetic construct
  misc_feature 1..20: note = CRISPR gRNA sequence
  source 1..20: mol_type = other DNA
gccagctaggccctccgggg

SEQ ID NO: 44179 - DNA, 20 bp, synthetic construct
  misc_feature 1..20: note = CRISPR gRNA sequence
  source 1..20: mol_type = other DNA
ccagctaggccctccgggga

SEQ ID NO: 44180 - DNA, 20 bp, synthetic construct
  misc_feature 1..20: note = CRISPR gRNA sequence
  source 1..20: mol_type = other DNA
aaggctgcccgacctcacgt

SEQ ID NO: 44181 - DNA, 20 bp, synthetic construct
  misc_feature 1..20: note = CRISPR gRNA sequence
  source 1..20: mol_type = other DNA
gttggttactgctcactcct

SEQ ID NO: 44182 - DNA, 20 bp, synthetic construct
  misc_feature 1..20: note = CRISPR gRNA sequence
  source 1..20: mol_type = other DNA
gctcactcctcagcatctcc

SEQ ID NO: 44183 - DNA, 20 bp, synthetic construct
  misc_feature 1..20: note = CRISPR gRNA sequence
  source 1..20: mol_type = other DNA
tcctcagcatctccgagacc

SEQ ID NO: 44184 - DNA, 20 bp, synthetic construct
  misc_feature 1..20: note = CRISPR gRNA sequence
  source 1..20: mol_type = other DNA
tcagcatctccgagacccag

SEQ ID NO: 44185 - DNA, 20 bp, synthetic construct
  misc_feature 1..20: note = CRISPR gRNA sequence
  source 1..20: mol_type = other DNA
gcatctccgagacccagcag

SEQ ID NO: 44186 - DNA, 20 bp, synthetic construct
  misc_feature 1..20: note = CRISPR gRNA sequence
  source 1..20: mol_type = other DNA
cccagcagcagctctgtgtc

SEQ ID NO: 44187 - DNA, 20 bp, synthetic construct
  misc_feature 1..20: note = CRISPR gRNA sequence
  source 1..20: mol_type = other DNA
gcagcagctctgtgtccagc

SEQ ID NO: 44188 - DNA, 20 bp, synthetic construct
  misc_feature 1..20: note = CRISPR gRNA sequence
  source 1..20: mol_type = other DNA
tccagctggaatttcctcgc

SEQ ID NO: 44189 - DNA, 20 bp, synthetic construct
  misc_feature 1..20: note = CRISPR gRNA sequence
  source 1..20: mol_type = other DNA
ccagctggaatttcctcgcc

SEQ ID NO: 44190 - DNA, 20 bp, synthetic construct
  misc_feature 1..20: note = CRISPR gRNA sequence
  source 1..20: mol_type = other DNA
gctggaatttcctcgccagg

SEQ ID NO: 44191 - DNA, 20 bp, synthetic construct
  misc_feature 1..20: note = CRISPR gRNA sequence
  source 1..20: mol_type = other DNA
tggaatttcctcgccaggaa

SEQ ID NO: 44192 - DNA, 20 bp, synthetic construct
  misc_feature 1..20: note = CRISPR gRNA sequence
  source 1..20: mol_type = other DNA
tcctcgccaggaagagaatc

SEQ ID NO: 44193 - DNA, 20 bp, synthetic construct
  misc_feature 1..20: note = CRISPR gRNA sequence
  source 1..20: mol_type = other DNA
tcgccaggaagagaatccag

SEQ ID NO: 44194 - DNA, 20 bp, synthetic construct
  misc_feature 1..20: note = CRISPR gRNA sequence
  source 1..20: mol_type = other DNA
ggaagagaatccagaagctg

SEQ ID NO: 44195 - DNA, 20 bp, synthetic construct
  misc_feature 1..20: note = CRISPR gRNA sequence
  source 1..20: mol_type = other DNA
aatccagaagctgtggcact

SEQ ID NO: 44196 - DNA, 20 bp, synthetic construct
  misc_feature 1..20: note = CRISPR gRNA sequence
  source 1..20: mol_type = other DNA
atccagaagctgtggcactc

SEQ ID NO: 44197 - DNA, 20 bp, synthetic construct
  misc_feature 1..20: note = CRISPR gRNA sequence
  source 1..20: mol_type = other DNA
cagaagctgtggcactcagg

SEQ ID NO: 44198 - DNA, 20 bp, synthetic construct
  misc_feature 1..20: note = CRISPR gRNA sequence
  source 1..20: mol_type = other DNA
agaagctgtggcactcaggt

SEQ ID NO: 44199 - DNA, 20 bp, synthetic construct
  misc_feature 1..20: note = CRISPR gRNA sequence
  source 1..20: mol_type = other DNA
tgtggcactcaggtgggacc

SEQ ID NO: 44200 - DNA, 20 bp, synthetic construct
  misc_feature 1..20: note = CRISPR gRNA sequence
  source 1..20: mol_type = other DNA
actcaggtgggacccagcac

SEQ ID NO: 44201 - DNA, 20 bp, synthetic construct
  misc_feature 1..20: note = CRISPR gRNA sequence
  source 1..20: mol_type = other DNA
ctcaggtgggacccagcacc

SEQ ID NO: 44202 - DNA, 20 bp, synthetic construct
  misc_feature 1..20: note = CRISPR gRNA sequence
  source 1..20: mol_type = other DNA
tcaggtgggacccagcacca

SEQ ID NO: 44203 - DNA, 20 bp, synthetic construct
  misc_feature 1..20: note = CRISPR gRNA sequence
  source 1..20: mol_type = other DNA
gacccagcaccagggacccc

SEQ ID NO: 44204 - DNA, 20 bp, synthetic construct
  misc_feature 1..20: note = CRISPR gRNA sequence
  source 1..20: mol_type = other DNA
acccagcaccagggacccca

SEQ ID NO: 44205 - DNA, 20 bp, synthetic construct
  misc_feature 1..20: note = CRISPR gRNA sequence
  source 1..20: mol_type = other DNA
cagcaccagggaccccaagg

SEQ ID NO: 44206 - DNA, 20 bp, synthetic construct
  misc_feature 1..20: note = CRISPR gRNA sequence
  source 1..20: mol_type = other DNA
agcaccagggaccccaaggc

SEQ ID NO: 44207 - DNA, 20 bp, synthetic construct
  misc_feature 1..20: note = CRISPR gRNA sequence
  source 1..20: mol_type = other DNA
gcaccagggaccccaaggca

SEQ ID NO: 44208 - DNA, 20 bp, synthetic construct
  misc_feature 1..20: note = CRISPR gRNA sequence
  source 1..20: mol_type = other DNA
caccagggaccccaaggcag

SEQ ID NO: 44209 - DNA, 20 bp, synthetic construct
  misc_feature 1..20: note = CRISPR gRNA sequence
  source 1..20: mol_type = other DNA
agggaccccaaggcaggggc

SEQ ID NO: 44210 - DNA, 20 bp, synthetic construct
  misc_feature 1..20: note = CRISPR gRNA sequence
  source 1..20: mol_type = other DNA
cccaaggcaggggctggtgt

SEQ ID NO: 44211 - DNA, 20 bp, synthetic construct
  misc_feature 1..20: note = CRISPR gRNA sequence
  source 1..20: mol_type = other DNA
ccaaggcaggggctggtgtt

SEQ ID NO: 44212 - DNA, 20 bp, synthetic construct
  misc_feature 1..20: note = CRISPR gRNA sequence
  source 1..20: mol_type = other DNA
caaggcaggggctggtgttg

SEQ ID NO: 44213 - DNA, 20 bp, synthetic construct
  misc_feature 1..20: note = CRISPR gRNA sequence
  source 1..20: mol_type = other DNA
aggcaggggctggtgttggg

SEQ ID NO: 44214 - DNA, 20 bp, synthetic construct
  misc_feature 1..20: note = CRISPR gRNA sequence
  source 1..20: mol_type = other DNA
ggcaggggctggtgttgggg

SEQ ID NO: 44215 - DNA, 20 bp, synthetic construct
  misc_feature 1..20: note = CRISPR gRNA sequence
  source 1..20: mol_type = other DNA
gcaggggctggtgttgggga

SEQ ID NO: 44216 - DNA, 20 bp, synthetic construct
  misc_feature 1..20: note = CRISPR gRNA sequence
  source 1..20: mol_type = other DNA
caggggctggtgttggggag

SEQ ID NO: 44217 - DNA, 20 bp, synthetic construct
  misc_feature 1..20: note = CRISPR gRNA sequence
  source 1..20: mol_type = other DNA
aggggctggtgttggggagg

SEQ ID NO: 44218 - DNA, 20 bp, synthetic construct
  misc_feature 1..20: note = CRISPR gRNA sequence
  source 1..20: mol_type = other DNA
ggctggtgttggggaggggg

SEQ ID NO: 44219 - DNA, 20 bp, synthetic construct
  misc_feature 1..20: note = CRISPR gRNA sequence
  source 1..20: mol_type = other DNA
gctggtgttggggagggggc

SEQ ID NO: 44220 - DNA, 20 bp, synthetic construct
  misc_feature 1..20: note = CRISPR gRNA sequence
  source 1..20: mol_type = other DNA
ctggtgttggggagggggca

SEQ ID NO: 44221 - DNA, 20 bp, synthetic construct
  misc_feature 1..20: note = CRISPR gRNA sequence
  source 1..20: mol_type = other DNA
ccaatattcaccaccctgcc

SEQ ID NO: 44222 - DNA, 20 bp, synthetic construct
  misc_feature 1..20: note = CRISPR gRNA sequence
  source 1..20: mol_type = other DNA
aatattcaccaccctgccca

SEQ ID NO: 44223 - DNA, 20 bp, synthetic construct
  misc_feature 1..20: note = CRISPR gRNA sequence
  source 1..20: mol_type = other DNA
accaccctgcccagagacct

SEQ ID NO: 44224 - DNA, 20 bp, synthetic construct
  misc_feature 1..20: note = CRISPR gRNA sequence
  source 1..20: mol_type = other DNA
ccaccctgcccagagacctt

SEQ ID NO: 44225 - DNA, 20 bp, synthetic construct
  misc_feature 1..20: note = CRISPR gRNA sequence
  source 1..20: mol_type = other DNA
caccctgcccagagacctta

SEQ ID NO: 44226 - DNA, 20 bp, synthetic construct
  misc_feature 1..20: note = CRISPR gRNA sequence
  source 1..20: mol_type = other DNA
accctgcccagagaccttag

SEQ ID NO: 44227 - DNA, 20 bp, synthetic construct
  misc_feature 1..20: note = CRISPR gRNA sequence
  source 1..20: mol_type = other DNA
ccagagaccttaggggttcg

SEQ ID NO: 44228 - DNA, 20 bp, synthetic construct
  misc_feature 1..20: note = CRISPR gRNA sequence
  source 1..20: mol_type = other DNA
aggggttcgaagtctttaca

SEQ ID NO: 44229 - DNA, 20 bp, synthetic construct
  misc_feature 1..20: note = CRISPR gRNA sequence
  source 1..20: mol_type = other DNA
ggggttcgaagtctttacac

SEQ ID NO: 44230 - DNA, 20 bp, synthetic construct
  misc_feature 1..20: note = CRISPR gRNA sequence
  source 1..20: mol_type = other DNA
cgaagtctttacacaggcta

SEQ ID NO: 44231 - DNA, 20 bp, synthetic construct
  misc_feature 1..20: note = CRISPR gRNA sequence
  source 1..20: mol_type = other DNA
aagtctttacacaggctaca

SEQ ID NO: 44232 - DNA, 20 bp, synthetic construct
  misc_feature 1..20: note = CRISPR gRNA sequence
  source 1..20: mol_type = other DNA
agtctttacacaggctacag

SEQ ID NO: 44233 - DNA, 20 bp, synthetic construct
  misc_feature 1..20: note = CRISPR gRNA sequence
  source 1..20: mol_type = other DNA
ggtctgaccaacccacttct

SEQ ID NO: 44234 - DNA, 20 bp, synthetic construct
  misc_feature 1..20: note = CRISPR gRNA sequence
  source 1..20: mol_type = other DNA
gtctgaccaacccacttctg

SEQ ID NO: 44235 - DNA, 20 bp, synthetic construct
  misc_feature 1..20: note = CRISPR gRNA sequence
  source 1..20: mol_type = other DNA
aacccacttctgaggcgttt

SEQ ID NO: 44236 - DNA, 20 bp, synthetic construct
  misc_feature 1..20: note = CRISPR gRNA sequence
  source 1..20: mol_type = other DNA
gaggcgtttcagccccactc

SEQ ID NO: 44237 - DNA, 20 bp, synthetic construct
  misc_feature 1..20: note = CRISPR gRNA sequence
  source 1..20: mol_type = other DNA
aggcgtttcagccccactcc

SEQ ID NO: 44238 - DNA, 20 bp, synthetic construct
  misc_feature 1..20: note = CRISPR gRNA sequence
  source 1..20: mol_type = other DNA
ttcagccccactccaggccc

SEQ ID NO: 44239 - DNA, 20 bp, synthetic construct
  misc_feature 1..20: note = CRISPR gRNA sequence
  source 1..20: mol_type = other DNA
cccactccaggccccagtct

SEQ ID NO: 44240 - DNA, 20 bp, synthetic construct
  misc_feature 1..20: note = CRISPR gRNA sequence
  source 1..20: mol_type = other DNA
ccaggccccagtctcagctc

SEQ ID NO: 44241 - DNA, 20 bp, synthetic construct
  misc_feature 1..20: note = CRISPR gRNA sequence
  source 1..20: mol_type = other DNA
cagtcacccccatgaacttt

SEQ ID NO: 44242 - DNA, 20 bp, synthetic construct
  misc_feature 1..20: note = CRISPR gRNA sequence
  source 1..20: mol_type = other DNA
tccccgaacaccatcttgct

SEQ ID NO: 44243 - DNA, 20 bp, synthetic construct
  misc_feature 1..20: note = CRISPR gRNA sequence
  source 1..20: mol_type = other DNA
acaccatcttgcttagacct

SEQ ID NO: 44244 - DNA, 20 bp, synthetic construct
  misc_feature 1..20: note = CRISPR gRNA sequence
  source 1..20: mol_type = other DNA
caccatcttgcttagacctt

SEQ ID NO: 44245 - DNA, 20 bp, synthetic construct
  misc_feature 1..20: note = CRISPR gRNA sequence
  source 1..20: mol_type = other DNA
accatcttgcttagacctta

SEQ ID NO: 44246 - DNA, 20 bp, synthetic construct
  misc_feature 1..20: note = CRISPR gRNA sequence
  source 1..20: mol_type = other DNA
tagaccttagggcatttgca

SEQ ID NO: 44247 - DNA, 20 bp, synthetic construct
  misc_feature 1..20: note = CRISPR gRNA sequence
  source 1..20: mol_type = other DNA
agaccttagggcatttgcac

SEQ ID NO: 44248 - DNA, 20 bp, synthetic construct
  misc_feature 1..20: note = CRISPR gRNA sequence
  source 1..20: mol_type = other DNA
cacaggctgtgctctctgcc

SEQ ID NO: 44249 - DNA, 20 bp, synthetic construct
  misc_feature 1..20: note = CRISPR gRNA sequence
  source 1..20: mol_type = other DNA
cctaactcctcctcatccct

SEQ ID NO: 44250 - DNA, 20 bp, synthetic construct
  misc_feature 1..20: note = CRISPR gRNA sequence
  source 1..20: mol_type = other DNA
ctaactcctcctcatccctc

SEQ ID NO: 44251 - DNA, 20 bp, synthetic construct
  misc_feature 1..20: note = CRISPR gRNA sequence
  source 1..20: mol_type = other DNA
cctcctcatccctcaggtct

SEQ ID NO: 44252 - DNA, 20 bp, synthetic construct
  misc_feature 1..20: note = CRISPR gRNA sequence
  source 1..20: mol_type = other DNA
cagcttaaatgccaccacct

SEQ ID NO: 44253 - DNA, 20 bp, synthetic construct
  misc_feature 1..20: note = CRISPR gRNA sequence
  source 1..20: mol_type = other DNA
agcttaaatgccaccacctc

SEQ ID NO: 44254 - DNA, 20 bp, synthetic construct
  misc_feature 1..20: note = CRISPR gRNA sequence
  source 1..20: mol_type = other DNA
gcttaaatgccaccacctca

SEQ ID NO: 44255 - DNA, 20 bp, synthetic construct
  misc_feature 1..20: note = CRISPR gRNA sequence
  source 1..20: mol_type = other DNA
ttaaatgccaccacctcagg

SEQ ID NO: 44256 - DNA, 20 bp, synthetic construct
  misc_feature 1..20: note = CRISPR gRNA sequence
  source 1..20: mol_type = other DNA
taaatgccaccacctcaggg

SEQ ID NO: 44257 - DNA, 20 bp, synthetic construct
  misc_feature 1..20: note = CRISPR gRNA sequence
  source 1..20: mol_type = other DNA
accacctcagggaggccccc

SEQ ID NO: 44258 - DNA, 20 bp, synthetic construct
  misc_feature 1..20: note = CRISPR gRNA sequence
  source 1..20: mol_type = other DNA
agggaggccccctggacccc

SEQ ID NO: 44259 - DNA, 20 bp, synthetic construct
  misc_feature 1..20: note = CRISPR gRNA sequence
  source 1..20: mol_type = other DNA
gggaggccccctggacccca

SEQ ID NO: 44260 - DNA, 20 bp, synthetic construct
  misc_feature 1..20: note = CRISPR gRNA sequence
  source 1..20: mol_type = other DNA
gccccctggaccccaaggct

SEQ ID NO: 44261 - DNA, 20 bp, synthetic construct
  misc_feature 1..20: note = CRISPR gRNA sequence
  source 1..20: mol_type = other DNA
acttccattatccactctta

SEQ ID NO: 44262 - DNA, 20 bp, synthetic construct
  misc_feature 1..20: note = CRISPR gRNA sequence
  source 1..20: mol_type = other DNA
tatccactcttatagatccc

SEQ ID NO: 44263 - DNA, 20 bp, synthetic construct
  misc_feature 1..20: note = CRISPR gRNA sequence
  source 1..20: mol_type = other DNA
cttatagatccctggattca

SEQ ID NO: 44264 - DNA, 20 bp, synthetic construct
  misc_feature 1..20: note = CRISPR gRNA sequence
  source 1..20: mol_type = other DNA
acagcacctctaaatccata

SEQ ID NO: 44265 - DNA, 20 bp, synthetic construct
  misc_feature 1..20: note = CRISPR gRNA sequence
  source 1..20: mol_type = other DNA
acctctaaatccatatggca

SEQ ID NO: 44266 - DNA, 20 bp, synthetic construct
  misc_feature 1..20: note = CRISPR gRNA sequence
  source 1..20: mol_type = other DNA
taaatccatatggcacagtt

SEQ ID NO: 44267 - DNA, 20 bp, synthetic construct
  misc_feature 1..20: note = CRISPR gRNA sequence
  source 1..20: mol_type = other DNA
aaatccatatggcacagttt

SEQ ID NO: 44268 - DNA, 20 bp, synthetic construct
  misc_feature 1..20: note = CRISPR gRNA sequence
  source 1..20: mol_type = other DNA
aattaaaatgtcaccctttt

SEQ ID NO: 44269 - DNA, 20 bp, synthetic construct
  misc_feature 1..20: note = CRISPR gRNA sequence
  source 1..20: mol_type = other DNA
taaaatgtcacccttttgag

SEQ ID NO: 44270 - DNA, 20 bp, synthetic construct
  misc_feature 1..20: note = CRISPR gRNA sequence
  source 1..20: mol_type = other DNA
gtcacccttttgagtggatg

SEQ ID NO: 44271 - DNA, 20 bp, synthetic construct
  misc_feature 1..20: note = CRISPR gRNA sequence
  source 1..20: mol_type = other DNA
agccctgcatgtgtacattc

SEQ ID NO: 44272 - DNA, 20 bp, synthetic construct
  misc_feature 1..20: note = CRISPR gRNA sequence
  source 1..20: mol_type = other DNA
gccctgcatgtgtacattct

SEQ ID NO: 44273 - DNA, 20 bp, synthetic construct
  misc_feature 1..20: note = CRISPR gRNA sequence
  source 1..20: mol_type = other DNA
catgtgtacattctgggaaa

SEQ ID NO: 44274 - DNA, 20 bp, synthetic construct
  misc_feature 1..20: note = CRISPR gRNA sequence
  source 1..20: mol_type = other DNA
tgtgtacattctgggaaata

SEQ ID NO: 44275 - DNA, 20 bp, synthetic construct
  misc_feature 1..20: note = CRISPR gRNA sequence
  source 1..20: mol_type = other DNA
acattctgggaaatagagca

SEQ ID NO: 44276 - DNA, 20 bp, synthetic construct
  misc_feature 1..20: note = CRISPR gRNA sequence
  source 1..20: mol_type = other DNA
ttctgggaaatagagcatgg

SEQ ID NO: 44277 - DNA, 20 bp, synthetic construct
  misc_feature 1..20: note = CRISPR gRNA sequence
  source 1..20: mol_type = other DNA
tctgggaaatagagcatggt

SEQ ID NO: 44278 - DNA, 20 bp, synthetic construct
  misc_feature 1..20: note = CRISPR gRNA sequence
  source 1..20: mol_type = other DNA
aatagagcatggtaggatct

SEQ ID NO: 44279 - DNA, 20 bp, synthetic construct
  misc_feature 1..20: note = CRISPR gRNA sequence
  source 1..20: mol_type = other DNA
tcagcctcacctcacctcct

SEQ ID NO: 44280 - DNA, 20 bp, synthetic construct
  misc_feature 1..20: note = CRISPR gRNA sequence
  source 1..20: mol_type = other DNA
ctcggctgtgtgtccttgtg

SEQ ID NO: 44281 - DNA, 20 bp, synthetic construct
  misc_feature 1..20: note = CRISPR gRNA sequence
  source 1..20: mol_type = other DNA
aacaacctgcacaaccatac

SEQ ID NO: 44282 - DNA, 20 bp, synthetic construct
  misc_feature 1..20: note = CRISPR gRNA sequence
  source 1..20: mol_type = other DNA
accataccagctgccccatc

SEQ ID NO: 44283 - DNA, 20 bp, synthetic construct
  misc_feature 1..20: note = CRISPR gRNA sequence
  source 1..20: mol_type = other DNA
ccatctggactcctgcttcc

SEQ ID NO: 44284 - DNA, 20 bp, synthetic construct
  misc_feature 1..20: note = CRISPR gRNA sequence
  source 1..20: mol_type = other DNA
tgcttcctagcacttctcat

SEQ ID NO: 44285 - DNA, 20 bp, synthetic construct
  misc_feature 1..20: note = CRISPR gRNA sequence
  source 1..20: mol_type = other DNA
tagcacttctcataagtgaa

SEQ ID NO: 44286 - DNA, 20 bp, synthetic construct
  misc_feature 1..20: note = CRISPR gRNA sequence
  source 1..20: mol_type = other DNA
cataagtgaatagcaaactg

SEQ ID NO: 44287 - DNA, 20 bp, synthetic construct
  misc_feature 1..20: note = CRISPR gRNA sequence
  source 1..20: mol_type = other DNA
ataagtgaatagcaaactgt

SEQ ID NO: 44288 - DNA, 20 bp, synthetic construct
  misc_feature 1..20: note = CRISPR gRNA sequence
  source 1..20: mol_type = other DNA
actgtaggacttcatttgat

SEQ ID NO: 44289 - DNA, 20 bp, synthetic construct
  misc_feature 1..20: note = CRISPR gRNA sequence
  source 1..20: mol_type = other DNA
tttatttacccctacaccat

SEQ ID NO: 44290 - DNA, 20 bp, synthetic construct
  misc_feature 1..20: note = CRISPR gRNA sequence
  source 1..20: mol_type = other DNA
cctacaccataagctccttg

SEQ ID NO: 44291 - DNA, 20 bp, synthetic construct
  misc_feature 1..20: note = CRISPR gRNA sequence
  source 1..20: mol_type = other DNA
ctacaccataagctccttgc

SEQ ID NO: 44292 - DNA, 20 bp, synthetic construct
  misc_feature 1..20: note = CRISPR gRNA sequence
  source 1..20: mol_type = other DNA
caccataagctccttgcagg

SEQ ID NO: 44293 - DNA, 20 bp, synthetic construct
  misc_feature 1..20: note = CRISPR gRNA sequence
  source 1..20: mol_type = other DNA
agatactgaatcccacatac

SEQ ID NO: 44294 - DNA, 20 bp, synthetic construct
  misc_feature 1..20: note = CRISPR gRNA sequence
  source 1..20: mol_type = other DNA
ctgaatcccacatactggac

SEQ ID NO: 44295 - DNA, 20 bp, synthetic construct
  misc_feature 1..20: note = CRISPR gRNA sequence
  source 1..20: mol_type = other DNA
gtcgtctccctgtctgtgtc

SEQ ID NO: 44296 - DNA, 20 bp, synthetic construct
  misc_feature 1..20: note = CRISPR gRNA sequence
  source 1..20: mol_type = other DNA
tcgtctccctgtctgtgtcc

SEQ ID NO: 44297 - DNA, 20 bp, synthetic construct
  misc_feature 1..20: note = CRISPR gRNA sequence
  source 1..20: mol_type = other DNA
ctccctgtctgtgtccaggt

SEQ ID NO: 44298 - DNA, 20 bp, synthetic construct
  misc_feature 1..20: note = CRISPR gRNA sequence
  source 1..20: mol_type = other DNA
aggttggctcactgtgacct

SEQ ID NO: 44299 - DNA, 20 bp, synthetic construct
  misc_feature 1..20: note = CRISPR gRNA sequence
  source 1..20: mol_type = other DNA
gttggctcactgtgaccttg

SEQ ID NO: 44300 - DNA, 20 bp, synthetic construct
  misc_feature 1..20: note = CRISPR gRNA sequence
  source 1..20: mol_type = other DNA
tgtgaccttggagcccacca

SEQ ID NO: 44301 - DNA, 20 bp, synthetic construct
  misc_feature 1..20: note = CRISPR gRNA sequence
  source 1..20: mol_type = other DNA
gcccaccacagccttcttgt

SEQ ID NO: 44302 - DNA, 20 bp, synthetic construct
  misc_feature 1..20: note = CRISPR gRNA sequence
  source 1..20: mol_type = other DNA
cccaccacagccttcttgtc

SEQ ID NO: 44303 - DNA, 20 bp, synthetic construct
  misc_feature 1..20: note = CRISPR gRNA sequence
  source 1..20: mol_type = other DNA
accacagccttcttgtcggg

SEQ ID NO: 44304 - DNA, 20 bp, synthetic construct
  misc_feature 1..20: note = CRISPR gRNA sequence
  source 1..20: mol_type = other DNA
ccttcttgtcgggcagctga

SEQ ID NO: 44305 - DNA, 20 bp, synthetic construct
  misc_feature 1..20: note = CRISPR gRNA sequence
  source 1..20: mol_type = other DNA
ttcttgtcgggcagctgatg

SEQ ID NO: 44306 - DNA, 20 bp, synthetic construct
  misc_feature 1..20: note = CRISPR gRNA sequence
  source 1..20: mol_type = other DNA
cagctgatggagacatgtgc

SEQ ID NO: 44307 - DNA, 20 bp, synthetic construct
  misc_feature 1..20: note = CRISPR gRNA sequence
  source 1..20: mol_type = other DNA
agctgatggagacatgtgcc

SEQ ID NO: 44308 - DNA, 20 bp, synthetic construct
  misc_feature 1..20: note = CRISPR gRNA sequence
  source 1..20: mol_type = other DNA
tggagacatgtgccaggctg

SEQ ID NO: 44309 - DNA, 20 bp, synthetic construct
  misc_feature 1..20: note = CRISPR gRNA sequence
  source 1..20: mol_type = other DNA
agacatgtgccaggctgcag

SEQ ID NO: 44310 - DNA, 20 bp, synthetic construct
  misc_feature 1..20: note = CRISPR gRNA sequence
  source 1..20: mol_type = other DNA
tgtgccaggctgcagcagct

SEQ ID NO: 44311 - DNA, 20 bp, synthetic construct
  misc_feature 1..20: note = CRISPR gRNA sequence
  source 1..20: mol_type = other DNA
gtgccaggctgcagcagctc

SEQ ID NO: 44312 - DNA, 20 bp, synthetic construct
  misc_feature 1..20: note = CRISPR gRNA sequence
  source 1..20: mol_type = other DNA
caggctgcagcagctcaggt

SEQ ID NO: 44313 - DNA, 20 bp, synthetic construct
  misc_feature 1..20: note = CRISPR gRNA sequence
  source 1..20: mol_type = other DNA
cagcagctcaggtcagcgcc

SEQ ID NO: 44314 - DNA, 20 bp, synthetic construct
  misc_feature 1..20: note = CRISPR gRNA sequence
  source 1..20: mol_type = other DNA
cagcgcctggaaactctgtg

SEQ ID NO: 44315 - DNA, 20 bp, synthetic construct
  misc_feature 1..20: note = CRISPR gRNA sequence
  source 1..20: mol_type = other DNA
agcgcctggaaactctgtgt

SEQ ID NO: 44316 - DNA, 20 bp, synthetic construct
  misc_feature 1..20: note = CRISPR gRNA sequence
  source 1..20: mol_type = other DNA
gcgcctggaaactctgtgtg

SEQ ID NO: 44317 - DNA, 20 bp, synthetic construct
  misc_feature 1..20: note = CRISPR gRNA sequence
  source 1..20: mol_type = other DNA
gaaactctgtgtggggccct

SEQ ID NO: 44318 - DNA, 20 bp, synthetic construct
  misc_feature 1..20: note = CRISPR gRNA sequence
  source 1..20: mol_type = other DNA
gtgtggggccctgagttctc

SEQ ID NO: 44319 - DNA, 20 bp, synthetic construct
  misc_feature 1..20: note = CRISPR gRNA sequence
  source 1..20: mol_type = other DNA
ctgagttctctggttgaccc

SEQ ID NO: 44320 - DNA, 20 bp, synthetic construct
  misc_feature 1..20: note = CRISPR gRNA sequence
  source 1..20: mol_type = other DNA
gttgaccctggtacctactc

SEQ ID NO: 44321 - DNA, 20 bp, synthetic construct
  misc_feature 1..20: note = CRISPR gRNA sequence
  source 1..20: mol_type = other DNA
ttgaccctggtacctactcc

SEQ ID NO: 44322 - DNA, 20 bp, synthetic construct
  misc_feature 1..20: note = CRISPR gRNA sequence
  source 1..20: mol_type = other DNA
ctccaggccatgtgtgaccc

SEQ ID NO: 44323 - DNA, 20 bp, synthetic construct
  misc_feature 1..20: note = CRISPR gRNA sequence
  source 1..20: mol_type = other DNA
ggcattctcacttccttgtg

SEQ ID NO: 44324 - DNA, 20 bp, synthetic construct
  misc_feature 1..20: note = CRISPR gRNA sequence
  source 1..20: mol_type = other DNA
gcattctcacttccttgtgc

SEQ ID NO: 44325 - DNA, 20 bp, synthetic construct
  misc_feature 1..20: note = CRISPR gRNA sequence
  source 1..20: mol_type = other DNA
attctcacttccttgtgcag

SEQ ID NO: 44326 - DNA, 20 bp, synthetic construct
  misc_feature 1..20: note = CRISPR gRNA sequence
  source 1..20: mol_type = other DNA
gtgcaggagaaaatcacact

SEQ ID NO: 44327 - DNA, 20 bp, synthetic construct
  misc_feature 1..20: note = CRISPR gRNA sequence
  source 1..20: mol_type = other DNA
aggagaaaatcacacttggc

SEQ ID NO: 44328 - DNA, 20 bp, synthetic construct
  misc_feature 1..20: note = CRISPR gRNA sequence
  source 1..20: mol_type = other DNA
agaaaatcacacttggccag

SEQ ID NO: 44329 - DNA, 20 bp, synthetic construct
  misc_feature 1..20: note = CRISPR gRNA sequence
  source 1..20: mol_type = other DNA
aaaatcacacttggccagtg

SEQ ID NO: 44330 - DNA, 20 bp, synthetic construct
  misc_feature 1..20: note = CRISPR gRNA sequence
  source 1..20: mol_type = other DNA
aaatcacacttggccagtgg

SEQ ID NO: 44331 - DNA, 20 bp, synthetic construct
  misc_feature 1..20: note = CRISPR gRNA sequence
  source 1..20: mol_type = other DNA
aatcacacttggccagtgga

SEQ ID NO: 44332 - DNA, 20 bp, synthetic construct
  misc_feature 1..20: note = CRISPR gRNA sequence
  source 1..20: mol_type = other DNA
atcacacttggccagtggag

SEQ ID NO: 44333 - DNA, 20 bp, synthetic construct
  misc_feature 1..20: note = CRISPR gRNA sequence
  source 1..20: mol_type = other DNA
cacacttggccagtggaggg

SEQ ID NO: 44334 - DNA, 20 bp, synthetic construct
  misc_feature 1..20: note = CRISPR gRNA sequence
  source 1..20: mol_type = other DNA
acacttggccagtggagggg

SEQ ID NO: 44335 - DNA, 20 bp, synthetic construct
  misc_feature 1..20: note = CRISPR gRNA sequence
  source 1..20: mol_type = other DNA
cacttggccagtggagggga

SEQ ID NO: 44336 - DNA, 20 bp, synthetic construct
  misc_feature 1..20: note = CRISPR gRNA sequence
  source 1..20: mol_type = other DNA
cttggccagtggaggggagg

SEQ ID NO: 44337 - DNA, 20 bp, synthetic construct
  misc_feature 1..20: note = CRISPR gRNA sequence
  source 1..20: mol_type = other DNA
tggccagtggaggggaggga

SEQ ID NO: 44338 - DNA, 20 bp, synthetic construct
  misc_feature 1..20: note = CRISPR gRNA sequence
  source 1..20: mol_type = other DNA
gtggaggggagggagagccc

SEQ ID NO: 44339 - DNA, 20 bp, synthetic construct
  misc_feature 1..20: note = CRISPR gRNA sequence
  source 1..20: mol_type = other DNA
tggaggggagggagagcccc

SEQ ID NO: 44340 - DNA, 20 bp, synthetic construct
  misc_feature 1..20: note = CRISPR gRNA sequence
  source 1..20: mol_type = other DNA
ggaggggagggagagcccca

SEQ ID NO: 44341 - DNA, 20 bp, synthetic construct
  misc_feature 1..20: note = CRISPR gRNA sequence
  source 1..20: mol_type = other DNA
ggggagggagagccccaggg

SEQ ID NO: 44342 - DNA, 20 bp, synthetic construct
  misc_feature 1..20: note = CRISPR gRNA sequence
  source 1..20: mol_type = other DNA
gggagagccccagggtggct

SEQ ID NO: 44343 - DNA, 20 bp, synthetic construct
  misc_feature 1..20: note = CRISPR gRNA sequence
  source 1..20: mol_type = other DNA
ggagagccccagggtggctc

SEQ ID NO: 44344 - DNA, 20 bp, synthetic construct
  misc_feature 1..20: note = CRISPR gRNA sequence
  source 1..20: mol_type = other DNA
gagagccccagggtggctca

SEQ ID NO: 44345 - DNA, 20 bp, synthetic construct
  misc_feature 1..20: note = CRISPR gRNA sequence
  source 1..20: mol_type = other DNA
agagccccagggtggctcag

SEQ ID NO: 44346 - DNA, 20 bp, synthetic construct
  misc_feature 1..20: note = CRISPR gRNA sequence
  source 1..20: mol_type = other DNA
agccccagggtggctcaggg

SEQ ID NO: 44347 - DNA, 20 bp, synthetic construct
  misc_feature 1..20: note = CRISPR gRNA sequence
  source 1..20: mol_type = other DNA
gggtggctcaggggagctct

SEQ ID NO: 44348 - DNA, 20 bp, synthetic construct
  misc_feature 1..20: note = CRISPR gRNA sequence
  source 1..20: mol_type = other DNA
ggtggctcaggggagctctt

SEQ ID NO: 44349 - DNA, 20 bp, synthetic construct
  misc_feature 1..20: note = CRISPR gRNA sequence
  source 1..20: mol_type = other DNA
ggctcaggggagctcttggg

SEQ ID NO: 44350 - DNA, 20 bp, synthetic construct
  misc_feature 1..20: note = CRISPR gRNA sequence
  source 1..20: mol_type = other DNA
ggtggccccttctcctctct

SEQ ID NO: 44351 - DNA, 20 bp, synthetic construct
  misc_feature 1..20: note = CRISPR gRNA sequence
  source 1..20: mol_type = other DNA
cctctcttggcacccccttc

SEQ ID NO: 44352 - DNA, 20 bp, synthetic construct
  misc_feature 1..20: note = CRISPR gRNA sequence
  source 1..20: mol_type = other DNA
ttctggatgtgatgacctct

SEQ ID NO: 44353 - DNA, 20 bp, synthetic construct
  misc_feature 1..20: note = CRISPR gRNA sequence
  source 1..20: mol_type = other DNA
tctggatgtgatgacctctg

SEQ ID NO: 44354 - DNA, 20 bp, synthetic construct
  misc_feature 1..20: note = CRISPR gRNA sequence
  source 1..20: mol_type = other DNA
gatgacctctgaggtgtgtc

SEQ ID NO: 44355 - DNA, 20 bp, synthetic construct
  misc_feature 1..20: note = CRISPR gRNA sequence
  source 1..20: mol_type = other DNA
gtgtccagcctgaaatcctc

SEQ ID NO: 44356 - DNA, 20 bp, synthetic construct
  misc_feature 1..20: note = CRISPR gRNA sequence
  source 1..20: mol_type = other DNA
gaaatcctctagaatatcct

SEQ ID NO: 44357 - DNA, 20 bp, synthetic construct
  misc_feature 1..20: note = CRISPR gRNA sequence
  source 1..20: mol_type = other DNA
agaatatccttggacctttt

SEQ ID NO: 44358 - DNA, 20 bp, synthetic construct
  misc_feature 1..20: note = CRISPR gRNA sequence
  source 1..20: mol_type = other DNA
tggaccttttcagcttgtct

SEQ ID NO: 44359 - DNA, 20 bp, synthetic construct
  misc_feature 1..20: note = CRISPR gRNA sequence
  source 1..20: mol_type = other DNA
ggaccttttcagcttgtctc

SEQ ID NO: 44360 - DNA, 20 bp, synthetic construct
  misc_feature 1..20: note = CRISPR gRNA sequence
  source 1..20: mol_type = other DNA
tgtctcaggttaacctctgt

SEQ ID NO: 44361 - DNA, 20 bp, synthetic construct
  misc_feature 1..20: note = CRISPR gRNA sequence
  source 1..20: mol_type = other DNA
gtctcaggttaacctctgtg

SEQ ID NO: 44362 - DNA, 20 bp, synthetic construct
  misc_feature 1..20: note = CRISPR gRNA sequence
  source 1..20: mol_type = other DNA
ctctgtgaggacgatgatgc

SEQ ID NO: 44363 - DNA, 20 bp, synthetic construct
  misc_feature 1..20: note = CRISPR gRNA sequence
  source 1..20: mol_type = other DNA
atgccagttccctgctgctg

SEQ ID NO: 44364 - DNA, 20 bp, synthetic construct
  misc_feature 1..20: note = CRISPR gRNA sequence
  source 1..20: mol_type = other DNA
gccagttccctgctgctgca

SEQ ID NO: 44365 - DNA, 20 bp, synthetic construct
  misc_feature 1..20: note = CRISPR gRNA sequence
  source 1..20: mol_type = other DNA
gcctcctgctgtccctctct

SEQ ID NO: 44366 - DNA, 20 bp, synthetic construct
  misc_feature 1..20: note = CRISPR gRNA sequence
  source 1..20: mol_type = other DNA
tgctgtccctctctgagctg

SEQ ID NO: 44367 - DNA, 20 bp, synthetic construct
  misc_feature 1..20: note = CRISPR gRNA sequence
  source 1..20: mol_type = other DNA
tctctgagctgaagacattt

SEQ ID NO: 44368 - DNA, 20 bp, synthetic construct
  misc_feature 1..20: note = CRISPR gRNA sequence
  source 1..20: mol_type = other DNA
gctgaagacatttcggtatg

SEQ ID NO: 44369 - DNA, 20 bp, synthetic construct
  misc_feature 1..20: note = CRISPR gRNA sequence
  source 1..20: mol_type = other DNA
agacatttcggtatgtagac

SEQ ID NO: 44370 - DNA, 20 bp, synthetic construct
  misc_feature 1..20: note = CRISPR gRNA sequence
  source 1..20: mol_type = other DNA
atgtagacaagacattcact

SEQ ID NO: 44371 - DNA, 20 bp, synthetic construct
  misc_feature 1..20: note = CRISPR gRNA sequence
  source 1..20: mol_type = other DNA
cattcactcagtcccctttg

SEQ ID NO: 44372 - DNA, 20 bp, synthetic construct
  misc_feature 1..20: note = CRISPR gRNA sequence
  source 1..20: mol_type = other DNA
ctgacacctcccgttattcc

SEQ ID NO: 44373 - DNA, 20 bp, synthetic construct
  misc_feature 1..20: note = CRISPR gRNA sequence
  source 1..20: mol_type = other DNA
cctcccgttattcccagccc

SEQ ID NO: 44374 - DNA, 20 bp, synthetic construct
  misc_feature 1..20: note = CRISPR gRNA sequence
  source 1..20: mol_type = other DNA
ctcccgttattcccagccct

SEQ ID NO: 44375 - DNA, 20 bp, synthetic construct
  misc_feature 1..20: note = CRISPR gRNA sequence
  source 1..20: mol_type = other DNA
gttattcccagccctgggct

SEQ ID NO: 44376 - DNA, 20 bp, synthetic construct
  misc_feature 1..20: note = CRISPR gRNA sequence
  source 1..20: mol_type = other DNA
tattcccagccctgggctca

SEQ ID NO: 44377 - DNA, 20 bp, synthetic construct
  misc_feature 1..20: note = CRISPR gRNA sequence
  source 1..20: mol_type = other DNA
attcccagccctgggctcag

SEQ ID NO: 44378 - DNA, 20 bp, synthetic construct
  misc_feature 1..20: note = CRISPR gRNA sequence
  source 1..20: mol_type = other DNA
ttactctgtgtcttactctg

SEQ ID NO: 44379 - DNA, 20 bp, synthetic construct
  misc_feature 1..20: note = CRISPR gRNA sequence
  source 1..20: mol_type = other DNA
tactctgtggacacaaacca

SEQ ID NO: 44380 - DNA, 20 bp, synthetic construct
  misc_feature 1..20: note = CRISPR gRNA sequence
  source 1..20: mol_type = other DNA
actctgtggacacaaaccac

SEQ ID NO: 44381 - DNA, 20 bp, synthetic construct
  misc_feature 1..20: note = CRISPR gRNA sequence
  source 1..20: mol_type = other DNA
ctgtggacacaaaccacagg

SEQ ID NO: 44382 - DNA, 20 bp, synthetic construct
  misc_feature 1..20: note = CRISPR gRNA sequence
  source 1..20: mol_type = other DNA
acacaaaccacaggtggccc

SEQ ID NO: 44383 - DNA, 20 bp, synthetic construct
  misc_feature 1..20: note = CRISPR gRNA sequence
  source 1..20: mol_type = other DNA
acaaaccacaggtggccctg

SEQ ID NO: 44384 - DNA, 20 bp, synthetic construct
  misc_feature 1..20: note = CRISPR gRNA sequence
  source 1..20: mol_type = other DNA
gtggccctggagatgatttt

SEQ ID NO: 44385 - DNA, 20 bp, synthetic construct
  misc_feature 1..20: note = CRISPR gRNA sequence
  source 1..20: mol_type = other DNA
tggccctggagatgattttt

SEQ ID NO: 44386 - DNA, 20 bp, synthetic construct
  misc_feature 1..20: note = CRISPR gRNA sequence
  source 1..20: mol_type = other DNA
ggccctggagatgattttta

SEQ ID NO: 44387 - DNA, 20 bp, synthetic construct
  misc_feature 1..20: note = CRISPR gRNA sequence
  source 1..20: mol_type = other DNA
gccctggagatgatttttag

SEQ ID NO: 44388 - DNA, 20 bp, synthetic construct
  misc_feature 1..20: note = CRISPR gRNA sequence
  source 1..20: mol_type = other DNA
agatgatttttaggggtacc

SEQ ID NO: 44389 - DNA, 20 bp, synthetic construct
  misc_feature 1..20: note = CRISPR gRNA sequence
  source 1..20: mol_type = other DNA
cctagtcgtaaacatgacct

SEQ ID NO: 44390 - DNA, 20 bp, synthetic construct
  misc_feature 1..20: note = CRISPR gRNA sequence
  source 1..20: mol_type = other DNA
ctagtcgtaaacatgacctt

SEQ ID NO: 44391 - DNA, 20 bp, synthetic construct
  misc_feature 1..20: note = CRISPR gRNA sequence
  source 1..20: mol_type = other DNA
aacatgaccttaggaacatt

SEQ ID NO: 44392 - DNA, 20 bp, synthetic construct
  misc_feature 1..20: note = CRISPR gRNA sequence
  source 1..20: mol_type = other DNA
cttaggaacattgagccaca

SEQ ID NO: 44393 - DNA, 20 bp, synthetic construct
  misc_feature 1..20: note = CRISPR gRNA sequence
  source 1..20: mol_type = other DNA
ggaacattgagccacatggc

SEQ ID NO: 44394 - DNA, 20 bp, synthetic construct
  misc_feature 1..20: note = CRISPR gRNA sequence
  source 1..20: mol_type = other DNA
cattgagccacatggcaaga

SEQ ID NO: 44395 - DNA, 20 bp, synthetic construct
  misc_feature 1..20: note = CRISPR gRNA sequence
  source 1..20: mol_type = other DNA
aataactgcgaactaacaca

SEQ ID NO: 44396 - DNA, 20 bp, synthetic construct
  misc_feature 1..20: note = CRISPR gRNA sequence
  source 1..20: mol_type = other DNA
gcgaactaacacaaagtttc

SEQ ID NO: 44397 - DNA, 20 bp, synthetic construct
  misc_feature 1..20: note = CRISPR gRNA sequence
  source 1..20: mol_type = other DNA
aactaacacaaagtttcaag

SEQ ID NO: 44398 - DNA, 20 bp, synthetic construct
  misc_feature 1..20: note = CRISPR gRNA sequence
  source 1..20: mol_type = other DNA
cacaaagtttcaagaagact

SEQ ID NO: 44399 - DNA, 20 bp, synthetic construct
  misc_feature 1..20: note = CRISPR gRNA sequence
  source 1..20: mol_type = other DNA
catttacccaaattcaccct

SEQ ID NO: 44400 - DNA, 20 bp, synthetic construct
  misc_feature 1..20: note = CRISPR gRNA sequence
  source 1..20: mol_type = other DNA
tttacccaaattcaccctta

SEQ ID NO: 44401 - DNA, 20 bp, synthetic construct
  misc_feature 1..20: note = CRISPR gRNA sequence
  source 1..20: mol_type = other DNA
cccaaattcacccttagagc

SEQ ID NO: 44402 - DNA, 20 bp, synthetic construct
  misc_feature 1..20: note = CRISPR gRNA sequence
  source 1..20: mol_type = other DNA
ccaaattcacccttagagct

SEQ ID NO: 44403 - DNA, 20 bp, synthetic construct
  misc_feature 1..20: note = CRISPR gRNA sequence
  source 1..20: mol_type = other DNA
ttcacccttagagctgggcg

SEQ ID NO: 44404 - DNA, 20 bp, synthetic construct
  misc_feature 1..20: note = CRISPR gRNA sequence
  source 1..20: mol_type = other DNA
acccttagagctgggcgtgg

SEQ ID NO: 44405 - DNA, 20 bp, synthetic construct
  misc_feature 1..20: note = CRISPR gRNA sequence
  source 1..20: mol_type = other DNA
gtggctcatgtctgtaatcc

SEQ ID NO: 44406 - DNA, 20 bp, synthetic construct
  misc_feature 1..20: note = CRISPR gRNA sequence
  source 1..20: mol_type = other DNA
tgtctgtaatcctagcactt

SEQ ID NO: 44407 - DNA, 20 bp, synthetic construct
  misc_feature 1..20: note = CRISPR gRNA sequence
  source 1..20: mol_type = other DNA
gtctgtaatcctagcacttt

SEQ ID NO: 44408 - DNA, 20 bp, synthetic construct
  misc_feature 1..20: note = CRISPR gRNA sequence
  source 1..20: mol_type = other DNA
ctgtaatcctagcactttgg

SEQ ID NO: 44409 - DNA, 20 bp, synthetic construct
  misc_feature 1..20: note = CRISPR gRNA sequence
  source 1..20: mol_type = other DNA
tgtaatcctagcactttggg

SEQ ID NO: 44410 - DNA, 20 bp, synthetic construct
  misc_feature 1..20: note = CRISPR gRNA sequence
  source 1..20: mol_type = other DNA
tcctagcactttgggaggcc

SEQ ID NO: 44411 - DNA, 20 bp, synthetic construct
  misc_feature 1..20: note = CRISPR gRNA sequence
  source 1..20: mol_type = other DNA
cctagcactttgggaggccg

SEQ ID NO: 44412 - DNA, 20 bp, synthetic construct
  misc_feature 1..20: note = CRISPR gRNA sequence
  source 1..20: mol_type = other DNA
agcactttgggaggccgagg

SEQ ID NO: 44413 - DNA, 20 bp, synthetic construct
  misc_feature 1..20: note = CRISPR gRNA sequence
  source 1..20: mol_type = other DNA
gcactttgggaggccgaggc

SEQ ID NO: 44414 - DNA, 20 bp, synthetic construct
  misc_feature 1..20: note = CRISPR gRNA sequence
  source 1..20: mol_type = other DNA
ctttgggaggccgaggcagg

SEQ ID NO: 44415 - DNA, 20 bp, synthetic construct
  misc_feature 1..20: note = CRISPR gRNA sequence
  source 1..20: mol_type = other DNA
ccgaggcaggtggattgcct

SEQ ID NO: 44416 - DNA, 20 bp, synthetic construct
  misc_feature 1..20: note = CRISPR gRNA sequence
  source 1..20: mol_type = other DNA
gcaggtggattgcctgagct

SEQ ID NO: 44417 - DNA, 20 bp, synthetic construct
  misc_feature 1..20: note = CRISPR gRNA sequence
  source 1..20: mol_type = other DNA
caggtggattgcctgagctc

SEQ ID NO: 44418 - DNA, 20 bp, synthetic construct
  misc_feature 1..20: note = CRISPR gRNA sequence
  source 1..20: mol_type = other DNA
ttgcctgagctcaggaattc

SEQ ID NO: 44419 - DNA, 20 bp, synthetic construct
  misc_feature 1..20: note = CRISPR gRNA sequence
  source 1..20: mol_type = other DNA
tcaggaattcgagaccaccc

SEQ ID NO: 44420 - DNA, 20 bp, synthetic construct
  misc_feature 1..20: note = CRISPR gRNA sequence
  source 1..20: mol_type = other DNA
cgagaccaccctggacaaca

SEQ ID NO: 44421 - DNA, 20 bp, synthetic construct
  misc_feature 1..20: note = CRISPR gRNA sequence
  source 1..20: mol_type = other DNA
ctactaaaatacaaaaaaat

SEQ ID NO: 44422 - DNA, 20 bp, synthetic construct
  misc_feature 1..20: note = CRISPR gRNA sequence
  source 1..20: mol_type = other DNA
taaaatacaaaaaaattagc

SEQ ID NO: 44423 - DNA, 20 bp, synthetic construct
  misc_feature 1..20: note = CRISPR gRNA sequence
  source 1..20: mol_type = other DNA
aaaatacaaaaaaattagct

SEQ ID NO: 44424 - DNA, 20 bp, synthetic construct
  misc_feature 1..20: note = CRISPR gRNA sequence
  source 1..20: mol_type = other DNA
acaaaaaaattagctgggca

SEQ ID NO: 44425 - DNA, 20 bp, synthetic construct
  misc_feature 1..20: note = CRISPR gRNA sequence
  source 1..20: mol_type = other DNA
aaaaaattagctgggcatgg

SEQ ID NO: 44426 - DNA, 20 bp, synthetic construct
  misc_feature 1..20: note = CRISPR gRNA sequence
  source 1..20: mol_type = other DNA
gtggtgcatgcctgtaatcc

SEQ ID NO: 44427 - DNA, 20 bp, synthetic construct
  misc_feature 1..20: note = CRISPR gRNA sequence
  source 1..20: mol_type = other DNA
tgcctgtaatcccagctaat

SEQ ID NO: 44428 - DNA, 20 bp, synthetic construct
  misc_feature 1..20: note = CRISPR gRNA sequence
  source 1..20: mol_type = other DNA
gcctgtaatcccagctaatt

SEQ ID NO: 44429 - DNA, 20 bp, synthetic construct
  misc_feature 1..20: note = CRISPR gRNA sequence
  source 1..20: mol_type = other DNA
ctgtaatcccagctaattgg

SEQ ID NO: 44430 - DNA, 20 bp, synthetic construct
  misc_feature 1..20: note = CRISPR gRNA sequence
  source 1..20: mol_type = other DNA
tgtaatcccagctaattggg

SEQ ID NO: 44431 - DNA, 20 bp, synthetic construct
  misc_feature 1..20: note = CRISPR gRNA sequence
  source 1..20: mol_type = other DNA
tcccagctaattgggaggct

SEQ ID NO: 44432 - DNA, 20 bp, synthetic construct
  misc_feature 1..20: note = CRISPR gRNA sequence
  source 1..20: mol_type = other DNA
cccagctaattgggaggctg

SEQ ID NO: 44433 - DNA, 20 bp, synthetic construct
  misc_feature 1..20: note = CRISPR gRNA sequence
  source 1..20: mol_type = other DNA
taattgggaggctgaggcac

SEQ ID NO: 44434 - DNA, 20 bp, synthetic construct
  misc_feature 1..20: note = CRISPR gRNA sequence
  source 1..20: mol_type = other DNA
gcacaagaattgcttgaacc

SEQ ID NO: 44435 - DNA, 20 bp, synthetic construct
  misc_feature 1..20: note = CRISPR gRNA sequence
  source 1..20: mol_type = other DNA
cacaagaattgcttgaaccc

SEQ ID NO: 44436 - DNA, 20 bp, synthetic construct
  misc_feature 1..20: note = CRISPR gRNA sequence
  source 1..20: mol_type = other DNA
caagaattgcttgaacccgg

SEQ ID NO: 44437 - DNA, 20 bp, synthetic construct
  misc_feature 1..20: note = CRISPR gRNA sequence
  source 1..20: mol_type = other DNA
aagaattgcttgaacccggg

SEQ ID NO: 44438 - DNA, 20 bp, synthetic construct
  misc_feature 1..20: note = CRISPR gRNA sequence
  source 1..20: mol_type = other DNA
ttgcttgaacccgggaggct

SEQ ID NO: 44439 - DNA, 20 bp, synthetic construct
  misc_feature 1..20: note = CRISPR gRNA sequence
  source 1..20: mol_type = other DNA
tgcttgaacccgggaggctg

SEQ ID NO: 44440 - DNA, 20 bp, synthetic construct
  misc_feature 1..20: note = CRISPR gRNA sequence
  source 1..20: mol_type = other DNA
aacccgggaggctgaggtta

SEQ ID NO: 44441 - DNA, 20 bp, synthetic construct
  misc_feature 1..20: note = CRISPR gRNA sequence
  source 1..20: mol_type = other DNA
cgggaggctgaggttacagt

SEQ ID NO: 44442 - DNA, 20 bp, synthetic construct
  misc_feature 1..20: note = CRISPR gRNA sequence
  source 1..20: mol_type = other DNA
ggctgaggttacagtgagcc

SEQ ID NO: 44443 - DNA, 20 bp, synthetic construct
  misc_feature 1..20: note = CRISPR gRNA sequence
  source 1..20: mol_type = other DNA
aagattgtgccactgcactc

SEQ ID NO: 44444 - DNA, 20 bp, synthetic construct
  misc_feature 1..20: note = CRISPR gRNA sequence
  source 1..20: mol_type = other DNA
tgtgccactgcactctagcc

SEQ ID NO: 44445 - DNA, 20 bp, synthetic construct
  misc_feature 1..20: note = CRISPR gRNA sequence
  source 1..20: mol_type = other DNA
gtgccactgcactctagcct

SEQ ID NO: 44446 - DNA, 20 bp, synthetic construct
  misc_feature 1..20: note = CRISPR gRNA sequence
  source 1..20: mol_type = other DNA
ctgcactctagcctaggtga

SEQ ID NO: 44447 - DNA, 20 bp, synthetic construct
  misc_feature 1..20: note = CRISPR gRNA sequence
  source 1..20: mol_type = other DNA
gcactctagcctaggtgaca

SEQ ID NO: 44448 - DNA, 20 bp, synthetic construct
  misc_feature 1..20: note = CRISPR gRNA sequence
  source 1..20: mol_type = other DNA
tctagcctaggtgacagagc

SEQ ID NO: 44449 - DNA, 20 bp, synthetic construct
  misc_feature 1..20: note = CRISPR gRNA sequence
  source 1..20: mol_type = other DNA
ctagcctaggtgacagagcg

SEQ ID NO: 44450 - DNA, 20 bp, synthetic construct
  misc_feature 1..20: note = CRISPR gRNA sequence
  source 1..20: mol_type = other DNA
ctaggtgacagagcgaggct

SEQ ID NO: 44451 - DNA, 20 bp, synthetic construct
  misc_feature 1..20: note = CRISPR gRNA sequence
  source 1..20: mol_type = other DNA
ggtttccgaaaaaaaaaaaa

SEQ ID NO: 44452 - DNA, 20 bp, synthetic construct
  misc_feature 1..20: note = CRISPR gRNA sequence
  source 1..20: mol_type = other DNA
ctctccttttctgaaccatt

SEQ ID NO: 44453 - DNA, 20 bp, synthetic construct
  misc_feature 1..20: note = CRISPR gRNA sequence
  source 1..20: mol_type = other DNA
tccttttctgaaccatttag

SEQ ID NO: 44454 - DNA, 20 bp, synthetic construct
  misc_feature 1..20: note = CRISPR gRNA sequence
  source 1..20: mol_type = other DNA
tttctgaaccatttagaagt

SEQ ID NO: 44455 - DNA, 20 bp, synthetic construct
  misc_feature 1..20: note = CRISPR gRNA sequence
  source 1..20: mol_type = other DNA
ccctttacccgttaacattt

SEQ ID NO: 44456 - DNA, 20 bp, synthetic construct
  misc_feature 1..20: note = CRISPR gRNA sequence
  source 1..20: mol_type = other DNA
taacatttcagcgaatttgc

SEQ ID NO: 44457 - DNA, 20 bp, synthetic construct
  misc_feature 1..20: note = CRISPR gRNA sequence
  source 1..20: mol_type = other DNA
tcagcgaatttgctagaaat

SEQ ID NO: 44458 - DNA, 20 bp, synthetic construct
  misc_feature 1..20: note = CRISPR gRNA sequence
  source 1..20: mol_type = other DNA
cagcgaatttgctagaaata

SEQ ID NO: 44459 - DNA, 20 bp, synthetic construct
  misc_feature 1..20: note = CRISPR gRNA sequence
  source 1..20: mol_type = other DNA
ggacattctcttccataatc

SEQ ID NO: 44460 - DNA, 20 bp, synthetic construct
  misc_feature 1..20: note = CRISPR gRNA sequence
  source 1..20: mol_type = other DNA
tccagtaaaattataaaatc

SEQ ID NO: 44461 - DNA, 20 bp, synthetic construct
  misc_feature 1..20: note = CRISPR gRNA sequence
  source 1..20: mol_type = other DNA
ccagtaaaattataaaatcc

SEQ ID NO: 44462 - DNA, 20 bp, synthetic construct
  misc_feature 1..20: note = CRISPR gRNA sequence
  source 1..20: mol_type = other DNA
cactactattatctcaacta

SEQ ID NO: 44463 - DNA, 20 bp, synthetic construct
  misc_feature 1..20: note = CRISPR gRNA sequence
  source 1..20: mol_type = other DNA
agtttatactccaatctcac

SEQ ID NO: 44464 - DNA, 20 bp, synthetic construct
  misc_feature 1..20: note = CRISPR gRNA sequence
  source 1..20: mol_type = other DNA
tgcttattgcatttttttcc

SEQ ID NO: 44465 - DNA, 20 bp, synthetic construct
  misc_feature 1..20: note = CRISPR gRNA sequence
  source 1..20: mol_type = other DNA
ttgcatttttttcccagttg

SEQ ID NO: 44466 - DNA, 20 bp, synthetic construct
  misc_feature 1..20: note = CRISPR gRNA sequence
  source 1..20: mol_type = other DNA
tcccagttgtggatccaatc

SEQ ID NO: 44467 - DNA, 20 bp, synthetic construct
  misc_feature 1..20: note = CRISPR gRNA sequence
  source 1..20: mol_type = other DNA
cccagttgtggatccaatcc

SEQ ID NO: 44468 - DNA, 20 bp, synthetic construct
  misc_feature 1..20: note = CRISPR gRNA sequence
  source 1..20: mol_type = other DNA
ccaggatcacacgtctcatt

SEQ ID NO: 44469 - DNA, 20 bp, synthetic construct
  misc_feature 1..20: note = CRISPR gRNA sequence
  source 1..20: mol_type = other DNA
ctcatttagtgtcatctctt

SEQ ID NO: 44470 - DNA, 20 bp, synthetic construct
  misc_feature 1..20: note = CRISPR gRNA sequence
  source 1..20: mol_type = other DNA
ctttagtgtctccttcaatc

SEQ ID NO: 44471 - DNA, 20 bp, synthetic construct
  misc_feature 1..20: note = CRISPR gRNA sequence
  source 1..20: mol_type = other DNA
ttcaatctggaacacgtcct

SEQ ID NO: 44472 - DNA, 20 bp, synthetic construct
  misc_feature 1..20: note = CRISPR gRNA sequence
  source 1..20: mol_type = other DNA
tggcccttctttgtctttca

SEQ ID NO: 44473 - DNA, 20 bp, synthetic construct
  misc_feature 1..20: note = CRISPR gRNA sequence
  source 1..20: mol_type = other DNA
agcattgtctctgacattta

SEQ ID NO: 44474 - DNA, 20 bp, synthetic construct
  misc_feature 1..20: note = CRISPR gRNA sequence
  source 1..20: mol_type = other DNA
gcattgtctctgacatttac

SEQ ID NO: 44475 - DNA, 20 bp, synthetic construct
  misc_feature 1..20: note = CRISPR gRNA sequence
  source 1..20: mol_type = other DNA
tgtctctgacatttacaggc

SEQ ID NO: 44476 - DNA, 20 bp, synthetic construct
  misc_feature 1..20: note = CRISPR gRNA sequence
  source 1..20: mol_type = other DNA
tttacaggccagttatttta

SEQ ID NO: 44477 - DNA, 20 bp, synthetic construct
  misc_feature 1..20: note = CRISPR gRNA sequence
  source 1..20: mol_type = other DNA
ttatagaatgtccttccact

SEQ ID NO: 44478 - DNA, 20 bp, synthetic construct
  misc_feature 1..20: note = CRISPR gRNA sequence
  source 1..20: mol_type = other DNA
tatagaatgtccttccactt

SEQ ID NO: 44479 - DNA, 20 bp, synthetic construct
  misc_feature 1..20: note = CRISPR gRNA sequence
  source 1..20: mol_type = other DNA
gtccaatgtttcctcatgtt

SEQ ID NO: 44480 - DNA, 20 bp, synthetic construct
  misc_feature 1..20: note = CRISPR gRNA sequence
  source 1..20: mol_type = other DNA
ccaatgtttcctcatgttta

SEQ ID NO: 44481 - DNA, 20 bp, synthetic construct
  misc_feature 1..20: note = CRISPR gRNA sequence
  source 1..20: mol_type = other DNA
tgtttcctcatgtttagagt

SEQ ID NO: 44482 - DNA, 20 bp, synthetic construct
  misc_feature 1..20: note = CRISPR gRNA sequence
  source 1..20: mol_type = other DNA
tttcctcatgtttagagtta

SEQ ID NO: 44483 - DNA, 20 bp, synthetic construct
  misc_feature 1..20: note = CRISPR gRNA sequence
  source 1..20: mol_type = other DNA
tagagttagagtctgccctt

SEQ ID NO: 44484 - DNA, 20 bp, synthetic construct
  misc_feature 1..20: note = CRISPR gRNA sequence
  source 1..20: mol_type = other DNA
agagttagagtctgcccttt

SEQ ID NO: 44485 - DNA, 20 bp, synthetic construct
  misc_feature 1..20: note = CRISPR gRNA sequence
  source 1..20: mol_type = other DNA
gttagagtctgccctttggg

SEQ ID NO: 44486 - DNA, 20 bp, synthetic construct
  misc_feature 1..20: note = CRISPR gRNA sequence
  source 1..20: mol_type = other DNA
ttagagtctgccctttgggc

SEQ ID NO: 44487 - DNA, 20 bp, synthetic construct
  misc_feature 1..20: note = CRISPR gRNA sequence
  source 1..20: mol_type = other DNA
ctttgggcaggaatatcaca

SEQ ID NO: 44488 - DNA, 20 bp, synthetic construct
  misc_feature 1..20: note = CRISPR gRNA sequence
  source 1..20: mol_type = other DNA
tttgggcaggaatatcacac

SEQ ID NO: 44489 - DNA, 20 bp, synthetic construct
  misc_feature 1..20: note = CRISPR gRNA sequence
  source 1..20: mol_type = other DNA
tgtgttatcgtgccttccat

SEQ ID NO: 44490 - DNA, 20 bp, synthetic construct
  misc_feature 1..20: note = CRISPR gRNA sequence
  source 1..20: mol_type = other DNA
gtgttatcgtgccttccatc

SEQ ID NO: 44491 - DNA, 20 bp, synthetic construct
  misc_feature 1..20: note = CRISPR gRNA sequence
  source 1..20: mol_type = other DNA
tgttatcgtgccttccatcg

SEQ ID NO: 44492 - DNA, 20 bp, synthetic construct
  misc_feature 1..20: note = CRISPR gRNA sequence
  source 1..20: mol_type = other DNA
catcggggcacatgatgtgt

SEQ ID NO: 44493 - DNA, 20 bp, synthetic construct
  misc_feature 1..20: note = CRISPR gRNA sequence
  source 1..20: mol_type = other DNA
tcggggcacatgatgtgtca

SEQ ID NO: 44494 - DNA, 20 bp, synthetic construct
  misc_feature 1..20: note = CRISPR gRNA sequence
  source 1..20: mol_type = other DNA
acatgatgtgtcagagtcct

SEQ ID NO: 44495 - DNA, 20 bp, synthetic construct
  misc_feature 1..20: note = CRISPR gRNA sequence
  source 1..20: mol_type = other DNA
catgatgtgtcagagtcctc

SEQ ID NO: 44496 - DNA, 20 bp, synthetic construct
  misc_feature 1..20: note = CRISPR gRNA sequence
  source 1..20: mol_type = other DNA
atgtgtcagagtcctcgggc

SEQ ID NO: 44497 - DNA, 20 bp, synthetic construct
  misc_feature 1..20: note = CRISPR gRNA sequence
  source 1..20: mol_type = other DNA
ttaactgtgatcacctgtga

SEQ ID NO: 44498 - DNA, 20 bp, synthetic construct
  misc_feature 1..20: note = CRISPR gRNA sequence
  source 1..20: mol_type = other DNA
actgtgatcacctgtgacag

SEQ ID NO: 44499 - DNA, 20 bp, synthetic construct
  misc_feature 1..20: note = CRISPR gRNA sequence
  source 1..20: mol_type = other DNA
cctgtgacagtggtgtctgc

SEQ ID NO: 44500 - DNA, 20 bp, synthetic construct
  misc_feature 1..20: note = CRISPR gRNA sequence
  source 1..20: mol_type = other DNA
ctgtgacagtggtgtctgcc

SEQ ID NO: 44501 - DNA, 20 bp, synthetic construct
  misc_feature 1..20: note = CRISPR gRNA sequence
  source 1..20: mol_type = other DNA
ctttccctttgtaatcaaca

SEQ ID NO: 44502 - DNA, 20 bp, synthetic construct
  misc_feature 1..20: note = CRISPR gRNA sequence
  source 1..20: mol_type = other DNA
tgtaatcaacatagattatg

SEQ ID NO: 44503 - DNA, 20 bp, synthetic construct
  misc_feature 1..20: note = CRISPR gRNA sequence
  source 1..20: mol_type = other DNA
gtaatcaacatagattatgt

SEQ ID NO: 44504 - DNA, 20 bp, synthetic construct
  misc_feature 1..20: note = CRISPR gRNA sequence
  source 1..20: mol_type = other DNA
taatcaacatagattatgtg

SEQ ID NO: 44505 - DNA, 20 bp, synthetic construct
  misc_feature 1..20: note = CRISPR gRNA sequence
  source 1..20: mol_type = other DNA
atcaacatagattatgtggg

SEQ ID NO: 44506 - DNA, 20 bp, synthetic construct
  misc_feature 1..20: note = CRISPR gRNA sequence
  source 1..20: mol_type = other DNA
attatgtggggagatacttt

SEQ ID NO: 44507 - DNA, 20 bp, synthetic construct
  misc_feature 1..20: note = CRISPR gRNA sequence
  source 1..20: mol_type = other DNA
atactttaagattatgtatt

SEQ ID NO: 44508 - DNA, 20 bp, synthetic construct
  misc_feature 1..20: note = CRISPR gRNA sequence
  source 1..20: mol_type = other DNA
agtcttcctcaaactctcat

SEQ ID NO: 44509 - DNA, 20 bp, synthetic construct
  misc_feature 1..20: note = CRISPR gRNA sequence
  source 1..20: mol_type = other DNA
aaactctcattggcaaattt

SEQ ID NO: 44510 - DNA, 20 bp, synthetic construct
  misc_feature 1..20: note = CRISPR gRNA sequence
  source 1..20: mol_type = other DNA
ctctcattggcaaattttag

SEQ ID NO: 44511 - DNA, 20 bp, synthetic construct
  misc_feature 1..20: note = CRISPR gRNA sequence
  source 1..20: mol_type = other DNA
tcttacttaaatcgatgaat

SEQ ID NO: 44512 - DNA, 20 bp, synthetic construct
  misc_feature 1..20: note = CRISPR gRNA sequence
  source 1..20: mol_type = other DNA
aaatcgatgaatcagcatga

SEQ ID NO: 44513 - DNA, 20 bp, synthetic construct
  misc_feature 1..20: note = CRISPR gRNA sequence
  source 1..20: mol_type = other DNA
agcatgacagttgcaaaatg

SEQ ID NO: 44514 - DNA, 20 bp, synthetic construct
  misc_feature 1..20: note = CRISPR gRNA sequence
  source 1..20: mol_type = other DNA
tccatctaactgattacacc

SEQ ID NO: 44515 - DNA, 20 bp, synthetic construct
  misc_feature 1..20: note = CRISPR gRNA sequence
  source 1..20: mol_type = other DNA
atctaactgattacaccaag

SEQ ID NO: 44516 - DNA, 20 bp, synthetic construct
  misc_feature 1..20: note = CRISPR gRNA sequence
  source 1..20: mol_type = other DNA
ttacaccaagaagaaactct

SEQ ID NO: 44517 - DNA, 20 bp, synthetic construct
  misc_feature 1..20: note = CRISPR gRNA sequence
  source 1..20: mol_type = other DNA
tacaccaagaagaaactctt

SEQ ID NO: 44518 - DNA, 20 bp, synthetic construct
  misc_feature 1..20: note = CRISPR gRNA sequence
  source 1..20: mol_type = other DNA
ccaagaagaaactcttgggc

SEQ ID NO: 44519 - DNA, 20 bp, synthetic construct
  misc_feature 1..20: note = CRISPR gRNA sequence
  source 1..20: mol_type = other DNA
caagaagaaactcttgggct

SEQ ID NO: 44520 - DNA, 20 bp, synthetic construct
  misc_feature 1..20: note = CRISPR gRNA sequence
  source 1..20: mol_type = other DNA
agaaactcttgggctgggaa

SEQ ID NO: 44521 - DNA, 20 bp, synthetic construct
  misc_feature 1..20: note = CRISPR gRNA sequence
  source 1..20: mol_type = other DNA
aactcttgggctgggaacag

SEQ ID NO: 44522 - DNA, 20 bp, synthetic construct
  misc_feature 1..20: note = CRISPR gRNA sequence
  source 1..20: mol_type = other DNA
tgggctgggaacagtggctc

SEQ ID NO: 44523 - DNA, 20 bp, synthetic construct
  misc_feature 1..20: note = CRISPR gRNA sequence
  source 1..20: mol_type = other DNA
gtggctcaagcttgtaatcc

SEQ ID NO: 44524 - DNA, 20 bp, synthetic construct
  misc_feature 1..20: note = CRISPR gRNA sequence
  source 1..20: mol_type = other DNA
agcttgtaatcccagcactc

SEQ ID NO: 44525 - DNA, 20 bp, synthetic construct
  misc_feature 1..20: note = CRISPR gRNA sequence
  source 1..20: mol_type = other DNA
gcttgtaatcccagcactct

SEQ ID NO: 44526 - DNA, 20 bp, synthetic construct
  misc_feature 1..20: note = CRISPR gRNA sequence
  source 1..20: mol_type = other DNA
ttgtaatcccagcactctgg

SEQ ID NO: 44527 - DNA, 20 bp, synthetic construct
  misc_feature 1..20: note = CRISPR gRNA sequence
  source 1..20: mol_type = other DNA
tgtaatcccagcactctggg

SEQ ID NO: 44528 - DNA, 20 bp, synthetic construct
  misc_feature 1..20: note = CRISPR gRNA sequence
  source 1..20: mol_type = other DNA
tcccagcactctgggaggcc

SEQ ID NO: 44529 - DNA, 20 bp, synthetic construct
  misc_feature 1..20: note = CRISPR gRNA sequence
  source 1..20: mol_type = other DNA
cccagcactctgggaggccg

SEQ ID NO: 44530 - DNA, 20 bp, synthetic construct
  misc_feature 1..20: note = CRISPR gRNA sequence
  source 1..20: mol_type = other DNA
cagcactctgggaggccgag

SEQ ID NO: 44531 - DNA, 20 bp, synthetic construct
  misc_feature 1..20: note = CRISPR gRNA sequence
  source 1..20: mol_type = other DNA
agcactctgggaggccgagg

SEQ ID NO: 44532 - DNA, 20 bp, synthetic construct
  misc_feature 1..20: note = CRISPR gRNA sequence
  source 1..20: mol_type = other DNA
ccgaggaggaaaaatcgctt

SEQ ID NO: 44533 - DNA, 20 bp, synthetic construct
  misc_feature 1..20: note = CRISPR gRNA sequence
  source 1..20: mol_type = other DNA
gaggaaaaatcgcttgagcc

SEQ ID NO: 44534 - DNA, 20 bp, synthetic construct
  misc_feature 1..20: note = CRISPR gRNA sequence
  source 1..20: mol_type = other DNA
aggaaaaatcgcttgagccc

SEQ ID NO: 44535 - DNA, 20 bp, synthetic construct
  misc_feature 1..20: note = CRISPR gRNA sequence
  source 1..20: mol_type = other DNA
gaaaaatcgcttgagcccgg

SEQ ID NO: 44536 - DNA, 20 bp, synthetic construct
  misc_feature 1..20: note = CRISPR gRNA sequence
  source 1..20: mol_type = other DNA
tgagcccgggagttcgacac

SEQ ID NO: 44537 - DNA, 20 bp, synthetic construct
  misc_feature 1..20: note = CRISPR gRNA sequence
  source 1..20: mol_type = other DNA
cgggagttcgacaccagcct

SEQ ID NO: 44538 - DNA, 20 bp, synthetic construct
  misc_feature 1..20: note = CRISPR gRNA sequence
  source 1..20: mol_type = other DNA
cgacaccagcctgagcaaca

SEQ ID NO: 44539 - DNA, 20 bp, synthetic construct
  misc_feature 1..20: note = CRISPR gRNA sequence
  source 1..20: mol_type = other DNA
accagcctgagcaacatagc

SEQ ID NO: 44540 - DNA, 20 bp, synthetic construct
  misc_feature 1..20: note = CRISPR gRNA sequence
  source 1..20: mol_type = other DNA
aaataaaataaatgtttaaa

SEQ ID NO: 44541 - DNA, 20 bp, synthetic construct
  misc_feature 1..20: note = CRISPR gRNA sequence
  source 1..20: mol_type = other DNA
aataaaataaatgtttaaaa

SEQ ID NO: 44542 - DNA, 20 bp, synthetic construct
  misc_feature 1..20: note = CRISPR gRNA sequence
  source 1..20: mol_type = other DNA
aaaataaatgtttaaaaagg

SEQ ID NO: 44543 - DNA, 20 bp, synthetic construct
  misc_feature 1..20: note = CRISPR gRNA sequence
  source 1..20: mol_type = other DNA
ttaaaaaggaagaaactctt

SEQ ID NO: 44544 - DNA, 20 bp, synthetic construct
  misc_feature 1..20: note = CRISPR gRNA sequence
  source 1..20: mol_type = other DNA
taaaaaggaagaaactcttt

SEQ ID NO: 44545 - DNA, 20 bp, synthetic construct
  misc_feature 1..20: note = CRISPR gRNA sequence
  source 1..20: mol_type = other DNA
aaggaagaaactctttagga

SEQ ID NO: 44546 - DNA, 20 bp, synthetic construct
  misc_feature 1..20: note = CRISPR gRNA sequence
  source 1..20: mol_type = other DNA
ggaagaaactctttaggaca

SEQ ID NO: 44547 - DNA, 20 bp, synthetic construct
  misc_feature 1..20: note = CRISPR gRNA sequence
  source 1..20: mol_type = other DNA
aagaaactctttaggacaga

SEQ ID NO: 44548 - DNA, 20 bp, synthetic construct
  misc_feature 1..20: note = CRISPR gRNA sequence
  source 1..20: mol_type = other DNA
agagatctttgacacttctt

SEQ ID NO: 44549 - DNA, 20 bp, synthetic construct
  misc_feature 1..20: note = CRISPR gRNA sequence
  source 1..20: mol_type = other DNA
cttcttcagtatttgcttta

SEQ ID NO: 44550 - DNA, 20 bp, synthetic construct
  misc_feature 1..20: note = CRISPR gRNA sequence
  source 1..20: mol_type = other DNA
cagtatttgctttaaagatg

SEQ ID NO: 44551 - DNA, 20 bp, synthetic construct
  misc_feature 1..20: note = CRISPR gRNA sequence
  source 1..20: mol_type = other DNA
gtatttgctttaaagatgca

SEQ ID NO: 44552 - DNA, 20 bp, synthetic construct
  misc_feature 1..20: note = CRISPR gRNA sequence
  source 1..20: mol_type = other DNA
gcagagtttgtaataaacaa

SEQ ID NO: 44553 - DNA, 20 bp, synthetic construct
  misc_feature 1..20: note = CRISPR gRNA sequence
  source 1..20: mol_type = other DNA
ttgtaataaacaacagtaac

SEQ ID NO: 44554 - DNA, 20 bp, synthetic construct
  misc_feature 1..20: note = CRISPR gRNA sequence
  source 1..20: mol_type = other DNA
aacagtaactagctaaacta

SEQ ID NO: 44555 - DNA, 20 bp, synthetic construct
  misc_feature 1..20: note = CRISPR gRNA sequence
  source 1..20: mol_type = other DNA
actacagtgatacctaatcc

SEQ ID NO: 44556 - DNA, 20 bp, synthetic construct
  misc_feature 1..20: note = CRISPR gRNA sequence
  source 1..20: mol_type = other DNA
gtgatacctaatcctggctt

SEQ ID NO: 44557 - DNA, 20 bp, synthetic construct
  misc_feature 1..20: note = CRISPR gRNA sequence
  source 1..20: mol_type = other DNA
taatcctggcttaagttgtg

SEQ ID NO: 44558 - DNA, 20 bp, synthetic construct
  misc_feature 1..20: note = CRISPR gRNA sequence
  source 1..20: mol_type = other DNA
agttgctacctgaatgactg

SEQ ID NO: 44559 - DNA, 20 bp, synthetic construct
  misc_feature 1..20: note = CRISPR gRNA sequence
  source 1..20: mol_type = other DNA
ctacctgaatgactgcggtt

SEQ ID NO: 44560 - DNA, 20 bp, synthetic construct
  misc_feature 1..20: note = CRISPR gRNA sequence
  source 1..20: mol_type = other DNA
tacctgaatgactgcggttt

SEQ ID NO: 44561 - DNA, 20 bp, synthetic construct
  misc_feature 1..20: note = CRISPR gRNA sequence
  source 1..20: mol_type = other DNA
cggtttaggaaatactgaac

SEQ ID NO: 44562 - DNA, 20 bp, synthetic construct
  misc_feature 1..20: note = CRISPR gRNA sequence
  source 1..20: mol_type = other DNA
tagtccatgcttctgcttcc

SEQ ID NO: 44563 - DNA, 20 bp, synthetic construct
  misc_feature 1..20: note = CRISPR gRNA sequence
  source 1..20: mol_type = other DNA
gcttctgcttccaagctctg

SEQ ID NO: 44564 - DNA, 20 bp, synthetic construct
  misc_feature 1..20: note = CRISPR gRNA sequence
  source 1..20: mol_type = other DNA
tctgcttccaagctctgtgg

SEQ ID NO: 44565 - DNA, 20 bp, synthetic construct
  misc_feature 1..20: note = CRISPR gRNA sequence
  source 1..20: mol_type = other DNA
aagctctgtggtggcttaat

SEQ ID NO: 44566 - DNA, 20 bp, synthetic construct
  misc_feature 1..20: note = CRISPR gRNA sequence
  source 1..20: mol_type = other DNA
gtggtggcttaatgagttca

SEQ ID NO: 44567 - DNA, 20 bp, synthetic construct
  misc_feature 1..20: note = CRISPR gRNA sequence
  source 1..20: mol_type = other DNA
gtggcttaatgagttcatgg

SEQ ID NO: 44568 - DNA, 20 bp, synthetic construct
  misc_feature 1..20: note = CRISPR gRNA sequence
  source 1..20: mol_type = other DNA
gcttaatgagttcatggtgg

SEQ ID NO: 44569 - DNA, 20 bp, synthetic construct
  misc_feature 1..20: note = CRISPR gRNA sequence
  source 1..20: mol_type = other DNA
ttaatgagttcatggtggaa

SEQ ID NO: 44570 - DNA, 20 bp, synthetic construct
  misc_feature 1..20: note = CRISPR gRNA sequence
  source 1..20: mol_type = other DNA
catggtggaagagatttacg

SEQ ID NO: 44571 - DNA, 20 bp, synthetic construct
  misc_feature 1..20: note = CRISPR gRNA sequence
  source 1..20: mol_type = other DNA
atggtggaagagatttacga

SEQ ID NO: 44572 - DNA, 20 bp, synthetic construct
  misc_feature 1..20: note = CRISPR gRNA sequence
  source 1..20: mol_type = other DNA
tggtggaagagatttacgaa

SEQ ID NO: 44573 - DNA, 20 bp, synthetic construct
  misc_feature 1..20: note = CRISPR gRNA sequence
  source 1..20: mol_type = other DNA
tggaagagatttacgaaggg

SEQ ID NO: 44574 - DNA, 20 bp, synthetic construct
  misc_feature 1..20: note = CRISPR gRNA sequence
  source 1..20: mol_type = other DNA
ggaagagatttacgaaggga

SEQ ID NO: 44575 - DNA, 20 bp, synthetic construct
  misc_feature 1..20: note = CRISPR gRNA sequence
  source 1..20: mol_type = other DNA
aagagatttacgaagggaag

SEQ ID NO: 44576 - DNA, 20 bp, synthetic construct
  misc_feature 1..20: note = CRISPR gRNA sequence
  source 1..20: mol_type = other DNA
agagatttacgaagggaagg

SEQ ID NO: 44577 - DNA, 20 bp, synthetic construct
  misc_feature 1..20: note = CRISPR gRNA sequence
  source 1..20: mol_type = other DNA
acatccttgccctctgccac

SEQ ID NO: 44578 - DNA, 20 bp, synthetic construct
  misc_feature 1..20: note = CRISPR gRNA sequence
  source 1..20: mol_type = other DNA
tgccctctgccaccagcatt

SEQ ID NO: 44579 - DNA, 20 bp, synthetic construct
  misc_feature 1..20: note = CRISPR gRNA sequence
  source 1..20: mol_type = other DNA
ccctctgccaccagcattca

SEQ ID NO: 44580 - DNA, 20 bp, synthetic construct
  misc_feature 1..20: note = CRISPR gRNA sequence
  source 1..20: mol_type = other DNA
caccagcattcagagctccc

SEQ ID NO: 44581 - DNA, 20 bp, synthetic construct
  misc_feature 1..20: note = CRISPR gRNA sequence
  source 1..20: mol_type = other DNA
cattcagagctcccaagacc

SEQ ID NO: 44582 - DNA, 20 bp, synthetic construct
  misc_feature 1..20: note = CRISPR gRNA sequence
  source 1..20: mol_type = other DNA
attcagagctcccaagaccc

SEQ ID NO: 44583 - DNA, 20 bp, synthetic construct
  misc_feature 1..20: note = CRISPR gRNA sequence
  source 1..20: mol_type = other DNA
ttcagagctcccaagaccca

SEQ ID NO: 44584 - DNA, 20 bp, synthetic construct
  misc_feature 1..20: note = CRISPR gRNA sequence
  source 1..20: mol_type = other DNA
agagctcccaagacccaggg

SEQ ID NO: 44585 - DNA, 20 bp, synthetic construct
  misc_feature 1..20: note = CRISPR gRNA sequence
  source 1..20: mol_type = other DNA
tgttgccctttgacccccac

SEQ ID NO: 44586 - DNA, 20 bp, synthetic construct
  misc_feature 1..20: note = CRISPR gRNA sequence
  source 1..20: mol_type = other DNA
gttgccctttgacccccacc

SEQ ID NO: 44587 - DNA, 20 bp, synthetic construct
  misc_feature 1..20: note = CRISPR gRNA sequence
  source 1..20: mol_type = other DNA
acccccaccaggctgacctc

SEQ ID NO: 44588 - DNA, 20 bp, synthetic construct
  misc_feature 1..20: note = CRISPR gRNA sequence
  source 1..20: mol_type = other DNA
aggctgacctccagctgtgt

SEQ ID NO: 44589 - DNA, 20 bp, synthetic construct
  misc_feature 1..20: note = CRISPR gRNA sequence
  source 1..20: mol_type = other DNA
cctccagctgtgtgagcacc

SEQ ID NO: 44590 - DNA, 20 bp, synthetic construct
  misc_feature 1..20: note = CRISPR gRNA sequence
  source 1..20: mol_type = other DNA
ctccagctgtgtgagcaccg

SEQ ID NO: 44591 - DNA, 20 bp, synthetic construct
  misc_feature 1..20: note = CRISPR gRNA sequence
  source 1..20: mol_type = other DNA
tccagctgtgtgagcaccga

SEQ ID NO: 44592 - DNA, 20 bp, synthetic construct
  misc_feature 1..20: note = CRISPR gRNA sequence
  source 1..20: mol_type = other DNA
caccgagggcctcgcccacc

SEQ ID NO: 44593 - DNA, 20 bp, synthetic construct
  misc_feature 1..20: note = CRISPR gRNA sequence
  source 1..20: mol_type = other DNA
ggcctcgcccacctggcatc

SEQ ID NO: 44594 - DNA, 20 bp, synthetic construct
  misc_feature 1..20: note = CRISPR gRNA sequence
  source 1..20: mol_type = other DNA
cgcccacctggcatctggtc

SEQ ID NO: 44595 - DNA, 20 bp, synthetic construct
  misc_feature 1..20: note = CRISPR gRNA sequence
  source 1..20: mol_type = other DNA
gcccacctggcatctggtct

SEQ ID NO: 44596 - DNA, 20 bp, synthetic construct
  misc_feature 1..20: note = CRISPR gRNA sequence
  source 1..20: mol_type = other DNA
tctgggccactgccaccact

SEQ ID NO: 44597 - DNA, 20 bp, synthetic construct
  misc_feature 1..20: note = CRISPR gRNA sequence
  source 1..20: mol_type = other DNA
tgggccactgccaccacttg

SEQ ID NO: 44598 - DNA, 20 bp, synthetic construct
  misc_feature 1..20: note = CRISPR gRNA sequence
  source 1..20: mol_type = other DNA
gggccactgccaccacttgg

SEQ ID NO: 44599 - DNA, 20 bp, synthetic construct
  misc_feature 1..20: note = CRISPR gRNA sequence
  source 1..20: mol_type = other DNA
gccactgccaccacttggag

SEQ ID NO: 44600 - DNA, 20 bp, synthetic construct
  misc_feature 1..20: note = CRISPR gRNA sequence
  source 1..20: mol_type = other DNA
ctgccaccacttggaggagc

SEQ ID NO: 44601 - DNA, 20 bp, synthetic construct
  misc_feature 1..20: note = CRISPR gRNA sequence
  source 1..20: mol_type = other DNA
gccaccacttggaggagctg

SEQ ID NO: 44602 - DNA, 20 bp, synthetic construct
  misc_feature 1..20: note = CRISPR gRNA sequence
  source 1..20: mol_type = other DNA
ccacttggaggagctggagt

SEQ ID NO: 44603 - DNA, 20 bp, synthetic construct
  misc_feature 1..20: note = CRISPR gRNA sequence
  source 1..20: mol_type = other DNA
ggaggagctggagtgagttg

SEQ ID NO: 44604 - DNA, 20 bp, synthetic construct
  misc_feature 1..20: note = CRISPR gRNA sequence
  source 1..20: mol_type = other DNA
aggagctggagtgagttgca

SEQ ID NO: 44605 - DNA, 20 bp, synthetic construct
  misc_feature 1..20: note = CRISPR gRNA sequence
  source 1..20: mol_type = other DNA
agctggagtgagttgcagag

SEQ ID NO: 44606 - DNA, 20 bp, synthetic construct
  misc_feature 1..20: note = CRISPR gRNA sequence
  source 1..20: mol_type = other DNA
ctggagtgagttgcagagtg

SEQ ID NO: 44607 - DNA, 20 bp, synthetic construct
  misc_feature 1..20: note = CRISPR gRNA sequence
  source 1..20: mol_type = other DNA
tggagtgagttgcagagtgg

SEQ ID NO: 44608 - DNA, 20 bp, synthetic construct
  misc_feature 1..20: note = CRISPR gRNA sequence
  source 1..20: mol_type = other DNA
ggagtgagttgcagagtgga

SEQ ID NO: 44609 - DNA, 20 bp, synthetic construct
  misc_feature 1..20: note = CRISPR gRNA sequence
  source 1..20: mol_type = other DNA
gagttgcagagtggagggat

SEQ ID NO: 44610 - DNA, 20 bp, synthetic construct
  misc_feature 1..20: note = CRISPR gRNA sequence
  source 1..20: mol_type = other DNA
agttgcagagtggagggatt

SEQ ID NO: 44611 - DNA, 20 bp, synthetic construct
  misc_feature 1..20: note = CRISPR gRNA sequence
  source 1..20: mol_type = other DNA
gttgcagagtggagggattg

SEQ ID NO: 44612 - DNA, 20 bp, synthetic construct
  misc_feature 1..20: note = CRISPR gRNA sequence
  source 1..20: mol_type = other DNA
agagtggagggattggggac

SEQ ID NO: 44613 - DNA, 20 bp, synthetic construct
  misc_feature 1..20: note = CRISPR gRNA sequence
  source 1..20: mol_type = other DNA
gtggagggattggggacaag

SEQ ID NO: 44614 - DNA, 20 bp, synthetic construct
  misc_feature 1..20: note = CRISPR gRNA sequence
  source 1..20: mol_type = other DNA
gggattggggacaagtggcc

SEQ ID NO: 44615 - DNA, 20 bp, synthetic construct
  misc_feature 1..20: note = CRISPR gRNA sequence
  source 1..20: mol_type = other DNA
tggggacaagtggcccagct

SEQ ID NO: 44616 - DNA, 20 bp, synthetic construct
  misc_feature 1..20: note = CRISPR gRNA sequence
  source 1..20: mol_type = other DNA
ggggacaagtggcccagctg

SEQ ID NO: 44617 - DNA, 20 bp, synthetic construct
  misc_feature 1..20: note = CRISPR gRNA sequence
  source 1..20: mol_type = other DNA
gggacaagtggcccagctga

SEQ ID NO: 44618 - DNA, 20 bp, synthetic construct
  misc_feature 1..20: note = CRISPR gRNA sequence
  source 1..20: mol_type = other DNA
caagtggcccagctgagggt

SEQ ID NO: 44619 - DNA, 20 bp, synthetic construct
  misc_feature 1..20: note = CRISPR gRNA sequence
  source 1..20: mol_type = other DNA
aagtggcccagctgagggtg

SEQ ID NO: 44620 - DNA, 20 bp, synthetic construct
  misc_feature 1..20: note = CRISPR gRNA sequence
  source 1..20: mol_type = other DNA
agtggcccagctgagggtga

SEQ ID NO: 44621 - DNA, 20 bp, synthetic construct
  misc_feature 1..20: note = CRISPR gRNA sequence
  source 1..20: mol_type = other DNA
gtggcccagctgagggtgag

SEQ ID NO: 44622 - DNA, 20 bp, synthetic construct
  misc_feature 1..20: note = CRISPR gRNA sequence
  source 1..20: mol_type = other DNA
gcccagctgagggtgagggg

SEQ ID NO: 44623 - DNA, 20 bp, synthetic construct
  misc_feature 1..20: note = CRISPR gRNA sequence
  source 1..20: mol_type = other DNA
ccagctgagggtgaggggtg

SEQ ID NO: 44624 - DNA, 20 bp, synthetic construct
  misc_feature 1..20: note = CRISPR gRNA sequence
  source 1..20: mol_type = other DNA
gctgagggtgaggggtggag

SEQ ID NO: 44625 - DNA, 20 bp, synthetic construct
  misc_feature 1..20: note = CRISPR gRNA sequence
  source 1..20: mol_type = other DNA
tgagggtgaggggtggagaa

SEQ ID NO: 44626 - DNA, 20 bp, synthetic construct
  misc_feature 1..20: note = CRISPR gRNA sequence
  source 1..20: mol_type = other DNA
agggtgaggggtggagaaga

SEQ ID NO: 44627 - DNA, 20 bp, synthetic construct
  misc_feature 1..20: note = CRISPR gRNA sequence
  source 1..20: mol_type = other DNA
gtgaggggtggagaagagag

SEQ ID NO: 44628 - DNA, 20 bp, synthetic construct
  misc_feature 1..20: note = CRISPR gRNA sequence
  source 1..20: mol_type = other DNA
tgaggggtggagaagagagc

SEQ ID NO: 44629 - DNA, 20 bp, synthetic construct
  misc_feature 1..20: note = CRISPR gRNA sequence
  source 1..20: mol_type = other DNA
gaggggtggagaagagagca

SEQ ID NO: 44630 - DNA, 20 bp, synthetic construct
  misc_feature 1..20: note = CRISPR gRNA sequence
  source 1..20: mol_type = other DNA
ggagaagagagcagggcgtt

SEQ ID NO: 44631 - DNA, 20 bp, synthetic construct
  misc_feature 1..20: note = CRISPR gRNA sequence
  source 1..20: mol_type = other DNA
gagaagagagcagggcgttt

SEQ ID NO: 44632 - DNA, 20 bp, synthetic construct
  misc_feature 1..20: note = CRISPR gRNA sequence
  source 1..20: mol_type = other DNA
gaagagagcagggcgtttgg

SEQ ID NO: 44633 - DNA, 20 bp, synthetic construct
  misc_feature 1..20: note = CRISPR gRNA sequence
  source 1..20: mol_type = other DNA
aagagagcagggcgtttggg

SEQ ID NO: 44634 - DNA, 20 bp, synthetic construct
  misc_feature 1..20: note = CRISPR gRNA sequence
  source 1..20: mol_type = other DNA
agagagcagggcgtttggga

SEQ ID NO: 44635 - DNA, 20 bp, synthetic construct
  misc_feature 1..20: note = CRISPR gRNA sequence
  source 1..20: mol_type = other DNA
gagcagggcgtttgggaggg

SEQ ID NO: 44636 - DNA, 20 bp, synthetic construct
  misc_feature 1..20: note = CRISPR gRNA sequence
  source 1..20: mol_type = other DNA
agcagggcgtttgggagggc

SEQ ID NO: 44637 - DNA, 20 bp, synthetic construct
  misc_feature 1..20: note = CRISPR gRNA sequence
  source 1..20: mol_type = other DNA
cgtttgggagggcaggcaat

SEQ ID NO: 44638 - DNA, 20 bp, synthetic construct
  misc_feature 1..20: note = CRISPR gRNA sequence
  source 1..20: mol_type = other DNA
caatgacccttcccctgatg

SEQ ID NO: 44639 - DNA, 20 bp, synthetic construct
  misc_feature 1..20: note = CRISPR gRNA sequence
  source 1..20: mol_type = other DNA
acccttcccctgatgaagtg

SEQ ID NO: 44640 - DNA, 20 bp, synthetic construct
  misc_feature 1..20: note = CRISPR gRNA sequence
  source 1..20: mol_type = other DNA
cttcccctgatgaagtgcag

SEQ ID NO: 44641 - DNA, 20 bp, synthetic construct
  misc_feature 1..20: note = CRISPR gRNA sequence
  source 1..20: mol_type = other DNA
ctgatgaagtgcagcagttc

SEQ ID NO: 44642 - DNA, 20 bp, synthetic construct
  misc_feature 1..20: note = CRISPR gRNA sequence
  source 1..20: mol_type = other DNA
tgatgaagtgcagcagttct

SEQ ID NO: 44643 - DNA, 20 bp, synthetic construct
  misc_feature 1..20: note = CRISPR gRNA sequence
  source 1..20: mol_type = other DNA
aagtgcagcagttctgggtg

SEQ ID NO: 44644 - DNA, 20 bp, synthetic construct
  misc_feature 1..20: note = CRISPR gRNA sequence
  source 1..20: mol_type = other DNA
cagcagttctgggtgtggcc

SEQ ID NO: 44645 - DNA, 20 bp, synthetic construct
  misc_feature 1..20: note = CRISPR gRNA sequence
  source 1..20: mol_type = other DNA
agcagttctgggtgtggcct

SEQ ID NO: 44646 - DNA, 20 bp, synthetic construct
  misc_feature 1..20: note = CRISPR gRNA sequence
  source 1..20: mol_type = other DNA
gcagttctgggtgtggcctg

SEQ ID NO: 44647 - DNA, 20 bp, synthetic construct
  misc_feature 1..20: note = CRISPR gRNA sequence
  source 1..20: mol_type = other DNA
gttctgggtgtggcctgggg

SEQ ID NO: 44648 - DNA, 20 bp, synthetic construct
  misc_feature 1..20: note = CRISPR gRNA sequence
  source 1..20: mol_type = other DNA
ttctgggtgtggcctgggga

SEQ ID NO: 44649 - DNA, 20 bp, synthetic construct
  misc_feature 1..20: note = CRISPR gRNA sequence
  source 1..20: mol_type = other DNA
tgggtgtggcctggggaagg

SEQ ID NO: 44650 - DNA, 20 bp, synthetic construct
  misc_feature 1..20: note = CRISPR gRNA sequence
  source 1..20: mol_type = other DNA
ggtgtggcctggggaaggaa

SEQ ID NO: 44651 - DNA, 20 bp, synthetic construct
  misc_feature 1..20: note = CRISPR gRNA sequence
  source 1..20: mol_type = other DNA
ctggggaaggaagagcacca

SEQ ID NO: 44652 - DNA, 20 bp, synthetic construct
  misc_feature 1..20: note = CRISPR gRNA sequence
  source 1..20: mol_type = other DNA
aaggaagagcaccacagttt

SEQ ID NO: 44653 - DNA, 20 bp, synthetic construct
  misc_feature 1..20: note = CRISPR gRNA sequence
  source 1..20: mol_type = other DNA
tgaatttcgccactgactca

SEQ ID NO: 44654 - DNA, 20 bp, synthetic construct
  misc_feature 1..20: note = CRISPR gRNA sequence
  source 1..20: mol_type = other DNA
aatttcgccactgactcaca

SEQ ID NO: 44655 - DNA, 20 bp, synthetic construct
  misc_feature 1..20: note = CRISPR gRNA sequence
  source 1..20: mol_type = other DNA
atttcgccactgactcacag

SEQ ID NO: 44656 - DNA, 20 bp, synthetic construct
  misc_feature 1..20: note = CRISPR gRNA sequence
  source 1..20: mol_type = other DNA
tttcgccactgactcacaga

SEQ ID NO: 44657 - DNA, 20 bp, synthetic construct
  misc_feature 1..20: note = CRISPR gRNA sequence
  source 1..20: mol_type = other DNA
ttcgccactgactcacagag

SEQ ID NO: 44658 - DNA, 20 bp, synthetic construct
  misc_feature 1..20: note = CRISPR gRNA sequence
  source 1..20: mol_type = other DNA
actgactcacagaggggctg

SEQ ID NO: 44659 - DNA, 20 bp, synthetic construct
  misc_feature 1..20: note = CRISPR gRNA sequence
  source 1..20: mol_type = other DNA
ctgactcacagaggggctgt

SEQ ID NO: 44660 - DNA, 20 bp, synthetic construct
  misc_feature 1..20: note = CRISPR gRNA sequence
  source 1..20: mol_type = other DNA
tcacagaggggctgtgggca

SEQ ID NO: 44661 - DNA, 20 bp, synthetic construct
  misc_feature 1..20: note = CRISPR gRNA sequence
  source 1..20: mol_type = other DNA
tgggcatggctgttccactc

SEQ ID NO: 44662 - DNA, 20 bp, synthetic construct
  misc_feature 1..20: note = CRISPR gRNA sequence
  source 1..20: mol_type = other DNA
gggcatggctgttccactct

SEQ ID NO: 44663 - DNA, 20 bp, synthetic construct
  misc_feature 1..20: note = CRISPR gRNA sequence
  source 1..20: mol_type = other DNA
gattgccttatctatgaaaa

SEQ ID NO: 44664 - DNA, 20 bp, synthetic construct
  misc_feature 1..20: note = CRISPR gRNA sequence
  source 1..20: mol_type = other DNA
attgccttatctatgaaaat

SEQ ID NO: 44665 - DNA, 20 bp, synthetic construct
  misc_feature 1..20: note = CRISPR gRNA sequence
  source 1..20: mol_type = other DNA
ttgccttatctatgaaaatg

SEQ ID NO: 44666 - DNA, 20 bp, synthetic construct
  misc_feature 1..20: note = CRISPR gRNA sequence
  source 1..20: mol_type = other DNA
tctatgaaaatggggctcat

SEQ ID NO: 44667 - DNA, 20 bp, synthetic construct
  misc_feature 1..20: note = CRISPR gRNA sequence
  source 1..20: mol_type = other DNA
gctcatgagccttgctctgc

SEQ ID NO: 44668 - DNA, 20 bp, synthetic construct
  misc_feature 1..20: note = CRISPR gRNA sequence
  source 1..20: mol_type = other DNA
ctcatgagccttgctctgct

SEQ ID NO: 44669 - DNA, 20 bp, synthetic construct
  misc_feature 1..20: note = CRISPR gRNA sequence
  source 1..20: mol_type = other DNA
tgagccttgctctgctgggc

SEQ ID NO: 44670 - DNA, 20 bp, synthetic construct
  misc_feature 1..20: note = CRISPR gRNA sequence
  source 1..20: mol_type = other DNA
ttgctctgctgggctggctg

SEQ ID NO: 44671 - DNA, 20 bp, synthetic construct
  misc_feature 1..20: note = CRISPR gRNA sequence
  source 1..20: mol_type = other DNA
tgctctgctgggctggctgt

SEQ ID NO: 44672 - DNA, 20 bp, synthetic construct
  misc_feature 1..20: note = CRISPR gRNA sequence
  source 1..20: mol_type = other DNA
ctctgctgggctggctgtgg

SEQ ID NO: 44673 - DNA, 20 bp, synthetic construct
  misc_feature 1..20: note = CRISPR gRNA sequence
  source 1..20: mol_type = other DNA
gctgggctggctgtgggagt

SEQ ID NO: 44674 - DNA, 20 bp, synthetic construct
  misc_feature 1..20: note = CRISPR gRNA sequence
  source 1..20: mol_type = other DNA
ctgggctggctgtgggagtc

SEQ ID NO: 44675 - DNA, 20 bp, synthetic construct
  misc_feature 1..20: note = CRISPR gRNA sequence
  source 1..20: mol_type = other DNA
tggctgtgggagtcaggcta

SEQ ID NO: 44676 - DNA, 20 bp, synthetic construct
  misc_feature 1..20: note = CRISPR gRNA sequence
  source 1..20: mol_type = other DNA
gctgtgggagtcaggctacg

SEQ ID NO: 44677 - DNA, 20 bp, synthetic construct
  misc_feature 1..20: note = CRISPR gRNA sequence
  source 1..20: mol_type = other DNA
tgtgggagtcaggctacgga

SEQ ID NO: 44678 - DNA, 20 bp, synthetic construct
  misc_feature 1..20: note = CRISPR gRNA sequence
  source 1..20: mol_type = other DNA
gtgggagtcaggctacggag

SEQ ID NO: 44679 - DNA, 20 bp, synthetic construct
  misc_feature 1..20: note = CRISPR gRNA sequence
  source 1..20: mol_type = other DNA
tgggagtcaggctacggaga

SEQ ID NO: 44680 - DNA, 20 bp, synthetic construct
  misc_feature 1..20: note = CRISPR gRNA sequence
  source 1..20: mol_type = other DNA
tcaggctacggagagggctg

SEQ ID NO: 44681 - DNA, 20 bp, synthetic construct
  misc_feature 1..20: note = CRISPR gRNA sequence
  source 1..20: mol_type = other DNA
tacggagagggctgaagaac

SEQ ID NO: 44682 - DNA, 20 bp, synthetic construct
  misc_feature 1..20: note = CRISPR gRNA sequence
  source 1..20: mol_type = other DNA
cggagagggctgaagaacaa

SEQ ID NO: 44683 - DNA, 20 bp, synthetic construct
  misc_feature 1..20: note = CRISPR gRNA sequence
  source 1..20: mol_type = other DNA
ggagagggctgaagaacaag

SEQ ID NO: 44684 - DNA, 20 bp, synthetic construct
  misc_feature 1..20: note = CRISPR gRNA sequence
  source 1..20: mol_type = other DNA
gagagggctgaagaacaaga

SEQ ID NO: 44685 - DNA, 20 bp, synthetic construct
  misc_feature 1..20: note = CRISPR gRNA sequence
  source 1..20: mol_type = other DNA
tgtgtgtgtgtgtgtgtccc

SEQ ID NO: 44686 - DNA, 20 bp, synthetic construct
  misc_feature 1..20: note = CRISPR gRNA sequence
  source 1..20: mol_type = other DNA
tgtgtgtgtccctagtcccc

SEQ ID NO: 44687 - DNA, 20 bp, synthetic construct
  misc_feature 1..20: note = CRISPR gRNA sequence
  source 1..20: mol_type = other DNA
gtcccccagcttcctctctg

SEQ ID NO: 44688 - DNA, 20 bp, synthetic construct
  misc_feature 1..20: note = CRISPR gRNA sequence
  source 1..20: mol_type = other DNA
tcctctctgcagccttcatc

SEQ ID NO: 44689 - DNA, 20 bp, synthetic construct
  misc_feature 1..20: note = CRISPR gRNA sequence
  source 1..20: mol_type = other DNA
cctctctgcagccttcatcc

SEQ ID NO: 44690 - DNA, 20 bp, synthetic construct
  misc_feature 1..20: note = CRISPR gRNA sequence
  source 1..20: mol_type = other DNA
ctctctgcagccttcatcca

SEQ ID NO: 44691 - DNA, 20 bp, synthetic construct
  misc_feature 1..20: note = CRISPR gRNA sequence
  source 1..20: mol_type = other DNA
tgcagccttcatccagggca

SEQ ID NO: 44692 - DNA, 20 bp, synthetic construct
  misc_feature 1..20: note = CRISPR gRNA sequence
  source 1..20: mol_type = other DNA
tcatccagggcatagtttct

SEQ ID NO: 44693 - DNA, 20 bp, synthetic construct
  misc_feature 1..20: note = CRISPR gRNA sequence
  source 1..20: mol_type = other DNA
ccagggcatagtttctcagc

SEQ ID NO: 44694 - DNA, 20 bp, synthetic construct
  misc_feature 1..20: note = CRISPR gRNA sequence
  source 1..20: mol_type = other DNA
cagggcatagtttctcagct

SEQ ID NO: 44695 - DNA, 20 bp, synthetic construct
  misc_feature 1..20: note = CRISPR gRNA sequence
  source 1..20: mol_type = other DNA
gcatagtttctcagctgggc

SEQ ID NO: 44696 - DNA, 20 bp, synthetic construct
  misc_feature 1..20: note = CRISPR gRNA sequence
  source 1..20: mol_type = other DNA
ctgtgactatcatgcctacc

SEQ ID NO: 44697 - DNA, 20 bp, synthetic construct
  misc_feature 1..20: note = CRISPR gRNA sequence
  source 1..20: mol_type = other DNA
gtgactatcatgcctaccca

SEQ ID NO: 44698 - DNA, 20 bp, synthetic construct
  misc_feature 1..20: note = CRISPR gRNA sequence
  source 1..20: mol_type = other DNA
atcatgcctacccagagcct

SEQ ID NO: 44699 - DNA, 20 bp, synthetic construct
  misc_feature 1..20: note = CRISPR gRNA sequence
  source 1..20: mol_type = other DNA
cctacccagagcctgagccc

SEQ ID NO: 44700 - DNA, 20 bp, synthetic construct
  misc_feature 1..20: note = CRISPR gRNA sequence
  source 1..20: mol_type = other DNA
tacccagagcctgagccctg

SEQ ID NO: 44701 - DNA, 20 bp, synthetic construct
  misc_feature 1..20: note = CRISPR gRNA sequence
  source 1..20: mol_type = other DNA
cagagcctgagccctggagc

SEQ ID NO: 44702 - DNA, 20 bp, synthetic construct
  misc_feature 1..20: note = CRISPR gRNA sequence
  source 1..20: mol_type = other DNA
agagcctgagccctggagct

SEQ ID NO: 44703 - DNA, 20 bp, synthetic construct
  misc_feature 1..20: note = CRISPR gRNA sequence
  source 1..20: mol_type = other DNA
gagcctgagccctggagcta

SEQ ID NO: 44704 - DNA, 20 bp, synthetic construct
  misc_feature 1..20: note = CRISPR gRNA sequence
  source 1..20: mol_type = other DNA
cctggagctagggataccca

SEQ ID NO: 44705 - DNA, 20 bp, synthetic construct
  misc_feature 1..20: note = CRISPR gRNA sequence
  source 1..20: mol_type = other DNA
ctggagctagggatacccat

SEQ ID NO: 44706 - DNA, 20 bp, synthetic construct
  misc_feature 1..20: note = CRISPR gRNA sequence
  source 1..20: mol_type = other DNA
tggagctagggatacccatg

SEQ ID NO: 44707 - DNA, 20 bp, synthetic construct
  misc_feature 1..20: note = CRISPR gRNA sequence
  source 1..20: mol_type = other DNA
agggatacccatggggaacc

SEQ ID NO: 44708 - DNA, 20 bp, synthetic construct
  misc_feature 1..20: note = CRISPR gRNA sequence
  source 1..20: mol_type = other DNA
atacccatggggaacctgga

SEQ ID NO: 44709 - DNA, 20 bp, synthetic construct
  misc_feature 1..20: note = CRISPR gRNA sequence
  source 1..20: mol_type = other DNA
ccatggggaacctggacagc

SEQ ID NO: 44710 - DNA, 20 bp, synthetic construct
  misc_feature 1..20: note = CRISPR gRNA sequence
  source 1..20: mol_type = other DNA
catggggaacctggacagcg

SEQ ID NO: 44711 - DNA, 20 bp, synthetic construct
  misc_feature 1..20: note = CRISPR gRNA sequence
  source 1..20: mol_type = other DNA
atggggaacctggacagcga

SEQ ID NO: 44712 - DNA, 20 bp, synthetic construct
  misc_feature 1..20: note = CRISPR gRNA sequence
  source 1..20: mol_type = other DNA
gggaacctggacagcgaggg

SEQ ID NO: 44713 - DNA, 20 bp, synthetic construct
  misc_feature 1..20: note = CRISPR gRNA sequence
  source 1..20: mol_type = other DNA
cctggacagcgagggtggcc

SEQ ID NO: 44714 - DNA, 20 bp, synthetic construct
  misc_feature 1..20: note = CRISPR gRNA sequence
  source 1..20: mol_type = other DNA
ctggacagcgagggtggccc

SEQ ID NO: 44715 - DNA, 20 bp, synthetic construct
  misc_feature 1..20: note = CRISPR gRNA sequence
  source 1..20: mol_type = other DNA
tggacagcgagggtggccca

SEQ ID NO: 44716 - DNA, 20 bp, synthetic construct
  misc_feature 1..20: note = CRISPR gRNA sequence
  source 1..20: mol_type = other DNA
cgagggtggcccagggcatg

SEQ ID NO: 44717 - DNA, 20 bp, synthetic construct
  misc_feature 1..20: note = CRISPR gRNA sequence
  source 1..20: mol_type = other DNA
tggcccagggcatgcagatg

SEQ ID NO: 44718 - DNA, 20 bp, synthetic construct
  misc_feature 1..20: note = CRISPR gRNA sequence
  source 1..20: mol_type = other DNA
gcccagggcatgcagatgca

SEQ ID NO: 44719 - DNA, 20 bp, synthetic construct
  misc_feature 1..20: note = CRISPR gRNA sequence
  source 1..20: mol_type = other DNA
agggcatgcagatgcagagt

SEQ ID NO: 44720 - DNA, 20 bp, synthetic construct
  misc_feature 1..20: note = CRISPR gRNA sequence
  source 1..20: mol_type = other DNA
cagatgcagagttggcctcc

SEQ ID NO: 44721 - DNA, 20 bp, synthetic construct
  misc_feature 1..20: note = CRISPR gRNA sequence
  source 1..20: mol_type = other DNA
agatgcagagttggcctccc

SEQ ID NO: 44722 - DNA, 20 bp, synthetic construct
  misc_feature 1..20: note = CRISPR gRNA sequence
  source 1..20: mol_type = other DNA
gatgcagagttggcctccca

SEQ ID NO: 44723 - DNA, 20 bp, synthetic construct
  misc_feature 1..20: note = CRISPR gRNA sequence
  source 1..20: mol_type = other DNA
atgcagagttggcctcccag

SEQ ID NO: 44724 - DNA, 20 bp, synthetic construct
  misc_feature 1..20: note = CRISPR gRNA sequence
  source 1..20: mol_type = other DNA
agagttggcctcccagggga

SEQ ID NO: 44725 - DNA, 20 bp, synthetic construct
  misc_feature 1..20: note = CRISPR gRNA sequence
  source 1..20: mol_type = other DNA
agttggcctcccaggggaca

SEQ ID NO: 44726 - DNA, 20 bp, synthetic construct
  misc_feature 1..20: note = CRISPR gRNA sequence
  source 1..20: mol_type = other DNA
tggcctcccaggggacagag

SEQ ID NO: 44727 - DNA, 20 bp, synthetic construct
  misc_feature 1..20: note = CRISPR gRNA sequence
  source 1..20: mol_type = other DNA
ggcctcccaggggacagagc

SEQ ID NO: 44728 - DNA, 20 bp, synthetic construct
  misc_feature 1..20: note = CRISPR gRNA sequence
  source 1..20: mol_type = other DNA
cctcccaggggacagagcag

SEQ ID NO: 44729 - DNA, 20 bp, synthetic construct
  misc_feature 1..20: note = CRISPR gRNA sequence
  source 1..20: mol_type = other DNA
tcccaggggacagagcagga

SEQ ID NO: 44730 - DNA, 20 bp, synthetic construct
  misc_feature 1..20: note = CRISPR gRNA sequence
  source 1..20: mol_type = other DNA
cccaggggacagagcaggag

SEQ ID NO: 44731 - DNA, 20 bp, synthetic construct
  misc_feature 1..20: note = CRISPR gRNA sequence
  source 1..20: mol_type = other DNA
ccaggggacagagcaggaga

SEQ ID NO: 44732 - DNA, 20 bp, synthetic construct
  misc_feature 1..20: note = CRISPR gRNA sequence
  source 1..20: mol_type = other DNA
caggggacagagcaggagag

SEQ ID NO: 44733 - DNA, 20 bp, synthetic construct
  misc_feature 1..20: note = CRISPR gRNA sequence
  source 1..20: mol_type = other DNA
ggggacagagcaggagaggg

SEQ ID NO: 44734 - DNA, 20 bp, synthetic construct
  misc_feature 1..20: note = CRISPR gRNA sequence
  source 1..20: mol_type = other DNA
gagcaggagaggggagctga

SEQ ID NO: 44735 - DNA, 20 bp, synthetic construct
  misc_feature 1..20: note = CRISPR gRNA sequence
  source 1..20: mol_type = other DNA
agcaggagaggggagctgac

SEQ ID NO: 44736 - DNA, 20 bp, synthetic construct
  misc_feature 1..20: note = CRISPR gRNA sequence
  source 1..20: mol_type = other DNA
ggagaggggagctgacagga

SEQ ID NO: 44737 - DNA, 20 bp, synthetic construct
  misc_feature 1..20: note = CRISPR gRNA sequence
  source 1..20: mol_type = other DNA
ggggagctgacaggacagct

SEQ ID NO: 44738 - DNA, 20 bp, synthetic construct
  misc_feature 1..20: note = CRISPR gRNA sequence
  source 1..20: mol_type = other DNA
ctgacaggacagctcagctc

SEQ ID NO: 44739 - DNA, 20 bp, synthetic construct
  misc_feature 1..20: note = CRISPR gRNA sequence
  source 1..20: mol_type = other DNA
tgacaggacagctcagctcc

SEQ ID NO: 44740 - DNA, 20 bp, synthetic construct
  misc_feature 1..20: note = CRISPR gRNA sequence
  source 1..20: mol_type = other DNA
gacaggacagctcagctcca

SEQ ID NO: 44741 - DNA, 20 bp, synthetic construct
  misc_feature 1..20: note = CRISPR gRNA sequence
  source 1..20: mol_type = other DNA
ggacagctcagctccagggc

SEQ ID NO: 44742 - DNA, 20 bp, synthetic construct
  misc_feature 1..20: note = CRISPR gRNA sequence
  source 1..20: mol_type = other DNA
gacagctcagctccagggct

SEQ ID NO: 44743 - DNA, 20 bp, synthetic construct
  misc_feature 1..20: note = CRISPR gRNA sequence
  source 1..20: mol_type = other DNA
agctcagctccagggctggg

SEQ ID NO: 44744 - DNA, 20 bp, synthetic construct
  misc_feature 1..20: note = CRISPR gRNA sequence
  source 1..20: mol_type = other DNA
gctcagctccagggctgggc

SEQ ID NO: 44745 - DNA, 20 bp, synthetic construct
  misc_feature 1..20: note = CRISPR gRNA sequence
  source 1..20: mol_type = other DNA
cgctaacccttgcctctgcc

SEQ ID NO: 44746 - DNA, 20 bp, synthetic construct
  misc_feature 1..20: note = CRISPR gRNA sequence
  source 1..20: mol_type = other DNA
tgcctctgcctggtcttctg

SEQ ID NO: 44747 - DNA, 20 bp, synthetic construct
  misc_feature 1..20: note = CRISPR gRNA sequence
  source 1..20: mol_type = other DNA
tgtctaacaatcaatttgat

SEQ ID NO: 44748 - DNA, 20 bp, synthetic construct
  misc_feature 1..20: note = CRISPR gRNA sequence
  source 1..20: mol_type = other DNA
gtctaacaatcaatttgatg

SEQ ID NO: 44749 - DNA, 20 bp, synthetic construct
  misc_feature 1..20: note = CRISPR gRNA sequence
  source 1..20: mol_type = other DNA
ctaacaatcaatttgatgag

SEQ ID NO: 44750 - DNA, 20 bp, synthetic construct
  misc_feature 1..20: note = CRISPR gRNA sequence
  source 1..20: mol_type = other DNA
taacaatcaatttgatgagg

SEQ ID NO: 44751 - DNA, 20 bp, synthetic construct
  misc_feature 1..20: note = CRISPR gRNA sequence
  source 1..20: mol_type = other DNA
aacaatcaatttgatgagga

SEQ ID NO: 44752 - DNA, 20 bp, synthetic construct
  misc_feature 1..20: note = CRISPR gRNA sequence
  source 1..20: mol_type = other DNA
aatttgatgaggagggcacc

SEQ ID NO: 44753 - DNA, 20 bp, synthetic construct
  misc_feature 1..20: note = CRISPR gRNA sequence
  source 1..20: mol_type = other DNA
atttgatgaggagggcacca

SEQ ID NO: 44754 - DNA, 20 bp, synthetic construct
  misc_feature 1..20: note = CRISPR gRNA sequence
  source 1..20: mol_type = other DNA
gagggcaccaaggcgctgat

SEQ ID NO: 44755 - DNA, 20 bp, synthetic construct
  misc_feature 1..20: note = CRISPR gRNA sequence
  source 1..20: mol_type = other DNA
agggcaccaaggcgctgatg

SEQ ID NO: 44756 - DNA, 20 bp, synthetic construct
  misc_feature 1..20: note = CRISPR gRNA sequence
  source 1..20: mol_type = other DNA
gggcaccaaggcgctgatga

SEQ ID NO: 44757 - DNA, 20 bp, synthetic construct
  misc_feature 1..20: note = CRISPR gRNA sequence
  source 1..20: mol_type = other DNA
aggcgctgatgagggccctt

SEQ ID NO: 44758 - DNA, 20 bp, synthetic construct
  misc_feature 1..20: note = CRISPR gRNA sequence
  source 1..20: mol_type = other DNA
ggcgctgatgagggcccttg

SEQ ID NO: 44759 - DNA, 20 bp, synthetic construct
  misc_feature 1..20: note = CRISPR gRNA sequence
  source 1..20: mol_type = other DNA
gcgctgatgagggcccttga

SEQ ID NO: 44760 - DNA, 20 bp, synthetic construct
  misc_feature 1..20: note = CRISPR gRNA sequence
  source 1..20: mol_type = other DNA
cgctgatgagggcccttgag

SEQ ID NO: 44761 - DNA, 20 bp, synthetic construct
  misc_feature 1..20: note = CRISPR gRNA sequence
  source 1..20: mol_type = other DNA
tgagggcccttgaggggaaa

SEQ ID NO: 44762 - DNA, 20 bp, synthetic construct
  misc_feature 1..20: note = CRISPR gRNA sequence
  source 1..20: mol_type = other DNA
ttgaggggaaatggatgcta

SEQ ID NO: 44763 - DNA, 20 bp, synthetic construct
  misc_feature 1..20: note = CRISPR gRNA sequence
  source 1..20: mol_type = other DNA
gaggggaaatggatgctaaa

SEQ ID NO: 44764 - DNA, 20 bp, synthetic construct
  misc_feature 1..20: note = CRISPR gRNA sequence
  source 1..20: mol_type = other DNA
aggggaaatggatgctaaag

SEQ ID NO: 44765 - DNA, 20 bp, synthetic construct
  misc_feature 1..20: note = CRISPR gRNA sequence
  source 1..20: mol_type = other DNA
gaaatggatgctaaagaggc

SEQ ID NO: 44766 - DNA, 20 bp, synthetic construct
  misc_feature 1..20: note = CRISPR gRNA sequence
  source 1..20: mol_type = other DNA
aatggatgctaaagaggctg

SEQ ID NO: 44767 - DNA, 20 bp, synthetic construct
  misc_feature 1..20: note = CRISPR gRNA sequence
  source 1..20: mol_type = other DNA
gatgctaaagaggctggagt

SEQ ID NO: 44768 - DNA, 20 bp, synthetic construct
  misc_feature 1..20: note = CRISPR gRNA sequence
  source 1..20: mol_type = other DNA
gctaaagaggctggagtaag

SEQ ID NO: 44769 - DNA, 20 bp, synthetic construct
  misc_feature 1..20: note = CRISPR gRNA sequence
  source 1..20: mol_type = other DNA
gaggctggagtaagtagtga

SEQ ID NO: 44770 - DNA, 20 bp, synthetic construct
  misc_feature 1..20: note = CRISPR gRNA sequence
  source 1..20: mol_type = other DNA
gctggagtaagtagtgatgg

SEQ ID NO: 44771 - DNA, 20 bp, synthetic construct
  misc_feature 1..20: note = CRISPR gRNA sequence
  source 1..20: mol_type = other DNA
gtaagtagtgatggtggttg

SEQ ID NO: 44772 - DNA, 20 bp, synthetic construct
  misc_feature 1..20: note = CRISPR gRNA sequence
  source 1..20: mol_type = other DNA
taagtagtgatggtggttgt

SEQ ID NO: 44773 - DNA, 20 bp, synthetic construct
  misc_feature 1..20: note = CRISPR gRNA sequence
  source 1..20: mol_type = other DNA
tagtgatggtggttgtgggt

SEQ ID NO: 44774 - DNA, 20 bp, synthetic construct
  misc_feature 1..20: note = CRISPR gRNA sequence
  source 1..20: mol_type = other DNA
gatggtggttgtgggtgagt

SEQ ID NO: 44775 - DNA, 20 bp, synthetic construct
  misc_feature 1..20: note = CRISPR gRNA sequence
  source 1..20: mol_type = other DNA
ggtggttgtgggtgagtgag

SEQ ID NO: 44776 - DNA, 20 bp, synthetic construct
  misc_feature 1..20: note = CRISPR gRNA sequence
  source 1..20: mol_type = other DNA
ggttgtgggtgagtgagtgg

SEQ ID NO: 44777 - DNA, 20 bp, synthetic construct
  misc_feature 1..20: note = CRISPR gRNA sequence
  source 1..20: mol_type = other DNA
gttgtgggtgagtgagtggt

SEQ ID NO: 44778 - DNA, 20 bp, synthetic construct
  misc_feature 1..20: note = CRISPR gRNA sequence
  source 1..20: mol_type = other DNA
ttgtgggtgagtgagtggtg

SEQ ID NO: 44779 - DNA, 20 bp, synthetic construct
  misc_feature 1..20: note = CRISPR gRNA sequence
  source 1..20: mol_type = other DNA
tgtgggtgagtgagtggtgg

SEQ ID NO: 44780 - DNA, 20 bp, synthetic construct
  misc_feature 1..20: note = CRISPR gRNA sequence
  source 1..20: mol_type = other DNA
gggtgagtgagtggtggggg

SEQ ID NO: 44781 - DNA, 20 bp, synthetic construct
  misc_feature 1..20: note = CRISPR gRNA sequence
  source 1..20: mol_type = other DNA
tgagtggtgggggtggttaa

SEQ ID NO: 44782 - DNA, 20 bp, synthetic construct
  misc_feature 1..20: note = CRISPR gRNA sequence
  source 1..20: mol_type = other DNA
tggtgggggtggttaatgga

SEQ ID NO: 44783 - DNA, 20 bp, synthetic construct
  misc_feature 1..20: note = CRISPR gRNA sequence
  source 1..20: mol_type = other DNA
tgggggtggttaatggatgg

SEQ ID NO: 44784 - DNA, 20 bp, synthetic construct
  misc_feature 1..20: note = CRISPR gRNA sequence
  source 1..20: mol_type = other DNA
gggtggttaatggatggtgg

SEQ ID NO: 44785 - DNA, 20 bp, synthetic construct
  misc_feature 1..20: note = CRISPR gRNA sequence
  source 1..20: mol_type = other DNA
tggttaatggatggtggaag

SEQ ID NO: 44786 - DNA, 20 bp, synthetic construct
  misc_feature 1..20: note = CRISPR gRNA sequence
  source 1..20: mol_type = other DNA
ggttaatggatggtggaagt

SEQ ID NO: 44787 - DNA, 20 bp, synthetic construct
  misc_feature 1..20: note = CRISPR gRNA sequence
  source 1..20: mol_type = other DNA
aatggatggtggaagtgggt

SEQ ID NO: 44788 - DNA, 20 bp, synthetic construct
  misc_feature 1..20: note = CRISPR gRNA sequence
  source 1..20: mol_type = other DNA
ggatggtggaagtgggtgag

SEQ ID NO: 44789 - DNA, 20 bp, synthetic construct
  misc_feature 1..20: note = CRISPR gRNA sequence
  source 1..20: mol_type = other DNA
tggtggaagtgggtgagtgg

SEQ ID NO: 44790 - DNA, 20 bp, synthetic construct
  misc_feature 1..20: note = CRISPR gRNA sequence
  source 1..20: mol_type = other DNA
ggtggaagtgggtgagtggt

SEQ ID NO: 44791 - DNA, 20 bp, synthetic construct
  misc_feature 1..20: note = CRISPR gRNA sequence
  source 1..20: mol_type = other DNA
gtggaagtgggtgagtggtg

SEQ ID NO: 44792 - DNA, 20 bp, synthetic construct
  misc_feature 1..20: note = CRISPR gRNA sequence
  source 1..20: mol_type = other DNA
aagtgggtgagtggtggggt

SEQ ID NO: 44793 - DNA, 20 bp, synthetic construct
  misc_feature 1..20: note = CRISPR gRNA sequence
  source 1..20: mol_type = other DNA
tgagtggtggggttggttaa

SEQ ID NO: 44794 - DNA, 20 bp, synthetic construct
  misc_feature 1..20: note = CRISPR gRNA sequence
  source 1..20: mol_type = other DNA
tggtggggttggttaatgga

SEQ ID NO: 44795 - DNA, 20 bp, synthetic construct
  misc_feature 1..20: note = CRISPR gRNA sequence
  source 1..20: mol_type = other DNA
tggggttggttaatggatgg

SEQ ID NO: 44796 - DNA, 20 bp, synthetic construct
  misc_feature 1..20: note = CRISPR gRNA sequence
  source 1..20: mol_type = other DNA
ggttggttaatggatggtgg

SEQ ID NO: 44797 - DNA, 20 bp, synthetic construct
  misc_feature 1..20: note = CRISPR gRNA sequence
  source 1..20: mol_type = other DNA
tggttaatggatggtggaag

SEQ ID NO: 44798 - DNA, 20 bp, synthetic construct
  misc_feature 1..20: note = CRISPR gRNA sequence
  source 1..20: mol_type = other DNA
ggttaatggatggtggaagt

SEQ ID NO: 44799 - DNA, 20 bp, synthetic construct
  misc_feature 1..20: note = CRISPR gRNA sequence
  source 1..20: mol_type = other DNA
aatggatggtggaagtgggt

SEQ ID NO: 44800 - DNA, 20 bp, synthetic construct
  misc_feature 1..20: note = CRISPR gRNA sequence
  source 1..20: mol_type = other DNA
ggatggtggaagtgggtgag

SEQ ID NO: 44801 - DNA, 20 bp, synthetic construct
  misc_feature 1..20: note = CRISPR gRNA sequence
  source 1..20: mol_type = other DNA
tggtggaagtgggtgagtgg

SEQ ID NO: 44802 - DNA, 20 bp, synthetic construct
  misc_feature 1..20: note = CRISPR gRNA sequence
  source 1..20: mol_type = other DNA
ggtggaagtgggtgagtggt

SEQ ID NO: 44803 - DNA, 20 bp, synthetic construct
  misc_feature 1..20: note = CRISPR gRNA sequence
  source 1..20: mol_type = other DNA
gtggaagtgggtgagtggtg

SEQ ID NO: 44804 - DNA, 20 bp, synthetic construct
  misc_feature 1..20: note = CRISPR gRNA sequence
  source 1..20: mol_type = other DNA
aagtgggtgagtggtggggt

SEQ ID NO: 44805 - DNA, 20 bp, synthetic construct
  misc_feature 1..20: note = CRISPR gRNA sequence
  source 1..20: mol_type = other DNA
tgagtggtggggttggttaa

SEQ ID NO: 44806 - DNA, 20 bp, synthetic construct
  misc_feature 1..20: note = CRISPR gRNA sequence
  source 1..20: mol_type = other DNA
gagtggtggggttggttaat

SEQ ID NO: 44807 - DNA, 20 bp, synthetic construct
  misc_feature 1..20: note = CRISPR gRNA sequence
  source 1..20: mol_type = other DNA
agtggtggggttggttaatg

SEQ ID NO: 44808 - DNA, 20 bp, synthetic construct
  misc_feature 1..20: note = CRISPR gRNA sequence
  source 1..20: mol_type = other DNA
tggggttggttaatggggaa

SEQ ID NO: 44809 - DNA, 20 bp, synthetic construct
  misc_feature 1..20: note = CRISPR gRNA sequence
  source 1..20: mol_type = other DNA
ggggttggttaatggggaat

SEQ ID NO: 44810 - DNA, 20 bp, synthetic construct
  misc_feature 1..20: note = CRISPR gRNA sequence
  source 1..20: mol_type = other DNA
gggttggttaatggggaatg

SEQ ID NO: 44811 - DNA, 20 bp, synthetic construct
  misc_feature 1..20: note = CRISPR gRNA sequence
  source 1..20: mol_type = other DNA
tggttaatggggaatggggt

SEQ ID NO: 44812 - DNA, 20 bp, synthetic construct
  misc_feature 1..20: note = CRISPR gRNA sequence
  source 1..20: mol_type = other DNA
taatggggaatggggtgagt

SEQ ID NO: 44813 - DNA, 20 bp, synthetic construct
  misc_feature 1..20: note = CRISPR gRNA sequence
  source 1..20: mol_type = other DNA
tggggaatggggtgagtgag

SEQ ID NO: 44814 - DNA, 20 bp, synthetic construct
  misc_feature 1..20: note = CRISPR gRNA sequence
  source 1..20: mol_type = other DNA
ggaatggggtgagtgagtgg

SEQ ID NO: 44815 - DNA, 20 bp, synthetic construct
  misc_feature 1..20: note = CRISPR gRNA sequence
  source 1..20: mol_type = other DNA
gaatggggtgagtgagtggt

SEQ ID NO: 44816 - DNA, 20 bp, synthetic construct
  misc_feature 1..20: note = CRISPR gRNA sequence
  source 1..20: mol_type = other DNA
atggggtgagtgagtggtgg

SEQ ID NO: 44817 - DNA, 20 bp, synthetic construct
  misc_feature 1..20: note = CRISPR gRNA sequence
  source 1..20: mol_type = other DNA
gggtgagtgagtggtgggag

SEQ ID NO: 44818 - DNA, 20 bp, synthetic construct
  misc_feature 1..20: note = CRISPR gRNA sequence
  source 1..20: mol_type = other DNA
tgagtggtgggagtggttaa

SEQ ID NO: 44819 - DNA, 20 bp, synthetic construct
  misc_feature 1..20: note = CRISPR gRNA sequence
  source 1..20: mol_type = other DNA
gagtggtgggagtggttaat

SEQ ID NO: 44820 - DNA, 20 bp, synthetic construct
  misc_feature 1..20: note = CRISPR gRNA sequence
  source 1..20: mol_type = other DNA
agtggtgggagtggttaatg

SEQ ID NO: 44821 - DNA, 20 bp, synthetic construct
  misc_feature 1..20: note = CRISPR gRNA sequence
  source 1..20: mol_type = other DNA
tgggagtggttaatggggaa

SEQ ID NO: 44822 - DNA, 20 bp, synthetic construct
  misc_feature 1..20: note = CRISPR gRNA sequence
  source 1..20: mol_type = other DNA
gggagtggttaatggggaat

SEQ ID NO: 44823 - DNA, 20 bp, synthetic construct
  misc_feature 1..20: note = CRISPR gRNA sequence
  source 1..20: mol_type = other DNA
tggttaatggggaatgggct

SEQ ID NO: 44824 - DNA, 20 bp, synthetic construct
  misc_feature 1..20: note = CRISPR gRNA sequence
  source 1..20: mol_type = other DNA
taatggggaatgggctgagt

SEQ ID NO: 44825 - DNA, 20 bp, synthetic construct
  misc_feature 1..20: note = CRISPR gRNA sequence
  source 1..20: mol_type = other DNA
tggggaatgggctgagtgag

SEQ ID NO: 44826 - DNA, 20 bp, synthetic construct
  misc_feature 1..20: note = CRISPR gRNA sequence
  source 1..20: mol_type = other DNA
ggaatgggctgagtgagtgg

SEQ ID NO: 44827 - DNA, 20 bp, synthetic construct
  misc_feature 1..20: note = CRISPR gRNA sequence
  source 1..20: mol_type = other DNA
gaatgggctgagtgagtggt

SEQ ID NO: 44828 - DNA, 20 bp, synthetic construct
  misc_feature 1..20: note = CRISPR gRNA sequence
  source 1..20: mol_type = other DNA
atgggctgagtgagtggtgg

SEQ ID NO: 44829 - DNA, 20 bp, synthetic construct
  misc_feature 1..20: note = CRISPR gRNA sequence
  source 1..20: mol_type = other DNA
ggctgagtgagtggtgggag

SEQ ID NO: 44830 - DNA, 20 bp, synthetic construct
  misc_feature 1..20: note = CRISPR gRNA sequence
  source 1..20: mol_type = other DNA
tgagtggtgggagtggttaa

SEQ ID NO: 44831 - DNA, 20 bp, synthetic construct
  misc_feature 1..20: note = CRISPR gRNA sequence
  source 1..20: mol_type = other DNA
gagtggtgggagtggttaat

SEQ ID NO: 44832 - DNA, 20 bp, synthetic construct
  misc_feature 1..20: note = CRISPR gRNA sequence
  source 1..20: mol_type = other DNA
agtggtgggagtggttaatg

SEQ ID NO: 44833 - DNA, 20 bp, synthetic construct
  misc_feature 1..20: note = CRISPR gRNA sequence
  source 1..20: mol_type = other DNA
tgggagtggttaatggggaa

SEQ ID NO: 44834 - DNA, 20 bp, synthetic construct
  misc_feature 1..20: note = CRISPR gRNA sequence
  source 1..20: mol_type = other DNA
gggagtggttaatggggaat

SEQ ID NO: 44835 - DNA, 20 bp, synthetic construct
  misc_feature 1..20: note = CRISPR gRNA sequence
  source 1..20: mol_type = other DNA
ggagtggttaatggggaatg

SEQ ID NO: 44836 - DNA, 20 bp, synthetic construct
  misc_feature 1..20: note = CRISPR gRNA sequence
  source 1..20: mol_type = other DNA
tggttaatggggaatggggt

SEQ ID NO: 44837 - DNA, 20 bp, synthetic construct
  misc_feature 1..20: note = CRISPR gRNA sequence
  source 1..20: mol_type = other DNA
taatggggaatggggtgagt

SEQ ID NO: 44838 - DNA, 20 bp, synthetic construct
  misc_feature 1..20: note = CRISPR gRNA sequence
  source 1..20: mol_type = other DNA
tggggaatggggtgagtgag

SEQ ID NO: 44839 - DNA, 20 bp, synthetic construct
  misc_feature 1..20: note = CRISPR gRNA sequence
  source 1..20: mol_type = other DNA
atggggtgagtgagtggtga

SEQ ID NO: 44840 - DNA, 20 bp, synthetic construct
  misc_feature 1..20: note = CRISPR gRNA sequence
  source 1..20: mol_type = other DNA
gggtgagtgagtggtgatgg

SEQ ID NO: 44841 - DNA, 20 bp, synthetic construct
  misc_feature 1..20: note = CRISPR gRNA sequence
  source 1..20: mol_type = other DNA
tgagtggtgatggtggttaa

SEQ ID NO: 44842 - DNA, 20 bp, synthetic construct
  misc_feature 1..20: note = CRISPR gRNA sequence
  source 1..20: mol_type = other DNA
gagtggtgatggtggttaat

SEQ ID NO: 44843 - DNA, 20 bp, synthetic construct
  misc_feature 1..20: note = CRISPR gRNA sequence
  source 1..20: mol_type = other DNA
agtggtgatggtggttaatg

SEQ ID NO: 44844 - DNA, 20 bp, synthetic construct
  misc_feature 1..20: note = CRISPR gRNA sequence
  source 1..20: mol_type = other DNA
ggtgatggtggttaatgggg

SEQ ID NO: 44845 - DNA, 20 bp, synthetic construct
  misc_feature 1..20: note = CRISPR gRNA sequence
  source 1..20: mol_type = other DNA
gtgatggtggttaatgggga

SEQ ID NO: 44846 - DNA, 20 bp, synthetic construct
  misc_feature 1..20: note = CRISPR gRNA sequence
  source 1..20: mol_type = other DNA
tgatggtggttaatggggaa

SEQ ID NO: 44847 - DNA, 20 bp, synthetic construct
  misc_feature 1..20: note = CRISPR gRNA sequence
  source 1..20: mol_type = other DNA
tggttaatggggaagggtgt

SEQ ID NO: 44848 - DNA, 20 bp, synthetic construct
  misc_feature 1..20: note = CRISPR gRNA sequence
  source 1..20: mol_type = other DNA
gttaatggggaagggtgtga

SEQ ID NO: 44849 - DNA, 20 bp, synthetic construct
  misc_feature 1..20: note = CRISPR gRNA sequence
  source 1..20: mol_type = other DNA
aatggggaagggtgtgagag

SEQ ID NO: 44850 - DNA, 20 bp, synthetic construct
  misc_feature 1..20: note = CRISPR gRNA sequence
  source 1..20: mol_type = other DNA
gaagggtgtgagagtggtga

SEQ ID NO: 44851 - DNA, 20 bp, synthetic construct
  misc_feature 1..20: note = CRISPR gRNA sequence
  source 1..20: mol_type = other DNA
gggtgtgagagtggtgatgg

SEQ ID NO: 44852 - DNA, 20 bp, synthetic construct
  misc_feature 1..20: note = CRISPR gRNA sequence
  source 1..20: mol_type = other DNA
agagtggtgatggtggttaa

SEQ ID NO: 44853 - DNA, 20 bp, synthetic construct
  misc_feature 1..20: note = CRISPR gRNA sequence
  source 1..20: mol_type = other DNA
gagtggtgatggtggttaat

SEQ ID NO: 44854 - DNA, 20 bp, synthetic construct
  misc_feature 1..20: note = CRISPR gRNA sequence
  source 1..20: mol_type = other DNA
agtggtgatggtggttaatg

SEQ ID NO: 44855 - DNA, 20 bp, synthetic construct
  misc_feature 1..20: note = CRISPR gRNA sequence
  source 1..20: mol_type = other DNA
ggtgatggtggttaatgggg

SEQ ID NO: 44856 - DNA, 20 bp, synthetic construct
  misc_feature 1..20: note = CRISPR gRNA sequence
  source 1..20: mol_type = other DNA
gtgatggtggttaatgggga

SEQ ID NO: 44857 - DNA, 20 bp, synthetic construct
  misc_feature 1..20: note = CRISPR gRNA sequence
  source 1..20: mol_type = other DNA
tgatggtggttaatggggaa

SEQ ID NO: 44858 - DNA, 20 bp, synthetic construct
  misc_feature 1..20: note = CRISPR gRNA sequence
  source 1..20: mol_type = other DNA
gatggtggttaatggggaag

SEQ ID NO: 44859 - DNA, 20 bp, synthetic construct
  misc_feature 1..20: note = CRISPR gRNA sequence
  source 1..20: mol_type = other DNA
atggtggttaatggggaagg

SEQ ID NO: 44860 - DNA, 20 bp, synthetic construct
  misc_feature 1..20: note = CRISPR gRNA sequence
  source 1..20: mol_type = other DNA
tggttaatggggaagggggt

SEQ ID NO: 44861 - DNA, 20 bp, synthetic construct
  misc_feature 1..20: note = CRISPR gRNA sequence
  source 1..20: mol_type = other DNA
taatggggaagggggtgagt

SEQ ID NO: 44862 - DNA, 20 bp, synthetic construct
  misc_feature 1..20: note = CRISPR gRNA sequence
  source 1..20: mol_type = other DNA
tggggaagggggtgagtgag

SEQ ID NO: 44863 - DNA, 20 bp, synthetic construct
  misc_feature 1..20: note = CRISPR gRNA sequence
  source 1..20: mol_type = other DNA
agggggtgagtgagtggtga

SEQ ID NO: 44864 - DNA, 20 bp, synthetic construct
  misc_feature 1..20: note = CRISPR gRNA sequence
  source 1..20: mol_type = other DNA
gggtgagtgagtggtgatgg

SEQ ID NO: 44865 - DNA, 20 bp, synthetic construct
  misc_feature 1..20: note = CRISPR gRNA sequence
  source 1..20: mol_type = other DNA
tgagtggtgatggtggttaa

SEQ ID NO: 44866 - DNA, 20 bp, synthetic construct
  misc_feature 1..20: note = CRISPR gRNA sequence
  source 1..20: mol_type = other DNA
gagtggtgatggtggttaat

SEQ ID NO: 44867 - DNA, 20 bp, synthetic construct
  misc_feature 1..20: note = CRISPR gRNA sequence
  source 1..20: mol_type = other DNA
agtggtgatggtggttaatg

SEQ ID NO: 44868 - DNA, 20 bp, synthetic construct
  misc_feature 1..20: note = CRISPR gRNA sequence
  source 1..20: mol_type = other DNA
ggtgatggtggttaatgggg

SEQ ID NO: 44869 - DNA, 20 bp, synthetic construct
  misc_feature 1..20: note = CRISPR gRNA sequence
  source 1..20: mol_type = other DNA
ggttaatggggaagtgttgt

SEQ ID NO: 44870 - DNA, 20 bp, synthetic construct
  misc_feature 1..20: note = CRISPR gRNA sequence
  source 1..20: mol_type = other DNA
aatggggaagtgttgtgagt

SEQ ID NO: 44871 - DNA, 20 bp, synthetic construct
  misc_feature 1..20: note = CRISPR gRNA sequence
  source 1..20: mol_type = other DNA
gtgttgtgagtgagttgtgt

SEQ ID NO: 44872 - DNA, 20 bp, synthetic construct
  misc_feature 1..20: note = CRISPR gRNA sequence
  source 1..20: mol_type = other DNA
ttgtgagtgagttgtgttgg

SEQ ID NO: 44873 - DNA, 20 bp, synthetic construct
  misc_feature 1..20: note = CRISPR gRNA sequence
  source 1..20: mol_type = other DNA
tgagttgtgttggtggttaa

SEQ ID NO: 44874 - DNA, 20 bp, synthetic construct
  misc_feature 1..20: note = CRISPR gRNA sequence
  source 1..20: mol_type = other DNA
gagttgtgttggtggttaat

SEQ ID NO: 44875 - DNA, 20 bp, synthetic construct
  misc_feature 1..20: note = CRISPR gRNA sequence
  source 1..20: mol_type = other DNA
agttgtgttggtggttaatg

SEQ ID NO: 44876 - DNA, 20 bp, synthetic construct
  misc_feature 1..20: note = CRISPR gRNA sequence
  source 1..20: mol_type = other DNA
tgtgttggtggttaatgggg

SEQ ID NO: 44877 - DNA, 20 bp, synthetic construct
  misc_feature 1..20: note = CRISPR gRNA sequence
  source 1..20: mol_type = other DNA
gtgttggtggttaatgggga

SEQ ID NO: 44878 - DNA, 20 bp, synthetic construct
  misc_feature 1..20: note = CRISPR gRNA sequence
  source 1..20: mol_type = other DNA
gttggtggttaatggggaag

SEQ ID NO: 44879 - DNA, 20 bp, synthetic construct
  misc_feature 1..20: note = CRISPR gRNA sequence
  source 1..20: mol_type = other DNA
tggttaatggggaaggagat

SEQ ID NO: 44880 - DNA, 20 bp, synthetic construct
  misc_feature 1..20: note = CRISPR gRNA sequence
  source 1..20: mol_type = other DNA
taatggggaaggagatgagt

SEQ ID NO: 44881 - DNA, 20 bp, synthetic construct
  misc_feature 1..20: note = CRISPR gRNA sequence
  source 1..20: mol_type = other DNA
tggggaaggagatgagtgag

SEQ ID NO: 44882 - DNA, 20 bp, synthetic construct
  misc_feature 1..20: note = CRISPR gRNA sequence
  source 1..20: mol_type = other DNA
aggagatgagtgagtggtgt

SEQ ID NO: 44883 - DNA, 20 bp, synthetic construct
  misc_feature 1..20: note = CRISPR gRNA sequence
  source 1..20: mol_type = other DNA
agatgagtgagtggtgttgg

SEQ ID NO: 44884 - DNA, 20 bp, synthetic construct
  misc_feature 1..20: note = CRISPR gRNA sequence
  source 1..20: mol_type = other DNA
tgagtggtgttggtggttaa

SEQ ID NO: 44885 - DNA, 20 bp, synthetic construct
  misc_feature 1..20: note = CRISPR gRNA sequence
  source 1..20: mol_type = other DNA
gagtggtgttggtggttaat

SEQ ID NO: 44886 - DNA, 20 bp, synthetic construct
  misc_feature 1..20: note = CRISPR gRNA sequence
  source 1..20: mol_type = other DNA
agtggtgttggtggttaatg

SEQ ID NO: 44887 - DNA, 20 bp, synthetic construct
  misc_feature 1..20: note = CRISPR gRNA sequence
  source 1..20: mol_type = other DNA
ggtgttggtggttaatgggg

SEQ ID NO: 44888 - DNA, 20 bp, synthetic construct
  misc_feature 1..20: note = CRISPR gRNA sequence
  source 1..20: mol_type = other DNA
gtgttggtggttaatgggga

SEQ ID NO: 44889 - DNA, 20 bp, synthetic construct
  misc_feature 1..20: note = CRISPR gRNA sequence
  source 1..20: mol_type = other DNA
tgttggtggttaatggggaa

SEQ ID NO: 44890 - DNA, 20 bp, synthetic construct
  misc_feature 1..20: note = CRISPR gRNA sequence
  source 1..20: mol_type = other DNA
ggttaatggggaagggttgt

SEQ ID NO: 44891 - DNA, 20 bp, synthetic construct
  misc_feature 1..20: note = CRISPR gRNA sequence
  source 1..20: mol_type = other DNA
aatggggaagggttgtgagt

SEQ ID NO: 44892 - DNA, 20 bp, synthetic construct
  misc_feature 1..20: note = CRISPR gRNA sequence
  source 1..20: mol_type = other DNA
ggggaagggttgtgagtgag

SEQ ID NO: 44893 - DNA, 20 bp, synthetic construct
  misc_feature 1..20: note = CRISPR gRNA sequence
  source 1..20: mol_type = other DNA
gaagggttgtgagtgagtgg

SEQ ID NO: 44894 - DNA, 20 bp, synthetic construct
  misc_feature 1..20: note = CRISPR gRNA sequence
  source 1..20: mol_type = other DNA
ttgtgagtgagtggtggcgt

SEQ ID NO: 44895 - DNA, 20 bp, synthetic construct
  misc_feature 1..20: note = CRISPR gRNA sequence
  source 1..20: mol_type = other DNA
tgagtggtggcgttggttaa

SEQ ID NO: 44896 - DNA, 20 bp, synthetic construct
  misc_feature 1..20: note = CRISPR gRNA sequence
  source 1..20: mol_type = other DNA
gagtggtggcgttggttaat

SEQ ID NO: 44897 - DNA, 20 bp, synthetic construct
  misc_feature 1..20: note = CRISPR gRNA sequence
  source 1..20: mol_type = other DNA
agtggtggcgttggttaatg

SEQ ID NO: 44898 - DNA, 20 bp, synthetic construct
  misc_feature 1..20: note = CRISPR gRNA sequence
  source 1..20: mol_type = other DNA
ggtggcgttggttaatgggg

SEQ ID NO: 44899 - DNA, 20 bp, synthetic construct
  misc_feature 1..20: note = CRISPR gRNA sequence
  source 1..20: mol_type = other DNA
gtggcgttggttaatgggga

SEQ ID NO: 44900 - DNA, 20 bp, synthetic construct
  misc_feature 1..20: note = CRISPR gRNA sequence
  source 1..20: mol_type = other DNA
tggcgttggttaatggggaa

SEQ ID NO: 44901 - DNA, 20 bp, synthetic construct
  misc_feature 1..20: note = CRISPR gRNA sequence
  source 1..20: mol_type = other DNA
ggcgttggttaatggggaag

SEQ ID NO: 44902 - DNA, 20 bp, synthetic construct
  misc_feature 1..20: note = CRISPR gRNA sequence
  source 1..20: mol_type = other DNA
gcgttggttaatggggaagg

SEQ ID NO: 44903 - DNA, 20 bp, synthetic construct
  misc_feature 1..20: note = CRISPR gRNA sequence
  source 1..20: mol_type = other DNA
tggttaatggggaagggggt

SEQ ID NO: 44904 - DNA, 20 bp, synthetic construct
  misc_feature 1..20: note = CRISPR gRNA sequence
  source 1..20: mol_type = other DNA
taatggggaagggggtgagt

SEQ ID NO: 44905 - DNA, 20 bp, synthetic construct
  misc_feature 1..20: note = CRISPR gRNA sequence
  source 1..20: mol_type = other DNA
tggggaagggggtgagtgag

SEQ ID NO: 44906 - DNA, 20 bp, synthetic construct
  misc_feature 1..20: note = CRISPR gRNA sequence
  source 1..20: mol_type = other DNA
agggggtgagtgagtggtga

SEQ ID NO: 44907 - DNA, 20 bp, synthetic construct
  misc_feature 1..20: note = CRISPR gRNA sequence
  source 1..20: mol_type = other DNA
gggtgagtgagtggtgatgg

SEQ ID NO: 44908 - DNA, 20 bp, synthetic construct
  misc_feature 1..20: note = CRISPR gRNA sequence
  source 1..20: mol_type = other DNA
tgagtggtgatggtggttaa

SEQ ID NO: 44909 - DNA, 20 bp, synthetic construct
  misc_feature 1..20: note = CRISPR gRNA sequence
  source 1..20: mol_type = other DNA
gagtggtgatggtggttaat

SEQ ID NO: 44910 - DNA, 20 bp, synthetic construct
  misc_feature 1..20: note = CRISPR gRNA sequence
  source 1..20: mol_type = other DNA
agtggtgatggtggttaatg

SEQ ID NO: 44911 - DNA, 20 bp, synthetic construct
  misc_feature 1..20: note = CRISPR gRNA sequence
  source 1..20: mol_type = other DNA
ggtgatggtggttaatgggg

SEQ ID NO: 44912 - DNA, 20 bp, synthetic construct
  misc_feature 1..20: note = CRISPR gRNA sequence
  source 1..20: mol_type = other DNA
tgatggtggttaatggggaa

SEQ ID NO: 44913 - DNA, 20 bp, synthetic construct
  misc_feature 1..20: note = CRISPR gRNA sequence
  source 1..20: mol_type = other DNA
ggttaatggggaagagttgt

SEQ ID NO: 44914 - DNA, 20 bp, synthetic construct
  misc_feature 1..20: note = CRISPR gRNA sequence
  source 1..20: mol_type = other DNA
aatggggaagagttgtgagt

SEQ ID NO: 44915 - DNA, 20 bp, synthetic construct
  misc_feature 1..20: note = CRISPR gRNA sequence
  source 1..20: mol_type = other DNA
ggggaagagttgtgagtgag

SEQ ID NO: 44916 - DNA, 20 bp, synthetic construct
  misc_feature 1..20: note = CRISPR gRNA sequence
  source 1..20: mol_type = other DNA
gagttgtgagtgagtggtgt

SEQ ID NO: 44917 - DNA, 20 bp, synthetic construct
  misc_feature 1..20: note = CRISPR gRNA sequence
  source 1..20: mol_type = other DNA
ttgtgagtgagtggtgttgg

SEQ ID NO: 44918 - DNA, 20 bp, synthetic construct
  misc_feature 1..20: note = CRISPR gRNA sequence
  source 1..20: mol_type = other DNA
tgagtggtgttggtggttaa

SEQ ID NO: 44919 - DNA, 20 bp, synthetic construct
  misc_feature 1..20: note = CRISPR gRNA sequence
  source 1..20: mol_type = other DNA
gagtggtgttggtggttaat

SEQ ID NO: 44920 - DNA, 20 bp, synthetic construct
  misc_feature 1..20: note = CRISPR gRNA sequence
  source 1..20: mol_type = other DNA
agtggtgttggtggttaatg

SEQ ID NO: 44921 - DNA, 20 bp, synthetic construct
  misc_feature 1..20: note = CRISPR gRNA sequence
  source 1..20: mol_type = other DNA
ggtgttggtggttaatgggg

SEQ ID NO: 44922 - DNA, 20 bp, synthetic construct
  misc_feature 1..20: note = CRISPR gRNA sequence
  source 1..20: mol_type = other DNA
gtgttggtggttaatgggga

SEQ ID NO: 44923 - DNA, 20 bp, synthetic construct
  misc_feature 1..20: note = CRISPR gRNA sequence
  source 1..20: mol_type = other DNA
tgttggtggttaatggggaa

SEQ ID NO: 44924 - DNA, 20 bp, synthetic construct
  misc_feature 1..20: note = CRISPR gRNA sequence
  source 1..20: mol_type = other DNA
gttggtggttaatggggaag

SEQ ID NO: 44925 - DNA, 20 bp, synthetic construct
  misc_feature 1..20: note = CRISPR gRNA sequence
  source 1..20: mol_type = other DNA
ttggtggttaatggggaagg

SEQ ID NO: 44926 - DNA, 20 bp, synthetic construct
  misc_feature 1..20: note = CRISPR gRNA sequence
  source 1..20: mol_type = other DNA
tggttaatggggaagggggt

SEQ ID NO: 44927 - DNA, 20 bp, synthetic construct
  misc_feature 1..20: note = CRISPR gRNA sequence
  source 1..20: mol_type = other DNA
taatggggaagggggtgagt

SEQ ID NO: 44928 - DNA, 20 bp, synthetic construct
  misc_feature 1..20: note = CRISPR gRNA sequence
  source 1..20: mol_type = other DNA
tggggaagggggtgagtgag

SEQ ID NO: 44929 - DNA, 20 bp, synthetic construct
  misc_feature 1..20: note = CRISPR gRNA sequence
  source 1..20: mol_type = other DNA
ggaagggggtgagtgagtgg

SEQ ID NO: 44930 - DNA, 20 bp, synthetic construct
  misc_feature 1..20: note = CRISPR gRNA sequence
  source 1..20: mol_type = other DNA
gaagggggtgagtgagtggt

SEQ ID NO: 44931 - DNA, 20 bp, synthetic construct
  misc_feature 1..20: note = CRISPR gRNA sequence
  source 1..20: mol_type = other DNA
aagggggtgagtgagtggtg

SEQ ID NO: 44932 - DNA, 20 bp, synthetic construct
  misc_feature 1..20: note = CRISPR gRNA sequence
  source 1..20: mol_type = other DNA
gggtgagtgagtggtggggt

SEQ ID NO: 44933 - DNA, 20 bp, synthetic construct
  misc_feature 1..20: note = CRISPR gRNA sequence
  source 1..20: mol_type = other DNA
tgagtggtggggttggttaa

SEQ ID NO: 44934 - DNA, 20 bp, synthetic construct
  misc_feature 1..20: note = CRISPR gRNA sequence
  source 1..20: mol_type = other DNA
gagtggtggggttggttaat

SEQ ID NO: 44935 - DNA, 20 bp, synthetic construct
  misc_feature 1..20: note = CRISPR gRNA sequence
  source 1..20: mol_type = other DNA
agtggtggggttggttaatg

SEQ ID NO: 44936 - DNA, 20 bp, synthetic construct
  misc_feature 1..20: note = CRISPR gRNA sequence
  source 1..20: mol_type = other DNA
ggtggggttggttaatgggg

SEQ ID NO: 44937 - DNA, 20 bp, synthetic construct
  misc_feature 1..20: note = CRISPR gRNA sequence
  source 1..20: mol_type = other DNA
ggttaatggggaagtgttgt

SEQ ID NO: 44938 - DNA, 20 bp, synthetic construct
  misc_feature 1..20: note = CRISPR gRNA sequence
  source 1..20: mol_type = other DNA
aatggggaagtgttgtgagt

SEQ ID NO: 44939 - DNA, 20 bp, synthetic construct
  misc_feature 1..20: note = CRISPR gRNA sequence
  source 1..20: mol_type = other DNA
ggggaagtgttgtgagtgag

SEQ ID NO: 44940 - DNA, 20 bp, synthetic construct
  misc_feature 1..20: note = CRISPR gRNA sequence
  source 1..20: mol_type = other DNA
gtgttgtgagtgagtggtga

SEQ ID NO: 44941 - DNA, 20 bp, synthetic construct
  misc_feature 1..20: note = CRISPR gRNA sequence
  source 1..20: mol_type = other DNA
tgagtggtgatggtgattaa

SEQ ID NO: 44942 - DNA, 20 bp, synthetic construct
  misc_feature 1..20: note = CRISPR gRNA sequence
  source 1..20: mol_type = other DNA
gagtggtgatggtgattaat

SEQ ID NO: 44943 - DNA, 20 bp, synthetic construct
  misc_feature 1..20: note = CRISPR gRNA sequence
  source 1..20: mol_type = other DNA
agtggtgatggtgattaatg

SEQ ID NO: 44944 - DNA, 20 bp, synthetic construct
  misc_feature 1..20: note = CRISPR gRNA sequence
  source 1..20: mol_type = other DNA
ggtgatggtgattaatgggg

SEQ ID NO: 44945 - DNA, 20 bp, synthetic construct
  misc_feature 1..20: note = CRISPR gRNA sequence
  source 1..20: mol_type = other DNA
gtgatggtgattaatgggga

SEQ ID NO: 44946 - DNA, 20 bp, synthetic construct
  misc_feature 1..20: note = CRISPR gRNA sequence
  source 1..20: mol_type = other DNA
tgatggtgattaatggggaa

SEQ ID NO: 44947 - DNA, 20 bp, synthetic construct
  misc_feature 1..20: note = CRISPR gRNA sequence
  source 1..20: mol_type = other DNA
gattaatggggaagggttgt

SEQ ID NO: 44948 - DNA, 20 bp, synthetic construct
  misc_feature 1..20: note = CRISPR gRNA sequence
  source 1..20: mol_type = other DNA
aatggggaagggttgtgagt

SEQ ID NO: 44949 - DNA, 20 bp, synthetic construct
  misc_feature 1..20: note = CRISPR gRNA sequence
  source 1..20: mol_type = other DNA
ggggaagggttgtgagtgag

SEQ ID NO: 44950 - DNA, 20 bp, synthetic construct
  misc_feature 1..20: note = CRISPR gRNA sequence
  source 1..20: mol_type = other DNA
gggttgtgagtgagtggcgt

SEQ ID NO: 44951 - DNA, 20 bp, synthetic construct
  misc_feature 1..20: note = CRISPR gRNA sequence
  source 1..20: mol_type = other DNA
ttgtgagtgagtggcgttgg

SEQ ID NO: 44952 - DNA, 20 bp, synthetic construct
  misc_feature 1..20: note = CRISPR gRNA sequence
  source 1..20: mol_type = other DNA
tgagtggcgttggtggttaa

SEQ ID NO: 44953 - DNA, 20 bp, synthetic construct
  misc_feature 1..20: note = CRISPR gRNA sequence
  source 1..20: mol_type = other DNA
gagtggcgttggtggttaat

SEQ ID NO: 44954 - DNA, 20 bp, synthetic construct
  misc_feature 1..20: note = CRISPR gRNA sequence
  source 1..20: mol_type = other DNA
agtggcgttggtggttaatg

SEQ ID NO: 44955 - DNA, 20 bp, synthetic construct
  misc_feature 1..20: note = CRISPR gRNA sequence
  source 1..20: mol_type = other DNA
ggcgttggtggttaatgggg

SEQ ID NO: 44956 - DNA, 20 bp, synthetic construct
  misc_feature 1..20: note = CRISPR gRNA sequence
  source 1..20: mol_type = other DNA
gcgttggtggttaatgggga

SEQ ID NO: 44957 - DNA, 20 bp, synthetic construct
  misc_feature 1..20: note = CRISPR gRNA sequence
  source 1..20: mol_type = other DNA
cgttggtggttaatggggaa

SEQ ID NO: 44958 - DNA, 20 bp, synthetic construct
  misc_feature 1..20: note = CRISPR gRNA sequence
  source 1..20: mol_type = other DNA
ttggtggttaatggggaagg

SEQ ID NO: 44959 - DNA, 20 bp, synthetic construct
  misc_feature 1..20: note = CRISPR gRNA sequence
  source 1..20: mol_type = other DNA
tggtggttaatggggaaggg

SEQ ID NO: 44960 - DNA, 20 bp, synthetic construct
  misc_feature 1..20: note = CRISPR gRNA sequence
  source 1..20: mol_type = other DNA
ggtggttaatggggaaggga

SEQ ID NO: 44961 - DNA, 20 bp, synthetic construct
  misc_feature 1..20: note = CRISPR gRNA sequence
  source 1..20: mol_type = other DNA
tggttaatggggaagggagg

SEQ ID NO: 44962 - DNA, 20 bp, synthetic construct
  misc_feature 1..20: note = CRISPR gRNA sequence
  source 1..20: mol_type = other DNA
taatggggaagggagggagt

SEQ ID NO: 44963 - DNA, 20 bp, synthetic construct
  misc_feature 1..20: note = CRISPR gRNA sequence
  source 1..20: mol_type = other DNA
agggagggagtgagtgatga

SEQ ID NO: 44964 - DNA, 20 bp, synthetic construct
  misc_feature 1..20: note = CRISPR gRNA sequence
  source 1..20: mol_type = other DNA
gagggagtgagtgatgatgg

SEQ ID NO: 44965 - DNA, 20 bp, synthetic construct
  misc_feature 1..20: note = CRISPR gRNA sequence
  source 1..20: mol_type = other DNA
tgagtgatgatggtggttaa

SEQ ID NO: 44966 - DNA, 20 bp, synthetic construct
  misc_feature 1..20: note = CRISPR gRNA sequence
  source 1..20: mol_type = other DNA
gagtgatgatggtggttaat

SEQ ID NO: 44967 - DNA, 20 bp, synthetic construct
  misc_feature 1..20: note = CRISPR gRNA sequence
  source 1..20: mol_type = other DNA
agtgatgatggtggttaatg

SEQ ID NO: 44968 - DNA, 20 bp, synthetic construct
  misc_feature 1..20: note = CRISPR gRNA sequence
  source 1..20: mol_type = other DNA
gatgatggtggttaatgggg

SEQ ID NO: 44969 - DNA, 20 bp, synthetic construct
  misc_feature 1..20: note = CRISPR gRNA sequence
  source 1..20: mol_type = other DNA
atgatggtggttaatgggga

SEQ ID NO: 44970 - DNA, 20 bp, synthetic construct
  misc_feature 1..20: note = CRISPR gRNA sequence
  source 1..20: mol_type = other DNA
tgatggtggttaatggggaa

SEQ ID NO: 44971 - DNA, 20 bp, synthetic construct
  misc_feature 1..20: note = CRISPR gRNA sequence
  source 1..20: mol_type = other DNA
ggttaatggggaagggttgt

SEQ ID NO: 44972 - DNA, 20 bp, synthetic construct
  misc_feature 1..20: note = CRISPR gRNA sequence
  source 1..20: mol_type = other DNA
aatggggaagggttgtgagt

SEQ ID NO: 44973 - DNA, 20 bp, synthetic construct
  misc_feature 1..20: note = CRISPR gRNA sequence
  source 1..20: mol_type = other DNA
gaagggttgtgagtgagttg

SEQ ID NO: 44974 - DNA, 20 bp, synthetic construct
  misc_feature 1..20: note = CRISPR gRNA sequence
  source 1..20: mol_type = other DNA
aagggttgtgagtgagttgt

SEQ ID NO: 44975 - DNA, 20 bp, synthetic construct
  misc_feature 1..20: note = CRISPR gRNA sequence
  source 1..20: mol_type = other DNA
agggttgtgagtgagttgtg

SEQ ID NO: 44976 - DNA, 20 bp, synthetic construct
  misc_feature 1..20: note = CRISPR gRNA sequence
  source 1..20: mol_type = other DNA
ttgtgagtgagttgtggggt

SEQ ID NO: 44977 - DNA, 20 bp, synthetic construct
  misc_feature 1..20: note = CRISPR gRNA sequence
  source 1..20: mol_type = other DNA
tgagttgtggggttggttaa

SEQ ID NO: 44978 - DNA, 20 bp, synthetic construct
  misc_feature 1..20: note = CRISPR gRNA sequence
  source 1..20: mol_type = other DNA
gagttgtggggttggttaat

SEQ ID NO: 44979 - DNA, 20 bp, synthetic construct
  misc_feature 1..20: note = CRISPR gRNA sequence
  source 1..20: mol_type = other DNA
agttgtggggttggttaatg

SEQ ID NO: 44980 - DNA, 20 bp, synthetic construct
  misc_feature 1..20: note = CRISPR gRNA sequence
  source 1..20: mol_type = other DNA
tgtggggttggttaatgggg

SEQ ID NO: 44981 - DNA, 20 bp, synthetic construct
  misc_feature 1..20: note = CRISPR gRNA sequence
  source 1..20: mol_type = other DNA
ggttaatggggaagcgttgt

SEQ ID NO: 44982 - DNA, 20 bp, synthetic construct
  misc_feature 1..20: note = CRISPR gRNA sequence
  source 1..20: mol_type = other DNA
aatggggaagcgttgtgagt

SEQ ID NO: 44983 - DNA, 20 bp, synthetic construct
  misc_feature 1..20: note = CRISPR gRNA sequence
  source 1..20: mol_type = other DNA
ggggaagcgttgtgagtgag

SEQ ID NO: 44984 - DNA, 20 bp, synthetic construct
  misc_feature 1..20: note = CRISPR gRNA sequence
  source 1..20: mol_type = other DNA
gcgttgtgagtgagtggtga

SEQ ID NO: 44985 - DNA, 20 bp, synthetic construct
  misc_feature 1..20: note = CRISPR gRNA sequence
  source 1..20: mol_type = other DNA
tgtgagtgagtggtgatggt

SEQ ID NO: 44986 - DNA, 20 bp, synthetic construct
  misc_feature 1..20: note = CRISPR gRNA sequence
  source 1..20: mol_type = other DNA
gagtggtgatggttggttaa

SEQ ID NO: 44987 - DNA, 20 bp, synthetic construct
  misc_feature 1..20: note = CRISPR gRNA sequence
  source 1..20: mol_type = other DNA
agtggtgatggttggttaat

SEQ ID NO: 44988 - DNA, 20 bp, synthetic construct
  misc_feature 1..20: note = CRISPR gRNA sequence
  source 1..20: mol_type = other DNA
gtggtgatggttggttaatg

SEQ ID NO: 44989 - DNA, 20 bp, synthetic construct
  misc_feature 1..20: note = CRISPR gRNA sequence
  source 1..20: mol_type = other DNA
gtgatggttggttaatgggg

SEQ ID NO: 44990 - DNA, 20 bp, synthetic construct
  misc_feature 1..20: note = CRISPR gRNA sequence
  source 1..20: mol_type = other DNA
tgatggttggttaatgggga

SEQ ID NO: 44991 - DNA, 20 bp, synthetic construct
  misc_feature 1..20: note = CRISPR gRNA sequence
  source 1..20: mol_type = other DNA
gatggttggttaatggggaa

SEQ ID NO: 44992 - DNA, 20 bp, synthetic construct
  misc_feature 1..20: note = CRISPR gRNA sequence
  source 1..20: mol_type = other DNA
ggttaatggggaagggttgt

SEQ ID NO: 44993 - DNA, 20 bp, synthetic construct
  misc_feature 1..20: note = CRISPR gRNA sequence
  source 1..20: mol_type = other DNA
aatggggaagggttgtgagt

SEQ ID NO: 44994 - DNA, 20 bp, synthetic construct
  misc_feature 1..20: note = CRISPR gRNA sequence
  source 1..20: mol_type = other DNA
ggggaagggttgtgagtgag

SEQ ID NO: 44995 - DNA, 20 bp, synthetic construct
  misc_feature 1..20: note = CRISPR gRNA sequence
  source 1..20: mol_type = other DNA
gggttgtgagtgagtggtga

SEQ ID NO: 44996 - DNA, 20 bp, synthetic construct
  misc_feature 1..20: note = CRISPR gRNA sequence
  source 1..20: mol_type = other DNA
ttgtgagtgagtggtgatgg

SEQ ID NO: 44997 - DNA, 20 bp, synthetic construct
  misc_feature 1..20: note = CRISPR gRNA sequence
  source 1..20: mol_type = other DNA
tgagtggtgatggtggttaa

SEQ ID NO: 44998 - DNA, 20 bp, synthetic construct
  misc_feature 1..20: note = CRISPR gRNA sequence
  source 1..20: mol_type = other DNA
gagtggtgatggtggttaat

SEQ ID NO: 44999 - DNA, 20 bp, synthetic construct
  misc_feature 1..20: note = CRISPR gRNA sequence
  source 1..20: mol_type = other DNA
agtggtgatggtggttaatg

SEQ ID NO: 45000 - DNA, 20 bp, synthetic construct
  misc_feature 1..20: note = CRISPR gRNA sequence
  source 1..20: mol_type = other DNA
ggtgatggtggttaatgggg

SEQ ID NO: 45001 - DNA, 20 bp, synthetic construct
  misc_feature 1..20: note = CRISPR gRNA sequence
  source 1..20: mol_type = other DNA
gtgatggtggttaatgggga

SEQ ID NO: 45002 - DNA, 20 bp, synthetic construct
  misc_feature 1..20: note = CRISPR gRNA sequence
  source 1..20: mol_type = other DNA
tgatggtggttaatggggaa

SEQ ID NO: 45003 - DNA, 20 bp, synthetic construct
  misc_feature 1..20: note = CRISPR gRNA sequence
  source 1..20: mol_type = other DNA
gatggtggttaatggggaag

SEQ ID NO: 45004 - DNA, 20 bp, synthetic construct
  misc_feature 1..20: note = CRISPR gRNA sequence
  source 1..20: mol_type = other DNA
atggtggttaatggggaagg

SEQ ID NO: 45005 - DNA, 20 bp, synthetic construct
  misc_feature 1..20: note = CRISPR gRNA sequence
  source 1..20: mol_type = other DNA
tggttaatggggaagggggt

SEQ ID NO: 45006 - DNA, 20 bp, synthetic construct
  misc_feature 1..20: note = CRISPR gRNA sequence
  source 1..20: mol_type = other DNA
taatggggaagggggtgagt

SEQ ID NO: 45007 - DNA, 20 bp, synthetic construct
  misc_feature 1..20: note = CRISPR gRNA sequence
  source 1..20: mol_type = other DNA
tggggaagggggtgagtgag

SEQ ID NO: 45008 - DNA, 20 bp, synthetic construct
  misc_feature 1..20: note = CRISPR gRNA sequence
  source 1..20: mol_type = other DNA
agggggtgagtgagtggtgt

SEQ ID NO: 45009 - DNA, 20 bp, synthetic construct
  misc_feature 1..20: note = CRISPR gRNA sequence
  source 1..20: mol_type = other DNA
gggtgagtgagtggtgttgg

SEQ ID NO: 45010 - DNA, 20 bp, synthetic construct
  misc_feature 1..20: note = CRISPR gRNA sequence
  source 1..20: mol_type = other DNA
tgagtggtgttggtggttaa

SEQ ID NO: 45011 - DNA, 20 bp, synthetic construct
  misc_feature 1..20: note = CRISPR gRNA sequence
  source 1..20: mol_type = other DNA
gagtggtgttggtggttaat

SEQ ID NO: 45012 - DNA, 20 bp, synthetic construct
  misc_feature 1..20: note = CRISPR gRNA sequence
  source 1..20: mol_type = other DNA
agtggtgttggtggttaatg

SEQ ID NO: 45013 - DNA, 20 bp, synthetic construct
  misc_feature 1..20: note = CRISPR gRNA sequence
  source 1..20: mol_type = other DNA
ggtgttggtggttaatgggg

SEQ ID NO: 45014 - DNA, 20 bp, synthetic construct
  misc_feature 1..20: note = CRISPR gRNA sequence
  source 1..20: mol_type = other DNA
ggttaatggggaagtgttgt

SEQ ID NO: 45015 - DNA, 20 bp, synthetic construct
  misc_feature 1..20: note = CRISPR gRNA sequence
  source 1..20: mol_type = other DNA
aatggggaagtgttgtgagt

SEQ ID NO: 45016 - DNA, 20 bp, synthetic construct
  misc_feature 1..20: note = CRISPR gRNA sequence
  source 1..20: mol_type = other DNA
ggggaagtgttgtgagtgag

SEQ ID NO: 45017 - DNA, 20 bp, synthetic construct
  misc_feature 1..20: note = CRISPR gRNA sequence
  source 1..20: mol_type = other DNA
gtgttgtgagtgagtggtga

SEQ ID NO: 45018 - DNA, 20 bp, synthetic construct
  misc_feature 1..20: note = CRISPR gRNA sequence
  source 1..20: mol_type = other DNA
ttgtgagtgagtggtgatgg

SEQ ID NO: 45019 - DNA, 20 bp, synthetic construct
  misc_feature 1..20: note = CRISPR gRNA sequence
  source 1..20: mol_type = other DNA
tgagtggtgatggtggttaa

SEQ ID NO: 45020 - DNA, 20 bp, synthetic construct
  misc_feature 1..20: note = CRISPR gRNA sequence
  source 1..20: mol_type = other DNA
gagtggtgatggtggttaat

SEQ ID NO: 45021 - DNA, 20 bp, synthetic construct
  misc_feature 1..20: note = CRISPR gRNA sequence
  source 1..20: mol_type = other DNA
agtggtgatggtggttaatg

SEQ ID NO: 45022 - DNA, 20 bp, synthetic construct
  misc_feature 1..20: note = CRISPR gRNA sequence
  source 1..20: mol_type = other DNA
ggtgatggtggttaatgggg

SEQ ID NO: 45023 - DNA, 20 bp, synthetic construct
  misc_feature 1..20: note = CRISPR gRNA sequence
  source 1..20: mol_type = other DNA
gtgatggtggttaatgggga

SEQ ID NO: 45024 - DNA, 20 bp, synthetic construct
  misc_feature 1..20: note = CRISPR gRNA sequence
  source 1..20: mol_type = other DNA
tgatggtggttaatggggaa

SEQ ID NO: 45025 - DNA, 20 bp, synthetic construct
  misc_feature 1..20: note = CRISPR gRNA sequence
  source 1..20: mol_type = other DNA
ggttaatggggaagggttgt

SEQ ID NO: 45026 - DNA, 20 bp, synthetic construct
  misc_feature 1..20: note = CRISPR gRNA sequence
  source 1..20: mol_type = other DNA
aatggggaagggttgtgagt

SEQ ID NO: 45027 - DNA, 20 bp, synthetic construct
  misc_feature 1..20: note = CRISPR gRNA sequence
  source 1..20: mol_type = other DNA
ggggaagggttgtgagtgag

SEQ ID NO: 45028 - DNA, 20 bp, synthetic construct
  misc_feature 1..20: note = CRISPR gRNA sequence
  source 1..20: mol_type = other DNA
gggttgtgagtgagtggtgt

SEQ ID NO: 45029 - DNA, 20 bp, synthetic construct
  misc_feature 1..20: note = CRISPR gRNA sequence
  source 1..20: mol_type = other DNA
ttgtgagtgagtggtgttgg

SEQ ID NO: 45030 - DNA, 20 bp, synthetic construct
  misc_feature 1..20: note = CRISPR gRNA sequence
  source 1..20: mol_type = other DNA
tgagtggtgttggtggttaa

SEQ ID NO: 45031 - DNA, 20 bp, synthetic construct
  misc_feature 1..20: note = CRISPR gRNA sequence
  source 1..20: mol_type = other DNA
gagtggtgttggtggttaat

SEQ ID NO: 45032 - DNA, 20 bp, synthetic construct
  misc_feature 1..20: note = CRISPR gRNA sequence
  source 1..20: mol_type = other DNA
agtggtgttggtggttaatg

SEQ ID NO: 45033 - DNA, 20 bp, synthetic construct
  misc_feature 1..20: note = CRISPR gRNA sequence
  source 1..20: mol_type = other DNA
ggtgttggtggttaatgggg

SEQ ID NO: 45034 - DNA, 20 bp, synthetic construct
  misc_feature 1..20: note = CRISPR gRNA sequence
  source 1..20: mol_type = other DNA
gtgttggtggttaatgggga

SEQ ID NO: 45035 - DNA, 20 bp, synthetic construct
  misc_feature 1..20: note = CRISPR gRNA sequence
  source 1..20: mol_type = other DNA
tgttggtggttaatggggaa

SEQ ID NO: 45036 - DNA, 20 bp, synthetic construct
  misc_feature 1..20: note = CRISPR gRNA sequence
  source 1..20: mol_type = other DNA
gttggtggttaatggggaag

SEQ ID NO: 45037 - DNA, 20 bp, synthetic construct
  misc_feature 1..20: note = CRISPR gRNA sequence
  source 1..20: mol_type = other DNA
ttggtggttaatggggaagg

SEQ ID NO: 45038 - DNA, 20 bp, synthetic construct
  misc_feature 1..20: note = CRISPR gRNA sequence
  source 1..20: mol_type = other DNA
tggttaatggggaagggggt

SEQ ID NO: 45039 - DNA, 20 bp, synthetic construct
  misc_feature 1..20: note = CRISPR gRNA sequence
  source 1..20: mol_type = other DNA
taatggggaagggggtgagt

SEQ ID NO: 45040 - DNA, 20 bp, synthetic construct
  misc_feature 1..20: note = CRISPR gRNA sequence
  source 1..20: mol_type = other DNA
agggggtgagtgagcgatga

SEQ ID NO: 45041 - DNA, 20 bp, synthetic construct
  misc_feature 1..20: note = CRISPR gRNA sequence
  source 1..20: mol_type = other DNA
gggtgagtgagcgatgatgg

SEQ ID NO: 45042 - DNA, 20 bp, synthetic construct
  misc_feature 1..20: note = CRISPR gRNA sequence
  source 1..20: mol_type = other DNA
tgagcgatgatggtggttaa

SEQ ID NO: 45043 - DNA, 20 bp, synthetic construct
  misc_feature 1..20: note = CRISPR gRNA sequence
  source 1..20: mol_type = other DNA
gagcgatgatggtggttaat

SEQ ID NO: 45044 - DNA, 20 bp, synthetic construct
  misc_feature 1..20: note = CRISPR gRNA sequence
  source 1..20: mol_type = other DNA
agcgatgatggtggttaatg

SEQ ID NO: 45045 - DNA, 20 bp, synthetic construct
  misc_feature 1..20: note = CRISPR gRNA sequence
  source 1..20: mol_type = other DNA
gatgatggtggttaatgggg

SEQ ID NO: 45046 - DNA, 20 bp, synthetic construct
  misc_feature 1..20: note = CRISPR gRNA sequence
  source 1..20: mol_type = other DNA
atgatggtggttaatgggga

SEQ ID NO: 45047 - DNA, 20 bp, synthetic construct
  misc_feature 1..20: note = CRISPR gRNA sequence
  source 1..20: mol_type = other DNA
tgatggtggttaatggggaa

SEQ ID NO: 45048 - DNA, 20 bp, synthetic construct
  misc_feature 1..20: note = CRISPR gRNA sequence
  source 1..20: mol_type = other DNA
ggttaatggggaagggttgt

SEQ ID NO: 45049 - DNA, 20 bp, synthetic construct
  misc_feature 1..20: note = CRISPR gRNA sequence
  source 1..20: mol_type = other DNA
aatggggaagggttgtgagt

SEQ ID NO: 45050 - DNA, 20 bp, synthetic construct
  misc_feature 1..20: note = CRISPR gRNA sequence
  source 1..20: mol_type = other DNA
ggggaagggttgtgagtgag

SEQ ID NO: 45051 - DNA, 20 bp, synthetic construct
  misc_feature 1..20: note = CRISPR gRNA sequence
  source 1..20: mol_type = other DNA
gaagggttgtgagtgagtgg

SEQ ID NO: 45052 - DNA, 20 bp, synthetic construct
  misc_feature 1..20: note = CRISPR gRNA sequence
  source 1..20: mol_type = other DNA
aagggttgtgagtgagtggt

SEQ ID NO: 45053 - DNA, 20 bp, synthetic construct
  misc_feature 1..20: note = CRISPR gRNA sequence
  source 1..20: mol_type = other DNA
agggttgtgagtgagtggtg

SEQ ID NO: 45054 - DNA, 20 bp, synthetic construct
  misc_feature 1..20: note = CRISPR gRNA sequence
  source 1..20: mol_type = other DNA
ttgtgagtgagtggtggggt

SEQ ID NO: 45055 - DNA, 20 bp, synthetic construct
  misc_feature 1..20: note = CRISPR gRNA sequence
  source 1..20: mol_type = other DNA
tgagtggtggggttggttaa

SEQ ID NO: 45056 - DNA, 20 bp, synthetic construct
  misc_feature 1..20: note = CRISPR gRNA sequence
  source 1..20: mol_type = other DNA
gagtggtggggttggttaac

SEQ ID NO: 45057 - DNA, 20 bp, synthetic construct
  misc_feature 1..20: note = CRISPR gRNA sequence
  source 1..20: mol_type = other DNA
agtggtggggttggttaacg

SEQ ID NO: 45058 - DNA, 20 bp, synthetic construct
  misc_feature 1..20: note = CRISPR gRNA sequence
  source 1..20: mol_type = other DNA
ggtggggttggttaacgggg

SEQ ID NO: 45059 - DNA, 20 bp, synthetic construct
  misc_feature 1..20: note = CRISPR gRNA sequence
  source 1..20: mol_type = other DNA
gtggggttggttaacgggga

SEQ ID NO: 45060 - DNA, 20 bp, synthetic construct
  misc_feature 1..20: note = CRISPR gRNA sequence
  source 1..20: mol_type = other DNA
tggggttggttaacggggaa

SEQ ID NO: 45061 - DNA, 20 bp, synthetic construct
  misc_feature 1..20: note = CRISPR gRNA sequence
  source 1..20: mol_type = other DNA
ggggttggttaacggggaag

SEQ ID NO: 45062 - DNA, 20 bp, synthetic construct
  misc_feature 1..20: note = CRISPR gRNA sequence
  source 1..20: mol_type = other DNA
gggttggttaacggggaagg

SEQ ID NO: 45063 - DNA, 20 bp, synthetic construct
  misc_feature 1..20: note = CRISPR gRNA sequence
  source 1..20: mol_type = other DNA
tggttaacggggaagggggt

SEQ ID NO: 45064 - DNA, 20 bp, synthetic construct
  misc_feature 1..20: note = CRISPR gRNA sequence
  source 1..20: mol_type = other DNA
taacggggaagggggtgagt

SEQ ID NO: 45065 - DNA, 20 bp, synthetic construct
  misc_feature 1..20: note = CRISPR gRNA sequence
  source 1..20: mol_type = other DNA
cggggaagggggtgagtgag

SEQ ID NO: 45066 - DNA, 20 bp, synthetic construct
  misc_feature 1..20: note = CRISPR gRNA sequence
  source 1..20: mol_type = other DNA
ggaagggggtgagtgagtgg

SEQ ID NO: 45067 - DNA, 20 bp, synthetic construct
  misc_feature 1..20: note = CRISPR gRNA sequence
  source 1..20: mol_type = other DNA
agggggtgagtgagtggtgg

SEQ ID NO: 45068 - DNA, 20 bp, synthetic construct
  misc_feature 1..20: note = CRISPR gRNA sequence
  source 1..20: mol_type = other DNA
gggtgagtgagtggtggtgg

SEQ ID NO: 45069 - DNA, 20 bp, synthetic construct
  misc_feature 1..20: note = CRISPR gRNA sequence
  source 1..20: mol_type = other DNA
tgagtggtggtggtggttaa

SEQ ID NO: 45070 - DNA, 20 bp, synthetic construct
  misc_feature 1..20: note = CRISPR gRNA sequence
  source 1..20: mol_type = other DNA
gagtggtggtggtggttaat

SEQ ID NO: 45071 - DNA, 20 bp, synthetic construct
  misc_feature 1..20: note = CRISPR gRNA sequence
  source 1..20: mol_type = other DNA
agtggtggtggtggttaatg

SEQ ID NO: 45072 - DNA, 20 bp, synthetic construct
  misc_feature 1..20: note = CRISPR gRNA sequence
  source 1..20: mol_type = other DNA
ggtggtggtggttaatgggg

SEQ ID NO: 45073 - DNA, 20 bp, synthetic construct
  misc_feature 1..20: note = CRISPR gRNA sequence
  source 1..20: mol_type = other DNA
gtggtggtggttaatgggga

SEQ ID NO: 45074 - DNA, 20 bp, synthetic construct
  misc_feature 1..20: note = CRISPR gRNA sequence
  source 1..20: mol_type = other DNA
tggtggtggttaatggggaa

SEQ ID NO: 45075 - DNA, 20 bp, synthetic construct
  misc_feature 1..20: note = CRISPR gRNA sequence
  source 1..20: mol_type = other DNA
ggtggtggttaatggggaag

SEQ ID NO: 45076 - DNA, 20 bp, synthetic construct
  misc_feature 1..20: note = CRISPR gRNA sequence
  source 1..20: mol_type = other DNA
gtggtggttaatggggaagg

SEQ ID NO: 45077 - DNA, 20 bp, synthetic construct
  misc_feature 1..20: note = CRISPR gRNA sequence
  source 1..20: mol_type = other DNA
tggttaatggggaagggggt

SEQ ID NO: 45078 - DNA, 20 bp, synthetic construct
  misc_feature 1..20: note = CRISPR gRNA sequence
  source 1..20: mol_type = other DNA
taatggggaagggggtgagt

SEQ ID NO: 45079 - DNA, 20 bp, synthetic construct
  misc_feature 1..20: note = CRISPR gRNA sequence
  source 1..20: mol_type = other DNA
tggggaagggggtgagtgag

SEQ ID NO: 45080 - DNA, 20 bp, synthetic construct
  misc_feature 1..20: note = CRISPR gRNA sequence
  source 1..20: mol_type = other DNA
agggggtgagtgagtggtgt

SEQ ID NO: 45081 - DNA, 20 bp, synthetic construct
  misc_feature 1..20: note = CRISPR gRNA sequence
  source 1..20: mol_type = other DNA
gggtgagtgagtggtgttgg

SEQ ID NO: 45082 - DNA, 20 bp, synthetic construct
  misc_feature 1..20: note = CRISPR gRNA sequence
  source 1..20: mol_type = other DNA
tgagtggtgttggtggttaa

SEQ ID NO: 45083 - DNA, 20 bp, synthetic construct
  misc_feature 1..20: note = CRISPR gRNA sequence
  source 1..20: mol_type = other DNA
gagtggtgttggtggttaat

SEQ ID NO: 45084 - DNA, 20 bp, synthetic construct
  misc_feature 1..20: note = CRISPR gRNA sequence
  source 1..20: mol_type = other DNA
agtggtgttggtggttaatg

SEQ ID NO: 45085 - DNA, 20 bp, synthetic construct
  misc_feature 1..20: note = CRISPR gRNA sequence
  source 1..20: mol_type = other DNA
ggtgttggtggttaatgggg

SEQ ID NO: 45086 - DNA, 20 bp, synthetic construct
  misc_feature 1..20: note = CRISPR gRNA sequence
  source 1..20: mol_type = other DNA
gtgttggtggttaatgggga

SEQ ID NO: 45087 - DNA, 20 bp, synthetic construct
  misc_feature 1..20: note = CRISPR gRNA sequence
  source 1..20: mol_type = other DNA
tgttggtggttaatggggaa

SEQ ID NO: 45088 - DNA, 20 bp, synthetic construct
  misc_feature 1..20: note = CRISPR gRNA sequence
  source 1..20: mol_type = other DNA
gttggtggttaatggggaag

SEQ ID NO: 45089 - DNA, 20 bp, synthetic construct
  misc_feature 1..20: note = CRISPR gRNA sequence
  source 1..20: mol_type = other DNA
ttggtggttaatggggaagg

SEQ ID NO: 45090 - DNA, 20 bp, synthetic construct
  misc_feature 1..20: note = CRISPR gRNA sequence
  source 1..20: mol_type = other DNA
gtggttaatggggaaggggg

SEQ ID NO: 45091 - DNA, 20 bp, synthetic construct
  misc_feature 1..20: note = CRISPR gRNA sequence
  source 1..20: mol_type = other DNA
tggttaatggggaagggggt

SEQ ID NO: 45092 - DNA, 20 bp, synthetic construct
  misc_feature 1..20: note = CRISPR gRNA sequence
  source 1..20: mol_type = other DNA
taatggggaagggggtgggt

SEQ ID NO: 45093 - DNA, 20 bp, synthetic construct
  misc_feature 1..20: note = CRISPR gRNA sequence
  source 1..20: mol_type = other DNA
tggggaagggggtgggtgag

SEQ ID NO: 45094 - DNA, 20 bp, synthetic construct
  misc_feature 1..20: note = CRISPR gRNA sequence
  source 1..20: mol_type = other DNA
agggggtgggtgagtggtga

SEQ ID NO: 45095 - DNA, 20 bp, synthetic construct
  misc_feature 1..20: note = CRISPR gRNA sequence
  source 1..20: mol_type = other DNA
gggtgggtgagtggtgatgg

SEQ ID NO: 45096 - DNA, 20 bp, synthetic construct
  misc_feature 1..20: note = CRISPR gRNA sequence
  source 1..20: mol_type = other DNA
tgagtggtgatggtggttaa

SEQ ID NO: 45097 - DNA, 20 bp, synthetic construct
  misc_feature 1..20: note = CRISPR gRNA sequence
  source 1..20: mol_type = other DNA
gagtggtgatggtggttaat

SEQ ID NO: 45098 - DNA, 20 bp, synthetic construct
  misc_feature 1..20: note = CRISPR gRNA sequence
  source 1..20: mol_type = other DNA
tggtgatggtggttaatggg

SEQ ID NO: 45099 - DNA, 20 bp, synthetic construct
  misc_feature 1..20: note = CRISPR gRNA sequence
  source 1..20: mol_type = other DNA
ggtgatggtggttaatggga

SEQ ID NO: 45100 - DNA, 20 bp, synthetic construct
  misc_feature 1..20: note = CRISPR gRNA sequence
  source 1..20: mol_type = other DNA
gtgatggtggttaatgggaa

SEQ ID NO: 45101 - DNA, 20 bp, synthetic construct
  misc_feature 1..20: note = CRISPR gRNA sequence
  source 1..20: mol_type = other DNA
gatggtggttaatgggaagg

SEQ ID NO: 45102 - DNA, 20 bp, synthetic construct
  misc_feature 1..20: note = CRISPR gRNA sequence
  source 1..20: mol_type = other DNA
gtggttaatgggaagggagt

SEQ ID NO: 45103 - DNA, 20 bp, synthetic construct
  misc_feature 1..20: note = CRISPR gRNA sequence
  source 1..20: mol_type = other DNA
gttaatgggaagggagtgag

SEQ ID NO: 45104 - DNA, 20 bp, synthetic construct
  misc_feature 1..20: note = CRISPR gRNA sequence
  source 1..20: mol_type = other DNA
gggaagggagtgagtggtga

SEQ ID NO: 45105 - DNA, 20 bp, synthetic construct
  misc_feature 1..20: note = CRISPR gRNA sequence
  source 1..20: mol_type = other DNA
aagggagtgagtggtgatgg

SEQ ID NO: 45106 - DNA, 20 bp, synthetic construct
  misc_feature 1..20: note = CRISPR gRNA sequence
  source 1..20: mol_type = other DNA
tgagtggtgatggtggttaa

SEQ ID NO: 45107 - DNA, 20 bp, synthetic construct
  misc_feature 1..20: note = CRISPR gRNA sequence
  source 1..20: mol_type = other DNA
gagtggtgatggtggttaat

SEQ ID NO: 45108 - DNA, 20 bp, synthetic construct
  misc_feature 1..20: note = CRISPR gRNA sequence
  source 1..20: mol_type = other DNA
agtggtgatggtggttaatg

SEQ ID NO: 45109 - DNA, 20 bp, synthetic construct
  misc_feature 1..20: note = CRISPR gRNA sequence
  source 1..20: mol_type = other DNA
ggtgatggtggttaatgggg

SEQ ID NO: 45110 - DNA, 20 bp, synthetic construct
  misc_feature 1..20: note = CRISPR gRNA sequence
  source 1..20: mol_type = other DNA
gtgatggtggttaatgggga

SEQ ID NO: 45111 - DNA, 20 bp, synthetic construct
  misc_feature 1..20: note = CRISPR gRNA sequence
  source 1..20: mol_type = other DNA
tgatggtggttaatggggaa

SEQ ID NO: 45112 - DNA, 20 bp, synthetic construct
  misc_feature 1..20: note = CRISPR gRNA sequence
  source 1..20: mol_type = other DNA
ggttaatggggaagggttgt

SEQ ID NO: 45113 - DNA, 20 bp, synthetic construct
  misc_feature 1..20: note = CRISPR gRNA sequence
  source 1..20: mol_type = other DNA
aatggggaagggttgtgagt

SEQ ID NO: 45114 - DNA, 20 bp, synthetic construct
  misc_feature 1..20: note = CRISPR gRNA sequence
  source 1..20: mol_type = other DNA
ggggaagggttgtgagtgag

SEQ ID NO: 45115 - DNA, 20 bp, synthetic construct
  misc_feature 1..20: note = CRISPR gRNA sequence
  source 1..20: mol_type = other DNA
gggttgtgagtgagtggtga

SEQ ID NO: 45116 - DNA, 20 bp, synthetic construct
  misc_feature 1..20: note = CRISPR gRNA sequence
  source 1..20: mol_type = other DNA
ttgtgagtgagtggtgatgg

SEQ ID NO: 45117 - DNA, 20 bp, synthetic construct
  misc_feature 1..20: note = CRISPR gRNA sequence
  source 1..20: mol_type = other DNA
tgagtggtgatggtggttaa

SEQ ID NO: 45118 - DNA, 20 bp, synthetic construct
  misc_feature 1..20: note = CRISPR gRNA sequence
  source 1..20: mol_type = other DNA
gagtggtgatggtggttaat

SEQ ID NO: 45119 - DNA, 20 bp, synthetic construct
  misc_feature 1..20: note = CRISPR gRNA sequence
  source 1..20: mol_type = other DNA
agtggtgatggtggttaatg

SEQ ID NO: 45120 - DNA, 20 bp, synthetic construct
  misc_feature 1..20: note = CRISPR gRNA sequence
  source 1..20: mol_type = other DNA
ggtgatggtggttaatgggg

SEQ ID NO: 45121 - DNA, 20 bp, synthetic construct
  misc_feature 1..20: note = CRISPR gRNA sequence
  source 1..20: mol_type = other DNA
gtgatggtggttaatgggga

SEQ ID NO: 45122 - DNA, 20 bp, synthetic construct
  misc_feature 1..20: note = CRISPR gRNA sequence
  source 1..20: mol_type = other DNA
tgatggtggttaatggggaa

SEQ ID NO: 45123 - DNA, 20 bp, synthetic construct
  misc_feature 1..20: note = CRISPR gRNA sequence
  source 1..20: mol_type = other DNA
gatggtggttaatggggaag

SEQ ID NO: 45124 - DNA, 20 bp, synthetic construct
  misc_feature 1..20: note = CRISPR gRNA sequence
  source 1..20: mol_type = other DNA
atggtggttaatggggaagg

SEQ ID NO: 45125 - DNA, 20 bp, synthetic construct
  misc_feature 1..20: note = CRISPR gRNA sequence
  source 1..20: mol_type = other DNA
tggttaatggggaagggggt

SEQ ID NO: 45126 - DNA, 20 bp, synthetic construct
  misc_feature 1..20: note = CRISPR gRNA sequence
  source 1..20: mol_type = other DNA
taatggggaagggggtgagt

SEQ ID NO: 45127 - DNA, 20 bp, synthetic construct
  misc_feature 1..20: note = CRISPR gRNA sequence
  source 1..20: mol_type = other DNA
aatggggaagggggtgagta

SEQ ID NO: 45128 - DNA, 20 bp, synthetic construct
  misc_feature 1..20: note = CRISPR gRNA sequence
  source 1..20: mol_type = other DNA
atggggaagggggtgagtaa

SEQ ID NO: 45129 - DNA, 20 bp, synthetic construct
  misc_feature 1..20: note = CRISPR gRNA sequence
  source 1..20: mol_type = other DNA
tggggaagggggtgagtaag

SEQ ID NO: 45130 - DNA, 20 bp, synthetic construct
  misc_feature 1..20: note = CRISPR gRNA sequence
  source 1..20: mol_type = other DNA
ggaagggggtgagtaagggg

SEQ ID NO: 45131 - DNA, 20 bp, synthetic construct
  misc_feature 1..20: note = CRISPR gRNA sequence
  source 1..20: mol_type = other DNA
gaagggggtgagtaaggggt

SEQ ID NO: 45132 - DNA, 20 bp, synthetic construct
  misc_feature 1..20: note = CRISPR gRNA sequence
  source 1..20: mol_type = other DNA
aagggggtgagtaaggggtg

SEQ ID NO: 45133 - DNA, 20 bp, synthetic construct
  misc_feature 1..20: note = CRISPR gRNA sequence
  source 1..20: mol_type = other DNA
agggggtgagtaaggggtgg

SEQ ID NO: 45134 - DNA, 20 bp, synthetic construct
  misc_feature 1..20: note = CRISPR gRNA sequence
  source 1..20: mol_type = other DNA
gggtgagtaaggggtggggg

SEQ ID NO: 45135 - DNA, 20 bp, synthetic construct
  misc_feature 1..20: note = CRISPR gRNA sequence
  source 1..20: mol_type = other DNA
taaggggtgggggtggttaa

SEQ ID NO: 45136 - DNA, 20 bp, synthetic construct
  misc_feature 1..20: note = CRISPR gRNA sequence
  source 1..20: mol_type = other DNA
aaggggtgggggtggttaat

SEQ ID NO: 45137 - DNA, 20 bp, synthetic construct
  misc_feature 1..20: note = CRISPR gRNA sequence
  source 1..20: mol_type = other DNA
aggggtgggggtggttaata

SEQ ID NO: 45138 - DNA, 20 bp, synthetic construct
  misc_feature 1..20: note = CRISPR gRNA sequence
  source 1..20: mol_type = other DNA
ggtgggggtggttaataggg

SEQ ID NO: 45139 - DNA, 20 bp, synthetic construct
  misc_feature 1..20: note = CRISPR gRNA sequence
  source 1..20: mol_type = other DNA
tgggggtggttaatagggaa

SEQ ID NO: 45140 - DNA, 20 bp, synthetic construct
  misc_feature 1..20: note = CRISPR gRNA sequence
  source 1..20: mol_type = other DNA
ggttaatagggaagagttgt

SEQ ID NO: 45141 - DNA, 20 bp, synthetic construct
  misc_feature 1..20: note = CRISPR gRNA sequence
  source 1..20: mol_type = other DNA
aatagggaagagttgtgagt

SEQ ID NO: 45142 - DNA, 20 bp, synthetic construct
  misc_feature 1..20: note = CRISPR gRNA sequence
  source 1..20: mol_type = other DNA
agggaagagttgtgagtgag

SEQ ID NO: 45143 - DNA, 20 bp, synthetic construct
  misc_feature 1..20: note = CRISPR gRNA sequence
  source 1..20: mol_type = other DNA
gaagagttgtgagtgagtgg

SEQ ID NO: 45144 - DNA, 20 bp, synthetic construct
  misc_feature 1..20: note = CRISPR gRNA sequence
  source 1..20: mol_type = other DNA
aagagttgtgagtgagtggt

SEQ ID NO: 45145 - DNA, 20 bp, synthetic construct
  misc_feature 1..20: note = CRISPR gRNA sequence
  source 1..20: mol_type = other DNA
agagttgtgagtgagtggtg

SEQ ID NO: 45146 - DNA, 20 bp, synthetic construct
  misc_feature 1..20: note = CRISPR gRNA sequence
  source 1..20: mol_type = other DNA
ttgtgagtgagtggtggggt

SEQ ID NO: 45147 - DNA, 20 bp, synthetic construct
  misc_feature 1..20: note = CRISPR gRNA sequence
  source 1..20: mol_type = other DNA
tgagtggtggggttggttaa

SEQ ID NO: 45148 - DNA, 20 bp, synthetic construct
  misc_feature 1..20: note = CRISPR gRNA sequence
  source 1..20: mol_type = other DNA
gagtggtggggttggttaat

SEQ ID NO: 45149 - DNA, 20 bp, synthetic construct
  misc_feature 1..20: note = CRISPR gRNA sequence
  source 1..20: mol_type = other DNA
agtggtggggttggttaatg

SEQ ID NO: 45150 - DNA, 20 bp, synthetic construct
  misc_feature 1..20: note = CRISPR gRNA sequence
  source 1..20: mol_type = other DNA
ggtggggttggttaatgggg

SEQ ID NO: 45151 - DNA, 20 bp, synthetic construct
  misc_feature 1..20: note = CRISPR gRNA sequence
  source 1..20: mol_type = other DNA
gtggggttggttaatgggga

SEQ ID NO: 45152 - DNA, 20 bp, synthetic construct
  misc_feature 1..20: note = CRISPR gRNA sequence
  source 1..20: mol_type = other DNA
tggggttggttaatggggaa

SEQ ID NO: 45153 - DNA, 20 bp, synthetic construct
  misc_feature 1..20: note = CRISPR gRNA sequence
  source 1..20: mol_type = other DNA
ggggttggttaatggggaag

SEQ ID NO: 45154 - DNA, 20 bp, synthetic construct
  misc_feature 1..20: note = CRISPR gRNA sequence
  source 1..20: mol_type = other DNA
gggttggttaatggggaagg

SEQ ID NO: 45155 - DNA, 20 bp, synthetic construct
  misc_feature 1..20: note = CRISPR gRNA sequence
  source 1..20: mol_type = other DNA
tggttaatggggaagggggt

SEQ ID NO: 45156 - DNA, 20 bp, synthetic construct
  misc_feature 1..20: note = CRISPR gRNA sequence
  source 1..20: mol_type = other DNA
taatggggaagggggtgagt

SEQ ID NO: 45157 - DNA, 20 bp, synthetic construct
  misc_feature 1..20: note = CRISPR gRNA sequence
  source 1..20: mol_type = other DNA
aatggggaagggggtgagtg

SEQ ID NO: 45158 - DNA, 20 bp, synthetic construct
  misc_feature 1..20: note = CRISPR gRNA sequence
  source 1..20: mol_type = other DNA
atggggaagggggtgagtga

SEQ ID NO: 45159 - DNA, 20 bp, synthetic construct
  misc_feature 1..20: note = CRISPR gRNA sequence
  source 1..20: mol_type = other DNA
agggggtgagtgagggatga

SEQ ID NO: 45160 - DNA, 20 bp, synthetic construct
  misc_feature 1..20: note = CRISPR gRNA sequence
  source 1..20: mol_type = other DNA
gggtgagtgagggatgacag

SEQ ID NO: 45161 - DNA, 20 bp, synthetic construct
  misc_feature 1..20: note = CRISPR gRNA sequence
  source 1..20: mol_type = other DNA
tgagggatgacagtggttaa

SEQ ID NO: 45162 - DNA, 20 bp, synthetic construct
  misc_feature 1..20: note = CRISPR gRNA sequence
  source 1..20: mol_type = other DNA
gagggatgacagtggttaat

SEQ ID NO: 45163 - DNA, 20 bp, synthetic construct
  misc_feature 1..20: note = CRISPR gRNA sequence
  source 1..20: mol_type = other DNA
agggatgacagtggttaatg

SEQ ID NO: 45164 - DNA, 20 bp, synthetic construct
  misc_feature 1..20: note = CRISPR gRNA sequence
  source 1..20: mol_type = other DNA
atgacagtggttaatgggga

SEQ ID NO: 45165 - DNA, 20 bp, synthetic construct
  misc_feature 1..20: note = CRISPR gRNA sequence
  source 1..20: mol_type = other DNA
tgacagtggttaatggggaa

SEQ ID NO: 45166 - DNA, 20 bp, synthetic construct
  misc_feature 1..20: note = CRISPR gRNA sequence
  source 1..20: mol_type = other DNA
acagtggttaatggggaaag

SEQ ID NO: 45167 - DNA, 20 bp, synthetic construct
  misc_feature 1..20: note = CRISPR gRNA sequence
  source 1..20: mol_type = other DNA
tggttaatggggaaaggagt

SEQ ID NO: 45168 - DNA, 20 bp, synthetic construct
  misc_feature 1..20: note = CRISPR gRNA sequence
  source 1..20: mol_type = other DNA
taatggggaaaggagtgagt

SEQ ID NO: 45169 - DNA, 20 bp, synthetic construct
  misc_feature 1..20: note = CRISPR gRNA sequence
  source 1..20: mol_type = other DNA
aatggggaaaggagtgagtg

SEQ ID NO: 45170 - DNA, 20 bp, synthetic construct
  misc_feature 1..20: note = CRISPR gRNA sequence
  source 1..20: mol_type = other DNA
atggggaaaggagtgagtga

SEQ ID NO: 45171 - DNA, 20 bp, synthetic construct
  misc_feature 1..20: note = CRISPR gRNA sequence
  source 1..20: mol_type = other DNA
tggggaaaggagtgagtgag

SEQ ID NO: 45172 - DNA, 20 bp, synthetic construct
  misc_feature 1..20: note = CRISPR gRNA sequence
  source 1..20: mol_type = other DNA
aaggagtgagtgaggggtga

SEQ ID NO: 45173 - DNA, 20 bp, synthetic construct
  misc_feature 1..20: note = CRISPR gRNA sequence
  source 1..20: mol_type = other DNA
gagtgaggggtgatggtgct

SEQ ID NO: 45174 - DNA, 20 bp, synthetic construct
  misc_feature 1..20: note = CRISPR gRNA sequence
  source 1..20: mol_type = other DNA
tgatggtgcttagtgctgca

SEQ ID NO: 45175 - DNA, 20 bp, synthetic construct
  misc_feature 1..20: note = CRISPR gRNA sequence
  source 1..20: mol_type = other DNA
ggtgcttagtgctgcatggt

SEQ ID NO: 45176 - DNA, 20 bp, synthetic construct
  misc_feature 1..20: note = CRISPR gRNA sequence
  source 1..20: mol_type = other DNA
cttagtgctgcatggtcagt

SEQ ID NO: 45177 - DNA, 20 bp, synthetic construct
  misc_feature 1..20: note = CRISPR gRNA sequence
  source 1..20: mol_type = other DNA
agtgctgcatggtcagtgag

SEQ ID NO: 45178 - DNA, 20 bp, synthetic construct
  misc_feature 1..20: note = CRISPR gRNA sequence
  source 1..20: mol_type = other DNA
tggtcagtgagtagcatgcc

SEQ ID NO: 45179 - DNA, 20 bp, synthetic construct
  misc_feature 1..20: note = CRISPR gRNA sequence
  source 1..20: mol_type = other DNA
ggtcagtgagtagcatgcct

SEQ ID NO: 45180 - DNA, 20 bp, synthetic construct
  misc_feature 1..20: note = CRISPR gRNA sequence
  source 1..20: mol_type = other DNA
aacacaaaccgccatgtttc

SEQ ID NO: 45181 - DNA, 20 bp, synthetic construct
  misc_feature 1..20: note = CRISPR gRNA sequence
  source 1..20: mol_type = other DNA
caaaccgccatgtttctgga

SEQ ID NO: 45182 - DNA, 20 bp, synthetic construct
  misc_feature 1..20: note = CRISPR gRNA sequence
  source 1..20: mol_type = other DNA
gccatgtttctggatggacc

SEQ ID NO: 45183 - DNA, 20 bp, synthetic construct
  misc_feature 1..20: note = CRISPR gRNA sequence
  source 1..20: mol_type = other DNA
ccatgtttctggatggaccc

SEQ ID NO: 45184 - DNA, 20 bp, synthetic construct
  misc_feature 1..20: note = CRISPR gRNA sequence
  source 1..20: mol_type = other DNA
gtttctggatggacccaggt

SEQ ID NO: 45185 - DNA, 20 bp, synthetic construct
  misc_feature 1..20: note = CRISPR gRNA sequence
  source 1..20: mol_type = other DNA
tgaccttttactttctattc

SEQ ID NO: 45186 - DNA, 20 bp, synthetic construct
  misc_feature 1..20: note = CRISPR gRNA sequence
  source 1..20: mol_type = other DNA
ttactttctattctggatct

SEQ ID NO: 45187 - DNA, 20 bp, synthetic construct
  misc_feature 1..20: note = CRISPR gRNA sequence
  source 1..20: mol_type = other DNA
tctattctggatctcagtgc

SEQ ID NO: 45188 - DNA, 20 bp, synthetic construct
  misc_feature 1..20: note = CRISPR gRNA sequence
  source 1..20: mol_type = other DNA
ttctggatctcagtgccagc

SEQ ID NO: 45189 - DNA, 20 bp, synthetic construct
  misc_feature 1..20: note = CRISPR gRNA sequence
  source 1..20: mol_type = other DNA
ctcagtgccagcaagaacct

SEQ ID NO: 45190 - DNA, 20 bp, synthetic construct
  misc_feature 1..20: note = CRISPR gRNA sequence
  source 1..20: mol_type = other DNA
gccagcaagaaccttggtca

SEQ ID NO: 45191 - DNA, 20 bp, synthetic construct
  misc_feature 1..20: note = CRISPR gRNA sequence
  source 1..20: mol_type = other DNA
ccagcaagaaccttggtcat

SEQ ID NO: 45192 - DNA, 20 bp, synthetic construct
  misc_feature 1..20: note = CRISPR gRNA sequence
  source 1..20: mol_type = other DNA
agaaccttggtcataggaaa

SEQ ID NO: 45193 - DNA, 20 bp, synthetic construct
  misc_feature 1..20: note = CRISPR gRNA sequence
  source 1..20: mol_type = other DNA
gaaacagaatacacaactca

SEQ ID NO: 45194 - DNA, 20 bp, synthetic construct
  misc_feature 1..20: note = CRISPR gRNA sequence
  source 1..20: mol_type = other DNA
tacacaactcaaagcaatcc

SEQ ID NO: 45195 - DNA, 20 bp, synthetic construct
  misc_feature 1..20: note = CRISPR gRNA sequence
  source 1..20: mol_type = other DNA
caactcaaagcaatccaaga

SEQ ID NO: 45196 - DNA, 20 bp, synthetic construct
  misc_feature 1..20: note = CRISPR gRNA sequence
  source 1..20: mol_type = other DNA
aatccaagacagaaatatat

SEQ ID NO: 45197 - DNA, 20 bp, synthetic construct
  misc_feature 1..20: note = CRISPR gRNA sequence
  source 1..20: mol_type = other DNA
aaatatattggcttatgtca

SEQ ID NO: 45198 - DNA, 20 bp, synthetic construct
  misc_feature 1..20: note = CRISPR gRNA sequence
  source 1..20: mol_type = other DNA
cttatgtcatggaaaattac

SEQ ID NO: 45199 - DNA, 20 bp, synthetic construct
  misc_feature 1..20: note = CRISPR gRNA sequence
  source 1..20: mol_type = other DNA
ttatgtcatggaaaattacg

SEQ ID NO: 45200 - DNA, 20 bp, synthetic construct
  misc_feature 1..20: note = CRISPR gRNA sequence
  source 1..20: mol_type = other DNA
aattacgaggccaatgactt

SEQ ID NO: 45201 - DNA, 20 bp, synthetic construct
  misc_feature 1..20: note = CRISPR gRNA sequence
  source 1..20: mol_type = other DNA
attacgaggccaatgacttc

SEQ ID NO: 45202 - DNA, 20 bp, synthetic construct
  misc_feature 1..20: note = CRISPR gRNA sequence
  source 1..20: mol_type = other DNA
gaggccaatgacttcaggca

SEQ ID NO: 45203 - DNA, 20 bp, synthetic construct
  misc_feature 1..20: note = CRISPR gRNA sequence
  source 1..20: mol_type = other DNA
ccaatgacttcaggcacagc

SEQ ID NO: 45204 - DNA, 20 bp, synthetic construct
  misc_feature 1..20: note = CRISPR gRNA sequence
  source 1..20: mol_type = other DNA
acttcaggcacagctggatc

SEQ ID NO: 45205 - DNA, 20 bp, synthetic construct
  misc_feature 1..20: note = CRISPR gRNA sequence
  source 1..20: mol_type = other DNA
cttcaggcacagctggatcc

SEQ ID NO: 45206 - DNA, 20 bp, synthetic construct
  misc_feature 1..20: note = CRISPR gRNA sequence
  source 1..20: mol_type = other DNA
ttcaggcacagctggatcca

SEQ ID NO: 45207 - DNA, 20 bp, synthetic construct
  misc_feature 1..20: note = CRISPR gRNA sequence
  source 1..20: mol_type = other DNA
tcaggcacagctggatccag

SEQ ID NO: 45208 - DNA, 20 bp, synthetic construct
  misc_feature 1..20: note = CRISPR gRNA sequence
  source 1..20: mol_type = other DNA
tccaggggttctatatttgt

SEQ ID NO: 45209 - DNA, 20 bp, synthetic construct
  misc_feature 1..20: note = CRISPR gRNA sequence
  source 1..20: mol_type = other DNA
ccaggggttctatatttgtc

SEQ ID NO: 45210 - DNA, 20 bp, synthetic construct
  misc_feature 1..20: note = CRISPR gRNA sequence
  source 1..20: mol_type = other DNA
ctctctcacacacttcactc

SEQ ID NO: 45211 - DNA, 20 bp, synthetic construct
  misc_feature 1..20: note = CRISPR gRNA sequence
  source 1..20: mol_type = other DNA
tactctttctctgtccacct

SEQ ID NO: 45212 - DNA, 20 bp, synthetic construct
  misc_feature 1..20: note = CRISPR gRNA sequence
  source 1..20: mol_type = other DNA
gtccaccttggcttccttct

SEQ ID NO: 45213 - DNA, 20 bp, synthetic construct
  misc_feature 1..20: note = CRISPR gRNA sequence
  source 1..20: mol_type = other DNA
tccaccttggcttccttctc

SEQ ID NO: 45214 - DNA, 20 bp, synthetic construct
  misc_feature 1..20: note = CRISPR gRNA sequence
  source 1..20: mol_type = other DNA
accttggcttccttctcagg

SEQ ID NO: 45215 - DNA, 20 bp, synthetic construct
  misc_feature 1..20: note = CRISPR gRNA sequence
  source 1..20: mol_type = other DNA
ccttggcttccttctcaggc

SEQ ID NO: 45216 - DNA, 20 bp, synthetic construct
  misc_feature 1..20: note = CRISPR gRNA sequence
  source 1..20: mol_type = other DNA
gcaggccatccctgcacctg

SEQ ID NO: 45217 - DNA, 20 bp, synthetic construct
  misc_feature 1..20: note = CRISPR gRNA sequence
  source 1..20: mol_type = other DNA
caggccatccctgcacctgc

SEQ ID NO: 45218 - DNA, 20 bp, synthetic construct
  misc_feature 1..20: note = CRISPR gRNA sequence
  source 1..20: mol_type = other DNA
cctgcaggcttactttctct

SEQ ID NO: 45219 - DNA, 20 bp, synthetic construct
  misc_feature 1..20: note = CRISPR gRNA sequence
  source 1..20: mol_type = other DNA
aggcttactttctctcagct

SEQ ID NO: 45220 - DNA, 20 bp, synthetic construct
  misc_feature 1..20: note = CRISPR gRNA sequence
  source 1..20: mol_type = other DNA
cttactttctctcagcttag

SEQ ID NO: 45221 - DNA, 20 bp, synthetic construct
  misc_feature 1..20: note = CRISPR gRNA sequence
  source 1..20: mol_type = other DNA
ctttctctcagcttagtgga

SEQ ID NO: 45222 - DNA, 20 bp, synthetic construct
  misc_feature 1..20: note = CRISPR gRNA sequence
  source 1..20: mol_type = other DNA
tttctctcagcttagtggaa

SEQ ID NO: 45223 - DNA, 20 bp, synthetic construct
  misc_feature 1..20: note = CRISPR gRNA sequence
  source 1..20: mol_type = other DNA
ttctctcagcttagtggaaa

SEQ ID NO: 45224 - DNA, 20 bp, synthetic construct
  misc_feature 1..20: note = CRISPR gRNA sequence
  source 1..20: mol_type = other DNA
ctctcagcttagtggaaagg

SEQ ID NO: 45225 - DNA, 20 bp, synthetic construct
  misc_feature 1..20: note = CRISPR gRNA sequence
  source 1..20: mol_type = other DNA
agggagtaccattctctctg

SEQ ID NO: 45226 - DNA, 20 bp, synthetic construct
  misc_feature 1..20: note = CRISPR gRNA sequence
  source 1..20: mol_type = other DNA
tctctctgtggttacaacaa

SEQ ID NO: 45227 - DNA, 20 bp, synthetic construct
  misc_feature 1..20: note = CRISPR gRNA sequence
  source 1..20: mol_type = other DNA
ctctctgtggttacaacaaa

SEQ ID NO: 45228 - DNA, 20 bp, synthetic construct
  misc_feature 1..20: note = CRISPR gRNA sequence
  source 1..20: mol_type = other DNA
gtggttacaacaaaaggtcc

SEQ ID NO: 45229 - DNA, 20 bp, synthetic construct
  misc_feature 1..20: note = CRISPR gRNA sequence
  source 1..20: mol_type = other DNA
acaacaaaaggtcctagact

SEQ ID NO: 45230 - DNA, 20 bp, synthetic construct
  misc_feature 1..20: note = CRISPR gRNA sequence
  source 1..20: mol_type = other DNA
ggtcctagactgagtctcac

SEQ ID NO: 45231 - DNA, 20 bp, synthetic construct
  misc_feature 1..20: note = CRISPR gRNA sequence
  source 1..20: mol_type = other DNA
tagactgagtctcactggac

SEQ ID NO: 45232 - DNA, 20 bp, synthetic construct
  misc_feature 1..20: note = CRISPR gRNA sequence
  source 1..20: mol_type = other DNA
gagtctcactggactagctt

SEQ ID NO: 45233 - DNA, 20 bp, synthetic construct
  misc_feature 1..20: note = CRISPR gRNA sequence
  source 1..20: mol_type = other DNA
gagtcacctgccccacccta

SEQ ID NO: 45234 - DNA, 20 bp, synthetic construct
  misc_feature 1..20: note = CRISPR gRNA sequence
  source 1..20: mol_type = other DNA
ccaccctaaagcaatcactg

SEQ ID NO: 45235 - DNA, 20 bp, synthetic construct
  misc_feature 1..20: note = CRISPR gRNA sequence
  source 1..20: mol_type = other DNA
aaagcaatcactgtggctgt

SEQ ID NO: 45236 - DNA, 20 bp, synthetic construct
  misc_feature 1..20: note = CRISPR gRNA sequence
  source 1..20: mol_type = other DNA
gcacaaaatattctcctcac

SEQ ID NO: 45237 - DNA, 20 bp, synthetic construct
  misc_feature 1..20: note = CRISPR gRNA sequence
  source 1..20: mol_type = other DNA
aaaatattctcctcactggc

SEQ ID NO: 45238 - DNA, 20 bp, synthetic construct
  misc_feature 1..20: note = CRISPR gRNA sequence
  source 1..20: mol_type = other DNA
ttctcctcactggccagacc

SEQ ID NO: 45239 - DNA, 20 bp, synthetic construct
  misc_feature 1..20: note = CRISPR gRNA sequence
  source 1..20: mol_type = other DNA
tctcctcactggccagacct

SEQ ID NO: 45240 - DNA, 20 bp, synthetic construct
  misc_feature 1..20: note = CRISPR gRNA sequence
  source 1..20: mol_type = other DNA
cgcatgcacaccctatcttc

SEQ ID NO: 45241 - DNA, 20 bp, synthetic construct
  misc_feature 1..20: note = CRISPR gRNA sequence
  source 1..20: mol_type = other DNA
cacaccctatcttctggact

SEQ ID NO: 45242 - DNA, 20 bp, synthetic construct
  misc_feature 1..20: note = CRISPR gRNA sequence
  source 1..20: mol_type = other DNA
caccctatcttctggactta

SEQ ID NO: 45243 - DNA, 20 bp, synthetic construct
  misc_feature 1..20: note = CRISPR gRNA sequence
  source 1..20: mol_type = other DNA
accctatcttctggacttag

SEQ ID NO: 45244 - DNA, 20 bp, synthetic construct
  misc_feature 1..20: note = CRISPR gRNA sequence
  source 1..20: mol_type = other DNA
ccctatcttctggacttaga

SEQ ID NO: 45245 - DNA, 20 bp, synthetic construct
  misc_feature 1..20: note = CRISPR gRNA sequence
  source 1..20: mol_type = other DNA
cctatcttctggacttagag

SEQ ID NO: 45246 - DNA, 20 bp, synthetic construct
  misc_feature 1..20: note = CRISPR gRNA sequence
  source 1..20: mol_type = other DNA
atcttctggacttagagggg

SEQ ID NO: 45247 - DNA, 20 bp, synthetic construct
  misc_feature 1..20: note = CRISPR gRNA sequence
  source 1..20: mol_type = other DNA
gacttagaggggtggtattt

SEQ ID NO: 45248 - DNA, 20 bp, synthetic construct
  misc_feature 1..20: note = CRISPR gRNA sequence
  source 1..20: mol_type = other DNA
acttagaggggtggtatttc

SEQ ID NO: 45249 - DNA, 20 bp, synthetic construct
  misc_feature 1..20: note = CRISPR gRNA sequence
  source 1..20: mol_type = other DNA
ggggtggtatttcaggatgt

SEQ ID NO: 45250 - DNA, 20 bp, synthetic construct
  misc_feature 1..20: note = CRISPR gRNA sequence
  source 1..20: mol_type = other DNA
gtatttcaggatgtgagtaa

SEQ ID NO: 45251 - DNA, 20 bp, synthetic construct
  misc_feature 1..20: note = CRISPR gRNA sequence
  source 1..20: mol_type = other DNA
tttcaggatgtgagtaacag

SEQ ID NO: 45252 - DNA, 20 bp, synthetic construct
  misc_feature 1..20: note = CRISPR gRNA sequence
  source 1..20: mol_type = other DNA
tcaggatgtgagtaacagaa

SEQ ID NO: 45253 - DNA, 20 bp, synthetic construct
  misc_feature 1..20: note = CRISPR gRNA sequence
  source 1..20: mol_type = other DNA
caggatgtgagtaacagaag

SEQ ID NO: 45254 - DNA, 20 bp, synthetic construct
  misc_feature 1..20: note = CRISPR gRNA sequence
  source 1..20: mol_type = other DNA
atgtgagtaacagaagagga

SEQ ID NO: 45255 - DNA, 20 bp, synthetic construct
  misc_feature 1..20: note = CRISPR gRNA sequence
  source 1..20: mol_type = other DNA
acagaagaggaaagaaactc

SEQ ID NO: 45256 - DNA, 20 bp, synthetic construct
  misc_feature 1..20: note = CRISPR gRNA sequence
  source 1..20: mol_type = other DNA
cagaagaggaaagaaactct

SEQ ID NO: 45257 - DNA, 20 bp, synthetic construct
  misc_feature 1..20: note = CRISPR gRNA sequence
  source 1..20: mol_type = other DNA
aagaggaaagaaactctggg

SEQ ID NO: 45258 - DNA, 20 bp, synthetic construct
  misc_feature 1..20: note = CRISPR gRNA sequence
  source 1..20: mol_type = other DNA
tctgggcagaaaaaaatcta

SEQ ID NO: 45259 - DNA, 20 bp, synthetic construct
  misc_feature 1..20: note = CRISPR gRNA sequence
  source 1..20: mol_type = other DNA
atgtccactacatttgtcta

SEQ ID NO: 45260 - DNA, 20 bp, synthetic construct
  misc_feature 1..20: note = CRISPR gRNA sequence
  source 1..20: mol_type = other DNA
tttgtctacagttgtttcct

SEQ ID NO: 45261 - DNA, 20 bp, synthetic construct
  misc_feature 1..20: note = CRISPR gRNA sequence
  source 1..20: mol_type = other DNA
acagttgtttccttggtaac

SEQ ID NO: 45262 - DNA, 20 bp, synthetic construct
  misc_feature 1..20: note = CRISPR gRNA sequence
  source 1..20: mol_type = other DNA
gttgtttccttggtaactgg

SEQ ID NO: 45263 - DNA, 20 bp, synthetic construct
  misc_feature 1..20: note = CRISPR gRNA sequence
  source 1..20: mol_type = other DNA
ctactctcccccataatttg

SEQ ID NO: 45264 - DNA, 20 bp, synthetic construct
  misc_feature 1..20: note = CRISPR gRNA sequence
  source 1..20: mol_type = other DNA
atttgaagtcatcaaattct

SEQ ID NO: 45265 - DNA, 20 bp, synthetic construct
  misc_feature 1..20: note = CRISPR gRNA sequence
  source 1..20: mol_type = other DNA
catcaaattcttagaaatgc

SEQ ID NO: 45266 - DNA, 20 bp, synthetic construct
  misc_feature 1..20: note = CRISPR gRNA sequence
  source 1..20: mol_type = other DNA
attcttagaaatgccagaaa

SEQ ID NO: 45267 - DNA, 20 bp, synthetic construct
  misc_feature 1..20: note = CRISPR gRNA sequence
  source 1..20: mol_type = other DNA
agaaatgccagaaacagcct

SEQ ID NO: 45268 - DNA, 20 bp, synthetic construct
  misc_feature 1..20: note = CRISPR gRNA sequence
  source 1..20: mol_type = other DNA
cagaaacagcctcagtctaa

SEQ ID NO: 45269 - DNA, 20 bp, synthetic construct
  misc_feature 1..20: note = CRISPR gRNA sequence
  source 1..20: mol_type = other DNA
aacagcctcagtctaaaaga

SEQ ID NO: 45270 - DNA, 20 bp, synthetic construct
  misc_feature 1..20: note = CRISPR gRNA sequence
  source 1..20: mol_type = other DNA
acagcctcagtctaaaagac

SEQ ID NO: 45271 - DNA, 20 bp, synthetic construct
  misc_feature 1..20: note = CRISPR gRNA sequence
  source 1..20: mol_type = other DNA
agacaggtccccgtcctgca

SEQ ID NO: 45272 - DNA, 20 bp, synthetic construct
  misc_feature 1..20: note = CRISPR gRNA sequence
  source 1..20: mol_type = other DNA
gtcctgcacagattcctgtt

SEQ ID NO: 45273 - DNA, 20 bp, synthetic construct
  misc_feature 1..20: note = CRISPR gRNA sequence
  source 1..20: mol_type = other DNA
tgcacagattcctgtttaga

SEQ ID NO: 45274 - DNA, 20 bp, synthetic construct
  misc_feature 1..20: note = CRISPR gRNA sequence
  source 1..20: mol_type = other DNA
attcctgtttagacagtatc

SEQ ID NO: 45275 - DNA, 20 bp, synthetic construct
  misc_feature 1..20: note = CRISPR gRNA sequence
  source 1..20: mol_type = other DNA
ctgtttagacagtatctgga

SEQ ID NO: 45276 - DNA, 20 bp, synthetic construct
  misc_feature 1..20: note = CRISPR gRNA sequence
  source 1..20: mol_type = other DNA
tatctggacagaaaatttaa

SEQ ID NO: 45277 - DNA, 20 bp, synthetic construct
  misc_feature 1..20: note = CRISPR gRNA sequence
  source 1..20: mol_type = other DNA
actttttctgatgaccaaaa

SEQ ID NO: 45278 - DNA, 20 bp, synthetic construct
  misc_feature 1..20: note = CRISPR gRNA sequence
  source 1..20: mol_type = other DNA
ccaaaaaagttccatctttc

SEQ ID NO: 45279 - DNA, 20 bp, synthetic construct
  misc_feature 1..20: note = CRISPR gRNA sequence
  source 1..20: mol_type = other DNA
acaaataacatgaaatgccc

SEQ ID NO: 45280 - DNA, 20 bp, synthetic construct
  misc_feature 1..20: note = CRISPR gRNA sequence
  source 1..20: mol_type = other DNA
caaataacatgaaatgcccc

SEQ ID NO: 45281 - DNA, 20 bp, synthetic construct
  misc_feature 1..20: note = CRISPR gRNA sequence
  source 1..20: mol_type = other DNA
aaataacatgaaatgccccg

SEQ ID NO: 45282 - DNA, 20 bp, synthetic construct
  misc_feature 1..20: note = CRISPR gRNA sequence
  source 1..20: mol_type = other DNA
ccccggggatgacaccccct

SEQ ID NO: 45283 - DNA, 20 bp, synthetic construct
  misc_feature 1..20: note = CRISPR gRNA sequence
  source 1..20: mol_type = other DNA
ctgagaaaacttctgttgaa

SEQ ID NO: 45284 - DNA, 20 bp, synthetic construct
  misc_feature 1..20: note = CRISPR gRNA sequence
  source 1..20: mol_type = other DNA
acggtttgtgaatttttctc

SEQ ID NO: 45285 - DNA, 20 bp, synthetic construct
  misc_feature 1..20: note = CRISPR gRNA sequence
  source 1..20: mol_type = other DNA
ttctacatatgttttgaatt

SEQ ID NO: 45286 - DNA, 20 bp, synthetic construct
  misc_feature 1..20: note = CRISPR gRNA sequence
  source 1..20: mol_type = other DNA
atgttttgaattcagcttga

SEQ ID NO: 45287 - DNA, 20 bp, synthetic construct
  misc_feature 1..20: note = CRISPR gRNA sequence
  source 1..20: mol_type = other DNA
ttttgaattcagcttgaaag

SEQ ID NO: 45288 - DNA, 20 bp, synthetic construct
  misc_feature 1..20: note = CRISPR gRNA sequence
  source 1..20: mol_type = other DNA
ttgtccctctttgcttgtcc

SEQ ID NO: 45289 - DNA, 20 bp, synthetic construct
  misc_feature 1..20: note = CRISPR gRNA sequence
  source 1..20: mol_type = other DNA
tgtccctctttgcttgtcct

SEQ ID NO: 45290 - DNA, 20 bp, synthetic construct
  misc_feature 1..20: note = CRISPR gRNA sequence
  source 1..20: mol_type = other DNA
gtccctctttgcttgtcctg

SEQ ID NO: 45291 - DNA, 20 bp, synthetic construct
  misc_feature 1..20: note = CRISPR gRNA sequence
  source 1..20: mol_type = other DNA
ccctctttgcttgtcctggg

SEQ ID NO: 45292 - DNA, 20 bp, synthetic construct
  misc_feature 1..20: note = CRISPR gRNA sequence
  source 1..20: mol_type = other DNA
ctctttgcttgtcctgggga

SEQ ID NO: 45293 - DNA, 20 bp, synthetic construct
  misc_feature 1..20: note = CRISPR gRNA sequence
  source 1..20: mol_type = other DNA
tctttgcttgtcctggggag

SEQ ID NO: 45294 - DNA, 20 bp, synthetic construct
  misc_feature 1..20: note = CRISPR gRNA sequence
  source 1..20: mol_type = other DNA
gcttgtcctggggagaggat

SEQ ID NO: 45295 - DNA, 20 bp, synthetic construct
  misc_feature 1..20: note = CRISPR gRNA sequence
  source 1..20: mol_type = other DNA
cttgtcctggggagaggatc

SEQ ID NO: 45296 - DNA, 20 bp, synthetic construct
  misc_feature 1..20: note = CRISPR gRNA sequence
  source 1..20: mol_type = other DNA
ctggggagaggatcaggtaa

SEQ ID NO: 45297 - DNA, 20 bp, synthetic construct
  misc_feature 1..20: note = CRISPR gRNA sequence
  source 1..20: mol_type = other DNA
tggggagaggatcaggtaaa

SEQ ID NO: 45298 - DNA, 20 bp, synthetic construct
  misc_feature 1..20: note = CRISPR gRNA sequence
  source 1..20: mol_type = other DNA
gggagaggatcaggtaaaag

SEQ ID NO: 45299 - DNA, 20 bp, synthetic construct
  misc_feature 1..20: note = CRISPR gRNA sequence
  source 1..20: mol_type = other DNA
agaggatcaggtaaaaggag

SEQ ID NO: 45300 - DNA, 20 bp, synthetic construct
  misc_feature 1..20: note = CRISPR gRNA sequence
  source 1..20: mol_type = other DNA
aggatcaggtaaaaggagaa

SEQ ID NO: 45301 - DNA, 20 bp, synthetic construct
  misc_feature 1..20: note = CRISPR gRNA sequence
  source 1..20: mol_type = other DNA
ggatcaggtaaaaggagaag

SEQ ID NO: 45302 - DNA, 20 bp, synthetic construct
  misc_feature 1..20: note = CRISPR gRNA sequence
  source 1..20: mol_type = other DNA
gatcaggtaaaaggagaaga

SEQ ID NO: 45303 - DNA, 20 bp, synthetic construct
  misc_feature 1..20: note = CRISPR gRNA sequence
  source 1..20: mol_type = other DNA
taaaaggagaagagggatta

SEQ ID NO: 45304 - DNA, 20 bp, synthetic construct
  misc_feature 1..20: note = CRISPR gRNA sequence
  source 1..20: mol_type = other DNA
aaaggagaagagggattaca

SEQ ID NO: 45305 - DNA, 20 bp, synthetic construct
  misc_feature 1..20: note = CRISPR gRNA sequence
  source 1..20: mol_type = other DNA
attacagagacctttgacca

SEQ ID NO: 45306 - DNA, 20 bp, synthetic construct
  misc_feature 1..20: note = CRISPR gRNA sequence
  source 1..20: mol_type = other DNA
ttacagagacctttgaccac

SEQ ID NO: 45307 - DNA, 20 bp, synthetic construct
  misc_feature 1..20: note = CRISPR gRNA sequence
  source 1..20: mol_type = other DNA
tacagagacctttgaccaca

SEQ ID NO: 45308 - DNA, 20 bp, synthetic construct
  misc_feature 1..20: note = CRISPR gRNA sequence
  source 1..20: mol_type = other DNA
gggccctcctgtcgtctcac

SEQ ID NO: 45309 - DNA, 20 bp, synthetic construct
  misc_feature 1..20: note = CRISPR gRNA sequence
  source 1..20: mol_type = other DNA
ctgtccatgtacctgcatct

SEQ ID NO: 45310 - DNA, 20 bp, synthetic construct
  misc_feature 1..20: note = CRISPR gRNA sequence
  source 1..20: mol_type = other DNA
catgtacctgcatctcggct

SEQ ID NO: 45311 - DNA, 20 bp, synthetic construct
  misc_feature 1..20: note = CRISPR gRNA sequence
  source 1..20: mol_type = other DNA
tgcatctcggctcagccttc

SEQ ID NO: 45312 - DNA, 20 bp, synthetic construct
  misc_feature 1..20: note = CRISPR gRNA sequence
  source 1..20: mol_type = other DNA
atctcggctcagccttctgg

SEQ ID NO: 45313 - DNA, 20 bp, synthetic construct
  misc_feature 1..20: note = CRISPR gRNA sequence
  source 1..20: mol_type = other DNA
gccttctggaagcttttatt

SEQ ID NO: 45314 - DNA, 20 bp, synthetic construct
  misc_feature 1..20: note = CRISPR gRNA sequence
  source 1..20: mol_type = other DNA
ccttctggaagcttttattt

SEQ ID NO: 45315 - DNA, 20 bp, synthetic construct
  misc_feature 1..20: note = CRISPR gRNA sequence
  source 1..20: mol_type = other DNA
cttctggaagcttttattta

SEQ ID NO: 45316 - DNA, 20 bp, synthetic construct
  misc_feature 1..20: note = CRISPR gRNA sequence
  source 1..20: mol_type = other DNA
ttctggaagcttttatttag

SEQ ID NO: 45317 - DNA, 20 bp, synthetic construct
  misc_feature 1..20: note = CRISPR gRNA sequence
  source 1..20: mol_type = other DNA
gaagcttttatttaggggat

SEQ ID NO: 45318 - DNA, 20 bp, synthetic construct
  misc_feature 1..20: note = CRISPR gRNA sequence
  source 1..20: mol_type = other DNA
agcttttatttaggggattg

SEQ ID NO: 45319 - DNA, 20 bp, synthetic construct
  misc_feature 1..20: note = CRISPR gRNA sequence
  source 1..20: mol_type = other DNA
gcttttatttaggggattgg

SEQ ID NO: 45320 - DNA, 20 bp, synthetic construct
  misc_feature 1..20: note = CRISPR gRNA sequence
  source 1..20: mol_type = other DNA
tatttaggggattggaggcc

SEQ ID NO: 45321 - DNA, 20 bp, synthetic construct
  misc_feature 1..20: note = CRISPR gRNA sequence
  source 1..20: mol_type = other DNA
taggggattggaggcccagt

SEQ ID NO: 45322 - DNA, 20 bp, synthetic construct
  misc_feature 1..20: note = CRISPR gRNA sequence
  source 1..20: mol_type = other DNA
aggggattggaggcccagtg

SEQ ID NO: 45323 - DNA, 20 bp, synthetic construct
  misc_feature 1..20: note = CRISPR gRNA sequence
  source 1..20: mol_type = other DNA
ggcccagtgaggtcattcat

SEQ ID NO: 45324 - DNA, 20 bp, synthetic construct
  misc_feature 1..20: note = CRISPR gRNA sequence
  source 1..20: mol_type = other DNA
gcattcgacaaatatgtact

SEQ ID NO: 45325 - DNA, 20 bp, synthetic construct
  misc_feature 1..20: note = CRISPR gRNA sequence
  source 1..20: mol_type = other DNA
tcgacaaatatgtactgagc

SEQ ID NO: 45326 - DNA, 20 bp, synthetic construct
  misc_feature 1..20: note = CRISPR gRNA sequence
  source 1..20: mol_type = other DNA
cgacaaatatgtactgagct

SEQ ID NO: 45327 - DNA, 20 bp, synthetic construct
  misc_feature 1..20: note = CRISPR gRNA sequence
  source 1..20: mol_type = other DNA
tatgtactgagctgggcacc

SEQ ID NO: 45328 - DNA, 20 bp, synthetic construct
  misc_feature 1..20: note = CRISPR gRNA sequence
  source 1..20: mol_type = other DNA
atgtactgagctgggcacct

SEQ ID NO: 45329 - DNA, 20 bp, synthetic construct
  misc_feature 1..20: note = CRISPR gRNA sequence
  source 1..20: mol_type = other DNA
actgagctgggcacctgggc

SEQ ID NO: 45330 - DNA, 20 bp, synthetic construct
  misc_feature 1..20: note = CRISPR gRNA sequence
  source 1..20: mol_type = other DNA
ctgagctgggcacctgggcc

SEQ ID NO: 45331 - DNA, 20 bp, synthetic construct
  misc_feature 1..20: note = CRISPR gRNA sequence
  source 1..20: mol_type = other DNA
tgagctgggcacctgggccg

SEQ ID NO: 45332 - DNA, 20 bp, synthetic construct
  misc_feature 1..20: note = CRISPR gRNA sequence
  source 1..20: mol_type = other DNA
ctgggcacctgggccgggga

SEQ ID NO: 45333 - DNA, 20 bp, synthetic construct
  misc_feature 1..20: note = CRISPR gRNA sequence
  source 1..20: mol_type = other DNA
tgggcacctgggccggggac

SEQ ID NO: 45334 - DNA, 20 bp, synthetic construct
  misc_feature 1..20: note = CRISPR gRNA sequence
  source 1..20: mol_type = other DNA
cacctgggccggggacagga

SEQ ID NO: 45335 - DNA, 20 bp, synthetic construct
  misc_feature 1..20: note = CRISPR gRNA sequence
  source 1..20: mol_type = other DNA
gacagattcatccatgcccc

SEQ ID NO: 45336 - DNA, 20 bp, synthetic construct
  misc_feature 1..20: note = CRISPR gRNA sequence
  source 1..20: mol_type = other DNA
acagattcatccatgcccct

SEQ ID NO: 45337 - DNA, 20 bp, synthetic construct
  misc_feature 1..20: note = CRISPR gRNA sequence
  source 1..20: mol_type = other DNA
cagattcatccatgcccctg

SEQ ID NO: 45338 - DNA, 20 bp, synthetic construct
  misc_feature 1..20: note = CRISPR gRNA sequence
  source 1..20: mol_type = other DNA
agattcatccatgcccctgg

SEQ ID NO: 45339 - DNA, 20 bp, synthetic construct
  misc_feature 1..20: note = CRISPR gRNA sequence
  source 1..20: mol_type = other DNA
ttttcttcctcctgatttcc

SEQ ID NO: 45340 - DNA, 20 bp, synthetic construct
  misc_feature 1..20: note = CRISPR gRNA sequence
  source 1..20: mol_type = other DNA
tttcttcctcctgatttccc

SEQ ID NO: 45341 - DNA, 20 bp, synthetic construct
  misc_feature 1..20: note = CRISPR gRNA sequence
  source 1..20: mol_type = other DNA
ctccttacctcctgctgcct

SEQ ID NO: 45342 - DNA, 20 bp, synthetic construct
  misc_feature 1..20: note = CRISPR gRNA sequence
  source 1..20: mol_type = other DNA
tagttgccctatctgtaaac

SEQ ID NO: 45343 - DNA, 20 bp, synthetic construct
  misc_feature 1..20: note = CRISPR gRNA sequence
  source 1..20: mol_type = other DNA
agttgccctatctgtaaact

SEQ ID NO: 45344 - DNA, 20 bp, synthetic construct
  misc_feature 1..20: note = CRISPR gRNA sequence
  source 1..20: mol_type = other DNA
cataatatcttccctgtccg

SEQ ID NO: 45345 - DNA, 20 bp, synthetic construct
  misc_feature 1..20: note = CRISPR gRNA sequence
  source 1..20: mol_type = other DNA
ataatatcttccctgtccga

SEQ ID NO: 45346 - DNA, 20 bp, synthetic construct
  misc_feature 1..20: note = CRISPR gRNA sequence
  source 1..20: mol_type = other DNA
atatcttccctgtccgaagg

SEQ ID NO: 45347 - DNA, 20 bp, synthetic construct
  misc_feature 1..20: note = CRISPR gRNA sequence
  source 1..20: mol_type = other DNA
tatcttccctgtccgaagga

SEQ ID NO: 45348 - DNA, 20 bp, synthetic construct
  misc_feature 1..20: note = CRISPR gRNA sequence
  source 1..20: mol_type = other DNA
atcttccctgtccgaaggaa

SEQ ID NO: 45349 - DNA, 20 bp, synthetic construct
  misc_feature 1..20: note = CRISPR gRNA sequence
  source 1..20: mol_type = other DNA
tcttccctgtccgaaggaag

SEQ ID NO: 45350 - DNA, 20 bp, synthetic construct
  misc_feature 1..20: note = CRISPR gRNA sequence
  source 1..20: mol_type = other DNA
ccctgtccgaaggaagggga

SEQ ID NO: 45351 - DNA, 20 bp, synthetic construct
  misc_feature 1..20: note = CRISPR gRNA sequence
  source 1..20: mol_type = other DNA
gaaggaaggggatggatcgt

SEQ ID NO: 45352 - DNA, 20 bp, synthetic construct
  misc_feature 1..20: note = CRISPR gRNA sequence
  source 1..20: mol_type = other DNA
ggggatggatcgtcagtgcc

SEQ ID NO: 45353 - DNA, 20 bp, synthetic construct
  misc_feature 1..20: note = CRISPR gRNA sequence
  source 1..20: mol_type = other DNA
ggatggatcgtcagtgcccg

SEQ ID NO: 45354 - DNA, 20 bp, synthetic construct
  misc_feature 1..20: note = CRISPR gRNA sequence
  source 1..20: mol_type = other DNA
gatggatcgtcagtgcccgg

SEQ ID NO: 45355 - DNA, 20 bp, synthetic construct
  misc_feature 1..20: note = CRISPR gRNA sequence
  source 1..20: mol_type = other DNA
ccggaggtctcttcccatct

SEQ ID NO: 45356 - DNA, 20 bp, synthetic construct
  misc_feature 1..20: note = CRISPR gRNA sequence
  source 1..20: mol_type = other DNA
atctcagatctgtcatttcc

SEQ ID NO: 45357 - DNA, 20 bp, synthetic construct
  misc_feature 1..20: note = CRISPR gRNA sequence
  source 1..20: mol_type = other DNA
tttccaagtgtaactcccca

SEQ ID NO: 45358 - DNA, 20 bp, synthetic construct
  misc_feature 1..20: note = CRISPR gRNA sequence
  source 1..20: mol_type = other DNA
ttccaagtgtaactccccac

SEQ ID NO: 45359 - DNA, 20 bp, synthetic construct
  misc_feature 1..20: note = CRISPR gRNA sequence
  source 1..20: mol_type = other DNA
caagtgtaactccccacagg

SEQ ID NO: 45360 - DNA, 20 bp, synthetic construct
  misc_feature 1..20: note = CRISPR gRNA sequence
  source 1..20: mol_type = other DNA
caggcagttaccctcaaatc

SEQ ID NO: 45361 - DNA, 20 bp, synthetic construct
  misc_feature 1..20: note = CRISPR gRNA sequence
  source 1..20: mol_type = other DNA
cagttaccctcaaatccagt

SEQ ID NO: 45362 - DNA, 20 bp, synthetic construct
  misc_feature 1..20: note = CRISPR gRNA sequence
  source 1..20: mol_type = other DNA
caaatccagtcagcttcttc

SEQ ID NO: 45363 - DNA, 20 bp, synthetic construct
  misc_feature 1..20: note = CRISPR gRNA sequence
  source 1..20: mol_type = other DNA
ttccagctgtatacctgtga

SEQ ID NO: 45364 - DNA, 20 bp, synthetic construct
  misc_feature 1..20: note = CRISPR gRNA sequence
  source 1..20: mol_type = other DNA
ccagctgtatacctgtgatg

SEQ ID NO: 45365 - DNA, 20 bp, synthetic construct
  misc_feature 1..20: note = CRISPR gRNA sequence
  source 1..20: mol_type = other DNA
gctgtatacctgtgatggag

SEQ ID NO: 45366 - DNA, 20 bp, synthetic construct
  misc_feature 1..20: note = CRISPR gRNA sequence
  source 1..20: mol_type = other DNA
ctgtatacctgtgatggagt

SEQ ID NO: 45367 - DNA, 20 bp, synthetic construct
  misc_feature 1..20: note = CRISPR gRNA sequence
  source 1..20: mol_type = other DNA
tatacctgtgatggagtggg

SEQ ID NO: 45368 - DNA, 20 bp, synthetic construct
  misc_feature 1..20: note = CRISPR gRNA sequence
  source 1..20: mol_type = other DNA
atacctgtgatggagtgggt

SEQ ID NO: 45369 - DNA, 20 bp, synthetic construct
  misc_feature 1..20: note = CRISPR gRNA sequence
  source 1..20: mol_type = other DNA
acctgtgatggagtgggtag

SEQ ID NO: 45370 - DNA, 20 bp, synthetic construct
  misc_feature 1..20: note = CRISPR gRNA sequence
  source 1..20: mol_type = other DNA
tgatggagtgggtaggagca

SEQ ID NO: 45371 - DNA, 20 bp, synthetic construct
  misc_feature 1..20: note = CRISPR gRNA sequence
  source 1..20: mol_type = other DNA
gtgggtaggagcatggaccc

SEQ ID NO: 45372 - DNA, 20 bp, synthetic construct
  misc_feature 1..20: note = CRISPR gRNA sequence
  source 1..20: mol_type = other DNA
gtaggagcatggaccctagt

SEQ ID NO: 45373 - DNA, 20 bp, synthetic construct
  misc_feature 1..20: note = CRISPR gRNA sequence
  source 1..20: mol_type = other DNA
taggagcatggaccctagtt

SEQ ID NO: 45374 - DNA, 20 bp, synthetic construct
  misc_feature 1..20: note = CRISPR gRNA sequence
  source 1..20: mol_type = other DNA
ggagcatggaccctagttag

SEQ ID NO: 45375 - DNA, 20 bp, synthetic construct
  misc_feature 1..20: note = CRISPR gRNA sequence
  source 1..20: mol_type = other DNA
tagttaggagcctcactgcc

SEQ ID NO: 45376 - DNA, 20 bp, synthetic construct
  misc_feature 1..20: note = CRISPR gRNA sequence
  source 1..20: mol_type = other DNA
agttaggagcctcactgcct

SEQ ID NO: 45377 - DNA, 20 bp, synthetic construct
  misc_feature 1..20: note = CRISPR gRNA sequence
  source 1..20: mol_type = other DNA
tcactgcctgggttcaactc

SEQ ID NO: 45378 - DNA, 20 bp, synthetic construct
  misc_feature 1..20: note = CRISPR gRNA sequence
  source 1..20: mol_type = other DNA
cactgcctgggttcaactct

SEQ ID NO: 45379 - DNA, 20 bp, synthetic construct
  misc_feature 1..20: note = CRISPR gRNA sequence
  source 1..20: mol_type = other DNA
tgcctgggttcaactctggg

SEQ ID NO: 45380 - DNA, 20 bp, synthetic construct
  misc_feature 1..20: note = CRISPR gRNA sequence
  source 1..20: mol_type = other DNA
gcctgggttcaactctgggt

SEQ ID NO: 45381 - DNA, 20 bp, synthetic construct
  misc_feature 1..20: note = CRISPR gRNA sequence
  source 1..20: mol_type = other DNA
cctgggttcaactctgggtg

SEQ ID NO: 45382 - DNA, 20 bp, synthetic construct
  misc_feature 1..20: note = CRISPR gRNA sequence
  source 1..20: mol_type = other DNA
ggtggggtaactgacacttc

SEQ ID NO: 45383 - DNA, 20 bp, synthetic construct
  misc_feature 1..20: note = CRISPR gRNA sequence
  source 1..20: mol_type = other DNA
actgacacttccagtttgct

SEQ ID NO: 45384 - DNA, 20 bp, synthetic construct
  misc_feature 1..20: note = CRISPR gRNA sequence
  source 1..20: mol_type = other DNA
tgacacttccagtttgcttg

SEQ ID NO: 45385 - DNA, 20 bp, synthetic construct
  misc_feature 1..20: note = CRISPR gRNA sequence
  source 1..20: mol_type = other DNA
gcttggagctttccccattt

SEQ ID NO: 45386 - DNA, 20 bp, synthetic construct
  misc_feature 1..20: note = CRISPR gRNA sequence
  source 1..20: mol_type = other DNA
tttccccattttggcaccca

SEQ ID NO: 45387 - DNA, 20 bp, synthetic construct
  misc_feature 1..20: note = CRISPR gRNA sequence
  source 1..20: mol_type = other DNA
ggcacccaaagtcccacatc

SEQ ID NO: 45388 - DNA, 20 bp, synthetic construct
  misc_feature 1..20: note = CRISPR gRNA sequence
  source 1..20: mol_type = other DNA
gcacccaaagtcccacatcc

SEQ ID NO: 45389 - DNA, 20 bp, synthetic construct
  misc_feature 1..20: note = CRISPR gRNA sequence
  source 1..20: mol_type = other DNA
aggaaaaactcttctgttct

SEQ ID NO: 45390 - DNA, 20 bp, synthetic construct
  misc_feature 1..20: note = CRISPR gRNA sequence
  source 1..20: mol_type = other DNA
tcttctgttctgagccaacc

SEQ ID NO: 45391 - DNA, 20 bp, synthetic construct
  misc_feature 1..20: note = CRISPR gRNA sequence
  source 1..20: mol_type = other DNA
ctgttctgagccaaccaaga

SEQ ID NO: 45392 - DNA, 20 bp, synthetic construct
  misc_feature 1..20: note = CRISPR gRNA sequence
  source 1..20: mol_type = other DNA
attttattatttatttattt

SEQ ID NO: 45393 - DNA, 20 bp, synthetic construct
  misc_feature 1..20: note = CRISPR gRNA sequence
  source 1..20: mol_type = other DNA
ttatttatttatttgagacc

SEQ ID NO: 45394 - DNA, 20 bp, synthetic construct
  misc_feature 1..20: note = CRISPR gRNA sequence
  source 1..20: mol_type = other DNA
cccagtctctctccgttgcc

SEQ ID NO: 45395 - DNA, 20 bp, synthetic construct
  misc_feature 1..20: note = CRISPR gRNA sequence
  source 1..20: mol_type = other DNA
ccagtctctctccgttgccc

SEQ ID NO: 45396 - DNA, 20 bp, synthetic construct
  misc_feature 1..20: note = CRISPR gRNA sequence
  source 1..20: mol_type = other DNA
tctctctccgttgcccaggc

SEQ ID NO: 45397 - DNA, 20 bp, synthetic construct
  misc_feature 1..20: note = CRISPR gRNA sequence
  source 1..20: mol_type = other DNA
tctctccgttgcccaggctg

SEQ ID NO: 45398 - DNA, 20 bp, synthetic construct
  misc_feature 1..20: note = CRISPR gRNA sequence
  source 1..20: mol_type = other DNA
ccgttgcccaggctggagtg

SEQ ID NO: 45399 - DNA, 20 bp, synthetic construct
  misc_feature 1..20: note = CRISPR gRNA sequence
  source 1..20: mol_type = other DNA
ttgcccaggctggagtgcag

SEQ ID NO: 45400 - DNA, 20 bp, synthetic construct
  misc_feature 1..20: note = CRISPR gRNA sequence
  source 1..20: mol_type = other DNA
caggctggagtgcagtggca

SEQ ID NO: 45401 - DNA, 20 bp, synthetic construct
  misc_feature 1..20: note = CRISPR gRNA sequence
  source 1..20: mol_type = other DNA
ggagtgcagtggcacagtct

SEQ ID NO: 45402 - DNA, 20 bp, synthetic construct
  misc_feature 1..20: note = CRISPR gRNA sequence
  source 1..20: mol_type = other DNA
tcactgcaacctccgcctcc

SEQ ID NO: 45403 - DNA, 20 bp, synthetic construct
  misc_feature 1..20: note = CRISPR gRNA sequence
  source 1..20: mol_type = other DNA
cactgcaacctccgcctccc

SEQ ID NO: 45404 - DNA, 20 bp, synthetic construct
  misc_feature 1..20: note = CRISPR gRNA sequence
  source 1..20: mol_type = other DNA
aacctccgcctcccgggttc

SEQ ID NO: 45405 - DNA, 20 bp, synthetic construct
  misc_feature 1..20: note = CRISPR gRNA sequence
  source 1..20: mol_type = other DNA
ttcaagcaaccctcctgcct

SEQ ID NO: 45406 - DNA, 20 bp, synthetic construct
  misc_feature 1..20: note = CRISPR gRNA sequence
  source 1..20: mol_type = other DNA
ccctcctgcctcagcctccc

SEQ ID NO: 45407 - DNA, 20 bp, synthetic construct
  misc_feature 1..20: note = CRISPR gRNA sequence
  source 1..20: mol_type = other DNA
tcctgcctcagcctcccaag

SEQ ID NO: 45408 - DNA, 20 bp, synthetic construct
  misc_feature 1..20: note = CRISPR gRNA sequence
  source 1..20: mol_type = other DNA
gcctcagcctcccaagtagc

SEQ ID NO: 45409 - DNA, 20 bp, synthetic construct
  misc_feature 1..20: note = CRISPR gRNA sequence
  source 1..20: mol_type = other DNA
ctcccaagtagctggcatta

SEQ ID NO: 45410 - DNA, 20 bp, synthetic construct
  misc_feature 1..20: note = CRISPR gRNA sequence
  source 1..20: mol_type = other DNA
tcccaagtagctggcattac

SEQ ID NO: 45411 - DNA, 20 bp, synthetic construct
  misc_feature 1..20: note = CRISPR gRNA sequence
  source 1..20: mol_type = other DNA
gcattacaggcacatgccac

SEQ ID NO: 45412 - DNA, 20 bp, synthetic construct
  misc_feature 1..20: note = CRISPR gRNA sequence
  source 1..20: mol_type = other DNA
cattacaggcacatgccacc

SEQ ID NO: 45413 - DNA, 20 bp, synthetic construct
  misc_feature 1..20: note = CRISPR gRNA sequence
  source 1..20: mol_type = other DNA
caggcacatgccaccaggcc

SEQ ID NO: 45414 - DNA, 20 bp, synthetic construct
  misc_feature 1..20: note = CRISPR gRNA sequence
  source 1..20: mol_type = other DNA
ccagctaatttttctatttt

SEQ ID NO: 45415 - DNA, 20 bp, synthetic construct
  misc_feature 1..20: note = CRISPR gRNA sequence
  source 1..20: mol_type = other DNA
gctaatttttctatttttag

SEQ ID NO: 45416 - DNA, 20 bp, synthetic construct
  misc_feature 1..20: note = CRISPR gRNA sequence
  source 1..20: mol_type = other DNA
taatttttctatttttagtg

SEQ ID NO: 45417 - DNA, 20 bp, synthetic construct
  misc_feature 1..20: note = CRISPR gRNA sequence
  source 1..20: mol_type = other DNA
ttttctatttttagtggaga

SEQ ID NO: 45418 - DNA, 20 bp, synthetic construct
  misc_feature 1..20: note = CRISPR gRNA sequence
  source 1..20: mol_type = other DNA
tttctatttttagtggagat

SEQ ID NO: 45419 - DNA, 20 bp, synthetic construct
  misc_feature 1..20: note = CRISPR gRNA sequence
  source 1..20: mol_type = other DNA
ttctatttttagtggagatg

SEQ ID NO: 45420 - DNA, 20 bp, synthetic construct
  misc_feature 1..20: note = CRISPR gRNA sequence
  source 1..20: mol_type = other DNA
gagatggggtttcactttgt

SEQ ID NO: 45421 - DNA, 20 bp, synthetic construct
  misc_feature 1..20: note = CRISPR gRNA sequence
  source 1..20: mol_type = other DNA
tggggtttcactttgttggc

SEQ ID NO: 45422 - DNA, 20 bp, synthetic construct
  misc_feature 1..20: note = CRISPR gRNA sequence
  source 1..20: mol_type = other DNA
ggggtttcactttgttggcc

SEQ ID NO: 45423 - DNA, 20 bp, synthetic construct
  misc_feature 1..20: note = CRISPR gRNA sequence
  source 1..20: mol_type = other DNA
tttcactttgttggccaggc

SEQ ID NO: 45424 - DNA, 20 bp, synthetic construct
  misc_feature 1..20: note = CRISPR gRNA sequence
  source 1..20: mol_type = other DNA
tggtctcgaactcctgacct

SEQ ID NO: 45425 - DNA, 20 bp, synthetic construct
  misc_feature 1..20: note = CRISPR gRNA sequence
  source 1..20: mol_type = other DNA
ggtctcgaactcctgacctc

SEQ ID NO: 45426 - DNA, 20 bp, synthetic construct
  misc_feature 1..20: note = CRISPR gRNA sequence
  source 1..20: mol_type = other DNA
ctcaggtgattcacccgcct

SEQ ID NO: 45427 - DNA, 20 bp, synthetic construct
  misc_feature 1..20: note = CRISPR gRNA sequence
  source 1..20: mol_type = other DNA
tcacccgccttggcctcaca

SEQ ID NO: 45428 - DNA, 20 bp, synthetic construct
  misc_feature 1..20: note = CRISPR gRNA sequence
  source 1..20: mol_type = other DNA
gccttggcctcacaaagtcc

SEQ ID NO: 45429 - DNA, 20 bp, synthetic construct
  misc_feature 1..20: note = CRISPR gRNA sequence
  source 1..20: mol_type = other DNA
ccttggcctcacaaagtcct

SEQ ID NO: 45430 - DNA, 20 bp, synthetic construct
  misc_feature 1..20: note = CRISPR gRNA sequence
  source 1..20: mol_type = other DNA
ctcacaaagtcctgggatta

SEQ ID NO: 45431 - DNA, 20 bp, synthetic construct
  misc_feature 1..20: note = CRISPR gRNA sequence
  source 1..20: mol_type = other DNA
tcacaaagtcctgggattac

SEQ ID NO: 45432 - DNA, 20 bp, synthetic construct
  misc_feature 1..20: note = CRISPR gRNA sequence
  source 1..20: mol_type = other DNA
agtcctgggattacaggcat

SEQ ID NO: 45433 - DNA, 20 bp, synthetic construct
  misc_feature 1..20: note = CRISPR gRNA sequence
  source 1..20: mol_type = other DNA
caggcatgagccattgcgcc

SEQ ID NO: 45434 - DNA, 20 bp, synthetic construct
  misc_feature 1..20: note = CRISPR gRNA sequence
  source 1..20: mol_type = other DNA
catgagccattgcgcccagc

SEQ ID NO: 45435 - DNA, 20 bp, synthetic construct
  misc_feature 1..20: note = CRISPR gRNA sequence
  source 1..20: mol_type = other DNA
cttaatgtgtgaactcgtgc

SEQ ID NO: 45436 - DNA, 20 bp, synthetic construct
  misc_feature 1..20: note = CRISPR gRNA sequence
  source 1..20: mol_type = other DNA
gtgaactcgtgccagtccct

SEQ ID NO: 45437 - DNA, 20 bp, synthetic construct
  misc_feature 1..20: note = CRISPR gRNA sequence
  source 1..20: mol_type = other DNA
ccctcagcctctctgttctt

SEQ ID NO: 45438 - DNA, 20 bp, synthetic construct
  misc_feature 1..20: note = CRISPR gRNA sequence
  source 1..20: mol_type = other DNA
ggcctcctcatcttaacttt

SEQ ID NO: 45439 - DNA, 20 bp, synthetic construct
  misc_feature 1..20: note = CRISPR gRNA sequence
  source 1..20: mol_type = other DNA
gcctcctcatcttaactttg

SEQ ID NO: 45440 - DNA, 20 bp, synthetic construct
  misc_feature 1..20: note = CRISPR gRNA sequence
  source 1..20: mol_type = other DNA
ctcatcttaactttgaggat

SEQ ID NO: 45441 - DNA, 20 bp, synthetic construct
  misc_feature 1..20: note = CRISPR gRNA sequence
  source 1..20: mol_type = other DNA
catcttaactttgaggataa

SEQ ID NO: 45442 - DNA, 20 bp, synthetic construct
  misc_feature 1..20: note = CRISPR gRNA sequence
  source 1..20: mol_type = other DNA
aagagcaatctcccctgcta

SEQ ID NO: 45443 - DNA, 20 bp, synthetic construct
  misc_feature 1..20: note = CRISPR gRNA sequence
  source 1..20: mol_type = other DNA
tcccctgctacggttgttgt

SEQ ID NO: 45444 - DNA, 20 bp, synthetic construct
  misc_feature 1..20: note = CRISPR gRNA sequence
  source 1..20: mol_type = other DNA
ggttgttgtgagtattaaat

SEQ ID NO: 45445 - DNA, 20 bp, synthetic construct
  misc_feature 1..20: note = CRISPR gRNA sequence
  source 1..20: mol_type = other DNA
aaatgagataatatgtgtta

SEQ ID NO: 45446 - DNA, 20 bp, synthetic construct
  misc_feature 1..20: note = CRISPR gRNA sequence
  source 1..20: mol_type = other DNA
gataatatgtgttacagtct

SEQ ID NO: 45447 - DNA, 20 bp, synthetic construct
  misc_feature 1..20: note = CRISPR gRNA sequence
  source 1..20: mol_type = other DNA
taatatgtgttacagtctta

SEQ ID NO: 45448 - DNA, 20 bp, synthetic construct
  misc_feature 1..20: note = CRISPR gRNA sequence
  source 1..20: mol_type = other DNA
tgtgttacagtcttagagtc

SEQ ID NO: 45449 - DNA, 20 bp, synthetic construct
  misc_feature 1..20: note = CRISPR gRNA sequence
  source 1..20: mol_type = other DNA
ttacagtcttagagtctggt

SEQ ID NO: 45450 - DNA, 20 bp, synthetic construct
  misc_feature 1..20: note = CRISPR gRNA sequence
  source 1..20: mol_type = other DNA
acagtcttagagtctggtca

SEQ ID NO: 45451 - DNA, 20 bp, synthetic construct
  misc_feature 1..20: note = CRISPR gRNA sequence
  source 1..20: mol_type = other DNA
ggtcagagttcacactctac

SEQ ID NO: 45452 - DNA, 20 bp, synthetic construct
  misc_feature 1..20: note = CRISPR gRNA sequence
  source 1..20: mol_type = other DNA
agttcacactctacaagtgc

SEQ ID NO: 45453 - DNA, 20 bp, synthetic construct
  misc_feature 1..20: note = CRISPR gRNA sequence
  source 1..20: mol_type = other DNA
tgttattctcctctcctgcc

SEQ ID NO: 45454 - DNA, 20 bp, synthetic construct
  misc_feature 1..20: note = CRISPR gRNA sequence
  source 1..20: mol_type = other DNA
gttattctcctctcctgcct

SEQ ID NO: 45455 - DNA, 20 bp, synthetic construct
  misc_feature 1..20: note = CRISPR gRNA sequence
  source 1..20: mol_type = other DNA
ttctcctctcctgcctaggc

SEQ ID NO: 45456 - DNA, 20 bp, synthetic construct
  misc_feature 1..20: note = CRISPR gRNA sequence
  source 1..20: mol_type = other DNA
tctcctctcctgcctaggct

SEQ ID NO: 45457 - DNA, 20 bp, synthetic construct
  misc_feature 1..20: note = CRISPR gRNA sequence
  source 1..20: mol_type = other DNA
ctcctctcctgcctaggctg

SEQ ID NO: 45458 - DNA, 20 bp, synthetic construct
  misc_feature 1..20: note = CRISPR gRNA sequence
  source 1..20: mol_type = other DNA
tcctctcctgcctaggctgg

SEQ ID NO: 45459 - DNA, 20 bp, synthetic construct
  misc_feature 1..20: note = CRISPR gRNA sequence
  source 1..20: mol_type = other DNA
ctgcctaggctgggggcctc

SEQ ID NO: 45460 - DNA, 20 bp, synthetic construct
  misc_feature 1..20: note = CRISPR gRNA sequence
  source 1..20: mol_type = other DNA
cctaggctgggggcctctag

SEQ ID NO: 45461 - DNA, 20 bp, synthetic construct
  misc_feature 1..20: note = CRISPR gRNA sequence
  source 1..20: mol_type = other DNA
cctctagaagtacaatcgcc

SEQ ID NO: 45462 - DNA, 20 bp, synthetic construct
  misc_feature 1..20: note = CRISPR gRNA sequence
  source 1..20: mol_type = other DNA
ctctagaagtacaatcgcct

SEQ ID NO: 45463 - DNA, 20 bp, synthetic construct
  misc_feature 1..20: note = CRISPR gRNA sequence
  source 1..20: mol_type = other DNA
acaatcgcctgggtcacata

SEQ ID NO: 45464 - DNA, 20 bp, synthetic construct
  misc_feature 1..20: note = CRISPR gRNA sequence
  source 1..20: mol_type = other DNA
tcgcctgggtcacatatggt

SEQ ID NO: 45465 - DNA, 20 bp, synthetic construct
  misc_feature 1..20: note = CRISPR gRNA sequence
  source 1..20: mol_type = other DNA
cgcctgggtcacatatggtt

SEQ ID NO: 45466 - DNA, 20 bp, synthetic construct
  misc_feature 1..20: note = CRISPR gRNA sequence
  source 1..20: mol_type = other DNA
gcctgggtcacatatggttg

SEQ ID NO: 45467 - DNA, 20 bp, synthetic construct
  misc_feature 1..20: note = CRISPR gRNA sequence
  source 1..20: mol_type = other DNA
ggtcacatatggttggggct

SEQ ID NO: 45468 - DNA, 20 bp, synthetic construct
  misc_feature 1..20: note = CRISPR gRNA sequence
  source 1..20: mol_type = other DNA
gtcacatatggttggggctc

SEQ ID NO: 45469 - DNA, 20 bp, synthetic construct
  misc_feature 1..20: note = CRISPR gRNA sequence
  source 1..20: mol_type = other DNA
atatggttggggctcaggaa

SEQ ID NO: 45470 - DNA, 20 bp, synthetic construct
  misc_feature 1..20: note = CRISPR gRNA sequence
  source 1..20: mol_type = other DNA
tatggttggggctcaggaat

SEQ ID NO: 45471 - DNA, 20 bp, synthetic construct
  misc_feature 1..20: note = CRISPR gRNA sequence
  source 1..20: mol_type = other DNA
tggttggggctcaggaatgg

SEQ ID NO: 45472 - DNA, 20 bp, synthetic construct
  misc_feature 1..20: note = CRISPR gRNA sequence
  source 1..20: mol_type = other DNA
gctcaggaatgggagttcta

SEQ ID NO: 45473 - DNA, 20 bp, synthetic construct
  misc_feature 1..20: note = CRISPR gRNA sequence
  source 1..20: mol_type = other DNA
aatgggagttctatagtttt

SEQ ID NO: 45474 - DNA, 20 bp, synthetic construct
  misc_feature 1..20: note = CRISPR gRNA sequence
  source 1..20: mol_type = other DNA
agtttttggttctgttcctg

SEQ ID NO: 45475 - DNA, 20 bp, synthetic construct
  misc_feature 1..20: note = CRISPR gRNA sequence
  source 1..20: mol_type = other DNA
ttttggttctgttcctgaag

SEQ ID NO: 45476 - DNA, 20 bp, synthetic construct
  misc_feature 1..20: note = CRISPR gRNA sequence
  source 1..20: mol_type = other DNA
gccactttgtgtatgacctt

SEQ ID NO: 45477 - DNA, 20 bp, synthetic construct
  misc_feature 1..20: note = CRISPR gRNA sequence
  source 1..20: mol_type = other DNA
ctttgtgtatgaccttaagc

SEQ ID NO: 45478 - DNA, 20 bp, synthetic construct
  misc_feature 1..20: note = CRISPR gRNA sequence
  source 1..20: mol_type = other DNA
ttctctaactctctgaacct

SEQ ID NO: 45479 - DNA, 20 bp, synthetic construct
  misc_feature 1..20: note = CRISPR gRNA sequence
  source 1..20: mol_type = other DNA
ggtgttcctcacctgtaaaa

SEQ ID NO: 45480 - DNA, 20 bp, synthetic construct
  misc_feature 1..20: note = CRISPR gRNA sequence
  source 1..20: mol_type = other DNA
gtgttcctcacctgtaaaat

SEQ ID NO: 45481 - DNA, 20 bp, synthetic construct
  misc_feature 1..20: note = CRISPR gRNA sequence
  source 1..20: mol_type = other DNA
tgttcctcacctgtaaaatg

SEQ ID NO: 45482 - DNA, 20 bp, synthetic construct
  misc_feature 1..20: note = CRISPR gRNA sequence
  source 1..20: mol_type = other DNA
cgataataaacccacctttc

SEQ ID NO: 45483 - DNA, 20 bp, synthetic construct
  misc_feature 1..20: note = CRISPR gRNA sequence
  source 1..20: mol_type = other DNA
aataaacccacctttccaga

SEQ ID NO: 45484 - DNA, 20 bp, synthetic construct
  misc_feature 1..20: note = CRISPR gRNA sequence
  source 1..20: mol_type = other DNA
ccacctttccagatggcccc

SEQ ID NO: 45485 - DNA, 20 bp, synthetic construct
  misc_feature 1..20: note = CRISPR gRNA sequence
  source 1..20: mol_type = other DNA
tccagatggccccaagccct

SEQ ID NO: 45486 - DNA, 20 bp, synthetic construct
  misc_feature 1..20: note = CRISPR gRNA sequence
  source 1..20: mol_type = other DNA
atggccccaagccctgagtt

SEQ ID NO: 45487 - DNA, 20 bp, synthetic construct
  misc_feature 1..20: note = CRISPR gRNA sequence
  source 1..20: mol_type = other DNA
atgtgtgaccgccattatta

SEQ ID NO: 45488 - DNA, 20 bp, synthetic construct
  misc_feature 1..20: note = CRISPR gRNA sequence
  source 1..20: mol_type = other DNA
ccgccattattacggatcat

SEQ ID NO: 45489 - DNA, 20 bp, synthetic construct
  misc_feature 1..20: note = CRISPR gRNA sequence
  source 1..20: mol_type = other DNA
ttattacggatcattagtct

SEQ ID NO: 45490 - DNA, 20 bp, synthetic construct
  misc_feature 1..20: note = CRISPR gRNA sequence
  source 1..20: mol_type = other DNA
atcattagtcttggtccatg

SEQ ID NO: 45491 - DNA, 20 bp, synthetic construct
  misc_feature 1..20: note = CRISPR gRNA sequence
  source 1..20: mol_type = other DNA
tagtcttggtccatgtggtt

SEQ ID NO: 45492 - DNA, 20 bp, synthetic construct
  misc_feature 1..20: note = CRISPR gRNA sequence
  source 1..20: mol_type = other DNA
ggtccatgtggttcagaaca

SEQ ID NO: 45493 - DNA, 20 bp, synthetic construct
  misc_feature 1..20: note = CRISPR gRNA sequence
  source 1..20: mol_type = other DNA
aactgctgcctgcctgacct

SEQ ID NO: 45494 - DNA, 20 bp, synthetic construct
  misc_feature 1..20: note = CRISPR gRNA sequence
  source 1..20: mol_type = other DNA
cctgacctcagtaattcatg

SEQ ID NO: 45495 - DNA, 20 bp, synthetic construct
  misc_feature 1..20: note = CRISPR gRNA sequence
  source 1..20: mol_type = other DNA
tgacctcagtaattcatgca

SEQ ID NO: 45496 - DNA, 20 bp, synthetic construct
  misc_feature 1..20: note = CRISPR gRNA sequence
  source 1..20: mol_type = other DNA
cagtaattcatgcagagaaa

SEQ ID NO: 45497 - DNA, 20 bp, synthetic construct
  misc_feature 1..20: note = CRISPR gRNA sequence
  source 1..20: mol_type = other DNA
tcatgcagagaaacagcatt

SEQ ID NO: 45498 - DNA, 20 bp, synthetic construct
  misc_feature 1..20: note = CRISPR gRNA sequence
  source 1..20: mol_type = other DNA
gaaacagcatttggacctcc

SEQ ID NO: 45499 - DNA, 20 bp, synthetic construct
  misc_feature 1..20: note = CRISPR gRNA sequence
  source 1..20: mol_type = other DNA
agcatttggacctcccagta

SEQ ID NO: 45500 - DNA, 20 bp, synthetic construct
  misc_feature 1..20: note = CRISPR gRNA sequence
  source 1..20: mol_type = other DNA
tcccagtacagttcattttg

SEQ ID NO: 45501 - DNA, 20 bp, synthetic construct
  misc_feature 1..20: note = CRISPR gRNA sequence
  source 1..20: mol_type = other DNA
tgtagaatttttacactgtg

SEQ ID NO: 45502 - DNA, 20 bp, synthetic construct
  misc_feature 1..20: note = CRISPR gRNA sequence
  source 1..20: mol_type = other DNA
tttttacactgtgtggatat

SEQ ID NO: 45503 - DNA, 20 bp, synthetic construct
  misc_feature 1..20: note = CRISPR gRNA sequence
  source 1..20: mol_type = other DNA
ttacactgtgtggatataag

SEQ ID NO: 45504 - DNA, 20 bp, synthetic construct
  misc_feature 1..20: note = CRISPR gRNA sequence
  source 1..20: mol_type = other DNA
gtggatataagtggctgtct

SEQ ID NO: 45505 - DNA, 20 bp, synthetic construct
  misc_feature 1..20: note = CRISPR gRNA sequence
  source 1..20: mol_type = other DNA
ggatataagtggctgtcttg

SEQ ID NO: 45506 - DNA, 20 bp, synthetic construct
  misc_feature 1..20: note = CRISPR gRNA sequence
  source 1..20: mol_type = other DNA
gatataagtggctgtcttgg

SEQ ID NO: 45507 - DNA, 20 bp, synthetic construct
  misc_feature 1..20: note = CRISPR gRNA sequence
  source 1..20: mol_type = other DNA
gtggctgtcttggaggtccc

SEQ ID NO: 45508 - DNA, 20 bp, synthetic construct
  misc_feature 1..20: note = CRISPR gRNA sequence
  source 1..20: mol_type = other DNA
tggctgtcttggaggtccct

SEQ ID NO: 45509 - DNA, 20 bp, synthetic construct
  misc_feature 1..20: note = CRISPR gRNA sequence
  source 1..20: mol_type = other DNA
tggaggtccctaggcttgct

SEQ ID NO: 45510 - DNA, 20 bp, synthetic construct
  misc_feature 1..20: note = CRISPR gRNA sequence
  source 1..20: mol_type = other DNA
gtccctaggcttgctaagca

SEQ ID NO: 45511 - DNA, 20 bp, synthetic construct
  misc_feature 1..20: note = CRISPR gRNA sequence
  source 1..20: mol_type = other DNA
ccctaggcttgctaagcaca

SEQ ID NO: 45512 - DNA, 20 bp, synthetic construct
  misc_feature 1..20: note = CRISPR gRNA sequence
  source 1..20: mol_type = other DNA
cctaggcttgctaagcacag

SEQ ID NO: 45513 - DNA, 20 bp, synthetic construct
  misc_feature 1..20: note = CRISPR gRNA sequence
  source 1..20: mol_type = other DNA
cttgctaagcacagaggcct

SEQ ID NO: 45514 - DNA, 20 bp, synthetic construct
  misc_feature 1..20: note = CRISPR gRNA sequence
  source 1..20: mol_type = other DNA
gcacagaggcctcagacccc

SEQ ID NO: 45515 - DNA, 20 bp, synthetic construct
  misc_feature 1..20: note = CRISPR gRNA sequence
  source 1..20: mol_type = other DNA
gaggcctcagacccccagac

SEQ ID NO: 45516 - DNA, 20 bp, synthetic construct
  misc_feature 1..20: note = CRISPR gRNA sequence
  source 1..20: mol_type = other DNA
cctcagacccccagactgga

SEQ ID NO: 45517 - DNA, 20 bp, synthetic construct
  misc_feature 1..20: note = CRISPR gRNA sequence
  source 1..20: mol_type = other DNA
actggacagtgccccacccc

SEQ ID NO: 45518 - DNA, 20 bp, synthetic construct
  misc_feature 1..20: note = CRISPR gRNA sequence
  source 1..20: mol_type = other DNA
gtgccccacccccagatgtc

SEQ ID NO: 45519 - DNA, 20 bp, synthetic construct
  misc_feature 1..20: note = CRISPR gRNA sequence
  source 1..20: mol_type = other DNA
ccccagatgtcaagttcacc

SEQ ID NO: 45520 - DNA, 20 bp, synthetic construct
  misc_feature 1..20: note = CRISPR gRNA sequence
  source 1..20: mol_type = other DNA
tcacctggcctcctcttctc

SEQ ID NO: 45521 - DNA, 20 bp, synthetic construct
  misc_feature 1..20: note = CRISPR gRNA sequence
  source 1..20: mol_type = other DNA
ggcctcctcttctccagcct

SEQ ID NO: 45522 - DNA, 20 bp, synthetic construct
  misc_feature 1..20: note = CRISPR gRNA sequence
  source 1..20: mol_type = other DNA
ctcagtcaccttctgctgaa

SEQ ID NO: 45523 - DNA, 20 bp, synthetic construct
  misc_feature 1..20: note = CRISPR gRNA sequence
  source 1..20: mol_type = other DNA
tctgctgaacagctccacct

SEQ ID NO: 45524 - DNA, 20 bp, synthetic construct
  misc_feature 1..20: note = CRISPR gRNA sequence
  source 1..20: mol_type = other DNA
accttggccttgcttactca

SEQ ID NO: 45525 - DNA, 20 bp, synthetic construct
  misc_feature 1..20: note = CRISPR gRNA sequence
  source 1..20: mol_type = other DNA
gccttgcttactcacagact

SEQ ID NO: 45526 - DNA, 20 bp, synthetic construct
  misc_feature 1..20: note = CRISPR gRNA sequence
  source 1..20: mol_type = other DNA
tgcttactcacagactaagc

SEQ ID NO: 45527 - DNA, 20 bp, synthetic construct
  misc_feature 1..20: note = CRISPR gRNA sequence
  source 1..20: mol_type = other DNA
taagccagatgacctgcctg

SEQ ID NO: 45528 - DNA, 20 bp, synthetic construct
  misc_feature 1..20: note = CRISPR gRNA sequence
  source 1..20: mol_type = other DNA
agccagatgacctgcctgca

SEQ ID NO: 45529 - DNA, 20 bp, synthetic construct
  misc_feature 1..20: note = CRISPR gRNA sequence
  source 1..20: mol_type = other DNA
atgacctgcctgcagagcct

SEQ ID NO: 45530 - DNA, 20 bp, synthetic construct
  misc_feature 1..20: note = CRISPR gRNA sequence
  source 1..20: mol_type = other DNA
tgacctgcctgcagagcctc

SEQ ID NO: 45531 - DNA, 20 bp, synthetic construct
  misc_feature 1..20: note = CRISPR gRNA sequence
  source 1..20: mol_type = other DNA
ctgcctgcagagcctcaggt

SEQ ID NO: 45532 - DNA, 20 bp, synthetic construct
  misc_feature 1..20: note = CRISPR gRNA sequence
  source 1..20: mol_type = other DNA
agagcctcaggtgagtgacc

SEQ ID NO: 45533 - DNA, 20 bp, synthetic construct
  misc_feature 1..20: note = CRISPR gRNA sequence
  source 1..20: mol_type = other DNA
gcctcaggtgagtgaccgag

SEQ ID NO: 45534 - DNA, 20 bp, synthetic construct
  misc_feature 1..20: note = CRISPR gRNA sequence
  source 1..20: mol_type = other DNA
tgagtgaccgagcggcccca

SEQ ID NO: 45535 - DNA, 20 bp, synthetic construct
  misc_feature 1..20: note = CRISPR gRNA sequence
  source 1..20: mol_type = other DNA
gagtgaccgagcggccccat

SEQ ID NO: 45536 - DNA, 20 bp, synthetic construct
  misc_feature 1..20: note = CRISPR gRNA sequence
  source 1..20: mol_type = other DNA
ccgagcggccccatgggaat

SEQ ID NO: 45537 - DNA, 20 bp, synthetic construct
  misc_feature 1..20: note = CRISPR gRNA sequence
  source 1..20: mol_type = other DNA
agcggccccatgggaatgag

SEQ ID NO: 45538 - DNA, 20 bp, synthetic construct
  misc_feature 1..20: note = CRISPR gRNA sequence
  source 1..20: mol_type = other DNA
gcggccccatgggaatgagt

SEQ ID NO: 45539 - DNA, 20 bp, synthetic construct
  misc_feature 1..20: note = CRISPR gRNA sequence
  source 1..20: mol_type = other DNA
gccccatgggaatgagtggg

SEQ ID NO: 45540 - DNA, 20 bp, synthetic construct
  misc_feature 1..20: note = CRISPR gRNA sequence
  source 1..20: mol_type = other DNA
gggaagaaacacttcccact

SEQ ID NO: 45541 - DNA, 20 bp, synthetic construct
  misc_feature 1..20: note = CRISPR gRNA sequence
  source 1..20: mol_type = other DNA
agaaacacttcccactcagt

SEQ ID NO: 45542 - DNA, 20 bp, synthetic construct
  misc_feature 1..20: note = CRISPR gRNA sequence
  source 1..20: mol_type = other DNA
gaaacacttcccactcagtt

SEQ ID NO: 45543 - DNA, 20 bp, synthetic construct
  misc_feature 1..20: note = CRISPR gRNA sequence
  source 1..20: mol_type = other DNA
cactcagttgggaccacatc

SEQ ID NO: 45544 - DNA, 20 bp, synthetic construct
  misc_feature 1..20: note = CRISPR gRNA sequence
  source 1..20: mol_type = other DNA
actcagttgggaccacatcc

SEQ ID NO: 45545 - DNA, 20 bp, synthetic construct
  misc_feature 1..20: note = CRISPR gRNA sequence
  source 1..20: mol_type = other DNA
ctcagttgggaccacatcca

SEQ ID NO: 45546 - DNA, 20 bp, synthetic construct
  misc_feature 1..20: note = CRISPR gRNA sequence
  source 1..20: mol_type = other DNA
agttgggaccacatccaggg

SEQ ID NO: 45547 - DNA, 20 bp, synthetic construct
  misc_feature 1..20: note = CRISPR gRNA sequence
  source 1..20: mol_type = other DNA
accacatccagggaagcact

SEQ ID NO: 45548 - DNA, 20 bp, synthetic construct
  misc_feature 1..20: note = CRISPR gRNA sequence
  source 1..20: mol_type = other DNA
ccacatccagggaagcactg

SEQ ID NO: 45549 - DNA, 20 bp, synthetic construct
  misc_feature 1..20: note = CRISPR gRNA sequence
  source 1..20: mol_type = other DNA
gaagcactgaggccacctcc

SEQ ID NO: 45550 - DNA, 20 bp, synthetic construct
  misc_feature 1..20: note = CRISPR gRNA sequence
  source 1..20: mol_type = other DNA
aagcactgaggccacctccc

SEQ ID NO: 45551 - DNA, 20 bp, synthetic construct
  misc_feature 1..20: note = CRISPR gRNA sequence
  source 1..20: mol_type = other DNA
agcactgaggccacctccca

SEQ ID NO: 45552 - DNA, 20 bp, synthetic construct
  misc_feature 1..20: note = CRISPR gRNA sequence
  source 1..20: mol_type = other DNA
gcactgaggccacctcccag

SEQ ID NO: 45553 - DNA, 20 bp, synthetic construct
  misc_feature 1..20: note = CRISPR gRNA sequence
  source 1..20: mol_type = other DNA
acctcccaggggatcctttg

SEQ ID NO: 45554 - DNA, 20 bp, synthetic construct
  misc_feature 1..20: note = CRISPR gRNA sequence
  source 1..20: mol_type = other DNA
gatcctttgcggatccctcc

SEQ ID NO: 45555 - DNA, 20 bp, synthetic construct
  misc_feature 1..20: note = CRISPR gRNA sequence
  source 1..20: mol_type = other DNA
atcctttgcggatccctccc

SEQ ID NO: 45556 - DNA, 20 bp, synthetic construct
  misc_feature 1..20: note = CRISPR gRNA sequence
  source 1..20: mol_type = other DNA
ggcccatccctgtgccctcc

SEQ ID NO: 45557 - DNA, 20 bp, synthetic construct
  misc_feature 1..20: note = CRISPR gRNA sequence
  source 1..20: mol_type = other DNA
gcccatccctgtgccctccc

SEQ ID NO: 45558 - DNA, 20 bp, synthetic construct
  misc_feature 1..20: note = CRISPR gRNA sequence
  source 1..20: mol_type = other DNA
catccctgtgccctcccagg

SEQ ID NO: 45559 - DNA, 20 bp, synthetic construct
  misc_feature 1..20: note = CRISPR gRNA sequence
  source 1..20: mol_type = other DNA
atccctgtgccctcccaggt

SEQ ID NO: 45560 - DNA, 20 bp, synthetic construct
  misc_feature 1..20: note = CRISPR gRNA sequence
  source 1..20: mol_type = other DNA
ctcttgccttctaatgccat

SEQ ID NO: 45561 - DNA, 20 bp, synthetic construct
  misc_feature 1..20: note = CRISPR gRNA sequence
  source 1..20: mol_type = other DNA
taatgccatcagcttcctcc

SEQ ID NO: 45562 - DNA, 20 bp, synthetic construct
  misc_feature 1..20: note = CRISPR gRNA sequence
  source 1..20: mol_type = other DNA
cagcttcctcctggttacaa

SEQ ID NO: 45563 - DNA, 20 bp, synthetic construct
  misc_feature 1..20: note = CRISPR gRNA sequence
  source 1..20: mol_type = other DNA
cttcctcctggttacaaaag

SEQ ID NO: 45564 - DNA, 20 bp, synthetic construct
  misc_feature 1..20: note = CRISPR gRNA sequence
  source 1..20: mol_type = other DNA
ctggttacaaaagtggccta

SEQ ID NO: 45565 - DNA, 20 bp, synthetic construct
  misc_feature 1..20: note = CRISPR gRNA sequence
  source 1..20: mol_type = other DNA
tggttacaaaagtggcctaa

SEQ ID NO: 45566 - DNA, 20 bp, synthetic construct
  misc_feature 1..20: note = CRISPR gRNA sequence
  source 1..20: mol_type = other DNA
ggttacaaaagtggcctaaa

SEQ ID NO: 45567 - DNA, 20 bp, synthetic construct
  misc_feature 1..20: note = CRISPR gRNA sequence
  source 1..20: mol_type = other DNA
caaaagtggcctaaagggct

SEQ ID NO: 45568 - DNA, 20 bp, synthetic construct
  misc_feature 1..20: note = CRISPR gRNA sequence
  source 1..20: mol_type = other DNA
aaaagtggcctaaagggctt

SEQ ID NO: 45569 - DNA, 20 bp, synthetic construct
  misc_feature 1..20: note = CRISPR gRNA sequence
  source 1..20: mol_type = other DNA
aagggcttaggcccacgtcg

SEQ ID NO: 45570 - DNA, 20 bp, synthetic construct
  misc_feature 1..20: note = CRISPR gRNA sequence
  source 1..20: mol_type = other DNA
cacgtcgtagaacaaccctt

SEQ ID NO: 45571 - DNA, 20 bp, synthetic construct
  misc_feature 1..20: note = CRISPR gRNA sequence
  source 1..20: mol_type = other DNA
acgtcgtagaacaacccttg

SEQ ID NO: 45572 - DNA, 20 bp, synthetic construct
  misc_feature 1..20: note = CRISPR gRNA sequence
  source 1..20: mol_type = other DNA
caacccttgaggcacacaca

SEQ ID NO: 45573 - DNA, 20 bp, synthetic construct
  misc_feature 1..20: note = CRISPR gRNA sequence
  source 1..20: mol_type = other DNA
ggcacacacacagttcaccc

SEQ ID NO: 45574 - DNA, 20 bp, synthetic construct
  misc_feature 1..20: note = CRISPR gRNA sequence
  source 1..20: mol_type = other DNA
gcacacacacagttcaccct

SEQ ID NO: 45575 - DNA, 20 bp, synthetic construct
  misc_feature 1..20: note = CRISPR gRNA sequence
  source 1..20: mol_type = other DNA
aaatgctcattctgattccc

SEQ ID NO: 45576 - DNA, 20 bp, synthetic construct
  misc_feature 1..20: note = CRISPR gRNA sequence
  source 1..20: mol_type = other DNA
aatgctcattctgattcccc

SEQ ID NO: 45577 - DNA, 20 bp, synthetic construct
  misc_feature 1..20: note = CRISPR gRNA sequence
  source 1..20: mol_type = other DNA
tcattctgattccccaggtc

SEQ ID NO: 45578 - DNA, 20 bp, synthetic construct
  misc_feature 1..20: note = CRISPR gRNA sequence
  source 1..20: mol_type = other DNA
cccaggtctggaattctgcc

SEQ ID NO: 45579 - DNA, 20 bp, synthetic construct
  misc_feature 1..20: note = CRISPR gRNA sequence
  source 1..20: mol_type = other DNA
tttttttttttttttttttt

SEQ ID NO: 45580 - DNA, 20 bp, synthetic construct
  misc_feature 1..20: note = CRISPR gRNA sequence
  source 1..20: mol_type = other DNA
ttttttttttttttttgagt

SEQ ID NO: 45581 - DNA, 20 bp, synthetic construct
  misc_feature 1..20: note = CRISPR gRNA sequence
  source 1..20: mol_type = other DNA
tttttttttttttttgagtt

SEQ ID NO: 45582 - DNA, 20 bp, synthetic construct
  misc_feature 1..20: note = CRISPR gRNA sequence
  source 1..20: mol_type = other DNA
ttttttttttttttgagttg

SEQ ID NO: 45583 - DNA, 20 bp, synthetic construct
  misc_feature 1..20: note = CRISPR gRNA sequence
  source 1..20: mol_type = other DNA
tgagttggggcctcactgtg

SEQ ID NO: 45584 - DNA, 20 bp, synthetic construct
  misc_feature 1..20: note = CRISPR gRNA sequence
  source 1..20: mol_type = other DNA
tggggcctcactgtgtggcc

SEQ ID NO: 45585 - DNA, 20 bp, synthetic construct
  misc_feature 1..20: note = CRISPR gRNA sequence
  source 1..20: mol_type = other DNA
ggggcctcactgtgtggccc

SEQ ID NO: 45586 - DNA, 20 bp, synthetic construct
  misc_feature 1..20: note = CRISPR gRNA sequence
  source 1..20: mol_type = other DNA
cctcactgtgtggcccaggc

SEQ ID NO: 45587 - DNA, 20 bp, synthetic construct
  misc_feature 1..20: note = CRISPR gRNA sequence
  source 1..20: mol_type = other DNA
tcactgtgtggcccaggctg

SEQ ID NO: 45588 - DNA, 20 bp, synthetic construct
  misc_feature 1..20: note = CRISPR gRNA sequence
  source 1..20: mol_type = other DNA
gtgtggcccaggctggagtg

SEQ ID NO: 45589 - DNA, 20 bp, synthetic construct
  misc_feature 1..20: note = CRISPR gRNA sequence
  source 1..20: mol_type = other DNA
tggcccaggctggagtgcag

SEQ ID NO: 45590 - DNA, 20 bp, synthetic construct
  misc_feature 1..20: note = CRISPR gRNA sequence
  source 1..20: mol_type = other DNA
tggagtgcagtggcaatgca

SEQ ID NO: 45591 - DNA, 20 bp, synthetic construct
  misc_feature 1..20: note = CRISPR gRNA sequence
  source 1..20: mol_type = other DNA
ggagtgcagtggcaatgcac

SEQ ID NO: 45592 - DNA, 20 bp, synthetic construct
  misc_feature 1..20: note = CRISPR gRNA sequence
  source 1..20: mol_type = other DNA
ggtgcaatcgtgttgcactg

SEQ ID NO: 45593 - DNA, 20 bp, synthetic construct
  misc_feature 1..20: note = CRISPR gRNA sequence
  source 1..20: mol_type = other DNA
gcactgcagcctcaaactcc

SEQ ID NO: 45594 - DNA, 20 bp, synthetic construct
  misc_feature 1..20: note = CRISPR gRNA sequence
  source 1..20: mol_type = other DNA
cactgcagcctcaaactcct

SEQ ID NO: 45595 - DNA, 20 bp, synthetic construct
  misc_feature 1..20: note = CRISPR gRNA sequence
  source 1..20: mol_type = other DNA
tcctcctgcctcaccctcct

SEQ ID NO: 45596 - DNA, 20 bp, synthetic construct
  misc_feature 1..20: note = CRISPR gRNA sequence
  source 1..20: mol_type = other DNA
tcctgcctcaccctcctaag

SEQ ID NO: 45597 - DNA, 20 bp, synthetic construct
  misc_feature 1..20: note = CRISPR gRNA sequence
  source 1..20: mol_type = other DNA
gcctcaccctcctaagcagc

SEQ ID NO: 45598 - DNA, 20 bp, synthetic construct
  misc_feature 1..20: note = CRISPR gRNA sequence
  source 1..20: mol_type = other DNA
cctcaccctcctaagcagct

SEQ ID NO: 45599 - DNA, 20 bp, synthetic construct
  misc_feature 1..20: note = CRISPR gRNA sequence
  source 1..20: mol_type = other DNA
ctcctaagcagctgggacta

SEQ ID NO: 45600 - DNA, 20 bp, synthetic construct
  misc_feature 1..20: note = CRISPR gRNA sequence
  source 1..20: mol_type = other DNA
tcctaagcagctgggactac

SEQ ID NO: 45601 - DNA, 20 bp, synthetic construct
  misc_feature 1..20: note = CRISPR gRNA sequence
  source 1..20: mol_type = other DNA
gcagctgggactacaggcct

SEQ ID NO: 45602 - DNA, 20 bp, synthetic construct
  misc_feature 1..20: note = CRISPR gRNA sequence
  source 1..20: mol_type = other DNA
cagctgggactacaggccta

SEQ ID NO: 45603 - DNA, 20 bp, synthetic construct
  misc_feature 1..20: note = CRISPR gRNA sequence
  source 1..20: mol_type = other DNA
taaggcgttgcacccaaact

SEQ ID NO: 45604 - DNA, 20 bp, synthetic construct
  misc_feature 1..20: note = CRISPR gRNA sequence
  source 1..20: mol_type = other DNA
ttttttgtttgtttgttttt

SEQ ID NO: 45605 - DNA, 20 bp, synthetic construct
  misc_feature 1..20: note = CRISPR gRNA sequence
  source 1..20: mol_type = other DNA
ttgtttgtttgtttttgaga

SEQ ID NO: 45606 - DNA, 20 bp, synthetic construct
  misc_feature 1..20: note = CRISPR gRNA sequence
  source 1..20: mol_type = other DNA
gtttgtttgtttttgagaca

SEQ ID NO: 45607 - DNA, 20 bp, synthetic construct
  misc_feature 1..20: note = CRISPR gRNA sequence
  source 1..20: mol_type = other DNA
agagtttcgctcttgttgcc

SEQ ID NO: 45608 - DNA, 20 bp, synthetic construct
  misc_feature 1..20: note = CRISPR gRNA sequence
  source 1..20: mol_type = other DNA
gagtttcgctcttgttgccc

SEQ ID NO: 45609 - DNA, 20 bp, synthetic construct
  misc_feature 1..20: note = CRISPR gRNA sequence
  source 1..20: mol_type = other DNA
ttcgctcttgttgcccaggc

SEQ ID NO: 45610 - DNA, 20 bp, synthetic construct
  misc_feature 1..20: note = CRISPR gRNA sequence
  source 1..20: mol_type = other DNA
cgctcttgttgcccaggctg

SEQ ID NO: 45611 - DNA, 20 bp, synthetic construct
  misc_feature 1..20: note = CRISPR gRNA sequence
  source 1..20: mol_type = other DNA
ttgcccaggctggagtgcaa

SEQ ID NO: 45612 - DNA, 20 bp, synthetic construct
  misc_feature 1..20: note = CRISPR gRNA sequence
  source 1..20: mol_type = other DNA
ggagtgcaatggcacaatct

SEQ ID NO: 45613 - DNA, 20 bp, synthetic construct
  misc_feature 1..20: note = CRISPR gRNA sequence
  source 1..20: mol_type = other DNA
tcactgcaacctccgcctcc

SEQ ID NO: 45614 - DNA, 20 bp, synthetic construct
  misc_feature 1..20: note = CRISPR gRNA sequence
  source 1..20: mol_type = other DNA
cactgcaacctccgcctccc

SEQ ID NO: 45615 - DNA, 20 bp, synthetic construct
  misc_feature 1..20: note = CRISPR gRNA sequence
  source 1..20: mol_type = other DNA
aacctccgcctcccgggttc

SEQ ID NO: 45616 - DNA, 20 bp, synthetic construct
  misc_feature 1..20: note = CRISPR gRNA sequence
  source 1..20: mol_type = other DNA
ttcaagcgattctcctgcct

SEQ ID NO: 45617 - DNA, 20 bp, synthetic construct
  misc_feature 1..20: note = CRISPR gRNA sequence
  source 1..20: mol_type = other DNA
ttctcctgcctcagcctccc

SEQ ID NO: 45618 - DNA, 20 bp, synthetic construct
  misc_feature 1..20: note = CRISPR gRNA sequence
  source 1..20: mol_type = other DNA
tcctgcctcagcctcccgag

SEQ ID NO: 45619 - DNA, 20 bp, synthetic construct
  misc_feature 1..20: note = CRISPR gRNA sequence
  source 1..20: mol_type = other DNA
gcctcagcctcccgagtagc

SEQ ID NO: 45620 - DNA, 20 bp, synthetic construct
  misc_feature 1..20: note = CRISPR gRNA sequence
  source 1..20: mol_type = other DNA
cctcagcctcccgagtagcc

SEQ ID NO: 45621 - DNA, 20 bp, synthetic construct
  misc_feature 1..20: note = CRISPR gRNA sequence
  source 1..20: mol_type = other DNA
ctcccgagtagccgggatta

SEQ ID NO: 45622 - DNA, 20 bp, synthetic construct
  misc_feature 1..20: note = CRISPR gRNA sequence
  source 1..20: mol_type = other DNA
tcccgagtagccgggattat

SEQ ID NO: 45623 - DNA, 20 bp, synthetic construct
  misc_feature 1..20: note = CRISPR gRNA sequence
  source 1..20: mol_type = other DNA
taggcatgtgccaccacgcc

SEQ ID NO: 45624 - DNA, 20 bp, synthetic construct
  misc_feature 1..20: note = CRISPR gRNA sequence
  source 1..20: mol_type = other DNA
ccggctaatttttgtatttt

SEQ ID NO: 45625 - DNA, 20 bp, synthetic construct
  misc_feature 1..20: note = CRISPR gRNA sequence
  source 1..20: mol_type = other DNA
gctaatttttgtatttttgg

SEQ ID NO: 45626 - DNA, 20 bp, synthetic construct
  misc_feature 1..20: note = CRISPR gRNA sequence
  source 1..20: mol_type = other DNA
taatttttgtatttttggta

SEQ ID NO: 45627 - DNA, 20 bp, synthetic construct
  misc_feature 1..20: note = CRISPR gRNA sequence
  source 1..20: mol_type = other DNA
ttttgtatttttggtagaga

SEQ ID NO: 45628 - DNA, 20 bp, synthetic construct
  misc_feature 1..20: note = CRISPR gRNA sequence
  source 1..20: mol_type = other DNA
gagacagtgtttctccatgt

SEQ ID NO: 45629 - DNA, 20 bp, synthetic construct
  misc_feature 1..20: note = CRISPR gRNA sequence
  source 1..20: mol_type = other DNA
cagtgtttctccatgttggt

SEQ ID NO: 45630 - DNA, 20 bp, synthetic construct
  misc_feature 1..20: note = CRISPR gRNA sequence
  source 1..20: mol_type = other DNA
agtgtttctccatgttggtc

SEQ ID NO: 45631 - DNA, 20 bp, synthetic construct
  misc_feature 1..20: note = CRISPR gRNA sequence
  source 1..20: mol_type = other DNA
tttctccatgttggtcaggc

SEQ ID NO: 45632 - DNA, 20 bp, synthetic construct
  misc_feature 1..20: note = CRISPR gRNA sequence
  source 1..20: mol_type = other DNA
tggtcttgaacgtccaacct

SEQ ID NO: 45633 - DNA, 20 bp, synthetic construct
  misc_feature 1..20: note = CRISPR gRNA sequence
  source 1..20: mol_type = other DNA
ggtcttgaacgtccaacctc

SEQ ID NO: 45634 - DNA, 20 bp, synthetic construct
  misc_feature 1..20: note = CRISPR gRNA sequence
  source 1..20: mol_type = other DNA
ctcaggtgatctgcccacct

SEQ ID NO: 45635 - DNA, 20 bp, synthetic construct
  misc_feature 1..20: note = CRISPR gRNA sequence
  source 1..20: mol_type = other DNA
ctgcccacctcggcctccca

SEQ ID NO: 45636 - DNA, 20 bp, synthetic construct
  misc_feature 1..20: note = CRISPR gRNA sequence
  source 1..20: mol_type = other DNA
acctcggcctcccaaagtgc

SEQ ID NO: 45637 - DNA, 20 bp, synthetic construct
  misc_feature 1..20: note = CRISPR gRNA sequence
  source 1..20: mol_type = other DNA
cctcggcctcccaaagtgct

SEQ ID NO: 45638 - DNA, 20 bp, synthetic construct
  misc_feature 1..20: note = CRISPR gRNA sequence
  source 1..20: mol_type = other DNA
ctcccaaagtgctgggatta

SEQ ID NO: 45639 - DNA, 20 bp, synthetic construct
  misc_feature 1..20: note = CRISPR gRNA sequence
  source 1..20: mol_type = other DNA
tcccaaagtgctgggattac

SEQ ID NO: 45640 - DNA, 20 bp, synthetic construct
  misc_feature 1..20: note = CRISPR gRNA sequence
  source 1..20: mol_type = other DNA
agtgctgggattacaggcgt

SEQ ID NO: 45641 - DNA, 20 bp, synthetic construct
  misc_feature 1..20: note = CRISPR gRNA sequence
  source 1..20: mol_type = other DNA
caggcgtgagccaccacgcc

SEQ ID NO: 45642 - DNA, 20 bp, synthetic construct
  misc_feature 1..20: note = CRISPR gRNA sequence
  source 1..20: mol_type = other DNA
tgagccaccacgcctggctt

SEQ ID NO: 45643 - DNA, 20 bp, synthetic construct
  misc_feature 1..20: note = CRISPR gRNA sequence
  source 1..20: mol_type = other DNA
cagactctgcattttctaac

SEQ ID NO: 45644 - DNA, 20 bp, synthetic construct
  misc_feature 1..20: note = CRISPR gRNA sequence
  source 1..20: mol_type = other DNA
tgcattttctaacaagcttc

SEQ ID NO: 45645 - DNA, 20 bp, synthetic construct
  misc_feature 1..20: note = CRISPR gRNA sequence
  source 1..20: mol_type = other DNA
gcattttctaacaagcttcc

SEQ ID NO: 45646 - DNA, 20 bp, synthetic construct
  misc_feature 1..20: note = CRISPR gRNA sequence
  source 1..20: mol_type = other DNA
ttttctaacaagcttccggg

SEQ ID NO: 45647 - DNA, 20 bp, synthetic construct
  misc_feature 1..20: note = CRISPR gRNA sequence
  source 1..20: mol_type = other DNA
cttccgggtggtatcaattc

SEQ ID NO: 45648 - DNA, 20 bp, synthetic construct
  misc_feature 1..20: note = CRISPR gRNA sequence
  source 1..20: mol_type = other DNA
ttccgggtggtatcaattct

SEQ ID NO: 45649 - DNA, 20 bp, synthetic construct
  misc_feature 1..20: note = CRISPR gRNA sequence
  source 1..20: mol_type = other DNA
tccgggtggtatcaattctg

SEQ ID NO: 45650 - DNA, 20 bp, synthetic construct
  misc_feature 1..20: note = CRISPR gRNA sequence
  source 1..20: mol_type = other DNA
ccgggtggtatcaattctgg

SEQ ID NO: 45651 - DNA, 20 bp, synthetic construct
  misc_feature 1..20: note = CRISPR gRNA sequence
  source 1..20: mol_type = other DNA
ggtatcaattctgggggcca

SEQ ID NO: 45652 - DNA, 20 bp, synthetic construct
  misc_feature 1..20: note = CRISPR gRNA sequence
  source 1..20: mol_type = other DNA
tcaattctgggggccacggt

SEQ ID NO: 45653 - DNA, 20 bp, synthetic construct
  misc_feature 1..20: note = CRISPR gRNA sequence
  source 1..20: mol_type = other DNA
ggggccacggtcagcacttt

SEQ ID NO: 45654 - DNA, 20 bp, synthetic construct
  misc_feature 1..20: note = CRISPR gRNA sequence
  source 1..20: mol_type = other DNA
gccacggtcagcactttgag

SEQ ID NO: 45655 - DNA, 20 bp, synthetic construct
  misc_feature 1..20: note = CRISPR gRNA sequence
  source 1..20: mol_type = other DNA
ggtcagcactttgagtagtg

SEQ ID NO: 45656 - DNA, 20 bp, synthetic construct
  misc_feature 1..20: note = CRISPR gRNA sequence
  source 1..20: mol_type = other DNA
gtcagcactttgagtagtgt

SEQ ID NO: 45657 - DNA, 20 bp, synthetic construct
  misc_feature 1..20: note = CRISPR gRNA sequence
  source 1..20: mol_type = other DNA
cactttgagtagtgtgggtc

SEQ ID NO: 45658 - DNA, 20 bp, synthetic construct
  misc_feature 1..20: note = CRISPR gRNA sequence
  source 1..20: mol_type = other DNA
gagtagtgtgggtctagact

SEQ ID NO: 45659 - DNA, 20 bp, synthetic construct
  misc_feature 1..20: note = CRISPR gRNA sequence
  source 1..20: mol_type = other DNA
agtgtgggtctagactcaga

SEQ ID NO: 45660 - DNA, 20 bp, synthetic construct
  misc_feature 1..20: note = CRISPR gRNA sequence
  source 1..20: mol_type = other DNA
gtgtgggtctagactcagat

SEQ ID NO: 45661 - DNA, 20 bp, synthetic construct
  misc_feature 1..20: note = CRISPR gRNA sequence
  source 1..20: mol_type = other DNA
tgtgggtctagactcagatg

SEQ ID NO: 45662 - DNA, 20 bp, synthetic construct
  misc_feature 1..20: note = CRISPR gRNA sequence
  source 1..20: mol_type = other DNA
gggtctagactcagatgggg

SEQ ID NO: 45663 - DNA, 20 bp, synthetic construct
  misc_feature 1..20: note = CRISPR gRNA sequence
  source 1..20: mol_type = other DNA
gtgatttcactccctgctgc

SEQ ID NO: 45664 - DNA, 20 bp, synthetic construct
  misc_feature 1..20: note = CRISPR gRNA sequence
  source 1..20: mol_type = other DNA
tgatttcactccctgctgct

SEQ ID NO: 45665 - DNA, 20 bp, synthetic construct
  misc_feature 1..20: note = CRISPR gRNA sequence
  source 1..20: mol_type = other DNA
ttgtgactaaaaacaaatcc

SEQ ID NO: 45666 - DNA, 20 bp, synthetic construct
  misc_feature 1..20: note = CRISPR gRNA sequence
  source 1..20: mol_type = other DNA
tgactaaaaacaaatccaag

SEQ ID NO: 45667 - DNA, 20 bp, synthetic construct
  misc_feature 1..20: note = CRISPR gRNA sequence
  source 1..20: mol_type = other DNA
caaatccaagcagtgacaca

SEQ ID NO: 45668 - DNA, 20 bp, synthetic construct
  misc_feature 1..20: note = CRISPR gRNA sequence
  source 1..20: mol_type = other DNA
gcattgctttgtttatatcc

SEQ ID NO: 45669 - DNA, 20 bp, synthetic construct
  misc_feature 1..20: note = CRISPR gRNA sequence
  source 1..20: mol_type = other DNA
acacctcctaccccctacct

SEQ ID NO: 45670 - DNA, 20 bp, synthetic construct
  misc_feature 1..20: note = CRISPR gRNA sequence
  source 1..20: mol_type = other DNA
cacctcctaccccctacctc

SEQ ID NO: 45671 - DNA, 20 bp, synthetic construct
  misc_feature 1..20: note = CRISPR gRNA sequence
  source 1..20: mol_type = other DNA
ctcctaccccctacctcggg

SEQ ID NO: 45672 - DNA, 20 bp, synthetic construct
  misc_feature 1..20: note = CRISPR gRNA sequence
  source 1..20: mol_type = other DNA
cctaccccctacctcgggca

SEQ ID NO: 45673 - DNA, 20 bp, synthetic construct
  misc_feature 1..20: note = CRISPR gRNA sequence
  source 1..20: mol_type = other DNA
accccctacctcgggcagag

SEQ ID NO: 45674 - DNA, 20 bp, synthetic construct
  misc_feature 1..20: note = CRISPR gRNA sequence
  source 1..20: mol_type = other DNA
cccctacctcgggcagagca

SEQ ID NO: 45675 - DNA, 20 bp, synthetic construct
  misc_feature 1..20: note = CRISPR gRNA sequence
  source 1..20: mol_type = other DNA
ctacctcgggcagagcagag

SEQ ID NO: 45676 - DNA, 20 bp, synthetic construct
  misc_feature 1..20: note = CRISPR gRNA sequence
  source 1..20: mol_type = other DNA
tacctcgggcagagcagagt

SEQ ID NO: 45677 - DNA, 20 bp, synthetic construct
  misc_feature 1..20: note = CRISPR gRNA sequence
  source 1..20: mol_type = other DNA
ctcgggcagagcagagtagg

SEQ ID NO: 45678 - DNA, 20 bp, synthetic construct
  misc_feature 1..20: note = CRISPR gRNA sequence
  source 1..20: mol_type = other DNA
tcgggcagagcagagtaggt

SEQ ID NO: 45679 - DNA, 20 bp, synthetic construct
  misc_feature 1..20: note = CRISPR gRNA sequence
  source 1..20: mol_type = other DNA
gagcagagtaggtaggaaat

SEQ ID NO: 45680 - DNA, 20 bp, synthetic construct
  misc_feature 1..20: note = CRISPR gRNA sequence
  source 1..20: mol_type = other DNA
agcagagtaggtaggaaatg

SEQ ID NO: 45681 - DNA, 20 bp, synthetic construct
  misc_feature 1..20: note = CRISPR gRNA sequence
  source 1..20: mol_type = other DNA
gagtaggtaggaaatgaggt

SEQ ID NO: 45682 - DNA, 20 bp, synthetic construct
  misc_feature 1..20: note = CRISPR gRNA sequence
  source 1..20: mol_type = other DNA
gtaggtaggaaatgaggtta

SEQ ID NO: 45683 - DNA, 20 bp, synthetic construct
  misc_feature 1..20: note = CRISPR gRNA sequence
  source 1..20: mol_type = other DNA
aggtaggaaatgaggttaga

SEQ ID NO: 45684 - DNA, 20 bp, synthetic construct
  misc_feature 1..20: note = CRISPR gRNA sequence
  source 1..20: mol_type = other DNA
gaaatgaggttagagagttc

SEQ ID NO: 45685 - DNA, 20 bp, synthetic construct
  misc_feature 1..20: note = CRISPR gRNA sequence
  source 1..20: mol_type = other DNA
aaatgaggttagagagttcc

SEQ ID NO: 45686 - DNA, 20 bp, synthetic construct
  misc_feature 1..20: note = CRISPR gRNA sequence
  source 1..20: mol_type = other DNA
atgaggttagagagttccag

SEQ ID NO: 45687 - DNA, 20 bp, synthetic construct
  misc_feature 1..20: note = CRISPR gRNA sequence
  source 1..20: mol_type = other DNA
tgaggttagagagttccagg

SEQ ID NO: 45688 - DNA, 20 bp, synthetic construct
  misc_feature 1..20: note = CRISPR gRNA sequence
  source 1..20: mol_type = other DNA
tccaggaggttatatcatat

SEQ ID NO: 45689 - DNA, 20 bp, synthetic construct
  misc_feature 1..20: note = CRISPR gRNA sequence
  source 1..20: mol_type = other DNA
acccaaaattaatttactga

SEQ ID NO: 45690 - DNA, 20 bp, synthetic construct
  misc_feature 1..20: note = CRISPR gRNA sequence
  source 1..20: mol_type = other DNA
cccaaaattaatttactgaa

SEQ ID NO: 45691 - DNA, 20 bp, synthetic construct
  misc_feature 1..20: note = CRISPR gRNA sequence
  source 1..20: mol_type = other DNA
tactgaaaggtgatccatta

SEQ ID NO: 45692 - DNA, 20 bp, synthetic construct
  misc_feature 1..20: note = CRISPR gRNA sequence
  source 1..20: mol_type = other DNA
ctattttatttttatttttt

SEQ ID NO: 45693 - DNA, 20 bp, synthetic construct
  misc_feature 1..20: note = CRISPR gRNA sequence
  source 1..20: mol_type = other DNA
tatttttattttttgagaca

SEQ ID NO: 45694 - DNA, 20 bp, synthetic construct
  misc_feature 1..20: note = CRISPR gRNA sequence
  source 1..20: mol_type = other DNA
cacagtctcactctgtcgcc

SEQ ID NO: 45695 - DNA, 20 bp, synthetic construct
  misc_feature 1..20: note = CRISPR gRNA sequence
  source 1..20: mol_type = other DNA
acagtctcactctgtcgccc

SEQ ID NO: 45696 - DNA, 20 bp, synthetic construct
  misc_feature 1..20: note = CRISPR gRNA sequence
  source 1..20: mol_type = other DNA
tctcactctgtcgcccaggc

SEQ ID NO: 45697 - DNA, 20 bp, synthetic construct
  misc_feature 1..20: note = CRISPR gRNA sequence
  source 1..20: mol_type = other DNA
tcactctgtcgcccaggctg

SEQ ID NO: 45698 - DNA, 20 bp, synthetic construct
  misc_feature 1..20: note = CRISPR gRNA sequence
  source 1..20: mol_type = other DNA
ctgtcgcccaggctggagtg

SEQ ID NO: 45699 - DNA, 20 bp, synthetic construct
  misc_feature 1..20: note = CRISPR gRNA sequence
  source 1..20: mol_type = other DNA
tcgcccaggctggagtgcag

SEQ ID NO: 45700 - DNA, 20 bp, synthetic construct
  misc_feature 1..20: note = CRISPR gRNA sequence
  source 1..20: mol_type = other DNA
tcactgcaacctctgcctcc

SEQ ID NO: 45701 - DNA, 20 bp, synthetic construct
  misc_feature 1..20: note = CRISPR gRNA sequence
  source 1..20: mol_type = other DNA
cactgcaacctctgcctcct

SEQ ID NO: 45702 - DNA, 20 bp, synthetic construct
  misc_feature 1..20: note = CRISPR gRNA sequence
  source 1..20: mol_type = other DNA
aacctctgcctcctgggttc

SEQ ID NO: 45703 - DNA, 20 bp, synthetic construct
  misc_feature 1..20: note = CRISPR gRNA sequence
  source 1..20: mol_type = other DNA
ctcctgggttcaagcgattc

SEQ ID NO: 45704 - DNA, 20 bp, synthetic construct
  misc_feature 1..20: note = CRISPR gRNA sequence
  source 1..20: mol_type = other DNA
ttcaagcgattctggtgcct

SEQ ID NO: 45705 - DNA, 20 bp, synthetic construct
  misc_feature 1..20: note = CRISPR gRNA sequence
  source 1..20: mol_type = other DNA
ttctggtgcctcagccgccc

SEQ ID NO: 45706 - DNA, 20 bp, synthetic construct
  misc_feature 1..20: note = CRISPR gRNA sequence
  source 1..20: mol_type = other DNA
tggtgcctcagccgcccaag

SEQ ID NO: 45707 - DNA, 20 bp, synthetic construct
  misc_feature 1..20: note = CRISPR gRNA sequence
  source 1..20: mol_type = other DNA
gcctcagccgcccaagtagc

SEQ ID NO: 45708 - DNA, 20 bp, synthetic construct
  misc_feature 1..20: note = CRISPR gRNA sequence
  source 1..20: mol_type = other DNA
cctcagccgcccaagtagct

SEQ ID NO: 45709 - DNA, 20 bp, synthetic construct
  misc_feature 1..20: note = CRISPR gRNA sequence
  source 1..20: mol_type = other DNA
cgcccaagtagctgggatta

SEQ ID NO: 45710 - DNA, 20 bp, synthetic construct
  misc_feature 1..20: note = CRISPR gRNA sequence
  source 1..20: mol_type = other DNA
gcccaagtagctgggattac

SEQ ID NO: 45711 - DNA, 20 bp, synthetic construct
  misc_feature 1..20: note = CRISPR gRNA sequence
  source 1..20: mol_type = other DNA
caggtatgcaccaccacgcc

SEQ ID NO: 45712 - DNA, 20 bp, synthetic construct
  misc_feature 1..20: note = CRISPR gRNA sequence
  source 1..20: mol_type = other DNA
agataatttttgtatatttt

SEQ ID NO: 45713 - DNA, 20 bp, synthetic construct
  misc_feature 1..20: note = CRISPR gRNA sequence
  source 1..20: mol_type = other DNA
ttgtatatttttagtacaaa

SEQ ID NO: 45714 - DNA, 20 bp, synthetic construct
  misc_feature 1..20: note = CRISPR gRNA sequence
  source 1..20: mol_type = other DNA
tgtatatttttagtacaaat

SEQ ID NO: 45715 - DNA, 20 bp, synthetic construct
  misc_feature 1..20: note = CRISPR gRNA sequence
  source 1..20: mol_type = other DNA
gtatatttttagtacaaatg

SEQ ID NO: 45716 - DNA, 20 bp, synthetic construct
  misc_feature 1..20: note = CRISPR gRNA sequence
  source 1..20: mol_type = other DNA
caaatggggtttcaccatgt

SEQ ID NO: 45717 - DNA, 20 bp, synthetic construct
  misc_feature 1..20: note = CRISPR gRNA sequence
  source 1..20: mol_type = other DNA
tggggtttcaccatgttggc

SEQ ID NO: 45718 - DNA, 20 bp, synthetic construct
  misc_feature 1..20: note = CRISPR gRNA sequence
  source 1..20: mol_type = other DNA
ggggtttcaccatgttggcc

SEQ ID NO: 45719 - DNA, 20 bp, synthetic construct
  misc_feature 1..20: note = CRISPR gRNA sequence
  source 1..20: mol_type = other DNA
tttcaccatgttggccgggc

SEQ ID NO: 45720 - DNA, 20 bp, synthetic construct
  misc_feature 1..20: note = CRISPR gRNA sequence
  source 1..20: mol_type = other DNA
cctcaaatgatccacctgcc

SEQ ID NO: 45721 - DNA, 20 bp, synthetic construct
  misc_feature 1..20: note = CRISPR gRNA sequence
  source 1..20: mol_type = other DNA
tccacctgcctagactccga

SEQ ID NO: 45722 - DNA, 20 bp, synthetic construct
  misc_feature 1..20: note = CRISPR gRNA sequence
  source 1..20: mol_type = other DNA
tgcctagactccgaaagtgc

SEQ ID NO: 45723 - DNA, 20 bp, synthetic construct
  misc_feature 1..20: note = CRISPR gRNA sequence
  source 1..20: mol_type = other DNA
gcctagactccgaaagtgct

SEQ ID NO: 45724 - DNA, 20 bp, synthetic construct
  misc_feature 1..20: note = CRISPR gRNA sequence
  source 1..20: mol_type = other DNA
ctccgaaagtgctgggaata

SEQ ID NO: 45725 - DNA, 20 bp, synthetic construct
  misc_feature 1..20: note = CRISPR gRNA sequence
  source 1..20: mol_type = other DNA
tccgaaagtgctgggaatac

SEQ ID NO: 45726 - DNA, 20 bp, synthetic construct
  misc_feature 1..20: note = CRISPR gRNA sequence
  source 1..20: mol_type = other DNA
caggtgtgaaccactgctcc

SEQ ID NO: 45727 - DNA, 20 bp, synthetic construct
  misc_feature 1..20: note = CRISPR gRNA sequence
  source 1..20: mol_type = other DNA
aaatttaatttgcaaaataa

SEQ ID NO: 45728 - DNA, 20 bp, synthetic construct
  misc_feature 1..20: note = CRISPR gRNA sequence
  source 1..20: mol_type = other DNA
ttaatttgcaaaataaaaga

SEQ ID NO: 45729 - DNA, 20 bp, synthetic construct
  misc_feature 1..20: note = CRISPR gRNA sequence
  source 1..20: mol_type = other DNA
catgcaaacaaatacttccc

SEQ ID NO: 45730 - DNA, 20 bp, synthetic construct
  misc_feature 1..20: note = CRISPR gRNA sequence
  source 1..20: mol_type = other DNA
atgcaaacaaatacttccca

SEQ ID NO: 45731 - DNA, 20 bp, synthetic construct
  misc_feature 1..20: note = CRISPR gRNA sequence
  source 1..20: mol_type = other DNA
tgcaaacaaatacttcccaa

SEQ ID NO: 45732 - DNA, 20 bp, synthetic construct
  misc_feature 1..20: note = CRISPR gRNA sequence
  source 1..20: mol_type = other DNA
gcaaacaaatacttcccaag

SEQ ID NO: 45733 - DNA, 20 bp, synthetic construct
  misc_feature 1..20: note = CRISPR gRNA sequence
  source 1..20: mol_type = other DNA
caaatacttcccaaggggct

SEQ ID NO: 45734 - DNA, 20 bp, synthetic construct
  misc_feature 1..20: note = CRISPR gRNA sequence
  source 1..20: mol_type = other DNA
ggggctaagaccatttgcct

SEQ ID NO: 45735 - DNA, 20 bp, synthetic construct
  misc_feature 1..20: note = CRISPR gRNA sequence
  source 1..20: mol_type = other DNA
atttattgttttttcctacc

SEQ ID NO: 45736 - DNA, 20 bp, synthetic construct
  misc_feature 1..20: note = CRISPR gRNA sequence
  source 1..20: mol_type = other DNA
tttattgttttttcctaccc

SEQ ID NO: 45737 - DNA, 20 bp, synthetic construct
  misc_feature 1..20: note = CRISPR gRNA sequence
  source 1..20: mol_type = other DNA
attgttttttcctacccagg

SEQ ID NO: 45738 - DNA, 20 bp, synthetic construct
  misc_feature 1..20: note = CRISPR gRNA sequence
  source 1..20: mol_type = other DNA
tgttttttcctacccaggca

SEQ ID NO: 45739 - DNA, 20 bp, synthetic construct
  misc_feature 1..20: note = CRISPR gRNA sequence
  source 1..20: mol_type = other DNA
ttttcctacccaggcagagc

SEQ ID NO: 45740 - DNA, 20 bp, synthetic construct
  misc_feature 1..20: note = CRISPR gRNA sequence
  source 1..20: mol_type = other DNA
tttcctacccaggcagagca

SEQ ID NO: 45741 - DNA, 20 bp, synthetic construct
  misc_feature 1..20: note = CRISPR gRNA sequence
  source 1..20: mol_type = other DNA
ctacccaggcagagcaaggt

SEQ ID NO: 45742 - DNA, 20 bp, synthetic construct
  misc_feature 1..20: note = CRISPR gRNA sequence
  source 1..20: mol_type = other DNA
tacccaggcagagcaaggtc

SEQ ID NO: 45743 - DNA, 20 bp, synthetic construct
  misc_feature 1..20: note = CRISPR gRNA sequence
  source 1..20: mol_type = other DNA
acccaggcagagcaaggtca

SEQ ID NO: 45744 - DNA, 20 bp, synthetic construct
  misc_feature 1..20: note = CRISPR gRNA sequence
  source 1..20: mol_type = other DNA
ggcagagcaaggtcagggct

SEQ ID NO: 45745 - DNA, 20 bp, synthetic construct
  misc_feature 1..20: note = CRISPR gRNA sequence
  source 1..20: mol_type = other DNA
agcaaggtcagggctcagta

SEQ ID NO: 45746 - DNA, 20 bp, synthetic construct
  misc_feature 1..20: note = CRISPR gRNA sequence
  source 1..20: mol_type = other DNA
gctcagtaaagacaataccc

SEQ ID NO: 45747 - DNA, 20 bp, synthetic construct
  misc_feature 1..20: note = CRISPR gRNA sequence
  source 1..20: mol_type = other DNA
ctcagtaaagacaataccct

SEQ ID NO: 45748 - DNA, 20 bp, synthetic construct
  misc_feature 1..20: note = CRISPR gRNA sequence
  source 1..20: mol_type = other DNA
aaagacaataccctgggttt

SEQ ID NO: 45749 - DNA, 20 bp, synthetic construct
  misc_feature 1..20: note = CRISPR gRNA sequence
  source 1..20: mol_type = other DNA
aagacaataccctgggttta

SEQ ID NO: 45750 - DNA, 20 bp, synthetic construct
  misc_feature 1..20: note = CRISPR gRNA sequence
  source 1..20: mol_type = other DNA
ggaaaaacctaccatttgca

SEQ ID NO: 45751 - DNA, 20 bp, synthetic construct
  misc_feature 1..20: note = CRISPR gRNA sequence
  source 1..20: mol_type = other DNA
aacctaccatttgcatggat

SEQ ID NO: 45752 - DNA, 20 bp, synthetic construct
  misc_feature 1..20: note = CRISPR gRNA sequence
  source 1..20: mol_type = other DNA
atgagaacacatatgcccct

SEQ ID NO: 45753 - DNA, 20 bp, synthetic construct
  misc_feature 1..20: note = CRISPR gRNA sequence
  source 1..20: mol_type = other DNA
gagaactgatctgcgtgaat

SEQ ID NO: 45754 - DNA, 20 bp, synthetic construct
  misc_feature 1..20: note = CRISPR gRNA sequence
  source 1..20: mol_type = other DNA
gaactgatctgcgtgaatca

SEQ ID NO: 45755 - DNA, 20 bp, synthetic construct
  misc_feature 1..20: note = CRISPR gRNA sequence
  source 1..20: mol_type = other DNA
aatcagagaatcccacgtga

SEQ ID NO: 45756 - DNA, 20 bp, synthetic construct
  misc_feature 1..20: note = CRISPR gRNA sequence
  source 1..20: mol_type = other DNA
cagagaatcccacgtgaaag

SEQ ID NO: 45757 - DNA, 20 bp, synthetic construct
  misc_feature 1..20: note = CRISPR gRNA sequence
  source 1..20: mol_type = other DNA
tcccacgtgaaagtggcatt

SEQ ID NO: 45758 - DNA, 20 bp, synthetic construct
  misc_feature 1..20: note = CRISPR gRNA sequence
  source 1..20: mol_type = other DNA
acgtgaaagtggcattcagc

SEQ ID NO: 45759 - DNA, 20 bp, synthetic construct
  misc_feature 1..20: note = CRISPR gRNA sequence
  source 1..20: mol_type = other DNA
cgtgaaagtggcattcagcc

SEQ ID NO: 45760 - DNA, 20 bp, synthetic construct
  misc_feature 1..20: note = CRISPR gRNA sequence
  source 1..20: mol_type = other DNA
aaagtggcattcagccgggc

SEQ ID NO: 45761 - DNA, 20 bp, synthetic construct
  misc_feature 1..20: note = CRISPR gRNA sequence
  source 1..20: mol_type = other DNA
ggcattcagccgggccagcc

SEQ ID NO: 45762 - DNA, 20 bp, synthetic construct
  misc_feature 1..20: note = CRISPR gRNA sequence
  source 1..20: mol_type = other DNA
cattcagccgggccagcccg

SEQ ID NO: 45763 - DNA, 20 bp, synthetic construct
  misc_feature 1..20: note = CRISPR gRNA sequence
  source 1..20: mol_type = other DNA
cagcccggagatccctgaca

SEQ ID NO: 45764 - DNA, 20 bp, synthetic construct
  misc_feature 1..20: note = CRISPR gRNA sequence
  source 1..20: mol_type = other DNA
gcccggagatccctgacaca

SEQ ID NO: 45765 - DNA, 20 bp, synthetic construct
  misc_feature 1..20: note = CRISPR gRNA sequence
  source 1..20: mol_type = other DNA
cccggagatccctgacacag

SEQ ID NO: 45766 - DNA, 20 bp, synthetic construct
  misc_feature 1..20: note = CRISPR gRNA sequence
  source 1..20: mol_type = other DNA
agatccctgacacagaggct

SEQ ID NO: 45767 - DNA, 20 bp, synthetic construct
  misc_feature 1..20: note = CRISPR gRNA sequence
  source 1..20: mol_type = other DNA
gatccctgacacagaggctg

SEQ ID NO: 45768 - DNA, 20 bp, synthetic construct
  misc_feature 1..20: note = CRISPR gRNA sequence
  source 1..20: mol_type = other DNA
ctgacacagaggctgaggtg

SEQ ID NO: 45769 - DNA, 20 bp, synthetic construct
  misc_feature 1..20: note = CRISPR gRNA sequence
  source 1..20: mol_type = other DNA
acagaggctgaggtgaagct

SEQ ID NO: 45770 - DNA, 20 bp, synthetic construct
  misc_feature 1..20: note = CRISPR gRNA sequence
  source 1..20: mol_type = other DNA
ggctgaggtgaagcttggca

SEQ ID NO: 45771 - DNA, 20 bp, synthetic construct
  misc_feature 1..20: note = CRISPR gRNA sequence
  source 1..20: mol_type = other DNA
tgaagcttggcaaagaaatg

SEQ ID NO: 45772 - DNA, 20 bp, synthetic construct
  misc_feature 1..20: note = CRISPR gRNA sequence
  source 1..20: mol_type = other DNA
aagcttggcaaagaaatgta

SEQ ID NO: 45773 - DNA, 20 bp, synthetic construct
  misc_feature 1..20: note = CRISPR gRNA sequence
  source 1..20: mol_type = other DNA
agaaatgtagagactcctcc

SEQ ID NO: 45774 - DNA, 20 bp, synthetic construct
  misc_feature 1..20: note = CRISPR gRNA sequence
  source 1..20: mol_type = other DNA
gaaatgtagagactcctcct

SEQ ID NO: 45775 - DNA, 20 bp, synthetic construct
  misc_feature 1..20: note = CRISPR gRNA sequence
  source 1..20: mol_type = other DNA
tgtagagactcctcctgggc

SEQ ID NO: 45776 - DNA, 20 bp, synthetic construct
  misc_feature 1..20: note = CRISPR gRNA sequence
  source 1..20: mol_type = other DNA
gtagagactcctcctgggcc

SEQ ID NO: 45777 - DNA, 20 bp, synthetic construct
  misc_feature 1..20: note = CRISPR gRNA sequence
  source 1..20: mol_type = other DNA
tagagactcctcctgggcca

SEQ ID NO: 45778 - DNA, 20 bp, synthetic construct
  misc_feature 1..20: note = CRISPR gRNA sequence
  source 1..20: mol_type = other DNA
agagactcctcctgggccag

SEQ ID NO: 45779 - DNA, 20 bp, synthetic construct
  misc_feature 1..20: note = CRISPR gRNA sequence
  source 1..20: mol_type = other DNA
tcctcctgggccaggggctc

SEQ ID NO: 45780 - DNA, 20 bp, synthetic construct
  misc_feature 1..20: note = CRISPR gRNA sequence
  source 1..20: mol_type = other DNA
gctctggatttgtttccacc

SEQ ID NO: 45781 - DNA, 20 bp, synthetic construct
  misc_feature 1..20: note = CRISPR gRNA sequence
  source 1..20: mol_type = other DNA
tttgtttccacccagcctgc

SEQ ID NO: 45782 - DNA, 20 bp, synthetic construct
  misc_feature 1..20: note = CRISPR gRNA sequence
  source 1..20: mol_type = other DNA
cacccagcctgcaagtccct

SEQ ID NO: 45783 - DNA, 20 bp, synthetic construct
  misc_feature 1..20: note = CRISPR gRNA sequence
  source 1..20: mol_type = other DNA
cctgcaagtccctaagtctc

SEQ ID NO: 45784 - DNA, 20 bp, synthetic construct
  misc_feature 1..20: note = CRISPR gRNA sequence
  source 1..20: mol_type = other DNA
caagtccctaagtctctggc

SEQ ID NO: 45785 - DNA, 20 bp, synthetic construct
  misc_feature 1..20: note = CRISPR gRNA sequence
  source 1..20: mol_type = other DNA
cctaagtctctggccagtca

SEQ ID NO: 45786 - DNA, 20 bp, synthetic construct
  misc_feature 1..20: note = CRISPR gRNA sequence
  source 1..20: mol_type = other DNA
ggccagtcacagctcactgc

SEQ ID NO: 45787 - DNA, 20 bp, synthetic construct
  misc_feature 1..20: note = CRISPR gRNA sequence
  source 1..20: mol_type = other DNA
acagctcactgctggctctc

SEQ ID NO: 45788 - DNA, 20 bp, synthetic construct
  misc_feature 1..20: note = CRISPR gRNA sequence
  source 1..20: mol_type = other DNA
ggctctcaagttttctcacc

SEQ ID NO: 45789 - DNA, 20 bp, synthetic construct
  misc_feature 1..20: note = CRISPR gRNA sequence
  source 1..20: mol_type = other DNA
aagttttctcacctggacac

SEQ ID NO: 45790 - DNA, 20 bp, synthetic construct
  misc_feature 1..20: note = CRISPR gRNA sequence
  source 1..20: mol_type = other DNA
agttttctcacctggacact

SEQ ID NO: 45791 - DNA, 20 bp, synthetic construct
  misc_feature 1..20: note = CRISPR gRNA sequence
  source 1..20: mol_type = other DNA
gttttctcacctggacactg

SEQ ID NO: 45792 - DNA, 20 bp, synthetic construct
  misc_feature 1..20: note = CRISPR gRNA sequence
  source 1..20: mol_type = other DNA
tccccacctgccatgacccc

SEQ ID NO: 45793 - DNA, 20 bp, synthetic construct
  misc_feature 1..20: note = CRISPR gRNA sequence
  source 1..20: mol_type = other DNA
ccacctgccatgacccccag

SEQ ID NO: 45794 - DNA, 20 bp, synthetic construct
  misc_feature 1..20: note = CRISPR gRNA sequence
  source 1..20: mol_type = other DNA
acccccagaagttttgctac

SEQ ID NO: 45795 - DNA, 20 bp, synthetic construct
  misc_feature 1..20: note = CRISPR gRNA sequence
  source 1..20: mol_type = other DNA
gctaccagcatatgaattcc

SEQ ID NO: 45796 - DNA, 20 bp, synthetic construct
  misc_feature 1..20: note = CRISPR gRNA sequence
  source 1..20: mol_type = other DNA
ctaccagcatatgaattcct

SEQ ID NO: 45797 - DNA, 20 bp, synthetic construct
  misc_feature 1..20: note = CRISPR gRNA sequence
  source 1..20: mol_type = other DNA
atatgaattcctgggcgtgt

SEQ ID NO: 45798 - DNA, 20 bp, synthetic construct
  misc_feature 1..20: note = CRISPR gRNA sequence
  source 1..20: mol_type = other DNA
tatgaattcctgggcgtgta

SEQ ID NO: 45799 - DNA, 20 bp, synthetic construct
  misc_feature 1..20: note = CRISPR gRNA sequence
  source 1..20: mol_type = other DNA
gtgtaaggctttgcaaactg

SEQ ID NO: 45800 - DNA, 20 bp, synthetic construct
  misc_feature 1..20: note = CRISPR gRNA sequence
  source 1..20: mol_type = other DNA
gtaaggctttgcaaactgta

SEQ ID NO: 45801 - DNA, 20 bp, synthetic construct
  misc_feature 1..20: note = CRISPR gRNA sequence
  source 1..20: mol_type = other DNA
tttgcaaactgtagagttct

SEQ ID NO: 45802 - DNA, 20 bp, synthetic construct
  misc_feature 1..20: note = CRISPR gRNA sequence
  source 1..20: mol_type = other DNA
aaactgtagagttcttagca

SEQ ID NO: 45803 - DNA, 20 bp, synthetic construct
  misc_feature 1..20: note = CRISPR gRNA sequence
  source 1..20: mol_type = other DNA
ttcttagcacagcacctgca

SEQ ID NO: 45804 - DNA, 20 bp, synthetic construct
  misc_feature 1..20: note = CRISPR gRNA sequence
  source 1..20: mol_type = other DNA
tcttagcacagcacctgcaa

SEQ ID NO: 45805 - DNA, 20 bp, synthetic construct
  misc_feature 1..20: note = CRISPR gRNA sequence
  source 1..20: mol_type = other DNA
cagcacctgcaaaggccttt

SEQ ID NO: 45806 - DNA, 20 bp, synthetic construct
  misc_feature 1..20: note = CRISPR gRNA sequence
  source 1..20: mol_type = other DNA
aaaggcctttaagctcctga

SEQ ID NO: 45807 - DNA, 20 bp, synthetic construct
  misc_feature 1..20: note = CRISPR gRNA sequence
  source 1..20: mol_type = other DNA
ttaagctcctgaaagcctct

SEQ ID NO: 45808 - DNA, 20 bp, synthetic construct
  misc_feature 1..20: note = CRISPR gRNA sequence
  source 1..20: mol_type = other DNA
tggtctattccctgcttttc

SEQ ID NO: 45809 - DNA, 20 bp, synthetic construct
  misc_feature 1..20: note = CRISPR gRNA sequence
  source 1..20: mol_type = other DNA
ccctgcttttccagactgaa

SEQ ID NO: 45810 - DNA, 20 bp, synthetic construct
  misc_feature 1..20: note = CRISPR gRNA sequence
  source 1..20: mol_type = other DNA
cctgcttttccagactgaac

SEQ ID NO: 45811 - DNA, 20 bp, synthetic construct
  misc_feature 1..20: note = CRISPR gRNA sequence
  source 1..20: mol_type = other DNA
ttttccagactgaacaggaa

SEQ ID NO: 45812 - DNA, 20 bp, synthetic construct
  misc_feature 1..20: note = CRISPR gRNA sequence
  source 1..20: mol_type = other DNA
agactgaacaggaacagtat

SEQ ID NO: 45813 - DNA, 20 bp, synthetic construct
  misc_feature 1..20: note = CRISPR gRNA sequence
  source 1..20: mol_type = other DNA
aggaacagtatcggtgatgt

SEQ ID NO: 45814 - DNA, 20 bp, synthetic construct
  misc_feature 1..20: note = CRISPR gRNA sequence
  source 1..20: mol_type = other DNA
tcggttgctgccacctttct

SEQ ID NO: 45815 - DNA, 20 bp, synthetic construct
  misc_feature 1..20: note = CRISPR gRNA sequence
  source 1..20: mol_type = other DNA
cggttgctgccacctttctg

SEQ ID NO: 45816 - DNA, 20 bp, synthetic construct
  misc_feature 1..20: note = CRISPR gRNA sequence
  source 1..20: mol_type = other DNA
tgccacctttctgaggctct

SEQ ID NO: 45817 - DNA, 20 bp, synthetic construct
  misc_feature 1..20: note = CRISPR gRNA sequence
  source 1..20: mol_type = other DNA
gccacctttctgaggctctc

SEQ ID NO: 45818 - DNA, 20 bp, synthetic construct
  misc_feature 1..20: note = CRISPR gRNA sequence
  source 1..20: mol_type = other DNA
ccacctttctgaggctctca

SEQ ID NO: 45819 - DNA, 20 bp, synthetic construct
  misc_feature 1..20: note = CRISPR gRNA sequence
  source 1..20: mol_type = other DNA
gaggctctcagggctgccac

SEQ ID NO: 45820 - DNA, 20 bp, synthetic construct
  misc_feature 1..20: note = CRISPR gRNA sequence
  source 1..20: mol_type = other DNA
tctcagggctgccaccagcc

SEQ ID NO: 45821 - DNA, 20 bp, synthetic construct
  misc_feature 1..20: note = CRISPR gRNA sequence
  source 1..20: mol_type = other DNA
tcagggctgccaccagccta

SEQ ID NO: 45822 - DNA, 20 bp, synthetic construct
  misc_feature 1..20: note = CRISPR gRNA sequence
  source 1..20: mol_type = other DNA
cagggctgccaccagcctag

SEQ ID NO: 45823 - DNA, 20 bp, synthetic construct
  misc_feature 1..20: note = CRISPR gRNA sequence
  source 1..20: mol_type = other DNA
gggctgccaccagcctagag

SEQ ID NO: 45824 - DNA, 20 bp, synthetic construct
  misc_feature 1..20: note = CRISPR gRNA sequence
  source 1..20: mol_type = other DNA
tgccaccagcctagaggagc

SEQ ID NO: 45825 - DNA, 20 bp, synthetic construct
  misc_feature 1..20: note = CRISPR gRNA sequence
  source 1..20: mol_type = other DNA
ccaccagcctagaggagctg

SEQ ID NO: 45826 - DNA, 20 bp, synthetic construct
  misc_feature 1..20: note = CRISPR gRNA sequence
  source 1..20: mol_type = other DNA
cagcctagaggagctggagt

SEQ ID NO: 45827 - DNA, 20 bp, synthetic construct
  misc_feature 1..20: note = CRISPR gRNA sequence
  source 1..20: mol_type = other DNA
tgagttgcccattctgcccc

SEQ ID NO: 45828 - DNA, 20 bp, synthetic construct
  misc_feature 1..20: note = CRISPR gRNA sequence
  source 1..20: mol_type = other DNA
gcccattctgcccccagacc

SEQ ID NO: 45829 - DNA, 20 bp, synthetic construct
  misc_feature 1..20: note = CRISPR gRNA sequence
  source 1..20: mol_type = other DNA
cccattctgcccccagaccc

SEQ ID NO: 45830 - DNA, 20 bp, synthetic construct
  misc_feature 1..20: note = CRISPR gRNA sequence
  source 1..20: mol_type = other DNA
ccccagacccaggacaattt

SEQ ID NO: 45831 - DNA, 20 bp, synthetic construct
  misc_feature 1..20: note = CRISPR gRNA sequence
  source 1..20: mol_type = other DNA
agacccaggacaattttggc

SEQ ID NO: 45832 - DNA, 20 bp, synthetic construct
  misc_feature 1..20: note = CRISPR gRNA sequence
  source 1..20: mol_type = other DNA
gacccaggacaattttggcc

SEQ ID NO: 45833 - DNA, 20 bp, synthetic construct
  misc_feature 1..20: note = CRISPR gRNA sequence
  source 1..20: mol_type = other DNA
caggacaattttggccggga

SEQ ID NO: 45834 - DNA, 20 bp, synthetic construct
  misc_feature 1..20: note = CRISPR gRNA sequence
  source 1..20: mol_type = other DNA
ttttggccgggaaagatgac

SEQ ID NO: 45835 - DNA, 20 bp, synthetic construct
  misc_feature 1..20: note = CRISPR gRNA sequence
  source 1..20: mol_type = other DNA
tttggccgggaaagatgaca

SEQ ID NO: 45836 - DNA, 20 bp, synthetic construct
  misc_feature 1..20: note = CRISPR gRNA sequence
  source 1..20: mol_type = other DNA
ttggccgggaaagatgacaa

SEQ ID NO: 45837 - DNA, 20 bp, synthetic construct
  misc_feature 1..20: note = CRISPR gRNA sequence
  source 1..20: mol_type = other DNA
ccgggaaagatgacaagggc

SEQ ID NO: 45838 - DNA, 20 bp, synthetic construct
  misc_feature 1..20: note = CRISPR gRNA sequence
  source 1..20: mol_type = other DNA
cgggaaagatgacaagggca

SEQ ID NO: 45839 - DNA, 20 bp, synthetic construct
  misc_feature 1..20: note = CRISPR gRNA sequence
  source 1..20: mol_type = other DNA
gggaaagatgacaagggcaa

SEQ ID NO: 45840 - DNA, 20 bp, synthetic construct
  misc_feature 1..20: note = CRISPR gRNA sequence
  source 1..20: mol_type = other DNA
ggaaagatgacaagggcaag

SEQ ID NO: 45841 - DNA, 20 bp, synthetic construct
  misc_feature 1..20: note = CRISPR gRNA sequence
  source 1..20: mol_type = other DNA
acaagggcaaggggctacct

SEQ ID NO: 45842 - DNA, 20 bp, synthetic construct
  misc_feature 1..20: note = CRISPR gRNA sequence
  source 1..20: mol_type = other DNA
tctacactgtgtaaacaacc

SEQ ID NO: 45843 - DNA, 20 bp, synthetic construct
  misc_feature 1..20: note = CRISPR gRNA sequence
  source 1..20: mol_type = other DNA
ctacactgtgtaaacaacct

SEQ ID NO: 45844 - DNA, 20 bp, synthetic construct
  misc_feature 1..20: note = CRISPR gRNA sequence
  source 1..20: mol_type = other DNA
tacactgtgtaaacaacctg

SEQ ID NO: 45845 - DNA, 20 bp, synthetic construct
  misc_feature 1..20: note = CRISPR gRNA sequence
  source 1..20: mol_type = other DNA
tgtgtaaacaacctggggcc

SEQ ID NO: 45846 - DNA, 20 bp, synthetic construct
  misc_feature 1..20: note = CRISPR gRNA sequence
  source 1..20: mol_type = other DNA
gtaaacaacctggggcctag

SEQ ID NO: 45847 - DNA, 20 bp, synthetic construct
  misc_feature 1..20: note = CRISPR gRNA sequence
  source 1..20: mol_type = other DNA
caacctggggcctagaagct

SEQ ID NO: 45848 - DNA, 20 bp, synthetic construct
  misc_feature 1..20: note = CRISPR gRNA sequence
  source 1..20: mol_type = other DNA
aacctggggcctagaagctt

SEQ ID NO: 45849 - DNA, 20 bp, synthetic construct
  misc_feature 1..20: note = CRISPR gRNA sequence
  source 1..20: mol_type = other DNA
acctggggcctagaagcttg

SEQ ID NO: 45850 - DNA, 20 bp, synthetic construct
  misc_feature 1..20: note = CRISPR gRNA sequence
  source 1..20: mol_type = other DNA
cctggggcctagaagcttgg

SEQ ID NO: 45851 - DNA, 20 bp, synthetic construct
  misc_feature 1..20: note = CRISPR gRNA sequence
  source 1..20: mol_type = other DNA
ctagaagcttgggggaccca

SEQ ID NO: 45852 - DNA, 20 bp, synthetic construct
  misc_feature 1..20: note = CRISPR gRNA sequence
  source 1..20: mol_type = other DNA
aagcttgggggacccaaaga

SEQ ID NO: 45853 - DNA, 20 bp, synthetic construct
  misc_feature 1..20: note = CRISPR gRNA sequence
  source 1..20: mol_type = other DNA
agcttgggggacccaaagac

SEQ ID NO: 45854 - DNA, 20 bp, synthetic construct
  misc_feature 1..20: note = CRISPR gRNA sequence
  source 1..20: mol_type = other DNA
gggacccaaagacaggatgt

SEQ ID NO: 45855 - DNA, 20 bp, synthetic construct
  misc_feature 1..20: note = CRISPR gRNA sequence
  source 1..20: mol_type = other DNA
gacccaaagacaggatgtaa

SEQ ID NO: 45856 - DNA, 20 bp, synthetic construct
  misc_feature 1..20: note = CRISPR gRNA sequence
  source 1..20: mol_type = other DNA
ggatgtaagagtgtcaattg

SEQ ID NO: 45857 - DNA, 20 bp, synthetic construct
  misc_feature 1..20: note = CRISPR gRNA sequence
  source 1..20: mol_type = other DNA
gtaagagtgtcaattgtagc

SEQ ID NO: 45858 - DNA, 20 bp, synthetic construct
  misc_feature 1..20: note = CRISPR gRNA sequence
  source 1..20: mol_type = other DNA
aagagtgtcaattgtagcaa

SEQ ID NO: 45859 - DNA, 20 bp, synthetic construct
  misc_feature 1..20: note = CRISPR gRNA sequence
  source 1..20: mol_type = other DNA
agagtgtcaattgtagcaag

SEQ ID NO: 45860 - DNA, 20 bp, synthetic construct
  misc_feature 1..20: note = CRISPR gRNA sequence
  source 1..20: mol_type = other DNA
gagtgtcaattgtagcaaga

SEQ ID NO: 45861 - DNA, 20 bp, synthetic construct
  misc_feature 1..20: note = CRISPR gRNA sequence
  source 1..20: mol_type = other DNA
caattgtagcaagagggatt

SEQ ID NO: 45862 - DNA, 20 bp, synthetic construct
  misc_feature 1..20: note = CRISPR gRNA sequence
  source 1..20: mol_type = other DNA
aattgtagcaagagggattt

SEQ ID NO: 45863 - DNA, 20 bp, synthetic construct
  misc_feature 1..20: note = CRISPR gRNA sequence
  source 1..20: mol_type = other DNA
gtagcaagagggatttaggt

SEQ ID NO: 45864 - DNA, 20 bp, synthetic construct
  misc_feature 1..20: note = CRISPR gRNA sequence
  source 1..20: mol_type = other DNA
gagggatttaggtcagacaa

SEQ ID NO: 45865 - DNA, 20 bp, synthetic construct
  misc_feature 1..20: note = CRISPR gRNA sequence
  source 1..20: mol_type = other DNA
agggatttaggtcagacaat

SEQ ID NO: 45866 - DNA, 20 bp, synthetic construct
  misc_feature 1..20: note = CRISPR gRNA sequence
  source 1..20: mol_type = other DNA
gggatttaggtcagacaatg

SEQ ID NO: 45867 - DNA, 20 bp, synthetic construct
  misc_feature 1..20: note = CRISPR gRNA sequence
  source 1..20: mol_type = other DNA
gatttaggtcagacaatggg

SEQ ID NO: 45868 - DNA, 20 bp, synthetic construct
  misc_feature 1..20: note = CRISPR gRNA sequence
  source 1..20: mol_type = other DNA
aatggggagaacatcctaaa

SEQ ID NO: 45869 - DNA, 20 bp, synthetic construct
  misc_feature 1..20: note = CRISPR gRNA sequence
  source 1..20: mol_type = other DNA
ggggagaacatcctaaacag

SEQ ID NO: 45870 - DNA, 20 bp, synthetic construct
  misc_feature 1..20: note = CRISPR gRNA sequence
  source 1..20: mol_type = other DNA
gaacatcctaaacagaagcc

SEQ ID NO: 45871 - DNA, 20 bp, synthetic construct
  misc_feature 1..20: note = CRISPR gRNA sequence
  source 1..20: mol_type = other DNA
aacatcctaaacagaagcca

SEQ ID NO: 45872 - DNA, 20 bp, synthetic construct
  misc_feature 1..20: note = CRISPR gRNA sequence
  source 1..20: mol_type = other DNA
acatcctaaacagaagccaa

SEQ ID NO: 45873 - DNA, 20 bp, synthetic construct
  misc_feature 1..20: note = CRISPR gRNA sequence
  source 1..20: mol_type = other DNA
cctaaacagaagccaagggt

SEQ ID NO: 45874 - DNA, 20 bp, synthetic construct
  misc_feature 1..20: note = CRISPR gRNA sequence
  source 1..20: mol_type = other DNA
ctaaacagaagccaagggtt

SEQ ID NO: 45875 - DNA, 20 bp, synthetic construct
  misc_feature 1..20: note = CRISPR gRNA sequence
  source 1..20: mol_type = other DNA
aaacagaagccaagggttag

SEQ ID NO: 45876 - DNA, 20 bp, synthetic construct
  misc_feature 1..20: note = CRISPR gRNA sequence
  source 1..20: mol_type = other DNA
ttaggagctgtcactcaaca

SEQ ID NO: 45877 - DNA, 20 bp, synthetic construct
  misc_feature 1..20: note = CRISPR gRNA sequence
  source 1..20: mol_type = other DNA
taggagctgtcactcaacat

SEQ ID NO: 45878 - DNA, 20 bp, synthetic construct
  misc_feature 1..20: note = CRISPR gRNA sequence
  source 1..20: mol_type = other DNA
aggagctgtcactcaacatg

SEQ ID NO: 45879 - DNA, 20 bp, synthetic construct
  misc_feature 1..20: note = CRISPR gRNA sequence
  source 1..20: mol_type = other DNA
tgtcactcaacatggggtga

SEQ ID NO: 45880 - DNA, 20 bp, synthetic construct
  misc_feature 1..20: note = CRISPR gRNA sequence
  source 1..20: mol_type = other DNA
gtcactcaacatggggtgat

SEQ ID NO: 45881 - DNA, 20 bp, synthetic construct
  misc_feature 1..20: note = CRISPR gRNA sequence
  source 1..20: mol_type = other DNA
tcactcaacatggggtgatg

SEQ ID NO: 45882 - DNA, 20 bp, synthetic construct
  misc_feature 1..20: note = CRISPR gRNA sequence
  source 1..20: mol_type = other DNA
ggtgatggggctctctgtgt

SEQ ID NO: 45883 - DNA, 20 bp, synthetic construct
  misc_feature 1..20: note = CRISPR gRNA sequence
  source 1..20: mol_type = other DNA
tggggctctctgtgtgagtc

SEQ ID NO: 45884 - DNA, 20 bp, synthetic construct
  misc_feature 1..20: note = CRISPR gRNA sequence
  source 1..20: mol_type = other DNA
ggggctctctgtgtgagtcg

SEQ ID NO: 45885 - DNA, 20 bp, synthetic construct
  misc_feature 1..20: note = CRISPR gRNA sequence
  source 1..20: mol_type = other DNA
gtgtgagtcgaggcccttcc

SEQ ID NO: 45886 - DNA, 20 bp, synthetic construct
  misc_feature 1..20: note = CRISPR gRNA sequence
  source 1..20: mol_type = other DNA
tgtgagtcgaggcccttcct

SEQ ID NO: 45887 - DNA, 20 bp, synthetic construct
  misc_feature 1..20: note = CRISPR gRNA sequence
  source 1..20: mol_type = other DNA
cgaggcccttcctgggactt

SEQ ID NO: 45888 - DNA, 20 bp, synthetic construct
  misc_feature 1..20: note = CRISPR gRNA sequence
  source 1..20: mol_type = other DNA
tcagcctccccttctttttc

SEQ ID NO: 45889 - DNA, 20 bp, synthetic construct
  misc_feature 1..20: note = CRISPR gRNA sequence
  source 1..20: mol_type = other DNA
cagcctccccttctttttct

SEQ ID NO: 45890 - DNA, 20 bp, synthetic construct
  misc_feature 1..20: note = CRISPR gRNA sequence
  source 1..20: mol_type = other DNA
gcctccccttctttttctgg

SEQ ID NO: 45891 - DNA, 20 bp, synthetic construct
  misc_feature 1..20: note = CRISPR gRNA sequence
  source 1..20: mol_type = other DNA
tccccttctttttctgggag

SEQ ID NO: 45892 - DNA, 20 bp, synthetic construct
  misc_feature 1..20: note = CRISPR gRNA sequence
  source 1..20: mol_type = other DNA
ccccttctttttctgggagt

SEQ ID NO: 45893 - DNA, 20 bp, synthetic construct
  misc_feature 1..20: note = CRISPR gRNA sequence
  source 1..20: mol_type = other DNA
cccttctttttctgggagtg

SEQ ID NO: 45894 - DNA, 20 bp, synthetic construct
  misc_feature 1..20: note = CRISPR gRNA sequence
  source 1..20: mol_type = other DNA
ctttttctgggagtggggtg

SEQ ID NO: 45895 - DNA, 20 bp, synthetic construct
  misc_feature 1..20: note = CRISPR gRNA sequence
  source 1..20: mol_type = other DNA
tctgggagtggggtgtggac

SEQ ID NO: 45896 - DNA, 20 bp, synthetic construct
  misc_feature 1..20: note = CRISPR gRNA sequence
  source 1..20: mol_type = other DNA
gagtggggtgtggacaagat

SEQ ID NO: 45897 - DNA, 20 bp, synthetic construct
  misc_feature 1..20: note = CRISPR gRNA sequence
  source 1..20: mol_type = other DNA
ggggtgtggacaagatgaga

SEQ ID NO: 45898 - DNA, 20 bp, synthetic construct
  misc_feature 1..20: note = CRISPR gRNA sequence
  source 1..20: mol_type = other DNA
gtgtggacaagatgagacgg

SEQ ID NO: 45899 - DNA, 20 bp, synthetic construct
  misc_feature 1..20: note = CRISPR gRNA sequence
  source 1..20: mol_type = other DNA
tggacaagatgagacggcag

SEQ ID NO: 45900 - DNA, 20 bp, synthetic construct
  misc_feature 1..20: note = CRISPR gRNA sequence
  source 1..20: mol_type = other DNA
ggacaagatgagacggcaga

SEQ ID NO: 45901 - DNA, 20 bp, synthetic construct
  misc_feature 1..20: note = CRISPR gRNA sequence
  source 1..20: mol_type = other DNA
gagacggcagaaggctgatg

SEQ ID NO: 45902 - DNA, 20 bp, synthetic construct
  misc_feature 1..20: note = CRISPR gRNA sequence
  source 1..20: mol_type = other DNA
atgaagctgttttctccccc

SEQ ID NO: 45903 - DNA, 20 bp, synthetic construct
  misc_feature 1..20: note = CRISPR gRNA sequence
  source 1..20: mol_type = other DNA
ctgttttctcccccaagctt

SEQ ID NO: 45904 - DNA, 20 bp, synthetic construct
  misc_feature 1..20: note = CRISPR gRNA sequence
  source 1..20: mol_type = other DNA
ccccaagcttgagccacaac

SEQ ID NO: 45905 - DNA, 20 bp, synthetic construct
  misc_feature 1..20: note = CRISPR gRNA sequence
  source 1..20: mol_type = other DNA
agcttgagccacaaccagat

SEQ ID NO: 45906 - DNA, 20 bp, synthetic construct
  misc_feature 1..20: note = CRISPR gRNA sequence
  source 1..20: mol_type = other DNA
cttgagccacaaccagattg

SEQ ID NO: 45907 - DNA, 20 bp, synthetic construct
  misc_feature 1..20: note = CRISPR gRNA sequence
  source 1..20: mol_type = other DNA
cacaaccagattggagacgc

SEQ ID NO: 45908 - DNA, 20 bp, synthetic construct
  misc_feature 1..20: note = CRISPR gRNA sequence
  source 1..20: mol_type = other DNA
agattggagacgctggtgtc

SEQ ID NO: 45909 - DNA, 20 bp, synthetic construct
  misc_feature 1..20: note = CRISPR gRNA sequence
  source 1..20: mol_type = other DNA
agacgctggtgtccagcact

SEQ ID NO: 45910 - DNA, 20 bp, synthetic construct
  misc_feature 1..20: note = CRISPR gRNA sequence
  source 1..20: mol_type = other DNA
cacttagctaccatcctgcc

SEQ ID NO: 45911 - DNA, 20 bp, synthetic construct
  misc_feature 1..20: note = CRISPR gRNA sequence
  source 1..20: mol_type = other DNA
acttagctaccatcctgcct

SEQ ID NO: 45912 - DNA, 20 bp, synthetic construct
  misc_feature 1..20: note = CRISPR gRNA sequence
  source 1..20: mol_type = other DNA
taccatcctgcctgggctgc

SEQ ID NO: 45913 - DNA, 20 bp, synthetic construct
  misc_feature 1..20: note = CRISPR gRNA sequence
  source 1..20: mol_type = other DNA
ccatcctgcctgggctgcca

SEQ ID NO: 45914 - DNA, 20 bp, synthetic construct
  misc_feature 1..20: note = CRISPR gRNA sequence
  source 1..20: mol_type = other DNA
ctgcctgggctgccagagct

SEQ ID NO: 45915 - DNA, 20 bp, synthetic construct
  misc_feature 1..20: note = CRISPR gRNA sequence
  source 1..20: mol_type = other DNA
tgcctgggctgccagagctc

SEQ ID NO: 45916 - DNA, 20 bp, synthetic construct
  misc_feature 1..20: note = CRISPR gRNA sequence
  source 1..20: mol_type = other DNA
ctgggctgccagagctcagg

SEQ ID NO: 45917 - DNA, 20 bp, synthetic construct
  misc_feature 1..20: note = CRISPR gRNA sequence
  source 1..20: mol_type = other DNA
gctgccagagctcaggaaga

SEQ ID NO: 45918 - DNA, 20 bp, synthetic construct
  misc_feature 1..20: note = CRISPR gRNA sequence
  source 1..20: mol_type = other DNA
tgccagagctcaggaagata

SEQ ID NO: 45919 - DNA, 20 bp, synthetic construct
  misc_feature 1..20: note = CRISPR gRNA sequence
  source 1..20: mol_type = other DNA
agagctcaggaagatagagt

SEQ ID NO: 45920 - DNA, 20 bp, synthetic construct
  misc_feature 1..20: note = CRISPR gRNA sequence
  source 1..20: mol_type = other DNA
gctcaggaagatagagtgag

SEQ ID NO: 45921 - DNA, 20 bp, synthetic construct
  misc_feature 1..20: note = CRISPR gRNA sequence
  source 1..20: mol_type = other DNA
aggaagatagagtgagtagc

SEQ ID NO: 45922 - DNA, 20 bp, synthetic construct
  misc_feature 1..20: note = CRISPR gRNA sequence
  source 1..20: mol_type = other DNA
agagtgagtagccagcccta

SEQ ID NO: 45923 - DNA, 20 bp, synthetic construct
  misc_feature 1..20: note = CRISPR gRNA sequence
  source 1..20: mol_type = other DNA
agtgagtagccagccctaca

SEQ ID NO: 45924 - DNA, 20 bp, synthetic construct
  misc_feature 1..20: note = CRISPR gRNA sequence
  source 1..20: mol_type = other DNA
gtgagtagccagccctacag

SEQ ID NO: 45925 - DNA, 20 bp, synthetic construct
  misc_feature 1..20: note = CRISPR gRNA sequence
  source 1..20: mol_type = other DNA
gagtagccagccctacagag

SEQ ID NO: 45926 - DNA, 20 bp, synthetic construct
  misc_feature 1..20: note = CRISPR gRNA sequence
  source 1..20: mol_type = other DNA
agtagccagccctacagagg

SEQ ID NO: 45927 - DNA, 20 bp, synthetic construct
  misc_feature 1..20: note = CRISPR gRNA sequence
  source 1..20: mol_type = other DNA
gtagccagccctacagagga

SEQ ID NO: 45928 - DNA, 20 bp, synthetic construct
  misc_feature 1..20: note = CRISPR gRNA sequence
  source 1..20: mol_type = other DNA
agccctacagaggagggcca

SEQ ID NO: 45929 - DNA, 20 bp, synthetic construct
  misc_feature 1..20: note = CRISPR gRNA sequence
  source 1..20: mol_type = other DNA
gccctacagaggagggccac

SEQ ID NO: 45930 - DNA, 20 bp, synthetic construct
  misc_feature 1..20: note = CRISPR gRNA sequence
  source 1..20: mol_type = other DNA
ccctacagaggagggccaca

SEQ ID NO: 45931 - DNA, 20 bp, synthetic construct
  misc_feature 1..20: note = CRISPR gRNA sequence
  source 1..20: mol_type = other DNA
cctacagaggagggccacag

SEQ ID NO: 45932 - DNA, 20 bp, synthetic construct
  misc_feature 1..20: note = CRISPR gRNA sequence
  source 1..20: mol_type = other DNA
gggccacaggggtcacacga

SEQ ID NO: 45933 - DNA, 20 bp, synthetic construct
  misc_feature 1..20: note = CRISPR gRNA sequence
  source 1..20: mol_type = other DNA
caggggtcacacgatggtcc

SEQ ID NO: 45934 - DNA, 20 bp, synthetic construct
  misc_feature 1..20: note = CRISPR gRNA sequence
  source 1..20: mol_type = other DNA
aggggtcacacgatggtcct

SEQ ID NO: 45935 - DNA, 20 bp, synthetic construct
  misc_feature 1..20: note = CRISPR gRNA sequence
  source 1..20: mol_type = other DNA
gggtcacacgatggtcctag

SEQ ID NO: 45936 - DNA, 20 bp, synthetic construct
  misc_feature 1..20: note = CRISPR gRNA sequence
  source 1..20: mol_type = other DNA
acgatggtcctaggagatac

SEQ ID NO: 45937 - DNA, 20 bp, synthetic construct
  misc_feature 1..20: note = CRISPR gRNA sequence
  source 1..20: mol_type = other DNA
tcctaggagatactggcccc

SEQ ID NO: 45938 - DNA, 20 bp, synthetic construct
  misc_feature 1..20: note = CRISPR gRNA sequence
  source 1..20: mol_type = other DNA
ggagatactggcccctagct

SEQ ID NO: 45939 - DNA, 20 bp, synthetic construct
  misc_feature 1..20: note = CRISPR gRNA sequence
  source 1..20: mol_type = other DNA
gagatactggcccctagctg

SEQ ID NO: 45940 - DNA, 20 bp, synthetic construct
  misc_feature 1..20: note = CRISPR gRNA sequence
  source 1..20: mol_type = other DNA
tactggcccctagctgaggc

SEQ ID NO: 45941 - DNA, 20 bp, synthetic construct
  misc_feature 1..20: note = CRISPR gRNA sequence
  source 1..20: mol_type = other DNA
gcccctagctgaggccagca

SEQ ID NO: 45942 - DNA, 20 bp, synthetic construct
  misc_feature 1..20: note = CRISPR gRNA sequence
  source 1..20: mol_type = other DNA
aatctcccctgcgccaacct

SEQ ID NO: 45943 - DNA, 20 bp, synthetic construct
  misc_feature 1..20: note = CRISPR gRNA sequence
  source 1..20: mol_type = other DNA
cctgcgccaacctcagtgtc

SEQ ID NO: 45944 - DNA, 20 bp, synthetic construct
  misc_feature 1..20: note = CRISPR gRNA sequence
  source 1..20: mol_type = other DNA
ctgcgccaacctcagtgtcc

SEQ ID NO: 45945 - DNA, 20 bp, synthetic construct
  misc_feature 1..20: note = CRISPR gRNA sequence
  source 1..20: mol_type = other DNA
cgccaacctcagtgtccagg

SEQ ID NO: 45946 - DNA, 20 bp, synthetic construct
  misc_feature 1..20: note = CRISPR gRNA sequence
  source 1..20: mol_type = other DNA
caacctcagtgtccaggcag

SEQ ID NO: 45947 - DNA, 20 bp, synthetic construct
  misc_feature 1..20: note = CRISPR gRNA sequence
  source 1..20: mol_type = other DNA
aacctcagtgtccaggcagt

SEQ ID NO: 45948 - DNA, 20 bp, synthetic construct
  misc_feature 1..20: note = CRISPR gRNA sequence
  source 1..20: mol_type = other DNA
acctcagtgtccaggcagtg

SEQ ID NO: 45949 - DNA, 20 bp, synthetic construct
  misc_feature 1..20: note = CRISPR gRNA sequence
  source 1..20: mol_type = other DNA
agtgtccaggcagtggggct

SEQ ID NO: 45950 - DNA, 20 bp, synthetic construct
  misc_feature 1..20: note = CRISPR gRNA sequence
  source 1..20: mol_type = other DNA
agtggggctcggtgacctcc

SEQ ID NO: 45951 - DNA, 20 bp, synthetic construct
  misc_feature 1..20: note = CRISPR gRNA sequence
  source 1..20: mol_type = other DNA
tgacctcctggccctcactg

SEQ ID NO: 45952 - DNA, 20 bp, synthetic construct
  misc_feature 1..20: note = CRISPR gRNA sequence
  source 1..20: mol_type = other DNA
gacctcctggccctcactgc

SEQ ID NO: 45953 - DNA, 20 bp, synthetic construct
  misc_feature 1..20: note = CRISPR gRNA sequence
  source 1..20: mol_type = other DNA
ggccctcactgcgggacctt

SEQ ID NO: 45954 - DNA, 20 bp, synthetic construct
  misc_feature 1..20: note = CRISPR gRNA sequence
  source 1..20: mol_type = other DNA
tgcgggaccttaagccaccc

SEQ ID NO: 45955 - DNA, 20 bp, synthetic construct
  misc_feature 1..20: note = CRISPR gRNA sequence
  source 1..20: mol_type = other DNA
ccccagcccctgctcttctc

SEQ ID NO: 45956 - DNA, 20 bp, synthetic construct
  misc_feature 1..20: note = CRISPR gRNA sequence
  source 1..20: mol_type = other DNA
cccagcccctgctcttctct

SEQ ID NO: 45957 - DNA, 20 bp, synthetic construct
  misc_feature 1..20: note = CRISPR gRNA sequence
  source 1..20: mol_type = other DNA
ggcctttctgcctcattgtc

SEQ ID NO: 45958 - DNA, 20 bp, synthetic construct
  misc_feature 1..20: note = CRISPR gRNA sequence
  source 1..20: mol_type = other DNA
gcctttctgcctcattgtct

SEQ ID NO: 45959 - DNA, 20 bp, synthetic construct
  misc_feature 1..20: note = CRISPR gRNA sequence
  source 1..20: mol_type = other DNA
tttctgcctcattgtctggg

SEQ ID NO: 45960 - DNA, 20 bp, synthetic construct
  misc_feature 1..20: note = CRISPR gRNA sequence
  source 1..20: mol_type = other DNA
ttctgcctcattgtctgggt

SEQ ID NO: 45961 - DNA, 20 bp, synthetic construct
  misc_feature 1..20: note = CRISPR gRNA sequence
  source 1..20: mol_type = other DNA
tcattgtctgggtaggtgtg

SEQ ID NO: 45962 - DNA, 20 bp, synthetic construct
  misc_feature 1..20: note = CRISPR gRNA sequence
  source 1..20: mol_type = other DNA
tctgggtaggtgtgtggtgt

SEQ ID NO: 45963 - DNA, 20 bp, synthetic construct
  misc_feature 1..20: note = CRISPR gRNA sequence
  source 1..20: mol_type = other DNA
ctgggtaggtgtgtggtgtc

SEQ ID NO: 45964 - DNA, 20 bp, synthetic construct
  misc_feature 1..20: note = CRISPR gRNA sequence
  source 1..20: mol_type = other DNA
tgggtaggtgtgtggtgtcg

SEQ ID NO: 45965 - DNA, 20 bp, synthetic construct
  misc_feature 1..20: note = CRISPR gRNA sequence
  source 1..20: mol_type = other DNA
gggtaggtgtgtggtgtcgg

SEQ ID NO: 45966 - DNA, 20 bp, synthetic construct
  misc_feature 1..20: note = CRISPR gRNA sequence
  source 1..20: mol_type = other DNA
ggtaggtgtgtggtgtcggg

SEQ ID NO: 45967 - DNA, 20 bp, synthetic construct
  misc_feature 1..20: note = CRISPR gRNA sequence
  source 1..20: mol_type = other DNA
ggtgtcggggggttgtctct

SEQ ID NO: 45968 - DNA, 20 bp, synthetic construct
  misc_feature 1..20: note = CRISPR gRNA sequence
  source 1..20: mol_type = other DNA
gtgtcggggggttgtctctt

SEQ ID NO: 45969 - DNA, 20 bp, synthetic construct
  misc_feature 1..20: note = CRISPR gRNA sequence
  source 1..20: mol_type = other DNA
gttgtctcttaggccccctg

SEQ ID NO: 45970 - DNA, 20 bp, synthetic construct
  misc_feature 1..20: note = CRISPR gRNA sequence
  source 1..20: mol_type = other DNA
gtctcttaggccccctgaag

SEQ ID NO: 45971 - DNA, 20 bp, synthetic construct
  misc_feature 1..20: note = CRISPR gRNA sequence
  source 1..20: mol_type = other DNA
tctcttaggccccctgaagc

SEQ ID NO: 45972 - DNA, 20 bp, synthetic construct
  misc_feature 1..20: note = CRISPR gRNA sequence
  source 1..20: mol_type = other DNA
ctcttaggccccctgaagca

SEQ ID NO: 45973 - DNA, 20 bp, synthetic construct
  misc_feature 1..20: note = CRISPR gRNA sequence
  source 1..20: mol_type = other DNA
tcttaggccccctgaagcag

SEQ ID NO: 45974 - DNA, 20 bp, synthetic construct
  misc_feature 1..20: note = CRISPR gRNA sequence
  source 1..20: mol_type = other DNA
taggccccctgaagcagggg

SEQ ID NO: 45975 - DNA, 20 bp, synthetic construct
  misc_feature 1..20: note = CRISPR gRNA sequence
  source 1..20: mol_type = other DNA
gccccctgaagcaggggtgg

SEQ ID NO: 45976 - DNA, 20 bp, synthetic construct
  misc_feature 1..20: note = CRISPR gRNA sequence
  source 1..20: mol_type = other DNA
tgaagcaggggtggcagacc

SEQ ID NO: 45977 - DNA, 20 bp, synthetic construct
  misc_feature 1..20: note = CRISPR gRNA sequence
  source 1..20: mol_type = other DNA
agcaggggtggcagacccag

SEQ ID NO: 45978 - DNA, 20 bp, synthetic construct
  misc_feature 1..20: note = CRISPR gRNA sequence
  source 1..20: mol_type = other DNA
ggcagacccagcagatgtgc

SEQ ID NO: 45979 - DNA, 20 bp, synthetic construct
  misc_feature 1..20: note = CRISPR gRNA sequence
  source 1..20: mol_type = other DNA
gcagacccagcagatgtgct

SEQ ID NO: 45980 - DNA, 20 bp, synthetic construct
  misc_feature 1..20: note = CRISPR gRNA sequence
  source 1..20: mol_type = other DNA
cagacccagcagatgtgctg

SEQ ID NO: 45981 - DNA, 20 bp, synthetic construct
  misc_feature 1..20: note = CRISPR gRNA sequence
  source 1..20: mol_type = other DNA
cagcagatgtgctggggtgt

SEQ ID NO: 45982 - DNA, 20 bp, synthetic construct
  misc_feature 1..20: note = CRISPR gRNA sequence
  source 1..20: mol_type = other DNA
agcagatgtgctggggtgtc

SEQ ID NO: 45983 - DNA, 20 bp, synthetic construct
  misc_feature 1..20: note = CRISPR gRNA sequence
  source 1..20: mol_type = other DNA
gcagatgtgctggggtgtcg

SEQ ID NO: 45984 - DNA, 20 bp, synthetic construct
  misc_feature 1..20: note = CRISPR gRNA sequence
  source 1..20: mol_type = other DNA
agatgtgctggggtgtcggg

SEQ ID NO: 45985 - DNA, 20 bp, synthetic construct
  misc_feature 1..20: note = CRISPR gRNA sequence
  source 1..20: mol_type = other DNA
atgtgctggggtgtcgggga

SEQ ID NO: 45986 - DNA, 20 bp, synthetic construct
  misc_feature 1..20: note = CRISPR gRNA sequence
  source 1..20: mol_type = other DNA
tgtgctggggtgtcggggag

SEQ ID NO: 45987 - DNA, 20 bp, synthetic construct
  misc_feature 1..20: note = CRISPR gRNA sequence
  source 1..20: mol_type = other DNA
gtgctggggtgtcggggaga

SEQ ID NO: 45988 - DNA, 20 bp, synthetic construct
  misc_feature 1..20: note = CRISPR gRNA sequence
  source 1..20: mol_type = other DNA
tgctggggtgtcggggagag

SEQ ID NO: 45989 - DNA, 20 bp, synthetic construct
  misc_feature 1..20: note = CRISPR gRNA sequence
  source 1..20: mol_type = other DNA
gctggggtgtcggggagagg

SEQ ID NO: 45990 - DNA, 20 bp, synthetic construct
  misc_feature 1..20: note = CRISPR gRNA sequence
  source 1..20: mol_type = other DNA
gtgtcggggagagggggcat

SEQ ID NO: 45991 - DNA, 20 bp, synthetic construct
  misc_feature 1..20: note = CRISPR gRNA sequence
  source 1..20: mol_type = other DNA
gtcggggagagggggcatca

SEQ ID NO: 45992 - DNA, 20 bp, synthetic construct
  misc_feature 1..20: note = CRISPR gRNA sequence
  source 1..20: mol_type = other DNA
tcggggagagggggcatcag

SEQ ID NO: 45993 - DNA, 20 bp, synthetic construct
  misc_feature 1..20: note = CRISPR gRNA sequence
  source 1..20: mol_type = other DNA
gggggcatcagaggacctga

SEQ ID NO: 45994 - DNA, 20 bp, synthetic construct
  misc_feature 1..20: note = CRISPR gRNA sequence
  source 1..20: mol_type = other DNA
tgatggctgcccccctccca

SEQ ID NO: 45995 - DNA, 20 bp, synthetic construct
  misc_feature 1..20: note = CRISPR gRNA sequence
  source 1..20: mol_type = other DNA
gcccccctcccacagcctct

SEQ ID NO: 45996 - DNA, 20 bp, synthetic construct
  misc_feature 1..20: note = CRISPR gRNA sequence
  source 1..20: mol_type = other DNA
cccccctcccacagcctctc

SEQ ID NO: 45997 - DNA, 20 bp, synthetic construct
  misc_feature 1..20: note = CRISPR gRNA sequence
  source 1..20: mol_type = other DNA
ccccctcccacagcctctca

SEQ ID NO: 45998 - DNA, 20 bp, synthetic construct
  misc_feature 1..20: note = CRISPR gRNA sequence
  source 1..20: mol_type = other DNA
tcccacagcctctcagggaa

SEQ ID NO: 45999 - DNA, 20 bp, synthetic construct
  misc_feature 1..20: note = CRISPR gRNA sequence
  source 1..20: mol_type = other DNA
agcctctcagggaatagcat

SEQ ID NO: 46000 - DNA, 20 bp, synthetic construct
  misc_feature 1..20: note = CRISPR gRNA sequence
  source 1..20: mol_type = other DNA
ctcagggaatagcatcagct

SEQ ID NO: 46001 - DNA, 20 bp, synthetic construct
  misc_feature 1..20: note = CRISPR gRNA sequence
  source 1..20: mol_type = other DNA
gggaatagcatcagctcagc

SEQ ID NO: 46002 - DNA, 20 bp, synthetic construct
  misc_feature 1..20: note = CRISPR gRNA sequence
  source 1..20: mol_type = other DNA
ggaatagcatcagctcagcc

SEQ ID NO: 46003 - DNA, 20 bp, synthetic construct
  misc_feature 1..20: note = CRISPR gRNA sequence
  source 1..20: mol_type = other DNA
gaatagcatcagctcagccg

SEQ ID NO: 46004 - DNA, 20 bp, synthetic construct
  misc_feature 1..20: note = CRISPR gRNA sequence
  source 1..20: mol_type = other DNA
aatagcatcagctcagccgg

SEQ ID NO: 46005 - DNA, 20 bp, synthetic construct
  misc_feature 1..20: note = CRISPR gRNA sequence
  source 1..20: mol_type = other DNA
tagcatcagctcagccgggg

SEQ ID NO: 46006 - DNA, 20 bp, synthetic construct
  misc_feature 1..20: note = CRISPR gRNA sequence
  source 1..20: mol_type = other DNA
tcagctcagccgggggagtg

SEQ ID NO: 46007 - DNA, 20 bp, synthetic construct
  misc_feature 1..20: note = CRISPR gRNA sequence
  source 1..20: mol_type = other DNA
ctcagccgggggagtgcagt

SEQ ID NO: 46008 - DNA, 20 bp, synthetic construct
  misc_feature 1..20: note = CRISPR gRNA sequence
  source 1..20: mol_type = other DNA
agccgggggagtgcagttgg

SEQ ID NO: 46009 - DNA, 20 bp, synthetic construct
  misc_feature 1..20: note = CRISPR gRNA sequence
  source 1..20: mol_type = other DNA
ccgggggagtgcagttggca

SEQ ID NO: 46010 - DNA, 20 bp, synthetic construct
  misc_feature 1..20: note = CRISPR gRNA sequence
  source 1..20: mol_type = other DNA
gcagagtctctcgttctttg

SEQ ID NO: 46011 - DNA, 20 bp, synthetic construct
  misc_feature 1..20: note = CRISPR gRNA sequence
  source 1..20: mol_type = other DNA
cagagtctctcgttctttgc

SEQ ID NO: 46012 - DNA, 20 bp, synthetic construct
  misc_feature 1..20: note = CRISPR gRNA sequence
  source 1..20: mol_type = other DNA
tctcgttctttgcaggcgcc

SEQ ID NO: 46013 - DNA, 20 bp, synthetic construct
  misc_feature 1..20: note = CRISPR gRNA sequence
  source 1..20: mol_type = other DNA
tcgttctttgcaggcgcctg

SEQ ID NO: 46014 - DNA, 20 bp, synthetic construct
  misc_feature 1..20: note = CRISPR gRNA sequence
  source 1..20: mol_type = other DNA
cgttctttgcaggcgcctgg

SEQ ID NO: 46015 - DNA, 20 bp, synthetic construct
  misc_feature 1..20: note = CRISPR gRNA sequence
  source 1..20: mol_type = other DNA
ttctttgcaggcgcctggag

SEQ ID NO: 46016 - DNA, 20 bp, synthetic construct
  misc_feature 1..20: note = CRISPR gRNA sequence
  source 1..20: mol_type = other DNA
gcgcctggaggagttgatgt

SEQ ID NO: 46017 - DNA, 20 bp, synthetic construct
  misc_feature 1..20: note = CRISPR gRNA sequence
  source 1..20: mol_type = other DNA
agttgatgtgagtgtctgcc

SEQ ID NO: 46018 - DNA, 20 bp, synthetic construct
  misc_feature 1..20: note = CRISPR gRNA sequence
  source 1..20: mol_type = other DNA
gttgatgtgagtgtctgccc

SEQ ID NO: 46019 - DNA, 20 bp, synthetic construct
  misc_feature 1..20: note = CRISPR gRNA sequence
  source 1..20: mol_type = other DNA
gatgtgagtgtctgcccagg

SEQ ID NO: 46020 - DNA, 20 bp, synthetic construct
  misc_feature 1..20: note = CRISPR gRNA sequence
  source 1..20: mol_type = other DNA
cctctgccctctgtgccccc

SEQ ID NO: 46021 - DNA, 20 bp, synthetic construct
  misc_feature 1..20: note = CRISPR gRNA sequence
  source 1..20: mol_type = other DNA
ctctgccctctgtgcccccc

SEQ ID NO: 46022 - DNA, 20 bp, synthetic construct
  misc_feature 1..20: note = CRISPR gRNA sequence
  source 1..20: mol_type = other DNA
ctgtgccccccaggtccacc

SEQ ID NO: 46023 - DNA, 20 bp, synthetic construct
  misc_feature 1..20: note = CRISPR gRNA sequence
  source 1..20: mol_type = other DNA
ccacctggcctcctctcccg

SEQ ID NO: 46024 - DNA, 20 bp, synthetic construct
  misc_feature 1..20: note = CRISPR gRNA sequence
  source 1..20: mol_type = other DNA
cctggcctcctctcccgcag

SEQ ID NO: 46025 - DNA, 20 bp, synthetic construct
  misc_feature 1..20: note = CRISPR gRNA sequence
  source 1..20: mol_type = other DNA
ctggcctcctctcccgcagt

SEQ ID NO: 46026 - DNA, 20 bp, synthetic construct
  misc_feature 1..20: note = CRISPR gRNA sequence
  source 1..20: mol_type = other DNA
ctcctctcccgcagtgggca

SEQ ID NO: 46027 - DNA, 20 bp, synthetic construct
  misc_feature 1..20: note = CRISPR gRNA sequence
  source 1..20: mol_type = other DNA
tcctctcccgcagtgggcac

SEQ ID NO: 46028 - DNA, 20 bp, synthetic construct
  misc_feature 1..20: note = CRISPR gRNA sequence
  source 1..20: mol_type = other DNA
cctctcccgcagtgggcaca

SEQ ID NO: 46029 - DNA, 20 bp, synthetic construct
  misc_feature 1..20: note = CRISPR gRNA sequence
  source 1..20: mol_type = other DNA
ctcccgcagtgggcacaggg

SEQ ID NO: 46030 - DNA, 20 bp, synthetic construct
  misc_feature 1..20: note = CRISPR gRNA sequence
  source 1..20: mol_type = other DNA
tcccgcagtgggcacagggc

SEQ ID NO: 46031 - DNA, 20 bp, synthetic construct
  misc_feature 1..20: note = CRISPR gRNA sequence
  source 1..20: mol_type = other DNA
cccgcagtgggcacagggca

SEQ ID NO: 46032 - DNA, 20 bp, synthetic construct
  misc_feature 1..20: note = CRISPR gRNA sequence
  source 1..20: mol_type = other DNA
gcagtgggcacagggcaggg

SEQ ID NO: 46033 - DNA, 20 bp, synthetic construct
  misc_feature 1..20: note = CRISPR gRNA sequence
  source 1..20: mol_type = other DNA
cagtgggcacagggcagggc

SEQ ID NO: 46034 - DNA, 20 bp, synthetic construct
  misc_feature 1..20: note = CRISPR gRNA sequence
  source 1..20: mol_type = other DNA
agtgggcacagggcagggcg

SEQ ID NO: 46035 - DNA, 20 bp, synthetic construct
  misc_feature 1..20: note = CRISPR gRNA sequence
  source 1..20: mol_type = other DNA
gtgggcacagggcagggcgg

SEQ ID NO: 46036 - DNA, 20 bp, synthetic construct
  misc_feature 1..20: note = CRISPR gRNA sequence
  source 1..20: mol_type = other DNA
cagggcagggcgggggtccc

SEQ ID NO: 46037 - DNA, 20 bp, synthetic construct
  misc_feature 1..20: note = CRISPR gRNA sequence
  source 1..20: mol_type = other DNA
ggcagggcgggggtcccgag

SEQ ID NO: 46038 - DNA, 20 bp, synthetic construct
  misc_feature 1..20: note = CRISPR gRNA sequence
  source 1..20: mol_type = other DNA
gcagggcgggggtcccgagt

SEQ ID NO: 46039 - DNA, 20 bp, synthetic construct
  misc_feature 1..20: note = CRISPR gRNA sequence
  source 1..20: mol_type = other DNA
gggcgggggtcccgagtggg

SEQ ID NO: 46040 - DNA, 20 bp, synthetic construct
  misc_feature 1..20: note = CRISPR gRNA sequence
  source 1..20: mol_type = other DNA
ggcgggggtcccgagtgggc

SEQ ID NO: 46041 - DNA, 20 bp, synthetic construct
  misc_feature 1..20: note = CRISPR gRNA sequence
  source 1..20: mol_type = other DNA
gggtcccgagtgggcaggcc

SEQ ID NO: 46042 - DNA, 20 bp, synthetic construct
  misc_feature 1..20: note = CRISPR gRNA sequence
  source 1..20: mol_type = other DNA
tgctcattcctctcctcttc

SEQ ID NO: 46043 - DNA, 20 bp, synthetic construct
  misc_feature 1..20: note = CRISPR gRNA sequence
  source 1..20: mol_type = other DNA
gctcattcctctcctcttcc

SEQ ID NO: 46044 - DNA, 20 bp, synthetic construct
  misc_feature 1..20: note = CRISPR gRNA sequence
  source 1..20: mol_type = other DNA
ttcctctcctcttccaggct

SEQ ID NO: 46045 - DNA, 20 bp, synthetic construct
  misc_feature 1..20: note = CRISPR gRNA sequence
  source 1..20: mol_type = other DNA
caggcttggctgcaatgccc

SEQ ID NO: 46046 - DNA, 20 bp, synthetic construct
  misc_feature 1..20: note = CRISPR gRNA sequence
  source 1..20: mol_type = other DNA
aggcttggctgcaatgccct

SEQ ID NO: 46047 - DNA, 20 bp, synthetic construct
  misc_feature 1..20: note = CRISPR gRNA sequence
  source 1..20: mol_type = other DNA
ggcttggctgcaatgccctg

SEQ ID NO: 46048 - DNA, 20 bp, synthetic construct
  misc_feature 1..20: note = CRISPR gRNA sequence
  source 1..20: mol_type = other DNA
gcttggctgcaatgccctgg

SEQ ID NO: 46049 - DNA, 20 bp, synthetic construct
  misc_feature 1..20: note = CRISPR gRNA sequence
  source 1..20: mol_type = other DNA
caatgccctgggggatccca

SEQ ID NO: 46050 - DNA, 20 bp, synthetic construct
  misc_feature 1..20: note = CRISPR gRNA sequence
  source 1..20: mol_type = other DNA
cctgggggatcccacagccc

SEQ ID NO: 46051 - DNA, 20 bp, synthetic construct
  misc_feature 1..20: note = CRISPR gRNA sequence
  source 1..20: mol_type = other DNA
ctgggggatcccacagccct

SEQ ID NO: 46052 - DNA, 20 bp, synthetic construct
  misc_feature 1..20: note = CRISPR gRNA sequence
  source 1..20: mol_type = other DNA
tgggggatcccacagccctg

SEQ ID NO: 46053 - DNA, 20 bp, synthetic construct
  misc_feature 1..20: note = CRISPR gRNA sequence
  source 1..20: mol_type = other DNA
ggatcccacagccctggggc

SEQ ID NO: 46054 - DNA, 20 bp, synthetic construct
  misc_feature 1..20: note = CRISPR gRNA sequence
  source 1..20: mol_type = other DNA
ccacagccctggggctggct

SEQ ID NO: 46055 - DNA, 20 bp, synthetic construct
  misc_feature 1..20: note = CRISPR gRNA sequence
  source 1..20: mol_type = other DNA
cacagccctggggctggctc

SEQ ID NO: 46056 - DNA, 20 bp, synthetic construct
  misc_feature 1..20: note = CRISPR gRNA sequence
  source 1..20: mol_type = other DNA
cagccctggggctggctcag

SEQ ID NO: 46057 - DNA, 20 bp, synthetic construct
  misc_feature 1..20: note = CRISPR gRNA sequence
  source 1..20: mol_type = other DNA
ggctggctcaggagctgccc

SEQ ID NO: 46058 - DNA, 20 bp, synthetic construct
  misc_feature 1..20: note = CRISPR gRNA sequence
  source 1..20: mol_type = other DNA
caggagctgccccagcacct

SEQ ID NO: 46059 - DNA, 20 bp, synthetic construct
  misc_feature 1..20: note = CRISPR gRNA sequence
  source 1..20: mol_type = other DNA
aggagctgccccagcacctg

SEQ ID NO: 46060 - DNA, 20 bp, synthetic construct
  misc_feature 1..20: note = CRISPR gRNA sequence
  source 1..20: mol_type = other DNA
ggagctgccccagcacctga

SEQ ID NO: 46061 - DNA, 20 bp, synthetic construct
  misc_feature 1..20: note = CRISPR gRNA sequence
  source 1..20: mol_type = other DNA
cccagcacctgagggtccta

SEQ ID NO: 46062 - DNA, 20 bp, synthetic construct
  misc_feature 1..20: note = CRISPR gRNA sequence
  source 1..20: mol_type = other DNA
gcacctgagggtcctacagt

SEQ ID NO: 46063 - DNA, 20 bp, synthetic construct
  misc_feature 1..20: note = CRISPR gRNA sequence
  source 1..20: mol_type = other DNA
cctgagggtcctacagtgag

SEQ ID NO: 46064 - DNA, 20 bp, synthetic construct
  misc_feature 1..20: note = CRISPR gRNA sequence
  source 1..20: mol_type = other DNA
ggccccctgcccataccatg

SEQ ID NO: 46065 - DNA, 20 bp, synthetic construct
  misc_feature 1..20: note = CRISPR gRNA sequence
  source 1..20: mol_type = other DNA
gccccctgcccataccatgc

SEQ ID NO: 46066 - DNA, 20 bp, synthetic construct
  misc_feature 1..20: note = CRISPR gRNA sequence
  source 1..20: mol_type = other DNA
ccccctgcccataccatgca

SEQ ID NO: 46067 - DNA, 20 bp, synthetic construct
  misc_feature 1..20: note = CRISPR gRNA sequence
  source 1..20: mol_type = other DNA
ctgcccataccatgcagggc

SEQ ID NO: 46068 - DNA, 20 bp, synthetic construct
  misc_feature 1..20: note = CRISPR gRNA sequence
  source 1..20: mol_type = other DNA
cccataccatgcagggctgg

SEQ ID NO: 46069 - DNA, 20 bp, synthetic construct
  misc_feature 1..20: note = CRISPR gRNA sequence
  source 1..20: mol_type = other DNA
ccataccatgcagggctggt

SEQ ID NO: 46070 - DNA, 20 bp, synthetic construct
  misc_feature 1..20: note = CRISPR gRNA sequence
  source 1..20: mol_type = other DNA
cataccatgcagggctggtg

SEQ ID NO: 46071 - DNA, 20 bp, synthetic construct
  misc_feature 1..20: note = CRISPR gRNA sequence
  source 1..20: mol_type = other DNA
taccatgcagggctggtggg

SEQ ID NO: 46072 - DNA, 20 bp, synthetic construct
  misc_feature 1..20: note = CRISPR gRNA sequence
  source 1..20: mol_type = other DNA
accatgcagggctggtgggg

SEQ ID NO: 46073 - DNA, 20 bp, synthetic construct
  misc_feature 1..20: note = CRISPR gRNA sequence
  source 1..20: mol_type = other DNA
catgcagggctggtggggag

SEQ ID NO: 46074 - DNA, 20 bp, synthetic construct
  misc_feature 1..20: note = CRISPR gRNA sequence
  source 1..20: mol_type = other DNA
atgcagggctggtggggagg

SEQ ID NO: 46075 - DNA, 20 bp, synthetic construct
  misc_feature 1..20: note = CRISPR gRNA sequence
  source 1..20: mol_type = other DNA
tgcagggctggtggggagga

SEQ ID NO: 46076 - DNA, 20 bp, synthetic construct
  misc_feature 1..20: note = CRISPR gRNA sequence
  source 1..20: mol_type = other DNA
ctggtggggaggagggtcct

SEQ ID NO: 46077 - DNA, 20 bp, synthetic construct
  misc_feature 1..20: note = CRISPR gRNA sequence
  source 1..20: mol_type = other DNA
tggtggggaggagggtcctc

SEQ ID NO: 46078 - DNA, 20 bp, synthetic construct
  misc_feature 1..20: note = CRISPR gRNA sequence
  source 1..20: mol_type = other DNA
gtggggaggagggtcctcgg

SEQ ID NO: 46079 - DNA, 20 bp, synthetic construct
  misc_feature 1..20: note = CRISPR gRNA sequence
  source 1..20: mol_type = other DNA
gggaggagggtcctcgggag

SEQ ID NO: 46080 - DNA, 20 bp, synthetic construct
  misc_feature 1..20: note = CRISPR gRNA sequence
  source 1..20: mol_type = other DNA
aggagggtcctcgggagcag

SEQ ID NO: 46081 - DNA, 20 bp, synthetic construct
  misc_feature 1..20: note = CRISPR gRNA sequence
  source 1..20: mol_type = other DNA
ggagggtcctcgggagcagt

SEQ ID NO: 46082 - DNA, 20 bp, synthetic construct
  misc_feature 1..20: note = CRISPR gRNA sequence
  source 1..20: mol_type = other DNA
gagggtcctcgggagcagtg

SEQ ID NO: 46083 - DNA, 20 bp, synthetic construct
  misc_feature 1..20: note = CRISPR gRNA sequence
  source 1..20: mol_type = other DNA
agggtcctcgggagcagtgg

SEQ ID NO: 46084 - DNA, 20 bp, synthetic construct
  misc_feature 1..20: note = CRISPR gRNA sequence
  source 1..20: mol_type = other DNA
gggtcctcgggagcagtggg

SEQ ID NO: 46085 - DNA, 20 bp, synthetic construct
  misc_feature 1..20: note = CRISPR gRNA sequence
  source 1..20: mol_type = other DNA
ggtcctcgggagcagtgggg

SEQ ID NO: 46086 - DNA, 20 bp, synthetic construct
  misc_feature 1..20: note = CRISPR gRNA sequence
  source 1..20: mol_type = other DNA
tcgggagcagtgggggggtc

SEQ ID NO: 46087 - DNA, 20 bp, synthetic construct
  misc_feature 1..20: note = CRISPR gRNA sequence
  source 1..20: mol_type = other DNA
cgggagcagtgggggggtcc

SEQ ID NO: 46088 - DNA, 20 bp, synthetic construct
  misc_feature 1..20: note = CRISPR gRNA sequence
  source 1..20: mol_type = other DNA
gggggggtccaggcccccat

SEQ ID NO: 46089 - DNA, 20 bp, synthetic construct
  misc_feature 1..20: note = CRISPR gRNA sequence
  source 1..20: mol_type = other DNA
ggtccaggcccccatcagtt

SEQ ID NO: 46090 - DNA, 20 bp, synthetic construct
  misc_feature 1..20: note = CRISPR gRNA sequence
  source 1..20: mol_type = other DNA
cagttgagctgccctgcccc

SEQ ID NO: 46091 - DNA, 20 bp, synthetic construct
  misc_feature 1..20: note = CRISPR gRNA sequence
  source 1..20: mol_type = other DNA
gagctgccctgccccaagtc

SEQ ID NO: 46092 - DNA, 20 bp, synthetic construct
  misc_feature 1..20: note = CRISPR gRNA sequence
  source 1..20: mol_type = other DNA
gccctgccccaagtcaagct

SEQ ID NO: 46093 - DNA, 20 bp, synthetic construct
  misc_feature 1..20: note = CRISPR gRNA sequence
  source 1..20: mol_type = other DNA
ttccctgcctctgatgtctg

SEQ ID NO: 46094 - DNA, 20 bp, synthetic construct
  misc_feature 1..20: note = CRISPR gRNA sequence
  source 1..20: mol_type = other DNA
ctgcctctgatgtctgcagc

SEQ ID NO: 46095 - DNA, 20 bp, synthetic construct
  misc_feature 1..20: note = CRISPR gRNA sequence
  source 1..20: mol_type = other DNA
gatgtctgcagcaagaaaat

SEQ ID NO: 46096 - DNA, 20 bp, synthetic construct
  misc_feature 1..20: note = CRISPR gRNA sequence
  source 1..20: mol_type = other DNA
atgtctgcagcaagaaaatc

SEQ ID NO: 46097 - DNA, 20 bp, synthetic construct
  misc_feature 1..20: note = CRISPR gRNA sequence
  source 1..20: mol_type = other DNA
gtctgcagcaagaaaatcag

SEQ ID NO: 46098 - DNA, 20 bp, synthetic construct
  misc_feature 1..20: note = CRISPR gRNA sequence
  source 1..20: mol_type = other DNA
tctgcagcaagaaaatcagg

SEQ ID NO: 46099 - DNA, 20 bp, synthetic construct
  misc_feature 1..20: note = CRISPR gRNA sequence
  source 1..20: mol_type = other DNA
agcaagaaaatcaggaggcc

SEQ ID NO: 46100 - DNA, 20 bp, synthetic construct
  misc_feature 1..20: note = CRISPR gRNA sequence
  source 1..20: mol_type = other DNA
gaaaatcaggaggcccagcc

SEQ ID NO: 46101 - DNA, 20 bp, synthetic construct
  misc_feature 1..20: note = CRISPR gRNA sequence
  source 1..20: mol_type = other DNA
caggaggcccagcctagtcc

SEQ ID NO: 46102 - DNA, 20 bp, synthetic construct
  misc_feature 1..20: note = CRISPR gRNA sequence
  source 1..20: mol_type = other DNA
cctagtcctggctctgccac

SEQ ID NO: 46103 - DNA, 20 bp, synthetic construct
  misc_feature 1..20: note = CRISPR gRNA sequence
  source 1..20: mol_type = other DNA
cactggcccctgcctgacct

SEQ ID NO: 46104 - DNA, 20 bp, synthetic construct
  misc_feature 1..20: note = CRISPR gRNA sequence
  source 1..20: mol_type = other DNA
gccaaacccctgccccttct

SEQ ID NO: 46105 - DNA, 20 bp, synthetic construct
  misc_feature 1..20: note = CRISPR gRNA sequence
  source 1..20: mol_type = other DNA
cccctgccccttctcagcct

SEQ ID NO: 46106 - DNA, 20 bp, synthetic construct
  misc_feature 1..20: note = CRISPR gRNA sequence
  source 1..20: mol_type = other DNA
ctcagtttcttcacatgcaa

SEQ ID NO: 46107 - DNA, 20 bp, synthetic construct
  misc_feature 1..20: note = CRISPR gRNA sequence
  source 1..20: mol_type = other DNA
agtttcttcacatgcaaaag

SEQ ID NO: 46108 - DNA, 20 bp, synthetic construct
  misc_feature 1..20: note = CRISPR gRNA sequence
  source 1..20: mol_type = other DNA
caaaagaagtacaatgatcc

SEQ ID NO: 46109 - DNA, 20 bp, synthetic construct
  misc_feature 1..20: note = CRISPR gRNA sequence
  source 1..20: mol_type = other DNA
cccagttcattgtgccctgt

SEQ ID NO: 46110 - DNA, 20 bp, synthetic construct
  misc_feature 1..20: note = CRISPR gRNA sequence
  source 1..20: mol_type = other DNA
agttcattgtgccctgtgag

SEQ ID NO: 46111 - DNA, 20 bp, synthetic construct
  misc_feature 1..20: note = CRISPR gRNA sequence
  source 1..20: mol_type = other DNA
gttcattgtgccctgtgagc

SEQ ID NO: 46112 - DNA, 20 bp, synthetic construct
  misc_feature 1..20: note = CRISPR gRNA sequence
  source 1..20: mol_type = other DNA
tgccctgtgagcgggtccct

SEQ ID NO: 46113 - DNA, 20 bp, synthetic construct
  misc_feature 1..20: note = CRISPR gRNA sequence
  source 1..20: mol_type = other DNA
gccctgtgagcgggtccctg

SEQ ID NO: 46114 - DNA, 20 bp, synthetic construct
  misc_feature 1..20: note = CRISPR gRNA sequence
  source 1..20: mol_type = other DNA
ccctgtgagcgggtccctga

SEQ ID NO: 46115 - DNA, 20 bp, synthetic construct
  misc_feature 1..20: note = CRISPR gRNA sequence
  source 1..20: mol_type = other DNA
gcgggtccctgagggcgaat

SEQ ID NO: 46116 - DNA, 20 bp, synthetic construct
  misc_feature 1..20: note = CRISPR gRNA sequence
  source 1..20: mol_type = other DNA
tgagggcgaatgagaaatcc

SEQ ID NO: 46117 - DNA, 20 bp, synthetic construct
  misc_feature 1..20: note = CRISPR gRNA sequence
  source 1..20: mol_type = other DNA
gggcgaatgagaaatcctgg

SEQ ID NO: 46118 - DNA, 20 bp, synthetic construct
  misc_feature 1..20: note = CRISPR gRNA sequence
  source 1..20: mol_type = other DNA
gcgaatgagaaatcctggca

SEQ ID NO: 46119 - DNA, 20 bp, synthetic construct
  misc_feature 1..20: note = CRISPR gRNA sequence
  source 1..20: mol_type = other DNA
cgaatgagaaatcctggcag

SEQ ID NO: 46120 - DNA, 20 bp, synthetic construct
  misc_feature 1..20: note = CRISPR gRNA sequence
  source 1..20: mol_type = other DNA
gaatgagaaatcctggcaga

SEQ ID NO: 46121 - DNA, 20 bp, synthetic construct
  misc_feature 1..20: note = CRISPR gRNA sequence
  source 1..20: mol_type = other DNA
aatcctggcagagggcttcg

SEQ ID NO: 46122 - DNA, 20 bp, synthetic construct
  misc_feature 1..20: note = CRISPR gRNA sequence
  source 1..20: mol_type = other DNA
atcctggcagagggcttcgc

SEQ ID NO: 46123 - DNA, 20 bp, synthetic construct
  misc_feature 1..20: note = CRISPR gRNA sequence
  source 1..20: mol_type = other DNA
cctggcagagggcttcgcag

SEQ ID NO: 46124 - DNA, 20 bp, synthetic construct
  misc_feature 1..20: note = CRISPR gRNA sequence
  source 1..20: mol_type = other DNA
cagagggcttcgcaggagca

SEQ ID NO: 46125 - DNA, 20 bp, synthetic construct
  misc_feature 1..20: note = CRISPR gRNA sequence
  source 1..20: mol_type = other DNA
gagcacggtgccaatcaacg

SEQ ID NO: 46126 - DNA, 20 bp, synthetic construct
  misc_feature 1..20: note = CRISPR gRNA sequence
  source 1..20: mol_type = other DNA
ggtgccaatcaacgtggcct

SEQ ID NO: 46127 - DNA, 20 bp, synthetic construct
  misc_feature 1..20: note = CRISPR gRNA sequence
  source 1..20: mol_type = other DNA
cttcacaaatgacctcattg

SEQ ID NO: 46128 - DNA, 20 bp, synthetic construct
  misc_feature 1..20: note = CRISPR gRNA sequence
  source 1..20: mol_type = other DNA
atgacctcattgcagcccca

SEQ ID NO: 46129 - DNA, 20 bp, synthetic construct
  misc_feature 1..20: note = CRISPR gRNA sequence
  source 1..20: mol_type = other DNA
acctcattgcagccccatgg

SEQ ID NO: 46130 - DNA, 20 bp, synthetic construct
  misc_feature 1..20: note = CRISPR gRNA sequence
  source 1..20: mol_type = other DNA
tgcagccccatggcagcccc

SEQ ID NO: 46131 - DNA, 20 bp, synthetic construct
  misc_feature 1..20: note = CRISPR gRNA sequence
  source 1..20: mol_type = other DNA
cagccccatggcagccccca

SEQ ID NO: 46132 - DNA, 20 bp, synthetic construct
  misc_feature 1..20: note = CRISPR gRNA sequence
  source 1..20: mol_type = other DNA
catggcagcccccagagtcc

SEQ ID NO: 46133 - DNA, 20 bp, synthetic construct
  misc_feature 1..20: note = CRISPR gRNA sequence
  source 1..20: mol_type = other DNA
tggcagcccccagagtccca

SEQ ID NO: 46134 - DNA, 20 bp, synthetic construct
  misc_feature 1..20: note = CRISPR gRNA sequence
  source 1..20: mol_type = other DNA
cccccagagtcccagagtgc

SEQ ID NO: 46135 - DNA, 20 bp, synthetic construct
  misc_feature 1..20: note = CRISPR gRNA sequence
  source 1..20: mol_type = other DNA
ccccagagtcccagagtgct

SEQ ID NO: 46136 - DNA, 20 bp, synthetic construct
  misc_feature 1..20: note = CRISPR gRNA sequence
  source 1..20: mol_type = other DNA
tttttttttttttttttttt

SEQ ID NO: 46137 - DNA, 20 bp, synthetic construct
  misc_feature 1..20: note = CRISPR gRNA sequence
  source 1..20: mol_type = other DNA
tttttttttttttttttaga

SEQ ID NO: 46138 - DNA, 20 bp, synthetic construct
  misc_feature 1..20: note = CRISPR gRNA sequence
  source 1..20: mol_type = other DNA
tttttttttttttttagatg

SEQ ID NO: 46139 - DNA, 20 bp, synthetic construct
  misc_feature 1..20: note = CRISPR gRNA sequence
  source 1..20: mol_type = other DNA
tggagtctctctctgtcacc

SEQ ID NO: 46140 - DNA, 20 bp, synthetic construct
  misc_feature 1..20: note = CRISPR gRNA sequence
  source 1..20: mol_type = other DNA
ggagtctctctctgtcaccc

SEQ ID NO: 46141 - DNA, 20 bp, synthetic construct
  misc_feature 1..20: note = CRISPR gRNA sequence
  source 1..20: mol_type = other DNA
tctctctctgtcacccaggc

SEQ ID NO: 46142 - DNA, 20 bp, synthetic construct
  misc_feature 1..20: note = CRISPR gRNA sequence
  source 1..20: mol_type = other DNA
tctctctgtcacccaggctg

SEQ ID NO: 46143 - DNA, 20 bp, synthetic construct
  misc_feature 1..20: note = CRISPR gRNA sequence
  source 1..20: mol_type = other DNA
ctgtcacccaggctggagtg

SEQ ID NO: 46144 - DNA, 20 bp, synthetic construct
  misc_feature 1..20: note = CRISPR gRNA sequence
  source 1..20: mol_type = other DNA
tcacccaggctggagtgcag

SEQ ID NO: 46145 - DNA, 20 bp, synthetic construct
  misc_feature 1..20: note = CRISPR gRNA sequence
  source 1..20: mol_type = other DNA
ggagtgcagtggtgcaacct

SEQ ID NO: 46146 - DNA, 20 bp, synthetic construct
  misc_feature 1..20: note = CRISPR gRNA sequence
  source 1..20: mol_type = other DNA
tcactgcaacctccacctcc

SEQ ID NO: 46147 - DNA, 20 bp, synthetic construct
  misc_feature 1..20: note = CRISPR gRNA sequence
  source 1..20: mol_type = other DNA
cactgcaacctccacctccc

SEQ ID NO: 46148 - DNA, 20 bp, synthetic construct
  misc_feature 1..20: note = CRISPR gRNA sequence
  source 1..20: mol_type = other DNA
aacctccacctcccgggttc

SEQ ID NO: 46149 - DNA, 20 bp, synthetic construct
  misc_feature 1..20: note = CRISPR gRNA sequence
  source 1..20: mol_type = other DNA
ttcaagcaattcttgtgcct

SEQ ID NO: 46150 - DNA, 20 bp, synthetic construct
  misc_feature 1..20: note = CRISPR gRNA sequence
  source 1..20: mol_type = other DNA
aattcttgtgcctcagctac

SEQ ID NO: 46151 - DNA, 20 bp, synthetic construct
  misc_feature 1..20: note = CRISPR gRNA sequence
  source 1..20: mol_type = other DNA
ttcttgtgcctcagctacca

SEQ ID NO: 46152 - DNA, 20 bp, synthetic construct
  misc_feature 1..20: note = CRISPR gRNA sequence
  source 1..20: mol_type = other DNA
ttgtgcctcagctaccagag

SEQ ID NO: 46153 - DNA, 20 bp, synthetic construct
  misc_feature 1..20: note = CRISPR gRNA sequence
  source 1..20: mol_type = other DNA
gcctcagctaccagagtagc

SEQ ID NO: 46154 - DNA, 20 bp, synthetic construct
  misc_feature 1..20: note = CRISPR gRNA sequence
  source 1..20: mol_type = other DNA
cctcagctaccagagtagct

SEQ ID NO: 46155 - DNA, 20 bp, synthetic construct
  misc_feature 1..20: note = CRISPR gRNA sequence
  source 1..20: mol_type = other DNA
accagagtagctgggattac

SEQ ID NO: 46156 - DNA, 20 bp, synthetic construct
  misc_feature 1..20: note = CRISPR gRNA sequence
  source 1..20: mol_type = other DNA
acgagcatgcccaccatgcc

SEQ ID NO: 46157 - DNA, 20 bp, synthetic construct
  misc_feature 1..20: note = CRISPR gRNA sequence
  source 1..20: mol_type = other DNA
ccagctaatttttgtatttt

SEQ ID NO: 46158 - DNA, 20 bp, synthetic construct
  misc_feature 1..20: note = CRISPR gRNA sequence
  source 1..20: mol_type = other DNA
gctaatttttgtatttttag

SEQ ID NO: 46159 - DNA, 20 bp, synthetic construct
  misc_feature 1..20: note = CRISPR gRNA sequence
  source 1..20: mol_type = other DNA
taatttttgtatttttagta

SEQ ID NO: 46160 - DNA, 20 bp, synthetic construct
  misc_feature 1..20: note = CRISPR gRNA sequence
  source 1..20: mol_type = other DNA
ttttgtatttttagtagaga

SEQ ID NO: 46161 - DNA, 20 bp, synthetic construct
  misc_feature 1..20: note = CRISPR gRNA sequence
  source 1..20: mol_type = other DNA
cggcatttcaccatattgcc

SEQ ID NO: 46162 - DNA, 20 bp, synthetic construct
  misc_feature 1..20: note = CRISPR gRNA sequence
  source 1..20: mol_type = other DNA
ggcatttcaccatattgccc

SEQ ID NO: 46163 - DNA, 20 bp, synthetic construct
  misc_feature 1..20: note = CRISPR gRNA sequence
  source 1..20: mol_type = other DNA
tttcaccatattgcccaggc

SEQ ID NO: 46164 - DNA, 20 bp, synthetic construct
  misc_feature 1..20: note = CRISPR gRNA sequence
  source 1..20: mol_type = other DNA
catattgcccaggctggtct

SEQ ID NO: 46165 - DNA, 20 bp, synthetic construct
  misc_feature 1..20: note = CRISPR gRNA sequence
  source 1..20: mol_type = other DNA
ccaggctggtcttggactcc

SEQ ID NO: 46166 - DNA, 20 bp, synthetic construct
  misc_feature 1..20: note = CRISPR gRNA sequence
  source 1..20: mol_type = other DNA
ggtcttggactcctggcctc

SEQ ID NO: 46167 - DNA, 20 bp, synthetic construct
  misc_feature 1..20: note = CRISPR gRNA sequence
  source 1..20: mol_type = other DNA
ctcaagtgatccacccacct

SEQ ID NO: 46168 - DNA, 20 bp, synthetic construct
  misc_feature 1..20: note = CRISPR gRNA sequence
  source 1..20: mol_type = other DNA
ccacccacctcagcctccaa

SEQ ID NO: 46169 - DNA, 20 bp, synthetic construct
  misc_feature 1..20: note = CRISPR gRNA sequence
  source 1..20: mol_type = other DNA
acctcagcctccaaaagtgc

SEQ ID NO: 46170 - DNA, 20 bp, synthetic construct
  misc_feature 1..20: note = CRISPR gRNA sequence
  source 1..20: mol_type = other DNA
cctcagcctccaaaagtgct

SEQ ID NO: 46171 - DNA, 20 bp, synthetic construct
  misc_feature 1..20: note = CRISPR gRNA sequence
  source 1..20: mol_type = other DNA
ctccaaaagtgctgggatta

SEQ ID NO: 46172 - DNA, 20 bp, synthetic construct
  misc_feature 1..20: note = CRISPR gRNA sequence
  source 1..20: mol_type = other DNA
tccaaaagtgctgggattac

SEQ ID NO: 46173 - DNA, 20 bp, synthetic construct
  misc_feature 1..20: note = CRISPR gRNA sequence
  source 1..20: mol_type = other DNA
agtgctgggattacaggcgt

SEQ ID NO: 46174 - DNA, 20 bp, synthetic construct
  misc_feature 1..20: note = CRISPR gRNA sequence
  source 1..20: mol_type = other DNA
attacaggcgtgagccacca

SEQ ID NO: 46175 - DNA, 20 bp, synthetic construct
  misc_feature 1..20: note = CRISPR gRNA sequence
  source 1..20: mol_type = other DNA
caggcgtgagccaccatggc

SEQ ID NO: 46176 - DNA, 20 bp, synthetic construct
  misc_feature 1..20: note = CRISPR gRNA sequence
  source 1..20: mol_type = other DNA
cgtgagccaccatggctggc

SEQ ID NO: 46177 - DNA, 20 bp, synthetic construct
  misc_feature 1..20: note = CRISPR gRNA sequence
  source 1..20: mol_type = other DNA
ccaccatggctggctggtgc

SEQ ID NO: 46178 - DNA, 20 bp, synthetic construct
  misc_feature 1..20: note = CRISPR gRNA sequence
  source 1..20: mol_type = other DNA
caccatggctggctggtgct

SEQ ID NO: 46179 - DNA, 20 bp, synthetic construct
  misc_feature 1..20: note = CRISPR gRNA sequence
  source 1..20: mol_type = other DNA
cttttatgtgctcccttttc

SEQ ID NO: 46180 - DNA, 20 bp, synthetic construct
  misc_feature 1..20: note = CRISPR gRNA sequence
  source 1..20: mol_type = other DNA
ttttatgtgctcccttttcc

SEQ ID NO: 46181 - DNA, 20 bp, synthetic construct
  misc_feature 1..20: note = CRISPR gRNA sequence
  source 1..20: mol_type = other DNA
atgtgctcccttttccaggc

SEQ ID NO: 46182 - DNA, 20 bp, synthetic construct
  misc_feature 1..20: note = CRISPR gRNA sequence
  source 1..20: mol_type = other DNA
tgtgctcccttttccaggca

SEQ ID NO: 46183 - DNA, 20 bp, synthetic construct
  misc_feature 1..20: note = CRISPR gRNA sequence
  source 1..20: mol_type = other DNA
gtgctcccttttccaggcaa

SEQ ID NO: 46184 - DNA, 20 bp, synthetic construct
  misc_feature 1..20: note = CRISPR gRNA sequence
  source 1..20: mol_type = other DNA
cttttccaggcaagggaatg

SEQ ID NO: 46185 - DNA, 20 bp, synthetic construct
  misc_feature 1..20: note = CRISPR gRNA sequence
  source 1..20: mol_type = other DNA
ttttccaggcaagggaatga

SEQ ID NO: 46186 - DNA, 20 bp, synthetic construct
  misc_feature 1..20: note = CRISPR gRNA sequence
  source 1..20: mol_type = other DNA
ccaggcaagggaatgaaggc

SEQ ID NO: 46187 - DNA, 20 bp, synthetic construct
  misc_feature 1..20: note = CRISPR gRNA sequence
  source 1..20: mol_type = other DNA
caggcaagggaatgaaggcc

SEQ ID NO: 46188 - DNA, 20 bp, synthetic construct
  misc_feature 1..20: note = CRISPR gRNA sequence
  source 1..20: mol_type = other DNA
ggcaagggaatgaaggccag

SEQ ID NO: 46189 - DNA, 20 bp, synthetic construct
  misc_feature 1..20: note = CRISPR gRNA sequence
  source 1..20: mol_type = other DNA
caagggaatgaaggccagga

SEQ ID NO: 46190 - DNA, 20 bp, synthetic construct
  misc_feature 1..20: note = CRISPR gRNA sequence
  source 1..20: mol_type = other DNA
aagggaatgaaggccaggag

SEQ ID NO: 46191 - DNA, 20 bp, synthetic construct
  misc_feature 1..20: note = CRISPR gRNA sequence
  source 1..20: mol_type = other DNA
aatgaaggccaggagaggtg

SEQ ID NO: 46192 - DNA, 20 bp, synthetic construct
  misc_feature 1..20: note = CRISPR gRNA sequence
  source 1..20: mol_type = other DNA
tgaaggccaggagaggtgtg

SEQ ID NO: 46193 - DNA, 20 bp, synthetic construct
  misc_feature 1..20: note = CRISPR gRNA sequence
  source 1..20: mol_type = other DNA
attttccttactcatacacg

SEQ ID NO: 46194 - DNA, 20 bp, synthetic construct
  misc_feature 1..20: note = CRISPR gRNA sequence
  source 1..20: mol_type = other DNA
ttttccttactcatacacga

SEQ ID NO: 46195 - DNA, 20 bp, synthetic construct
  misc_feature 1..20: note = CRISPR gRNA sequence
  source 1..20: mol_type = other DNA
ttactcatacacgaaggacc

SEQ ID NO: 46196 - DNA, 20 bp, synthetic construct
  misc_feature 1..20: note = CRISPR gRNA sequence
  source 1..20: mol_type = other DNA
tactcatacacgaaggaccc

SEQ ID NO: 46197 - DNA, 20 bp, synthetic construct
  misc_feature 1..20: note = CRISPR gRNA sequence
  source 1..20: mol_type = other DNA
aaggacccaggtgttgaatt

SEQ ID NO: 46198 - DNA, 20 bp, synthetic construct
  misc_feature 1..20: note = CRISPR gRNA sequence
  source 1..20: mol_type = other DNA
aggacccaggtgttgaattt

SEQ ID NO: 46199 - DNA, 20 bp, synthetic construct
  misc_feature 1..20: note = CRISPR gRNA sequence
  source 1..20: mol_type = other DNA
aggtgttgaatttgggatct

SEQ ID NO: 46200 - DNA, 20 bp, synthetic construct
  misc_feature 1..20: note = CRISPR gRNA sequence
  source 1..20: mol_type = other DNA
atttgggatctcagacccca

SEQ ID NO: 46201 - DNA, 20 bp, synthetic construct
  misc_feature 1..20: note = CRISPR gRNA sequence
  source 1..20: mol_type = other DNA
gggatctcagaccccaaagc

SEQ ID NO: 46202 - DNA, 20 bp, synthetic construct
  misc_feature 1..20: note = CRISPR gRNA sequence
  source 1..20: mol_type = other DNA
ggatctcagaccccaaagcc

SEQ ID NO: 46203 - DNA, 20 bp, synthetic construct
  misc_feature 1..20: note = CRISPR gRNA sequence
  source 1..20: mol_type = other DNA
gatctcagaccccaaagcca

SEQ ID NO: 46204 - DNA, 20 bp, synthetic construct
  misc_feature 1..20: note = CRISPR gRNA sequence
  source 1..20: mol_type = other DNA
cagggtccttgatacctacc

SEQ ID NO: 46205 - DNA, 20 bp, synthetic construct
  misc_feature 1..20: note = CRISPR gRNA sequence
  source 1..20: mol_type = other DNA
agggtccttgatacctaccc

SEQ ID NO: 46206 - DNA, 20 bp, synthetic construct
  misc_feature 1..20: note = CRISPR gRNA sequence
  source 1..20: mol_type = other DNA
atacctacccaggtcctgtg

SEQ ID NO: 46207 - DNA, 20 bp, synthetic construct
  misc_feature 1..20: note = CRISPR gRNA sequence
  source 1..20: mol_type = other DNA
ctacccaggtcctgtgtgga

SEQ ID NO: 46208 - DNA, 20 bp, synthetic construct
  misc_feature 1..20: note = CRISPR gRNA sequence
  source 1..20: mol_type = other DNA
tacccaggtcctgtgtggat

SEQ ID NO: 46209 - DNA, 20 bp, synthetic construct
  misc_feature 1..20: note = CRISPR gRNA sequence
  source 1..20: mol_type = other DNA
acccaggtcctgtgtggatg

SEQ ID NO: 46210 - DNA, 20 bp, synthetic construct
  misc_feature 1..20: note = CRISPR gRNA sequence
  source 1..20: mol_type = other DNA
gtcctgtgtggatggggaat

SEQ ID NO: 46211 - DNA, 20 bp, synthetic construct
  misc_feature 1..20: note = CRISPR gRNA sequence
  source 1..20: mol_type = other DNA
tgtgtggatggggaattagc

SEQ ID NO: 46212 - DNA, 20 bp, synthetic construct
  misc_feature 1..20: note = CRISPR gRNA sequence
  source 1..20: mol_type = other DNA
tgtggatggggaattagcca

SEQ ID NO: 46213 - DNA, 20 bp, synthetic construct
  misc_feature 1..20: note = CRISPR gRNA sequence
  source 1..20: mol_type = other DNA
aattagccagagactgtcta

SEQ ID NO: 46214 - DNA, 20 bp, synthetic construct
  misc_feature 1..20: note = CRISPR gRNA sequence
  source 1..20: mol_type = other DNA
attagccagagactgtctac

SEQ ID NO: 46215 - DNA, 20 bp, synthetic construct
  misc_feature 1..20: note = CRISPR gRNA sequence
  source 1..20: mol_type = other DNA
gccagagactgtctacgggc

SEQ ID NO: 46216 - DNA, 20 bp, synthetic construct
  misc_feature 1..20: note = CRISPR gRNA sequence
  source 1..20: mol_type = other DNA
ctgtctacgggctggcactg

SEQ ID NO: 46217 - DNA, 20 bp, synthetic construct
  misc_feature 1..20: note = CRISPR gRNA sequence
  source 1..20: mol_type = other DNA
acgggctggcactgcagcct

SEQ ID NO: 46218 - DNA, 20 bp, synthetic construct
  misc_feature 1..20: note = CRISPR gRNA sequence
  source 1..20: mol_type = other DNA
ctggcactgcagcctgagac

SEQ ID NO: 46219 - DNA, 20 bp, synthetic construct
  misc_feature 1..20: note = CRISPR gRNA sequence
  source 1..20: mol_type = other DNA
tggcactgcagcctgagaca

SEQ ID NO: 46220 - DNA, 20 bp, synthetic construct
  misc_feature 1..20: note = CRISPR gRNA sequence
  source 1..20: mol_type = other DNA
ctgcagcctgagacaaggct

SEQ ID NO: 46221 - DNA, 20 bp, synthetic construct
  misc_feature 1..20: note = CRISPR gRNA sequence
  source 1..20: mol_type = other DNA
tgcagcctgagacaaggctg

SEQ ID NO: 46222 - DNA, 20 bp, synthetic construct
  misc_feature 1..20: note = CRISPR gRNA sequence
  source 1..20: mol_type = other DNA
gcagcctgagacaaggctga

SEQ ID NO: 46223 - DNA, 20 bp, synthetic construct
  misc_feature 1..20: note = CRISPR gRNA sequence
  source 1..20: mol_type = other DNA
gcctgagacaaggctgaggg

SEQ ID NO: 46224 - DNA, 20 bp, synthetic construct
  misc_feature 1..20: note = CRISPR gRNA sequence
  source 1..20: mol_type = other DNA
cctgagacaaggctgagggt

SEQ ID NO: 46225 - DNA, 20 bp, synthetic construct
  misc_feature 1..20: note = CRISPR gRNA sequence
  source 1..20: mol_type = other DNA
ctgagacaaggctgagggtg

SEQ ID NO: 46226 - DNA, 20 bp, synthetic construct
  misc_feature 1..20: note = CRISPR gRNA sequence
  source 1..20: mol_type = other DNA
caaggctgagggtggggctc

SEQ ID NO: 46227 - DNA, 20 bp, synthetic construct
  misc_feature 1..20: note = CRISPR gRNA sequence
  source 1..20: mol_type = other DNA
gggtggggctctggaaacgc

SEQ ID NO: 46228 - DNA, 20 bp, synthetic construct
  misc_feature 1..20: note = CRISPR gRNA sequence
  source 1..20: mol_type = other DNA
ctctggaaacgccagtccct

SEQ ID NO: 46229 - DNA, 20 bp, synthetic construct
  misc_feature 1..20: note = CRISPR gRNA sequence
  source 1..20: mol_type = other DNA
tctggaaacgccagtccctc

SEQ ID NO: 46230 - DNA, 20 bp, synthetic construct
  misc_feature 1..20: note = CRISPR gRNA sequence
  source 1..20: mol_type = other DNA
ctcaccctctcctctttccc

SEQ ID NO: 46231 - DNA, 20 bp, synthetic construct
  misc_feature 1..20: note = CRISPR gRNA sequence
  source 1..20: mol_type = other DNA
tctttccccagcctaccatt

SEQ ID NO: 46232 - DNA, 20 bp, synthetic construct
  misc_feature 1..20: note = CRISPR gRNA sequence
  source 1..20: mol_type = other DNA
cagcctaccattcagccatc

SEQ ID NO: 46233 - DNA, 20 bp, synthetic construct
  misc_feature 1..20: note = CRISPR gRNA sequence
  source 1..20: mol_type = other DNA
agcctaccattcagccatct

SEQ ID NO: 46234 - DNA, 20 bp, synthetic construct
  misc_feature 1..20: note = CRISPR gRNA sequence
  source 1..20: mol_type = other DNA
accattcagccatctgggcc

SEQ ID NO: 46235 - DNA, 20 bp, synthetic construct
  misc_feature 1..20: note = CRISPR gRNA sequence
  source 1..20: mol_type = other DNA
ccattcagccatctgggccc

SEQ ID NO: 46236 - DNA, 20 bp, synthetic construct
  misc_feature 1..20: note = CRISPR gRNA sequence
  source 1..20: mol_type = other DNA
ttcagccatctgggcccagg

SEQ ID NO: 46237 - DNA, 20 bp, synthetic construct
  misc_feature 1..20: note = CRISPR gRNA sequence
  source 1..20: mol_type = other DNA
tcagccatctgggcccaggt

SEQ ID NO: 46238 - DNA, 20 bp, synthetic construct
  misc_feature 1..20: note = CRISPR gRNA sequence
  source 1..20: mol_type = other DNA
cagccatctgggcccaggtg

SEQ ID NO: 46239 - DNA, 20 bp, synthetic construct
  misc_feature 1..20: note = CRISPR gRNA sequence
  source 1..20: mol_type = other DNA
ctgggcccaggtggggccct

SEQ ID NO: 46240 - DNA, 20 bp, synthetic construct
  misc_feature 1..20: note = CRISPR gRNA sequence
  source 1..20: mol_type = other DNA
cccaggtggggccctgagcc

SEQ ID NO: 46241 - DNA, 20 bp, synthetic construct
  misc_feature 1..20: note = CRISPR gRNA sequence
  source 1..20: mol_type = other DNA
gtggggccctgagcctggcc

SEQ ID NO: 46242 - DNA, 20 bp, synthetic construct
  misc_feature 1..20: note = CRISPR gRNA sequence
  source 1..20: mol_type = other DNA
tggggccctgagcctggccc

SEQ ID NO: 46243 - DNA, 20 bp, synthetic construct
  misc_feature 1..20: note = CRISPR gRNA sequence
  source 1..20: mol_type = other DNA
cctgagcctggcccaggccc

SEQ ID NO: 46244 - DNA, 20 bp, synthetic construct
  misc_feature 1..20: note = CRISPR gRNA sequence
  source 1..20: mol_type = other DNA
agcctggcccaggccctgga

SEQ ID NO: 46245 - DNA, 20 bp, synthetic construct
  misc_feature 1..20: note = CRISPR gRNA sequence
  source 1..20: mol_type = other DNA
cctggatggatccccccatt

SEQ ID NO: 46246 - DNA, 20 bp, synthetic construct
  misc_feature 1..20: note = CRISPR gRNA sequence
  source 1..20: mol_type = other DNA
ggatggatccccccatttgg

SEQ ID NO: 46247 - DNA, 20 bp, synthetic construct
  misc_feature 1..20: note = CRISPR gRNA sequence
  source 1..20: mol_type = other DNA
atggatccccccatttggaa

SEQ ID NO: 46248 - DNA, 20 bp, synthetic construct
  misc_feature 1..20: note = CRISPR gRNA sequence
  source 1..20: mol_type = other DNA
tccccccatttggaagagat

SEQ ID NO: 46249 - DNA, 20 bp, synthetic construct
  misc_feature 1..20: note = CRISPR gRNA sequence
  source 1..20: mol_type = other DNA
ccccccatttggaagagatc

SEQ ID NO: 46250 - DNA, 20 bp, synthetic construct
  misc_feature 1..20: note = CRISPR gRNA sequence
  source 1..20: mol_type = other DNA
ccatttggaagagatcaggt

SEQ ID NO: 46251 - DNA, 20 bp, synthetic construct
  misc_feature 1..20: note = CRISPR gRNA sequence
  source 1..20: mol_type = other DNA
tttggaagagatcaggtaag

SEQ ID NO: 46252 - DNA, 20 bp, synthetic construct
  misc_feature 1..20: note = CRISPR gRNA sequence
  source 1..20: mol_type = other DNA
ttggaagagatcaggtaagt

SEQ ID NO: 46253 - DNA, 20 bp, synthetic construct
  misc_feature 1..20: note = CRISPR gRNA sequence
  source 1..20: mol_type = other DNA
tggaagagatcaggtaagta

SEQ ID NO: 46254 - DNA, 20 bp, synthetic construct
  misc_feature 1..20: note = CRISPR gRNA sequence
  source 1..20: mol_type = other DNA
ggaagagatcaggtaagtag

SEQ ID NO: 46255 - DNA, 20 bp, synthetic construct
  misc_feature 1..20: note = CRISPR gRNA sequence
  source 1..20: mol_type = other DNA
tcaggtaagtaggggctgcc

SEQ ID NO: 46256 - DNA, 20 bp, synthetic construct
  misc_feature 1..20: note = CRISPR gRNA sequence
  source 1..20: mol_type = other DNA
taagtaggggctgcccagcc

SEQ ID NO: 46257 - DNA, 20 bp, synthetic construct
  misc_feature 1..20: note = CRISPR gRNA sequence
  source 1..20: mol_type = other DNA
aagtaggggctgcccagccc

SEQ ID NO: 46258 - DNA, 20 bp, synthetic construct
  misc_feature 1..20: note = CRISPR gRNA sequence
  source 1..20: mol_type = other DNA
ggggctgcccagcccaggca

SEQ ID NO: 46259 - DNA, 20 bp, synthetic construct
  misc_feature 1..20: note = CRISPR gRNA sequence
  source 1..20: mol_type = other DNA
gggctgcccagcccaggcac

SEQ ID NO: 46260 - DNA, 20 bp, synthetic construct
  misc_feature 1..20: note = CRISPR gRNA sequence
  source 1..20: mol_type = other DNA
ggctgcccagcccaggcacg

SEQ ID NO: 46261 - DNA, 20 bp, synthetic construct
  misc_feature 1..20: note = CRISPR gRNA sequence
  source 1..20: mol_type = other DNA
gcccagcccaggcacgggga

SEQ ID NO: 46262 - DNA, 20 bp, synthetic construct
  misc_feature 1..20: note = CRISPR gRNA sequence
  source 1..20: mol_type = other DNA
cccaggcacggggacagtcc

SEQ ID NO: 46263 - DNA, 20 bp, synthetic construct
  misc_feature 1..20: note = CRISPR gRNA sequence
  source 1..20: mol_type = other DNA
ccaggcacggggacagtcct

SEQ ID NO: 46264 - DNA, 20 bp, synthetic construct
  misc_feature 1..20: note = CRISPR gRNA sequence
  source 1..20: mol_type = other DNA
ggcacggggacagtcctggg

SEQ ID NO: 46265 - DNA, 20 bp, synthetic construct
  misc_feature 1..20: note = CRISPR gRNA sequence
  source 1..20: mol_type = other DNA
gcacggggacagtcctgggc

SEQ ID NO: 46266 - DNA, 20 bp, synthetic construct
  misc_feature 1..20: note = CRISPR gRNA sequence
  source 1..20: mol_type = other DNA
gggacagtcctgggcgggtc

SEQ ID NO: 46267 - DNA, 20 bp, synthetic construct
  misc_feature 1..20: note = CRISPR gRNA sequence
  source 1..20: mol_type = other DNA
ggacagtcctgggcgggtct

SEQ ID NO: 46268 - DNA, 20 bp, synthetic construct
  misc_feature 1..20: note = CRISPR gRNA sequence
  source 1..20: mol_type = other DNA
gacagtcctgggcgggtctg

SEQ ID NO: 46269 - DNA, 20 bp, synthetic construct
  misc_feature 1..20: note = CRISPR gRNA sequence
  source 1..20: mol_type = other DNA
acagtcctgggcgggtctgg

SEQ ID NO: 46270 - DNA, 20 bp, synthetic construct
  misc_feature 1..20: note = CRISPR gRNA sequence
  source 1..20: mol_type = other DNA
gggtctgggggttcctctca

SEQ ID NO: 46271 - DNA, 20 bp, synthetic construct
  misc_feature 1..20: note = CRISPR gRNA sequence
  source 1..20: mol_type = other DNA
ggtctgggggttcctctcac

SEQ ID NO: 46272 - DNA, 20 bp, synthetic construct
  misc_feature 1..20: note = CRISPR gRNA sequence
  source 1..20: mol_type = other DNA
caggtatctcccctaccctg

SEQ ID NO: 46273 - DNA, 20 bp, synthetic construct
  misc_feature 1..20: note = CRISPR gRNA sequence
  source 1..20: mol_type = other DNA
atctcccctaccctgcagct

SEQ ID NO: 46274 - DNA, 20 bp, synthetic construct
  misc_feature 1..20: note = CRISPR gRNA sequence
  source 1..20: mol_type = other DNA
tcccctaccctgcagcttgg

SEQ ID NO: 46275 - DNA, 20 bp, synthetic construct
  misc_feature 1..20: note = CRISPR gRNA sequence
  source 1..20: mol_type = other DNA
cagcttggcggaaaacaacc

SEQ ID NO: 46276 - DNA, 20 bp, synthetic construct
  misc_feature 1..20: note = CRISPR gRNA sequence
  source 1..20: mol_type = other DNA
ttggcggaaaacaacctggc

SEQ ID NO: 46277 - DNA, 20 bp, synthetic construct
  misc_feature 1..20: note = CRISPR gRNA sequence
  source 1..20: mol_type = other DNA
ggcggaaaacaacctggctg

SEQ ID NO: 46278 - DNA, 20 bp, synthetic construct
  misc_feature 1..20: note = CRISPR gRNA sequence
  source 1..20: mol_type = other DNA
gcggaaaacaacctggctgg

SEQ ID NO: 46279 - DNA, 20 bp, synthetic construct
  misc_feature 1..20: note = CRISPR gRNA sequence
  source 1..20: mol_type = other DNA
cggaaaacaacctggctgga

SEQ ID NO: 46280 - DNA, 20 bp, synthetic construct
  misc_feature 1..20: note = CRISPR gRNA sequence
  source 1..20: mol_type = other DNA
ggaaaacaacctggctggag

SEQ ID NO: 46281 - DNA, 20 bp, synthetic construct
  misc_feature 1..20: note = CRISPR gRNA sequence
  source 1..20: mol_type = other DNA
aggggtcctgcgtttctgta

SEQ ID NO: 46282 - DNA, 20 bp, synthetic construct
  misc_feature 1..20: note = CRISPR gRNA sequence
  source 1..20: mol_type = other DNA
gggtcctgcgtttctgtatg

SEQ ID NO: 46283 - DNA, 20 bp, synthetic construct
  misc_feature 1..20: note = CRISPR gRNA sequence
  source 1..20: mol_type = other DNA
tgtatggagctcccgctgct

SEQ ID NO: 46284 - DNA, 20 bp, synthetic construct
  misc_feature 1..20: note = CRISPR gRNA sequence
  source 1..20: mol_type = other DNA
tggagctcccgctgctcaga

SEQ ID NO: 46285 - DNA, 20 bp, synthetic construct
  misc_feature 1..20: note = CRISPR gRNA sequence
  source 1..20: mol_type = other DNA
gctcccgctgctcagacaga

SEQ ID NO: 46286 - DNA, 20 bp, synthetic construct
  misc_feature 1..20: note = CRISPR gRNA sequence
  source 1..20: mol_type = other DNA
tcccgctgctcagacagata

SEQ ID NO: 46287 - DNA, 20 bp, synthetic construct
  misc_feature 1..20: note = CRISPR gRNA sequence
  source 1..20: mol_type = other DNA
gctgctcagacagatagagt

SEQ ID NO: 46288 - DNA, 20 bp, synthetic construct
  misc_feature 1..20: note = CRISPR gRNA sequence
  source 1..20: mol_type = other DNA
gctcagacagatagagtaag

SEQ ID NO: 46289 - DNA, 20 bp, synthetic construct
  misc_feature 1..20: note = CRISPR gRNA sequence
  source 1..20: mol_type = other DNA
agtagcctcccctgcctgcc

SEQ ID NO: 46290 - DNA, 20 bp, synthetic construct
  misc_feature 1..20: note = CRISPR gRNA sequence
  source 1..20: mol_type = other DNA
gtagcctcccctgcctgcct

SEQ ID NO: 46291 - DNA, 20 bp, synthetic construct
  misc_feature 1..20: note = CRISPR gRNA sequence
  source 1..20: mol_type = other DNA
tagcctcccctgcctgccta

SEQ ID NO: 46292 - DNA, 20 bp, synthetic construct
  misc_feature 1..20: note = CRISPR gRNA sequence
  source 1..20: mol_type = other DNA
agcctcccctgcctgcctag

SEQ ID NO: 46293 - DNA, 20 bp, synthetic construct
  misc_feature 1..20: note = CRISPR gRNA sequence
  source 1..20: mol_type = other DNA
cccctgcctgcctaggggac

SEQ ID NO: 46294 - DNA, 20 bp, synthetic construct
  misc_feature 1..20: note = CRISPR gRNA sequence
  source 1..20: mol_type = other DNA
ctgcctgcctaggggaccag

SEQ ID NO: 46295 - DNA, 20 bp, synthetic construct
  misc_feature 1..20: note = CRISPR gRNA sequence
  source 1..20: mol_type = other DNA
cctgcctaggggaccagtgg

SEQ ID NO: 46296 - DNA, 20 bp, synthetic construct
  misc_feature 1..20: note = CRISPR gRNA sequence
  source 1..20: mol_type = other DNA
ctgcctaggggaccagtggc

SEQ ID NO: 46297 - DNA, 20 bp, synthetic construct
  misc_feature 1..20: note = CRISPR gRNA sequence
  source 1..20: mol_type = other DNA
taggggaccagtggcaggct

SEQ ID NO: 46298 - DNA, 20 bp, synthetic construct
  misc_feature 1..20: note = CRISPR gRNA sequence
  source 1..20: mol_type = other DNA
aggggaccagtggcaggctg

SEQ ID NO: 46299 - DNA, 20 bp, synthetic construct
  misc_feature 1..20: note = CRISPR gRNA sequence
  source 1..20: mol_type = other DNA
ggggaccagtggcaggctga

SEQ ID NO: 46300 - DNA, 20 bp, synthetic construct
  misc_feature 1..20: note = CRISPR gRNA sequence
  source 1..20: mol_type = other DNA
gaccagtggcaggctgaggg

SEQ ID NO: 46301 - DNA, 20 bp, synthetic construct
  misc_feature 1..20: note = CRISPR gRNA sequence
  source 1..20: mol_type = other DNA
agggcagcccttctctgact

SEQ ID NO: 46302 - DNA, 20 bp, synthetic construct
  misc_feature 1..20: note = CRISPR gRNA sequence
  source 1..20: mol_type = other DNA
ctctgactgagcctaacacc

SEQ ID NO: 46303 - DNA, 20 bp, synthetic construct
  misc_feature 1..20: note = CRISPR gRNA sequence
  source 1..20: mol_type = other DNA
tctgactgagcctaacacct

SEQ ID NO: 46304 - DNA, 20 bp, synthetic construct
  misc_feature 1..20: note = CRISPR gRNA sequence
  source 1..20: mol_type = other DNA
ctgactgagcctaacacctg

SEQ ID NO: 46305 - DNA, 20 bp, synthetic construct
  misc_feature 1..20: note = CRISPR gRNA sequence
  source 1..20: mol_type = other DNA
gactgagcctaacacctggg

SEQ ID NO: 46306 - DNA, 20 bp, synthetic construct
  misc_feature 1..20: note = CRISPR gRNA sequence
  source 1..20: mol_type = other DNA
actgagcctaacacctgggg

SEQ ID NO: 46307 - DNA, 20 bp, synthetic construct
  misc_feature 1..20: note = CRISPR gRNA sequence
  source 1..20: mol_type = other DNA
aacacctggggaggcctttg

SEQ ID NO: 46308 - DNA, 20 bp, synthetic construct
  misc_feature 1..20: note = CRISPR gRNA sequence
  source 1..20: mol_type = other DNA
tggggaggcctttgaagtga

SEQ ID NO: 46309 - DNA, 20 bp, synthetic construct
  misc_feature 1..20: note = CRISPR gRNA sequence
  source 1..20: mol_type = other DNA
ggaggcctttgaagtgatag

SEQ ID NO: 46310 - DNA, 20 bp, synthetic construct
  misc_feature 1..20: note = CRISPR gRNA sequence
  source 1..20: mol_type = other DNA
ctttgaagtgatagaagccc

SEQ ID NO: 46311 - DNA, 20 bp, synthetic construct
  misc_feature 1..20: note = CRISPR gRNA sequence
  source 1..20: mol_type = other DNA
tttgaagtgatagaagcccc

SEQ ID NO: 46312 - DNA, 20 bp, synthetic construct
  misc_feature 1..20: note = CRISPR gRNA sequence
  source 1..20: mol_type = other DNA
ttgaagtgatagaagcccca

SEQ ID NO: 46313 - DNA, 20 bp, synthetic construct
  misc_feature 1..20: note = CRISPR gRNA sequence
  source 1..20: mol_type = other DNA
agtgatagaagccccaggga

SEQ ID NO: 46314 - DNA, 20 bp, synthetic construct
  misc_feature 1..20: note = CRISPR gRNA sequence
  source 1..20: mol_type = other DNA
gatagaagccccagggatgg

SEQ ID NO: 46315 - DNA, 20 bp, synthetic construct
  misc_feature 1..20: note = CRISPR gRNA sequence
  source 1..20: mol_type = other DNA
atagaagccccagggatggt

SEQ ID NO: 46316 - DNA, 20 bp, synthetic construct
  misc_feature 1..20: note = CRISPR gRNA sequence
  source 1..20: mol_type = other DNA
tagaagccccagggatggtg

SEQ ID NO: 46317 - DNA, 20 bp, synthetic construct
  misc_feature 1..20: note = CRISPR gRNA sequence
  source 1..20: mol_type = other DNA
agaagccccagggatggtgg

SEQ ID NO: 46318 - DNA, 20 bp, synthetic construct
  misc_feature 1..20: note = CRISPR gRNA sequence
  source 1..20: mol_type = other DNA
ccccagggatggtgggggcc

SEQ ID NO: 46319 - DNA, 20 bp, synthetic construct
  misc_feature 1..20: note = CRISPR gRNA sequence
  source 1..20: mol_type = other DNA
ggatggtgggggcctggctc

SEQ ID NO: 46320 - DNA, 20 bp, synthetic construct
  misc_feature 1..20: note = CRISPR gRNA sequence
  source 1..20: mol_type = other DNA
ggtgggggcctggctcaaga

SEQ ID NO: 46321 - DNA, 20 bp, synthetic construct
  misc_feature 1..20: note = CRISPR gRNA sequence
  source 1..20: mol_type = other DNA
gtgggggcctggctcaagaa

SEQ ID NO: 46322 - DNA, 20 bp, synthetic construct
  misc_feature 1..20: note = CRISPR gRNA sequence
  source 1..20: mol_type = other DNA
ggggcctggctcaagaaagg

SEQ ID NO: 46323 - DNA, 20 bp, synthetic construct
  misc_feature 1..20: note = CRISPR gRNA sequence
  source 1..20: mol_type = other DNA
gaagtctttcctaaaacgcc

SEQ ID NO: 46324 - DNA, 20 bp, synthetic construct
  misc_feature 1..20: note = CRISPR gRNA sequence
  source 1..20: mol_type = other DNA
ctaaaacgcctagcttaccc

SEQ ID NO: 46325 - DNA, 20 bp, synthetic construct
  misc_feature 1..20: note = CRISPR gRNA sequence
  source 1..20: mol_type = other DNA
gcctagcttaccccagaccc

SEQ ID NO: 46326 - DNA, 20 bp, synthetic construct
  misc_feature 1..20: note = CRISPR gRNA sequence
  source 1..20: mol_type = other DNA
tagcttaccccagaccctgg

SEQ ID NO: 46327 - DNA, 20 bp, synthetic construct
  misc_feature 1..20: note = CRISPR gRNA sequence
  source 1..20: mol_type = other DNA
accccagaccctggtggctc

SEQ ID NO: 46328 - DNA, 20 bp, synthetic construct
  misc_feature 1..20: note = CRISPR gRNA sequence
  source 1..20: mol_type = other DNA
cccagaccctggtggctctg

SEQ ID NO: 46329 - DNA, 20 bp, synthetic construct
  misc_feature 1..20: note = CRISPR gRNA sequence
  source 1..20: mol_type = other DNA
ccagaccctggtggctctgg

SEQ ID NO: 46330 - DNA, 20 bp, synthetic construct
  misc_feature 1..20: note = CRISPR gRNA sequence
  source 1..20: mol_type = other DNA
gaccctggtggctctggagg

SEQ ID NO: 46331 - DNA, 20 bp, synthetic construct
  misc_feature 1..20: note = CRISPR gRNA sequence
  source 1..20: mol_type = other DNA
accctggtggctctggaggc

SEQ ID NO: 46332 - DNA, 20 bp, synthetic construct
  misc_feature 1..20: note = CRISPR gRNA sequence
  source 1..20: mol_type = other DNA
gctctggaggcaggacctgc

SEQ ID NO: 46333 - DNA, 20 bp, synthetic construct
  misc_feature 1..20: note = CRISPR gRNA sequence
  source 1..20: mol_type = other DNA
cccatgcccttctccatccc

SEQ ID NO: 46334 - DNA, 20 bp, synthetic construct
  misc_feature 1..20: note = CRISPR gRNA sequence
  source 1..20: mol_type = other DNA
gcccttctccatccccagcc

SEQ ID NO: 46335 - DNA, 20 bp, synthetic construct
  misc_feature 1..20: note = CRISPR gRNA sequence
  source 1..20: mol_type = other DNA
tccccagcctggtttcctgt

SEQ ID NO: 46336 - DNA, 20 bp, synthetic construct
  misc_feature 1..20: note = CRISPR gRNA sequence
  source 1..20: mol_type = other DNA
tttcctgtaagattgacaac

SEQ ID NO: 46337 - DNA, 20 bp, synthetic construct
  misc_feature 1..20: note = CRISPR gRNA sequence
  source 1..20: mol_type = other DNA
agattgacaaccagactgcc

SEQ ID NO: 46338 - DNA, 20 bp, synthetic construct
  misc_feature 1..20: note = CRISPR gRNA sequence
  source 1..20: mol_type = other DNA
actgccaagctcctcacctc

SEQ ID NO: 46339 - DNA, 20 bp, synthetic construct
  misc_feature 1..20: note = CRISPR gRNA sequence
  source 1..20: mol_type = other DNA
ctcctcacctccagcttcac

SEQ ID NO: 46340 - DNA, 20 bp, synthetic construct
  misc_feature 1..20: note = CRISPR gRNA sequence
  source 1..20: mol_type = other DNA
cttcacgagctgccctgccc

SEQ ID NO: 46341 - DNA, 20 bp, synthetic construct
  misc_feature 1..20: note = CRISPR gRNA sequence
  source 1..20: mol_type = other DNA
cacgagctgccctgccctgg

SEQ ID NO: 46342 - DNA, 20 bp, synthetic construct
  misc_feature 1..20: note = CRISPR gRNA sequence
  source 1..20: mol_type = other DNA
tgccctggaagtaatcttgt

SEQ ID NO: 46343 - DNA, 20 bp, synthetic construct
  misc_feature 1..20: note = CRISPR gRNA sequence
  source 1..20: mol_type = other DNA
gaagtaatcttgtgagtgat

SEQ ID NO: 46344 - DNA, 20 bp, synthetic construct
  misc_feature 1..20: note = CRISPR gRNA sequence
  source 1..20: mol_type = other DNA
gtaatcttgtgagtgattgg

SEQ ID NO: 46345 - DNA, 20 bp, synthetic construct
  misc_feature 1..20: note = CRISPR gRNA sequence
  source 1..20: mol_type = other DNA
aatcttgtgagtgattggaa

SEQ ID NO: 46346 - DNA, 20 bp, synthetic construct
  misc_feature 1..20: note = CRISPR gRNA sequence
  source 1..20: mol_type = other DNA
tgagtgattggaagagccct

SEQ ID NO: 46347 - DNA, 20 bp, synthetic construct
  misc_feature 1..20: note = CRISPR gRNA sequence
  source 1..20: mol_type = other DNA
tgattggaagagccctgagc

SEQ ID NO: 46348 - DNA, 20 bp, synthetic construct
  misc_feature 1..20: note = CRISPR gRNA sequence
  source 1..20: mol_type = other DNA
tggaagagccctgagctggc

SEQ ID NO: 46349 - DNA, 20 bp, synthetic construct
  misc_feature 1..20: note = CRISPR gRNA sequence
  source 1..20: mol_type = other DNA
ggaagagccctgagctggct

SEQ ID NO: 46350 - DNA, 20 bp, synthetic construct
  misc_feature 1..20: note = CRISPR gRNA sequence
  source 1..20: mol_type = other DNA
agccctgagctggctgggaa

SEQ ID NO: 46351 - DNA, 20 bp, synthetic construct
  misc_feature 1..20: note = CRISPR gRNA sequence
  source 1..20: mol_type = other DNA
gccctgagctggctgggaaa

SEQ ID NO: 46352 - DNA, 20 bp, synthetic construct
  misc_feature 1..20: note = CRISPR gRNA sequence
  source 1..20: mol_type = other DNA
gagctggctgggaaaaggaa

SEQ ID NO: 46353 - DNA, 20 bp, synthetic construct
  misc_feature 1..20: note = CRISPR gRNA sequence
  source 1..20: mol_type = other DNA
tggctgggaaaaggaaaagt

SEQ ID NO: 46354 - DNA, 20 bp, synthetic construct
  misc_feature 1..20: note = CRISPR gRNA sequence
  source 1..20: mol_type = other DNA
ggctgggaaaaggaaaagtc

SEQ ID NO: 46355 - DNA, 20 bp, synthetic construct
  misc_feature 1..20: note = CRISPR gRNA sequence
  source 1..20: mol_type = other DNA
ctgggaaaaggaaaagtcgg

SEQ ID NO: 46356 - DNA, 20 bp, synthetic construct
  misc_feature 1..20: note = CRISPR gRNA sequence
  source 1..20: mol_type = other DNA
tgggaaaaggaaaagtcggg

SEQ ID NO: 46357 - DNA, 20 bp, synthetic construct
  misc_feature 1..20: note = CRISPR gRNA sequence
  source 1..20: mol_type = other DNA
gggaaaaggaaaagtcggga

SEQ ID NO: 46358 - DNA, 20 bp, synthetic construct
  misc_feature 1..20: note = CRISPR gRNA sequence
  source 1..20: mol_type = other DNA
ggaaaaggaaaagtcgggag

SEQ ID NO: 46359 - DNA, 20 bp, synthetic construct
  misc_feature 1..20: note = CRISPR gRNA sequence
  source 1..20: mol_type = other DNA
aaggaaaagtcgggaggggt

SEQ ID NO: 46360 - DNA, 20 bp, synthetic construct
  misc_feature 1..20: note = CRISPR gRNA sequence
  source 1..20: mol_type = other DNA
aggaaaagtcgggaggggtc

SEQ ID NO: 46361 - DNA, 20 bp, synthetic construct
  misc_feature 1..20: note = CRISPR gRNA sequence
  source 1..20: mol_type = other DNA
ggaaaagtcgggaggggtcg

SEQ ID NO: 46362 - DNA, 20 bp, synthetic construct
  misc_feature 1..20: note = CRISPR gRNA sequence
  source 1..20: mol_type = other DNA
gaaaagtcgggaggggtcgg

SEQ ID NO: 46363 - DNA, 20 bp, synthetic construct
  misc_feature 1..20: note = CRISPR gRNA sequence
  source 1..20: mol_type = other DNA
aaagtcgggaggggtcgggg

SEQ ID NO: 46364 - DNA, 20 bp, synthetic construct
  misc_feature 1..20: note = CRISPR gRNA sequence
  source 1..20: mol_type = other DNA
tcgggaggggtcgggggagt

SEQ ID NO: 46365 - DNA, 20 bp, synthetic construct
  misc_feature 1..20: note = CRISPR gRNA sequence
  source 1..20: mol_type = other DNA
ggggtcgggggagttggctc

SEQ ID NO: 46366 - DNA, 20 bp, synthetic construct
  misc_feature 1..20: note = CRISPR gRNA sequence
  source 1..20: mol_type = other DNA
gttggctccagcctgctgtg

SEQ ID NO: 46367 - DNA, 20 bp, synthetic construct
  misc_feature 1..20: note = CRISPR gRNA sequence
  source 1..20: mol_type = other DNA
ctccagcctgctgtgtggcc

SEQ ID NO: 46368 - DNA, 20 bp, synthetic construct
  misc_feature 1..20: note = CRISPR gRNA sequence
  source 1..20: mol_type = other DNA
ccagcctgctgtgtggcctg

SEQ ID NO: 46369 - DNA, 20 bp, synthetic construct
  misc_feature 1..20: note = CRISPR gRNA sequence
  source 1..20: mol_type = other DNA
ggagctgctcccatcctctc

SEQ ID NO: 46370 - DNA, 20 bp, synthetic construct
  misc_feature 1..20: note = CRISPR gRNA sequence
  source 1..20: mol_type = other DNA
ctgctcccatcctctctggc

SEQ ID NO: 46371 - DNA, 20 bp, synthetic construct
  misc_feature 1..20: note = CRISPR gRNA sequence
  source 1..20: mol_type = other DNA
ccagtcctcccatttgtaaa

SEQ ID NO: 46372 - DNA, 20 bp, synthetic construct
  misc_feature 1..20: note = CRISPR gRNA sequence
  source 1..20: mol_type = other DNA
cagtcctcccatttgtaaat

SEQ ID NO: 46373 - DNA, 20 bp, synthetic construct
  misc_feature 1..20: note = CRISPR gRNA sequence
  source 1..20: mol_type = other DNA
agtcctcccatttgtaaatg

SEQ ID NO: 46374 - DNA, 20 bp, synthetic construct
  misc_feature 1..20: note = CRISPR gRNA sequence
  source 1..20: mol_type = other DNA
cctcccatttgtaaatgggg

SEQ ID NO: 46375 - DNA, 20 bp, synthetic construct
  misc_feature 1..20: note = CRISPR gRNA sequence
  source 1..20: mol_type = other DNA
tggggaagatcatccttact

SEQ ID NO: 46376 - DNA, 20 bp, synthetic construct
  misc_feature 1..20: note = CRISPR gRNA sequence
  source 1..20: mol_type = other DNA
cttactcagacatcctctca

SEQ ID NO: 46377 - DNA, 20 bp, synthetic construct
  misc_feature 1..20: note = CRISPR gRNA sequence
  source 1..20: mol_type = other DNA
tcaaagacattttaacactt

SEQ ID NO: 46378 - DNA, 20 bp, synthetic construct
  misc_feature 1..20: note = CRISPR gRNA sequence
  source 1..20: mol_type = other DNA
acattttaacacttgagctg

SEQ ID NO: 46379 - DNA, 20 bp, synthetic construct
  misc_feature 1..20: note = CRISPR gRNA sequence
  source 1..20: mol_type = other DNA
cattttaacacttgagctgc

SEQ ID NO: 46380 - DNA, 20 bp, synthetic construct
  misc_feature 1..20: note = CRISPR gRNA sequence
  source 1..20: mol_type = other DNA
acttgagctgcaggtaatgt

SEQ ID NO: 46381 - DNA, 20 bp, synthetic construct
  misc_feature 1..20: note = CRISPR gRNA sequence
  source 1..20: mol_type = other DNA
cttgagctgcaggtaatgtt

SEQ ID NO: 46382 - DNA, 20 bp, synthetic construct
  misc_feature 1..20: note = CRISPR gRNA sequence
  source 1..20: mol_type = other DNA
gcaggtaatgttgggtaaaa

SEQ ID NO: 46383 - DNA, 20 bp, synthetic construct
  misc_feature 1..20: note = CRISPR gRNA sequence
  source 1..20: mol_type = other DNA
tctgcctttttccccatttg

SEQ ID NO: 46384 - DNA, 20 bp, synthetic construct
  misc_feature 1..20: note = CRISPR gRNA sequence
  source 1..20: mol_type = other DNA
ctttttccccatttgtagat

SEQ ID NO: 46385 - DNA, 20 bp, synthetic construct
  misc_feature 1..20: note = CRISPR gRNA sequence
  source 1..20: mol_type = other DNA
tttccccatttgtagattgg

SEQ ID NO: 46386 - DNA, 20 bp, synthetic construct
  misc_feature 1..20: note = CRISPR gRNA sequence
  source 1..20: mol_type = other DNA
ttccccatttgtagattggt

SEQ ID NO: 46387 - DNA, 20 bp, synthetic construct
  misc_feature 1..20: note = CRISPR gRNA sequence
  source 1..20: mol_type = other DNA
ccccatttgtagattggtgg

SEQ ID NO: 46388 - DNA, 20 bp, synthetic construct
  misc_feature 1..20: note = CRISPR gRNA sequence
  source 1..20: mol_type = other DNA
cccatttgtagattggtggg

SEQ ID NO: 46389 - DNA, 20 bp, synthetic construct
  misc_feature 1..20: note = CRISPR gRNA sequence
  source 1..20: mol_type = other DNA
ccatttgtagattggtggga

SEQ ID NO: 46390 - DNA, 20 bp, synthetic construct
  misc_feature 1..20: note = CRISPR gRNA sequence
  source 1..20: mol_type = other DNA
catttgtagattggtgggag

SEQ ID NO: 46391 - DNA, 20 bp, synthetic construct
  misc_feature 1..20: note = CRISPR gRNA sequence
  source 1..20: mol_type = other DNA
tttgtagattggtgggaggg

SEQ ID NO: 46392 - DNA, 20 bp, synthetic construct
  misc_feature 1..20: note = CRISPR gRNA sequence
  source 1..20: mol_type = other DNA
ttgtagattggtgggagggg

SEQ ID NO: 46393 - DNA, 20 bp, synthetic construct
  misc_feature 1..20: note = CRISPR gRNA sequence
  source 1..20: mol_type = other DNA
tagattggtgggaggggagg

SEQ ID NO: 46394 - DNA, 20 bp, synthetic construct
  misc_feature 1..20: note = CRISPR gRNA sequence
  source 1..20: mol_type = other DNA
tggtgggaggggaggtggac

SEQ ID NO: 46395 - DNA, 20 bp, synthetic construct
  misc_feature 1..20: note = CRISPR gRNA sequence
  source 1..20: mol_type = other DNA
gggaggggaggtggaccaga

SEQ ID NO: 46396 - DNA, 20 bp, synthetic construct
  misc_feature 1..20: note = CRISPR gRNA sequence
  source 1..20: mol_type = other DNA
ggtggaccagatggtcttta

SEQ ID NO: 46397 - DNA, 20 bp, synthetic construct
  misc_feature 1..20: note = CRISPR gRNA sequence
  source 1..20: mol_type = other DNA
gtggaccagatggtctttaa

SEQ ID NO: 46398 - DNA, 20 bp, synthetic construct
  misc_feature 1..20: note = CRISPR gRNA sequence
  source 1..20: mol_type = other DNA
agatggtctttaaaggtttt

SEQ ID NO: 46399 - DNA, 20 bp, synthetic construct
  misc_feature 1..20: note = CRISPR gRNA sequence
  source 1..20: mol_type = other DNA
ttttggtccaaccttccttt

SEQ ID NO: 46400 - DNA, 20 bp, synthetic construct
  misc_feature 1..20: note = CRISPR gRNA sequence
  source 1..20: mol_type = other DNA
tttggtccaaccttcctttt

SEQ ID NO: 46401 - DNA, 20 bp, synthetic construct
  misc_feature 1..20: note = CRISPR gRNA sequence
  source 1..20: mol_type = other DNA
tggtccaaccttccttttgg

SEQ ID NO: 46402 - DNA, 20 bp, synthetic construct
  misc_feature 1..20: note = CRISPR gRNA sequence
  source 1..20: mol_type = other DNA
ggtccaaccttccttttggg

SEQ ID NO: 46403 - DNA, 20 bp, synthetic construct
  misc_feature 1..20: note = CRISPR gRNA sequence
  source 1..20: mol_type = other DNA
ccttccttttgggaggcaac

SEQ ID NO: 46404 - DNA, 20 bp, synthetic construct
  misc_feature 1..20: note = CRISPR gRNA sequence
  source 1..20: mol_type = other DNA
ccttttgggaggcaactgga

SEQ ID NO: 46405 - DNA, 20 bp, synthetic construct
  misc_feature 1..20: note = CRISPR gRNA sequence
  source 1..20: mol_type = other DNA
aaacctccatttatgaacca

SEQ ID NO: 46406 - DNA, 20 bp, synthetic construct
  misc_feature 1..20: note = CRISPR gRNA sequence
  source 1..20: mol_type = other DNA
ctccatttatgaaccacagt

SEQ ID NO: 46407 - DNA, 20 bp, synthetic construct
  misc_feature 1..20: note = CRISPR gRNA sequence
  source 1..20: mol_type = other DNA
catttatgaaccacagttgg

SEQ ID NO: 46408 - DNA, 20 bp, synthetic construct
  misc_feature 1..20: note = CRISPR gRNA sequence
  source 1..20: mol_type = other DNA
tgaaccacagttggtagaaa

SEQ ID NO: 46409 - DNA, 20 bp, synthetic construct
  misc_feature 1..20: note = CRISPR gRNA sequence
  source 1..20: mol_type = other DNA
accacagttggtagaaacag

SEQ ID NO: 46410 - DNA, 20 bp, synthetic construct
  misc_feature 1..20: note = CRISPR gRNA sequence
  source 1..20: mol_type = other DNA
gttggtagaaacagtggcta

SEQ ID NO: 46411 - DNA, 20 bp, synthetic construct
  misc_feature 1..20: note = CRISPR gRNA sequence
  source 1..20: mol_type = other DNA
gtagaaacagtggctaaagc

SEQ ID NO: 46412 - DNA, 20 bp, synthetic construct
  misc_feature 1..20: note = CRISPR gRNA sequence
  source 1..20: mol_type = other DNA
tagaaacagtggctaaagcc

SEQ ID NO: 46413 - DNA, 20 bp, synthetic construct
  misc_feature 1..20: note = CRISPR gRNA sequence
  source 1..20: mol_type = other DNA
gaaacagtggctaaagccag

SEQ ID NO: 46414 - DNA, 20 bp, synthetic construct
  misc_feature 1..20: note = CRISPR gRNA sequence
  source 1..20: mol_type = other DNA
cagtggctaaagccaggaga

SEQ ID NO: 46415 - DNA, 20 bp, synthetic construct
  misc_feature 1..20: note = CRISPR gRNA sequence
  source 1..20: mol_type = other DNA
agccaggagaaagccacccc

SEQ ID NO: 46416 - DNA, 20 bp, synthetic construct
  misc_feature 1..20: note = CRISPR gRNA sequence
  source 1..20: mol_type = other DNA
aaagccacccccagacctgc

SEQ ID NO: 46417 - DNA, 20 bp, synthetic construct
  misc_feature 1..20: note = CRISPR gRNA sequence
  source 1..20: mol_type = other DNA
ccacccccagacctgctggc

SEQ ID NO: 46418 - DNA, 20 bp, synthetic construct
  misc_feature 1..20: note = CRISPR gRNA sequence
  source 1..20: mol_type = other DNA
acctgctggctggccgtgct

SEQ ID NO: 46419 - DNA, 20 bp, synthetic construct
  misc_feature 1..20: note = CRISPR gRNA sequence
  source 1..20: mol_type = other DNA
ggccgtgcttggctgtctct

SEQ ID NO: 46420 - DNA, 20 bp, synthetic construct
  misc_feature 1..20: note = CRISPR gRNA sequence
  source 1..20: mol_type = other DNA
cttggctgtctcttagcaat

SEQ ID NO: 46421 - DNA, 20 bp, synthetic construct
  misc_feature 1..20: note = CRISPR gRNA sequence
  source 1..20: mol_type = other DNA
tcttagcaatcagaatcccc

SEQ ID NO: 46422 - DNA, 20 bp, synthetic construct
  misc_feature 1..20: note = CRISPR gRNA sequence
  source 1..20: mol_type = other DNA
aatcagaatcccccagacct

SEQ ID NO: 46423 - DNA, 20 bp, synthetic construct
  misc_feature 1..20: note = CRISPR gRNA sequence
  source 1..20: mol_type = other DNA
atcagaatcccccagacctt

SEQ ID NO: 46424 - DNA, 20 bp, synthetic construct
  misc_feature 1..20: note = CRISPR gRNA sequence
  source 1..20: mol_type = other DNA
tcagaatcccccagaccttg

SEQ ID NO: 46425 - DNA, 20 bp, synthetic construct
  misc_feature 1..20: note = CRISPR gRNA sequence
  source 1..20: mol_type = other DNA
ccccagaccttggggctttg

SEQ ID NO: 46426 - DNA, 20 bp, synthetic construct
  misc_feature 1..20: note = CRISPR gRNA sequence
  source 1..20: mol_type = other DNA
gctttgcagtgctgcctcat

SEQ ID NO: 46427 - DNA, 20 bp, synthetic construct
  misc_feature 1..20: note = CRISPR gRNA sequence
  source 1..20: mol_type = other DNA
gtgctgcctcatgagtaaac

SEQ ID NO: 46428 - DNA, 20 bp, synthetic construct
  misc_feature 1..20: note = CRISPR gRNA sequence
  source 1..20: mol_type = other DNA
tcatgagtaaactagaattc

SEQ ID NO: 46429 - DNA, 20 bp, synthetic construct
  misc_feature 1..20: note = CRISPR gRNA sequence
  source 1..20: mol_type = other DNA
catgagtaaactagaattct

SEQ ID NO: 46430 - DNA, 20 bp, synthetic construct
  misc_feature 1..20: note = CRISPR gRNA sequence
  source 1..20: mol_type = other DNA
gtaaactagaattctaggac

SEQ ID NO: 46431 - DNA, 20 bp, synthetic construct
  misc_feature 1..20: note = CRISPR gRNA sequence
  source 1..20: mol_type = other DNA
ctagaattctaggactagcc

SEQ ID NO: 46432 - DNA, 20 bp, synthetic construct
  misc_feature 1..20: note = CRISPR gRNA sequence
  source 1..20: mol_type = other DNA
tagaattctaggactagcct

SEQ ID NO: 46433 - DNA, 20 bp, synthetic construct
  misc_feature 1..20: note = CRISPR gRNA sequence
  source 1..20: mol_type = other DNA
ctagcctgggaccctaacca

SEQ ID NO: 46434 - DNA, 20 bp, synthetic construct
  misc_feature 1..20: note = CRISPR gRNA sequence
  source 1..20: mol_type = other DNA
ctgggaccctaaccatggta

SEQ ID NO: 46435 - DNA, 20 bp, synthetic construct
  misc_feature 1..20: note = CRISPR gRNA sequence
  source 1..20: mol_type = other DNA
gggaccctaaccatggtatg

SEQ ID NO: 46436 - DNA, 20 bp, synthetic construct
  misc_feature 1..20: note = CRISPR gRNA sequence
  source 1..20: mol_type = other DNA
ggaccctaaccatggtatgg

SEQ ID NO: 46437 - DNA, 20 bp, synthetic construct
  misc_feature 1..20: note = CRISPR gRNA sequence
  source 1..20: mol_type = other DNA
taaccatggtatggaggaca

SEQ ID NO: 46438 - DNA, 20 bp, synthetic construct
  misc_feature 1..20: note = CRISPR gRNA sequence
  source 1..20: mol_type = other DNA
gaggacaaagctgtttccta

SEQ ID NO: 46439 - DNA, 20 bp, synthetic construct
  misc_feature 1..20: note = CRISPR gRNA sequence
  source 1..20: mol_type = other DNA
caaagctgtttcctaaagaa

SEQ ID NO: 46440 - DNA, 20 bp, synthetic construct
  misc_feature 1..20: note = CRISPR gRNA sequence
  source 1..20: mol_type = other DNA
aaagctgtttcctaaagaac

SEQ ID NO: 46441 - DNA, 20 bp, synthetic construct
  misc_feature 1..20: note = CRISPR gRNA sequence
  source 1..20: mol_type = other DNA
tttcctaaagaacaggacac

SEQ ID NO: 46442 - DNA, 20 bp, synthetic construct
  misc_feature 1..20: note = CRISPR gRNA sequence
  source 1..20: mol_type = other DNA
aacaggacacaagtgattac

SEQ ID NO: 46443 - DNA, 20 bp, synthetic construct
  misc_feature 1..20: note = CRISPR gRNA sequence
  source 1..20: mol_type = other DNA
aggacacaagtgattacgag

SEQ ID NO: 46444 - DNA, 20 bp, synthetic construct
  misc_feature 1..20: note = CRISPR gRNA sequence
  source 1..20: mol_type = other DNA
aagtgattacgagaagattt

SEQ ID NO: 46445 - DNA, 20 bp, synthetic construct
  misc_feature 1..20: note = CRISPR gRNA sequence
  source 1..20: mol_type = other DNA
agattttagtttgcatccta

SEQ ID NO: 46446 - DNA, 20 bp, synthetic construct
  misc_feature 1..20: note = CRISPR gRNA sequence
  source 1..20: mol_type = other DNA
gattttagtttgcatcctaa

SEQ ID NO: 46447 - DNA, 20 bp, synthetic construct
  misc_feature 1..20: note = CRISPR gRNA sequence
  source 1..20: mol_type = other DNA
taacccttctcattacacca

SEQ ID NO: 46448 - DNA, 20 bp, synthetic construct
  misc_feature 1..20: note = CRISPR gRNA sequence
  source 1..20: mol_type = other DNA
ttctcattacaccaaagcga

SEQ ID NO: 46449 - DNA, 20 bp, synthetic construct
  misc_feature 1..20: note = CRISPR gRNA sequence
  source 1..20: mol_type = other DNA
ttacaccaaagcgaaagtct

SEQ ID NO: 46450 - DNA, 20 bp, synthetic construct
  misc_feature 1..20: note = CRISPR gRNA sequence
  source 1..20: mol_type = other DNA
ccaaagcgaaagtctcagat

SEQ ID NO: 46451 - DNA, 20 bp, synthetic construct
  misc_feature 1..20: note = CRISPR gRNA sequence
  source 1..20: mol_type = other DNA
aagcgaaagtctcagatcag

SEQ ID NO: 46452 - DNA, 20 bp, synthetic construct
  misc_feature 1..20: note = CRISPR gRNA sequence
  source 1..20: mol_type = other DNA
tcatctttaacacctaacac

SEQ ID NO: 46453 - DNA, 20 bp, synthetic construct
  misc_feature 1..20: note = CRISPR gRNA sequence
  source 1..20: mol_type = other DNA
gattctccctttttaaccaa

SEQ ID NO: 46454 - DNA, 20 bp, synthetic construct
  misc_feature 1..20: note = CRISPR gRNA sequence
  source 1..20: mol_type = other DNA
attctccctttttaaccaaa

SEQ ID NO: 46455 - DNA, 20 bp, synthetic construct
  misc_feature 1..20: note = CRISPR gRNA sequence
  source 1..20: mol_type = other DNA
ttctccctttttaaccaaaa

SEQ ID NO: 46456 - DNA, 20 bp, synthetic construct
  misc_feature 1..20: note = CRISPR gRNA sequence
  source 1..20: mol_type = other DNA
gggttaaaaacccaacatct

SEQ ID NO: 46457 - DNA, 20 bp, synthetic construct
  misc_feature 1..20: note = CRISPR gRNA sequence
  source 1..20: mol_type = other DNA
ggttaaaaacccaacatctt

SEQ ID NO: 46458 - DNA, 20 bp, synthetic construct
  misc_feature 1..20: note = CRISPR gRNA sequence
  source 1..20: mol_type = other DNA
taaaaacccaacatcttagg

SEQ ID NO: 46459 - DNA, 20 bp, synthetic construct
  misc_feature 1..20: note = CRISPR gRNA sequence
  source 1..20: mol_type = other DNA
aaaaacccaacatcttagga

SEQ ID NO: 46460 - DNA, 20 bp, synthetic construct
  misc_feature 1..20: note = CRISPR gRNA sequence
  source 1..20: mol_type = other DNA
aaaacccaacatcttaggaa

SEQ ID NO: 46461 - DNA, 20 bp, synthetic construct
  misc_feature 1..20: note = CRISPR gRNA sequence
  source 1..20: mol_type = other DNA
ggaagggcatatgttccaac

SEQ ID NO: 46462 - DNA, 20 bp, synthetic construct
  misc_feature 1..20: note = CRISPR gRNA sequence
  source 1..20: mol_type = other DNA
agggcatatgttccaactag

SEQ ID NO: 46463 - DNA, 20 bp, synthetic construct
  misc_feature 1..20: note = CRISPR gRNA sequence
  source 1..20: mol_type = other DNA
ttttgtaactaccttctata

SEQ ID NO: 46464 - DNA, 20 bp, synthetic construct
  misc_feature 1..20: note = CRISPR gRNA sequence
  source 1..20: mol_type = other DNA
ttgtaactaccttctatatg

SEQ ID NO: 46465 - DNA, 20 bp, synthetic construct
  misc_feature 1..20: note = CRISPR gRNA sequence
  source 1..20: mol_type = other DNA
ctatatggagtctgtaacac

SEQ ID NO: 46466 - DNA, 20 bp, synthetic construct
  misc_feature 1..20: note = CRISPR gRNA sequence
  source 1..20: mol_type = other DNA
taacacaagttttccattga

SEQ ID NO: 46467 - DNA, 20 bp, synthetic construct
  misc_feature 1..20: note = CRISPR gRNA sequence
  source 1..20: mol_type = other DNA
cacaagttttccattgatag

SEQ ID NO: 46468 - DNA, 20 bp, synthetic construct
  misc_feature 1..20: note = CRISPR gRNA sequence
  source 1..20: mol_type = other DNA
tccattgatagtagcaataa

SEQ ID NO: 46469 - DNA, 20 bp, synthetic construct
  misc_feature 1..20: note = CRISPR gRNA sequence
  source 1..20: mol_type = other DNA
agcaataaaagtttcctttc

SEQ ID NO: 46470 - DNA, 20 bp, synthetic construct
  misc_feature 1..20: note = CRISPR gRNA sequence
  source 1..20: mol_type = other DNA
tttttttttttttttttttt

SEQ ID NO: 46471 - DNA, 20 bp, synthetic construct
  misc_feature 1..20: note = CRISPR gRNA sequence
  source 1..20: mol_type = other DNA
ttttttttttttttttgaga

SEQ ID NO: 46472 - DNA, 20 bp, synthetic construct
  misc_feature 1..20: note = CRISPR gRNA sequence
  source 1..20: mol_type = other DNA
ttttttttttttttgagatg

SEQ ID NO: 46473 - DNA, 20 bp, synthetic construct
  misc_feature 1..20: note = CRISPR gRNA sequence
  source 1..20: mol_type = other DNA
tggagtctccctctgttacc

SEQ ID NO: 46474 - DNA, 20 bp, synthetic construct
  misc_feature 1..20: note = CRISPR gRNA sequence
  source 1..20: mol_type = other DNA
ggagtctccctctgttaccc

SEQ ID NO: 46475 - DNA, 20 bp, synthetic construct
  misc_feature 1..20: note = CRISPR gRNA sequence
  source 1..20: mol_type = other DNA
tctccctctgttacccaggc

SEQ ID NO: 46476 - DNA, 20 bp, synthetic construct
  misc_feature 1..20: note = CRISPR gRNA sequence
  source 1..20: mol_type = other DNA
tccctctgttacccaggctg

SEQ ID NO: 46477 - DNA, 20 bp, synthetic construct
  misc_feature 1..20: note = CRISPR gRNA sequence
  source 1..20: mol_type = other DNA
ctgttacccaggctggagtg

SEQ ID NO: 46478 - DNA, 20 bp, synthetic construct
  misc_feature 1..20: note = CRISPR gRNA sequence
  source 1..20: mol_type = other DNA
ttacccaggctggagtgcag

SEQ ID NO: 46479 - DNA, 20 bp, synthetic construct
  misc_feature 1..20: note = CRISPR gRNA sequence
  source 1..20: mol_type = other DNA
ggagtgcagtggtgcaatct

SEQ ID NO: 46480 - DNA, 20 bp, synthetic construct
  misc_feature 1..20: note = CRISPR gRNA sequence
  source 1..20: mol_type = other DNA
tcactgcaacctccacctgc

SEQ ID NO: 46481 - DNA, 20 bp, synthetic construct
  misc_feature 1..20: note = CRISPR gRNA sequence
  source 1..20: mol_type = other DNA
cactgcaacctccacctgcc

SEQ ID NO: 46482 - DNA, 20 bp, synthetic construct
  misc_feature 1..20: note = CRISPR gRNA sequence
  source 1..20: mol_type = other DNA
aacctccacctgccgggttc

SEQ ID NO: 46483 - DNA, 20 bp, synthetic construct
  misc_feature 1..20: note = CRISPR gRNA sequence
  source 1..20: mol_type = other DNA
cctccacctgccgggttcaa

SEQ ID NO: 46484 - DNA, 20 bp, synthetic construct
  misc_feature 1..20: note = CRISPR gRNA sequence
  source 1..20: mol_type = other DNA
ttcaagagattctcctgcct

SEQ ID NO: 46485 - DNA, 20 bp, synthetic construct
  misc_feature 1..20: note = CRISPR gRNA sequence
  source 1..20: mol_type = other DNA
ttctcctgcctcagcctcct

SEQ ID NO: 46486 - DNA, 20 bp, synthetic construct
  misc_feature 1..20: note = CRISPR gRNA sequence
  source 1..20: mol_type = other DNA
tcctgcctcagcctcctgag

SEQ ID NO: 46487 - DNA, 20 bp, synthetic construct
  misc_feature 1..20: note = CRISPR gRNA sequence
  source 1..20: mol_type = other DNA
gcctcagcctcctgagtagc

SEQ ID NO: 46488 - DNA, 20 bp, synthetic construct
  misc_feature 1..20: note = CRISPR gRNA sequence
  source 1..20: mol_type = other DNA
cctcagcctcctgagtagct

SEQ ID NO: 46489 - DNA, 20 bp, synthetic construct
  misc_feature 1..20: note = CRISPR gRNA sequence
  source 1..20: mol_type = other DNA
tcctgagtagctgggattac

SEQ ID NO: 46490 - DNA, 20 bp, synthetic construct
  misc_feature 1..20: note = CRISPR gRNA sequence
  source 1..20: mol_type = other DNA
caagtgcccaccaccacacc

SEQ ID NO: 46491 - DNA, 20 bp, synthetic construct
  misc_feature 1..20: note = CRISPR gRNA sequence
  source 1..20: mol_type = other DNA
ccagctaatttttgtatttt

SEQ ID NO: 46492 - DNA, 20 bp, synthetic construct
  misc_feature 1..20: note = CRISPR gRNA sequence
  source 1..20: mol_type = other DNA
gctaatttttgtatttttag

SEQ ID NO: 46493 - DNA, 20 bp, synthetic construct
  misc_feature 1..20: note = CRISPR gRNA sequence
  source 1..20: mol_type = other DNA
taatttttgtatttttagta

SEQ ID NO: 46494 - DNA, 20 bp, synthetic construct
  misc_feature 1..20: note = CRISPR gRNA sequence
  source 1..20: mol_type = other DNA
ttttgtatttttagtagaga

SEQ ID NO: 46495 - DNA, 20 bp, synthetic construct
  misc_feature 1..20: note = CRISPR gRNA sequence
  source 1..20: mol_type = other DNA
tttgtatttttagtagagac

SEQ ID NO: 46496 - DNA, 20 bp, synthetic construct
  misc_feature 1..20: note = CRISPR gRNA sequence
  source 1..20: mol_type = other DNA
gagacaggatttcaccatgt

SEQ ID NO: 46497 - DNA, 20 bp, synthetic construct
  misc_feature 1..20: note = CRISPR gRNA sequence
  source 1..20: mol_type = other DNA
caggatttcaccatgttggt

SEQ ID NO: 46498 - DNA, 20 bp, synthetic construct
  misc_feature 1..20: note = CRISPR gRNA sequence
  source 1..20: mol_type = other DNA
aggatttcaccatgttggtt

SEQ ID NO: 46499 - DNA, 20 bp, synthetic construct
  misc_feature 1..20: note = CRISPR gRNA sequence
  source 1..20: mol_type = other DNA
tcgtctcaaacacctgacct

SEQ ID NO: 46500 - DNA, 20 bp, synthetic construct
  misc_feature 1..20: note = CRISPR gRNA sequence
  source 1..20: mol_type = other DNA
cacctgaccttggcctccca

SEQ ID NO: 46501 - DNA, 20 bp, synthetic construct
  misc_feature 1..20: note = CRISPR gRNA sequence
  source 1..20: mol_type = other DNA
accttggcctcccaaagtgc

SEQ ID NO: 46502 - DNA, 20 bp, synthetic construct
  misc_feature 1..20: note = CRISPR gRNA sequence
  source 1..20: mol_type = other DNA
ccttggcctcccaaagtgct

SEQ ID NO: 46503 - DNA, 20 bp, synthetic construct
  misc_feature 1..20: note = CRISPR gRNA sequence
  source 1..20: mol_type = other DNA
ctcccaaagtgctgggatta

SEQ ID NO: 46504 - DNA, 20 bp, synthetic construct
  misc_feature 1..20: note = CRISPR gRNA sequence
  source 1..20: mol_type = other DNA
tcccaaagtgctgggattac

SEQ ID NO: 46505 - DNA, 20 bp, synthetic construct
  misc_feature 1..20: note = CRISPR gRNA sequence
  source 1..20: mol_type = other DNA
agtgctgggattacaggcgt

SEQ ID NO: 46506 - DNA, 20 bp, synthetic construct
  misc_feature 1..20: note = CRISPR gRNA sequence
  source 1..20: mol_type = other DNA
caggcgtgagcaaccacgcc

SEQ ID NO: 46507 - DNA, 20 bp, synthetic construct
  misc_feature 1..20: note = CRISPR gRNA sequence
  source 1..20: mol_type = other DNA
gtgagcaaccacgcccagcc

SEQ ID NO: 46508 - DNA, 20 bp, synthetic construct
  misc_feature 1..20: note = CRISPR gRNA sequence
  source 1..20: mol_type = other DNA
cagccaagattaatttttta

SEQ ID NO: 46509 - DNA, 20 bp, synthetic construct
  misc_feature 1..20: note = CRISPR gRNA sequence
  source 1..20: mol_type = other DNA
caagattaattttttaaagt

SEQ ID NO: 46510 - DNA, 20 bp, synthetic construct
  misc_feature 1..20: note = CRISPR gRNA sequence
  source 1..20: mol_type = other DNA
aattttttaaagtaagaaaa

SEQ ID NO: 46511 - DNA, 20 bp, synthetic construct
  misc_feature 1..20: note = CRISPR gRNA sequence
  source 1..20: mol_type = other DNA
ttttttaaagtaagaaaaaa

SEQ ID NO: 46512 - DNA, 20 bp, synthetic construct
  misc_feature 1..20: note = CRISPR gRNA sequence
  source 1..20: mol_type = other DNA
tttttaaagtaagaaaaaag

SEQ ID NO: 46513 - DNA, 20 bp, synthetic construct
  misc_feature 1..20: note = CRISPR gRNA sequence
  source 1..20: mol_type = other DNA
ttttaaagtaagaaaaaaga

SEQ ID NO: 46514 - DNA, 20 bp, synthetic construct
  misc_feature 1..20: note = CRISPR gRNA sequence
  source 1..20: mol_type = other DNA
tttaaagtaagaaaaaagag

SEQ ID NO: 46515 - DNA, 20 bp, synthetic construct
  misc_feature 1..20: note = CRISPR gRNA sequence
  source 1..20: mol_type = other DNA
ttaaagtaagaaaaaagagg

SEQ ID NO: 46516 - DNA, 20 bp, synthetic construct
  misc_feature 1..20: note = CRISPR gRNA sequence
  source 1..20: mol_type = other DNA
aaaaagagggggccaattta

SEQ ID NO: 46517 - DNA, 20 bp, synthetic construct
  misc_feature 1..20: note = CRISPR gRNA sequence
  source 1..20: mol_type = other DNA
aatatgatgcatcttaaata

SEQ ID NO: 46518 - DNA, 20 bp, synthetic construct
  misc_feature 1..20: note = CRISPR gRNA sequence
  source 1..20: mol_type = other DNA
atatgatgcatcttaaatac

SEQ ID NO: 46519 - DNA, 20 bp, synthetic construct
  misc_feature 1..20: note = CRISPR gRNA sequence
  source 1..20: mol_type = other DNA
atgatgcatcttaaatacag

SEQ ID NO: 46520 - DNA, 20 bp, synthetic construct
  misc_feature 1..20: note = CRISPR gRNA sequence
  source 1..20: mol_type = other DNA
tgatgcatcttaaatacagg

SEQ ID NO: 46521 - DNA, 20 bp, synthetic construct
  misc_feature 1..20: note = CRISPR gRNA sequence
  source 1..20: mol_type = other DNA
atacaggaggtacatgtatg

SEQ ID NO: 46522 - DNA, 20 bp, synthetic construct
  misc_feature 1..20: note = CRISPR gRNA sequence
  source 1..20: mol_type = other DNA
gtacatgtatgtggcaaaaa

SEQ ID NO: 46523 - DNA, 20 bp, synthetic construct
  misc_feature 1..20: note = CRISPR gRNA sequence
  source 1..20: mol_type = other DNA
acgtcatgattcaaacttga

SEQ ID NO: 46524 - DNA, 20 bp, synthetic construct
  misc_feature 1..20: note = CRISPR gRNA sequence
  source 1..20: mol_type = other DNA
cgtcatgattcaaacttgac

SEQ ID NO: 46525 - DNA, 20 bp, synthetic construct
  misc_feature 1..20: note = CRISPR gRNA sequence
  source 1..20: mol_type = other DNA
gtcatgattcaaacttgacg

SEQ ID NO: 46526 - DNA, 20 bp, synthetic construct
  misc_feature 1..20: note = CRISPR gRNA sequence
  source 1..20: mol_type = other DNA
catgattcaaacttgacggg

SEQ ID NO: 46527 - DNA, 20 bp, synthetic construct
  misc_feature 1..20: note = CRISPR gRNA sequence
  source 1..20: mol_type = other DNA
atgattcaaacttgacgggg

SEQ ID NO: 46528 - DNA, 20 bp, synthetic construct
  misc_feature 1..20: note = CRISPR gRNA sequence
  source 1..20: mol_type = other DNA
tgattcaaacttgacgggga

SEQ ID NO: 46529 - DNA, 20 bp, synthetic construct
  misc_feature 1..20: note = CRISPR gRNA sequence
  source 1..20: mol_type = other DNA
gattcaaacttgacggggag

SEQ ID NO: 46530 - DNA, 20 bp, synthetic construct
  misc_feature 1..20: note = CRISPR gRNA sequence
  source 1..20: mol_type = other DNA
ttcaaacttgacggggaggg

SEQ ID NO: 46531 - DNA, 20 bp, synthetic construct
  misc_feature 1..20: note = CRISPR gRNA sequence
  source 1..20: mol_type = other DNA
aaacttgacggggaggggag

SEQ ID NO: 46532 - DNA, 20 bp, synthetic construct
  misc_feature 1..20: note = CRISPR gRNA sequence
  source 1..20: mol_type = other DNA
aacttgacggggaggggagc

SEQ ID NO: 46533 - DNA, 20 bp, synthetic construct
  misc_feature 1..20: note = CRISPR gRNA sequence
  source 1..20: mol_type = other DNA
acttgacggggaggggagca

SEQ ID NO: 46534 - DNA, 20 bp, synthetic construct
  misc_feature 1..20: note = CRISPR gRNA sequence
  source 1..20: mol_type = other DNA
ttgacggggaggggagcagg

SEQ ID NO: 46535 - DNA, 20 bp, synthetic construct
  misc_feature 1..20: note = CRISPR gRNA sequence
  source 1..20: mol_type = other DNA
tgacggggaggggagcaggg

SEQ ID NO: 46536 - DNA, 20 bp, synthetic construct
  misc_feature 1..20: note = CRISPR gRNA sequence
  source 1..20: mol_type = other DNA
cggggaggggagcagggagg

SEQ ID NO: 46537 - DNA, 20 bp, synthetic construct
  misc_feature 1..20: note = CRISPR gRNA sequence
  source 1..20: mol_type = other DNA
ggggaggggagcagggagga

SEQ ID NO: 46538 - DNA, 20 bp, synthetic construct
  misc_feature 1..20: note = CRISPR gRNA sequence
  source 1..20: mol_type = other DNA
aacctgcaccctgacgtctt

SEQ ID NO: 46539 - DNA, 20 bp, synthetic construct
  misc_feature 1..20: note = CRISPR gRNA sequence
  source 1..20: mol_type = other DNA
acctgcaccctgacgtcttc

SEQ ID NO: 46540 - DNA, 20 bp, synthetic construct
  misc_feature 1..20: note = CRISPR gRNA sequence
  source 1..20: mol_type = other DNA
cctgcaccctgacgtcttca

SEQ ID NO: 46541 - DNA, 20 bp, synthetic construct
  misc_feature 1..20: note = CRISPR gRNA sequence
  source 1..20: mol_type = other DNA
ctgcaccctgacgtcttcag

SEQ ID NO: 46542 - DNA, 20 bp, synthetic construct
  misc_feature 1..20: note = CRISPR gRNA sequence
  source 1..20: mol_type = other DNA
gcaccctgacgtcttcaggg

SEQ ID NO: 46543 - DNA, 20 bp, synthetic construct
  misc_feature 1..20: note = CRISPR gRNA sequence
  source 1..20: mol_type = other DNA
caccctgacgtcttcagggg

SEQ ID NO: 46544 - DNA, 20 bp, synthetic construct
  misc_feature 1..20: note = CRISPR gRNA sequence
  source 1..20: mol_type = other DNA
gtcttcaggggaggacacac

SEQ ID NO: 46545 - DNA, 20 bp, synthetic construct
  misc_feature 1..20: note = CRISPR gRNA sequence
  source 1..20: mol_type = other DNA
aggacacacaagcaccctat

SEQ ID NO: 46546 - DNA, 20 bp, synthetic construct
  misc_feature 1..20: note = CRISPR gRNA sequence
  source 1..20: mol_type = other DNA
ggacacacaagcaccctatc

SEQ ID NO: 46547 - DNA, 20 bp, synthetic construct
  misc_feature 1..20: note = CRISPR gRNA sequence
  source 1..20: mol_type = other DNA
cacacaagcaccctatcagg

SEQ ID NO: 46548 - DNA, 20 bp, synthetic construct
  misc_feature 1..20: note = CRISPR gRNA sequence
  source 1..20: mol_type = other DNA
aaaacccttgcccccacgac

SEQ ID NO: 46549 - DNA, 20 bp, synthetic construct
  misc_feature 1..20: note = CRISPR gRNA sequence
  source 1..20: mol_type = other DNA
tgctctcctgccgctgactt

SEQ ID NO: 46550 - DNA, 20 bp, synthetic construct
  misc_feature 1..20: note = CRISPR gRNA sequence
  source 1..20: mol_type = other DNA
gctctcctgccgctgacttt

SEQ ID NO: 46551 - DNA, 20 bp, synthetic construct
  misc_feature 1..20: note = CRISPR gRNA sequence
  source 1..20: mol_type = other DNA
actttgggacccctaccctg

SEQ ID NO: 46552 - DNA, 20 bp, synthetic construct
  misc_feature 1..20: note = CRISPR gRNA sequence
  source 1..20: mol_type = other DNA
ctttgggacccctaccctgc

SEQ ID NO: 46553 - DNA, 20 bp, synthetic construct
  misc_feature 1..20: note = CRISPR gRNA sequence
  source 1..20: mol_type = other DNA
ccctaccctgcaggctgtcc

SEQ ID NO: 46554 - DNA, 20 bp, synthetic construct
  misc_feature 1..20: note = CRISPR gRNA sequence
  source 1..20: mol_type = other DNA
aggctgtcctggaatctcct

SEQ ID NO: 46555 - DNA, 20 bp, synthetic construct
  misc_feature 1..20: note = CRISPR gRNA sequence
  source 1..20: mol_type = other DNA
ggctgtcctggaatctcctc

SEQ ID NO: 46556 - DNA, 20 bp, synthetic construct
  misc_feature 1..20: note = CRISPR gRNA sequence
  source 1..20: mol_type = other DNA
gctgtcctggaatctcctcg

SEQ ID NO: 46557 - DNA, 20 bp, synthetic construct
  misc_feature 1..20: note = CRISPR gRNA sequence
  source 1..20: mol_type = other DNA
cctggaatctcctcggggat

SEQ ID NO: 46558 - DNA, 20 bp, synthetic construct
  misc_feature 1..20: note = CRISPR gRNA sequence
  source 1..20: mol_type = other DNA
ctggaatctcctcggggatg

SEQ ID NO: 46559 - DNA, 20 bp, synthetic construct
  misc_feature 1..20: note = CRISPR gRNA sequence
  source 1..20: mol_type = other DNA
gaatctcctcggggatgagg

SEQ ID NO: 46560 - DNA, 20 bp, synthetic construct
  misc_feature 1..20: note = CRISPR gRNA sequence
  source 1..20: mol_type = other DNA
tcggggatgaggcagctgcc

SEQ ID NO: 46561 - DNA, 20 bp, synthetic construct
  misc_feature 1..20: note = CRISPR gRNA sequence
  source 1..20: mol_type = other DNA
ggatgaggcagctgccgagc

SEQ ID NO: 46562 - DNA, 20 bp, synthetic construct
  misc_feature 1..20: note = CRISPR gRNA sequence
  source 1..20: mol_type = other DNA
aggcagctgccgagctggcc

SEQ ID NO: 46563 - DNA, 20 bp, synthetic construct
  misc_feature 1..20: note = CRISPR gRNA sequence
  source 1..20: mol_type = other DNA
ggcagctgccgagctggccc

SEQ ID NO: 46564 - DNA, 20 bp, synthetic construct
  misc_feature 1..20: note = CRISPR gRNA sequence
  source 1..20: mol_type = other DNA
agctggcccaggtgctgccg

SEQ ID NO: 46565 - DNA, 20 bp, synthetic construct
  misc_feature 1..20: note = CRISPR gRNA sequence
  source 1..20: mol_type = other DNA
ggcccaggtgctgccgcaga

SEQ ID NO: 46566 - DNA, 20 bp, synthetic construct
  misc_feature 1..20: note = CRISPR gRNA sequence
  source 1..20: mol_type = other DNA
gcccaggtgctgccgcagat

SEQ ID NO: 46567 - DNA, 20 bp, synthetic construct
  misc_feature 1..20: note = CRISPR gRNA sequence
  source 1..20: mol_type = other DNA
aggtgctgccgcagatgggc

SEQ ID NO: 46568 - DNA, 20 bp, synthetic construct
  misc_feature 1..20: note = CRISPR gRNA sequence
  source 1..20: mol_type = other DNA
tgccgcagatgggccggctg

SEQ ID NO: 46569 - DNA, 20 bp, synthetic construct
  misc_feature 1..20: note = CRISPR gRNA sequence
  source 1..20: mol_type = other DNA
ccgcagatgggccggctgaa

SEQ ID NO: 46570 - DNA, 20 bp, synthetic construct
  misc_feature 1..20: note = CRISPR gRNA sequence
  source 1..20: mol_type = other DNA
gcagatgggccggctgaaga

SEQ ID NO: 46571 - DNA, 20 bp, synthetic construct
  misc_feature 1..20: note = CRISPR gRNA sequence
  source 1..20: mol_type = other DNA
gatgggccggctgaagagag

SEQ ID NO: 46572 - DNA, 20 bp, synthetic construct
  misc_feature 1..20: note = CRISPR gRNA sequence
  source 1..20: mol_type = other DNA
tgggccggctgaagagagtg

SEQ ID NO: 46573 - DNA, 20 bp, synthetic construct
  misc_feature 1..20: note = CRISPR gRNA sequence
  source 1..20: mol_type = other DNA
ggctgaagagagtggagtat

SEQ ID NO: 46574 - DNA, 20 bp, synthetic construct
  misc_feature 1..20: note = CRISPR gRNA sequence
  source 1..20: mol_type = other DNA
gctgaagagagtggagtatg

SEQ ID NO: 46575 - DNA, 20 bp, synthetic construct
  misc_feature 1..20: note = CRISPR gRNA sequence
  source 1..20: mol_type = other DNA
ctgaagagagtggagtatga

SEQ ID NO: 46576 - DNA, 20 bp, synthetic construct
  misc_feature 1..20: note = CRISPR gRNA sequence
  source 1..20: mol_type = other DNA
tgaagagagtggagtatgag

SEQ ID NO: 46577 - DNA, 20 bp, synthetic construct
  misc_feature 1..20: note = CRISPR gRNA sequence
  source 1..20: mol_type = other DNA
gagagtggagtatgaggggc

SEQ ID NO: 46578 - DNA, 20 bp, synthetic construct
  misc_feature 1..20: note = CRISPR gRNA sequence
  source 1..20: mol_type = other DNA
agagtggagtatgaggggcc

SEQ ID NO: 46579 - DNA, 20 bp, synthetic construct
  misc_feature 1..20: note = CRISPR gRNA sequence
  source 1..20: mol_type = other DNA
gagtggagtatgaggggccg

SEQ ID NO: 46580 - DNA, 20 bp, synthetic construct
  misc_feature 1..20: note = CRISPR gRNA sequence
  source 1..20: mol_type = other DNA
agtggagtatgaggggccgg

SEQ ID NO: 46581 - DNA, 20 bp, synthetic construct
  misc_feature 1..20: note = CRISPR gRNA sequence
  source 1..20: mol_type = other DNA
tggagtatgaggggccgggg

SEQ ID NO: 46582 - DNA, 20 bp, synthetic construct
  misc_feature 1..20: note = CRISPR gRNA sequence
  source 1..20: mol_type = other DNA
ggagtatgaggggccggggg

SEQ ID NO: 46583 - DNA, 20 bp, synthetic construct
  misc_feature 1..20: note = CRISPR gRNA sequence
  source 1..20: mol_type = other DNA
atgaggggccgggggaggaa

SEQ ID NO: 46584 - DNA, 20 bp, synthetic construct
  misc_feature 1..20: note = CRISPR gRNA sequence
  source 1..20: mol_type = other DNA
tgaggggccgggggaggaat

SEQ ID NO: 46585 - DNA, 20 bp, synthetic construct
  misc_feature 1..20: note = CRISPR gRNA sequence
  source 1..20: mol_type = other DNA
gggccgggggaggaatggga

SEQ ID NO: 46586 - DNA, 20 bp, synthetic construct
  misc_feature 1..20: note = CRISPR gRNA sequence
  source 1..20: mol_type = other DNA
ggccgggggaggaatgggac

SEQ ID NO: 46587 - DNA, 20 bp, synthetic construct
  misc_feature 1..20: note = CRISPR gRNA sequence
  source 1..20: mol_type = other DNA
gggaggaatgggacgggcta

SEQ ID NO: 46588 - DNA, 20 bp, synthetic construct
  misc_feature 1..20: note = CRISPR gRNA sequence
  source 1..20: mol_type = other DNA
ggaggaatgggacgggctaa

SEQ ID NO: 46589 - DNA, 20 bp, synthetic construct
  misc_feature 1..20: note = CRISPR gRNA sequence
  source 1..20: mol_type = other DNA
gaggaatgggacgggctaaa

SEQ ID NO: 46590 - DNA, 20 bp, synthetic construct
  misc_feature 1..20: note = CRISPR gRNA sequence
  source 1..20: mol_type = other DNA
aggaatgggacgggctaaag

SEQ ID NO: 46591 - DNA, 20 bp, synthetic construct
  misc_feature 1..20: note = CRISPR gRNA sequence
  source 1..20: mol_type = other DNA
ggaatgggacgggctaaagg

SEQ ID NO: 46592 - DNA, 20 bp, synthetic construct
  misc_feature 1..20: note = CRISPR gRNA sequence
  source 1..20: mol_type = other DNA
ctaaagggggacctacatcc

SEQ ID NO: 46593 - DNA, 20 bp, synthetic construct
  misc_feature 1..20: note = CRISPR gRNA sequence
  source 1..20: mol_type = other DNA
taaagggggacctacatccc

SEQ ID NO: 46594 - DNA, 20 bp, synthetic construct
  misc_feature 1..20: note = CRISPR gRNA sequence
  source 1..20: mol_type = other DNA
acctacatcccgggaacacc

SEQ ID NO: 46595 - DNA, 20 bp, synthetic construct
  misc_feature 1..20: note = CRISPR gRNA sequence
  source 1..20: mol_type = other DNA
ctacatcccgggaacaccaa

SEQ ID NO: 46596 - DNA, 20 bp, synthetic construct
  misc_feature 1..20: note = CRISPR gRNA sequence
  source 1..20: mol_type = other DNA
tacatcccgggaacaccaag

SEQ ID NO: 46597 - DNA, 20 bp, synthetic construct
  misc_feature 1..20: note = CRISPR gRNA sequence
  source 1..20: mol_type = other DNA
cgggaacaccaagaggccac

SEQ ID NO: 46598 - DNA, 20 bp, synthetic construct
  misc_feature 1..20: note = CRISPR gRNA sequence
  source 1..20: mol_type = other DNA
gggaacaccaagaggccact

SEQ ID NO: 46599 - DNA, 20 bp, synthetic construct
  misc_feature 1..20: note = CRISPR gRNA sequence
  source 1..20: mol_type = other DNA
acaccaagaggccactgggt

SEQ ID NO: 46600 - DNA, 20 bp, synthetic construct
  misc_feature 1..20: note = CRISPR gRNA sequence
  source 1..20: mol_type = other DNA
tgggtcagtcccctgcctcc

SEQ ID NO: 46601 - DNA, 20 bp, synthetic construct
  misc_feature 1..20: note = CRISPR gRNA sequence
  source 1..20: mol_type = other DNA
tcagtcccctgcctcccaga

SEQ ID NO: 46602 - DNA, 20 bp, synthetic construct
  misc_feature 1..20: note = CRISPR gRNA sequence
  source 1..20: mol_type = other DNA
ctcccagaaagcccttcctt

SEQ ID NO: 46603 - DNA, 20 bp, synthetic construct
  misc_feature 1..20: note = CRISPR gRNA sequence
  source 1..20: mol_type = other DNA
cttccttgagttgcacactc

SEQ ID NO: 46604 - DNA, 20 bp, synthetic construct
  misc_feature 1..20: note = CRISPR gRNA sequence
  source 1..20: mol_type = other DNA
tgcacactctggcctgttcc

SEQ ID NO: 46605 - DNA, 20 bp, synthetic construct
  misc_feature 1..20: note = CRISPR gRNA sequence
  source 1..20: mol_type = other DNA
ggcctgttccaagcccctgc

SEQ ID NO: 46606 - DNA, 20 bp, synthetic construct
  misc_feature 1..20: note = CRISPR gRNA sequence
  source 1..20: mol_type = other DNA
gcctgttccaagcccctgcc

SEQ ID NO: 46607 - DNA, 20 bp, synthetic construct
  misc_feature 1..20: note = CRISPR gRNA sequence
  source 1..20: mol_type = other DNA
ttccaagcccctgccaggct

SEQ ID NO: 46608 - DNA, 20 bp, synthetic construct
  misc_feature 1..20: note = CRISPR gRNA sequence
  source 1..20: mol_type = other DNA
ctgccaggcttagttccccc

SEQ ID NO: 46609 - DNA, 20 bp, synthetic construct
  misc_feature 1..20: note = CRISPR gRNA sequence
  source 1..20: mol_type = other DNA
tgccaggcttagttccccct

SEQ ID NO: 46610 - DNA, 20 bp, synthetic construct
  misc_feature 1..20: note = CRISPR gRNA sequence
  source 1..20: mol_type = other DNA
gcttagttccccctgggttc

SEQ ID NO: 46611 - DNA, 20 bp, synthetic construct
  misc_feature 1..20: note = CRISPR gRNA sequence
  source 1..20: mol_type = other DNA
tccccctgggttctagcctt

SEQ ID NO: 46612 - DNA, 20 bp, synthetic construct
  misc_feature 1..20: note = CRISPR gRNA sequence
  source 1..20: mol_type = other DNA
cttcctgctgcacctgccac

SEQ ID NO: 46613 - DNA, 20 bp, synthetic construct
  misc_feature 1..20: note = CRISPR gRNA sequence
  source 1..20: mol_type = other DNA
accagtcccctgttgtcttt

SEQ ID NO: 46614 - DNA, 20 bp, synthetic construct
  misc_feature 1..20: note = CRISPR gRNA sequence
  source 1..20: mol_type = other DNA
ccagtcccctgttgtctttt

SEQ ID NO: 46615 - DNA, 20 bp, synthetic construct
  misc_feature 1..20: note = CRISPR gRNA sequence
  source 1..20: mol_type = other DNA
tgttgtcttttgggttccct

SEQ ID NO: 46616 - DNA, 20 bp, synthetic construct
  misc_feature 1..20: note = CRISPR gRNA sequence
  source 1..20: mol_type = other DNA
tgtcttttgggttccctgag

SEQ ID NO: 46617 - DNA, 20 bp, synthetic construct
  misc_feature 1..20: note = CRISPR gRNA sequence
  source 1..20: mol_type = other DNA
gtcttttgggttccctgaga

SEQ ID NO: 46618 - DNA, 20 bp, synthetic construct
  misc_feature 1..20: note = CRISPR gRNA sequence
  source 1..20: mol_type = other DNA
ttttgggttccctgagaagg

SEQ ID NO: 46619 - DNA, 20 bp, synthetic construct
  misc_feature 1..20: note = CRISPR gRNA sequence
  source 1..20: mol_type = other DNA
ggttccctgagaaggtagtg

SEQ ID NO: 46620 - DNA, 20 bp, synthetic construct
  misc_feature 1..20: note = CRISPR gRNA sequence
  source 1..20: mol_type = other DNA
gttccctgagaaggtagtgt

SEQ ID NO: 46621 - DNA, 20 bp, synthetic construct
  misc_feature 1..20: note = CRISPR gRNA sequence
  source 1..20: mol_type = other DNA
tccctgagaaggtagtgtgg

SEQ ID NO: 46622 - DNA, 20 bp, synthetic construct
  misc_feature 1..20: note = CRISPR gRNA sequence
  source 1..20: mol_type = other DNA
gagactgtgtcccctgacct

SEQ ID NO: 46623 - DNA, 20 bp, synthetic construct
  misc_feature 1..20: note = CRISPR gRNA sequence
  source 1..20: mol_type = other DNA
gtgtcccctgaccttggcct

SEQ ID NO: 46624 - DNA, 20 bp, synthetic construct
  misc_feature 1..20: note = CRISPR gRNA sequence
  source 1..20: mol_type = other DNA
tgtcccctgaccttggcctg

SEQ ID NO: 46625 - DNA, 20 bp, synthetic construct
  misc_feature 1..20: note = CRISPR gRNA sequence
  source 1..20: mol_type = other DNA
cccctgaccttggcctgagg

SEQ ID NO: 46626 - DNA, 20 bp, synthetic construct
  misc_feature 1..20: note = CRISPR gRNA sequence
  source 1..20: mol_type = other DNA
ccctgaccttggcctgagga

SEQ ID NO: 46627 - DNA, 20 bp, synthetic construct
  misc_feature 1..20: note = CRISPR gRNA sequence
  source 1..20: mol_type = other DNA
cctgaccttggcctgaggaa

SEQ ID NO: 46628 - DNA, 20 bp, synthetic construct
  misc_feature 1..20: note = CRISPR gRNA sequence
  source 1..20: mol_type = other DNA
cttggcctgaggaagggacc

SEQ ID NO: 46629 - DNA, 20 bp, synthetic construct
  misc_feature 1..20: note = CRISPR gRNA sequence
  source 1..20: mol_type = other DNA
ttggcctgaggaagggacct

SEQ ID NO: 46630 - DNA, 20 bp, synthetic construct
  misc_feature 1..20: note = CRISPR gRNA sequence
  source 1..20: mol_type = other DNA
aactctcacacccattctca

SEQ ID NO: 46631 - DNA, 20 bp, synthetic construct
  misc_feature 1..20: note = CRISPR gRNA sequence
  source 1..20: mol_type = other DNA
ccctcccctcactgtccact

SEQ ID NO: 46632 - DNA, 20 bp, synthetic construct
  misc_feature 1..20: note = CRISPR gRNA sequence
  source 1..20: mol_type = other DNA
tcccctcactgtccactgag

SEQ ID NO: 46633 - DNA, 20 bp, synthetic construct
  misc_feature 1..20: note = CRISPR gRNA sequence
  source 1..20: mol_type = other DNA
tcactgtccactgagaagcc

SEQ ID NO: 46634 - DNA, 20 bp, synthetic construct
  misc_feature 1..20: note = CRISPR gRNA sequence
  source 1..20: mol_type = other DNA
actgtccactgagaagcctg

SEQ ID NO: 46635 - DNA, 20 bp, synthetic construct
  misc_feature 1..20: note = CRISPR gRNA sequence
  source 1..20: mol_type = other DNA
gtccactgagaagcctggag

SEQ ID NO: 46636 - DNA, 20 bp, synthetic construct
  misc_feature 1..20: note = CRISPR gRNA sequence
  source 1..20: mol_type = other DNA
tgagaagcctggagaagaat

SEQ ID NO: 46637 - DNA, 20 bp, synthetic construct
  misc_feature 1..20: note = CRISPR gRNA sequence
  source 1..20: mol_type = other DNA
cctggagaagaatcagatca

SEQ ID NO: 46638 - DNA, 20 bp, synthetic construct
  misc_feature 1..20: note = CRISPR gRNA sequence
  source 1..20: mol_type = other DNA
gaagaatcagatcacagctt

SEQ ID NO: 46639 - DNA, 20 bp, synthetic construct
  misc_feature 1..20: note = CRISPR gRNA sequence
  source 1..20: mol_type = other DNA
aagaatcagatcacagcttt

SEQ ID NO: 46640 - DNA, 20 bp, synthetic construct
  misc_feature 1..20: note = CRISPR gRNA sequence
  source 1..20: mol_type = other DNA
agaatcagatcacagctttg

SEQ ID NO: 46641 - DNA, 20 bp, synthetic construct
  misc_feature 1..20: note = CRISPR gRNA sequence
  source 1..20: mol_type = other DNA
gaatcagatcacagctttgg

SEQ ID NO: 46642 - DNA, 20 bp, synthetic construct
  misc_feature 1..20: note = CRISPR gRNA sequence
  source 1..20: mol_type = other DNA
agatcacagctttgggggcc

SEQ ID NO: 46643 - DNA, 20 bp, synthetic construct
  misc_feature 1..20: note = CRISPR gRNA sequence
  source 1..20: mol_type = other DNA
agctttgggggcctggctcc

SEQ ID NO: 46644 - DNA, 20 bp, synthetic construct
  misc_feature 1..20: note = CRISPR gRNA sequence
  source 1..20: mol_type = other DNA
gggggcctggctcctggctg

SEQ ID NO: 46645 - DNA, 20 bp, synthetic construct
  misc_feature 1..20: note = CRISPR gRNA sequence
  source 1..20: mol_type = other DNA
ggggcctggctcctggctga

SEQ ID NO: 46646 - DNA, 20 bp, synthetic construct
  misc_feature 1..20: note = CRISPR gRNA sequence
  source 1..20: mol_type = other DNA
ctggctcctggctgaaggac

SEQ ID NO: 46647 - DNA, 20 bp, synthetic construct
  misc_feature 1..20: note = CRISPR gRNA sequence
  source 1..20: mol_type = other DNA
tcctggctgaaggactggcc

SEQ ID NO: 46648 - DNA, 20 bp, synthetic construct
  misc_feature 1..20: note = CRISPR gRNA sequence
  source 1..20: mol_type = other DNA
cctggctgaaggactggccc

SEQ ID NO: 46649 - DNA, 20 bp, synthetic construct
  misc_feature 1..20: note = CRISPR gRNA sequence
  source 1..20: mol_type = other DNA
ctggctgaaggactggccca

SEQ ID NO: 46650 - DNA, 20 bp, synthetic construct
  misc_feature 1..20: note = CRISPR gRNA sequence
  source 1..20: mol_type = other DNA
tggctgaaggactggcccag

SEQ ID NO: 46651 - DNA, 20 bp, synthetic construct
  misc_feature 1..20: note = CRISPR gRNA sequence
  source 1..20: mol_type = other DNA
gaaggactggcccaggggtc

SEQ ID NO: 46652 - DNA, 20 bp, synthetic construct
  misc_feature 1..20: note = CRISPR gRNA sequence
  source 1..20: mol_type = other DNA
ggcccaggggtctagcatcc

SEQ ID NO: 46653 - DNA, 20 bp, synthetic construct
  misc_feature 1..20: note = CRISPR gRNA sequence
  source 1..20: mol_type = other DNA
ggtctagcatccaagtcatc

SEQ ID NO: 46654 - DNA, 20 bp, synthetic construct
  misc_feature 1..20: note = CRISPR gRNA sequence
  source 1..20: mol_type = other DNA
gcatccaagtcatccggtaa

SEQ ID NO: 46655 - DNA, 20 bp, synthetic construct
  misc_feature 1..20: note = CRISPR gRNA sequence
  source 1..20: mol_type = other DNA
atccaagtcatccggtaaca

SEQ ID NO: 46656 - DNA, 20 bp, synthetic construct
  misc_feature 1..20: note = CRISPR gRNA sequence
  source 1..20: mol_type = other DNA
tccaagtcatccggtaacag

SEQ ID NO: 46657 - DNA, 20 bp, synthetic construct
  misc_feature 1..20: note = CRISPR gRNA sequence
  source 1..20: mol_type = other DNA
catccggtaacagaggcctg

SEQ ID NO: 46658 - DNA, 20 bp, synthetic construct
  misc_feature 1..20: note = CRISPR gRNA sequence
  source 1..20: mol_type = other DNA
atccggtaacagaggcctgc

SEQ ID NO: 46659 - DNA, 20 bp, synthetic construct
  misc_feature 1..20: note = CRISPR gRNA sequence
  source 1..20: mol_type = other DNA
tccggtaacagaggcctgca

SEQ ID NO: 46660 - DNA, 20 bp, synthetic construct
  misc_feature 1..20: note = CRISPR gRNA sequence
  source 1..20: mol_type = other DNA
ccggtaacagaggcctgcag

SEQ ID NO: 46661 - DNA, 20 bp, synthetic construct
  misc_feature 1..20: note = CRISPR gRNA sequence
  source 1..20: mol_type = other DNA
gtaacagaggcctgcagggg

SEQ ID NO: 46662 - DNA, 20 bp, synthetic construct
  misc_feature 1..20: note = CRISPR gRNA sequence
  source 1..20: mol_type = other DNA
taacagaggcctgcaggggc

SEQ ID NO: 46663 - DNA, 20 bp, synthetic construct
  misc_feature 1..20: note = CRISPR gRNA sequence
  source 1..20: mol_type = other DNA
aacagaggcctgcaggggca

SEQ ID NO: 46664 - DNA, 20 bp, synthetic construct
  misc_feature 1..20: note = CRISPR gRNA sequence
  source 1..20: mol_type = other DNA
gaggcctgcaggggcaggga

SEQ ID NO: 46665 - DNA, 20 bp, synthetic construct
  misc_feature 1..20: note = CRISPR gRNA sequence
  source 1..20: mol_type = other DNA
gcctgcaggggcagggatgg

SEQ ID NO: 46666 - DNA, 20 bp, synthetic construct
  misc_feature 1..20: note = CRISPR gRNA sequence
  source 1..20: mol_type = other DNA
cctgcaggggcagggatggt

SEQ ID NO: 46667 - DNA, 20 bp, synthetic construct
  misc_feature 1..20: note = CRISPR gRNA sequence
  source 1..20: mol_type = other DNA
gcaggggcagggatggtggg

SEQ ID NO: 46668 - DNA, 20 bp, synthetic construct
  misc_feature 1..20: note = CRISPR gRNA sequence
  source 1..20: mol_type = other DNA
caggggcagggatggtgggt

SEQ ID NO: 46669 - DNA, 20 bp, synthetic construct
  misc_feature 1..20: note = CRISPR gRNA sequence
  source 1..20: mol_type = other DNA
ggggcagggatggtgggtgg

SEQ ID NO: 46670 - DNA, 20 bp, synthetic construct
  misc_feature 1..20: note = CRISPR gRNA sequence
  source 1..20: mol_type = other DNA
gggcagggatggtgggtggg

SEQ ID NO: 46671 - DNA, 20 bp, synthetic construct
  misc_feature 1..20: note = CRISPR gRNA sequence
  source 1..20: mol_type = other DNA
tgggaggctacaccaacccc

SEQ ID NO: 46672 - DNA, 20 bp, synthetic construct
  misc_feature 1..20: note = CRISPR gRNA sequence
  source 1..20: mol_type = other DNA
acaccaacccccagatctaa

SEQ ID NO: 46673 - DNA, 20 bp, synthetic construct
  misc_feature 1..20: note = CRISPR gRNA sequence
  source 1..20: mol_type = other DNA
caccaacccccagatctaat

SEQ ID NO: 46674 - DNA, 20 bp, synthetic construct
  misc_feature 1..20: note = CRISPR gRNA sequence
  source 1..20: mol_type = other DNA
ccagatctaatgggactccc

SEQ ID NO: 46675 - DNA, 20 bp, synthetic construct
  misc_feature 1..20: note = CRISPR gRNA sequence
  source 1..20: mol_type = other DNA
agatctaatgggactccctg

SEQ ID NO: 46676 - DNA, 20 bp, synthetic construct
  misc_feature 1..20: note = CRISPR gRNA sequence
  source 1..20: mol_type = other DNA
gatctaatgggactccctgg

SEQ ID NO: 46677 - DNA, 20 bp, synthetic construct
  misc_feature 1..20: note = CRISPR gRNA sequence
  source 1..20: mol_type = other DNA
tctaatgggactccctggag

SEQ ID NO: 46678 - DNA, 20 bp, synthetic construct
  misc_feature 1..20: note = CRISPR gRNA sequence
  source 1..20: mol_type = other DNA
ctaatgggactccctggagg

SEQ ID NO: 46679 - DNA, 20 bp, synthetic construct
  misc_feature 1..20: note = CRISPR gRNA sequence
  source 1..20: mol_type = other DNA
atgggactccctggaggagg

SEQ ID NO: 46680 - DNA, 20 bp, synthetic construct
  misc_feature 1..20: note = CRISPR gRNA sequence
  source 1..20: mol_type = other DNA
ggactccctggaggaggcgg

SEQ ID NO: 46681 - DNA, 20 bp, synthetic construct
  misc_feature 1..20: note = CRISPR gRNA sequence
  source 1..20: mol_type = other DNA
gactccctggaggaggcggc

SEQ ID NO: 46682 - DNA, 20 bp, synthetic construct
  misc_feature 1..20: note = CRISPR gRNA sequence
  source 1..20: mol_type = other DNA
actccctggaggaggcggca

SEQ ID NO: 46683 - DNA, 20 bp, synthetic construct
  misc_feature 1..20: note = CRISPR gRNA sequence
  source 1..20: mol_type = other DNA
ctggaggaggcggcagggcc

SEQ ID NO: 46684 - DNA, 20 bp, synthetic construct
  misc_feature 1..20: note = CRISPR gRNA sequence
  source 1..20: mol_type = other DNA
tggaggaggcggcagggcct

SEQ ID NO: 46685 - DNA, 20 bp, synthetic construct
  misc_feature 1..20: note = CRISPR gRNA sequence
  source 1..20: mol_type = other DNA
ggaggcggcagggcctgggc

SEQ ID NO: 46686 - DNA, 20 bp, synthetic construct
  misc_feature 1..20: note = CRISPR gRNA sequence
  source 1..20: mol_type = other DNA
gaggcggcagggcctgggct

SEQ ID NO: 46687 - DNA, 20 bp, synthetic construct
  misc_feature 1..20: note = CRISPR gRNA sequence
  source 1..20: mol_type = other DNA
aggcggcagggcctgggctg

SEQ ID NO: 46688 - DNA, 20 bp, synthetic construct
  misc_feature 1..20: note = CRISPR gRNA sequence
  source 1..20: mol_type = other DNA
gcctgggctggggattatca

SEQ ID NO: 46689 - DNA, 20 bp, synthetic construct
  misc_feature 1..20: note = CRISPR gRNA sequence
  source 1..20: mol_type = other DNA
cctgggctggggattatcaa

SEQ ID NO: 46690 - DNA, 20 bp, synthetic construct
  misc_feature 1..20: note = CRISPR gRNA sequence
  source 1..20: mol_type = other DNA
tgggctggggattatcaaag

SEQ ID NO: 46691 - DNA, 20 bp, synthetic construct
  misc_feature 1..20: note = CRISPR gRNA sequence
  source 1..20: mol_type = other DNA
ggggattatcaaaggagact

SEQ ID NO: 46692 - DNA, 20 bp, synthetic construct
  misc_feature 1..20: note = CRISPR gRNA sequence
  source 1..20: mol_type = other DNA
gagacttggaccactccacc

SEQ ID NO: 46693 - DNA, 20 bp, synthetic construct
  misc_feature 1..20: note = CRISPR gRNA sequence
  source 1..20: mol_type = other DNA
ggaccactccaccaagaatt

SEQ ID NO: 46694 - DNA, 20 bp, synthetic construct
  misc_feature 1..20: note = CRISPR gRNA sequence
  source 1..20: mol_type = other DNA
ccactccaccaagaatttgg

SEQ ID NO: 46695 - DNA, 20 bp, synthetic construct
  misc_feature 1..20: note = CRISPR gRNA sequence
  source 1..20: mol_type = other DNA
tccaccaagaatttggcagc

SEQ ID NO: 46696 - DNA, 20 bp, synthetic construct
  misc_feature 1..20: note = CRISPR gRNA sequence
  source 1..20: mol_type = other DNA
accaagaatttggcagcaag

SEQ ID NO: 46697 - DNA, 20 bp, synthetic construct
  misc_feature 1..20: note = CRISPR gRNA sequence
  source 1..20: mol_type = other DNA
aatttggcagcaagcagact

SEQ ID NO: 46698 - DNA, 20 bp, synthetic construct
  misc_feature 1..20: note = CRISPR gRNA sequence
  source 1..20: mol_type = other DNA
agcagacttggatcaaaccc

SEQ ID NO: 46699 - DNA, 20 bp, synthetic construct
  misc_feature 1..20: note = CRISPR gRNA sequence
  source 1..20: mol_type = other DNA
ttgccaactgtgtaactttg

SEQ ID NO: 46700 - DNA, 20 bp, synthetic construct
  misc_feature 1..20: note = CRISPR gRNA sequence
  source 1..20: mol_type = other DNA
caattttctcatctgtgaaa

SEQ ID NO: 46701 - DNA, 20 bp, synthetic construct
  misc_feature 1..20: note = CRISPR gRNA sequence
  source 1..20: mol_type = other DNA
aattttctcatctgtgaaat

SEQ ID NO: 46702 - DNA, 20 bp, synthetic construct
  misc_feature 1..20: note = CRISPR gRNA sequence
  source 1..20: mol_type = other DNA
attttctcatctgtgaaatg

SEQ ID NO: 46703 - DNA, 20 bp, synthetic construct
  misc_feature 1..20: note = CRISPR gRNA sequence
  source 1..20: mol_type = other DNA
ctgtgaaatggggatactga

SEQ ID NO: 46704 - DNA, 20 bp, synthetic construct
  misc_feature 1..20: note = CRISPR gRNA sequence
  source 1..20: mol_type = other DNA
gatactgatagtatctacct

SEQ ID NO: 46705 - DNA, 20 bp, synthetic construct
  misc_feature 1..20: note = CRISPR gRNA sequence
  source 1..20: mol_type = other DNA
tactgatagtatctacctca

SEQ ID NO: 46706 - DNA, 20 bp, synthetic construct
  misc_feature 1..20: note = CRISPR gRNA sequence
  source 1..20: mol_type = other DNA
ctgatagtatctacctcaga

SEQ ID NO: 46707 - DNA, 20 bp, synthetic construct
  misc_feature 1..20: note = CRISPR gRNA sequence
  source 1..20: mol_type = other DNA
atctacctcagagagttgtg

SEQ ID NO: 46708 - DNA, 20 bp, synthetic construct
  misc_feature 1..20: note = CRISPR gRNA sequence
  source 1..20: mol_type = other DNA
gagagttgtgaagactaaat

SEQ ID NO: 46709 - DNA, 20 bp, synthetic construct
  misc_feature 1..20: note = CRISPR gRNA sequence
  source 1..20: mol_type = other DNA
gaagactaaatgagcatata

SEQ ID NO: 46710 - DNA, 20 bp, synthetic construct
  misc_feature 1..20: note = CRISPR gRNA sequence
  source 1..20: mol_type = other DNA
aaagcactgaacccaatgcc

SEQ ID NO: 46711 - DNA, 20 bp, synthetic construct
  misc_feature 1..20: note = CRISPR gRNA sequence
  source 1..20: mol_type = other DNA
tgaacccaatgcctggcaca

SEQ ID NO: 46712 - DNA, 20 bp, synthetic construct
  misc_feature 1..20: note = CRISPR gRNA sequence
  source 1..20: mol_type = other DNA
cccaatgcctggcacatagt

SEQ ID NO: 46713 - DNA, 20 bp, synthetic construct
  misc_feature 1..20: note = CRISPR gRNA sequence
  source 1..20: mol_type = other DNA
cacatagtaagcacttaaaa

SEQ ID NO: 46714 - DNA, 20 bp, synthetic construct
  misc_feature 1..20: note = CRISPR gRNA sequence
  source 1..20: mol_type = other DNA
atagtaagcacttaaaatgg

SEQ ID NO: 46715 - DNA, 20 bp, synthetic construct
  misc_feature 1..20: note = CRISPR gRNA sequence
  source 1..20: mol_type = other DNA
cttaaaatggcagctataat

SEQ ID NO: 46716 - DNA, 20 bp, synthetic construct
  misc_feature 1..20: note = CRISPR gRNA sequence
  source 1..20: mol_type = other DNA
taaaatggcagctataatca

SEQ ID NO: 46717 - DNA, 20 bp, synthetic construct
  misc_feature 1..20: note = CRISPR gRNA sequence
  source 1..20: mol_type = other DNA
ataatcagagccatcacata

SEQ ID NO: 46718 - DNA, 20 bp, synthetic construct
  misc_feature 1..20: note = CRISPR gRNA sequence
  source 1..20: mol_type = other DNA
agccatcacatacagttgta

SEQ ID NO: 46719 - DNA, 20 bp, synthetic construct
  misc_feature 1..20: note = CRISPR gRNA sequence
  source 1..20: mol_type = other DNA
gccatcacatacagttgtat

SEQ ID NO: 46720 - DNA, 20 bp, synthetic construct
  misc_feature 1..20: note = CRISPR gRNA sequence
  source 1..20: mol_type = other DNA
gtataggttgtgcactgcac

SEQ ID NO: 46721 - DNA, 20 bp, synthetic construct
  misc_feature 1..20: note = CRISPR gRNA sequence
  source 1..20: mol_type = other DNA
tataggttgtgcactgcaca

SEQ ID NO: 46722 - DNA, 20 bp, synthetic construct
  misc_feature 1..20: note = CRISPR gRNA sequence
  source 1..20: mol_type = other DNA
ataggttgtgcactgcacaa

SEQ ID NO: 46723 - DNA, 20 bp, synthetic construct
  misc_feature 1..20: note = CRISPR gRNA sequence
  source 1..20: mol_type = other DNA
tgcacaagggcattaaacct

SEQ ID NO: 46724 - DNA, 20 bp, synthetic construct
  misc_feature 1..20: note = CRISPR gRNA sequence
  source 1..20: mol_type = other DNA
gcacaagggcattaaaccta

SEQ ID NO: 46725 - DNA, 20 bp, synthetic construct
  misc_feature 1..20: note = CRISPR gRNA sequence
  source 1..20: mol_type = other DNA
cacaagggcattaaacctaa

SEQ ID NO: 46726 - DNA, 20 bp, synthetic construct
  misc_feature 1..20: note = CRISPR gRNA sequence
  source 1..20: mol_type = other DNA
acaagggcattaaacctaag

SEQ ID NO: 46727 - DNA, 20 bp, synthetic construct
  misc_feature 1..20: note = CRISPR gRNA sequence
  source 1..20: mol_type = other DNA
cattcacattgtcaacctgc

SEQ ID NO: 46728 - DNA, 20 bp, synthetic construct
  misc_feature 1..20: note = CRISPR gRNA sequence
  source 1..20: mol_type = other DNA
ttgtcaacctgctagatttc

SEQ ID NO: 46729 - DNA, 20 bp, synthetic construct
  misc_feature 1..20: note = CRISPR gRNA sequence
  source 1..20: mol_type = other DNA
tcaacctgctagatttctag

SEQ ID NO: 46730 - DNA, 20 bp, synthetic construct
  misc_feature 1..20: note = CRISPR gRNA sequence
  source 1..20: mol_type = other DNA
ctgctagatttctagcagat

SEQ ID NO: 46731 - DNA, 20 bp, synthetic construct
  misc_feature 1..20: note = CRISPR gRNA sequence
  source 1..20: mol_type = other DNA
gctagatttctagcagatga

SEQ ID NO: 46732 - DNA, 20 bp, synthetic construct
  misc_feature 1..20: note = CRISPR gRNA sequence
  source 1..20: mol_type = other DNA
atttctagcagatgagagta

SEQ ID NO: 46733 - DNA, 20 bp, synthetic construct
  misc_feature 1..20: note = CRISPR gRNA sequence
  source 1..20: mol_type = other DNA
atcatatattatgacaattt

SEQ ID NO: 46734 - DNA, 20 bp, synthetic construct
  misc_feature 1..20: note = CRISPR gRNA sequence
  source 1..20: mol_type = other DNA
tatattatgacaatttcaga

SEQ ID NO: 46735 - DNA, 20 bp, synthetic construct
  misc_feature 1..20: note = CRISPR gRNA sequence
  source 1..20: mol_type = other DNA
ttatgacaatttcagacaga

SEQ ID NO: 46736 - DNA, 20 bp, synthetic construct
  misc_feature 1..20: note = CRISPR gRNA sequence
  source 1..20: mol_type = other DNA
tgacaatttcagacagatgg

SEQ ID NO: 46737 - DNA, 20 bp, synthetic construct
  misc_feature 1..20: note = CRISPR gRNA sequence
  source 1..20: mol_type = other DNA
gatggaagtaaaacatcttg

SEQ ID NO: 46738 - DNA, 20 bp, synthetic construct
  misc_feature 1..20: note = CRISPR gRNA sequence
  source 1..20: mol_type = other DNA
gaagtaaaacatcttgaaga

SEQ ID NO: 46739 - DNA, 20 bp, synthetic construct
  misc_feature 1..20: note = CRISPR gRNA sequence
  source 1..20: mol_type = other DNA
agtaaaacatcttgaagaaa

SEQ ID NO: 46740 - DNA, 20 bp, synthetic construct
  misc_feature 1..20: note = CRISPR gRNA sequence
  source 1..20: mol_type = other DNA
gtaaaacatcttgaagaaag

SEQ ID NO: 46741 - DNA, 20 bp, synthetic construct
  misc_feature 1..20: note = CRISPR gRNA sequence
  source 1..20: mol_type = other DNA
taaaacatcttgaagaaaga

SEQ ID NO: 46742 - DNA, 20 bp, synthetic construct
  misc_feature 1..20: note = CRISPR gRNA sequence
  source 1..20: mol_type = other DNA
tttgcacaaatgtgtcatat

SEQ ID NO: 46743 - DNA, 20 bp, synthetic construct
  misc_feature 1..20: note = CRISPR gRNA sequence
  source 1..20: mol_type = other DNA
acaaatgtgtcatatgagtg

SEQ ID NO: 46744 - DNA, 20 bp, synthetic construct
  misc_feature 1..20: note = CRISPR gRNA sequence
  source 1..20: mol_type = other DNA
gtgtcatatgagtgtggcct

SEQ ID NO: 46745 - DNA, 20 bp, synthetic construct
  misc_feature 1..20: note = CRISPR gRNA sequence
  source 1..20: mol_type = other DNA
catatgagtgtggccttagc

SEQ ID NO: 46746 - DNA, 20 bp, synthetic construct
  misc_feature 1..20: note = CRISPR gRNA sequence
  source 1..20: mol_type = other DNA
tagctggcatcactatctcc

SEQ ID NO: 46747 - DNA, 20 bp, synthetic construct
  misc_feature 1..20: note = CRISPR gRNA sequence
  source 1..20: mol_type = other DNA
agctggcatcactatctccc

SEQ ID NO: 46748 - DNA, 20 bp, synthetic construct
  misc_feature 1..20: note = CRISPR gRNA sequence
  source 1..20: mol_type = other DNA
gctggcatcactatctccca

SEQ ID NO: 46749 - DNA, 20 bp, synthetic construct
  misc_feature 1..20: note = CRISPR gRNA sequence
  source 1..20: mol_type = other DNA
tggcatcactatctcccagg

SEQ ID NO: 46750 - DNA, 20 bp, synthetic construct
  misc_feature 1..20: note = CRISPR gRNA sequence
  source 1..20: mol_type = other DNA
ggcatcactatctcccaggg

SEQ ID NO: 46751 - DNA, 20 bp, synthetic construct
  misc_feature 1..20: note = CRISPR gRNA sequence
  source 1..20: mol_type = other DNA
atcactatctcccagggagg

SEQ ID NO: 46752 - DNA, 20 bp, synthetic construct
  misc_feature 1..20: note = CRISPR gRNA sequence
  source 1..20: mol_type = other DNA
tcactatctcccagggagga

SEQ ID NO: 46753 - DNA, 20 bp, synthetic construct
  misc_feature 1..20: note = CRISPR gRNA sequence
  source 1..20: mol_type = other DNA
atctcccagggaggaaggtt

SEQ ID NO: 46754 - DNA, 20 bp, synthetic construct
  misc_feature 1..20: note = CRISPR gRNA sequence
  source 1..20: mol_type = other DNA
cccagggaggaaggttgagt

SEQ ID NO: 46755 - DNA, 20 bp, synthetic construct
  misc_feature 1..20: note = CRISPR gRNA sequence
  source 1..20: mol_type = other DNA
cagggaggaaggttgagttg

SEQ ID NO: 46756 - DNA, 20 bp, synthetic construct
  misc_feature 1..20: note = CRISPR gRNA sequence
  source 1..20: mol_type = other DNA
agggaggaaggttgagttgg

SEQ ID NO: 46757 - DNA, 20 bp, synthetic construct
  misc_feature 1..20: note = CRISPR gRNA sequence
  source 1..20: mol_type = other DNA
gaaggttgagttggaggact

SEQ ID NO: 46758 - DNA, 20 bp, synthetic construct
  misc_feature 1..20: note = CRISPR gRNA sequence
  source 1..20: mol_type = other DNA
aaggttgagttggaggactc

SEQ ID NO: 46759 - DNA, 20 bp, synthetic construct
  misc_feature 1..20: note = CRISPR gRNA sequence
  source 1..20: mol_type = other DNA
ggttgagttggaggactcag

SEQ ID NO: 46760 - DNA, 20 bp, synthetic construct
  misc_feature 1..20: note = CRISPR gRNA sequence
  source 1..20: mol_type = other DNA
gttgagttggaggactcagg

SEQ ID NO: 46761 - DNA, 20 bp, synthetic construct
  misc_feature 1..20: note = CRISPR gRNA sequence
  source 1..20: mol_type = other DNA
gagttggaggactcaggagg

SEQ ID NO: 46762 - DNA, 20 bp, synthetic construct
  misc_feature 1..20: note = CRISPR gRNA sequence
  source 1..20: mol_type = other DNA
agttggaggactcaggaggc

SEQ ID NO: 46763 - DNA, 20 bp, synthetic construct
  misc_feature 1..20: note = CRISPR gRNA sequence
  source 1..20: mol_type = other DNA
gaggactcaggaggcaggtg

SEQ ID NO: 46764 - DNA, 20 bp, synthetic construct
  misc_feature 1..20: note = CRISPR gRNA sequence
  source 1..20: mol_type = other DNA
aggactcaggaggcaggtgt

SEQ ID NO: 46765 - DNA, 20 bp, synthetic construct
  misc_feature 1..20: note = CRISPR gRNA sequence
  source 1..20: mol_type = other DNA
ggactcaggaggcaggtgtg

SEQ ID NO: 46766 - DNA, 20 bp, synthetic construct
  misc_feature 1..20: note = CRISPR gRNA sequence
  source 1..20: mol_type = other DNA
tgtggggtacaccctctccc

SEQ ID NO: 46767 - DNA, 20 bp, synthetic construct
  misc_feature 1..20: note = CRISPR gRNA sequence
  source 1..20: mol_type = other DNA
gtggggtacaccctctccct

SEQ ID NO: 46768 - DNA, 20 bp, synthetic construct
  misc_feature 1..20: note = CRISPR gRNA sequence
  source 1..20: mol_type = other DNA
ggtacaccctctccctaggt

SEQ ID NO: 46769 - DNA, 20 bp, synthetic construct
  misc_feature 1..20: note = CRISPR gRNA sequence
  source 1..20: mol_type = other DNA
tctccctaggtcagctatgc

SEQ ID NO: 46770 - DNA, 20 bp, synthetic construct
  misc_feature 1..20: note = CRISPR gRNA sequence
  source 1..20: mol_type = other DNA
ggtctaacacctgcctctgc

SEQ ID NO: 46771 - DNA, 20 bp, synthetic construct
  misc_feature 1..20: note = CRISPR gRNA sequence
  source 1..20: mol_type = other DNA
gtctaacacctgcctctgcc

SEQ ID NO: 46772 - DNA, 20 bp, synthetic construct
  misc_feature 1..20: note = CRISPR gRNA sequence
  source 1..20: mol_type = other DNA
ctgcctctgccaggtaactc

SEQ ID NO: 46773 - DNA, 20 bp, synthetic construct
  misc_feature 1..20: note = CRISPR gRNA sequence
  source 1..20: mol_type = other DNA
tgcctctgccaggtaactct

SEQ ID NO: 46774 - DNA, 20 bp, synthetic construct
  misc_feature 1..20: note = CRISPR gRNA sequence
  source 1..20: mol_type = other DNA
ctgccaggtaactctaggca

SEQ ID NO: 46775 - DNA, 20 bp, synthetic construct
  misc_feature 1..20: note = CRISPR gRNA sequence
  source 1..20: mol_type = other DNA
taggcacagctctacctttt

SEQ ID NO: 46776 - DNA, 20 bp, synthetic construct
  misc_feature 1..20: note = CRISPR gRNA sequence
  source 1..20: mol_type = other DNA
aggcacagctctaccttttt

SEQ ID NO: 46777 - DNA, 20 bp, synthetic construct
  misc_feature 1..20: note = CRISPR gRNA sequence
  source 1..20: mol_type = other DNA
agctctacctttttgggcct

SEQ ID NO: 46778 - DNA, 20 bp, synthetic construct
  misc_feature 1..20: note = CRISPR gRNA sequence
  source 1..20: mol_type = other DNA
ggcctcagcctcccaatctg

SEQ ID NO: 46779 - DNA, 20 bp, synthetic construct
  misc_feature 1..20: note = CRISPR gRNA sequence
  source 1..20: mol_type = other DNA
ctcccaatctgcagatacga

SEQ ID NO: 46780 - DNA, 20 bp, synthetic construct
  misc_feature 1..20: note = CRISPR gRNA sequence
  source 1..20: mol_type = other DNA
caatctgcagatacgacaga

SEQ ID NO: 46781 - DNA, 20 bp, synthetic construct
  misc_feature 1..20: note = CRISPR gRNA sequence
  source 1..20: mol_type = other DNA
tgcagatacgacagatggca

SEQ ID NO: 46782 - DNA, 20 bp, synthetic construct
  misc_feature 1..20: note = CRISPR gRNA sequence
  source 1..20: mol_type = other DNA
gatacgacagatggcaaaga

SEQ ID NO: 46783 - DNA, 20 bp, synthetic construct
  misc_feature 1..20: note = CRISPR gRNA sequence
  source 1..20: mol_type = other DNA
atacgacagatggcaaagat

SEQ ID NO: 46784 - DNA, 20 bp, synthetic construct
  misc_feature 1..20: note = CRISPR gRNA sequence
  source 1..20: mol_type = other DNA
acgacagatggcaaagatgg

SEQ ID NO: 46785 - DNA, 20 bp, synthetic construct
  misc_feature 1..20: note = CRISPR gRNA sequence
  source 1..20: mol_type = other DNA
cgacagatggcaaagatggg

SEQ ID NO: 46786 - DNA, 20 bp, synthetic construct
  misc_feature 1..20: note = CRISPR gRNA sequence
  source 1..20: mol_type = other DNA
gcaaagatgggaggatgaat

SEQ ID NO: 46787 - DNA, 20 bp, synthetic construct
  misc_feature 1..20: note = CRISPR gRNA sequence
  source 1..20: mol_type = other DNA
gtgcctatatctgtgcccca

SEQ ID NO: 46788 - DNA, 20 bp, synthetic construct
  misc_feature 1..20: note = CRISPR gRNA sequence
  source 1..20: mol_type = other DNA
tatctgtgccccacagcctc

SEQ ID NO: 46789 - DNA, 20 bp, synthetic construct
  misc_feature 1..20: note = CRISPR gRNA sequence
  source 1..20: mol_type = other DNA
taaccccattccctgcgaca

SEQ ID NO: 46790 - DNA, 20 bp, synthetic construct
  misc_feature 1..20: note = CRISPR gRNA sequence
  source 1..20: mol_type = other DNA
ccattccctgcgacatggcc

SEQ ID NO: 46791 - DNA, 20 bp, synthetic construct
  misc_feature 1..20: note = CRISPR gRNA sequence
  source 1..20: mol_type = other DNA
gcgacatggcccagcacctg

SEQ ID NO: 46792 - DNA, 20 bp, synthetic construct
  misc_feature 1..20: note = CRISPR gRNA sequence
  source 1..20: mol_type = other DNA
gacatggcccagcacctgaa

SEQ ID NO: 46793 - DNA, 20 bp, synthetic construct
  misc_feature 1..20: note = CRISPR gRNA sequence
  source 1..20: mol_type = other DNA
tggcccagcacctgaagagc

SEQ ID NO: 46794 - DNA, 20 bp, synthetic construct
  misc_feature 1..20: note = CRISPR gRNA sequence
  source 1..20: mol_type = other DNA
ggcccagcacctgaagagcc

SEQ ID NO: 46795 - DNA, 20 bp, synthetic construct
  misc_feature 1..20: note = CRISPR gRNA sequence
  source 1..20: mol_type = other DNA
cccagcacctgaagagccag

SEQ ID NO: 46796 - DNA, 20 bp, synthetic construct
  misc_feature 1..20: note = CRISPR gRNA sequence
  source 1..20: mol_type = other DNA
cacctgaagagccaggagcc

SEQ ID NO: 46797 - DNA, 20 bp, synthetic construct
  misc_feature 1..20: note = CRISPR gRNA sequence
  source 1..20: mol_type = other DNA
acctgaagagccaggagccc

SEQ ID NO: 46798 - DNA, 20 bp, synthetic construct
  misc_feature 1..20: note = CRISPR gRNA sequence
  source 1..20: mol_type = other DNA
gaagagccaggagcccaggc

SEQ ID NO: 46799 - DNA, 20 bp, synthetic construct
  misc_feature 1..20: note = CRISPR gRNA sequence
  source 1..20: mol_type = other DNA
actttgccttctttgacaac

SEQ ID NO: 46800 - DNA, 20 bp, synthetic construct
  misc_feature 1..20: note = CRISPR gRNA sequence
  source 1..20: mol_type = other DNA
ccttctttgacaaccagccc

SEQ ID NO: 46801 - DNA, 20 bp, synthetic construct
  misc_feature 1..20: note = CRISPR gRNA sequence
  source 1..20: mol_type = other DNA
cttctttgacaaccagcccc

SEQ ID NO: 46802 - DNA, 20 bp, synthetic construct
  misc_feature 1..20: note = CRISPR gRNA sequence
  source 1..20: mol_type = other DNA
acaaccagccccaggcccct

SEQ ID NO: 46803 - DNA, 20 bp, synthetic construct
  misc_feature 1..20: note = CRISPR gRNA sequence
  source 1..20: mol_type = other DNA
caaccagccccaggcccctt

SEQ ID NO: 46804 - DNA, 20 bp, synthetic construct
  misc_feature 1..20: note = CRISPR gRNA sequence
  source 1..20: mol_type = other DNA
aaccagccccaggccccttg

SEQ ID NO: 46805 - DNA, 20 bp, synthetic construct
  misc_feature 1..20: note = CRISPR gRNA sequence
  source 1..20: mol_type = other DNA
aggccccttggggtacttga

SEQ ID NO: 46806 - DNA, 20 bp, synthetic construct
  misc_feature 1..20: note = CRISPR gRNA sequence
  source 1..20: mol_type = other DNA
gggtacttgatggccccctc

SEQ ID NO: 46807 - DNA, 20 bp, synthetic construct
  misc_feature 1..20: note = CRISPR gRNA sequence
  source 1..20: mol_type = other DNA
gatggccccctcaagacctt

SEQ ID NO: 46808 - DNA, 20 bp, synthetic construct
  misc_feature 1..20: note = CRISPR gRNA sequence
  source 1..20: mol_type = other DNA
ccctcaagacctttggaatc

SEQ ID NO: 46809 - DNA, 20 bp, synthetic construct
  misc_feature 1..20: note = CRISPR gRNA sequence
  source 1..20: mol_type = other DNA
aagacctttggaatccagcc

SEQ ID NO: 46810 - DNA, 20 bp, synthetic construct
  misc_feature 1..20: note = CRISPR gRNA sequence
  source 1..20: mol_type = other DNA
atgatccacctttcgcccac

SEQ ID NO: 46811 - DNA, 20 bp, synthetic construct
  misc_feature 1..20: note = CRISPR gRNA sequence
  source 1..20: mol_type = other DNA
tgatccacctttcgcccact

SEQ ID NO: 46812 - DNA, 20 bp, synthetic construct
  misc_feature 1..20: note = CRISPR gRNA sequence
  source 1..20: mol_type = other DNA
gcccactgggataattgact

SEQ ID NO: 46813 - DNA, 20 bp, synthetic construct
  misc_feature 1..20: note = CRISPR gRNA sequence
  source 1..20: mol_type = other DNA
cccactgggataattgactc

SEQ ID NO: 46814 - DNA, 20 bp, synthetic construct
  misc_feature 1..20: note = CRISPR gRNA sequence
  source 1..20: mol_type = other DNA
ctgggataattgactcagga

SEQ ID NO: 46815 - DNA, 20 bp, synthetic construct
  misc_feature 1..20: note = CRISPR gRNA sequence
  source 1..20: mol_type = other DNA
ggataattgactcaggaaag

SEQ ID NO: 46816 - DNA, 20 bp, synthetic construct
  misc_feature 1..20: note = CRISPR gRNA sequence
  source 1..20: mol_type = other DNA
ataattgactcaggaaagaa

SEQ ID NO: 46817 - DNA, 20 bp, synthetic construct
  misc_feature 1..20: note = CRISPR gRNA sequence
  source 1..20: mol_type = other DNA
gactcaggaaagaagagcct

SEQ ID NO: 46818 - DNA, 20 bp, synthetic construct
  misc_feature 1..20: note = CRISPR gRNA sequence
  source 1..20: mol_type = other DNA
tcaggaaagaagagcctcgg

SEQ ID NO: 46819 - DNA, 20 bp, synthetic construct
  misc_feature 1..20: note = CRISPR gRNA sequence
  source 1..20: mol_type = other DNA
caggaaagaagagcctcggc

SEQ ID NO: 46820 - DNA, 20 bp, synthetic construct
  misc_feature 1..20: note = CRISPR gRNA sequence
  source 1..20: mol_type = other DNA
aggaaagaagagcctcggca

SEQ ID NO: 46821 - DNA, 20 bp, synthetic construct
  misc_feature 1..20: note = CRISPR gRNA sequence
  source 1..20: mol_type = other DNA
agggcgctctgcactccacc

SEQ ID NO: 46822 - DNA, 20 bp, synthetic construct
  misc_feature 1..20: note = CRISPR gRNA sequence
  source 1..20: mol_type = other DNA
gggcgctctgcactccaccc

SEQ ID NO: 46823 - DNA, 20 bp, synthetic construct
  misc_feature 1..20: note = CRISPR gRNA sequence
  source 1..20: mol_type = other DNA
gcgctctgcactccacccag

SEQ ID NO: 46824 - DNA, 20 bp, synthetic construct
  misc_feature 1..20: note = CRISPR gRNA sequence
  source 1..20: mol_type = other DNA
cgctctgcactccacccagg

SEQ ID NO: 46825 - DNA, 20 bp, synthetic construct
  misc_feature 1..20: note = CRISPR gRNA sequence
  source 1..20: mol_type = other DNA
tctgcactccacccaggagg

SEQ ID NO: 46826 - DNA, 20 bp, synthetic construct
  misc_feature 1..20: note = CRISPR gRNA sequence
  source 1..20: mol_type = other DNA
ctgcactccacccaggagga

SEQ ID NO: 46827 - DNA, 20 bp, synthetic construct
  misc_feature 1..20: note = CRISPR gRNA sequence
  source 1..20: mol_type = other DNA
aggatacgtgtgtcctgctg

SEQ ID NO: 46828 - DNA, 20 bp, synthetic construct
  misc_feature 1..20: note = CRISPR gRNA sequence
  source 1..20: mol_type = other DNA
gtgtgtcctgctgcagtcct

SEQ ID NO: 46829 - DNA, 20 bp, synthetic construct
  misc_feature 1..20: note = CRISPR gRNA sequence
  source 1..20: mol_type = other DNA
tgtgtcctgctgcagtcctc

SEQ ID NO: 46830 - DNA, 20 bp, synthetic construct
  misc_feature 1..20: note = CRISPR gRNA sequence
  source 1..20: mol_type = other DNA
gtgtcctgctgcagtcctca

SEQ ID NO: 46831 - DNA, 20 bp, synthetic construct
  misc_feature 1..20: note = CRISPR gRNA sequence
  source 1..20: mol_type = other DNA
gtcctgctgcagtcctcagg

SEQ ID NO: 46832 - DNA, 20 bp, synthetic construct
  misc_feature 1..20: note = CRISPR gRNA sequence
  source 1..20: mol_type = other DNA
gtcctcagggagaacttttt

SEQ ID NO: 46833 - DNA, 20 bp, synthetic construct
  misc_feature 1..20: note = CRISPR gRNA sequence
  source 1..20: mol_type = other DNA
tcctcagggagaactttttt

SEQ ID NO: 46834 - DNA, 20 bp, synthetic construct
  misc_feature 1..20: note = CRISPR gRNA sequence
  source 1..20: mol_type = other DNA
gggagaacttttttgggaac

SEQ ID NO: 46835 - DNA, 20 bp, synthetic construct
  misc_feature 1..20: note = CRISPR gRNA sequence
  source 1..20: mol_type = other DNA
ggagaacttttttgggaacc

SEQ ID NO: 46836 - DNA, 20 bp, synthetic construct
  misc_feature 1..20: note = CRISPR gRNA sequence
  source 1..20: mol_type = other DNA
agaacttttttgggaaccag

SEQ ID NO: 46837 - DNA, 20 bp, synthetic construct
  misc_feature 1..20: note = CRISPR gRNA sequence
  source 1..20: mol_type = other DNA
cttttttgggaaccaggagc

SEQ ID NO: 46838 - DNA, 20 bp, synthetic construct
  misc_feature 1..20: note = CRISPR gRNA sequence
  source 1..20: mol_type = other DNA
ttttttgggaaccaggagct

SEQ ID NO: 46839 - DNA, 20 bp, synthetic construct
  misc_feature 1..20: note = CRISPR gRNA sequence
  source 1..20: mol_type = other DNA
tgggaaccaggagctgggtc

SEQ ID NO: 46840 - DNA, 20 bp, synthetic construct
  misc_feature 1..20: note = CRISPR gRNA sequence
  source 1..20: mol_type = other DNA
ccaggagctgggtctggaca

SEQ ID NO: 46841 - DNA, 20 bp, synthetic construct
  misc_feature 1..20: note = CRISPR gRNA sequence
  source 1..20: mol_type = other DNA
caggagctgggtctggacaa

SEQ ID NO: 46842 - DNA, 20 bp, synthetic construct
  misc_feature 1..20: note = CRISPR gRNA sequence
  source 1..20: mol_type = other DNA
ggagctgggtctggacaaag

SEQ ID NO: 46843 - DNA, 20 bp, synthetic construct
  misc_feature 1..20: note = CRISPR gRNA sequence
  source 1..20: mol_type = other DNA
aaggagtaccctgcattacg

SEQ ID NO: 46844 - DNA, 20 bp, synthetic construct
  misc_feature 1..20: note = CRISPR gRNA sequence
  source 1..20: mol_type = other DNA
aggagtaccctgcattacgt

SEQ ID NO: 46845 - DNA, 20 bp, synthetic construct
  misc_feature 1..20: note = CRISPR gRNA sequence
  source 1..20: mol_type = other DNA
gtgggatatgtgtgatcaat

SEQ ID NO: 46846 - DNA, 20 bp, synthetic construct
  misc_feature 1..20: note = CRISPR gRNA sequence
  source 1..20: mol_type = other DNA
tgggatatgtgtgatcaatt

SEQ ID NO: 46847 - DNA, 20 bp, synthetic construct
  misc_feature 1..20: note = CRISPR gRNA sequence
  source 1..20: mol_type = other DNA
gggatatgtgtgatcaattg

SEQ ID NO: 46848 - DNA, 20 bp, synthetic construct
  misc_feature 1..20: note = CRISPR gRNA sequence
  source 1..20: mol_type = other DNA
ggggacatgcgacacacaat

SEQ ID NO: 46849 - DNA, 20 bp, synthetic construct
  misc_feature 1..20: note = CRISPR gRNA sequence
  source 1..20: mol_type = other DNA
gggacatgcgacacacaatg

SEQ ID NO: 46850 - DNA, 20 bp, synthetic construct
  misc_feature 1..20: note = CRISPR gRNA sequence
  source 1..20: mol_type = other DNA
ggacatgcgacacacaatga

SEQ ID NO: 46851 - DNA, 20 bp, synthetic construct
  misc_feature 1..20: note = CRISPR gRNA sequence
  source 1..20: mol_type = other DNA
atgacaatgcatgacacgta

SEQ ID NO: 46852 - DNA, 20 bp, synthetic construct
  misc_feature 1..20: note = CRISPR gRNA sequence
  source 1..20: mol_type = other DNA
atgacacgtacggttatatg

SEQ ID NO: 46853 - DNA, 20 bp, synthetic construct
  misc_feature 1..20: note = CRISPR gRNA sequence
  source 1..20: mol_type = other DNA
acacgtacggttatatgtgg

SEQ ID NO: 46854 - DNA, 20 bp, synthetic construct
  misc_feature 1..20: note = CRISPR gRNA sequence
  source 1..20: mol_type = other DNA
cagtgtgaccccttgacatg

SEQ ID NO: 46855 - DNA, 20 bp, synthetic construct
  misc_feature 1..20: note = CRISPR gRNA sequence
  source 1..20: mol_type = other DNA
tgacatgtggcgttacatga

SEQ ID NO: 46856 - DNA, 20 bp, synthetic construct
  misc_feature 1..20: note = CRISPR gRNA sequence
  source 1..20: mol_type = other DNA
atgtggcgttacatgaaagt

SEQ ID NO: 46857 - DNA, 20 bp, synthetic construct
  misc_feature 1..20: note = CRISPR gRNA sequence
  source 1..20: mol_type = other DNA
gcgttacatgaaagtcagtg

SEQ ID NO: 46858 - DNA, 20 bp, synthetic construct
  misc_feature 1..20: note = CRISPR gRNA sequence
  source 1..20: mol_type = other DNA
tcagtgtggcacgtgttctg

SEQ ID NO: 46859 - DNA, 20 bp, synthetic construct
  misc_feature 1..20: note = CRISPR gRNA sequence
  source 1..20: mol_type = other DNA
gtggcacgtgttctgtggca

SEQ ID NO: 46860 - DNA, 20 bp, synthetic construct
  misc_feature 1..20: note = CRISPR gRNA sequence
  source 1..20: mol_type = other DNA
tggcacgtgttctgtggcat

SEQ ID NO: 46861 - DNA, 20 bp, synthetic construct
  misc_feature 1..20: note = CRISPR gRNA sequence
  source 1..20: mol_type = other DNA
gtgttctgtggcatgggtgc

SEQ ID NO: 46862 - DNA, 20 bp, synthetic construct
  misc_feature 1..20: note = CRISPR gRNA sequence
  source 1..20: mol_type = other DNA
ggcatgggtgctggcatccc

SEQ ID NO: 46863 - DNA, 20 bp, synthetic construct
  misc_feature 1..20: note = CRISPR gRNA sequence
  source 1..20: mol_type = other DNA
atgggtgctggcatcccaag

SEQ ID NO: 46864 - DNA, 20 bp, synthetic construct
  misc_feature 1..20: note = CRISPR gRNA sequence
  source 1..20: mol_type = other DNA
ggtgctggcatcccaagtag

SEQ ID NO: 46865 - DNA, 20 bp, synthetic construct
  misc_feature 1..20: note = CRISPR gRNA sequence
  source 1..20: mol_type = other DNA
gtgctggcatcccaagtagc

SEQ ID NO: 46866 - DNA, 20 bp, synthetic construct
  misc_feature 1..20: note = CRISPR gRNA sequence
  source 1..20: mol_type = other DNA
gtagcaggatacatgattgt

SEQ ID NO: 46867 - DNA, 20 bp, synthetic construct
  misc_feature 1..20: note = CRISPR gRNA sequence
  source 1..20: mol_type = other DNA
catgacaaatgtccatgtca

SEQ ID NO: 46868 - DNA, 20 bp, synthetic construct
  misc_feature 1..20: note = CRISPR gRNA sequence
  source 1..20: mol_type = other DNA
atgacaaatgtccatgtcac

SEQ ID NO: 46869 - DNA, 20 bp, synthetic construct
  misc_feature 1..20: note = CRISPR gRNA sequence
  source 1..20: mol_type = other DNA
tgtccatgtcacaggactca

SEQ ID NO: 46870 - DNA, 20 bp, synthetic construct
  misc_feature 1..20: note = CRISPR gRNA sequence
  source 1..20: mol_type = other DNA
catgtcacaggactcatggc

SEQ ID NO: 46871 - DNA, 20 bp, synthetic construct
  misc_feature 1..20: note = CRISPR gRNA sequence
  source 1..20: mol_type = other DNA
tcacaggactcatggctggc

SEQ ID NO: 46872 - DNA, 20 bp, synthetic construct
  misc_feature 1..20: note = CRISPR gRNA sequence
  source 1..20: mol_type = other DNA
catggctggccagatgacct

SEQ ID NO: 46873 - DNA, 20 bp, synthetic construct
  misc_feature 1..20: note = CRISPR gRNA sequence
  source 1..20: mol_type = other DNA
atggctggccagatgacctc

SEQ ID NO: 46874 - DNA, 20 bp, synthetic construct
  misc_feature 1..20: note = CRISPR gRNA sequence
  source 1..20: mol_type = other DNA
ctggccagatgacctcaggc

SEQ ID NO: 46875 - DNA, 20 bp, synthetic construct
  misc_feature 1..20: note = CRISPR gRNA sequence
  source 1..20: mol_type = other DNA
agatgacctcaggctggccc

SEQ ID NO: 46876 - DNA, 20 bp, synthetic construct
  misc_feature 1..20: note = CRISPR gRNA sequence
  source 1..20: mol_type = other DNA
atctaatttattaattttta

SEQ ID NO: 46877 - DNA, 20 bp, synthetic construct
  misc_feature 1..20: note = CRISPR gRNA sequence
  source 1..20: mol_type = other DNA
ttaaagcaaatacatattta

SEQ ID NO: 46878 - DNA, 20 bp, synthetic construct
  misc_feature 1..20: note = CRISPR gRNA sequence
  source 1..20: mol_type = other DNA
atatttatagattgtgtgta

SEQ ID NO: 46879 - DNA, 20 bp, synthetic construct
  misc_feature 1..20: note = CRISPR gRNA sequence
  source 1..20: mol_type = other DNA
atttatagattgtgtgtatg

SEQ ID NO: 46880 - DNA, 20 bp, synthetic construct
  misc_feature 1..20: note = CRISPR gRNA sequence
  source 1..20: mol_type = other DNA
tatagattgtgtgtatggag

SEQ ID NO: 46881 - DNA, 20 bp, synthetic construct
  misc_feature 1..20: note = CRISPR gRNA sequence
  source 1..20: mol_type = other DNA
attgtgtgtatggagcagct

SEQ ID NO: 46882 - DNA, 20 bp, synthetic construct
  misc_feature 1..20: note = CRISPR gRNA sequence
  source 1..20: mol_type = other DNA
tgtgtatggagcagctaagt

SEQ ID NO: 46883 - DNA, 20 bp, synthetic construct
  misc_feature 1..20: note = CRISPR gRNA sequence
  source 1..20: mol_type = other DNA
gtgtatggagcagctaagtc

SEQ ID NO: 46884 - DNA, 20 bp, synthetic construct
  misc_feature 1..20: note = CRISPR gRNA sequence
  source 1..20: mol_type = other DNA
tggagcagctaagtcaggaa

SEQ ID NO: 46885 - DNA, 20 bp, synthetic construct
  misc_feature 1..20: note = CRISPR gRNA sequence
  source 1..20: mol_type = other DNA
tcaggaaaagtcttccgccc

SEQ ID NO: 46886 - DNA, 20 bp, synthetic construct
  misc_feature 1..20: note = CRISPR gRNA sequence
  source 1..20: mol_type = other DNA
gaaaagtcttccgcccgagc

SEQ ID NO: 46887 - DNA, 20 bp, synthetic construct
  misc_feature 1..20: note = CRISPR gRNA sequence
  source 1..20: mol_type = other DNA
aaaagtcttccgcccgagct

SEQ ID NO: 46888 - DNA, 20 bp, synthetic construct
  misc_feature 1..20: note = CRISPR gRNA sequence
  source 1..20: mol_type = other DNA
aagtcttccgcccgagctgg

SEQ ID NO: 46889 - DNA, 20 bp, synthetic construct
  misc_feature 1..20: note = CRISPR gRNA sequence
  source 1..20: mol_type = other DNA
agtcttccgcccgagctggg

SEQ ID NO: 46890 - DNA, 20 bp, synthetic construct
  misc_feature 1..20: note = CRISPR gRNA sequence
  source 1..20: mol_type = other DNA
gtcttccgcccgagctggga

SEQ ID NO: 46891 - DNA, 20 bp, synthetic construct
  misc_feature 1..20: note = CRISPR gRNA sequence
  source 1..20: mol_type = other DNA
tcttccgcccgagctgggag

SEQ ID NO: 46892 - DNA, 20 bp, synthetic construct
  misc_feature 1..20: note = CRISPR gRNA sequence
  source 1..20: mol_type = other DNA
ttccgcccgagctgggaggg

SEQ ID NO: 46893 - DNA, 20 bp, synthetic construct
  misc_feature 1..20: note = CRISPR gRNA sequence
  source 1..20: mol_type = other DNA
ccgcccgagctgggagggga

SEQ ID NO: 46894 - DNA, 20 bp, synthetic construct
  misc_feature 1..20: note = CRISPR gRNA sequence
  source 1..20: mol_type = other DNA
gagagtgtccatgcactgac

SEQ ID NO: 46895 - DNA, 20 bp, synthetic construct
  misc_feature 1..20: note = CRISPR gRNA sequence
  source 1..20: mol_type = other DNA
tgtccatgcactgaccagtc

SEQ ID NO: 46896 - DNA, 20 bp, synthetic construct
  misc_feature 1..20: note = CRISPR gRNA sequence
  source 1..20: mol_type = other DNA
gtccatgcactgaccagtcc

SEQ ID NO: 46897 - DNA, 20 bp, synthetic construct
  misc_feature 1..20: note = CRISPR gRNA sequence
  source 1..20: mol_type = other DNA
tccatgcactgaccagtcca

SEQ ID NO: 46898 - DNA, 20 bp, synthetic construct
  misc_feature 1..20: note = CRISPR gRNA sequence
  source 1..20: mol_type = other DNA
ccatgcactgaccagtccag

SEQ ID NO: 46899 - DNA, 20 bp, synthetic construct
  misc_feature 1..20: note = CRISPR gRNA sequence
  source 1..20: mol_type = other DNA
actgaccagtccaggggctc

SEQ ID NO: 46900 - DNA, 20 bp, synthetic construct
  misc_feature 1..20: note = CRISPR gRNA sequence
  source 1..20: mol_type = other DNA
ctgaccagtccaggggctca

SEQ ID NO: 46901 - DNA, 20 bp, synthetic construct
  misc_feature 1..20: note = CRISPR gRNA sequence
  source 1..20: mol_type = other DNA
tgaccagtccaggggctcaa

SEQ ID NO: 46902 - DNA, 20 bp, synthetic construct
  misc_feature 1..20: note = CRISPR gRNA sequence
  source 1..20: mol_type = other DNA
cagtccaggggctcaagggc

SEQ ID NO: 46903 - DNA, 20 bp, synthetic construct
  misc_feature 1..20: note = CRISPR gRNA sequence
  source 1..20: mol_type = other DNA
agtccaggggctcaagggcc

SEQ ID NO: 46904 - DNA, 20 bp, synthetic construct
  misc_feature 1..20: note = CRISPR gRNA sequence
  source 1..20: mol_type = other DNA
gtccaggggctcaagggcca

SEQ ID NO: 46905 - DNA, 20 bp, synthetic construct
  misc_feature 1..20: note = CRISPR gRNA sequence
  source 1..20: mol_type = other DNA
gggctcaagggccagggctc

SEQ ID NO: 46906 - DNA, 20 bp, synthetic construct
  misc_feature 1..20: note = CRISPR gRNA sequence
  source 1..20: mol_type = other DNA
aagggccagggctctggaac

SEQ ID NO: 46907 - DNA, 20 bp, synthetic construct
  misc_feature 1..20: note = CRISPR gRNA sequence
  source 1..20: mol_type = other DNA
gccagggctctggaacaagc

SEQ ID NO: 46908 - DNA, 20 bp, synthetic construct
  misc_feature 1..20: note = CRISPR gRNA sequence
  source 1..20: mol_type = other DNA
ccagggctctggaacaagcc

SEQ ID NO: 46909 - DNA, 20 bp, synthetic construct
  misc_feature 1..20: note = CRISPR gRNA sequence
  source 1..20: mol_type = other DNA
cagggctctggaacaagcca

SEQ ID NO: 46910 - DNA, 20 bp, synthetic construct
  misc_feature 1..20: note = CRISPR gRNA sequence
  source 1..20: mol_type = other DNA
tctggaacaagccagggact

SEQ ID NO: 46911 - DNA, 20 bp, synthetic construct
  misc_feature 1..20: note = CRISPR gRNA sequence
  source 1..20: mol_type = other DNA
aagccagggactcagccatt

SEQ ID NO: 46912 - DNA, 20 bp, synthetic construct
  misc_feature 1..20: note = CRISPR gRNA sequence
  source 1..20: mol_type = other DNA
tcccctcctgcctcaatcct

SEQ ID NO: 46913 - DNA, 20 bp, synthetic construct
  misc_feature 1..20: note = CRISPR gRNA sequence
  source 1..20: mol_type = other DNA
ctcctcccttacttacatac

SEQ ID NO: 46914 - DNA, 20 bp, synthetic construct
  misc_feature 1..20: note = CRISPR gRNA sequence
  source 1..20: mol_type = other DNA
ttacttacatactagcttcc

SEQ ID NO: 46915 - DNA, 20 bp, synthetic construct
  misc_feature 1..20: note = CRISPR gRNA sequence
  source 1..20: mol_type = other DNA
tacttacatactagcttcca

SEQ ID NO: 46916 - DNA, 20 bp, synthetic construct
  misc_feature 1..20: note = CRISPR gRNA sequence
  source 1..20: mol_type = other DNA
tacatactagcttccaagga

SEQ ID NO: 46917 - DNA, 20 bp, synthetic construct
  misc_feature 1..20: note = CRISPR gRNA sequence
  source 1..20: mol_type = other DNA
acatactagcttccaaggac

SEQ ID NO: 46918 - DNA, 20 bp, synthetic construct
  misc_feature 1..20: note = CRISPR gRNA sequence
  source 1..20: mol_type = other DNA
tactagcttccaaggacagg

SEQ ID NO: 46919 - DNA, 20 bp, synthetic construct
  misc_feature 1..20: note = CRISPR gRNA sequence
  source 1..20: mol_type = other DNA
ctagcttccaaggacaggtg

SEQ ID NO: 46920 - DNA, 20 bp, synthetic construct
  misc_feature 1..20: note = CRISPR gRNA sequence
  source 1..20: mol_type = other DNA
tagcttccaaggacaggtgg

SEQ ID NO: 46921 - DNA, 20 bp, synthetic construct
  misc_feature 1..20: note = CRISPR gRNA sequence
  source 1..20: mol_type = other DNA
cttccaaggacaggtggagg

SEQ ID NO: 46922 - DNA, 20 bp, synthetic construct
  misc_feature 1..20: note = CRISPR gRNA sequence
  source 1..20: mol_type = other DNA
ttccaaggacaggtggaggt

SEQ ID NO: 46923 - DNA, 20 bp, synthetic construct
  misc_feature 1..20: note = CRISPR gRNA sequence
  source 1..20: mol_type = other DNA
tccaaggacaggtggaggta

SEQ ID NO: 46924 - DNA, 20 bp, synthetic construct
  misc_feature 1..20: note = CRISPR gRNA sequence
  source 1..20: mol_type = other DNA
aggacaggtggaggtagggc

SEQ ID NO: 46925 - DNA, 20 bp, synthetic construct
  misc_feature 1..20: note = CRISPR gRNA sequence
  source 1..20: mol_type = other DNA
aggtggaggtagggccagcc

SEQ ID NO: 46926 - DNA, 20 bp, synthetic construct
  misc_feature 1..20: note = CRISPR gRNA sequence
  source 1..20: mol_type = other DNA
tggaggtagggccagcctgg

SEQ ID NO: 46927 - DNA, 20 bp, synthetic construct
  misc_feature 1..20: note = CRISPR gRNA sequence
  source 1..20: mol_type = other DNA
ggaggtagggccagcctggc

SEQ ID NO: 46928 - DNA, 20 bp, synthetic construct
  misc_feature 1..20: note = CRISPR gRNA sequence
  source 1..20: mol_type = other DNA
aggtagggccagcctggcgg

SEQ ID NO: 46929 - DNA, 20 bp, synthetic construct
  misc_feature 1..20: note = CRISPR gRNA sequence
  source 1..20: mol_type = other DNA
tagggccagcctggcgggag

SEQ ID NO: 46930 - DNA, 20 bp, synthetic construct
  misc_feature 1..20: note = CRISPR gRNA sequence
  source 1..20: mol_type = other DNA
gggccagcctggcgggagtg

SEQ ID NO: 46931 - DNA, 20 bp, synthetic construct
  misc_feature 1..20: note = CRISPR gRNA sequence
  source 1..20: mol_type = other DNA
ccagcctggcgggagtggag

SEQ ID NO: 46932 - DNA, 20 bp, synthetic construct
  misc_feature 1..20: note = CRISPR gRNA sequence
  source 1..20: mol_type = other DNA
ctggcgggagtggagaagcc

SEQ ID NO: 46933 - DNA, 20 bp, synthetic construct
  misc_feature 1..20: note = CRISPR gRNA sequence
  source 1..20: mol_type = other DNA
aagcccagtctgtcctatgt

SEQ ID NO: 46934 - DNA, 20 bp, synthetic construct
  misc_feature 1..20: note = CRISPR gRNA sequence
  source 1..20: mol_type = other DNA
agcccagtctgtcctatgta

SEQ ID NO: 46935 - DNA, 20 bp, synthetic construct
  misc_feature 1..20: note = CRISPR gRNA sequence
  source 1..20: mol_type = other DNA
gcccagtctgtcctatgtaa

SEQ ID NO: 46936 - DNA, 20 bp, synthetic construct
  misc_feature 1..20: note = CRISPR gRNA sequence
  source 1..20: mol_type = other DNA
tctgtcctatgtaagggaca

SEQ ID NO: 46937 - DNA, 20 bp, synthetic construct
  misc_feature 1..20: note = CRISPR gRNA sequence
  source 1..20: mol_type = other DNA
tcctatgtaagggacaaagc

SEQ ID NO: 46938 - DNA, 20 bp, synthetic construct
  misc_feature 1..20: note = CRISPR gRNA sequence
  source 1..20: mol_type = other DNA
cctatgtaagggacaaagcc

SEQ ID NO: 46939 - DNA, 20 bp, synthetic construct
  misc_feature 1..20: note = CRISPR gRNA sequence
  source 1..20: mol_type = other DNA
agggacaaagccaggtctaa

SEQ ID NO: 46940 - DNA, 20 bp, synthetic construct
  misc_feature 1..20: note = CRISPR gRNA sequence
  source 1..20: mol_type = other DNA
aaagccaggtctaatggtac

SEQ ID NO: 46941 - DNA, 20 bp, synthetic construct
  misc_feature 1..20: note = CRISPR gRNA sequence
  source 1..20: mol_type = other DNA
aagccaggtctaatggtact

SEQ ID NO: 46942 - DNA, 20 bp, synthetic construct
  misc_feature 1..20: note = CRISPR gRNA sequence
  source 1..20: mol_type = other DNA
ccaggtctaatggtactggg

SEQ ID NO: 46943 - DNA, 20 bp, synthetic construct
  misc_feature 1..20: note = CRISPR gRNA sequence
  source 1..20: mol_type = other DNA
caggtctaatggtactgggt

SEQ ID NO: 46944 - DNA, 20 bp, synthetic construct
  misc_feature 1..20: note = CRISPR gRNA sequence
  source 1..20: mol_type = other DNA
aggtctaatggtactgggta

SEQ ID NO: 46945 - DNA, 20 bp, synthetic construct
  misc_feature 1..20: note = CRISPR gRNA sequence
  source 1..20: mol_type = other DNA
ggtctaatggtactgggtag

SEQ ID NO: 46946 - DNA, 20 bp, synthetic construct
  misc_feature 1..20: note = CRISPR gRNA sequence
  source 1..20: mol_type = other DNA
gtctaatggtactgggtagg

SEQ ID NO: 46947 - DNA, 20 bp, synthetic construct
  misc_feature 1..20: note = CRISPR gRNA sequence
  source 1..20: mol_type = other DNA
actgggtagggggcactgcc

SEQ ID NO: 46948 - DNA, 20 bp, synthetic construct
  misc_feature 1..20: note = CRISPR gRNA sequence
  source 1..20: mol_type = other DNA
gggggcactgccaagacaat

SEQ ID NO: 46949 - DNA, 20 bp, synthetic construct
  misc_feature 1..20: note = CRISPR gRNA sequence
  source 1..20: mol_type = other DNA
gcactgccaagacaataagc

SEQ ID NO: 46950 - DNA, 20 bp, synthetic construct
  misc_feature 1..20: note = CRISPR gRNA sequence
  source 1..20: mol_type = other DNA
cactgccaagacaataagct

SEQ ID NO: 46951 - DNA, 20 bp, synthetic construct
  misc_feature 1..20: note = CRISPR gRNA sequence
  source 1..20: mol_type = other DNA
aagacaataagctaggctac

SEQ ID NO: 46952 - DNA, 20 bp, synthetic construct
  misc_feature 1..20: note = CRISPR gRNA sequence
  source 1..20: mol_type = other DNA
agacaataagctaggctact

SEQ ID NO: 46953 - DNA, 20 bp, synthetic construct
  misc_feature 1..20: note = CRISPR gRNA sequence
  source 1..20: mol_type = other DNA
ataagctaggctactgggtc

SEQ ID NO: 46954 - DNA, 20 bp, synthetic construct
  misc_feature 1..20: note = CRISPR gRNA sequence
  source 1..20: mol_type = other DNA
actgggtccagctactactt

SEQ ID NO: 46955 - DNA, 20 bp, synthetic construct
  misc_feature 1..20: note = CRISPR gRNA sequence
  source 1..20: mol_type = other DNA
gggtccagctactactttgg

SEQ ID NO: 46956 - DNA, 20 bp, synthetic construct
  misc_feature 1..20: note = CRISPR gRNA sequence
  source 1..20: mol_type = other DNA
ggtccagctactactttggt

SEQ ID NO: 46957 - DNA, 20 bp, synthetic construct
  misc_feature 1..20: note = CRISPR gRNA sequence
  source 1..20: mol_type = other DNA
gctactactttggtgggatt

SEQ ID NO: 46958 - DNA, 20 bp, synthetic construct
  misc_feature 1..20: note = CRISPR gRNA sequence
  source 1..20: mol_type = other DNA
ctactactttggtgggattc

SEQ ID NO: 46959 - DNA, 20 bp, synthetic construct
  misc_feature 1..20: note = CRISPR gRNA sequence
  source 1..20: mol_type = other DNA
tactttggtgggattcaggt

SEQ ID NO: 46960 - DNA, 20 bp, synthetic construct
  misc_feature 1..20: note = CRISPR gRNA sequence
  source 1..20: mol_type = other DNA
catgcacttcacatgttacc

SEQ ID NO: 46961 - DNA, 20 bp, synthetic construct
  misc_feature 1..20: note = CRISPR gRNA sequence
  source 1..20: mol_type = other DNA
ccagtgttcttgttacttcc

SEQ ID NO: 46962 - DNA, 20 bp, synthetic construct
  misc_feature 1..20: note = CRISPR gRNA sequence
  source 1..20: mol_type = other DNA
cagtgttcttgttacttcca

SEQ ID NO: 46963 - DNA, 20 bp, synthetic construct
  misc_feature 1..20: note = CRISPR gRNA sequence
  source 1..20: mol_type = other DNA
gtgttcttgttacttccaag

SEQ ID NO: 46964 - DNA, 20 bp, synthetic construct
  misc_feature 1..20: note = CRISPR gRNA sequence
  source 1..20: mol_type = other DNA
tgttacttccaaggagaacc

SEQ ID NO: 46965 - DNA, 20 bp, synthetic construct
  misc_feature 1..20: note = CRISPR gRNA sequence
  source 1..20: mol_type = other DNA
cttccaaggagaaccaagaa

SEQ ID NO: 46966 - DNA, 20 bp, synthetic construct
  misc_feature 1..20: note = CRISPR gRNA sequence
  source 1..20: mol_type = other DNA
gaatggctctgtcacactcg

SEQ ID NO: 46967 - DNA, 20 bp, synthetic construct
  misc_feature 1..20: note = CRISPR gRNA sequence
  source 1..20: mol_type = other DNA
ggctctgtcacactcgaagc

SEQ ID NO: 46968 - DNA, 20 bp, synthetic construct
  misc_feature 1..20: note = CRISPR gRNA sequence
  source 1..20: mol_type = other DNA
gctctgtcacactcgaagcc

SEQ ID NO: 46969 - DNA, 20 bp, synthetic construct
  misc_feature 1..20: note = CRISPR gRNA sequence
  source 1..20: mol_type = other DNA
ggcttgatcaataaacacaa

SEQ ID NO: 46970 - DNA, 20 bp, synthetic construct
  misc_feature 1..20: note = CRISPR gRNA sequence
  source 1..20: mol_type = other DNA
acacaatggtattccacgtc

SEQ ID NO: 46971 - DNA, 20 bp, synthetic construct
  misc_feature 1..20: note = CRISPR gRNA sequence
  source 1..20: mol_type = other DNA
tgtttcctcttaccccactg

SEQ ID NO: 46972 - DNA, 20 bp, synthetic construct
  misc_feature 1..20: note = CRISPR gRNA sequence
  source 1..20: mol_type = other DNA
tcctcttaccccactgaagt

SEQ ID NO: 46973 - DNA, 20 bp, synthetic construct
  misc_feature 1..20: note = CRISPR gRNA sequence
  source 1..20: mol_type = other DNA
ctcttaccccactgaagtca

SEQ ID NO: 46974 - DNA, 20 bp, synthetic construct
  misc_feature 1..20: note = CRISPR gRNA sequence
  source 1..20: mol_type = other DNA
tcttaccccactgaagtcag

SEQ ID NO: 46975 - DNA, 20 bp, synthetic construct
  misc_feature 1..20: note = CRISPR gRNA sequence
  source 1..20: mol_type = other DNA
taccccactgaagtcagagg

SEQ ID NO: 46976 - DNA, 20 bp, synthetic construct
  misc_feature 1..20: note = CRISPR gRNA sequence
  source 1..20: mol_type = other DNA
ggtggttcaccccctgccgt

SEQ ID NO: 46977 - DNA, 20 bp, synthetic construct
  misc_feature 1..20: note = CRISPR gRNA sequence
  source 1..20: mol_type = other DNA
gtggttcaccccctgccgta

SEQ ID NO: 46978 - DNA, 20 bp, synthetic construct
  misc_feature 1..20: note = CRISPR gRNA sequence
  source 1..20: mol_type = other DNA
tcaccccctgccgtaaggac

SEQ ID NO: 46979 - DNA, 20 bp, synthetic construct
  misc_feature 1..20: note = CRISPR gRNA sequence
  source 1..20: mol_type = other DNA
cccctgccgtaaggactgga

SEQ ID NO: 46980 - DNA, 20 bp, synthetic construct
  misc_feature 1..20: note = CRISPR gRNA sequence
  source 1..20: mol_type = other DNA
ctgccgtaaggactggacag

SEQ ID NO: 46981 - DNA, 20 bp, synthetic construct
  misc_feature 1..20: note = CRISPR gRNA sequence
  source 1..20: mol_type = other DNA
ctggacagcagcgcaaacaa

SEQ ID NO: 46982 - DNA, 20 bp, synthetic construct
  misc_feature 1..20: note = CRISPR gRNA sequence
  source 1..20: mol_type = other DNA
ggacagcagcgcaaacaaca

SEQ ID NO: 46983 - DNA, 20 bp, synthetic construct
  misc_feature 1..20: note = CRISPR gRNA sequence
  source 1..20: mol_type = other DNA
acagcagcgcaaacaacaga

SEQ ID NO: 46984 - DNA, 20 bp, synthetic construct
  misc_feature 1..20: note = CRISPR gRNA sequence
  source 1..20: mol_type = other DNA
cagcagcgcaaacaacagag

SEQ ID NO: 46985 - DNA, 20 bp, synthetic construct
  misc_feature 1..20: note = CRISPR gRNA sequence
  source 1..20: mol_type = other DNA
ctgttgtttgcgctgctgtc

SEQ ID NO: 46986 - DNA, 20 bp, synthetic construct
  misc_feature 1..20: note = CRISPR gRNA sequence
  source 1..20: mol_type = other DNA
gcgctgctgtccagtcctta

SEQ ID NO: 46987 - DNA, 20 bp, synthetic construct
  misc_feature 1..20: note = CRISPR gRNA sequence
  source 1..20: mol_type = other DNA
ctgctgtccagtccttacgg

SEQ ID NO: 46988 - DNA, 20 bp, synthetic construct
  misc_feature 1..20: note = CRISPR gRNA sequence
  source 1..20: mol_type = other DNA
tgctgtccagtccttacggc

SEQ ID NO: 46989 - DNA, 20 bp, synthetic construct
  misc_feature 1..20: note = CRISPR gRNA sequence
  source 1..20: mol_type = other DNA
gctgtccagtccttacggca

SEQ ID NO: 46990 - DNA, 20 bp, synthetic construct
  misc_feature 1..20: note = CRISPR gRNA sequence
  source 1..20: mol_type = other DNA
ctgtccagtccttacggcag

SEQ ID NO: 46991 - DNA, 20 bp, synthetic construct
  misc_feature 1..20: note = CRISPR gRNA sequence
  source 1..20: mol_type = other DNA
tgtccagtccttacggcagg

SEQ ID NO: 46992 - DNA, 20 bp, synthetic construct
  misc_feature 1..20: note = CRISPR gRNA sequence
  source 1..20: mol_type = other DNA
gggtgaaccacctctgactt

SEQ ID NO: 46993 - DNA, 20 bp, synthetic construct
  misc_feature 1..20: note = CRISPR gRNA sequence
  source 1..20: mol_type = other DNA
tgaaccacctctgacttcag

SEQ ID NO: 46994 - DNA, 20 bp, synthetic construct
  misc_feature 1..20: note = CRISPR gRNA sequence
  source 1..20: mol_type = other DNA
gaaccacctctgacttcagt

SEQ ID NO: 46995 - DNA, 20 bp, synthetic construct
  misc_feature 1..20: note = CRISPR gRNA sequence
  source 1..20: mol_type = other DNA
aaccacctctgacttcagtg

SEQ ID NO: 46996 - DNA, 20 bp, synthetic construct
  misc_feature 1..20: note = CRISPR gRNA sequence
  source 1..20: mol_type = other DNA
acctctgacttcagtggggt

SEQ ID NO: 46997 - DNA, 20 bp, synthetic construct
  misc_feature 1..20: note = CRISPR gRNA sequence
  source 1..20: mol_type = other DNA
ctctgacttcagtggggtaa

SEQ ID NO: 46998 - DNA, 20 bp, synthetic construct
  misc_feature 1..20: note = CRISPR gRNA sequence
  source 1..20: mol_type = other DNA
tctgacttcagtggggtaag

SEQ ID NO: 46999 - DNA, 20 bp, synthetic construct
  misc_feature 1..20: note = CRISPR gRNA sequence
  source 1..20: mol_type = other DNA
agtggggtaagaggaaacat

SEQ ID NO: 47000 - DNA, 20 bp, synthetic construct
  misc_feature 1..20: note = CRISPR gRNA sequence
  source 1..20: mol_type = other DNA
aggaaacattggattcacgc

SEQ ID NO: 47001 - DNA, 20 bp, synthetic construct
  misc_feature 1..20: note = CRISPR gRNA sequence
  source 1..20: mol_type = other DNA
cattggattcacgctagacg

SEQ ID NO: 47002 - DNA, 20 bp, synthetic construct
  misc_feature 1..20: note = CRISPR gRNA sequence
  source 1..20: mol_type = other DNA
taccattgtgtttattgatc

SEQ ID NO: 47003 - DNA, 20 bp, synthetic construct
  misc_feature 1..20: note = CRISPR gRNA sequence
  source 1..20: mol_type = other DNA
ttgtgtttattgatcaagcc

SEQ ID NO: 47004 - DNA, 20 bp, synthetic construct
  misc_feature 1..20: note = CRISPR gRNA sequence
  source 1..20: mol_type = other DNA
tattgatcaagcctggcttc

SEQ ID NO: 47005 - DNA, 20 bp, synthetic construct
  misc_feature 1..20: note = CRISPR gRNA sequence
  source 1..20: mol_type = other DNA
aagcctggcttcgagtgtga

SEQ ID NO: 47006 - DNA, 20 bp, synthetic construct
  misc_feature 1..20: note = CRISPR gRNA sequence
  source 1..20: mol_type = other DNA
gcctggcttcgagtgtgaca

SEQ ID NO: 47007 - DNA, 20 bp, synthetic construct
  misc_feature 1..20: note = CRISPR gRNA sequence
  source 1..20: mol_type = other DNA
gagtgtgacagagccattct

SEQ ID NO: 47008 - DNA, 20 bp, synthetic construct
  misc_feature 1..20: note = CRISPR gRNA sequence
  source 1..20: mol_type = other DNA
gagccattcttggttctcct

SEQ ID NO: 47009 - DNA, 20 bp, synthetic construct
  misc_feature 1..20: note = CRISPR gRNA sequence
  source 1..20: mol_type = other DNA
ccattcttggttctccttgg

SEQ ID NO: 47010 - DNA, 20 bp, synthetic construct
  misc_feature 1..20: note = CRISPR gRNA sequence
  source 1..20: mol_type = other DNA
tggttctccttggaagtaac

SEQ ID NO: 47011 - DNA, 20 bp, synthetic construct
  misc_feature 1..20: note = CRISPR gRNA sequence
  source 1..20: mol_type = other DNA
cttggaagtaacaagaacac

SEQ ID NO: 47012 - DNA, 20 bp, synthetic construct
  misc_feature 1..20: note = CRISPR gRNA sequence
  source 1..20: mol_type = other DNA
ttggaagtaacaagaacact

SEQ ID NO: 47013 - DNA, 20 bp, synthetic construct
  misc_feature 1..20: note = CRISPR gRNA sequence
  source 1..20: mol_type = other DNA
agaacactgggtaacatgtg

SEQ ID NO: 47014 - DNA, 20 bp, synthetic construct
  misc_feature 1..20: note = CRISPR gRNA sequence
  source 1..20: mol_type = other DNA
tgggtaacatgtgaagtgca

SEQ ID NO: 47015 - DNA, 20 bp, synthetic construct
  misc_feature 1..20: note = CRISPR gRNA sequence
  source 1..20: mol_type = other DNA
ggtaacatgtgaagtgcatg

SEQ ID NO: 47016 - DNA, 20 bp, synthetic construct
  misc_feature 1..20: note = CRISPR gRNA sequence
  source 1..20: mol_type = other DNA
gactcacctgaatcccacca

SEQ ID NO: 47017 - DNA, 20 bp, synthetic construct
  misc_feature 1..20: note = CRISPR gRNA sequence
  source 1..20: mol_type = other DNA
tcacctgaatcccaccaaag

SEQ ID NO: 47018 - DNA, 20 bp, synthetic construct
  misc_feature 1..20: note = CRISPR gRNA sequence
  source 1..20: mol_type = other DNA
cctgaatcccaccaaagtag

SEQ ID NO: 47019 - DNA, 20 bp, synthetic construct
  misc_feature 1..20: note = CRISPR gRNA sequence
  source 1..20: mol_type = other DNA
aatcccaccaaagtagtagc

SEQ ID NO: 47020 - DNA, 20 bp, synthetic construct
  misc_feature 1..20: note = CRISPR gRNA sequence
  source 1..20: mol_type = other DNA
accaaagtagtagctggacc

SEQ ID NO: 47021 - DNA, 20 bp, synthetic construct
  misc_feature 1..20: note = CRISPR gRNA sequence
  source 1..20: mol_type = other DNA
aaagtagtagctggacccag

SEQ ID NO: 47022 - DNA, 20 bp, synthetic construct
  misc_feature 1..20: note = CRISPR gRNA sequence
  source 1..20: mol_type = other DNA
agtagctggacccagtagcc

SEQ ID NO: 47023 - DNA, 20 bp, synthetic construct
  misc_feature 1..20: note = CRISPR gRNA sequence
  source 1..20: mol_type = other DNA
agtagcctagcttattgtct

SEQ ID NO: 47024 - DNA, 20 bp, synthetic construct
  misc_feature 1..20: note = CRISPR gRNA sequence
  source 1..20: mol_type = other DNA
agcctagcttattgtcttgg

SEQ ID NO: 47025 - DNA, 20 bp, synthetic construct
  misc_feature 1..20: note = CRISPR gRNA sequence
  source 1..20: mol_type = other DNA
tcttggcagtgccccctacc

SEQ ID NO: 47026 - DNA, 20 bp, synthetic construct
  misc_feature 1..20: note = CRISPR gRNA sequence
  source 1..20: mol_type = other DNA
tgccccctacccagtaccat

SEQ ID NO: 47027 - DNA, 20 bp, synthetic construct
  misc_feature 1..20: note = CRISPR gRNA sequence
  source 1..20: mol_type = other DNA
ctacccagtaccattagacc

SEQ ID NO: 47028 - DNA, 20 bp, synthetic construct
  misc_feature 1..20: note = CRISPR gRNA sequence
  source 1..20: mol_type = other DNA
acctggctttgtcccttaca

SEQ ID NO: 47029 - DNA, 20 bp, synthetic construct
  misc_feature 1..20: note = CRISPR gRNA sequence
  source 1..20: mol_type = other DNA
cctggctttgtcccttacat

SEQ ID NO: 47030 - DNA, 20 bp, synthetic construct
  misc_feature 1..20: note = CRISPR gRNA sequence
  source 1..20: mol_type = other DNA
gctttgtcccttacatagga

SEQ ID NO: 47031 - DNA, 20 bp, synthetic construct
  misc_feature 1..20: note = CRISPR gRNA sequence
  source 1..20: mol_type = other DNA
gtcccttacataggacagac

SEQ ID NO: 47032 - DNA, 20 bp, synthetic construct
  misc_feature 1..20: note = CRISPR gRNA sequence
  source 1..20: mol_type = other DNA
tcccttacataggacagact

SEQ ID NO: 47033 - DNA, 20 bp, synthetic construct
  misc_feature 1..20: note = CRISPR gRNA sequence
  source 1..20: mol_type = other DNA
ctgggcttctccactcccgc

SEQ ID NO: 47034 - DNA, 20 bp, synthetic construct
  misc_feature 1..20: note = CRISPR gRNA sequence
  source 1..20: mol_type = other DNA
tgggcttctccactcccgcc

SEQ ID NO: 47035 - DNA, 20 bp, synthetic construct
  misc_feature 1..20: note = CRISPR gRNA sequence
  source 1..20: mol_type = other DNA
cttctccactcccgccaggc

SEQ ID NO: 47036 - DNA, 20 bp, synthetic construct
  misc_feature 1..20: note = CRISPR gRNA sequence
  source 1..20: mol_type = other DNA
gccctacctccacctgtcct

SEQ ID NO: 47037 - DNA, 20 bp, synthetic construct
  misc_feature 1..20: note = CRISPR gRNA sequence
  source 1..20: mol_type = other DNA
ctacctccacctgtccttgg

SEQ ID NO: 47038 - DNA, 20 bp, synthetic construct
  misc_feature 1..20: note = CRISPR gRNA sequence
  source 1..20: mol_type = other DNA
ctccacctgtccttggaagc

SEQ ID NO: 47039 - DNA, 20 bp, synthetic construct
  misc_feature 1..20: note = CRISPR gRNA sequence
  source 1..20: mol_type = other DNA
gtccttggaagctagtatgt

SEQ ID NO: 47040 - DNA, 20 bp, synthetic construct
  misc_feature 1..20: note = CRISPR gRNA sequence
  source 1..20: mol_type = other DNA
ttggaagctagtatgtaagt

SEQ ID NO: 47041 - DNA, 20 bp, synthetic construct
  misc_feature 1..20: note = CRISPR gRNA sequence
  source 1..20: mol_type = other DNA
tggaagctagtatgtaagta

SEQ ID NO: 47042 - DNA, 20 bp, synthetic construct
  misc_feature 1..20: note = CRISPR gRNA sequence
  source 1..20: mol_type = other DNA
ggaagctagtatgtaagtaa

SEQ ID NO: 47043 - DNA, 20 bp, synthetic construct
  misc_feature 1..20: note = CRISPR gRNA sequence
  source 1..20: mol_type = other DNA
aagctagtatgtaagtaagg

SEQ ID NO: 47044 - DNA, 20 bp, synthetic construct
  misc_feature 1..20: note = CRISPR gRNA sequence
  source 1..20: mol_type = other DNA
agctagtatgtaagtaaggg

SEQ ID NO: 47045 - DNA, 20 bp, synthetic construct
  misc_feature 1..20: note = CRISPR gRNA sequence
  source 1..20: mol_type = other DNA
ctagtatgtaagtaagggag

SEQ ID NO: 47046 - DNA, 20 bp, synthetic construct
  misc_feature 1..20: note = CRISPR gRNA sequence
  source 1..20: mol_type = other DNA
taagtaagggaggagtcatc

SEQ ID NO: 47047 - DNA, 20 bp, synthetic construct
  misc_feature 1..20: note = CRISPR gRNA sequence
  source 1..20: mol_type = other DNA
gggaggagtcatcaagttta

SEQ ID NO: 47048 - DNA, 20 bp, synthetic construct
  misc_feature 1..20: note = CRISPR gRNA sequence
  source 1..20: mol_type = other DNA
ggagtcatcaagtttataga

SEQ ID NO: 47049 - DNA, 20 bp, synthetic construct
  misc_feature 1..20: note = CRISPR gRNA sequence
  source 1..20: mol_type = other DNA
gagtcatcaagtttatagat

SEQ ID NO: 47050 - DNA, 20 bp, synthetic construct
  misc_feature 1..20: note = CRISPR gRNA sequence
  source 1..20: mol_type = other DNA
tcatcaagtttatagatggg

SEQ ID NO: 47051 - DNA, 20 bp, synthetic construct
  misc_feature 1..20: note = CRISPR gRNA sequence
  source 1..20: mol_type = other DNA
catcaagtttatagatgggt

SEQ ID NO: 47052 - DNA, 20 bp, synthetic construct
  misc_feature 1..20: note = CRISPR gRNA sequence
  source 1..20: mol_type = other DNA
agtttatagatgggtaggct

SEQ ID NO: 47053 - DNA, 20 bp, synthetic construct
  misc_feature 1..20: note = CRISPR gRNA sequence
  source 1..20: mol_type = other DNA
gtttatagatgggtaggctg

SEQ ID NO: 47054 - DNA, 20 bp, synthetic construct
  misc_feature 1..20: note = CRISPR gRNA sequence
  source 1..20: mol_type = other DNA
agatgggtaggctgaggatt

SEQ ID NO: 47055 - DNA, 20 bp, synthetic construct
  misc_feature 1..20: note = CRISPR gRNA sequence
  source 1..20: mol_type = other DNA
gatgggtaggctgaggattg

SEQ ID NO: 47056 - DNA, 20 bp, synthetic construct
  misc_feature 1..20: note = CRISPR gRNA sequence
  source 1..20: mol_type = other DNA
gggtaggctgaggattgagg

SEQ ID NO: 47057 - DNA, 20 bp, synthetic construct
  misc_feature 1..20: note = CRISPR gRNA sequence
  source 1..20: mol_type = other DNA
ggtaggctgaggattgaggc

SEQ ID NO: 47058 - DNA, 20 bp, synthetic construct
  misc_feature 1..20: note = CRISPR gRNA sequence
  source 1..20: mol_type = other DNA
taggctgaggattgaggcag

SEQ ID NO: 47059 - DNA, 20 bp, synthetic construct
  misc_feature 1..20: note = CRISPR gRNA sequence
  source 1..20: mol_type = other DNA
aggctgaggattgaggcagg

SEQ ID NO: 47060 - DNA, 20 bp, synthetic construct
  misc_feature 1..20: note = CRISPR gRNA sequence
  source 1..20: mol_type = other DNA
ggctgaggattgaggcagga

SEQ ID NO: 47061 - DNA, 20 bp, synthetic construct
  misc_feature 1..20: note = CRISPR gRNA sequence
  source 1..20: mol_type = other DNA
gctgaggattgaggcaggag

SEQ ID NO: 47062 - DNA, 20 bp, synthetic construct
  misc_feature 1..20: note = CRISPR gRNA sequence
  source 1..20: mol_type = other DNA
tgaggcaggaggggacttaa

SEQ ID NO: 47063 - DNA, 20 bp, synthetic construct
  misc_feature 1..20: note = CRISPR gRNA sequence
  source 1..20: mol_type = other DNA
caggaggggacttaatggct

SEQ ID NO: 47064 - DNA, 20 bp, synthetic construct
  misc_feature 1..20: note = CRISPR gRNA sequence
  source 1..20: mol_type = other DNA
ggacttaatggctgagtccc

SEQ ID NO: 47065 - DNA, 20 bp, synthetic construct
  misc_feature 1..20: note = CRISPR gRNA sequence
  source 1..20: mol_type = other DNA
gctgagtccctggcttgttc

SEQ ID NO: 47066 - DNA, 20 bp, synthetic construct
  misc_feature 1..20: note = CRISPR gRNA sequence
  source 1..20: mol_type = other DNA
tgagtccctggcttgttcca

SEQ ID NO: 47067 - DNA, 20 bp, synthetic construct
  misc_feature 1..20: note = CRISPR gRNA sequence
  source 1..20: mol_type = other DNA
cctggcttgttccagagccc

SEQ ID NO: 47068 - DNA, 20 bp, synthetic construct
  misc_feature 1..20: note = CRISPR gRNA sequence
  source 1..20: mol_type = other DNA
gttccagagccctggccctt

SEQ ID NO: 47069 - DNA, 20 bp, synthetic construct
  misc_feature 1..20: note = CRISPR gRNA sequence
  source 1..20: mol_type = other DNA
agccctggcccttgagcccc

SEQ ID NO: 47070 - DNA, 20 bp, synthetic construct
  misc_feature 1..20: note = CRISPR gRNA sequence
  source 1..20: mol_type = other DNA
tggcccttgagcccctggac

SEQ ID NO: 47071 - DNA, 20 bp, synthetic construct
  misc_feature 1..20: note = CRISPR gRNA sequence
  source 1..20: mol_type = other DNA
ccttgagcccctggactggt

SEQ ID NO: 47072 - DNA, 20 bp, synthetic construct
  misc_feature 1..20: note = CRISPR gRNA sequence
  source 1..20: mol_type = other DNA
cccctggactggtcagtgca

SEQ ID NO: 47073 - DNA, 20 bp, synthetic construct
  misc_feature 1..20: note = CRISPR gRNA sequence
  source 1..20: mol_type = other DNA
gcatggacactctcccctcc

SEQ ID NO: 47074 - DNA, 20 bp, synthetic construct
  misc_feature 1..20: note = CRISPR gRNA sequence
  source 1..20: mol_type = other DNA
gacactctcccctcccagct

SEQ ID NO: 47075 - DNA, 20 bp, synthetic construct
  misc_feature 1..20: note = CRISPR gRNA sequence
  source 1..20: mol_type = other DNA
acactctcccctcccagctc

SEQ ID NO: 47076 - DNA, 20 bp, synthetic construct
  misc_feature 1..20: note = CRISPR gRNA sequence
  source 1..20: mol_type = other DNA
ctctcccctcccagctcggg

SEQ ID NO: 47077 - DNA, 20 bp, synthetic construct
  misc_feature 1..20: note = CRISPR gRNA sequence
  source 1..20: mol_type = other DNA
tcccctcccagctcgggcgg

SEQ ID NO: 47078 - DNA, 20 bp, synthetic construct
  misc_feature 1..20: note = CRISPR gRNA sequence
  source 1..20: mol_type = other DNA
gcggaagacttttcctgact

SEQ ID NO: 47079 - DNA, 20 bp, synthetic construct
  misc_feature 1..20: note = CRISPR gRNA sequence
  source 1..20: mol_type = other DNA
tgctttaaaaattaataaat

SEQ ID NO: 47080 - DNA, 20 bp, synthetic construct
  misc_feature 1..20: note = CRISPR gRNA sequence
  source 1..20: mol_type = other DNA
aaaattaataaattagatct

SEQ ID NO: 47081 - DNA, 20 bp, synthetic construct
  misc_feature 1..20: note = CRISPR gRNA sequence
  source 1..20: mol_type = other DNA
aaattaataaattagatctt

SEQ ID NO: 47082 - DNA, 20 bp, synthetic construct
  misc_feature 1..20: note = CRISPR gRNA sequence
  source 1..20: mol_type = other DNA
taataaattagatcttgggc

SEQ ID NO: 47083 - DNA, 20 bp, synthetic construct
  misc_feature 1..20: note = CRISPR gRNA sequence
  source 1..20: mol_type = other DNA
attagatcttgggccagcct

SEQ ID NO: 47084 - DNA, 20 bp, synthetic construct
  misc_feature 1..20: note = CRISPR gRNA sequence
  source 1..20: mol_type = other DNA
ttagatcttgggccagcctg

SEQ ID NO: 47085 - DNA, 20 bp, synthetic construct
  misc_feature 1..20: note = CRISPR gRNA sequence
  source 1..20: mol_type = other DNA
tgggccagcctgaggtcatc

SEQ ID NO: 47086 - DNA, 20 bp, synthetic construct
  misc_feature 1..20: note = CRISPR gRNA sequence
  source 1..20: mol_type = other DNA
ccagcctgaggtcatctggc

SEQ ID NO: 47087 - DNA, 20 bp, synthetic construct
  misc_feature 1..20: note = CRISPR gRNA sequence
  source 1..20: mol_type = other DNA
gaggtcatctggccagccat

SEQ ID NO: 47088 - DNA, 20 bp, synthetic construct
  misc_feature 1..20: note = CRISPR gRNA sequence
  source 1..20: mol_type = other DNA
cagccatgagtcctgtgaca

SEQ ID NO: 47089 - DNA, 20 bp, synthetic construct
  misc_feature 1..20: note = CRISPR gRNA sequence
  source 1..20: mol_type = other DNA
catttgtcatgtgtcatata

SEQ ID NO: 47090 - DNA, 20 bp, synthetic construct
  misc_feature 1..20: note = CRISPR gRNA sequence
  source 1..20: mol_type = other DNA
caatcatgtatcctgctact

SEQ ID NO: 47091 - DNA, 20 bp, synthetic construct
  misc_feature 1..20: note = CRISPR gRNA sequence
  source 1..20: mol_type = other DNA
aatcatgtatcctgctactt

SEQ ID NO: 47092 - DNA, 20 bp, synthetic construct
  misc_feature 1..20: note = CRISPR gRNA sequence
  source 1..20: mol_type = other DNA
tatcctgctacttgggatgc

SEQ ID NO: 47093 - DNA, 20 bp, synthetic construct
  misc_feature 1..20: note = CRISPR gRNA sequence
  source 1..20: mol_type = other DNA
ggatgccagcacccatgcca

SEQ ID NO: 47094 - DNA, 20 bp, synthetic construct
  misc_feature 1..20: note = CRISPR gRNA sequence
  source 1..20: mol_type = other DNA
ttcatgtaacgccacatgtc

SEQ ID NO: 47095 - DNA, 20 bp, synthetic construct
  misc_feature 1..20: note = CRISPR gRNA sequence
  source 1..20: mol_type = other DNA
tcatgtaacgccacatgtca

SEQ ID NO: 47096 - DNA, 20 bp, synthetic construct
  misc_feature 1..20: note = CRISPR gRNA sequence
  source 1..20: mol_type = other DNA
catgtaacgccacatgtcaa

SEQ ID NO: 47097 - DNA, 20 bp, synthetic construct
  misc_feature 1..20: note = CRISPR gRNA sequence
  source 1..20: mol_type = other DNA
atgtaacgccacatgtcaag

SEQ ID NO: 47098 - DNA, 20 bp, synthetic construct
  misc_feature 1..20: note = CRISPR gRNA sequence
  source 1..20: mol_type = other DNA
cacacatatcccacgtaatg

SEQ ID NO: 47099 - DNA, 20 bp, synthetic construct
  misc_feature 1..20: note = CRISPR gRNA sequence
  source 1..20: mol_type = other DNA
acacatatcccacgtaatgc

SEQ ID NO: 47100 - DNA, 20 bp, synthetic construct
  misc_feature 1..20: note = CRISPR gRNA sequence
  source 1..20: mol_type = other DNA
cacatatcccacgtaatgca

SEQ ID NO: 47101 - DNA, 20 bp, synthetic construct
  misc_feature 1..20: note = CRISPR gRNA sequence
  source 1..20: mol_type = other DNA
atgcagggtactcctttgtc

SEQ ID NO: 47102 - DNA, 20 bp, synthetic construct
  misc_feature 1..20: note = CRISPR gRNA sequence
  source 1..20: mol_type = other DNA
ggtactcctttgtccagacc

SEQ ID NO: 47103 - DNA, 20 bp, synthetic construct
  misc_feature 1..20: note = CRISPR gRNA sequence
  source 1..20: mol_type = other DNA
ctttgtccagacccagctcc

SEQ ID NO: 47104 - DNA, 20 bp, synthetic construct
  misc_feature 1..20: note = CRISPR gRNA sequence
  source 1..20: mol_type = other DNA
ccagctcctggttcccaaaa

SEQ ID NO: 47105 - DNA, 20 bp, synthetic construct
  misc_feature 1..20: note = CRISPR gRNA sequence
  source 1..20: mol_type = other DNA
ttcccaaaaaagttctccct

SEQ ID NO: 47106 - DNA, 20 bp, synthetic construct
  misc_feature 1..20: note = CRISPR gRNA sequence
  source 1..20: mol_type = other DNA
tcccaaaaaagttctccctg

SEQ ID NO: 47107 - DNA, 20 bp, synthetic construct
  misc_feature 1..20: note = CRISPR gRNA sequence
  source 1..20: mol_type = other DNA
aaagttctccctgaggactg

SEQ ID NO: 47108 - DNA, 20 bp, synthetic construct
  misc_feature 1..20: note = CRISPR gRNA sequence
  source 1..20: mol_type = other DNA
gttctccctgaggactgcag

SEQ ID NO: 47109 - DNA, 20 bp, synthetic construct
  misc_feature 1..20: note = CRISPR gRNA sequence
  source 1..20: mol_type = other DNA
ttctccctgaggactgcagc

SEQ ID NO: 47110 - DNA, 20 bp, synthetic construct
  misc_feature 1..20: note = CRISPR gRNA sequence
  source 1..20: mol_type = other DNA
gacacacgtatccttcctcc

SEQ ID NO: 47111 - DNA, 20 bp, synthetic construct
  misc_feature 1..20: note = CRISPR gRNA sequence
  source 1..20: mol_type = other DNA
acacacgtatccttcctcct

SEQ ID NO: 47112 - DNA, 20 bp, synthetic construct
  misc_feature 1..20: note = CRISPR gRNA sequence
  source 1..20: mol_type = other DNA
cacgtatccttcctcctggg

SEQ ID NO: 47113 - DNA, 20 bp, synthetic construct
  misc_feature 1..20: note = CRISPR gRNA sequence
  source 1..20: mol_type = other DNA
cgtatccttcctcctgggtg

SEQ ID NO: 47114 - DNA, 20 bp, synthetic construct
  misc_feature 1..20: note = CRISPR gRNA sequence
  source 1..20: mol_type = other DNA
ccttcctcctgggtggagtg

SEQ ID NO: 47115 - DNA, 20 bp, synthetic construct
  misc_feature 1..20: note = CRISPR gRNA sequence
  source 1..20: mol_type = other DNA
ttcctcctgggtggagtgca

SEQ ID NO: 47116 - DNA, 20 bp, synthetic construct
  misc_feature 1..20: note = CRISPR gRNA sequence
  source 1..20: mol_type = other DNA
ggagtgcagagcgccctgcc

SEQ ID NO: 47117 - DNA, 20 bp, synthetic construct
  misc_feature 1..20: note = CRISPR gRNA sequence
  source 1..20: mol_type = other DNA
gagtgcagagcgccctgccg

SEQ ID NO: 47118 - DNA, 20 bp, synthetic construct
  misc_feature 1..20: note = CRISPR gRNA sequence
  source 1..20: mol_type = other DNA
tgccgaggctcttctttcct

SEQ ID NO: 47119 - DNA, 20 bp, synthetic construct
  misc_feature 1..20: note = CRISPR gRNA sequence
  source 1..20: mol_type = other DNA
ctttcctgagtcaattatcc

SEQ ID NO: 47120 - DNA, 20 bp, synthetic construct
  misc_feature 1..20: note = CRISPR gRNA sequence
  source 1..20: mol_type = other DNA
tcctgagtcaattatcccag

SEQ ID NO: 47121 - DNA, 20 bp, synthetic construct
  misc_feature 1..20: note = CRISPR gRNA sequence
  source 1..20: mol_type = other DNA
cctgagtcaattatcccagt

SEQ ID NO: 47122 - DNA, 20 bp, synthetic construct
  misc_feature 1..20: note = CRISPR gRNA sequence
  source 1..20: mol_type = other DNA
tcaattatcccagtgggcga

SEQ ID NO: 47123 - DNA, 20 bp, synthetic construct
  misc_feature 1..20: note = CRISPR gRNA sequence
  source 1..20: mol_type = other DNA
caattatcccagtgggcgaa

SEQ ID NO: 47124 - DNA, 20 bp, synthetic construct
  misc_feature 1..20: note = CRISPR gRNA sequence
  source 1..20: mol_type = other DNA
ttatcccagtgggcgaaagg

SEQ ID NO: 47125 - DNA, 20 bp, synthetic construct
  misc_feature 1..20: note = CRISPR gRNA sequence
  source 1..20: mol_type = other DNA
tgggcgaaaggtggatcatt

SEQ ID NO: 47126 - DNA, 20 bp, synthetic construct
  misc_feature 1..20: note = CRISPR gRNA sequence
  source 1..20: mol_type = other DNA
gggcgaaaggtggatcattt

SEQ ID NO: 47127 - DNA, 20 bp, synthetic construct
  misc_feature 1..20: note = CRISPR gRNA sequence
  source 1..20: mol_type = other DNA
gatcatttgggtgcatcact

SEQ ID NO: 47128 - DNA, 20 bp, synthetic construct
  misc_feature 1..20: note = CRISPR gRNA sequence
  source 1..20: mol_type = other DNA
atttgggtgcatcacttggc

SEQ ID NO: 47129 - DNA, 20 bp, synthetic construct
  misc_feature 1..20: note = CRISPR gRNA sequence
  source 1..20: mol_type = other DNA
catcacttggctggattcca

SEQ ID NO: 47130 - DNA, 20 bp, synthetic construct
  misc_feature 1..20: note = CRISPR gRNA sequence
  source 1..20: mol_type = other DNA
atcacttggctggattccaa

SEQ ID NO: 47131 - DNA, 20 bp, synthetic construct
  misc_feature 1..20: note = CRISPR gRNA sequence
  source 1..20: mol_type = other DNA
ggctggattccaaaggtctt

SEQ ID NO: 47132 - DNA, 20 bp, synthetic construct
  misc_feature 1..20: note = CRISPR gRNA sequence
  source 1..20: mol_type = other DNA
gctggattccaaaggtcttg

SEQ ID NO: 47133 - DNA, 20 bp, synthetic construct
  misc_feature 1..20: note = CRISPR gRNA sequence
  source 1..20: mol_type = other DNA
ctggattccaaaggtcttga

SEQ ID NO: 47134 - DNA, 20 bp, synthetic construct
  misc_feature 1..20: note = CRISPR gRNA sequence
  source 1..20: mol_type = other DNA
tggattccaaaggtcttgag

SEQ ID NO: 47135 - DNA, 20 bp, synthetic construct
  misc_feature 1..20: note = CRISPR gRNA sequence
  source 1..20: mol_type = other DNA
ggattccaaaggtcttgagg

SEQ ID NO: 47136 - DNA, 20 bp, synthetic construct
  misc_feature 1..20: note = CRISPR gRNA sequence
  source 1..20: mol_type = other DNA
aaggtcttgagggggccatc

SEQ ID NO: 47137 - DNA, 20 bp, synthetic construct
  misc_feature 1..20: note = CRISPR gRNA sequence
  source 1..20: mol_type = other DNA
agggggccatcaagtacccc

SEQ ID NO: 47138 - DNA, 20 bp, synthetic construct
  misc_feature 1..20: note = CRISPR gRNA sequence
  source 1..20: mol_type = other DNA
gggggccatcaagtacccca

SEQ ID NO: 47139 - DNA, 20 bp, synthetic construct
  misc_feature 1..20: note = CRISPR gRNA sequence
  source 1..20: mol_type = other DNA
ggggccatcaagtaccccaa

SEQ ID NO: 47140 - DNA, 20 bp, synthetic construct
  misc_feature 1..20: note = CRISPR gRNA sequence
  source 1..20: mol_type = other DNA
gggccatcaagtaccccaag

SEQ ID NO: 47141 - DNA, 20 bp, synthetic construct
  misc_feature 1..20: note = CRISPR gRNA sequence
  source 1..20: mol_type = other DNA
atcaagtaccccaaggggcc

SEQ ID NO: 47142 - DNA, 20 bp, synthetic construct
  misc_feature 1..20: note = CRISPR gRNA sequence
  source 1..20: mol_type = other DNA
tcaagtaccccaaggggcct

SEQ ID NO: 47143 - DNA, 20 bp, synthetic construct
  misc_feature 1..20: note = CRISPR gRNA sequence
  source 1..20: mol_type = other DNA
caagtaccccaaggggcctg

SEQ ID NO: 47144 - DNA, 20 bp, synthetic construct
  misc_feature 1..20: note = CRISPR gRNA sequence
  source 1..20: mol_type = other DNA
taccccaaggggcctggggc

SEQ ID NO: 47145 - DNA, 20 bp, synthetic construct
  misc_feature 1..20: note = CRISPR gRNA sequence
  source 1..20: mol_type = other DNA
gggcctggggctggttgtca

SEQ ID NO: 47146 - DNA, 20 bp, synthetic construct
  misc_feature 1..20: note = CRISPR gRNA sequence
  source 1..20: mol_type = other DNA
cctggggctggttgtcaaag

SEQ ID NO: 47147 - DNA, 20 bp, synthetic construct
  misc_feature 1..20: note = CRISPR gRNA sequence
  source 1..20: mol_type = other DNA
ctggggctggttgtcaaaga

SEQ ID NO: 47148 - DNA, 20 bp, synthetic construct
  misc_feature 1..20: note = CRISPR gRNA sequence
  source 1..20: mol_type = other DNA
gctggttgtcaaagaaggca

SEQ ID NO: 47149 - DNA, 20 bp, synthetic construct
  misc_feature 1..20: note = CRISPR gRNA sequence
  source 1..20: mol_type = other DNA
ttgtcaaagaaggcaaagtc

SEQ ID NO: 47150 - DNA, 20 bp, synthetic construct
  misc_feature 1..20: note = CRISPR gRNA sequence
  source 1..20: mol_type = other DNA
aaagaaggcaaagtccagcc

SEQ ID NO: 47151 - DNA, 20 bp, synthetic construct
  misc_feature 1..20: note = CRISPR gRNA sequence
  source 1..20: mol_type = other DNA
aagaaggcaaagtccagcct

SEQ ID NO: 47152 - DNA, 20 bp, synthetic construct
  misc_feature 1..20: note = CRISPR gRNA sequence
  source 1..20: mol_type = other DNA
caaagtccagcctgggctcc

SEQ ID NO: 47153 - DNA, 20 bp, synthetic construct
  misc_feature 1..20: note = CRISPR gRNA sequence
  source 1..20: mol_type = other DNA
agcctgggctcctggctctt

SEQ ID NO: 47154 - DNA, 20 bp, synthetic construct
  misc_feature 1..20: note = CRISPR gRNA sequence
  source 1..20: mol_type = other DNA
gcctgggctcctggctcttc

SEQ ID NO: 47155 - DNA, 20 bp, synthetic construct
  misc_feature 1..20: note = CRISPR gRNA sequence
  source 1..20: mol_type = other DNA
gctcctggctcttcaggtgc

SEQ ID NO: 47156 - DNA, 20 bp, synthetic construct
  misc_feature 1..20: note = CRISPR gRNA sequence
  source 1..20: mol_type = other DNA
ctcctggctcttcaggtgct

SEQ ID NO: 47157 - DNA, 20 bp, synthetic construct
  misc_feature 1..20: note = CRISPR gRNA sequence
  source 1..20: mol_type = other DNA
tcaggtgctgggccatgtcg

SEQ ID NO: 47158 - DNA, 20 bp, synthetic construct
  misc_feature 1..20: note = CRISPR gRNA sequence
  source 1..20: mol_type = other DNA
caggtgctgggccatgtcgc

SEQ ID NO: 47159 - DNA, 20 bp, synthetic construct
  misc_feature 1..20: note = CRISPR gRNA sequence
  source 1..20: mol_type = other DNA
aggtgctgggccatgtcgca

SEQ ID NO: 47160 - DNA, 20 bp, synthetic construct
  misc_feature 1..20: note = CRISPR gRNA sequence
  source 1..20: mol_type = other DNA
ctgggccatgtcgcagggaa

SEQ ID NO: 47161 - DNA, 20 bp, synthetic construct
  misc_feature 1..20: note = CRISPR gRNA sequence
  source 1..20: mol_type = other DNA
tgggccatgtcgcagggaat

SEQ ID NO: 47162 - DNA, 20 bp, synthetic construct
  misc_feature 1..20: note = CRISPR gRNA sequence
  source 1..20: mol_type = other DNA
gggccatgtcgcagggaatg

SEQ ID NO: 47163 - DNA, 20 bp, synthetic construct
  misc_feature 1..20: note = CRISPR gRNA sequence
  source 1..20: mol_type = other DNA
cgcagggaatggggttattc

SEQ ID NO: 47164 - DNA, 20 bp, synthetic construct
  misc_feature 1..20: note = CRISPR gRNA sequence
  source 1..20: mol_type = other DNA
cagggaatggggttattcca

SEQ ID NO: 47165 - DNA, 20 bp, synthetic construct
  misc_feature 1..20: note = CRISPR gRNA sequence
  source 1..20: mol_type = other DNA
agggaatggggttattccag

SEQ ID NO: 47166 - DNA, 20 bp, synthetic construct
  misc_feature 1..20: note = CRISPR gRNA sequence
  source 1..20: mol_type = other DNA
tggggttattccagaggctg

SEQ ID NO: 47167 - DNA, 20 bp, synthetic construct
  misc_feature 1..20: note = CRISPR gRNA sequence
  source 1..20: mol_type = other DNA
ggggttattccagaggctgt

SEQ ID NO: 47168 - DNA, 20 bp, synthetic construct
  misc_feature 1..20: note = CRISPR gRNA sequence
  source 1..20: mol_type = other DNA
gggttattccagaggctgtg

SEQ ID NO: 47169 - DNA, 20 bp, synthetic construct
  misc_feature 1..20: note = CRISPR gRNA sequence
  source 1..20: mol_type = other DNA
attccagaggctgtggggca

SEQ ID NO: 47170 - DNA, 20 bp, synthetic construct
  misc_feature 1..20: note = CRISPR gRNA sequence
  source 1..20: mol_type = other DNA
gaggctgtggggcacagata

SEQ ID NO: 47171 - DNA, 20 bp, synthetic construct
  misc_feature 1..20: note = CRISPR gRNA sequence
  source 1..20: mol_type = other DNA
aggctgtggggcacagatat

SEQ ID NO: 47172 - DNA, 20 bp, synthetic construct
  misc_feature 1..20: note = CRISPR gRNA sequence
  source 1..20: mol_type = other DNA
tttgccatctgtcgtatctg

SEQ ID NO: 47173 - DNA, 20 bp, synthetic construct
  misc_feature 1..20: note = CRISPR gRNA sequence
  source 1..20: mol_type = other DNA
catctgtcgtatctgcagat

SEQ ID NO: 47174 - DNA, 20 bp, synthetic construct
  misc_feature 1..20: note = CRISPR gRNA sequence
  source 1..20: mol_type = other DNA
atctgtcgtatctgcagatt

SEQ ID NO: 47175 - DNA, 20 bp, synthetic construct
  misc_feature 1..20: note = CRISPR gRNA sequence
  source 1..20: mol_type = other DNA
ctgtcgtatctgcagattgg

SEQ ID NO: 47176 - DNA, 20 bp, synthetic construct
  misc_feature 1..20: note = CRISPR gRNA sequence
  source 1..20: mol_type = other DNA
tgtcgtatctgcagattggg

SEQ ID NO: 47177 - DNA, 20 bp, synthetic construct
  misc_feature 1..20: note = CRISPR gRNA sequence
  source 1..20: mol_type = other DNA
tatctgcagattgggaggct

SEQ ID NO: 47178 - DNA, 20 bp, synthetic construct
  misc_feature 1..20: note = CRISPR gRNA sequence
  source 1..20: mol_type = other DNA
atctgcagattgggaggctg

SEQ ID NO: 47179 - DNA, 20 bp, synthetic construct
  misc_feature 1..20: note = CRISPR gRNA sequence
  source 1..20: mol_type = other DNA
ttgggaggctgaggcccaaa

SEQ ID NO: 47180 - DNA, 20 bp, synthetic construct
  misc_feature 1..20: note = CRISPR gRNA sequence
  source 1..20: mol_type = other DNA
tgggaggctgaggcccaaaa

SEQ ID NO: 47181 - DNA, 20 bp, synthetic construct
  misc_feature 1..20: note = CRISPR gRNA sequence
  source 1..20: mol_type = other DNA
gaggctgaggcccaaaaagg

SEQ ID NO: 47182 - DNA, 20 bp, synthetic construct
  misc_feature 1..20: note = CRISPR gRNA sequence
  source 1..20: mol_type = other DNA
ggctgaggcccaaaaaggta

SEQ ID NO: 47183 - DNA, 20 bp, synthetic construct
  misc_feature 1..20: note = CRISPR gRNA sequence
  source 1..20: mol_type = other DNA
caaaaaggtagagctgtgcc

SEQ ID NO: 47184 - DNA, 20 bp, synthetic construct
  misc_feature 1..20: note = CRISPR gRNA sequence
  source 1..20: mol_type = other DNA
aaaaggtagagctgtgccta

SEQ ID NO: 47185 - DNA, 20 bp, synthetic construct
  misc_feature 1..20: note = CRISPR gRNA sequence
  source 1..20: mol_type = other DNA
gagctgtgcctagagttacc

SEQ ID NO: 47186 - DNA, 20 bp, synthetic construct
  misc_feature 1..20: note = CRISPR gRNA sequence
  source 1..20: mol_type = other DNA
ctgtgcctagagttacctgg

SEQ ID NO: 47187 - DNA, 20 bp, synthetic construct
  misc_feature 1..20: note = CRISPR gRNA sequence
  source 1..20: mol_type = other DNA
gtgcctagagttacctggca

SEQ ID NO: 47188 - DNA, 20 bp, synthetic construct
  misc_feature 1..20: note = CRISPR gRNA sequence
  source 1..20: mol_type = other DNA
tgcctagagttacctggcag

SEQ ID NO: 47189 - DNA, 20 bp, synthetic construct
  misc_feature 1..20: note = CRISPR gRNA sequence
  source 1..20: mol_type = other DNA
ctagagttacctggcagagg

SEQ ID NO: 47190 - DNA, 20 bp, synthetic construct
  misc_feature 1..20: note = CRISPR gRNA sequence
  source 1..20: mol_type = other DNA
tagagttacctggcagaggc

SEQ ID NO: 47191 - DNA, 20 bp, synthetic construct
  misc_feature 1..20: note = CRISPR gRNA sequence
  source 1..20: mol_type = other DNA
tacctggcagaggcaggtgt

SEQ ID NO: 47192 - DNA, 20 bp, synthetic construct
  misc_feature 1..20: note = CRISPR gRNA sequence
  source 1..20: mol_type = other DNA
ggcagaggcaggtgttagac

SEQ ID NO: 47193 - DNA, 20 bp, synthetic construct
  misc_feature 1..20: note = CRISPR gRNA sequence
  source 1..20: mol_type = other DNA
aggcaggtgttagaccagca

SEQ ID NO: 47194 - DNA, 20 bp, synthetic construct
  misc_feature 1..20: note = CRISPR gRNA sequence
  source 1..20: mol_type = other DNA
ttagaccagcatagctgacc

SEQ ID NO: 47195 - DNA, 20 bp, synthetic construct
  misc_feature 1..20: note = CRISPR gRNA sequence
  source 1..20: mol_type = other DNA
tagaccagcatagctgacct

SEQ ID NO: 47196 - DNA, 20 bp, synthetic construct
  misc_feature 1..20: note = CRISPR gRNA sequence
  source 1..20: mol_type = other DNA
agaccagcatagctgaccta

SEQ ID NO: 47197 - DNA, 20 bp, synthetic construct
  misc_feature 1..20: note = CRISPR gRNA sequence
  source 1..20: mol_type = other DNA
accagcatagctgacctagg

SEQ ID NO: 47198 - DNA, 20 bp, synthetic construct
  misc_feature 1..20: note = CRISPR gRNA sequence
  source 1..20: mol_type = other DNA
cagcatagctgacctaggga

SEQ ID NO: 47199 - DNA, 20 bp, synthetic construct
  misc_feature 1..20: note = CRISPR gRNA sequence
  source 1..20: mol_type = other DNA
agcatagctgacctagggag

SEQ ID NO: 47200 - DNA, 20 bp, synthetic construct
  misc_feature 1..20: note = CRISPR gRNA sequence
  source 1..20: mol_type = other DNA
gcatagctgacctagggaga

SEQ ID NO: 47201 - DNA, 20 bp, synthetic construct
  misc_feature 1..20: note = CRISPR gRNA sequence
  source 1..20: mol_type = other DNA
gtaccccacacctgcctcct

SEQ ID NO: 47202 - DNA, 20 bp, synthetic construct
  misc_feature 1..20: note = CRISPR gRNA sequence
  source 1..20: mol_type = other DNA
tccaactcaaccttcctccc

SEQ ID NO: 47203 - DNA, 20 bp, synthetic construct
  misc_feature 1..20: note = CRISPR gRNA sequence
  source 1..20: mol_type = other DNA
ccaactcaaccttcctccct

SEQ ID NO: 47204 - DNA, 20 bp, synthetic construct
  misc_feature 1..20: note = CRISPR gRNA sequence
  source 1..20: mol_type = other DNA
aactcaaccttcctccctgg

SEQ ID NO: 47205 - DNA, 20 bp, synthetic construct
  misc_feature 1..20: note = CRISPR gRNA sequence
  source 1..20: mol_type = other DNA
caaccttcctccctgggaga

SEQ ID NO: 47206 - DNA, 20 bp, synthetic construct
  misc_feature 1..20: note = CRISPR gRNA sequence
  source 1..20: mol_type = other DNA
tccctgggagatagtgatgc

SEQ ID NO: 47207 - DNA, 20 bp, synthetic construct
  misc_feature 1..20: note = CRISPR gRNA sequence
  source 1..20: mol_type = other DNA
gggagatagtgatgccagct

SEQ ID NO: 47208 - DNA, 20 bp, synthetic construct
  misc_feature 1..20: note = CRISPR gRNA sequence
  source 1..20: mol_type = other DNA
ggagatagtgatgccagcta

SEQ ID NO: 47209 - DNA, 20 bp, synthetic construct
  misc_feature 1..20: note = CRISPR gRNA sequence
  source 1..20: mol_type = other DNA
tatgacacatttgtgcaaat

SEQ ID NO: 47210 - DNA, 20 bp, synthetic construct
  misc_feature 1..20: note = CRISPR gRNA sequence
  source 1..20: mol_type = other DNA
atgacacatttgtgcaaata

SEQ ID NO: 47211 - DNA, 20 bp, synthetic construct
  misc_feature 1..20: note = CRISPR gRNA sequence
  source 1..20: mol_type = other DNA
acatttgtgcaaataaggaa

SEQ ID NO: 47212 - DNA, 20 bp, synthetic construct
  misc_feature 1..20: note = CRISPR gRNA sequence
  source 1..20: mol_type = other DNA
ggaaaagaccctctttcttc

SEQ ID NO: 47213 - DNA, 20 bp, synthetic construct
  misc_feature 1..20: note = CRISPR gRNA sequence
  source 1..20: mol_type = other DNA
attgtcataatatatgattt

SEQ ID NO: 47214 - DNA, 20 bp, synthetic construct
  misc_feature 1..20: note = CRISPR gRNA sequence
  source 1..20: mol_type = other DNA
gtcataatatatgattttgg

SEQ ID NO: 47215 - DNA, 20 bp, synthetic construct
  misc_feature 1..20: note = CRISPR gRNA sequence
  source 1..20: mol_type = other DNA
atatatgattttggtagaac

SEQ ID NO: 47216 - DNA, 20 bp, synthetic construct
  misc_feature 1..20: note = CRISPR gRNA sequence
  source 1..20: mol_type = other DNA
tatatgattttggtagaaca

SEQ ID NO: 47217 - DNA, 20 bp, synthetic construct
  misc_feature 1..20: note = CRISPR gRNA sequence
  source 1..20: mol_type = other DNA
ggtactttactctcatctgc

SEQ ID NO: 47218 - DNA, 20 bp, synthetic construct
  misc_feature 1..20: note = CRISPR gRNA sequence
  source 1..20: mol_type = other DNA
actctcatctgctagaaatc

SEQ ID NO: 47219 - DNA, 20 bp, synthetic construct
  misc_feature 1..20: note = CRISPR gRNA sequence
  source 1..20: mol_type = other DNA
ctcatctgctagaaatctag

SEQ ID NO: 47220 - DNA, 20 bp, synthetic construct
  misc_feature 1..20: note = CRISPR gRNA sequence
  source 1..20: mol_type = other DNA
tcatctgctagaaatctagc

SEQ ID NO: 47221 - DNA, 20 bp, synthetic construct
  misc_feature 1..20: note = CRISPR gRNA sequence
  source 1..20: mol_type = other DNA
tagcaggttgacaatgtgaa

SEQ ID NO: 47222 - DNA, 20 bp, synthetic construct
  misc_feature 1..20: note = CRISPR gRNA sequence
  source 1..20: mol_type = other DNA
acaatgtgaatggtgcccct

SEQ ID NO: 47223 - DNA, 20 bp, synthetic construct
  misc_feature 1..20: note = CRISPR gRNA sequence
  source 1..20: mol_type = other DNA
caatgtgaatggtgcccctt

SEQ ID NO: 47224 - DNA, 20 bp, synthetic construct
  misc_feature 1..20: note = CRISPR gRNA sequence
  source 1..20: mol_type = other DNA
ttaggtttaatgcccttgtg

SEQ ID NO: 47225 - DNA, 20 bp, synthetic construct
  misc_feature 1..20: note = CRISPR gRNA sequence
  source 1..20: mol_type = other DNA
acctatacaactgtatgtga

SEQ ID NO: 47226 - DNA, 20 bp, synthetic construct
  misc_feature 1..20: note = CRISPR gRNA sequence
  source 1..20: mol_type = other DNA
gtatgtgatggctctgatta

SEQ ID NO: 47227 - DNA, 20 bp, synthetic construct
  misc_feature 1..20: note = CRISPR gRNA sequence
  source 1..20: mol_type = other DNA
ctgattatagctgccatttt

SEQ ID NO: 47228 - DNA, 20 bp, synthetic construct
  misc_feature 1..20: note = CRISPR gRNA sequence
  source 1..20: mol_type = other DNA
tttaagtgcttactatgtgc

SEQ ID NO: 47229 - DNA, 20 bp, synthetic construct
  misc_feature 1..20: note = CRISPR gRNA sequence
  source 1..20: mol_type = other DNA
ttaagtgcttactatgtgcc

SEQ ID NO: 47230 - DNA, 20 bp, synthetic construct
  misc_feature 1..20: note = CRISPR gRNA sequence
  source 1..20: mol_type = other DNA
gcttactatgtgccaggcat

SEQ ID NO: 47231 - DNA, 20 bp, synthetic construct
  misc_feature 1..20: note = CRISPR gRNA sequence
  source 1..20: mol_type = other DNA
cttactatgtgccaggcatt

SEQ ID NO: 47232 - DNA, 20 bp, synthetic construct
  misc_feature 1..20: note = CRISPR gRNA sequence
  source 1..20: mol_type = other DNA
tatgtgccaggcattgggtt

SEQ ID NO: 47233 - DNA, 20 bp, synthetic construct
  misc_feature 1..20: note = CRISPR gRNA sequence
  source 1..20: mol_type = other DNA
cagtgctttatatgctcatt

SEQ ID NO: 47234 - DNA, 20 bp, synthetic construct
  misc_feature 1..20: note = CRISPR gRNA sequence
  source 1..20: mol_type = other DNA
tttagtcttcacaactctct

SEQ ID NO: 47235 - DNA, 20 bp, synthetic construct
  misc_feature 1..20: note = CRISPR gRNA sequence
  source 1..20: mol_type = other DNA
ttagtcttcacaactctctg

SEQ ID NO: 47236 - DNA, 20 bp, synthetic construct
  misc_feature 1..20: note = CRISPR gRNA sequence
  source 1..20: mol_type = other DNA
gtcttcacaactctctgagg

SEQ ID NO: 47237 - DNA, 20 bp, synthetic construct
  misc_feature 1..20: note = CRISPR gRNA sequence
  source 1..20: mol_type = other DNA
ctctctgaggtagatactat

SEQ ID NO: 47238 - DNA, 20 bp, synthetic construct
  misc_feature 1..20: note = CRISPR gRNA sequence
  source 1..20: mol_type = other DNA
ctatcagtatccccatttca

SEQ ID NO: 47239 - DNA, 20 bp, synthetic construct
  misc_feature 1..20: note = CRISPR gRNA sequence
  source 1..20: mol_type = other DNA
agtatccccatttcacagat

SEQ ID NO: 47240 - DNA, 20 bp, synthetic construct
  misc_feature 1..20: note = CRISPR gRNA sequence
  source 1..20: mol_type = other DNA
catttcacagatgagaaaat

SEQ ID NO: 47241 - DNA, 20 bp, synthetic construct
  misc_feature 1..20: note = CRISPR gRNA sequence
  source 1..20: mol_type = other DNA
atttcacagatgagaaaatt

SEQ ID NO: 47242 - DNA, 20 bp, synthetic construct
  misc_feature 1..20: note = CRISPR gRNA sequence
  source 1..20: mol_type = other DNA
tttcacagatgagaaaattg

SEQ ID NO: 47243 - DNA, 20 bp, synthetic construct
  misc_feature 1..20: note = CRISPR gRNA sequence
  source 1..20: mol_type = other DNA
cagatgagaaaattggggtt

SEQ ID NO: 47244 - DNA, 20 bp, synthetic construct
  misc_feature 1..20: note = CRISPR gRNA sequence
  source 1..20: mol_type = other DNA
gatgagaaaattggggttca

SEQ ID NO: 47245 - DNA, 20 bp, synthetic construct
  misc_feature 1..20: note = CRISPR gRNA sequence
  source 1..20: mol_type = other DNA
tgagaaaattggggttcaga

SEQ ID NO: 47246 - DNA, 20 bp, synthetic construct
  misc_feature 1..20: note = CRISPR gRNA sequence
  source 1..20: mol_type = other DNA
gagaaaattggggttcagag

SEQ ID NO: 47247 - DNA, 20 bp, synthetic construct
  misc_feature 1..20: note = CRISPR gRNA sequence
  source 1..20: mol_type = other DNA
aattggggttcagagaggtt

SEQ ID NO: 47248 - DNA, 20 bp, synthetic construct
  misc_feature 1..20: note = CRISPR gRNA sequence
  source 1..20: mol_type = other DNA
ggttcagagaggttgagtta

SEQ ID NO: 47249 - DNA, 20 bp, synthetic construct
  misc_feature 1..20: note = CRISPR gRNA sequence
  source 1..20: mol_type = other DNA
gaggttgagttatggctaca

SEQ ID NO: 47250 - DNA, 20 bp, synthetic construct
  misc_feature 1..20: note = CRISPR gRNA sequence
  source 1..20: mol_type = other DNA
gttatggctacaaagttaca

SEQ ID NO: 47251 - DNA, 20 bp, synthetic construct
  misc_feature 1..20: note = CRISPR gRNA sequence
  source 1..20: mol_type = other DNA
tggctacaaagttacacagt

SEQ ID NO: 47252 - DNA, 20 bp, synthetic construct
  misc_feature 1..20: note = CRISPR gRNA sequence
  source 1..20: mol_type = other DNA
tacaaagttacacagttggc

SEQ ID NO: 47253 - DNA, 20 bp, synthetic construct
  misc_feature 1..20: note = CRISPR gRNA sequence
  source 1..20: mol_type = other DNA
aaagttacacagttggcaag

SEQ ID NO: 47254 - DNA, 20 bp, synthetic construct
  misc_feature 1..20: note = CRISPR gRNA sequence
  source 1..20: mol_type = other DNA
gttacacagttggcaagtgg

SEQ ID NO: 47255 - DNA, 20 bp, synthetic construct
  misc_feature 1..20: note = CRISPR gRNA sequence
  source 1..20: mol_type = other DNA
tacacagttggcaagtggca

SEQ ID NO: 47256 - DNA, 20 bp, synthetic construct
  misc_feature 1..20: note = CRISPR gRNA sequence
  source 1..20: mol_type = other DNA
cagttggcaagtggcagagc

SEQ ID NO: 47257 - DNA, 20 bp, synthetic construct
  misc_feature 1..20: note = CRISPR gRNA sequence
  source 1..20: mol_type = other DNA
agttggcaagtggcagagct

SEQ ID NO: 47258 - DNA, 20 bp, synthetic construct
  misc_feature 1..20: note = CRISPR gRNA sequence
  source 1..20: mol_type = other DNA
gttggcaagtggcagagctg

SEQ ID NO: 47259 - DNA, 20 bp, synthetic construct
  misc_feature 1..20: note = CRISPR gRNA sequence
  source 1..20: mol_type = other DNA
gcagagctggggtttgatcc

SEQ ID NO: 47260 - DNA, 20 bp, synthetic construct
  misc_feature 1..20: note = CRISPR gRNA sequence
  source 1..20: mol_type = other DNA
tctgcttgctgccaaattct

SEQ ID NO: 47261 - DNA, 20 bp, synthetic construct
  misc_feature 1..20: note = CRISPR gRNA sequence
  source 1..20: mol_type = other DNA
gcttgctgccaaattcttgg

SEQ ID NO: 47262 - DNA, 20 bp, synthetic construct
  misc_feature 1..20: note = CRISPR gRNA sequence
  source 1..20: mol_type = other DNA
ttgctgccaaattcttggtg

SEQ ID NO: 47263 - DNA, 20 bp, synthetic construct
  misc_feature 1..20: note = CRISPR gRNA sequence
  source 1..20: mol_type = other DNA
ctgccaaattcttggtggag

SEQ ID NO: 47264 - DNA, 20 bp, synthetic construct
  misc_feature 1..20: note = CRISPR gRNA sequence
  source 1..20: mol_type = other DNA
aattcttggtggagtggtcc

SEQ ID NO: 47265 - DNA, 20 bp, synthetic construct
  misc_feature 1..20: note = CRISPR gRNA sequence
  source 1..20: mol_type = other DNA
aagtctcctttgataatccc

SEQ ID NO: 47266 - DNA, 20 bp, synthetic construct
  misc_feature 1..20: note = CRISPR gRNA sequence
  source 1..20: mol_type = other DNA
tcctttgataatccccagcc

SEQ ID NO: 47267 - DNA, 20 bp, synthetic construct
  misc_feature 1..20: note = CRISPR gRNA sequence
  source 1..20: mol_type = other DNA
cctttgataatccccagccc

SEQ ID NO: 47268 - DNA, 20 bp, synthetic construct
  misc_feature 1..20: note = CRISPR gRNA sequence
  source 1..20: mol_type = other DNA
ccaggccctgccgcctcctc

SEQ ID NO: 47269 - DNA, 20 bp, synthetic construct
  misc_feature 1..20: note = CRISPR gRNA sequence
  source 1..20: mol_type = other DNA
caggccctgccgcctcctcc

SEQ ID NO: 47270 - DNA, 20 bp, synthetic construct
  misc_feature 1..20: note = CRISPR gRNA sequence
  source 1..20: mol_type = other DNA
aggccctgccgcctcctcca

SEQ ID NO: 47271 - DNA, 20 bp, synthetic construct
  misc_feature 1..20: note = CRISPR gRNA sequence
  source 1..20: mol_type = other DNA
gccctgccgcctcctccagg

SEQ ID NO: 47272 - DNA, 20 bp, synthetic construct
  misc_feature 1..20: note = CRISPR gRNA sequence
  source 1..20: mol_type = other DNA
cctcctccagggagtcccat

SEQ ID NO: 47273 - DNA, 20 bp, synthetic construct
  misc_feature 1..20: note = CRISPR gRNA sequence
  source 1..20: mol_type = other DNA
ccagggagtcccattagatc

SEQ ID NO: 47274 - DNA, 20 bp, synthetic construct
  misc_feature 1..20: note = CRISPR gRNA sequence
  source 1..20: mol_type = other DNA
cagggagtcccattagatct

SEQ ID NO: 47275 - DNA, 20 bp, synthetic construct
  misc_feature 1..20: note = CRISPR gRNA sequence
  source 1..20: mol_type = other DNA
agggagtcccattagatctg

SEQ ID NO: 47276 - DNA, 20 bp, synthetic construct
  misc_feature 1..20: note = CRISPR gRNA sequence
  source 1..20: mol_type = other DNA
gggagtcccattagatctgg

SEQ ID NO: 47277 - DNA, 20 bp, synthetic construct
  misc_feature 1..20: note = CRISPR gRNA sequence
  source 1..20: mol_type = other DNA
gtcccattagatctgggggt

SEQ ID NO: 47278 - DNA, 20 bp, synthetic construct
  misc_feature 1..20: note = CRISPR gRNA sequence
  source 1..20: mol_type = other DNA
attagatctgggggttggtg

SEQ ID NO: 47279 - DNA, 20 bp, synthetic construct
  misc_feature 1..20: note = CRISPR gRNA sequence
  source 1..20: mol_type = other DNA
acccaccatccctgcccctg

SEQ ID NO: 47280 - DNA, 20 bp, synthetic construct
  misc_feature 1..20: note = CRISPR gRNA sequence
  source 1..20: mol_type = other DNA
cccaccatccctgcccctgc

SEQ ID NO: 47281 - DNA, 20 bp, synthetic construct
  misc_feature 1..20: note = CRISPR gRNA sequence
  source 1..20: mol_type = other DNA
cccctgcaggcctctgttac

SEQ ID NO: 47282 - DNA, 20 bp, synthetic construct
  misc_feature 1..20: note = CRISPR gRNA sequence
  source 1..20: mol_type = other DNA
gcctctgttaccggatgact

SEQ ID NO: 47283 - DNA, 20 bp, synthetic construct
  misc_feature 1..20: note = CRISPR gRNA sequence
  source 1..20: mol_type = other DNA
ttaccggatgacttggatgc

SEQ ID NO: 47284 - DNA, 20 bp, synthetic construct
  misc_feature 1..20: note = CRISPR gRNA sequence
  source 1..20: mol_type = other DNA
tgacttggatgctagacccc

SEQ ID NO: 47285 - DNA, 20 bp, synthetic construct
  misc_feature 1..20: note = CRISPR gRNA sequence
  source 1..20: mol_type = other DNA
gacttggatgctagacccct

SEQ ID NO: 47286 - DNA, 20 bp, synthetic construct
  misc_feature 1..20: note = CRISPR gRNA sequence
  source 1..20: mol_type = other DNA
tggatgctagacccctgggc

SEQ ID NO: 47287 - DNA, 20 bp, synthetic construct
  misc_feature 1..20: note = CRISPR gRNA sequence
  source 1..20: mol_type = other DNA
agacccctgggccagtcctt

SEQ ID NO: 47288 - DNA, 20 bp, synthetic construct
  misc_feature 1..20: note = CRISPR gRNA sequence
  source 1..20: mol_type = other DNA
ccctgggccagtccttcagc

SEQ ID NO: 47289 - DNA, 20 bp, synthetic construct
  misc_feature 1..20: note = CRISPR gRNA sequence
  source 1..20: mol_type = other DNA
cctgggccagtccttcagcc

SEQ ID NO: 47290 - DNA, 20 bp, synthetic construct
  misc_feature 1..20: note = CRISPR gRNA sequence
  source 1..20: mol_type = other DNA
tgggccagtccttcagccag

SEQ ID NO: 47291 - DNA, 20 bp, synthetic construct
  misc_feature 1..20: note = CRISPR gRNA sequence
  source 1..20: mol_type = other DNA
ccagtccttcagccaggagc

SEQ ID NO: 47292 - DNA, 20 bp, synthetic construct
  misc_feature 1..20: note = CRISPR gRNA sequence
  source 1..20: mol_type = other DNA
cagtccttcagccaggagcc

SEQ ID NO: 47293 - DNA, 20 bp, synthetic construct
  misc_feature 1..20: note = CRISPR gRNA sequence
  source 1..20: mol_type = other DNA
agccaggagccaggccccca

SEQ ID NO: 47294 - DNA, 20 bp, synthetic construct
  misc_feature 1..20: note = CRISPR gRNA sequence
  source 1..20: mol_type = other DNA
gctgtgatctgattcttctc

SEQ ID NO: 47295 - DNA, 20 bp, synthetic construct
  misc_feature 1..20: note = CRISPR gRNA sequence
  source 1..20: mol_type = other DNA
ctgtgatctgattcttctcc

SEQ ID NO: 47296 - DNA, 20 bp, synthetic construct
  misc_feature 1..20: note = CRISPR gRNA sequence
  source 1..20: mol_type = other DNA
tgattcttctccaggcttct

SEQ ID NO: 47297 - DNA, 20 bp, synthetic construct
  misc_feature 1..20: note = CRISPR gRNA sequence
  source 1..20: mol_type = other DNA
ttcttctccaggcttctcag

SEQ ID NO: 47298 - DNA, 20 bp, synthetic construct
  misc_feature 1..20: note = CRISPR gRNA sequence
  source 1..20: mol_type = other DNA
tctccaggcttctcagtgga

SEQ ID NO: 47299 - DNA, 20 bp, synthetic construct
  misc_feature 1..20: note = CRISPR gRNA sequence
  source 1..20: mol_type = other DNA
caggcttctcagtggacagt

SEQ ID NO: 47300 - DNA, 20 bp, synthetic construct
  misc_feature 1..20: note = CRISPR gRNA sequence
  source 1..20: mol_type = other DNA
aggcttctcagtggacagtg

SEQ ID NO: 47301 - DNA, 20 bp, synthetic construct
  misc_feature 1..20: note = CRISPR gRNA sequence
  source 1..20: mol_type = other DNA
ggcttctcagtggacagtga

SEQ ID NO: 47302 - DNA, 20 bp, synthetic construct
  misc_feature 1..20: note = CRISPR gRNA sequence
  source 1..20: mol_type = other DNA
gcttctcagtggacagtgag

SEQ ID NO: 47303 - DNA, 20 bp, synthetic construct
  misc_feature 1..20: note = CRISPR gRNA sequence
  source 1..20: mol_type = other DNA
ttctcagtggacagtgaggg

SEQ ID NO: 47304 - DNA, 20 bp, synthetic construct
  misc_feature 1..20: note = CRISPR gRNA sequence
  source 1..20: mol_type = other DNA
tctcagtggacagtgagggg

SEQ ID NO: 47305 - DNA, 20 bp, synthetic construct
  misc_feature 1..20: note = CRISPR gRNA sequence
  source 1..20: mol_type = other DNA
ctcagtggacagtgagggga

SEQ ID NO: 47306 - DNA, 20 bp, synthetic construct
  misc_feature 1..20: note = CRISPR gRNA sequence
  source 1..20: mol_type = other DNA
tcagtggacagtgaggggag

SEQ ID NO: 47307 - DNA, 20 bp, synthetic construct
  misc_feature 1..20: note = CRISPR gRNA sequence
  source 1..20: mol_type = other DNA
tggacagtgaggggagggga

SEQ ID NO: 47308 - DNA, 20 bp, synthetic construct
  misc_feature 1..20: note = CRISPR gRNA sequence
  source 1..20: mol_type = other DNA
gacagtgaggggaggggaaa

SEQ ID NO: 47309 - DNA, 20 bp, synthetic construct
  misc_feature 1..20: note = CRISPR gRNA sequence
  source 1..20: mol_type = other DNA
ggggaggggaaagagaaaca

SEQ ID NO: 47310 - DNA, 20 bp, synthetic construct
  misc_feature 1..20: note = CRISPR gRNA sequence
  source 1..20: mol_type = other DNA
ggaaagagaaacacggccat

SEQ ID NO: 47311 - DNA, 20 bp, synthetic construct
  misc_feature 1..20: note = CRISPR gRNA sequence
  source 1..20: mol_type = other DNA
gagaaacacggccatgagaa

SEQ ID NO: 47312 - DNA, 20 bp, synthetic construct
  misc_feature 1..20: note = CRISPR gRNA sequence
  source 1..20: mol_type = other DNA
agaaacacggccatgagaat

SEQ ID NO: 47313 - DNA, 20 bp, synthetic construct
  misc_feature 1..20: note = CRISPR gRNA sequence
  source 1..20: mol_type = other DNA
acggccatgagaatgggtgt

SEQ ID NO: 47314 - DNA, 20 bp, synthetic construct
  misc_feature 1..20: note = CRISPR gRNA sequence
  source 1..20: mol_type = other DNA
ggccatgagaatgggtgtga

SEQ ID NO: 47315 - DNA, 20 bp, synthetic construct
  misc_feature 1..20: note = CRISPR gRNA sequence
  source 1..20: mol_type = other DNA
gaatgggtgtgagagtttcc

SEQ ID NO: 47316 - DNA, 20 bp, synthetic construct
  misc_feature 1..20: note = CRISPR gRNA sequence
  source 1..20: mol_type = other DNA
aatgggtgtgagagtttcct

SEQ ID NO: 47317 - DNA, 20 bp, synthetic construct
  misc_feature 1..20: note = CRISPR gRNA sequence
  source 1..20: mol_type = other DNA
agtttcctaggtcccttcct

SEQ ID NO: 47318 - DNA, 20 bp, synthetic construct
  misc_feature 1..20: note = CRISPR gRNA sequence
  source 1..20: mol_type = other DNA
gtttcctaggtcccttcctc

SEQ ID NO: 47319 - DNA, 20 bp, synthetic construct
  misc_feature 1..20: note = CRISPR gRNA sequence
  source 1..20: mol_type = other DNA
ctaggtcccttcctcaggcc

SEQ ID NO: 47320 - DNA, 20 bp, synthetic construct
  misc_feature 1..20: note = CRISPR gRNA sequence
  source 1..20: mol_type = other DNA
taggtcccttcctcaggcca

SEQ ID NO: 47321 - DNA, 20 bp, synthetic construct
  misc_feature 1..20: note = CRISPR gRNA sequence
  source 1..20: mol_type = other DNA
tcccttcctcaggccaaggt

SEQ ID NO: 47322 - DNA, 20 bp, synthetic construct
  misc_feature 1..20: note = CRISPR gRNA sequence
  source 1..20: mol_type = other DNA
cccttcctcaggccaaggtc

SEQ ID NO: 47323 - DNA, 20 bp, synthetic construct
  misc_feature 1..20: note = CRISPR gRNA sequence
  source 1..20: mol_type = other DNA
ccttcctcaggccaaggtca

SEQ ID NO: 47324 - DNA, 20 bp, synthetic construct
  misc_feature 1..20: note = CRISPR gRNA sequence
  source 1..20: mol_type = other DNA
cttcctcaggccaaggtcag

SEQ ID NO: 47325 - DNA, 20 bp, synthetic construct
  misc_feature 1..20: note = CRISPR gRNA sequence
  source 1..20: mol_type = other DNA
caggccaaggtcaggggaca

SEQ ID NO: 47326 - DNA, 20 bp, synthetic construct
  misc_feature 1..20: note = CRISPR gRNA sequence
  source 1..20: mol_type = other DNA
agtctcccacactaccttct

SEQ ID NO: 47327 - DNA, 20 bp, synthetic construct
  misc_feature 1..20: note = CRISPR gRNA sequence
  source 1..20: mol_type = other DNA
gtctcccacactaccttctc

SEQ ID NO: 47328 - DNA, 20 bp, synthetic construct
  misc_feature 1..20: note = CRISPR gRNA sequence
  source 1..20: mol_type = other DNA
tctcccacactaccttctca

SEQ ID NO: 47329 - DNA, 20 bp, synthetic construct
  misc_feature 1..20: note = CRISPR gRNA sequence
  source 1..20: mol_type = other DNA
taccttctcagggaacccaa

SEQ ID NO: 47330 - DNA, 20 bp, synthetic construct
  misc_feature 1..20: note = CRISPR gRNA sequence
  source 1..20: mol_type = other DNA
tcagggaacccaaaagacaa

SEQ ID NO: 47331 - DNA, 20 bp, synthetic construct
  misc_feature 1..20: note = CRISPR gRNA sequence
  source 1..20: mol_type = other DNA
cagggaacccaaaagacaac

SEQ ID NO: 47332 - DNA, 20 bp, synthetic construct
  misc_feature 1..20: note = CRISPR gRNA sequence
  source 1..20: mol_type = other DNA
agggaacccaaaagacaaca

SEQ ID NO: 47333 - DNA, 20 bp, synthetic construct
  misc_feature 1..20: note = CRISPR gRNA sequence
  source 1..20: mol_type = other DNA
gggaacccaaaagacaacag

SEQ ID NO: 47334 - DNA, 20 bp, synthetic construct
  misc_feature 1..20: note = CRISPR gRNA sequence
  source 1..20: mol_type = other DNA
cccaaaagacaacaggggac

SEQ ID NO: 47335 - DNA, 20 bp, synthetic construct
  misc_feature 1..20: note = CRISPR gRNA sequence
  source 1..20: mol_type = other DNA
aaaagacaacaggggactgg

SEQ ID NO: 47336 - DNA, 20 bp, synthetic construct
  misc_feature 1..20: note = CRISPR gRNA sequence
  source 1..20: mol_type = other DNA
agacaacaggggactggtgg

SEQ ID NO: 47337 - DNA, 20 bp, synthetic construct
  misc_feature 1..20: note = CRISPR gRNA sequence
  source 1..20: mol_type = other DNA
gacaacaggggactggtggc

SEQ ID NO: 47338 - DNA, 20 bp, synthetic construct
  misc_feature 1..20: note = CRISPR gRNA sequence
  source 1..20: mol_type = other DNA
caggggactggtggcaggtg

SEQ ID NO: 47339 - DNA, 20 bp, synthetic construct
  misc_feature 1..20: note = CRISPR gRNA sequence
  source 1..20: mol_type = other DNA
gggactggtggcaggtgcag

SEQ ID NO: 47340 - DNA, 20 bp, synthetic construct
  misc_feature 1..20: note = CRISPR gRNA sequence
  source 1..20: mol_type = other DNA
ggactggtggcaggtgcagc

SEQ ID NO: 47341 - DNA, 20 bp, synthetic construct
  misc_feature 1..20: note = CRISPR gRNA sequence
  source 1..20: mol_type = other DNA
ctggtggcaggtgcagcagg

SEQ ID NO: 47342 - DNA, 20 bp, synthetic construct
  misc_feature 1..20: note = CRISPR gRNA sequence
  source 1..20: mol_type = other DNA
tggtggcaggtgcagcagga

SEQ ID NO: 47343 - DNA, 20 bp, synthetic construct
  misc_feature 1..20: note = CRISPR gRNA sequence
  source 1..20: mol_type = other DNA
caggtgcagcaggaaggctg

SEQ ID NO: 47344 - DNA, 20 bp, synthetic construct
  misc_feature 1..20: note = CRISPR gRNA sequence
  source 1..20: mol_type = other DNA
aggtgcagcaggaaggctga

SEQ ID NO: 47345 - DNA, 20 bp, synthetic construct
  misc_feature 1..20: note = CRISPR gRNA sequence
  source 1..20: mol_type = other DNA
gcagcaggaaggctgaaggc

SEQ ID NO: 47346 - DNA, 20 bp, synthetic construct
  misc_feature 1..20: note = CRISPR gRNA sequence
  source 1..20: mol_type = other DNA
gaaggctgaaggctagaacc

SEQ ID NO: 47347 - DNA, 20 bp, synthetic construct
  misc_feature 1..20: note = CRISPR gRNA sequence
  source 1..20: mol_type = other DNA
aaggctgaaggctagaaccc

SEQ ID NO: 47348 - DNA, 20 bp, synthetic construct
  misc_feature 1..20: note = CRISPR gRNA sequence
  source 1..20: mol_type = other DNA
aggctgaaggctagaaccca

SEQ ID NO: 47349 - DNA, 20 bp, synthetic construct
  misc_feature 1..20: note = CRISPR gRNA sequence
  source 1..20: mol_type = other DNA
ggctgaaggctagaacccag

SEQ ID NO: 47350 - DNA, 20 bp, synthetic construct
  misc_feature 1..20: note = CRISPR gRNA sequence
  source 1..20: mol_type = other DNA
gctgaaggctagaacccagg

SEQ ID NO: 47351 - DNA, 20 bp, synthetic construct
  misc_feature 1..20: note = CRISPR gRNA sequence
  source 1..20: mol_type = other DNA
gctagaacccagggggaact

SEQ ID NO: 47352 - DNA, 20 bp, synthetic construct
  misc_feature 1..20: note = CRISPR gRNA sequence
  source 1..20: mol_type = other DNA
aacccagggggaactaagcc

SEQ ID NO: 47353 - DNA, 20 bp, synthetic construct
  misc_feature 1..20: note = CRISPR gRNA sequence
  source 1..20: mol_type = other DNA
ccagggggaactaagcctgg

SEQ ID NO: 47354 - DNA, 20 bp, synthetic construct
  misc_feature 1..20: note = CRISPR gRNA sequence
  source 1..20: mol_type = other DNA
cagggggaactaagcctggc

SEQ ID NO: 47355 - DNA, 20 bp, synthetic construct
  misc_feature 1..20: note = CRISPR gRNA sequence
  source 1..20: mol_type = other DNA
agggggaactaagcctggca

SEQ ID NO: 47356 - DNA, 20 bp, synthetic construct
  misc_feature 1..20: note = CRISPR gRNA sequence
  source 1..20: mol_type = other DNA
gggggaactaagcctggcag

SEQ ID NO: 47357 - DNA, 20 bp, synthetic construct
  misc_feature 1..20: note = CRISPR gRNA sequence
  source 1..20: mol_type = other DNA
aactaagcctggcaggggct

SEQ ID NO: 47358 - DNA, 20 bp, synthetic construct
  misc_feature 1..20: note = CRISPR gRNA sequence
  source 1..20: mol_type = other DNA
agcctggcaggggcttggaa

SEQ ID NO: 47359 - DNA, 20 bp, synthetic construct
  misc_feature 1..20: note = CRISPR gRNA sequence
  source 1..20: mol_type = other DNA
gcctggcaggggcttggaac

SEQ ID NO: 47360 - DNA, 20 bp, synthetic construct
  misc_feature 1..20: note = CRISPR gRNA sequence
  source 1..20: mol_type = other DNA
ggcaggggcttggaacaggc

SEQ ID NO: 47361 - DNA, 20 bp, synthetic construct
  misc_feature 1..20: note = CRISPR gRNA sequence
  source 1..20: mol_type = other DNA
caggggcttggaacaggcca

SEQ ID NO: 47362 - DNA, 20 bp, synthetic construct
  misc_feature 1..20: note = CRISPR gRNA sequence
  source 1..20: mol_type = other DNA
caggccagagtgtgcaactc

SEQ ID NO: 47363 - DNA, 20 bp, synthetic construct
  misc_feature 1..20: note = CRISPR gRNA sequence
  source 1..20: mol_type = other DNA
aggccagagtgtgcaactca

SEQ ID NO: 47364 - DNA, 20 bp, synthetic construct
  misc_feature 1..20: note = CRISPR gRNA sequence
  source 1..20: mol_type = other DNA
ccagagtgtgcaactcaagg

SEQ ID NO: 47365 - DNA, 20 bp, synthetic construct
  misc_feature 1..20: note = CRISPR gRNA sequence
  source 1..20: mol_type = other DNA
cagagtgtgcaactcaagga

SEQ ID NO: 47366 - DNA, 20 bp, synthetic construct
  misc_feature 1..20: note = CRISPR gRNA sequence
  source 1..20: mol_type = other DNA
agagtgtgcaactcaaggaa

SEQ ID NO: 47367 - DNA, 20 bp, synthetic construct
  misc_feature 1..20: note = CRISPR gRNA sequence
  source 1..20: mol_type = other DNA
caactcaaggaagggctttc

SEQ ID NO: 47368 - DNA, 20 bp, synthetic construct
  misc_feature 1..20: note = CRISPR gRNA sequence
  source 1..20: mol_type = other DNA
aactcaaggaagggctttct

SEQ ID NO: 47369 - DNA, 20 bp, synthetic construct
  misc_feature 1..20: note = CRISPR gRNA sequence
  source 1..20: mol_type = other DNA
ctcaaggaagggctttctgg

SEQ ID NO: 47370 - DNA, 20 bp, synthetic construct
  misc_feature 1..20: note = CRISPR gRNA sequence
  source 1..20: mol_type = other DNA
tcaaggaagggctttctggg

SEQ ID NO: 47371 - DNA, 20 bp, synthetic construct
  misc_feature 1..20: note = CRISPR gRNA sequence
  source 1..20: mol_type = other DNA
aggaagggctttctgggagg

SEQ ID NO: 47372 - DNA, 20 bp, synthetic construct
  misc_feature 1..20: note = CRISPR gRNA sequence
  source 1..20: mol_type = other DNA
ggaagggctttctgggaggc

SEQ ID NO: 47373 - DNA, 20 bp, synthetic construct
  misc_feature 1..20: note = CRISPR gRNA sequence
  source 1..20: mol_type = other DNA
gaagggctttctgggaggca

SEQ ID NO: 47374 - DNA, 20 bp, synthetic construct
  misc_feature 1..20: note = CRISPR gRNA sequence
  source 1..20: mol_type = other DNA
aagggctttctgggaggcag

SEQ ID NO: 47375 - DNA, 20 bp, synthetic construct
  misc_feature 1..20: note = CRISPR gRNA sequence
  source 1..20: mol_type = other DNA
tgggaggcaggggactgacc

SEQ ID NO: 47376 - DNA, 20 bp, synthetic construct
  misc_feature 1..20: note = CRISPR gRNA sequence
  source 1..20: mol_type = other DNA
gaggcaggggactgacccag

SEQ ID NO: 47377 - DNA, 20 bp, synthetic construct
  misc_feature 1..20: note = CRISPR gRNA sequence
  source 1..20: mol_type = other DNA
ggactgacccagtggcctct

SEQ ID NO: 47378 - DNA, 20 bp, synthetic construct
  misc_feature 1..20: note = CRISPR gRNA sequence
  source 1..20: mol_type = other DNA
cagtggcctcttggtgttcc

SEQ ID NO: 47379 - DNA, 20 bp, synthetic construct
  misc_feature 1..20: note = CRISPR gRNA sequence
  source 1..20: mol_type = other DNA
agtggcctcttggtgttccc

SEQ ID NO: 47380 - DNA, 20 bp, synthetic construct
  misc_feature 1..20: note = CRISPR gRNA sequence
  source 1..20: mol_type = other DNA
ctcttggtgttcccgggatg

SEQ ID NO: 47381 - DNA, 20 bp, synthetic construct
  misc_feature 1..20: note = CRISPR gRNA sequence
  source 1..20: mol_type = other DNA
tcttggtgttcccgggatgt

SEQ ID NO: 47382 - DNA, 20 bp, synthetic construct
  misc_feature 1..20: note = CRISPR gRNA sequence
  source 1..20: mol_type = other DNA
ccgggatgtaggtccccctt

SEQ ID NO: 47383 - DNA, 20 bp, synthetic construct
  misc_feature 1..20: note = CRISPR gRNA sequence
  source 1..20: mol_type = other DNA
agcccgtcccattcctcccc

SEQ ID NO: 47384 - DNA, 20 bp, synthetic construct
  misc_feature 1..20: note = CRISPR gRNA sequence
  source 1..20: mol_type = other DNA
ccctcatactccactctctt

SEQ ID NO: 47385 - DNA, 20 bp, synthetic construct
  misc_feature 1..20: note = CRISPR gRNA sequence
  source 1..20: mol_type = other DNA
catactccactctcttcagc

SEQ ID NO: 47386 - DNA, 20 bp, synthetic construct
  misc_feature 1..20: note = CRISPR gRNA sequence
  source 1..20: mol_type = other DNA
ctcttcagccggcccatctg

SEQ ID NO: 47387 - DNA, 20 bp, synthetic construct
  misc_feature 1..20: note = CRISPR gRNA sequence
  source 1..20: mol_type = other DNA
ttcagccggcccatctgcgg

SEQ ID NO: 47388 - DNA, 20 bp, synthetic construct
  misc_feature 1..20: note = CRISPR gRNA sequence
  source 1..20: mol_type = other DNA
ggcccatctgcggcagcacc

SEQ ID NO: 47389 - DNA, 20 bp, synthetic construct
  misc_feature 1..20: note = CRISPR gRNA sequence
  source 1..20: mol_type = other DNA
gcccatctgcggcagcacct

SEQ ID NO: 47390 - DNA, 20 bp, synthetic construct
  misc_feature 1..20: note = CRISPR gRNA sequence
  source 1..20: mol_type = other DNA
atctgcggcagcacctgggc

SEQ ID NO: 47391 - DNA, 20 bp, synthetic construct
  misc_feature 1..20: note = CRISPR gRNA sequence
  source 1..20: mol_type = other DNA
cggcagcacctgggccagct

SEQ ID NO: 47392 - DNA, 20 bp, synthetic construct
  misc_feature 1..20: note = CRISPR gRNA sequence
  source 1..20: mol_type = other DNA
cagcacctgggccagctcgg

SEQ ID NO: 47393 - DNA, 20 bp, synthetic construct
  misc_feature 1..20: note = CRISPR gRNA sequence
  source 1..20: mol_type = other DNA
tcggcagctgcctcatcccc

SEQ ID NO: 47394 - DNA, 20 bp, synthetic construct
  misc_feature 1..20: note = CRISPR gRNA sequence
  source 1..20: mol_type = other DNA
cggcagctgcctcatccccg

SEQ ID NO: 47395 - DNA, 20 bp, synthetic construct
  misc_feature 1..20: note = CRISPR gRNA sequence
  source 1..20: mol_type = other DNA
gcagctgcctcatccccgag

SEQ ID NO: 47396 - DNA, 20 bp, synthetic construct
  misc_feature 1..20: note = CRISPR gRNA sequence
  source 1..20: mol_type = other DNA
cctcatccccgaggagattc

SEQ ID NO: 47397 - DNA, 20 bp, synthetic construct
  misc_feature 1..20: note = CRISPR gRNA sequence
  source 1..20: mol_type = other DNA
ctcatccccgaggagattcc

SEQ ID NO: 47398 - DNA, 20 bp, synthetic construct
  misc_feature 1..20: note = CRISPR gRNA sequence
  source 1..20: mol_type = other DNA
tccccgaggagattccagga

SEQ ID NO: 47399 - DNA, 20 bp, synthetic construct
  misc_feature 1..20: note = CRISPR gRNA sequence
  source 1..20: mol_type = other DNA
ggagattccaggacagcctg

SEQ ID NO: 47400 - DNA, 20 bp, synthetic construct
  misc_feature 1..20: note = CRISPR gRNA sequence
  source 1..20: mol_type = other DNA
gagattccaggacagcctgc

SEQ ID NO: 47401 - DNA, 20 bp, synthetic construct
  misc_feature 1..20: note = CRISPR gRNA sequence
  source 1..20: mol_type = other DNA
agattccaggacagcctgca

SEQ ID NO: 47402 - DNA, 20 bp, synthetic construct
  misc_feature 1..20: note = CRISPR gRNA sequence
  source 1..20: mol_type = other DNA
ttccaggacagcctgcaggg

SEQ ID NO: 47403 - DNA, 20 bp, synthetic construct
  misc_feature 1..20: note = CRISPR gRNA sequence
  source 1..20: mol_type = other DNA
tccaggacagcctgcagggt

SEQ ID NO: 47404 - DNA, 20 bp, synthetic construct
  misc_feature 1..20: note = CRISPR gRNA sequence
  source 1..20: mol_type = other DNA
ccaggacagcctgcagggta

SEQ ID NO: 47405 - DNA, 20 bp, synthetic construct
  misc_feature 1..20: note = CRISPR gRNA sequence
  source 1..20: mol_type = other DNA
caggacagcctgcagggtag

SEQ ID NO: 47406 - DNA, 20 bp, synthetic construct
  misc_feature 1..20: note = CRISPR gRNA sequence
  source 1..20: mol_type = other DNA
cctgcagggtaggggtccca

SEQ ID NO: 47407 - DNA, 20 bp, synthetic construct
  misc_feature 1..20: note = CRISPR gRNA sequence
  source 1..20: mol_type = other DNA
cagggtaggggtcccaaagt

SEQ ID NO: 47408 - DNA, 20 bp, synthetic construct
  misc_feature 1..20: note = CRISPR gRNA sequence
  source 1..20: mol_type = other DNA
ggtaggggtcccaaagtcag

SEQ ID NO: 47409 - DNA, 20 bp, synthetic construct
  misc_feature 1..20: note = CRISPR gRNA sequence
  source 1..20: mol_type = other DNA
aggggtcccaaagtcagcgg

SEQ ID NO: 47410 - DNA, 20 bp, synthetic construct
  misc_feature 1..20: note = CRISPR gRNA sequence
  source 1..20: mol_type = other DNA
ggggtcccaaagtcagcggc

SEQ ID NO: 47411 - DNA, 20 bp, synthetic construct
  misc_feature 1..20: note = CRISPR gRNA sequence
  source 1..20: mol_type = other DNA
ggtcccaaagtcagcggcag

SEQ ID NO: 47412 - DNA, 20 bp, synthetic construct
  misc_feature 1..20: note = CRISPR gRNA sequence
  source 1..20: mol_type = other DNA
tcccaaagtcagcggcagga

SEQ ID NO: 47413 - DNA, 20 bp, synthetic construct
  misc_feature 1..20: note = CRISPR gRNA sequence
  source 1..20: mol_type = other DNA
aaagtcagcggcaggagagc

SEQ ID NO: 47414 - DNA, 20 bp, synthetic construct
  misc_feature 1..20: note = CRISPR gRNA sequence
  source 1..20: mol_type = other DNA
aagtcagcggcaggagagca

SEQ ID NO: 47415 - DNA, 20 bp, synthetic construct
  misc_feature 1..20: note = CRISPR gRNA sequence
  source 1..20: mol_type = other DNA
gtcagcggcaggagagcaag

SEQ ID NO: 47416 - DNA, 20 bp, synthetic construct
  misc_feature 1..20: note = CRISPR gRNA sequence
  source 1..20: mol_type = other DNA
tcagcggcaggagagcaagg

SEQ ID NO: 47417 - DNA, 20 bp, synthetic construct
  misc_feature 1..20: note = CRISPR gRNA sequence
  source 1..20: mol_type = other DNA
ggcaggagagcaaggaggtc

SEQ ID NO: 47418 - DNA, 20 bp, synthetic construct
  misc_feature 1..20: note = CRISPR gRNA sequence
  source 1..20: mol_type = other DNA
gcaggagagcaaggaggtcg

SEQ ID NO: 47419 - DNA, 20 bp, synthetic construct
  misc_feature 1..20: note = CRISPR gRNA sequence
  source 1..20: mol_type = other DNA
caggagagcaaggaggtcga

SEQ ID NO: 47420 - DNA, 20 bp, synthetic construct
  misc_feature 1..20: note = CRISPR gRNA sequence
  source 1..20: mol_type = other DNA
aggagagcaaggaggtcgag

SEQ ID NO: 47421 - DNA, 20 bp, synthetic construct
  misc_feature 1..20: note = CRISPR gRNA sequence
  source 1..20: mol_type = other DNA
agagcaaggaggtcgagggg

SEQ ID NO: 47422 - DNA, 20 bp, synthetic construct
  misc_feature 1..20: note = CRISPR gRNA sequence
  source 1..20: mol_type = other DNA
agcaaggaggtcgaggggtg

SEQ ID NO: 47423 - DNA, 20 bp, synthetic construct
  misc_feature 1..20: note = CRISPR gRNA sequence
  source 1..20: mol_type = other DNA
ggaggtcgaggggtggagac

SEQ ID NO: 47424 - DNA, 20 bp, synthetic construct
  misc_feature 1..20: note = CRISPR gRNA sequence
  source 1..20: mol_type = other DNA
gaggtcgaggggtggagaca

SEQ ID NO: 47425 - DNA, 20 bp, synthetic construct
  misc_feature 1..20: note = CRISPR gRNA sequence
  source 1..20: mol_type = other DNA
gtcgaggggtggagacaagg

SEQ ID NO: 47426 - DNA, 20 bp, synthetic construct
  misc_feature 1..20: note = CRISPR gRNA sequence
  source 1..20: mol_type = other DNA
ggtggagacaaggcagtgaa

SEQ ID NO: 47427 - DNA, 20 bp, synthetic construct
  misc_feature 1..20: note = CRISPR gRNA sequence
  source 1..20: mol_type = other DNA
gtggagacaaggcagtgaat

SEQ ID NO: 47428 - DNA, 20 bp, synthetic construct
  misc_feature 1..20: note = CRISPR gRNA sequence
  source 1..20: mol_type = other DNA
tggagacaaggcagtgaatg

SEQ ID NO: 47429 - DNA, 20 bp, synthetic construct
  misc_feature 1..20: note = CRISPR gRNA sequence
  source 1..20: mol_type = other DNA
gacaaggcagtgaatgggga

SEQ ID NO: 47430 - DNA, 20 bp, synthetic construct
  misc_feature 1..20: note = CRISPR gRNA sequence
  source 1..20: mol_type = other DNA
aaggcagtgaatggggaaag

SEQ ID NO: 47431 - DNA, 20 bp, synthetic construct
  misc_feature 1..20: note = CRISPR gRNA sequence
  source 1..20: mol_type = other DNA
aggcagtgaatggggaaagc

SEQ ID NO: 47432 - DNA, 20 bp, synthetic construct
  misc_feature 1..20: note = CRISPR gRNA sequence
  source 1..20: mol_type = other DNA
ggcagtgaatggggaaagca

SEQ ID NO: 47433 - DNA, 20 bp, synthetic construct
  misc_feature 1..20: note = CRISPR gRNA sequence
  source 1..20: mol_type = other DNA
gaatggggaaagcagggtgc

SEQ ID NO: 47434 - DNA, 20 bp, synthetic construct
  misc_feature 1..20: note = CRISPR gRNA sequence
  source 1..20: mol_type = other DNA
ggaaagcagggtgccagtcg

SEQ ID NO: 47435 - DNA, 20 bp, synthetic construct
  misc_feature 1..20: note = CRISPR gRNA sequence
  source 1..20: mol_type = other DNA
gaaagcagggtgccagtcgt

SEQ ID NO: 47436 - DNA, 20 bp, synthetic construct
  misc_feature 1..20: note = CRISPR gRNA sequence
  source 1..20: mol_type = other DNA
aaagcagggtgccagtcgtg

SEQ ID NO: 47437 - DNA, 20 bp, synthetic construct
  misc_feature 1..20: note = CRISPR gRNA sequence
  source 1..20: mol_type = other DNA
aagcagggtgccagtcgtgg

SEQ ID NO: 47438 - DNA, 20 bp, synthetic construct
  misc_feature 1..20: note = CRISPR gRNA sequence
  source 1..20: mol_type = other DNA
agggtgccagtcgtgggggc

SEQ ID NO: 47439 - DNA, 20 bp, synthetic construct
  misc_feature 1..20: note = CRISPR gRNA sequence
  source 1..20: mol_type = other DNA
gggtgccagtcgtgggggca

SEQ ID NO: 47440 - DNA, 20 bp, synthetic construct
  misc_feature 1..20: note = CRISPR gRNA sequence
  source 1..20: mol_type = other DNA
ggtgccagtcgtgggggcaa

SEQ ID NO: 47441 - DNA, 20 bp, synthetic construct
  misc_feature 1..20: note = CRISPR gRNA sequence
  source 1..20: mol_type = other DNA
tcgtgggggcaagggttttc

SEQ ID NO: 47442 - DNA, 20 bp, synthetic construct
  misc_feature 1..20: note = CRISPR gRNA sequence
  source 1..20: mol_type = other DNA
gtgggggcaagggttttcaa

SEQ ID NO: 47443 - DNA, 20 bp, synthetic construct
  misc_feature 1..20: note = CRISPR gRNA sequence
  source 1..20: mol_type = other DNA
gggggcaagggttttcaaga

SEQ ID NO: 47444 - DNA, 20 bp, synthetic construct
  misc_feature 1..20: note = CRISPR gRNA sequence
  source 1..20: mol_type = other DNA
ggggcaagggttttcaagag

SEQ ID NO: 47445 - DNA, 20 bp, synthetic construct
  misc_feature 1..20: note = CRISPR gRNA sequence
  source 1..20: mol_type = other DNA
tttcaagagaggccacctga

SEQ ID NO: 47446 - DNA, 20 bp, synthetic construct
  misc_feature 1..20: note = CRISPR gRNA sequence
  source 1..20: mol_type = other DNA
ttcaagagaggccacctgat

SEQ ID NO: 47447 - DNA, 20 bp, synthetic construct
  misc_feature 1..20: note = CRISPR gRNA sequence
  source 1..20: mol_type = other DNA
tcaagagaggccacctgata

SEQ ID NO: 47448 - DNA, 20 bp, synthetic construct
  misc_feature 1..20: note = CRISPR gRNA sequence
  source 1..20: mol_type = other DNA
tgcttgtgtgtcctcccctg

SEQ ID NO: 47449 - DNA, 20 bp, synthetic construct
  misc_feature 1..20: note = CRISPR gRNA sequence
  source 1..20: mol_type = other DNA
gtgtcctcccctgaagacgt

SEQ ID NO: 47450 - DNA, 20 bp, synthetic construct
  misc_feature 1..20: note = CRISPR gRNA sequence
  source 1..20: mol_type = other DNA
tgtcctcccctgaagacgtc

SEQ ID NO: 47451 - DNA, 20 bp, synthetic construct
  misc_feature 1..20: note = CRISPR gRNA sequence
  source 1..20: mol_type = other DNA
gtcctcccctgaagacgtca

SEQ ID NO: 47452 - DNA, 20 bp, synthetic construct
  misc_feature 1..20: note = CRISPR gRNA sequence
  source 1..20: mol_type = other DNA
cccctgaagacgtcagggtg

SEQ ID NO: 47453 - DNA, 20 bp, synthetic construct
  misc_feature 1..20: note = CRISPR gRNA sequence
  source 1..20: mol_type = other DNA
ccctgaagacgtcagggtgc

SEQ ID NO: 47454 - DNA, 20 bp, synthetic construct
  misc_feature 1..20: note = CRISPR gRNA sequence
  source 1..20: mol_type = other DNA
tccctgctcccctccccgtc

SEQ ID NO: 47455 - DNA, 20 bp, synthetic construct
  misc_feature 1..20: note = CRISPR gRNA sequence
  source 1..20: mol_type = other DNA
tgaatcatgacgttgttcac

SEQ ID NO: 47456 - DNA, 20 bp, synthetic construct
  misc_feature 1..20: note = CRISPR gRNA sequence
  source 1..20: mol_type = other DNA
tacatgtacctcctgtattt

SEQ ID NO: 47457 - DNA, 20 bp, synthetic construct
  misc_feature 1..20: note = CRISPR gRNA sequence
  source 1..20: mol_type = other DNA
catcatatttttctttaaat

SEQ ID NO: 47458 - DNA, 20 bp, synthetic construct
  misc_feature 1..20: note = CRISPR gRNA sequence
  source 1..20: mol_type = other DNA
ttactttaaaaaattaatct

SEQ ID NO: 47459 - DNA, 20 bp, synthetic construct
  misc_feature 1..20: note = CRISPR gRNA sequence
  source 1..20: mol_type = other DNA
tttaaaaaattaatcttggc

SEQ ID NO: 47460 - DNA, 20 bp, synthetic construct
  misc_feature 1..20: note = CRISPR gRNA sequence
  source 1..20: mol_type = other DNA
ttaaaaaattaatcttggct

SEQ ID NO: 47461 - DNA, 20 bp, synthetic construct
  misc_feature 1..20: note = CRISPR gRNA sequence
  source 1..20: mol_type = other DNA
aaattaatcttggctgggcg

SEQ ID NO: 47462 - DNA, 20 bp, synthetic construct
  misc_feature 1..20: note = CRISPR gRNA sequence
  source 1..20: mol_type = other DNA
gttgctcacgcctgtaatcc

SEQ ID NO: 47463 - DNA, 20 bp, synthetic construct
  misc_feature 1..20: note = CRISPR gRNA sequence
  source 1..20: mol_type = other DNA
cgcctgtaatcccagcactt

SEQ ID NO: 47464 - DNA, 20 bp, synthetic construct
  misc_feature 1..20: note = CRISPR gRNA sequence
  source 1..20: mol_type = other DNA
gcctgtaatcccagcacttt

SEQ ID NO: 47465 - DNA, 20 bp, synthetic construct
  misc_feature 1..20: note = CRISPR gRNA sequence
  source 1..20: mol_type = other DNA
ctgtaatcccagcactttgg

SEQ ID NO: 47466 - DNA, 20 bp, synthetic construct
  misc_feature 1..20: note = CRISPR gRNA sequence
  source 1..20: mol_type = other DNA
tgtaatcccagcactttggg

SEQ ID NO: 47467 - DNA, 20 bp, synthetic construct
  misc_feature 1..20: note = CRISPR gRNA sequence
  source 1..20: mol_type = other DNA
tcccagcactttgggaggcc

SEQ ID NO: 47468 - DNA, 20 bp, synthetic construct
  misc_feature 1..20: note = CRISPR gRNA sequence
  source 1..20: mol_type = other DNA
cccagcactttgggaggcca

SEQ ID NO: 47469 - DNA, 20 bp, synthetic construct
  misc_feature 1..20: note = CRISPR gRNA sequence
  source 1..20: mol_type = other DNA
gcactttgggaggccaaggt

SEQ ID NO: 47470 - DNA, 20 bp, synthetic construct
  misc_feature 1..20: note = CRISPR gRNA sequence
  source 1..20: mol_type = other DNA
cactttgggaggccaaggtc

SEQ ID NO: 47471 - DNA, 20 bp, synthetic construct
  misc_feature 1..20: note = CRISPR gRNA sequence
  source 1..20: mol_type = other DNA
gaggccaaggtcaggtgttt

SEQ ID NO: 47472 - DNA, 20 bp, synthetic construct
  misc_feature 1..20: note = CRISPR gRNA sequence
  source 1..20: mol_type = other DNA
caaggtcaggtgtttgagac

SEQ ID NO: 47473 - DNA, 20 bp, synthetic construct
  misc_feature 1..20: note = CRISPR gRNA sequence
  source 1..20: mol_type = other DNA
tgagacgagcctaaccaaca

SEQ ID NO: 47474 - DNA, 20 bp, synthetic construct
  misc_feature 1..20: note = CRISPR gRNA sequence
  source 1..20: mol_type = other DNA
tctactaaaaatacaaaaat

SEQ ID NO: 47475 - DNA, 20 bp, synthetic construct
  misc_feature 1..20: note = CRISPR gRNA sequence
  source 1..20: mol_type = other DNA
ctaaaaatacaaaaattagc

SEQ ID NO: 47476 - DNA, 20 bp, synthetic construct
  misc_feature 1..20: note = CRISPR gRNA sequence
  source 1..20: mol_type = other DNA
taaaaatacaaaaattagct

SEQ ID NO: 47477 - DNA, 20 bp, synthetic construct
  misc_feature 1..20: note = CRISPR gRNA sequence
  source 1..20: mol_type = other DNA
atacaaaaattagctgggtg

SEQ ID NO: 47478 - DNA, 20 bp, synthetic construct
  misc_feature 1..20: note = CRISPR gRNA sequence
  source 1..20: mol_type = other DNA
caaaaattagctgggtgtgg

SEQ ID NO: 47479 - DNA, 20 bp, synthetic construct
  misc_feature 1..20: note = CRISPR gRNA sequence
  source 1..20: mol_type = other DNA
aaattagctgggtgtggtgg

SEQ ID NO: 47480 - DNA, 20 bp, synthetic construct
  misc_feature 1..20: note = CRISPR gRNA sequence
  source 1..20: mol_type = other DNA
aattagctgggtgtggtggt

SEQ ID NO: 47481 - DNA, 20 bp, synthetic construct
  misc_feature 1..20: note = CRISPR gRNA sequence
  source 1..20: mol_type = other DNA
gtggtgggcacttgtaatcc

SEQ ID NO: 47482 - DNA, 20 bp, synthetic construct
  misc_feature 1..20: note = CRISPR gRNA sequence
  source 1..20: mol_type = other DNA
cacttgtaatcccagctact

SEQ ID NO: 47483 - DNA, 20 bp, synthetic construct
  misc_feature 1..20: note = CRISPR gRNA sequence
  source 1..20: mol_type = other DNA
acttgtaatcccagctactc

SEQ ID NO: 47484 - DNA, 20 bp, synthetic construct
  misc_feature 1..20: note = CRISPR gRNA sequence
  source 1..20: mol_type = other DNA
ttgtaatcccagctactcag

SEQ ID NO: 47485 - DNA, 20 bp, synthetic construct
  misc_feature 1..20: note = CRISPR gRNA sequence
  source 1..20: mol_type = other DNA
tgtaatcccagctactcagg

SEQ ID NO: 47486 - DNA, 20 bp, synthetic construct
  misc_feature 1..20: note = CRISPR gRNA sequence
  source 1..20: mol_type = other DNA
tcccagctactcaggaggct

SEQ ID NO: 47487 - DNA, 20 bp, synthetic construct
  misc_feature 1..20: note = CRISPR gRNA sequence
  source 1..20: mol_type = other DNA
cccagctactcaggaggctg

SEQ ID NO: 47488 - DNA, 20 bp, synthetic construct
  misc_feature 1..20: note = CRISPR gRNA sequence
  source 1..20: mol_type = other DNA
agctactcaggaggctgagg

SEQ ID NO: 47489 - DNA, 20 bp, synthetic construct
  misc_feature 1..20: note = CRISPR gRNA sequence
  source 1..20: mol_type = other DNA
gctactcaggaggctgaggc

SEQ ID NO: 47490 - DNA, 20 bp, synthetic construct
  misc_feature 1..20: note = CRISPR gRNA sequence
  source 1..20: mol_type = other DNA
tactcaggaggctgaggcag

SEQ ID NO: 47491 - DNA, 20 bp, synthetic construct
  misc_feature 1..20: note = CRISPR gRNA sequence
  source 1..20: mol_type = other DNA
gcaggagaatctcttgaacc

SEQ ID NO: 47492 - DNA, 20 bp, synthetic construct
  misc_feature 1..20: note = CRISPR gRNA sequence
  source 1..20: mol_type = other DNA
ggagaatctcttgaacccgg

SEQ ID NO: 47493 - DNA, 20 bp, synthetic construct
  misc_feature 1..20: note = CRISPR gRNA sequence
  source 1..20: mol_type = other DNA
gagaatctcttgaacccggc

SEQ ID NO: 47494 - DNA, 20 bp, synthetic construct
  misc_feature 1..20: note = CRISPR gRNA sequence
  source 1..20: mol_type = other DNA
aatctcttgaacccggcagg

SEQ ID NO: 47495 - DNA, 20 bp, synthetic construct
  misc_feature 1..20: note = CRISPR gRNA sequence
  source 1..20: mol_type = other DNA
tctcttgaacccggcaggtg

SEQ ID NO: 47496 - DNA, 20 bp, synthetic construct
  misc_feature 1..20: note = CRISPR gRNA sequence
  source 1..20: mol_type = other DNA
ctcttgaacccggcaggtgg

SEQ ID NO: 47497 - DNA, 20 bp, synthetic construct
  misc_feature 1..20: note = CRISPR gRNA sequence
  source 1..20: mol_type = other DNA
aacccggcaggtggaggttg

SEQ ID NO: 47498 - DNA, 20 bp, synthetic construct
  misc_feature 1..20: note = CRISPR gRNA sequence
  source 1..20: mol_type = other DNA
cggcaggtggaggttgcagt

SEQ ID NO: 47499 - DNA, 20 bp, synthetic construct
  misc_feature 1..20: note = CRISPR gRNA sequence
  source 1..20: mol_type = other DNA
ggtggaggttgcagtgagcc

SEQ ID NO: 47500 - DNA, 20 bp, synthetic construct
  misc_feature 1..20: note = CRISPR gRNA sequence
  source 1..20: mol_type = other DNA
gagattgcaccactgcactc

SEQ ID NO: 47501 - DNA, 20 bp, synthetic construct
  misc_feature 1..20: note = CRISPR gRNA sequence
  source 1..20: mol_type = other DNA
tgcaccactgcactccagcc

SEQ ID NO: 47502 - DNA, 20 bp, synthetic construct
  misc_feature 1..20: note = CRISPR gRNA sequence
  source 1..20: mol_type = other DNA
gcaccactgcactccagcct

SEQ ID NO: 47503 - DNA, 20 bp, synthetic construct
  misc_feature 1..20: note = CRISPR gRNA sequence
  source 1..20: mol_type = other DNA
ctgcactccagcctgggtaa

SEQ ID NO: 47504 - DNA, 20 bp, synthetic construct
  misc_feature 1..20: note = CRISPR gRNA sequence
  source 1..20: mol_type = other DNA
gcactccagcctgggtaaca

SEQ ID NO: 47505 - DNA, 20 bp, synthetic construct
  misc_feature 1..20: note = CRISPR gRNA sequence
  source 1..20: mol_type = other DNA
cactccagcctgggtaacag

SEQ ID NO: 47506 - DNA, 20 bp, synthetic construct
  misc_feature 1..20: note = CRISPR gRNA sequence
  source 1..20: mol_type = other DNA
actccagcctgggtaacaga

SEQ ID NO: 47507 - DNA, 20 bp, synthetic construct
  misc_feature 1..20: note = CRISPR gRNA sequence
  source 1..20: mol_type = other DNA
tccagcctgggtaacagagg

SEQ ID NO: 47508 - DNA, 20 bp, synthetic construct
  misc_feature 1..20: note = CRISPR gRNA sequence
  source 1..20: mol_type = other DNA
aaaaaaaaaaaaaatcttga

SEQ ID NO: 47509 - DNA, 20 bp, synthetic construct
  misc_feature 1..20: note = CRISPR gRNA sequence
  source 1..20: mol_type = other DNA
aaaaaaaaaaaaatcttgaa

SEQ ID NO: 47510 - DNA, 20 bp, synthetic construct
  misc_feature 1..20: note = CRISPR gRNA sequence
  source 1..20: mol_type = other DNA
acttttattgctactatcaa

SEQ ID NO: 47511 - DNA, 20 bp, synthetic construct
  misc_feature 1..20: note = CRISPR gRNA sequence
  source 1..20: mol_type = other DNA
tcaatggaaaacttgtgtta

SEQ ID NO: 47512 - DNA, 20 bp, synthetic construct
  misc_feature 1..20: note = CRISPR gRNA sequence
  source 1..20: mol_type = other DNA
cttgtgttacagactccata

SEQ ID NO: 47513 - DNA, 20 bp, synthetic construct
  misc_feature 1..20: note = CRISPR gRNA sequence
  source 1..20: mol_type = other DNA
gtgttacagactccatatag

SEQ ID NO: 47514 - DNA, 20 bp, synthetic construct
  misc_feature 1..20: note = CRISPR gRNA sequence
  source 1..20: mol_type = other DNA
tgttacagactccatataga

SEQ ID NO: 47515 - DNA, 20 bp, synthetic construct
  misc_feature 1..20: note = CRISPR gRNA sequence
  source 1..20: mol_type = other DNA
tacagactccatatagaagg

SEQ ID NO: 47516 - DNA, 20 bp, synthetic construct
  misc_feature 1..20: note = CRISPR gRNA sequence
  source 1..20: mol_type = other DNA
ggtagttacaaaaataaata

SEQ ID NO: 47517 - DNA, 20 bp, synthetic construct
  misc_feature 1..20: note = CRISPR gRNA sequence
  source 1..20: mol_type = other DNA
aataaatatagtacaaacaa

SEQ ID NO: 47518 - DNA, 20 bp, synthetic construct
  misc_feature 1..20: note = CRISPR gRNA sequence
  source 1..20: mol_type = other DNA
caaacaatggtattaacttc

SEQ ID NO: 47519 - DNA, 20 bp, synthetic construct
  misc_feature 1..20: note = CRISPR gRNA sequence
  source 1..20: mol_type = other DNA
caatggtattaacttctagt

SEQ ID NO: 47520 - DNA, 20 bp, synthetic construct
  misc_feature 1..20: note = CRISPR gRNA sequence
  source 1..20: mol_type = other DNA
ttggaacatatgcccttcct

SEQ ID NO: 47521 - DNA, 20 bp, synthetic construct
  misc_feature 1..20: note = CRISPR gRNA sequence
  source 1..20: mol_type = other DNA
atatgcccttcctaagatgt

SEQ ID NO: 47522 - DNA, 20 bp, synthetic construct
  misc_feature 1..20: note = CRISPR gRNA sequence
  source 1..20: mol_type = other DNA
tatgcccttcctaagatgtt

SEQ ID NO: 47523 - DNA, 20 bp, synthetic construct
  misc_feature 1..20: note = CRISPR gRNA sequence
  source 1..20: mol_type = other DNA
tgttgggtttttaacccttt

SEQ ID NO: 47524 - DNA, 20 bp, synthetic construct
  misc_feature 1..20: note = CRISPR gRNA sequence
  source 1..20: mol_type = other DNA
ttttaacccttttggttaaa

SEQ ID NO: 47525 - DNA, 20 bp, synthetic construct
  misc_feature 1..20: note = CRISPR gRNA sequence
  source 1..20: mol_type = other DNA
tttaacccttttggttaaaa

SEQ ID NO: 47526 - DNA, 20 bp, synthetic construct
  misc_feature 1..20: note = CRISPR gRNA sequence
  source 1..20: mol_type = other DNA
ttaacccttttggttaaaaa

SEQ ID NO: 47527 - DNA, 20 bp, synthetic construct
  misc_feature 1..20: note = CRISPR gRNA sequence
  source 1..20: mol_type = other DNA
aacccttttggttaaaaagg

SEQ ID NO: 47528 - DNA, 20 bp, synthetic construct
  misc_feature 1..20: note = CRISPR gRNA sequence
  source 1..20: mol_type = other DNA
ttggttaaaaagggagaatc

SEQ ID NO: 47529 - DNA, 20 bp, synthetic construct
  misc_feature 1..20: note = CRISPR gRNA sequence
  source 1..20: mol_type = other DNA
aaaaagggagaatccagtgt

SEQ ID NO: 47530 - DNA, 20 bp, synthetic construct
  misc_feature 1..20: note = CRISPR gRNA sequence
  source 1..20: mol_type = other DNA
aaaagggagaatccagtgtt

SEQ ID NO: 47531 - DNA, 20 bp, synthetic construct
  misc_feature 1..20: note = CRISPR gRNA sequence
  source 1..20: mol_type = other DNA
gaatccagtgttaggtgtta

SEQ ID NO: 47532 - DNA, 20 bp, synthetic construct
  misc_feature 1..20: note = CRISPR gRNA sequence
  source 1..20: mol_type = other DNA
agatgaattaccactgatct

SEQ ID NO: 47533 - DNA, 20 bp, synthetic construct
  misc_feature 1..20: note = CRISPR gRNA sequence
  source 1..20: mol_type = other DNA
ctgatctgagactttcgctt

SEQ ID NO: 47534 - DNA, 20 bp, synthetic construct
  misc_feature 1..20: note = CRISPR gRNA sequence
  source 1..20: mol_type = other DNA
gactttcgctttggtgtaat

SEQ ID NO: 47535 - DNA, 20 bp, synthetic construct
  misc_feature 1..20: note = CRISPR gRNA sequence
  source 1..20: mol_type = other DNA
tttcgctttggtgtaatgag

SEQ ID NO: 47536 - DNA, 20 bp, synthetic construct
  misc_feature 1..20: note = CRISPR gRNA sequence
  source 1..20: mol_type = other DNA
ttcgctttggtgtaatgaga

SEQ ID NO: 47537 - DNA, 20 bp, synthetic construct
  misc_feature 1..20: note = CRISPR gRNA sequence
  source 1..20: mol_type = other DNA
tcgctttggtgtaatgagaa

SEQ ID NO: 47538 - DNA, 20 bp, synthetic construct
  misc_feature 1..20: note = CRISPR gRNA sequence
  source 1..20: mol_type = other DNA
ttggtgtaatgagaagggtt

SEQ ID NO: 47539 - DNA, 20 bp, synthetic construct
  misc_feature 1..20: note = CRISPR gRNA sequence
  source 1..20: mol_type = other DNA
atgagaagggttaagacctt

SEQ ID NO: 47540 - DNA, 20 bp, synthetic construct
  misc_feature 1..20: note = CRISPR gRNA sequence
  source 1..20: mol_type = other DNA
tgagaagggttaagaccttt

SEQ ID NO: 47541 - DNA, 20 bp, synthetic construct
  misc_feature 1..20: note = CRISPR gRNA sequence
  source 1..20: mol_type = other DNA
atcacttgtgtcctgttctt

SEQ ID NO: 47542 - DNA, 20 bp, synthetic construct
  misc_feature 1..20: note = CRISPR gRNA sequence
  source 1..20: mol_type = other DNA
tcacttgtgtcctgttcttt

SEQ ID NO: 47543 - DNA, 20 bp, synthetic construct
  misc_feature 1..20: note = CRISPR gRNA sequence
  source 1..20: mol_type = other DNA
gtgtcctgttctttaggaaa

SEQ ID NO: 47544 - DNA, 20 bp, synthetic construct
  misc_feature 1..20: note = CRISPR gRNA sequence
  source 1..20: mol_type = other DNA
cagctttgtcctccatacca

SEQ ID NO: 47545 - DNA, 20 bp, synthetic construct
  misc_feature 1..20: note = CRISPR gRNA sequence
  source 1..20: mol_type = other DNA
tttgtcctccataccatggt

SEQ ID NO: 47546 - DNA, 20 bp, synthetic construct
  misc_feature 1..20: note = CRISPR gRNA sequence
  source 1..20: mol_type = other DNA
ttgtcctccataccatggtt

SEQ ID NO: 47547 - DNA, 20 bp, synthetic construct
  misc_feature 1..20: note = CRISPR gRNA sequence
  source 1..20: mol_type = other DNA
tgtcctccataccatggtta

SEQ ID NO: 47548 - DNA, 20 bp, synthetic construct
  misc_feature 1..20: note = CRISPR gRNA sequence
  source 1..20: mol_type = other DNA
ccataccatggttagggtcc

SEQ ID NO: 47549 - DNA, 20 bp, synthetic construct
  misc_feature 1..20: note = CRISPR gRNA sequence
  source 1..20: mol_type = other DNA
cataccatggttagggtccc

SEQ ID NO: 47550 - DNA, 20 bp, synthetic construct
  misc_feature 1..20: note = CRISPR gRNA sequence
  source 1..20: mol_type = other DNA
ccatggttagggtcccaggc

SEQ ID NO: 47551 - DNA, 20 bp, synthetic construct
  misc_feature 1..20: note = CRISPR gRNA sequence
  source 1..20: mol_type = other DNA
ttagggtcccaggctagtcc

SEQ ID NO: 47552 - DNA, 20 bp, synthetic construct
  misc_feature 1..20: note = CRISPR gRNA sequence
  source 1..20: mol_type = other DNA
ccaggctagtcctagaattc

SEQ ID NO: 47553 - DNA, 20 bp, synthetic construct
  misc_feature 1..20: note = CRISPR gRNA sequence
  source 1..20: mol_type = other DNA
tagaattctagtttactcat

SEQ ID NO: 47554 - DNA, 20 bp, synthetic construct
  misc_feature 1..20: note = CRISPR gRNA sequence
  source 1..20: mol_type = other DNA
agaattctagtttactcatg

SEQ ID NO: 47555 - DNA, 20 bp, synthetic construct
  misc_feature 1..20: note = CRISPR gRNA sequence
  source 1..20: mol_type = other DNA
attctagtttactcatgagg

SEQ ID NO: 47556 - DNA, 20 bp, synthetic construct
  misc_feature 1..20: note = CRISPR gRNA sequence
  source 1..20: mol_type = other DNA
actcatgaggcagcactgca

SEQ ID NO: 47557 - DNA, 20 bp, synthetic construct
  misc_feature 1..20: note = CRISPR gRNA sequence
  source 1..20: mol_type = other DNA
aggcagcactgcaaagcccc

SEQ ID NO: 47558 - DNA, 20 bp, synthetic construct
  misc_feature 1..20: note = CRISPR gRNA sequence
  source 1..20: mol_type = other DNA
ggcagcactgcaaagcccca

SEQ ID NO: 47559 - DNA, 20 bp, synthetic construct
  misc_feature 1..20: note = CRISPR gRNA sequence
  source 1..20: mol_type = other DNA
cactgcaaagccccaaggtc

SEQ ID NO: 47560 - DNA, 20 bp, synthetic construct
  misc_feature 1..20: note = CRISPR gRNA sequence
  source 1..20: mol_type = other DNA
actgcaaagccccaaggtct

SEQ ID NO: 47561 - DNA, 20 bp, synthetic construct
  misc_feature 1..20: note = CRISPR gRNA sequence
  source 1..20: mol_type = other DNA
ctgcaaagccccaaggtctg

SEQ ID NO: 47562 - DNA, 20 bp, synthetic construct
  misc_feature 1..20: note = CRISPR gRNA sequence
  source 1..20: mol_type = other DNA
tgcaaagccccaaggtctgg

SEQ ID NO: 47563 - DNA, 20 bp, synthetic construct
  misc_feature 1..20: note = CRISPR gRNA sequence
  source 1..20: mol_type = other DNA
tctgggggattctgattgct

SEQ ID NO: 47564 - DNA, 20 bp, synthetic construct
  misc_feature 1..20: note = CRISPR gRNA sequence
  source 1..20: mol_type = other DNA
tgggggattctgattgctaa

SEQ ID NO: 47565 - DNA, 20 bp, synthetic construct
  misc_feature 1..20: note = CRISPR gRNA sequence
  source 1..20: mol_type = other DNA
ggattctgattgctaagaga

SEQ ID NO: 47566 - DNA, 20 bp, synthetic construct
  misc_feature 1..20: note = CRISPR gRNA sequence
  source 1..20: mol_type = other DNA
ctgattgctaagagacagcc

SEQ ID NO: 47567 - DNA, 20 bp, synthetic construct
  misc_feature 1..20: note = CRISPR gRNA sequence
  source 1..20: mol_type = other DNA
tgctaagagacagccaagca

SEQ ID NO: 47568 - DNA, 20 bp, synthetic construct
  misc_feature 1..20: note = CRISPR gRNA sequence
  source 1..20: mol_type = other DNA
aagagacagccaagcacggc

SEQ ID NO: 47569 - DNA, 20 bp, synthetic construct
  misc_feature 1..20: note = CRISPR gRNA sequence
  source 1..20: mol_type = other DNA
gacagccaagcacggccagc

SEQ ID NO: 47570 - DNA, 20 bp, synthetic construct
  misc_feature 1..20: note = CRISPR gRNA sequence
  source 1..20: mol_type = other DNA
agccaagcacggccagccag

SEQ ID NO: 47571 - DNA, 20 bp, synthetic construct
  misc_feature 1..20: note = CRISPR gRNA sequence
  source 1..20: mol_type = other DNA
gccaagcacggccagccagc

SEQ ID NO: 47572 - DNA, 20 bp, synthetic construct
  misc_feature 1..20: note = CRISPR gRNA sequence
  source 1..20: mol_type = other DNA
gcacggccagccagcaggtc

SEQ ID NO: 47573 - DNA, 20 bp, synthetic construct
  misc_feature 1..20: note = CRISPR gRNA sequence
  source 1..20: mol_type = other DNA
cacggccagccagcaggtct

SEQ ID NO: 47574 - DNA, 20 bp, synthetic construct
  misc_feature 1..20: note = CRISPR gRNA sequence
  source 1..20: mol_type = other DNA
acggccagccagcaggtctg

SEQ ID NO: 47575 - DNA, 20 bp, synthetic construct
  misc_feature 1..20: note = CRISPR gRNA sequence
  source 1..20: mol_type = other DNA
cggccagccagcaggtctgg

SEQ ID NO: 47576 - DNA, 20 bp, synthetic construct
  misc_feature 1..20: note = CRISPR gRNA sequence
  source 1..20: mol_type = other DNA
ccagccagcaggtctggggg

SEQ ID NO: 47577 - DNA, 20 bp, synthetic construct
  misc_feature 1..20: note = CRISPR gRNA sequence
  source 1..20: mol_type = other DNA
gtctgggggtggctttctcc

SEQ ID NO: 47578 - DNA, 20 bp, synthetic construct
  misc_feature 1..20: note = CRISPR gRNA sequence
  source 1..20: mol_type = other DNA
gggtggctttctcctggctt

SEQ ID NO: 47579 - DNA, 20 bp, synthetic construct
  misc_feature 1..20: note = CRISPR gRNA sequence
  source 1..20: mol_type = other DNA
gccactgtttctaccaactg

SEQ ID NO: 47580 - DNA, 20 bp, synthetic construct
  misc_feature 1..20: note = CRISPR gRNA sequence
  source 1..20: mol_type = other DNA
taccaactgtggttcataaa

SEQ ID NO: 47581 - DNA, 20 bp, synthetic construct
  misc_feature 1..20: note = CRISPR gRNA sequence
  source 1..20: mol_type = other DNA
ccaactgtggttcataaatg

SEQ ID NO: 47582 - DNA, 20 bp, synthetic construct
  misc_feature 1..20: note = CRISPR gRNA sequence
  source 1..20: mol_type = other DNA
caactgtggttcataaatgg

SEQ ID NO: 47583 - DNA, 20 bp, synthetic construct
  misc_feature 1..20: note = CRISPR gRNA sequence
  source 1..20: mol_type = other DNA
tcataaatggaggtttcatc

SEQ ID NO: 47584 - DNA, 20 bp, synthetic construct
  misc_feature 1..20: note = CRISPR gRNA sequence
  source 1..20: mol_type = other DNA
taaatggaggtttcatcaag

SEQ ID NO: 47585 - DNA, 20 bp, synthetic construct
  misc_feature 1..20: note = CRISPR gRNA sequence
  source 1..20: mol_type = other DNA
aaatggaggtttcatcaagc

SEQ ID NO: 47586 - DNA, 20 bp, synthetic construct
  misc_feature 1..20: note = CRISPR gRNA sequence
  source 1..20: mol_type = other DNA
ggaggtttcatcaagcaggc

SEQ ID NO: 47587 - DNA, 20 bp, synthetic construct
  misc_feature 1..20: note = CRISPR gRNA sequence
  source 1..20: mol_type = other DNA
gaggtttcatcaagcaggca

SEQ ID NO: 47588 - DNA, 20 bp, synthetic construct
  misc_feature 1..20: note = CRISPR gRNA sequence
  source 1..20: mol_type = other DNA
gtttcatcaagcaggcaagg

SEQ ID NO: 47589 - DNA, 20 bp, synthetic construct
  misc_feature 1..20: note = CRISPR gRNA sequence
  source 1..20: mol_type = other DNA
agcaggcaaggtggtctatc

SEQ ID NO: 47590 - DNA, 20 bp, synthetic construct
  misc_feature 1..20: note = CRISPR gRNA sequence
  source 1..20: mol_type = other DNA
tctatccagttgcctcccaa

SEQ ID NO: 47591 - DNA, 20 bp, synthetic construct
  misc_feature 1..20: note = CRISPR gRNA sequence
  source 1..20: mol_type = other DNA
ctatccagttgcctcccaaa

SEQ ID NO: 47592 - DNA, 20 bp, synthetic construct
  misc_feature 1..20: note = CRISPR gRNA sequence
  source 1..20: mol_type = other DNA
tccagttgcctcccaaaagg

SEQ ID NO: 47593 - DNA, 20 bp, synthetic construct
  misc_feature 1..20: note = CRISPR gRNA sequence
  source 1..20: mol_type = other DNA
ccagttgcctcccaaaagga

SEQ ID NO: 47594 - DNA, 20 bp, synthetic construct
  misc_feature 1..20: note = CRISPR gRNA sequence
  source 1..20: mol_type = other DNA
ttgcctcccaaaaggaaggt

SEQ ID NO: 47595 - DNA, 20 bp, synthetic construct
  misc_feature 1..20: note = CRISPR gRNA sequence
  source 1..20: mol_type = other DNA
ggttggaccaaaaaccttta

SEQ ID NO: 47596 - DNA, 20 bp, synthetic construct
  misc_feature 1..20: note = CRISPR gRNA sequence
  source 1..20: mol_type = other DNA
aaaaacctttaaagaccatc

SEQ ID NO: 47597 - DNA, 20 bp, synthetic construct
  misc_feature 1..20: note = CRISPR gRNA sequence
  source 1..20: mol_type = other DNA
ccctcccaccaatctacaaa

SEQ ID NO: 47598 - DNA, 20 bp, synthetic construct
  misc_feature 1..20: note = CRISPR gRNA sequence
  source 1..20: mol_type = other DNA
cctcccaccaatctacaaat

SEQ ID NO: 47599 - DNA, 20 bp, synthetic construct
  misc_feature 1..20: note = CRISPR gRNA sequence
  source 1..20: mol_type = other DNA
ctcccaccaatctacaaatg

SEQ ID NO: 47600 - DNA, 20 bp, synthetic construct
  misc_feature 1..20: note = CRISPR gRNA sequence
  source 1..20: mol_type = other DNA
ccaatctacaaatggggaaa

SEQ ID NO: 47601 - DNA, 20 bp, synthetic construct
  misc_feature 1..20: note = CRISPR gRNA sequence
  source 1..20: mol_type = other DNA
caatctacaaatggggaaaa

SEQ ID NO: 47602 - DNA, 20 bp, synthetic construct
  misc_feature 1..20: note = CRISPR gRNA sequence
  source 1..20: mol_type = other DNA
tctacaaatggggaaaaagg

SEQ ID NO: 47603 - DNA, 20 bp, synthetic construct
  misc_feature 1..20: note = CRISPR gRNA sequence
  source 1..20: mol_type = other DNA
acaaatggggaaaaaggcag

SEQ ID NO: 47604 - DNA, 20 bp, synthetic construct
  misc_feature 1..20: note = CRISPR gRNA sequence
  source 1..20: mol_type = other DNA
aatggggaaaaaggcagaag

SEQ ID NO: 47605 - DNA, 20 bp, synthetic construct
  misc_feature 1..20: note = CRISPR gRNA sequence
  source 1..20: mol_type = other DNA
atggggaaaaaggcagaaga

SEQ ID NO: 47606 - DNA, 20 bp, synthetic construct
  misc_feature 1..20: note = CRISPR gRNA sequence
  source 1..20: mol_type = other DNA
gttttacccaacattacctg

SEQ ID NO: 47607 - DNA, 20 bp, synthetic construct
  misc_feature 1..20: note = CRISPR gRNA sequence
  source 1..20: mol_type = other DNA
cccaacattacctgcagctc

SEQ ID NO: 47608 - DNA, 20 bp, synthetic construct
  misc_feature 1..20: note = CRISPR gRNA sequence
  source 1..20: mol_type = other DNA
tcaagtgttaaaatgtcttt

SEQ ID NO: 47609 - DNA, 20 bp, synthetic construct
  misc_feature 1..20: note = CRISPR gRNA sequence
  source 1..20: mol_type = other DNA
aagtgttaaaatgtctttga

SEQ ID NO: 47610 - DNA, 20 bp, synthetic construct
  misc_feature 1..20: note = CRISPR gRNA sequence
  source 1..20: mol_type = other DNA
agtgttaaaatgtctttgag

SEQ ID NO: 47611 - DNA, 20 bp, synthetic construct
  misc_feature 1..20: note = CRISPR gRNA sequence
  source 1..20: mol_type = other DNA
atgtctttgagaggatgtct

SEQ ID NO: 47612 - DNA, 20 bp, synthetic construct
  misc_feature 1..20: note = CRISPR gRNA sequence
  source 1..20: mol_type = other DNA
ctttgagaggatgtctgagt

SEQ ID NO: 47613 - DNA, 20 bp, synthetic construct
  misc_feature 1..20: note = CRISPR gRNA sequence
  source 1..20: mol_type = other DNA
tttgagaggatgtctgagta

SEQ ID NO: 47614 - DNA, 20 bp, synthetic construct
  misc_feature 1..20: note = CRISPR gRNA sequence
  source 1..20: mol_type = other DNA
tgatcttccccatttacaaa

SEQ ID NO: 47615 - DNA, 20 bp, synthetic construct
  misc_feature 1..20: note = CRISPR gRNA sequence
  source 1..20: mol_type = other DNA
gatcttccccatttacaaat

SEQ ID NO: 47616 - DNA, 20 bp, synthetic construct
  misc_feature 1..20: note = CRISPR gRNA sequence
  source 1..20: mol_type = other DNA
tcttccccatttacaaatgg

SEQ ID NO: 47617 - DNA, 20 bp, synthetic construct
  misc_feature 1..20: note = CRISPR gRNA sequence
  source 1..20: mol_type = other DNA
cttccccatttacaaatggg

SEQ ID NO: 47618 - DNA, 20 bp, synthetic construct
  misc_feature 1..20: note = CRISPR gRNA sequence
  source 1..20: mol_type = other DNA
ccatttacaaatgggaggac

SEQ ID NO: 47619 - DNA, 20 bp, synthetic construct
  misc_feature 1..20: note = CRISPR gRNA sequence
  source 1..20: mol_type = other DNA
ttacaaatgggaggactggc

SEQ ID NO: 47620 - DNA, 20 bp, synthetic construct
  misc_feature 1..20: note = CRISPR gRNA sequence
  source 1..20: mol_type = other DNA
acaaatgggaggactggcca

SEQ ID NO: 47621 - DNA, 20 bp, synthetic construct
  misc_feature 1..20: note = CRISPR gRNA sequence
  source 1..20: mol_type = other DNA
aaatgggaggactggccaga

SEQ ID NO: 47622 - DNA, 20 bp, synthetic construct
  misc_feature 1..20: note = CRISPR gRNA sequence
  source 1..20: mol_type = other DNA
aatgggaggactggccagag

SEQ ID NO: 47623 - DNA, 20 bp, synthetic construct
  misc_feature 1..20: note = CRISPR gRNA sequence
  source 1..20: mol_type = other DNA
ggaggactggccagagagga

SEQ ID NO: 47624 - DNA, 20 bp, synthetic construct
  misc_feature 1..20: note = CRISPR gRNA sequence
  source 1..20: mol_type = other DNA
gaggactggccagagaggat

SEQ ID NO: 47625 - DNA, 20 bp, synthetic construct
  misc_feature 1..20: note = CRISPR gRNA sequence
  source 1..20: mol_type = other DNA
ggactggccagagaggatgg

SEQ ID NO: 47626 - DNA, 20 bp, synthetic construct
  misc_feature 1..20: note = CRISPR gRNA sequence
  source 1..20: mol_type = other DNA
ctggccagagaggatgggag

SEQ ID NO: 47627 - DNA, 20 bp, synthetic construct
  misc_feature 1..20: note = CRISPR gRNA sequence
  source 1..20: mol_type = other DNA
agagaggatgggagcagctc

SEQ ID NO: 47628 - DNA, 20 bp, synthetic construct
  misc_feature 1..20: note = CRISPR gRNA sequence
  source 1..20: mol_type = other DNA
gagaggatgggagcagctcc

SEQ ID NO: 47629 - DNA, 20 bp, synthetic construct
  misc_feature 1..20: note = CRISPR gRNA sequence
  source 1..20: mol_type = other DNA
gggagcagctccaggccaca

SEQ ID NO: 47630 - DNA, 20 bp, synthetic construct
  misc_feature 1..20: note = CRISPR gRNA sequence
  source 1..20: mol_type = other DNA
agcagctccaggccacacag

SEQ ID NO: 47631 - DNA, 20 bp, synthetic construct
  misc_feature 1..20: note = CRISPR gRNA sequence
  source 1..20: mol_type = other DNA
gcagctccaggccacacagc

SEQ ID NO: 47632 - DNA, 20 bp, synthetic construct
  misc_feature 1..20: note = CRISPR gRNA sequence
  source 1..20: mol_type = other DNA
ctccaggccacacagcaggc

SEQ ID NO: 47633 - DNA, 20 bp, synthetic construct
  misc_feature 1..20: note = CRISPR gRNA sequence
  source 1..20: mol_type = other DNA
ccaggccacacagcaggctg

SEQ ID NO: 47634 - DNA, 20 bp, synthetic construct
  misc_feature 1..20: note = CRISPR gRNA sequence
  source 1..20: mol_type = other DNA
ctcccgacttttccttttcc

SEQ ID NO: 47635 - DNA, 20 bp, synthetic construct
  misc_feature 1..20: note = CRISPR gRNA sequence
  source 1..20: mol_type = other DNA
cgacttttccttttcccagc

SEQ ID NO: 47636 - DNA, 20 bp, synthetic construct
  misc_feature 1..20: note = CRISPR gRNA sequence
  source 1..20: mol_type = other DNA
tttccttttcccagccagct

SEQ ID NO: 47637 - DNA, 20 bp, synthetic construct
  misc_feature 1..20: note = CRISPR gRNA sequence
  source 1..20: mol_type = other DNA
ttccttttcccagccagctc

SEQ ID NO: 47638 - DNA, 20 bp, synthetic construct
  misc_feature 1..20: note = CRISPR gRNA sequence
  source 1..20: mol_type = other DNA
tccttttcccagccagctca

SEQ ID NO: 47639 - DNA, 20 bp, synthetic construct
  misc_feature 1..20: note = CRISPR gRNA sequence
  source 1..20: mol_type = other DNA
gggctcttccaatcactcac

SEQ ID NO: 47640 - DNA, 20 bp, synthetic construct
  misc_feature 1..20: note = CRISPR gRNA sequence
  source 1..20: mol_type = other DNA
atcactcacaagattacttc

SEQ ID NO: 47641 - DNA, 20 bp, synthetic construct
  misc_feature 1..20: note = CRISPR gRNA sequence
  source 1..20: mol_type = other DNA
tcactcacaagattacttcc

SEQ ID NO: 47642 - DNA, 20 bp, synthetic construct
  misc_feature 1..20: note = CRISPR gRNA sequence
  source 1..20: mol_type = other DNA
cactcacaagattacttcca

SEQ ID NO: 47643 - DNA, 20 bp, synthetic construct
  misc_feature 1..20: note = CRISPR gRNA sequence
  source 1..20: mol_type = other DNA
tcacaagattacttccaggg

SEQ ID NO: 47644 - DNA, 20 bp, synthetic construct
  misc_feature 1..20: note = CRISPR gRNA sequence
  source 1..20: mol_type = other DNA
cacaagattacttccagggc

SEQ ID NO: 47645 - DNA, 20 bp, synthetic construct
  misc_feature 1..20: note = CRISPR gRNA sequence
  source 1..20: mol_type = other DNA
acaagattacttccagggca

SEQ ID NO: 47646 - DNA, 20 bp, synthetic construct
  misc_feature 1..20: note = CRISPR gRNA sequence
  source 1..20: mol_type = other DNA
agattacttccagggcaggg

SEQ ID NO: 47647 - DNA, 20 bp, synthetic construct
  misc_feature 1..20: note = CRISPR gRNA sequence
  source 1..20: mol_type = other DNA
ccagggcagggcagctcgtg

SEQ ID NO: 47648 - DNA, 20 bp, synthetic construct
  misc_feature 1..20: note = CRISPR gRNA sequence
  source 1..20: mol_type = other DNA
ggcagggcagctcgtgaagc

SEQ ID NO: 47649 - DNA, 20 bp, synthetic construct
  misc_feature 1..20: note = CRISPR gRNA sequence
  source 1..20: mol_type = other DNA
cagggcagctcgtgaagctg

SEQ ID NO: 47650 - DNA, 20 bp, synthetic construct
  misc_feature 1..20: note = CRISPR gRNA sequence
  source 1..20: mol_type = other DNA
agggcagctcgtgaagctgg

SEQ ID NO: 47651 - DNA, 20 bp, synthetic construct
  misc_feature 1..20: note = CRISPR gRNA sequence
  source 1..20: mol_type = other DNA
cagctcgtgaagctggaggt

SEQ ID NO: 47652 - DNA, 20 bp, synthetic construct
  misc_feature 1..20: note = CRISPR gRNA sequence
  source 1..20: mol_type = other DNA
agctcgtgaagctggaggtg

SEQ ID NO: 47653 - DNA, 20 bp, synthetic construct
  misc_feature 1..20: note = CRISPR gRNA sequence
  source 1..20: mol_type = other DNA
ctcgtgaagctggaggtgag

SEQ ID NO: 47654 - DNA, 20 bp, synthetic construct
  misc_feature 1..20: note = CRISPR gRNA sequence
  source 1..20: mol_type = other DNA
gaagctggaggtgaggagct

SEQ ID NO: 47655 - DNA, 20 bp, synthetic construct
  misc_feature 1..20: note = CRISPR gRNA sequence
  source 1..20: mol_type = other DNA
gctggaggtgaggagcttgg

SEQ ID NO: 47656 - DNA, 20 bp, synthetic construct
  misc_feature 1..20: note = CRISPR gRNA sequence
  source 1..20: mol_type = other DNA
aggtgaggagcttggcagtc

SEQ ID NO: 47657 - DNA, 20 bp, synthetic construct
  misc_feature 1..20: note = CRISPR gRNA sequence
  source 1..20: mol_type = other DNA
cagtctggttgtcaatctta

SEQ ID NO: 47658 - DNA, 20 bp, synthetic construct
  misc_feature 1..20: note = CRISPR gRNA sequence
  source 1..20: mol_type = other DNA
agtctggttgtcaatcttac

SEQ ID NO: 47659 - DNA, 20 bp, synthetic construct
  misc_feature 1..20: note = CRISPR gRNA sequence
  source 1..20: mol_type = other DNA
ttgtcaatcttacaggaaac

SEQ ID NO: 47660 - DNA, 20 bp, synthetic construct
  misc_feature 1..20: note = CRISPR gRNA sequence
  source 1..20: mol_type = other DNA
tgtcaatcttacaggaaacc

SEQ ID NO: 47661 - DNA, 20 bp, synthetic construct
  misc_feature 1..20: note = CRISPR gRNA sequence
  source 1..20: mol_type = other DNA
aatcttacaggaaaccaggc

SEQ ID NO: 47662 - DNA, 20 bp, synthetic construct
  misc_feature 1..20: note = CRISPR gRNA sequence
  source 1..20: mol_type = other DNA
atcttacaggaaaccaggct

SEQ ID NO: 47663 - DNA, 20 bp, synthetic construct
  misc_feature 1..20: note = CRISPR gRNA sequence
  source 1..20: mol_type = other DNA
tcttacaggaaaccaggctg

SEQ ID NO: 47664 - DNA, 20 bp, synthetic construct
  misc_feature 1..20: note = CRISPR gRNA sequence
  source 1..20: mol_type = other DNA
acaggaaaccaggctgggga

SEQ ID NO: 47665 - DNA, 20 bp, synthetic construct
  misc_feature 1..20: note = CRISPR gRNA sequence
  source 1..20: mol_type = other DNA
aggaaaccaggctggggatg

SEQ ID NO: 47666 - DNA, 20 bp, synthetic construct
  misc_feature 1..20: note = CRISPR gRNA sequence
  source 1..20: mol_type = other DNA
aaaccaggctggggatggag

SEQ ID NO: 47667 - DNA, 20 bp, synthetic construct
  misc_feature 1..20: note = CRISPR gRNA sequence
  source 1..20: mol_type = other DNA
aaccaggctggggatggaga

SEQ ID NO: 47668 - DNA, 20 bp, synthetic construct
  misc_feature 1..20: note = CRISPR gRNA sequence
  source 1..20: mol_type = other DNA
accaggctggggatggagaa

SEQ ID NO: 47669 - DNA, 20 bp, synthetic construct
  misc_feature 1..20: note = CRISPR gRNA sequence
  source 1..20: mol_type = other DNA
gctggggatggagaagggca

SEQ ID NO: 47670 - DNA, 20 bp, synthetic construct
  misc_feature 1..20: note = CRISPR gRNA sequence
  source 1..20: mol_type = other DNA
ctggggatggagaagggcat

SEQ ID NO: 47671 - DNA, 20 bp, synthetic construct
  misc_feature 1..20: note = CRISPR gRNA sequence
  source 1..20: mol_type = other DNA
ggatggagaagggcatggga

SEQ ID NO: 47672 - DNA, 20 bp, synthetic construct
  misc_feature 1..20: note = CRISPR gRNA sequence
  source 1..20: mol_type = other DNA
gatggagaagggcatgggat

SEQ ID NO: 47673 - DNA, 20 bp, synthetic construct
  misc_feature 1..20: note = CRISPR gRNA sequence
  source 1..20: mol_type = other DNA
gagaagggcatgggatggga

SEQ ID NO: 47674 - DNA, 20 bp, synthetic construct
  misc_feature 1..20: note = CRISPR gRNA sequence
  source 1..20: mol_type = other DNA
agaagggcatgggatgggat

SEQ ID NO: 47675 - DNA, 20 bp, synthetic construct
  misc_feature 1..20: note = CRISPR gRNA sequence
  source 1..20: mol_type = other DNA
gaagggcatgggatgggatg

SEQ ID NO: 47676 - DNA, 20 bp, synthetic construct
  misc_feature 1..20: note = CRISPR gRNA sequence
  source 1..20: mol_type = other DNA
aagggcatgggatgggatgg

SEQ ID NO: 47677 - DNA, 20 bp, synthetic construct
  misc_feature 1..20: note = CRISPR gRNA sequence
  source 1..20: mol_type = other DNA
ggatgggatgggggttgttt

SEQ ID NO: 47678 - DNA, 20 bp, synthetic construct
  misc_feature 1..20: note = CRISPR gRNA sequence
  source 1..20: mol_type = other DNA
gggatgggggttgtttgagt

SEQ ID NO: 47679 - DNA, 20 bp, synthetic construct
  misc_feature 1..20: note = CRISPR gRNA sequence
  source 1..20: mol_type = other DNA
ggatgggggttgtttgagtc

SEQ ID NO: 47680 - DNA, 20 bp, synthetic construct
  misc_feature 1..20: note = CRISPR gRNA sequence
  source 1..20: mol_type = other DNA
gatgggggttgtttgagtca

SEQ ID NO: 47681 - DNA, 20 bp, synthetic construct
  misc_feature 1..20: note = CRISPR gRNA sequence
  source 1..20: mol_type = other DNA
atgggggttgtttgagtcag

SEQ ID NO: 47682 - DNA, 20 bp, synthetic construct
  misc_feature 1..20: note = CRISPR gRNA sequence
  source 1..20: mol_type = other DNA
gttgtttgagtcaggggatc

SEQ ID NO: 47683 - DNA, 20 bp, synthetic construct
  misc_feature 1..20: note = CRISPR gRNA sequence
  source 1..20: mol_type = other DNA
gtttgagtcaggggatctag

SEQ ID NO: 47684 - DNA, 20 bp, synthetic construct
  misc_feature 1..20: note = CRISPR gRNA sequence
  source 1..20: mol_type = other DNA
tttgagtcaggggatctagc

SEQ ID NO: 47685 - DNA, 20 bp, synthetic construct
  misc_feature 1..20: note = CRISPR gRNA sequence
  source 1..20: mol_type = other DNA
gatctagcaggtcctgcctc

SEQ ID NO: 47686 - DNA, 20 bp, synthetic construct
  misc_feature 1..20: note = CRISPR gRNA sequence
  source 1..20: mol_type = other DNA
tctagcaggtcctgcctcca

SEQ ID NO: 47687 - DNA, 20 bp, synthetic construct
  misc_feature 1..20: note = CRISPR gRNA sequence
  source 1..20: mol_type = other DNA
ggtcctgcctccagagccac

SEQ ID NO: 47688 - DNA, 20 bp, synthetic construct
  misc_feature 1..20: note = CRISPR gRNA sequence
  source 1..20: mol_type = other DNA
gtcctgcctccagagccacc

SEQ ID NO: 47689 - DNA, 20 bp, synthetic construct
  misc_feature 1..20: note = CRISPR gRNA sequence
  source 1..20: mol_type = other DNA
tcctgcctccagagccacca

SEQ ID NO: 47690 - DNA, 20 bp, synthetic construct
  misc_feature 1..20: note = CRISPR gRNA sequence
  source 1..20: mol_type = other DNA
cctccagagccaccagggtc

SEQ ID NO: 47691 - DNA, 20 bp, synthetic construct
  misc_feature 1..20: note = CRISPR gRNA sequence
  source 1..20: mol_type = other DNA
ctccagagccaccagggtct

SEQ ID NO: 47692 - DNA, 20 bp, synthetic construct
  misc_feature 1..20: note = CRISPR gRNA sequence
  source 1..20: mol_type = other DNA
tccagagccaccagggtctg

SEQ ID NO: 47693 - DNA, 20 bp, synthetic construct
  misc_feature 1..20: note = CRISPR gRNA sequence
  source 1..20: mol_type = other DNA
gagccaccagggtctggggt

SEQ ID NO: 47694 - DNA, 20 bp, synthetic construct
  misc_feature 1..20: note = CRISPR gRNA sequence
  source 1..20: mol_type = other DNA
caccagggtctggggtaagc

SEQ ID NO: 47695 - DNA, 20 bp, synthetic construct
  misc_feature 1..20: note = CRISPR gRNA sequence
  source 1..20: mol_type = other DNA
accagggtctggggtaagct

SEQ ID NO: 47696 - DNA, 20 bp, synthetic construct
  misc_feature 1..20: note = CRISPR gRNA sequence
  source 1..20: mol_type = other DNA
ctggggtaagctaggcgttt

SEQ ID NO: 47697 - DNA, 20 bp, synthetic construct
  misc_feature 1..20: note = CRISPR gRNA sequence
  source 1..20: mol_type = other DNA
tggggtaagctaggcgtttt

SEQ ID NO: 47698 - DNA, 20 bp, synthetic construct
  misc_feature 1..20: note = CRISPR gRNA sequence
  source 1..20: mol_type = other DNA
gtaagctaggcgttttagga

SEQ ID NO: 47699 - DNA, 20 bp, synthetic construct
  misc_feature 1..20: note = CRISPR gRNA sequence
  source 1..20: mol_type = other DNA
taggaaagacttcctttctt

SEQ ID NO: 47700 - DNA, 20 bp, synthetic construct
  misc_feature 1..20: note = CRISPR gRNA sequence
  source 1..20: mol_type = other DNA
aaagacttcctttcttgagc

SEQ ID NO: 47701 - DNA, 20 bp, synthetic construct
  misc_feature 1..20: note = CRISPR gRNA sequence
  source 1..20: mol_type = other DNA
aagacttcctttcttgagcc

SEQ ID NO: 47702 - DNA, 20 bp, synthetic construct
  misc_feature 1..20: note = CRISPR gRNA sequence
  source 1..20: mol_type = other DNA
agccaggcccccaccatccc

SEQ ID NO: 47703 - DNA, 20 bp, synthetic construct
  misc_feature 1..20: note = CRISPR gRNA sequence
  source 1..20: mol_type = other DNA
gccaggcccccaccatccct

SEQ ID NO: 47704 - DNA, 20 bp, synthetic construct
  misc_feature 1..20: note = CRISPR gRNA sequence
  source 1..20: mol_type = other DNA
ccaggcccccaccatccctg

SEQ ID NO: 47705 - DNA, 20 bp, synthetic construct
  misc_feature 1..20: note = CRISPR gRNA sequence
  source 1..20: mol_type = other DNA
ctggggcttctatcacttca

SEQ ID NO: 47706 - DNA, 20 bp, synthetic construct
  misc_feature 1..20: note = CRISPR gRNA sequence
  source 1..20: mol_type = other DNA
tggggcttctatcacttcaa

SEQ ID NO: 47707 - DNA, 20 bp, synthetic construct
  misc_feature 1..20: note = CRISPR gRNA sequence
  source 1..20: mol_type = other DNA
tatcacttcaaaggcctccc

SEQ ID NO: 47708 - DNA, 20 bp, synthetic construct
  misc_feature 1..20: note = CRISPR gRNA sequence
  source 1..20: mol_type = other DNA
atcacttcaaaggcctcccc

SEQ ID NO: 47709 - DNA, 20 bp, synthetic construct
  misc_feature 1..20: note = CRISPR gRNA sequence
  source 1..20: mol_type = other DNA
tcaaaggcctccccaggtgt

SEQ ID NO: 47710 - DNA, 20 bp, synthetic construct
  misc_feature 1..20: note = CRISPR gRNA sequence
  source 1..20: mol_type = other DNA
caaaggcctccccaggtgtt

SEQ ID NO: 47711 - DNA, 20 bp, synthetic construct
  misc_feature 1..20: note = CRISPR gRNA sequence
  source 1..20: mol_type = other DNA
gcctccccaggtgttaggct

SEQ ID NO: 47712 - DNA, 20 bp, synthetic construct
  misc_feature 1..20: note = CRISPR gRNA sequence
  source 1..20: mol_type = other DNA
ccccaggtgttaggctcagt

SEQ ID NO: 47713 - DNA, 20 bp, synthetic construct
  misc_feature 1..20: note = CRISPR gRNA sequence
  source 1..20: mol_type = other DNA
ccaggtgttaggctcagtca

SEQ ID NO: 47714 - DNA, 20 bp, synthetic construct
  misc_feature 1..20: note = CRISPR gRNA sequence
  source 1..20: mol_type = other DNA
ggtgttaggctcagtcagag

SEQ ID NO: 47715 - DNA, 20 bp, synthetic construct
  misc_feature 1..20: note = CRISPR gRNA sequence
  source 1..20: mol_type = other DNA
gtgttaggctcagtcagaga

SEQ ID NO: 47716 - DNA, 20 bp, synthetic construct
  misc_feature 1..20: note = CRISPR gRNA sequence
  source 1..20: mol_type = other DNA
tgttaggctcagtcagagaa

SEQ ID NO: 47717 - DNA, 20 bp, synthetic construct
  misc_feature 1..20: note = CRISPR gRNA sequence
  source 1..20: mol_type = other DNA
agtcagagaagggctgccct

SEQ ID NO: 47718 - DNA, 20 bp, synthetic construct
  misc_feature 1..20: note = CRISPR gRNA sequence
  source 1..20: mol_type = other DNA
ggctgccctcagcctgccac

SEQ ID NO: 47719 - DNA, 20 bp, synthetic construct
  misc_feature 1..20: note = CRISPR gRNA sequence
  source 1..20: mol_type = other DNA
tcagcctgccactggtcccc

SEQ ID NO: 47720 - DNA, 20 bp, synthetic construct
  misc_feature 1..20: note = CRISPR gRNA sequence
  source 1..20: mol_type = other DNA
cagcctgccactggtcccct

SEQ ID NO: 47721 - DNA, 20 bp, synthetic construct
  misc_feature 1..20: note = CRISPR gRNA sequence
  source 1..20: mol_type = other DNA
cctgccactggtcccctagg

SEQ ID NO: 47722 - DNA, 20 bp, synthetic construct
  misc_feature 1..20: note = CRISPR gRNA sequence
  source 1..20: mol_type = other DNA
ctgccactggtcccctaggc

SEQ ID NO: 47723 - DNA, 20 bp, synthetic construct
  misc_feature 1..20: note = CRISPR gRNA sequence
  source 1..20: mol_type = other DNA
ccactggtcccctaggcagg

SEQ ID NO: 47724 - DNA, 20 bp, synthetic construct
  misc_feature 1..20: note = CRISPR gRNA sequence
  source 1..20: mol_type = other DNA
cactggtcccctaggcaggc

SEQ ID NO: 47725 - DNA, 20 bp, synthetic construct
  misc_feature 1..20: note = CRISPR gRNA sequence
  source 1..20: mol_type = other DNA
actggtcccctaggcaggca

SEQ ID NO: 47726 - DNA, 20 bp, synthetic construct
  misc_feature 1..20: note = CRISPR gRNA sequence
  source 1..20: mol_type = other DNA
ctggtcccctaggcaggcag

SEQ ID NO: 47727 - DNA, 20 bp, synthetic construct
  misc_feature 1..20: note = CRISPR gRNA sequence
  source 1..20: mol_type = other DNA
ggtcccctaggcaggcaggg

SEQ ID NO: 47728 - DNA, 20 bp, synthetic construct
  misc_feature 1..20: note = CRISPR gRNA sequence
  source 1..20: mol_type = other DNA
gtcccctaggcaggcagggg

SEQ ID NO: 47729 - DNA, 20 bp, synthetic construct
  misc_feature 1..20: note = CRISPR gRNA sequence
  source 1..20: mol_type = other DNA
gctacttactctatctgtct

SEQ ID NO: 47730 - DNA, 20 bp, synthetic construct
  misc_feature 1..20: note = CRISPR gRNA sequence
  source 1..20: mol_type = other DNA
acttactctatctgtctgag

SEQ ID NO: 47731 - DNA, 20 bp, synthetic construct
  misc_feature 1..20: note = CRISPR gRNA sequence
  source 1..20: mol_type = other DNA
tactctatctgtctgagcag

SEQ ID NO: 47732 - DNA, 20 bp, synthetic construct
  misc_feature 1..20: note = CRISPR gRNA sequence
  source 1..20: mol_type = other DNA
actctatctgtctgagcagc

SEQ ID NO: 47733 - DNA, 20 bp, synthetic construct
  misc_feature 1..20: note = CRISPR gRNA sequence
  source 1..20: mol_type = other DNA
tctatctgtctgagcagcgg

SEQ ID NO: 47734 - DNA, 20 bp, synthetic construct
  misc_feature 1..20: note = CRISPR gRNA sequence
  source 1..20: mol_type = other DNA
tgagcagcgggagctccata

SEQ ID NO: 47735 - DNA, 20 bp, synthetic construct
  misc_feature 1..20: note = CRISPR gRNA sequence
  source 1..20: mol_type = other DNA
gggagctccatacagaaacg

SEQ ID NO: 47736 - DNA, 20 bp, synthetic construct
  misc_feature 1..20: note = CRISPR gRNA sequence
  source 1..20: mol_type = other DNA
ggagctccatacagaaacgc

SEQ ID NO: 47737 - DNA, 20 bp, synthetic construct
  misc_feature 1..20: note = CRISPR gRNA sequence
  source 1..20: mol_type = other DNA
acagaaacgcaggacccctc

SEQ ID NO: 47738 - DNA, 20 bp, synthetic construct
  misc_feature 1..20: note = CRISPR gRNA sequence
  source 1..20: mol_type = other DNA
aaacgcaggacccctccagc

SEQ ID NO: 47739 - DNA, 20 bp, synthetic construct
  misc_feature 1..20: note = CRISPR gRNA sequence
  source 1..20: mol_type = other DNA
aacgcaggacccctccagcc

SEQ ID NO: 47740 - DNA, 20 bp, synthetic construct
  misc_feature 1..20: note = CRISPR gRNA sequence
  source 1..20: mol_type = other DNA
cagccaggttgttttccgcc

SEQ ID NO: 47741 - DNA, 20 bp, synthetic construct
  misc_feature 1..20: note = CRISPR gRNA sequence
  source 1..20: mol_type = other DNA
ggttgttttccgccaagctg

SEQ ID NO: 47742 - DNA, 20 bp, synthetic construct
  misc_feature 1..20: note = CRISPR gRNA sequence
  source 1..20: mol_type = other DNA
gttgttttccgccaagctgc

SEQ ID NO: 47743 - DNA, 20 bp, synthetic construct
  misc_feature 1..20: note = CRISPR gRNA sequence
  source 1..20: mol_type = other DNA
ttgttttccgccaagctgca

SEQ ID NO: 47744 - DNA, 20 bp, synthetic construct
  misc_feature 1..20: note = CRISPR gRNA sequence
  source 1..20: mol_type = other DNA
ttttccgccaagctgcaggg

SEQ ID NO: 47745 - DNA, 20 bp, synthetic construct
  misc_feature 1..20: note = CRISPR gRNA sequence
  source 1..20: mol_type = other DNA
tttccgccaagctgcagggt

SEQ ID NO: 47746 - DNA, 20 bp, synthetic construct
  misc_feature 1..20: note = CRISPR gRNA sequence
  source 1..20: mol_type = other DNA
ttccgccaagctgcagggta

SEQ ID NO: 47747 - DNA, 20 bp, synthetic construct
  misc_feature 1..20: note = CRISPR gRNA sequence
  source 1..20: mol_type = other DNA
tccgccaagctgcagggtag

SEQ ID NO: 47748 - DNA, 20 bp, synthetic construct
  misc_feature 1..20: note = CRISPR gRNA sequence
  source 1..20: mol_type = other DNA
cgccaagctgcagggtaggg

SEQ ID NO: 47749 - DNA, 20 bp, synthetic construct
  misc_feature 1..20: note = CRISPR gRNA sequence
  source 1..20: mol_type = other DNA
agggtaggggagatacctgt

SEQ ID NO: 47750 - DNA, 20 bp, synthetic construct
  misc_feature 1..20: note = CRISPR gRNA sequence
  source 1..20: mol_type = other DNA
ggtaggggagatacctgtga

SEQ ID NO: 47751 - DNA, 20 bp, synthetic construct
  misc_feature 1..20: note = CRISPR gRNA sequence
  source 1..20: mol_type = other DNA
gtaggggagatacctgtgag

SEQ ID NO: 47752 - DNA, 20 bp, synthetic construct
  misc_feature 1..20: note = CRISPR gRNA sequence
  source 1..20: mol_type = other DNA
atacctgtgagaggaacccc

SEQ ID NO: 47753 - DNA, 20 bp, synthetic construct
  misc_feature 1..20: note = CRISPR gRNA sequence
  source 1..20: mol_type = other DNA
gaggaacccccagacccgcc

SEQ ID NO: 47754 - DNA, 20 bp, synthetic construct
  misc_feature 1..20: note = CRISPR gRNA sequence
  source 1..20: mol_type = other DNA
aggaacccccagacccgccc

SEQ ID NO: 47755 - DNA, 20 bp, synthetic construct
  misc_feature 1..20: note = CRISPR gRNA sequence
  source 1..20: mol_type = other DNA
cccaggactgtccccgtgcc

SEQ ID NO: 47756 - DNA, 20 bp, synthetic construct
  misc_feature 1..20: note = CRISPR gRNA sequence
  source 1..20: mol_type = other DNA
ccaggactgtccccgtgcct

SEQ ID NO: 47757 - DNA, 20 bp, synthetic construct
  misc_feature 1..20: note = CRISPR gRNA sequence
  source 1..20: mol_type = other DNA
gactgtccccgtgcctgggc

SEQ ID NO: 47758 - DNA, 20 bp, synthetic construct
  misc_feature 1..20: note = CRISPR gRNA sequence
  source 1..20: mol_type = other DNA
actgtccccgtgcctgggct

SEQ ID NO: 47759 - DNA, 20 bp, synthetic construct
  misc_feature 1..20: note = CRISPR gRNA sequence
  source 1..20: mol_type = other DNA
gtccccgtgcctgggctggg

SEQ ID NO: 47760 - DNA, 20 bp, synthetic construct
  misc_feature 1..20: note = CRISPR gRNA sequence
  source 1..20: mol_type = other DNA
cttacctgatctcttccaaa

SEQ ID NO: 47761 - DNA, 20 bp, synthetic construct
  misc_feature 1..20: note = CRISPR gRNA sequence
  source 1..20: mol_type = other DNA
ttacctgatctcttccaaat

SEQ ID NO: 47762 - DNA, 20 bp, synthetic construct
  misc_feature 1..20: note = CRISPR gRNA sequence
  source 1..20: mol_type = other DNA
tacctgatctcttccaaatg

SEQ ID NO: 47763 - DNA, 20 bp, synthetic construct
  misc_feature 1..20: note = CRISPR gRNA sequence
  source 1..20: mol_type = other DNA
acctgatctcttccaaatgg

SEQ ID NO: 47764 - DNA, 20 bp, synthetic construct
  misc_feature 1..20: note = CRISPR gRNA sequence
  source 1..20: mol_type = other DNA
cctgatctcttccaaatggg

SEQ ID NO: 47765 - DNA, 20 bp, synthetic construct
  misc_feature 1..20: note = CRISPR gRNA sequence
  source 1..20: mol_type = other DNA
tccaaatggggggatccatc

SEQ ID NO: 47766 - DNA, 20 bp, synthetic construct
  misc_feature 1..20: note = CRISPR gRNA sequence
  source 1..20: mol_type = other DNA
ccaaatggggggatccatcc

SEQ ID NO: 47767 - DNA, 20 bp, synthetic construct
  misc_feature 1..20: note = CRISPR gRNA sequence
  source 1..20: mol_type = other DNA
caaatggggggatccatcca

SEQ ID NO: 47768 - DNA, 20 bp, synthetic construct
  misc_feature 1..20: note = CRISPR gRNA sequence
  source 1..20: mol_type = other DNA
ggggggatccatccagggcc

SEQ ID NO: 47769 - DNA, 20 bp, synthetic construct
  misc_feature 1..20: note = CRISPR gRNA sequence
  source 1..20: mol_type = other DNA
gggggatccatccagggcct

SEQ ID NO: 47770 - DNA, 20 bp, synthetic construct
  misc_feature 1..20: note = CRISPR gRNA sequence
  source 1..20: mol_type = other DNA
gatccatccagggcctgggc

SEQ ID NO: 47771 - DNA, 20 bp, synthetic construct
  misc_feature 1..20: note = CRISPR gRNA sequence
  source 1..20: mol_type = other DNA
atccatccagggcctgggcc

SEQ ID NO: 47772 - DNA, 20 bp, synthetic construct
  misc_feature 1..20: note = CRISPR gRNA sequence
  source 1..20: mol_type = other DNA
tccagggcctgggccaggct

SEQ ID NO: 47773 - DNA, 20 bp, synthetic construct
  misc_feature 1..20: note = CRISPR gRNA sequence
  source 1..20: mol_type = other DNA
ccagggcctgggccaggctc

SEQ ID NO: 47774 - DNA, 20 bp, synthetic construct
  misc_feature 1..20: note = CRISPR gRNA sequence
  source 1..20: mol_type = other DNA
cagggcctgggccaggctca

SEQ ID NO: 47775 - DNA, 20 bp, synthetic construct
  misc_feature 1..20: note = CRISPR gRNA sequence
  source 1..20: mol_type = other DNA
gccaggctcagggccccacc

SEQ ID NO: 47776 - DNA, 20 bp, synthetic construct
  misc_feature 1..20: note = CRISPR gRNA sequence
  source 1..20: mol_type = other DNA
ccaggctcagggccccacct

SEQ ID NO: 47777 - DNA, 20 bp, synthetic construct
  misc_feature 1..20: note = CRISPR gRNA sequence
  source 1..20: mol_type = other DNA
ctcagggccccacctgggcc

SEQ ID NO: 47778 - DNA, 20 bp, synthetic construct
  misc_feature 1..20: note = CRISPR gRNA sequence
  source 1..20: mol_type = other DNA
gggccccacctgggcccaga

SEQ ID NO: 47779 - DNA, 20 bp, synthetic construct
  misc_feature 1..20: note = CRISPR gRNA sequence
  source 1..20: mol_type = other DNA
cctgggcccagatggctgaa

SEQ ID NO: 47780 - DNA, 20 bp, synthetic construct
  misc_feature 1..20: note = CRISPR gRNA sequence
  source 1..20: mol_type = other DNA
gggcccagatggctgaatgg

SEQ ID NO: 47781 - DNA, 20 bp, synthetic construct
  misc_feature 1..20: note = CRISPR gRNA sequence
  source 1..20: mol_type = other DNA
ggcccagatggctgaatggt

SEQ ID NO: 47782 - DNA, 20 bp, synthetic construct
  misc_feature 1..20: note = CRISPR gRNA sequence
  source 1..20: mol_type = other DNA
cagatggctgaatggtaggc

SEQ ID NO: 47783 - DNA, 20 bp, synthetic construct
  misc_feature 1..20: note = CRISPR gRNA sequence
  source 1..20: mol_type = other DNA
agatggctgaatggtaggct

SEQ ID NO: 47784 - DNA, 20 bp, synthetic construct
  misc_feature 1..20: note = CRISPR gRNA sequence
  source 1..20: mol_type = other DNA
gatggctgaatggtaggctg

SEQ ID NO: 47785 - DNA, 20 bp, synthetic construct
  misc_feature 1..20: note = CRISPR gRNA sequence
  source 1..20: mol_type = other DNA
gctgaatggtaggctgggga

SEQ ID NO: 47786 - DNA, 20 bp, synthetic construct
  misc_feature 1..20: note = CRISPR gRNA sequence
  source 1..20: mol_type = other DNA
tgaatggtaggctggggaaa

SEQ ID NO: 47787 - DNA, 20 bp, synthetic construct
  misc_feature 1..20: note = CRISPR gRNA sequence
  source 1..20: mol_type = other DNA
gaatggtaggctggggaaag

SEQ ID NO: 47788 - DNA, 20 bp, synthetic construct
  misc_feature 1..20: note = CRISPR gRNA sequence
  source 1..20: mol_type = other DNA
atggtaggctggggaaagag

SEQ ID NO: 47789 - DNA, 20 bp, synthetic construct
  misc_feature 1..20: note = CRISPR gRNA sequence
  source 1..20: mol_type = other DNA
ggtaggctggggaaagagga

SEQ ID NO: 47790 - DNA, 20 bp, synthetic construct
  misc_feature 1..20: note = CRISPR gRNA sequence
  source 1..20: mol_type = other DNA
gtaggctggggaaagaggag

SEQ ID NO: 47791 - DNA, 20 bp, synthetic construct
  misc_feature 1..20: note = CRISPR gRNA sequence
  source 1..20: mol_type = other DNA
taggctggggaaagaggaga

SEQ ID NO: 47792 - DNA, 20 bp, synthetic construct
  misc_feature 1..20: note = CRISPR gRNA sequence
  source 1..20: mol_type = other DNA
ctggggaaagaggagagggt

SEQ ID NO: 47793 - DNA, 20 bp, synthetic construct
  misc_feature 1..20: note = CRISPR gRNA sequence
  source 1..20: mol_type = other DNA
ggggaaagaggagagggtga

SEQ ID NO: 47794 - DNA, 20 bp, synthetic construct
  misc_feature 1..20: note = CRISPR gRNA sequence
  source 1..20: mol_type = other DNA
gggaaagaggagagggtgag

SEQ ID NO: 47795 - DNA, 20 bp, synthetic construct
  misc_feature 1..20: note = CRISPR gRNA sequence
  source 1..20: mol_type = other DNA
gaaagaggagagggtgagag

SEQ ID NO: 47796 - DNA, 20 bp, synthetic construct
  misc_feature 1..20: note = CRISPR gRNA sequence
  source 1..20: mol_type = other DNA
ggagagggtgagaggagcct

SEQ ID NO: 47797 - DNA, 20 bp, synthetic construct
  misc_feature 1..20: note = CRISPR gRNA sequence
  source 1..20: mol_type = other DNA
gagagggtgagaggagcctg

SEQ ID NO: 47798 - DNA, 20 bp, synthetic construct
  misc_feature 1..20: note = CRISPR gRNA sequence
  source 1..20: mol_type = other DNA
agagggtgagaggagcctga

SEQ ID NO: 47799 - DNA, 20 bp, synthetic construct
  misc_feature 1..20: note = CRISPR gRNA sequence
  source 1..20: mol_type = other DNA
gtgagaggagcctgagggac

SEQ ID NO: 47800 - DNA, 20 bp, synthetic construct
  misc_feature 1..20: note = CRISPR gRNA sequence
  source 1..20: mol_type = other DNA
gcctgagggactggcgtttc

SEQ ID NO: 47801 - DNA, 20 bp, synthetic construct
  misc_feature 1..20: note = CRISPR gRNA sequence
  source 1..20: mol_type = other DNA
ctgagggactggcgtttcca

SEQ ID NO: 47802 - DNA, 20 bp, synthetic construct
  misc_feature 1..20: note = CRISPR gRNA sequence
  source 1..20: mol_type = other DNA
cgtttccagagccccaccct

SEQ ID NO: 47803 - DNA, 20 bp, synthetic construct
  misc_feature 1..20: note = CRISPR gRNA sequence
  source 1..20: mol_type = other DNA
ccccaccctcagccttgtct

SEQ ID NO: 47804 - DNA, 20 bp, synthetic construct
  misc_feature 1..20: note = CRISPR gRNA sequence
  source 1..20: mol_type = other DNA
cccaccctcagccttgtctc

SEQ ID NO: 47805 - DNA, 20 bp, synthetic construct
  misc_feature 1..20: note = CRISPR gRNA sequence
  source 1..20: mol_type = other DNA
ctcagccttgtctcaggctg

SEQ ID NO: 47806 - DNA, 20 bp, synthetic construct
  misc_feature 1..20: note = CRISPR gRNA sequence
  source 1..20: mol_type = other DNA
cttgtctcaggctgcagtgc

SEQ ID NO: 47807 - DNA, 20 bp, synthetic construct
  misc_feature 1..20: note = CRISPR gRNA sequence
  source 1..20: mol_type = other DNA
caggctgcagtgccagcccg

SEQ ID NO: 47808 - DNA, 20 bp, synthetic construct
  misc_feature 1..20: note = CRISPR gRNA sequence
  source 1..20: mol_type = other DNA
ctgcagtgccagcccgtaga

SEQ ID NO: 47809 - DNA, 20 bp, synthetic construct
  misc_feature 1..20: note = CRISPR gRNA sequence
  source 1..20: mol_type = other DNA
gccagcccgtagacagtctc

SEQ ID NO: 47810 - DNA, 20 bp, synthetic construct
  misc_feature 1..20: note = CRISPR gRNA sequence
  source 1..20: mol_type = other DNA
tggctaattccccatccaca

SEQ ID NO: 47811 - DNA, 20 bp, synthetic construct
  misc_feature 1..20: note = CRISPR gRNA sequence
  source 1..20: mol_type = other DNA
ggctaattccccatccacac

SEQ ID NO: 47812 - DNA, 20 bp, synthetic construct
  misc_feature 1..20: note = CRISPR gRNA sequence
  source 1..20: mol_type = other DNA
ttccccatccacacaggacc

SEQ ID NO: 47813 - DNA, 20 bp, synthetic construct
  misc_feature 1..20: note = CRISPR gRNA sequence
  source 1..20: mol_type = other DNA
tccccatccacacaggacct

SEQ ID NO: 47814 - DNA, 20 bp, synthetic construct
  misc_feature 1..20: note = CRISPR gRNA sequence
  source 1..20: mol_type = other DNA
ccatccacacaggacctggg

SEQ ID NO: 47815 - DNA, 20 bp, synthetic construct
  misc_feature 1..20: note = CRISPR gRNA sequence
  source 1..20: mol_type = other DNA
catccacacaggacctgggt

SEQ ID NO: 47816 - DNA, 20 bp, synthetic construct
  misc_feature 1..20: note = CRISPR gRNA sequence
  source 1..20: mol_type = other DNA
acaggacctgggtaggtatc

SEQ ID NO: 47817 - DNA, 20 bp, synthetic construct
  misc_feature 1..20: note = CRISPR gRNA sequence
  source 1..20: mol_type = other DNA
caggacctgggtaggtatca

SEQ ID NO: 47818 - DNA, 20 bp, synthetic construct
  misc_feature 1..20: note = CRISPR gRNA sequence
  source 1..20: mol_type = other DNA
tgggtaggtatcaaggaccc

SEQ ID NO: 47819 - DNA, 20 bp, synthetic construct
  misc_feature 1..20: note = CRISPR gRNA sequence
  source 1..20: mol_type = other DNA
ggtatcaaggaccctggctt

SEQ ID NO: 47820 - DNA, 20 bp, synthetic construct
  misc_feature 1..20: note = CRISPR gRNA sequence
  source 1..20: mol_type = other DNA
gtatcaaggaccctggcttt

SEQ ID NO: 47821 - DNA, 20 bp, synthetic construct
  misc_feature 1..20: note = CRISPR gRNA sequence
  source 1..20: mol_type = other DNA
tatcaaggaccctggctttg

SEQ ID NO: 47822 - DNA, 20 bp, synthetic construct
  misc_feature 1..20: note = CRISPR gRNA sequence
  source 1..20: mol_type = other DNA
ggaccctggctttggggtct

SEQ ID NO: 47823 - DNA, 20 bp, synthetic construct
  misc_feature 1..20: note = CRISPR gRNA sequence
  source 1..20: mol_type = other DNA
gagatcccaaattcaacacc

SEQ ID NO: 47824 - DNA, 20 bp, synthetic construct
  misc_feature 1..20: note = CRISPR gRNA sequence
  source 1..20: mol_type = other DNA
agatcccaaattcaacacct

SEQ ID NO: 47825 - DNA, 20 bp, synthetic construct
  misc_feature 1..20: note = CRISPR gRNA sequence
  source 1..20: mol_type = other DNA
cacctgggtccttcgtgtat

SEQ ID NO: 47826 - DNA, 20 bp, synthetic construct
  misc_feature 1..20: note = CRISPR gRNA sequence
  source 1..20: mol_type = other DNA
tgggtccttcgtgtatgagt

SEQ ID NO: 47827 - DNA, 20 bp, synthetic construct
  misc_feature 1..20: note = CRISPR gRNA sequence
  source 1..20: mol_type = other DNA
gggtccttcgtgtatgagta

SEQ ID NO: 47828 - DNA, 20 bp, synthetic construct
  misc_feature 1..20: note = CRISPR gRNA sequence
  source 1..20: mol_type = other DNA
aaaattctccacacctctcc

SEQ ID NO: 47829 - DNA, 20 bp, synthetic construct
  misc_feature 1..20: note = CRISPR gRNA sequence
  source 1..20: mol_type = other DNA
ctggccttcattcccttgcc

SEQ ID NO: 47830 - DNA, 20 bp, synthetic construct
  misc_feature 1..20: note = CRISPR gRNA sequence
  source 1..20: mol_type = other DNA
cttcattcccttgcctggaa

SEQ ID NO: 47831 - DNA, 20 bp, synthetic construct
  misc_feature 1..20: note = CRISPR gRNA sequence
  source 1..20: mol_type = other DNA
ttcattcccttgcctggaaa

SEQ ID NO: 47832 - DNA, 20 bp, synthetic construct
  misc_feature 1..20: note = CRISPR gRNA sequence
  source 1..20: mol_type = other DNA
tcattcccttgcctggaaaa

SEQ ID NO: 47833 - DNA, 20 bp, synthetic construct
  misc_feature 1..20: note = CRISPR gRNA sequence
  source 1..20: mol_type = other DNA
attcccttgcctggaaaagg

SEQ ID NO: 47834 - DNA, 20 bp, synthetic construct
  misc_feature 1..20: note = CRISPR gRNA sequence
  source 1..20: mol_type = other DNA
ctggaaaagggagcacataa

SEQ ID NO: 47835 - DNA, 20 bp, synthetic construct
  misc_feature 1..20: note = CRISPR gRNA sequence
  source 1..20: mol_type = other DNA
aagggagcacataaaagtcc

SEQ ID NO: 47836 - DNA, 20 bp, synthetic construct
  misc_feature 1..20: note = CRISPR gRNA sequence
  source 1..20: mol_type = other DNA
gcacataaaagtcccagcac

SEQ ID NO: 47837 - DNA, 20 bp, synthetic construct
  misc_feature 1..20: note = CRISPR gRNA sequence
  source 1..20: mol_type = other DNA
ataaaagtcccagcaccagc

SEQ ID NO: 47838 - DNA, 20 bp, synthetic construct
  misc_feature 1..20: note = CRISPR gRNA sequence
  source 1..20: mol_type = other DNA
gtcccagcaccagccagcca

SEQ ID NO: 47839 - DNA, 20 bp, synthetic construct
  misc_feature 1..20: note = CRISPR gRNA sequence
  source 1..20: mol_type = other DNA
ccagcaccagccagccatgg

SEQ ID NO: 47840 - DNA, 20 bp, synthetic construct
  misc_feature 1..20: note = CRISPR gRNA sequence
  source 1..20: mol_type = other DNA
gtggctcacgcctgtaatcc

SEQ ID NO: 47841 - DNA, 20 bp, synthetic construct
  misc_feature 1..20: note = CRISPR gRNA sequence
  source 1..20: mol_type = other DNA
gcctgtaatcccagcacttt

SEQ ID NO: 47842 - DNA, 20 bp, synthetic construct
  misc_feature 1..20: note = CRISPR gRNA sequence
  source 1..20: mol_type = other DNA
ctgtaatcccagcacttttg

SEQ ID NO: 47843 - DNA, 20 bp, synthetic construct
  misc_feature 1..20: note = CRISPR gRNA sequence
  source 1..20: mol_type = other DNA
tgtaatcccagcacttttgg

SEQ ID NO: 47844 - DNA, 20 bp, synthetic construct
  misc_feature 1..20: note = CRISPR gRNA sequence
  source 1..20: mol_type = other DNA
tcccagcacttttggaggct

SEQ ID NO: 47845 - DNA, 20 bp, synthetic construct
  misc_feature 1..20: note = CRISPR gRNA sequence
  source 1..20: mol_type = other DNA
cccagcacttttggaggctg

SEQ ID NO: 47846 - DNA, 20 bp, synthetic construct
  misc_feature 1..20: note = CRISPR gRNA sequence
  source 1..20: mol_type = other DNA
agcacttttggaggctgagg

SEQ ID NO: 47847 - DNA, 20 bp, synthetic construct
  misc_feature 1..20: note = CRISPR gRNA sequence
  source 1..20: mol_type = other DNA
gcacttttggaggctgaggt

SEQ ID NO: 47848 - DNA, 20 bp, synthetic construct
  misc_feature 1..20: note = CRISPR gRNA sequence
  source 1..20: mol_type = other DNA
cttttggaggctgaggtggg

SEQ ID NO: 47849 - DNA, 20 bp, synthetic construct
  misc_feature 1..20: note = CRISPR gRNA sequence
  source 1..20: mol_type = other DNA
ctgaggtgggtggatcactt

SEQ ID NO: 47850 - DNA, 20 bp, synthetic construct
  misc_feature 1..20: note = CRISPR gRNA sequence
  source 1..20: mol_type = other DNA
tgaggtgggtggatcacttg

SEQ ID NO: 47851 - DNA, 20 bp, synthetic construct
  misc_feature 1..20: note = CRISPR gRNA sequence
  source 1..20: mol_type = other DNA
gtgggtggatcacttgaggc

SEQ ID NO: 47852 - DNA, 20 bp, synthetic construct
  misc_feature 1..20: note = CRISPR gRNA sequence
  source 1..20: mol_type = other DNA
tgggtggatcacttgaggcc

SEQ ID NO: 47853 - DNA, 20 bp, synthetic construct
  misc_feature 1..20: note = CRISPR gRNA sequence
  source 1..20: mol_type = other DNA
ggtggatcacttgaggccag

SEQ ID NO: 47854 - DNA, 20 bp, synthetic construct
  misc_feature 1..20: note = CRISPR gRNA sequence
  source 1..20: mol_type = other DNA
tcacttgaggccaggagtcc

SEQ ID NO: 47855 - DNA, 20 bp, synthetic construct
  misc_feature 1..20: note = CRISPR gRNA sequence
  source 1..20: mol_type = other DNA
tgaggccaggagtccaagac

SEQ ID NO: 47856 - DNA, 20 bp, synthetic construct
  misc_feature 1..20: note = CRISPR gRNA sequence
  source 1..20: mol_type = other DNA
ccaggagtccaagaccagcc

SEQ ID NO: 47857 - DNA, 20 bp, synthetic construct
  misc_feature 1..20: note = CRISPR gRNA sequence
  source 1..20: mol_type = other DNA
caggagtccaagaccagcct

SEQ ID NO: 47858 - DNA, 20 bp, synthetic construct
  misc_feature 1..20: note = CRISPR gRNA sequence
  source 1..20: mol_type = other DNA
caagaccagcctgggcaata

SEQ ID NO: 47859 - DNA, 20 bp, synthetic construct
  misc_feature 1..20: note = CRISPR gRNA sequence
  source 1..20: mol_type = other DNA
tctactaaaaatacaaaaat

SEQ ID NO: 47860 - DNA, 20 bp, synthetic construct
  misc_feature 1..20: note = CRISPR gRNA sequence
  source 1..20: mol_type = other DNA
ctaaaaatacaaaaattagc

SEQ ID NO: 47861 - DNA, 20 bp, synthetic construct
  misc_feature 1..20: note = CRISPR gRNA sequence
  source 1..20: mol_type = other DNA
taaaaatacaaaaattagct

SEQ ID NO: 47862 - DNA, 20 bp, synthetic construct
  misc_feature 1..20: note = CRISPR gRNA sequence
  source 1..20: mol_type = other DNA
atacaaaaattagctgggca

SEQ ID NO: 47863 - DNA, 20 bp, synthetic construct
  misc_feature 1..20: note = CRISPR gRNA sequence
  source 1..20: mol_type = other DNA
caaaaattagctgggcatgg

SEQ ID NO: 47864 - DNA, 20 bp, synthetic construct
  misc_feature 1..20: note = CRISPR gRNA sequence
  source 1..20: mol_type = other DNA
aaaaattagctgggcatggt

SEQ ID NO: 47865 - DNA, 20 bp, synthetic construct
  misc_feature 1..20: note = CRISPR gRNA sequence
  source 1..20: mol_type = other DNA
ggtgggcatgctcgtaatcc

SEQ ID NO: 47866 - DNA, 20 bp, synthetic construct
  misc_feature 1..20: note = CRISPR gRNA sequence
  source 1..20: mol_type = other DNA
gctcgtaatcccagctactc

SEQ ID NO: 47867 - DNA, 20 bp, synthetic construct
  misc_feature 1..20: note = CRISPR gRNA sequence
  source 1..20: mol_type = other DNA
cgtaatcccagctactctgg

SEQ ID NO: 47868 - DNA, 20 bp, synthetic construct
  misc_feature 1..20: note = CRISPR gRNA sequence
  source 1..20: mol_type = other DNA
tcccagctactctggtagct

SEQ ID NO: 47869 - DNA, 20 bp, synthetic construct
  misc_feature 1..20: note = CRISPR gRNA sequence
  source 1..20: mol_type = other DNA
cccagctactctggtagctg

SEQ ID NO: 47870 - DNA, 20 bp, synthetic construct
  misc_feature 1..20: note = CRISPR gRNA sequence
  source 1..20: mol_type = other DNA
tactctggtagctgaggcac

SEQ ID NO: 47871 - DNA, 20 bp, synthetic construct
  misc_feature 1..20: note = CRISPR gRNA sequence
  source 1..20: mol_type = other DNA
gcacaagaattgcttgaacc

SEQ ID NO: 47872 - DNA, 20 bp, synthetic construct
  misc_feature 1..20: note = CRISPR gRNA sequence
  source 1..20: mol_type = other DNA
cacaagaattgcttgaaccc

SEQ ID NO: 47873 - DNA, 20 bp, synthetic construct
  misc_feature 1..20: note = CRISPR gRNA sequence
  source 1..20: mol_type = other DNA
caagaattgcttgaacccgg

SEQ ID NO: 47874 - DNA, 20 bp, synthetic construct
  misc_feature 1..20: note = CRISPR gRNA sequence
  source 1..20: mol_type = other DNA
aagaattgcttgaacccggg

SEQ ID NO: 47875 - DNA, 20 bp, synthetic construct
  misc_feature 1..20: note = CRISPR gRNA sequence
  source 1..20: mol_type = other DNA
aattgcttgaacccgggagg

SEQ ID NO: 47876 - DNA, 20 bp, synthetic construct
  misc_feature 1..20: note = CRISPR gRNA sequence
  source 1..20: mol_type = other DNA
ttgcttgaacccgggaggtg

SEQ ID NO: 47877 - DNA, 20 bp, synthetic construct
  misc_feature 1..20: note = CRISPR gRNA sequence
  source 1..20: mol_type = other DNA
tgcttgaacccgggaggtgg

SEQ ID NO: 47878 - DNA, 20 bp, synthetic construct
  misc_feature 1..20: note = CRISPR gRNA sequence
  source 1..20: mol_type = other DNA
aacccgggaggtggaggttg

SEQ ID NO: 47879 - DNA, 20 bp, synthetic construct
  misc_feature 1..20: note = CRISPR gRNA sequence
  source 1..20: mol_type = other DNA
cgggaggtggaggttgcagt

SEQ ID NO: 47880 - DNA, 20 bp, synthetic construct
  misc_feature 1..20: note = CRISPR gRNA sequence
  source 1..20: mol_type = other DNA
ggtggaggttgcagtgagcc

SEQ ID NO: 47881 - DNA, 20 bp, synthetic construct
  misc_feature 1..20: note = CRISPR gRNA sequence
  source 1..20: mol_type = other DNA
gtggaggttgcagtgagccg

SEQ ID NO: 47882 - DNA, 20 bp, synthetic construct
  misc_feature 1..20: note = CRISPR gRNA sequence
  source 1..20: mol_type = other DNA
gaggttgcaccactgcactc

SEQ ID NO: 47883 - DNA, 20 bp, synthetic construct
  misc_feature 1..20: note = CRISPR gRNA sequence
  source 1..20: mol_type = other DNA
tgcaccactgcactccagcc

SEQ ID NO: 47884 - DNA, 20 bp, synthetic construct
  misc_feature 1..20: note = CRISPR gRNA sequence
  source 1..20: mol_type = other DNA
gcaccactgcactccagcct

SEQ ID NO: 47885 - DNA, 20 bp, synthetic construct
  misc_feature 1..20: note = CRISPR gRNA sequence
  source 1..20: mol_type = other DNA
ctgcactccagcctgggtga

SEQ ID NO: 47886 - DNA, 20 bp, synthetic construct
  misc_feature 1..20: note = CRISPR gRNA sequence
  source 1..20: mol_type = other DNA
gcactccagcctgggtgaca

SEQ ID NO: 47887 - DNA, 20 bp, synthetic construct
  misc_feature 1..20: note = CRISPR gRNA sequence
  source 1..20: mol_type = other DNA
actccagcctgggtgacaga

SEQ ID NO: 47888 - DNA, 20 bp, synthetic construct
  misc_feature 1..20: note = CRISPR gRNA sequence
  source 1..20: mol_type = other DNA
tccagcctgggtgacagaga

SEQ ID NO: 47889 - DNA, 20 bp, synthetic construct
  misc_feature 1..20: note = CRISPR gRNA sequence
  source 1..20: mol_type = other DNA
aaaaaaaaaaaaaaaaaaac

SEQ ID NO: 47890 - DNA, 20 bp, synthetic construct
  misc_feature 1..20: note = CRISPR gRNA sequence
  source 1..20: mol_type = other DNA
aaaaaaaaaaaaaaaaaaca

SEQ ID NO: 47891 - DNA, 20 bp, synthetic construct
  misc_feature 1..20: note = CRISPR gRNA sequence
  source 1..20: mol_type = other DNA
aaaaaaaaaaaacaaggtcc

SEQ ID NO: 47892 - DNA, 20 bp, synthetic construct
  misc_feature 1..20: note = CRISPR gRNA sequence
  source 1..20: mol_type = other DNA
aaaacaaggtcccagcactc

SEQ ID NO: 47893 - DNA, 20 bp, synthetic construct
  misc_feature 1..20: note = CRISPR gRNA sequence
  source 1..20: mol_type = other DNA
aaacaaggtcccagcactct

SEQ ID NO: 47894 - DNA, 20 bp, synthetic construct
  misc_feature 1..20: note = CRISPR gRNA sequence
  source 1..20: mol_type = other DNA
gtcccagcactctgggactc

SEQ ID NO: 47895 - DNA, 20 bp, synthetic construct
  misc_feature 1..20: note = CRISPR gRNA sequence
  source 1..20: mol_type = other DNA
tcccagcactctgggactct

SEQ ID NO: 47896 - DNA, 20 bp, synthetic construct
  misc_feature 1..20: note = CRISPR gRNA sequence
  source 1..20: mol_type = other DNA
cccagcactctgggactctg

SEQ ID NO: 47897 - DNA, 20 bp, synthetic construct
  misc_feature 1..20: note = CRISPR gRNA sequence
  source 1..20: mol_type = other DNA
ccagcactctgggactctgg

SEQ ID NO: 47898 - DNA, 20 bp, synthetic construct
  misc_feature 1..20: note = CRISPR gRNA sequence
  source 1..20: mol_type = other DNA
tgggactctgggggctgcca

SEQ ID NO: 47899 - DNA, 20 bp, synthetic construct
  misc_feature 1..20: note = CRISPR gRNA sequence
  source 1..20: mol_type = other DNA
gggactctgggggctgccat

SEQ ID NO: 47900 - DNA, 20 bp, synthetic construct
  misc_feature 1..20: note = CRISPR gRNA sequence
  source 1..20: mol_type = other DNA
ggactctgggggctgccatg

SEQ ID NO: 47901 - DNA, 20 bp, synthetic construct
  misc_feature 1..20: note = CRISPR gRNA sequence
  source 1..20: mol_type = other DNA
ggctgccatggggctgcaat

SEQ ID NO: 47902 - DNA, 20 bp, synthetic construct
  misc_feature 1..20: note = CRISPR gRNA sequence
  source 1..20: mol_type = other DNA
gctgccatggggctgcaatg

SEQ ID NO: 47903 - DNA, 20 bp, synthetic construct
  misc_feature 1..20: note = CRISPR gRNA sequence
  source 1..20: mol_type = other DNA
ctgcaatgaggtcatttgtg

SEQ ID NO: 47904 - DNA, 20 bp, synthetic construct
  misc_feature 1..20: note = CRISPR gRNA sequence
  source 1..20: mol_type = other DNA
gaggtcatttgtgaagtgct

SEQ ID NO: 47905 - DNA, 20 bp, synthetic construct
  misc_feature 1..20: note = CRISPR gRNA sequence
  source 1..20: mol_type = other DNA
aggtcatttgtgaagtgctg

SEQ ID NO: 47906 - DNA, 20 bp, synthetic construct
  misc_feature 1..20: note = CRISPR gRNA sequence
  source 1..20: mol_type = other DNA
agtgctgaggccacgttgat

SEQ ID NO: 47907 - DNA, 20 bp, synthetic construct
  misc_feature 1..20: note = CRISPR gRNA sequence
  source 1..20: mol_type = other DNA
attggcaccgtgctcctgcg

SEQ ID NO: 47908 - DNA, 20 bp, synthetic construct
  misc_feature 1..20: note = CRISPR gRNA sequence
  source 1..20: mol_type = other DNA
gctcctgcgaagccctctgc

SEQ ID NO: 47909 - DNA, 20 bp, synthetic construct
  misc_feature 1..20: note = CRISPR gRNA sequence
  source 1..20: mol_type = other DNA
ctcctgcgaagccctctgcc

SEQ ID NO: 47910 - DNA, 20 bp, synthetic construct
  misc_feature 1..20: note = CRISPR gRNA sequence
  source 1..20: mol_type = other DNA
caggatttctcattcgccct

SEQ ID NO: 47911 - DNA, 20 bp, synthetic construct
  misc_feature 1..20: note = CRISPR gRNA sequence
  source 1..20: mol_type = other DNA
aggatttctcattcgccctc

SEQ ID NO: 47912 - DNA, 20 bp, synthetic construct
  misc_feature 1..20: note = CRISPR gRNA sequence
  source 1..20: mol_type = other DNA
ggatttctcattcgccctca

SEQ ID NO: 47913 - DNA, 20 bp, synthetic construct
  misc_feature 1..20: note = CRISPR gRNA sequence
  source 1..20: mol_type = other DNA
cgccctcagggacccgctca

SEQ ID NO: 47914 - DNA, 20 bp, synthetic construct
  misc_feature 1..20: note = CRISPR gRNA sequence
  source 1..20: mol_type = other DNA
gccctcagggacccgctcac

SEQ ID NO: 47915 - DNA, 20 bp, synthetic construct
  misc_feature 1..20: note = CRISPR gRNA sequence
  source 1..20: mol_type = other DNA
ccctcagggacccgctcaca

SEQ ID NO: 47916 - DNA, 20 bp, synthetic construct
  misc_feature 1..20: note = CRISPR gRNA sequence
  source 1..20: mol_type = other DNA
gctcacagggcacaatgaac

SEQ ID NO: 47917 - DNA, 20 bp, synthetic construct
  misc_feature 1..20: note = CRISPR gRNA sequence
  source 1..20: mol_type = other DNA
ctcacagggcacaatgaact

SEQ ID NO: 47918 - DNA, 20 bp, synthetic construct
  misc_feature 1..20: note = CRISPR gRNA sequence
  source 1..20: mol_type = other DNA
ttgtacttcttttgcatgtg

SEQ ID NO: 47919 - DNA, 20 bp, synthetic construct
  misc_feature 1..20: note = CRISPR gRNA sequence
  source 1..20: mol_type = other DNA
cttttgcatgtgaagaaact

SEQ ID NO: 47920 - DNA, 20 bp, synthetic construct
  misc_feature 1..20: note = CRISPR gRNA sequence
  source 1..20: mol_type = other DNA
ttttgcatgtgaagaaactg

SEQ ID NO: 47921 - DNA, 20 bp, synthetic construct
  misc_feature 1..20: note = CRISPR gRNA sequence
  source 1..20: mol_type = other DNA
catgtgaagaaactgaggct

SEQ ID NO: 47922 - DNA, 20 bp, synthetic construct
  misc_feature 1..20: note = CRISPR gRNA sequence
  source 1..20: mol_type = other DNA
gtgaagaaactgaggctgag

SEQ ID NO: 47923 - DNA, 20 bp, synthetic construct
  misc_feature 1..20: note = CRISPR gRNA sequence
  source 1..20: mol_type = other DNA
tgaagaaactgaggctgaga

SEQ ID NO: 47924 - DNA, 20 bp, synthetic construct
  misc_feature 1..20: note = CRISPR gRNA sequence
  source 1..20: mol_type = other DNA
gaagaaactgaggctgagaa

SEQ ID NO: 47925 - DNA, 20 bp, synthetic construct
  misc_feature 1..20: note = CRISPR gRNA sequence
  source 1..20: mol_type = other DNA
aagaaactgaggctgagaag

SEQ ID NO: 47926 - DNA, 20 bp, synthetic construct
  misc_feature 1..20: note = CRISPR gRNA sequence
  source 1..20: mol_type = other DNA
aaactgaggctgagaagggg

SEQ ID NO: 47927 - DNA, 20 bp, synthetic construct
  misc_feature 1..20: note = CRISPR gRNA sequence
  source 1..20: mol_type = other DNA
aactgaggctgagaaggggc

SEQ ID NO: 47928 - DNA, 20 bp, synthetic construct
  misc_feature 1..20: note = CRISPR gRNA sequence
  source 1..20: mol_type = other DNA
actgaggctgagaaggggca

SEQ ID NO: 47929 - DNA, 20 bp, synthetic construct
  misc_feature 1..20: note = CRISPR gRNA sequence
  source 1..20: mol_type = other DNA
ctgaggctgagaaggggcag

SEQ ID NO: 47930 - DNA, 20 bp, synthetic construct
  misc_feature 1..20: note = CRISPR gRNA sequence
  source 1..20: mol_type = other DNA
gctgagaaggggcaggggtt

SEQ ID NO: 47931 - DNA, 20 bp, synthetic construct
  misc_feature 1..20: note = CRISPR gRNA sequence
  source 1..20: mol_type = other DNA
gaaggggcaggggtttggcc

SEQ ID NO: 47932 - DNA, 20 bp, synthetic construct
  misc_feature 1..20: note = CRISPR gRNA sequence
  source 1..20: mol_type = other DNA
aaggggcaggggtttggcca

SEQ ID NO: 47933 - DNA, 20 bp, synthetic construct
  misc_feature 1..20: note = CRISPR gRNA sequence
  source 1..20: mol_type = other DNA
ggcaggggtttggccaaggt

SEQ ID NO: 47934 - DNA, 20 bp, synthetic construct
  misc_feature 1..20: note = CRISPR gRNA sequence
  source 1..20: mol_type = other DNA
gcaggggtttggccaaggtc

SEQ ID NO: 47935 - DNA, 20 bp, synthetic construct
  misc_feature 1..20: note = CRISPR gRNA sequence
  source 1..20: mol_type = other DNA
ggggtttggccaaggtcagg

SEQ ID NO: 47936 - DNA, 20 bp, synthetic construct
  misc_feature 1..20: note = CRISPR gRNA sequence
  source 1..20: mol_type = other DNA
gggtttggccaaggtcaggc

SEQ ID NO: 47937 - DNA, 20 bp, synthetic construct
  misc_feature 1..20: note = CRISPR gRNA sequence
  source 1..20: mol_type = other DNA
ggtttggccaaggtcaggca

SEQ ID NO: 47938 - DNA, 20 bp, synthetic construct
  misc_feature 1..20: note = CRISPR gRNA sequence
  source 1..20: mol_type = other DNA
gtttggccaaggtcaggcag

SEQ ID NO: 47939 - DNA, 20 bp, synthetic construct
  misc_feature 1..20: note = CRISPR gRNA sequence
  source 1..20: mol_type = other DNA
ggccaaggtcaggcaggggc

SEQ ID NO: 47940 - DNA, 20 bp, synthetic construct
  misc_feature 1..20: note = CRISPR gRNA sequence
  source 1..20: mol_type = other DNA
caaggtcaggcaggggccag

SEQ ID NO: 47941 - DNA, 20 bp, synthetic construct
  misc_feature 1..20: note = CRISPR gRNA sequence
  source 1..20: mol_type = other DNA
ggtcaggcaggggccagtgg

SEQ ID NO: 47942 - DNA, 20 bp, synthetic construct
  misc_feature 1..20: note = CRISPR gRNA sequence
  source 1..20: mol_type = other DNA
tcaggcaggggccagtggca

SEQ ID NO: 47943 - DNA, 20 bp, synthetic construct
  misc_feature 1..20: note = CRISPR gRNA sequence
  source 1..20: mol_type = other DNA
gcaggggccagtggcagagc

SEQ ID NO: 47944 - DNA, 20 bp, synthetic construct
  misc_feature 1..20: note = CRISPR gRNA sequence
  source 1..20: mol_type = other DNA
caggggccagtggcagagcc

SEQ ID NO: 47945 - DNA, 20 bp, synthetic construct
  misc_feature 1..20: note = CRISPR gRNA sequence
  source 1..20: mol_type = other DNA
gccagtggcagagccaggac

SEQ ID NO: 47946 - DNA, 20 bp, synthetic construct
  misc_feature 1..20: note = CRISPR gRNA sequence
  source 1..20: mol_type = other DNA
ccagtggcagagccaggact

SEQ ID NO: 47947 - DNA, 20 bp, synthetic construct
  misc_feature 1..20: note = CRISPR gRNA sequence
  source 1..20: mol_type = other DNA
tggcagagccaggactaggc

SEQ ID NO: 47948 - DNA, 20 bp, synthetic construct
  misc_feature 1..20: note = CRISPR gRNA sequence
  source 1..20: mol_type = other DNA
ggcagagccaggactaggct

SEQ ID NO: 47949 - DNA, 20 bp, synthetic construct
  misc_feature 1..20: note = CRISPR gRNA sequence
  source 1..20: mol_type = other DNA
gcctcctgattttcttgctg

SEQ ID NO: 47950 - DNA, 20 bp, synthetic construct
  misc_feature 1..20: note = CRISPR gRNA sequence
  source 1..20: mol_type = other DNA
gattttcttgctgcagacat

SEQ ID NO: 47951 - DNA, 20 bp, synthetic construct
  misc_feature 1..20: note = CRISPR gRNA sequence
  source 1..20: mol_type = other DNA
ttttcttgctgcagacatca

SEQ ID NO: 47952 - DNA, 20 bp, synthetic construct
  misc_feature 1..20: note = CRISPR gRNA sequence
  source 1..20: mol_type = other DNA
tttcttgctgcagacatcag

SEQ ID NO: 47953 - DNA, 20 bp, synthetic construct
  misc_feature 1..20: note = CRISPR gRNA sequence
  source 1..20: mol_type = other DNA
cttgctgcagacatcagagg

SEQ ID NO: 47954 - DNA, 20 bp, synthetic construct
  misc_feature 1..20: note = CRISPR gRNA sequence
  source 1..20: mol_type = other DNA
ttgctgcagacatcagaggc

SEQ ID NO: 47955 - DNA, 20 bp, synthetic construct
  misc_feature 1..20: note = CRISPR gRNA sequence
  source 1..20: mol_type = other DNA
tgctgcagacatcagaggca

SEQ ID NO: 47956 - DNA, 20 bp, synthetic construct
  misc_feature 1..20: note = CRISPR gRNA sequence
  source 1..20: mol_type = other DNA
tgcagacatcagaggcaggg

SEQ ID NO: 47957 - DNA, 20 bp, synthetic construct
  misc_feature 1..20: note = CRISPR gRNA sequence
  source 1..20: mol_type = other DNA
gcagacatcagaggcaggga

SEQ ID NO: 47958 - DNA, 20 bp, synthetic construct
  misc_feature 1..20: note = CRISPR gRNA sequence
  source 1..20: mol_type = other DNA
catcagaggcagggaaggaa

SEQ ID NO: 47959 - DNA, 20 bp, synthetic construct
  misc_feature 1..20: note = CRISPR gRNA sequence
  source 1..20: mol_type = other DNA
atcagaggcagggaaggaac

SEQ ID NO: 47960 - DNA, 20 bp, synthetic construct
  misc_feature 1..20: note = CRISPR gRNA sequence
  source 1..20: mol_type = other DNA
agaggcagggaaggaacagg

SEQ ID NO: 47961 - DNA, 20 bp, synthetic construct
  misc_feature 1..20: note = CRISPR gRNA sequence
  source 1..20: mol_type = other DNA
gaggcagggaaggaacaggc

SEQ ID NO: 47962 - DNA, 20 bp, synthetic construct
  misc_feature 1..20: note = CRISPR gRNA sequence
  source 1..20: mol_type = other DNA
ggcagggaaggaacaggcag

SEQ ID NO: 47963 - DNA, 20 bp, synthetic construct
  misc_feature 1..20: note = CRISPR gRNA sequence
  source 1..20: mol_type = other DNA
cagggaaggaacaggcagga

SEQ ID NO: 47964 - DNA, 20 bp, synthetic construct
  misc_feature 1..20: note = CRISPR gRNA sequence
  source 1..20: mol_type = other DNA
ggaaggaacaggcaggagag

SEQ ID NO: 47965 - DNA, 20 bp, synthetic construct
  misc_feature 1..20: note = CRISPR gRNA sequence
  source 1..20: mol_type = other DNA
gaaggaacaggcaggagagt

SEQ ID NO: 47966 - DNA, 20 bp, synthetic construct
  misc_feature 1..20: note = CRISPR gRNA sequence
  source 1..20: mol_type = other DNA
caggagagtgggtatatgcc

SEQ ID NO: 47967 - DNA, 20 bp, synthetic construct
  misc_feature 1..20: note = CRISPR gRNA sequence
  source 1..20: mol_type = other DNA
ggtatatgccaagcttgact

SEQ ID NO: 47968 - DNA, 20 bp, synthetic construct
  misc_feature 1..20: note = CRISPR gRNA sequence
  source 1..20: mol_type = other DNA
gtatatgccaagcttgactt

SEQ ID NO: 47969 - DNA, 20 bp, synthetic construct
  misc_feature 1..20: note = CRISPR gRNA sequence
  source 1..20: mol_type = other DNA
tatatgccaagcttgacttg

SEQ ID NO: 47970 - DNA, 20 bp, synthetic construct
  misc_feature 1..20: note = CRISPR gRNA sequence
  source 1..20: mol_type = other DNA
atgccaagcttgacttgggg

SEQ ID NO: 47971 - DNA, 20 bp, synthetic construct
  misc_feature 1..20: note = CRISPR gRNA sequence
  source 1..20: mol_type = other DNA
tgccaagcttgacttggggc

SEQ ID NO: 47972 - DNA, 20 bp, synthetic construct
  misc_feature 1..20: note = CRISPR gRNA sequence
  source 1..20: mol_type = other DNA
gccaagcttgacttggggca

SEQ ID NO: 47973 - DNA, 20 bp, synthetic construct
  misc_feature 1..20: note = CRISPR gRNA sequence
  source 1..20: mol_type = other DNA
aagcttgacttggggcaggg

SEQ ID NO: 47974 - DNA, 20 bp, synthetic construct
  misc_feature 1..20: note = CRISPR gRNA sequence
  source 1..20: mol_type = other DNA
gggcagggcagctcaactga

SEQ ID NO: 47975 - DNA, 20 bp, synthetic construct
  misc_feature 1..20: note = CRISPR gRNA sequence
  source 1..20: mol_type = other DNA
ggcagggcagctcaactgat

SEQ ID NO: 47976 - DNA, 20 bp, synthetic construct
  misc_feature 1..20: note = CRISPR gRNA sequence
  source 1..20: mol_type = other DNA
gcagggcagctcaactgatg

SEQ ID NO: 47977 - DNA, 20 bp, synthetic construct
  misc_feature 1..20: note = CRISPR gRNA sequence
  source 1..20: mol_type = other DNA
cagggcagctcaactgatgg

SEQ ID NO: 47978 - DNA, 20 bp, synthetic construct
  misc_feature 1..20: note = CRISPR gRNA sequence
  source 1..20: mol_type = other DNA
cagctcaactgatgggggcc

SEQ ID NO: 47979 - DNA, 20 bp, synthetic construct
  misc_feature 1..20: note = CRISPR gRNA sequence
  source 1..20: mol_type = other DNA
tggacccccccactgctccc

SEQ ID NO: 47980 - DNA, 20 bp, synthetic construct
  misc_feature 1..20: note = CRISPR gRNA sequence
  source 1..20: mol_type = other DNA
ggacccccccactgctcccg

SEQ ID NO: 47981 - DNA, 20 bp, synthetic construct
  misc_feature 1..20: note = CRISPR gRNA sequence
  source 1..20: mol_type = other DNA
ccgaggaccctcctccccac

SEQ ID NO: 47982 - DNA, 20 bp, synthetic construct
  misc_feature 1..20: note = CRISPR gRNA sequence
  source 1..20: mol_type = other DNA
tcctccccaccagccctgca

SEQ ID NO: 47983 - DNA, 20 bp, synthetic construct
  misc_feature 1..20: note = CRISPR gRNA sequence
  source 1..20: mol_type = other DNA
cccaccagccctgcatggta

SEQ ID NO: 47984 - DNA, 20 bp, synthetic construct
  misc_feature 1..20: note = CRISPR gRNA sequence
  source 1..20: mol_type = other DNA
ccaccagccctgcatggtat

SEQ ID NO: 47985 - DNA, 20 bp, synthetic construct
  misc_feature 1..20: note = CRISPR gRNA sequence
  source 1..20: mol_type = other DNA
ccagccctgcatggtatggg

SEQ ID NO: 47986 - DNA, 20 bp, synthetic construct
  misc_feature 1..20: note = CRISPR gRNA sequence
  source 1..20: mol_type = other DNA
cagccctgcatggtatgggc

SEQ ID NO: 47987 - DNA, 20 bp, synthetic construct
  misc_feature 1..20: note = CRISPR gRNA sequence
  source 1..20: mol_type = other DNA
agccctgcatggtatgggca

SEQ ID NO: 47988 - DNA, 20 bp, synthetic construct
  misc_feature 1..20: note = CRISPR gRNA sequence
  source 1..20: mol_type = other DNA
gccctgcatggtatgggcag

SEQ ID NO: 47989 - DNA, 20 bp, synthetic construct
  misc_feature 1..20: note = CRISPR gRNA sequence
  source 1..20: mol_type = other DNA
ccctgcatggtatgggcagg

SEQ ID NO: 47990 - DNA, 20 bp, synthetic construct
  misc_feature 1..20: note = CRISPR gRNA sequence
  source 1..20: mol_type = other DNA
gggcagggggccactcactg

SEQ ID NO: 47991 - DNA, 20 bp, synthetic construct
  misc_feature 1..20: note = CRISPR gRNA sequence
  source 1..20: mol_type = other DNA
ggcagggggccactcactgt

SEQ ID NO: 47992 - DNA, 20 bp, synthetic construct
  misc_feature 1..20: note = CRISPR gRNA sequence
  source 1..20: mol_type = other DNA
gccactcactgtaggaccct

SEQ ID NO: 47993 - DNA, 20 bp, synthetic construct
  misc_feature 1..20: note = CRISPR gRNA sequence
  source 1..20: mol_type = other DNA
ccactcactgtaggaccctc

SEQ ID NO: 47994 - DNA, 20 bp, synthetic construct
  misc_feature 1..20: note = CRISPR gRNA sequence
  source 1..20: mol_type = other DNA
actgtaggaccctcaggtgc

SEQ ID NO: 47995 - DNA, 20 bp, synthetic construct
  misc_feature 1..20: note = CRISPR gRNA sequence
  source 1..20: mol_type = other DNA
ctgtaggaccctcaggtgct

SEQ ID NO: 47996 - DNA, 20 bp, synthetic construct
  misc_feature 1..20: note = CRISPR gRNA sequence
  source 1..20: mol_type = other DNA
tgtaggaccctcaggtgctg

SEQ ID NO: 47997 - DNA, 20 bp, synthetic construct
  misc_feature 1..20: note = CRISPR gRNA sequence
  source 1..20: mol_type = other DNA
aggaccctcaggtgctgggg

SEQ ID NO: 47998 - DNA, 20 bp, synthetic construct
  misc_feature 1..20: note = CRISPR gRNA sequence
  source 1..20: mol_type = other DNA
caggtgctggggcagctcct

SEQ ID NO: 47999 - DNA, 20 bp, synthetic construct
  misc_feature 1..20: note = CRISPR gRNA sequence
  source 1..20: mol_type = other DNA
tgctggggcagctcctgagc

SEQ ID NO: 48000 - DNA, 20 bp, synthetic construct
  misc_feature 1..20: note = CRISPR gRNA sequence
  source 1..20: mol_type = other DNA
ggcagctcctgagccagccc

SEQ ID NO: 48001 - DNA, 20 bp, synthetic construct
  misc_feature 1..20: note = CRISPR gRNA sequence
  source 1..20: mol_type = other DNA
gcagctcctgagccagcccc

SEQ ID NO: 48002 - DNA, 20 bp, synthetic construct
  misc_feature 1..20: note = CRISPR gRNA sequence
  source 1..20: mol_type = other DNA
cagctcctgagccagcccca

SEQ ID NO: 48003 - DNA, 20 bp, synthetic construct
  misc_feature 1..20: note = CRISPR gRNA sequence
  source 1..20: mol_type = other DNA
ctgagccagccccagggctg

SEQ ID NO: 48004 - DNA, 20 bp, synthetic construct
  misc_feature 1..20: note = CRISPR gRNA sequence
  source 1..20: mol_type = other DNA
tgagccagccccagggctgt

SEQ ID NO: 48005 - DNA, 20 bp, synthetic construct
  misc_feature 1..20: note = CRISPR gRNA sequence
  source 1..20: mol_type = other DNA
cccagggctgtgggatcccc

SEQ ID NO: 48006 - DNA, 20 bp, synthetic construct
  misc_feature 1..20: note = CRISPR gRNA sequence
  source 1..20: mol_type = other DNA
ccagggctgtgggatccccc

SEQ ID NO: 48007 - DNA, 20 bp, synthetic construct
  misc_feature 1..20: note = CRISPR gRNA sequence
  source 1..20: mol_type = other DNA
cagggctgtgggatccccca

SEQ ID NO: 48008 - DNA, 20 bp, synthetic construct
  misc_feature 1..20: note = CRISPR gRNA sequence
  source 1..20: mol_type = other DNA
tgggatcccccagggcattg

SEQ ID NO: 48009 - DNA, 20 bp, synthetic construct
  misc_feature 1..20: note = CRISPR gRNA sequence
  source 1..20: mol_type = other DNA
tcccccagggcattgcagcc

SEQ ID NO: 48010 - DNA, 20 bp, synthetic construct
  misc_feature 1..20: note = CRISPR gRNA sequence
  source 1..20: mol_type = other DNA
cagggcattgcagccaagcc

SEQ ID NO: 48011 - DNA, 20 bp, synthetic construct
  misc_feature 1..20: note = CRISPR gRNA sequence
  source 1..20: mol_type = other DNA
ggcattgcagccaagcctgg

SEQ ID NO: 48012 - DNA, 20 bp, synthetic construct
  misc_feature 1..20: note = CRISPR gRNA sequence
  source 1..20: mol_type = other DNA
cattgcagccaagcctggaa

SEQ ID NO: 48013 - DNA, 20 bp, synthetic construct
  misc_feature 1..20: note = CRISPR gRNA sequence
  source 1..20: mol_type = other DNA
attgcagccaagcctggaag

SEQ ID NO: 48014 - DNA, 20 bp, synthetic construct
  misc_feature 1..20: note = CRISPR gRNA sequence
  source 1..20: mol_type = other DNA
tgcagccaagcctggaagag

SEQ ID NO: 48015 - DNA, 20 bp, synthetic construct
  misc_feature 1..20: note = CRISPR gRNA sequence
  source 1..20: mol_type = other DNA
cagccaagcctggaagagga

SEQ ID NO: 48016 - DNA, 20 bp, synthetic construct
  misc_feature 1..20: note = CRISPR gRNA sequence
  source 1..20: mol_type = other DNA
agccaagcctggaagaggag

SEQ ID NO: 48017 - DNA, 20 bp, synthetic construct
  misc_feature 1..20: note = CRISPR gRNA sequence
  source 1..20: mol_type = other DNA
gcctggaagaggagaggaat

SEQ ID NO: 48018 - DNA, 20 bp, synthetic construct
  misc_feature 1..20: note = CRISPR gRNA sequence
  source 1..20: mol_type = other DNA
agaggagaggaatgagcatt

SEQ ID NO: 48019 - DNA, 20 bp, synthetic construct
  misc_feature 1..20: note = CRISPR gRNA sequence
  source 1..20: mol_type = other DNA
gaggaatgagcattgagtac

SEQ ID NO: 48020 - DNA, 20 bp, synthetic construct
  misc_feature 1..20: note = CRISPR gRNA sequence
  source 1..20: mol_type = other DNA
aggaatgagcattgagtact

SEQ ID NO: 48021 - DNA, 20 bp, synthetic construct
  misc_feature 1..20: note = CRISPR gRNA sequence
  source 1..20: mol_type = other DNA
gagtactgggcctgcccact

SEQ ID NO: 48022 - DNA, 20 bp, synthetic construct
  misc_feature 1..20: note = CRISPR gRNA sequence
  source 1..20: mol_type = other DNA
agtactgggcctgcccactc

SEQ ID NO: 48023 - DNA, 20 bp, synthetic construct
  misc_feature 1..20: note = CRISPR gRNA sequence
  source 1..20: mol_type = other DNA
gccctgccctgtgcccactg

SEQ ID NO: 48024 - DNA, 20 bp, synthetic construct
  misc_feature 1..20: note = CRISPR gRNA sequence
  source 1..20: mol_type = other DNA
ccctgccctgtgcccactgc

SEQ ID NO: 48025 - DNA, 20 bp, synthetic construct
  misc_feature 1..20: note = CRISPR gRNA sequence
  source 1..20: mol_type = other DNA
ctgccctgtgcccactgcgg

SEQ ID NO: 48026 - DNA, 20 bp, synthetic construct
  misc_feature 1..20: note = CRISPR gRNA sequence
  source 1..20: mol_type = other DNA
gccctgtgcccactgcggga

SEQ ID NO: 48027 - DNA, 20 bp, synthetic construct
  misc_feature 1..20: note = CRISPR gRNA sequence
  source 1..20: mol_type = other DNA
ccctgtgcccactgcgggag

SEQ ID NO: 48028 - DNA, 20 bp, synthetic construct
  misc_feature 1..20: note = CRISPR gRNA sequence
  source 1..20: mol_type = other DNA
ctgtgcccactgcgggagag

SEQ ID NO: 48029 - DNA, 20 bp, synthetic construct
  misc_feature 1..20: note = CRISPR gRNA sequence
  source 1..20: mol_type = other DNA
tgtgcccactgcgggagagg

SEQ ID NO: 48030 - DNA, 20 bp, synthetic construct
  misc_feature 1..20: note = CRISPR gRNA sequence
  source 1..20: mol_type = other DNA
cccactgcgggagaggaggc

SEQ ID NO: 48031 - DNA, 20 bp, synthetic construct
  misc_feature 1..20: note = CRISPR gRNA sequence
  source 1..20: mol_type = other DNA
ccactgcgggagaggaggcc

SEQ ID NO: 48032 - DNA, 20 bp, synthetic construct
  misc_feature 1..20: note = CRISPR gRNA sequence
  source 1..20: mol_type = other DNA
ctgcgggagaggaggccagg

SEQ ID NO: 48033 - DNA, 20 bp, synthetic construct
  misc_feature 1..20: note = CRISPR gRNA sequence
  source 1..20: mol_type = other DNA
gagaggaggccaggtggacc

SEQ ID NO: 48034 - DNA, 20 bp, synthetic construct
  misc_feature 1..20: note = CRISPR gRNA sequence
  source 1..20: mol_type = other DNA
agaggaggccaggtggacct

SEQ ID NO: 48035 - DNA, 20 bp, synthetic construct
  misc_feature 1..20: note = CRISPR gRNA sequence
  source 1..20: mol_type = other DNA
gaggaggccaggtggacctg

SEQ ID NO: 48036 - DNA, 20 bp, synthetic construct
  misc_feature 1..20: note = CRISPR gRNA sequence
  source 1..20: mol_type = other DNA
aggaggccaggtggacctgg

SEQ ID NO: 48037 - DNA, 20 bp, synthetic construct
  misc_feature 1..20: note = CRISPR gRNA sequence
  source 1..20: mol_type = other DNA
ggaggccaggtggacctggg

SEQ ID NO: 48038 - DNA, 20 bp, synthetic construct
  misc_feature 1..20: note = CRISPR gRNA sequence
  source 1..20: mol_type = other DNA
ccaggtggacctggggggca

SEQ ID NO: 48039 - DNA, 20 bp, synthetic construct
  misc_feature 1..20: note = CRISPR gRNA sequence
  source 1..20: mol_type = other DNA
aggtggacctggggggcaca

SEQ ID NO: 48040 - DNA, 20 bp, synthetic construct
  misc_feature 1..20: note = CRISPR gRNA sequence
  source 1..20: mol_type = other DNA
ggtggacctggggggcacag

SEQ ID NO: 48041 - DNA, 20 bp, synthetic construct
  misc_feature 1..20: note = CRISPR gRNA sequence
  source 1..20: mol_type = other DNA
gtggacctggggggcacaga

SEQ ID NO: 48042 - DNA, 20 bp, synthetic construct
  misc_feature 1..20: note = CRISPR gRNA sequence
  source 1..20: mol_type = other DNA
gacctggggggcacagaggg

SEQ ID NO: 48043 - DNA, 20 bp, synthetic construct
  misc_feature 1..20: note = CRISPR gRNA sequence
  source 1..20: mol_type = other DNA
cctggggggcacagagggca

SEQ ID NO: 48044 - DNA, 20 bp, synthetic construct
  misc_feature 1..20: note = CRISPR gRNA sequence
  source 1..20: mol_type = other DNA
ctggggggcacagagggcag

SEQ ID NO: 48045 - DNA, 20 bp, synthetic construct
  misc_feature 1..20: note = CRISPR gRNA sequence
  source 1..20: mol_type = other DNA
cacagagggcagaggccacc

SEQ ID NO: 48046 - DNA, 20 bp, synthetic construct
  misc_feature 1..20: note = CRISPR gRNA sequence
  source 1..20: mol_type = other DNA
acagagggcagaggccacct

SEQ ID NO: 48047 - DNA, 20 bp, synthetic construct
  misc_feature 1..20: note = CRISPR gRNA sequence
  source 1..20: mol_type = other DNA
gagggcagaggccacctggg

SEQ ID NO: 48048 - DNA, 20 bp, synthetic construct
  misc_feature 1..20: note = CRISPR gRNA sequence
  source 1..20: mol_type = other DNA
gacactcacatcaactcctc

SEQ ID NO: 48049 - DNA, 20 bp, synthetic construct
  misc_feature 1..20: note = CRISPR gRNA sequence
  source 1..20: mol_type = other DNA
acactcacatcaactcctcc

SEQ ID NO: 48050 - DNA, 20 bp, synthetic construct
  misc_feature 1..20: note = CRISPR gRNA sequence
  source 1..20: mol_type = other DNA
aactcctccaggcgcctgca

SEQ ID NO: 48051 - DNA, 20 bp, synthetic construct
  misc_feature 1..20: note = CRISPR gRNA sequence
  source 1..20: mol_type = other DNA
tccaggcgcctgcaaagaac

SEQ ID NO: 48052 - DNA, 20 bp, synthetic construct
  misc_feature 1..20: note = CRISPR gRNA sequence
  source 1..20: mol_type = other DNA
caggcgcctgcaaagaacga

SEQ ID NO: 48053 - DNA, 20 bp, synthetic construct
  misc_feature 1..20: note = CRISPR gRNA sequence
  source 1..20: mol_type = other DNA
ctctgccaactgcactcccc

SEQ ID NO: 48054 - DNA, 20 bp, synthetic construct
  misc_feature 1..20: note = CRISPR gRNA sequence
  source 1..20: mol_type = other DNA
ccaactgcactcccccggct

SEQ ID NO: 48055 - DNA, 20 bp, synthetic construct
  misc_feature 1..20: note = CRISPR gRNA sequence
  source 1..20: mol_type = other DNA
ctgagctgatgctattccct

SEQ ID NO: 48056 - DNA, 20 bp, synthetic construct
  misc_feature 1..20: note = CRISPR gRNA sequence
  source 1..20: mol_type = other DNA
gagctgatgctattccctga

SEQ ID NO: 48057 - DNA, 20 bp, synthetic construct
  misc_feature 1..20: note = CRISPR gRNA sequence
  source 1..20: mol_type = other DNA
agctgatgctattccctgag

SEQ ID NO: 48058 - DNA, 20 bp, synthetic construct
  misc_feature 1..20: note = CRISPR gRNA sequence
  source 1..20: mol_type = other DNA
tgctattccctgagaggctg

SEQ ID NO: 48059 - DNA, 20 bp, synthetic construct
  misc_feature 1..20: note = CRISPR gRNA sequence
  source 1..20: mol_type = other DNA
gctattccctgagaggctgt

SEQ ID NO: 48060 - DNA, 20 bp, synthetic construct
  misc_feature 1..20: note = CRISPR gRNA sequence
  source 1..20: mol_type = other DNA
tattccctgagaggctgtgg

SEQ ID NO: 48061 - DNA, 20 bp, synthetic construct
  misc_feature 1..20: note = CRISPR gRNA sequence
  source 1..20: mol_type = other DNA
attccctgagaggctgtggg

SEQ ID NO: 48062 - DNA, 20 bp, synthetic construct
  misc_feature 1..20: note = CRISPR gRNA sequence
  source 1..20: mol_type = other DNA
ttccctgagaggctgtggga

SEQ ID NO: 48063 - DNA, 20 bp, synthetic construct
  misc_feature 1..20: note = CRISPR gRNA sequence
  source 1..20: mol_type = other DNA
tccctgagaggctgtgggag

SEQ ID NO: 48064 - DNA, 20 bp, synthetic construct
  misc_feature 1..20: note = CRISPR gRNA sequence
  source 1..20: mol_type = other DNA
ccctgagaggctgtgggagg

SEQ ID NO: 48065 - DNA, 20 bp, synthetic construct
  misc_feature 1..20: note = CRISPR gRNA sequence
  source 1..20: mol_type = other DNA
cctgagaggctgtgggaggg

SEQ ID NO: 48066 - DNA, 20 bp, synthetic construct
  misc_feature 1..20: note = CRISPR gRNA sequence
  source 1..20: mol_type = other DNA
gagaggctgtgggagggggg

SEQ ID NO: 48067 - DNA, 20 bp, synthetic construct
  misc_feature 1..20: note = CRISPR gRNA sequence
  source 1..20: mol_type = other DNA
tgtgggaggggggcagccat

SEQ ID NO: 48068 - DNA, 20 bp, synthetic construct
  misc_feature 1..20: note = CRISPR gRNA sequence
  source 1..20: mol_type = other DNA
gtgggaggggggcagccatc

SEQ ID NO: 48069 - DNA, 20 bp, synthetic construct
  misc_feature 1..20: note = CRISPR gRNA sequence
  source 1..20: mol_type = other DNA
gccccctctccccgacaccc

SEQ ID NO: 48070 - DNA, 20 bp, synthetic construct
  misc_feature 1..20: note = CRISPR gRNA sequence
  source 1..20: mol_type = other DNA
cgacaccccagcacatctgc

SEQ ID NO: 48071 - DNA, 20 bp, synthetic construct
  misc_feature 1..20: note = CRISPR gRNA sequence
  source 1..20: mol_type = other DNA
gacaccccagcacatctgct

SEQ ID NO: 48072 - DNA, 20 bp, synthetic construct
  misc_feature 1..20: note = CRISPR gRNA sequence
  source 1..20: mol_type = other DNA
tgggtctgccacccctgctt

SEQ ID NO: 48073 - DNA, 20 bp, synthetic construct
  misc_feature 1..20: note = CRISPR gRNA sequence
  source 1..20: mol_type = other DNA
gggtctgccacccctgcttc

SEQ ID NO: 48074 - DNA, 20 bp, synthetic construct
  misc_feature 1..20: note = CRISPR gRNA sequence
  source 1..20: mol_type = other DNA
ggtctgccacccctgcttca

SEQ ID NO: 48075 - DNA, 20 bp, synthetic construct
  misc_feature 1..20: note = CRISPR gRNA sequence
  source 1..20: mol_type = other DNA
gtctgccacccctgcttcag

SEQ ID NO: 48076 - DNA, 20 bp, synthetic construct
  misc_feature 1..20: note = CRISPR gRNA sequence
  source 1..20: mol_type = other DNA
tctgccacccctgcttcagg

SEQ ID NO: 48077 - DNA, 20 bp, synthetic construct
  misc_feature 1..20: note = CRISPR gRNA sequence
  source 1..20: mol_type = other DNA
acccctgcttcagggggcct

SEQ ID NO: 48078 - DNA, 20 bp, synthetic construct
  misc_feature 1..20: note = CRISPR gRNA sequence
  source 1..20: mol_type = other DNA
ccctgcttcagggggcctaa

SEQ ID NO: 48079 - DNA, 20 bp, synthetic construct
  misc_feature 1..20: note = CRISPR gRNA sequence
  source 1..20: mol_type = other DNA
cccgacaccacacacctacc

SEQ ID NO: 48080 - DNA, 20 bp, synthetic construct
  misc_feature 1..20: note = CRISPR gRNA sequence
  source 1..20: mol_type = other DNA
cacacacctacccagacaat

SEQ ID NO: 48081 - DNA, 20 bp, synthetic construct
  misc_feature 1..20: note = CRISPR gRNA sequence
  source 1..20: mol_type = other DNA
acacacctacccagacaatg

SEQ ID NO: 48082 - DNA, 20 bp, synthetic construct
  misc_feature 1..20: note = CRISPR gRNA sequence
  source 1..20: mol_type = other DNA
cacctacccagacaatgagg

SEQ ID NO: 48083 - DNA, 20 bp, synthetic construct
  misc_feature 1..20: note = CRISPR gRNA sequence
  source 1..20: mol_type = other DNA
tacccagacaatgaggcaga

SEQ ID NO: 48084 - DNA, 20 bp, synthetic construct
  misc_feature 1..20: note = CRISPR gRNA sequence
  source 1..20: mol_type = other DNA
acccagacaatgaggcagaa

SEQ ID NO: 48085 - DNA, 20 bp, synthetic construct
  misc_feature 1..20: note = CRISPR gRNA sequence
  source 1..20: mol_type = other DNA
gacaatgaggcagaaaggcc

SEQ ID NO: 48086 - DNA, 20 bp, synthetic construct
  misc_feature 1..20: note = CRISPR gRNA sequence
  source 1..20: mol_type = other DNA
caatgaggcagaaaggccca

SEQ ID NO: 48087 - DNA, 20 bp, synthetic construct
  misc_feature 1..20: note = CRISPR gRNA sequence
  source 1..20: mol_type = other DNA
tgaggcagaaaggcccagag

SEQ ID NO: 48088 - DNA, 20 bp, synthetic construct
  misc_feature 1..20: note = CRISPR gRNA sequence
  source 1..20: mol_type = other DNA
aggcagaaaggcccagagaa

SEQ ID NO: 48089 - DNA, 20 bp, synthetic construct
  misc_feature 1..20: note = CRISPR gRNA sequence
  source 1..20: mol_type = other DNA
cagaaaggcccagagaagag

SEQ ID NO: 48090 - DNA, 20 bp, synthetic construct
  misc_feature 1..20: note = CRISPR gRNA sequence
  source 1..20: mol_type = other DNA
agaaaggcccagagaagagc

SEQ ID NO: 48091 - DNA, 20 bp, synthetic construct
  misc_feature 1..20: note = CRISPR gRNA sequence
  source 1..20: mol_type = other DNA
gaaaggcccagagaagagca

SEQ ID NO: 48092 - DNA, 20 bp, synthetic construct
  misc_feature 1..20: note = CRISPR gRNA sequence
  source 1..20: mol_type = other DNA
aaaggcccagagaagagcag

SEQ ID NO: 48093 - DNA, 20 bp, synthetic construct
  misc_feature 1..20: note = CRISPR gRNA sequence
  source 1..20: mol_type = other DNA
gcccagagaagagcaggggc

SEQ ID NO: 48094 - DNA, 20 bp, synthetic construct
  misc_feature 1..20: note = CRISPR gRNA sequence
  source 1..20: mol_type = other DNA
cccagagaagagcaggggct

SEQ ID NO: 48095 - DNA, 20 bp, synthetic construct
  misc_feature 1..20: note = CRISPR gRNA sequence
  source 1..20: mol_type = other DNA
ccagagaagagcaggggctg

SEQ ID NO: 48096 - DNA, 20 bp, synthetic construct
  misc_feature 1..20: note = CRISPR gRNA sequence
  source 1..20: mol_type = other DNA
gagaagagcaggggctgggg

SEQ ID NO: 48097 - DNA, 20 bp, synthetic construct
  misc_feature 1..20: note = CRISPR gRNA sequence
  source 1..20: mol_type = other DNA
agcaggggctggggtggctt

SEQ ID NO: 48098 - DNA, 20 bp, synthetic construct
  misc_feature 1..20: note = CRISPR gRNA sequence
  source 1..20: mol_type = other DNA
gcaggggctggggtggctta

SEQ ID NO: 48099 - DNA, 20 bp, synthetic construct
  misc_feature 1..20: note = CRISPR gRNA sequence
  source 1..20: mol_type = other DNA
tggggtggcttaaggtcccg

SEQ ID NO: 48100 - DNA, 20 bp, synthetic construct
  misc_feature 1..20: note = CRISPR gRNA sequence
  source 1..20: mol_type = other DNA
gtggcttaaggtcccgcagt

SEQ ID NO: 48101 - DNA, 20 bp, synthetic construct
  misc_feature 1..20: note = CRISPR gRNA sequence
  source 1..20: mol_type = other DNA
tggcttaaggtcccgcagtg

SEQ ID NO: 48102 - DNA, 20 bp, synthetic construct
  misc_feature 1..20: note = CRISPR gRNA sequence
  source 1..20: mol_type = other DNA
ggcttaaggtcccgcagtga

SEQ ID NO: 48103 - DNA, 20 bp, synthetic construct
  misc_feature 1..20: note = CRISPR gRNA sequence
  source 1..20: mol_type = other DNA
taaggtcccgcagtgagggc

SEQ ID NO: 48104 - DNA, 20 bp, synthetic construct
  misc_feature 1..20: note = CRISPR gRNA sequence
  source 1..20: mol_type = other DNA
aaggtcccgcagtgagggcc

SEQ ID NO: 48105 - DNA, 20 bp, synthetic construct
  misc_feature 1..20: note = CRISPR gRNA sequence
  source 1..20: mol_type = other DNA
ggtcccgcagtgagggccag

SEQ ID NO: 48106 - DNA, 20 bp, synthetic construct
  misc_feature 1..20: note = CRISPR gRNA sequence
  source 1..20: mol_type = other DNA
gtcccgcagtgagggccagg

SEQ ID NO: 48107 - DNA, 20 bp, synthetic construct
  misc_feature 1..20: note = CRISPR gRNA sequence
  source 1..20: mol_type = other DNA
gtgagggccaggaggtcacc

SEQ ID NO: 48108 - DNA, 20 bp, synthetic construct
  misc_feature 1..20: note = CRISPR gRNA sequence
  source 1..20: mol_type = other DNA
ggtcaccgagccccactgcc

SEQ ID NO: 48109 - DNA, 20 bp, synthetic construct
  misc_feature 1..20: note = CRISPR gRNA sequence
  source 1..20: mol_type = other DNA
agccccactgcctggacact

SEQ ID NO: 48110 - DNA, 20 bp, synthetic construct
  misc_feature 1..20: note = CRISPR gRNA sequence
  source 1..20: mol_type = other DNA
gccccactgcctggacactg

SEQ ID NO: 48111 - DNA, 20 bp, synthetic construct
  misc_feature 1..20: note = CRISPR gRNA sequence
  source 1..20: mol_type = other DNA
cactgcctggacactgaggt

SEQ ID NO: 48112 - DNA, 20 bp, synthetic construct
  misc_feature 1..20: note = CRISPR gRNA sequence
  source 1..20: mol_type = other DNA
cctggacactgaggttggcg

SEQ ID NO: 48113 - DNA, 20 bp, synthetic construct
  misc_feature 1..20: note = CRISPR gRNA sequence
  source 1..20: mol_type = other DNA
ctggacactgaggttggcgc

SEQ ID NO: 48114 - DNA, 20 bp, synthetic construct
  misc_feature 1..20: note = CRISPR gRNA sequence
  source 1..20: mol_type = other DNA
tggacactgaggttggcgca

SEQ ID NO: 48115 - DNA, 20 bp, synthetic construct
  misc_feature 1..20: note = CRISPR gRNA sequence
  source 1..20: mol_type = other DNA
ggacactgaggttggcgcag

SEQ ID NO: 48116 - DNA, 20 bp, synthetic construct
  misc_feature 1..20: note = CRISPR gRNA sequence
  source 1..20: mol_type = other DNA
acactgaggttggcgcaggg

SEQ ID NO: 48117 - DNA, 20 bp, synthetic construct
  misc_feature 1..20: note = CRISPR gRNA sequence
  source 1..20: mol_type = other DNA
caggggagattttaccatgc

SEQ ID NO: 48118 - DNA, 20 bp, synthetic construct
  misc_feature 1..20: note = CRISPR gRNA sequence
  source 1..20: mol_type = other DNA
agattttaccatgctggcct

SEQ ID NO: 48119 - DNA, 20 bp, synthetic construct
  misc_feature 1..20: note = CRISPR gRNA sequence
  source 1..20: mol_type = other DNA
tttaccatgctggcctcagc

SEQ ID NO: 48120 - DNA, 20 bp, synthetic construct
  misc_feature 1..20: note = CRISPR gRNA sequence
  source 1..20: mol_type = other DNA
ttaccatgctggcctcagct

SEQ ID NO: 48121 - DNA, 20 bp, synthetic construct
  misc_feature 1..20: note = CRISPR gRNA sequence
  source 1..20: mol_type = other DNA
taccatgctggcctcagcta

SEQ ID NO: 48122 - DNA, 20 bp, synthetic construct
  misc_feature 1..20: note = CRISPR gRNA sequence
  source 1..20: mol_type = other DNA
accatgctggcctcagctag

SEQ ID NO: 48123 - DNA, 20 bp, synthetic construct
  misc_feature 1..20: note = CRISPR gRNA sequence
  source 1..20: mol_type = other DNA
tgctggcctcagctaggggc

SEQ ID NO: 48124 - DNA, 20 bp, synthetic construct
  misc_feature 1..20: note = CRISPR gRNA sequence
  source 1..20: mol_type = other DNA
agctaggggccagtatctcc

SEQ ID NO: 48125 - DNA, 20 bp, synthetic construct
  misc_feature 1..20: note = CRISPR gRNA sequence
  source 1..20: mol_type = other DNA
gctaggggccagtatctcct

SEQ ID NO: 48126 - DNA, 20 bp, synthetic construct
  misc_feature 1..20: note = CRISPR gRNA sequence
  source 1..20: mol_type = other DNA
ggaccatcgtgtgacccctg

SEQ ID NO: 48127 - DNA, 20 bp, synthetic construct
  misc_feature 1..20: note = CRISPR gRNA sequence
  source 1..20: mol_type = other DNA
acccctgtggccctcctctg

SEQ ID NO: 48128 - DNA, 20 bp, synthetic construct
  misc_feature 1..20: note = CRISPR gRNA sequence
  source 1..20: mol_type = other DNA
cccctgtggccctcctctgt

SEQ ID NO: 48129 - DNA, 20 bp, synthetic construct
  misc_feature 1..20: note = CRISPR gRNA sequence
  source 1..20: mol_type = other DNA
ccctgtggccctcctctgta

SEQ ID NO: 48130 - DNA, 20 bp, synthetic construct
  misc_feature 1..20: note = CRISPR gRNA sequence
  source 1..20: mol_type = other DNA
gtggccctcctctgtagggc

SEQ ID NO: 48131 - DNA, 20 bp, synthetic construct
  misc_feature 1..20: note = CRISPR gRNA sequence
  source 1..20: mol_type = other DNA
gctactcactctatcttcct

SEQ ID NO: 48132 - DNA, 20 bp, synthetic construct
  misc_feature 1..20: note = CRISPR gRNA sequence
  source 1..20: mol_type = other DNA
cactctatcttcctgagctc

SEQ ID NO: 48133 - DNA, 20 bp, synthetic construct
  misc_feature 1..20: note = CRISPR gRNA sequence
  source 1..20: mol_type = other DNA
tctatcttcctgagctctgg

SEQ ID NO: 48134 - DNA, 20 bp, synthetic construct
  misc_feature 1..20: note = CRISPR gRNA sequence
  source 1..20: mol_type = other DNA
cttcctgagctctggcagcc

SEQ ID NO: 48135 - DNA, 20 bp, synthetic construct
  misc_feature 1..20: note = CRISPR gRNA sequence
  source 1..20: mol_type = other DNA
ttcctgagctctggcagccc

SEQ ID NO: 48136 - DNA, 20 bp, synthetic construct
  misc_feature 1..20: note = CRISPR gRNA sequence
  source 1..20: mol_type = other DNA
ctgagctctggcagcccagg

SEQ ID NO: 48137 - DNA, 20 bp, synthetic construct
  misc_feature 1..20: note = CRISPR gRNA sequence
  source 1..20: mol_type = other DNA
tgagctctggcagcccaggc

SEQ ID NO: 48138 - DNA, 20 bp, synthetic construct
  misc_feature 1..20: note = CRISPR gRNA sequence
  source 1..20: mol_type = other DNA
ctctggcagcccaggcagga

SEQ ID NO: 48139 - DNA, 20 bp, synthetic construct
  misc_feature 1..20: note = CRISPR gRNA sequence
  source 1..20: mol_type = other DNA
tggcagcccaggcaggatgg

SEQ ID NO: 48140 - DNA, 20 bp, synthetic construct
  misc_feature 1..20: note = CRISPR gRNA sequence
  source 1..20: mol_type = other DNA
gcccaggcaggatggtagct

SEQ ID NO: 48141 - DNA, 20 bp, synthetic construct
  misc_feature 1..20: note = CRISPR gRNA sequence
  source 1..20: mol_type = other DNA
gcaggatggtagctaagtgc

SEQ ID NO: 48142 - DNA, 20 bp, synthetic construct
  misc_feature 1..20: note = CRISPR gRNA sequence
  source 1..20: mol_type = other DNA
ggtagctaagtgctggacac

SEQ ID NO: 48143 - DNA, 20 bp, synthetic construct
  misc_feature 1..20: note = CRISPR gRNA sequence
  source 1..20: mol_type = other DNA
ggacaccagcgtctccaatc

SEQ ID NO: 48144 - DNA, 20 bp, synthetic construct
  misc_feature 1..20: note = CRISPR gRNA sequence
  source 1..20: mol_type = other DNA
cagcgtctccaatctggttg

SEQ ID NO: 48145 - DNA, 20 bp, synthetic construct
  misc_feature 1..20: note = CRISPR gRNA sequence
  source 1..20: mol_type = other DNA
ctccaatctggttgtggctc

SEQ ID NO: 48146 - DNA, 20 bp, synthetic construct
  misc_feature 1..20: note = CRISPR gRNA sequence
  source 1..20: mol_type = other DNA
atctggttgtggctcaagct

SEQ ID NO: 48147 - DNA, 20 bp, synthetic construct
  misc_feature 1..20: note = CRISPR gRNA sequence
  source 1..20: mol_type = other DNA
tctggttgtggctcaagctt

SEQ ID NO: 48148 - DNA, 20 bp, synthetic construct
  misc_feature 1..20: note = CRISPR gRNA sequence
  source 1..20: mol_type = other DNA
ctggttgtggctcaagcttg

SEQ ID NO: 48149 - DNA, 20 bp, synthetic construct
  misc_feature 1..20: note = CRISPR gRNA sequence
  source 1..20: mol_type = other DNA
tggttgtggctcaagcttgg

SEQ ID NO: 48150 - DNA, 20 bp, synthetic construct
  misc_feature 1..20: note = CRISPR gRNA sequence
  source 1..20: mol_type = other DNA
gttgtggctcaagcttgggg

SEQ ID NO: 48151 - DNA, 20 bp, synthetic construct
  misc_feature 1..20: note = CRISPR gRNA sequence
  source 1..20: mol_type = other DNA
ctcaagcttgggggagaaaa

SEQ ID NO: 48152 - DNA, 20 bp, synthetic construct
  misc_feature 1..20: note = CRISPR gRNA sequence
  source 1..20: mol_type = other DNA
gggggagaaaacagcttcat

SEQ ID NO: 48153 - DNA, 20 bp, synthetic construct
  misc_feature 1..20: note = CRISPR gRNA sequence
  source 1..20: mol_type = other DNA
tcttgtccacaccccactcc

SEQ ID NO: 48154 - DNA, 20 bp, synthetic construct
  misc_feature 1..20: note = CRISPR gRNA sequence
  source 1..20: mol_type = other DNA
ccacaccccactcccagaaa

SEQ ID NO: 48155 - DNA, 20 bp, synthetic construct
  misc_feature 1..20: note = CRISPR gRNA sequence
  source 1..20: mol_type = other DNA
caccccactcccagaaaaag

SEQ ID NO: 48156 - DNA, 20 bp, synthetic construct
  misc_feature 1..20: note = CRISPR gRNA sequence
  source 1..20: mol_type = other DNA
accccactcccagaaaaaga

SEQ ID NO: 48157 - DNA, 20 bp, synthetic construct
  misc_feature 1..20: note = CRISPR gRNA sequence
  source 1..20: mol_type = other DNA
ccccactcccagaaaaagaa

SEQ ID NO: 48158 - DNA, 20 bp, synthetic construct
  misc_feature 1..20: note = CRISPR gRNA sequence
  source 1..20: mol_type = other DNA
cccactcccagaaaaagaag

SEQ ID NO: 48159 - DNA, 20 bp, synthetic construct
  misc_feature 1..20: note = CRISPR gRNA sequence
  source 1..20: mol_type = other DNA
cactcccagaaaaagaaggg

SEQ ID NO: 48160 - DNA, 20 bp, synthetic construct
  misc_feature 1..20: note = CRISPR gRNA sequence
  source 1..20: mol_type = other DNA
actcccagaaaaagaagggg

SEQ ID NO: 48161 - DNA, 20 bp, synthetic construct
  misc_feature 1..20: note = CRISPR gRNA sequence
  source 1..20: mol_type = other DNA
agaaaaagaaggggaggctg

SEQ ID NO: 48162 - DNA, 20 bp, synthetic construct
  misc_feature 1..20: note = CRISPR gRNA sequence
  source 1..20: mol_type = other DNA
agaaggggaggctgaagtcc

SEQ ID NO: 48163 - DNA, 20 bp, synthetic construct
  misc_feature 1..20: note = CRISPR gRNA sequence
  source 1..20: mol_type = other DNA
gaaggggaggctgaagtccc

SEQ ID NO: 48164 - DNA, 20 bp, synthetic construct
  misc_feature 1..20: note = CRISPR gRNA sequence
  source 1..20: mol_type = other DNA
ggggaggctgaagtcccagg

SEQ ID NO: 48165 - DNA, 20 bp, synthetic construct
  misc_feature 1..20: note = CRISPR gRNA sequence
  source 1..20: mol_type = other DNA
gggaggctgaagtcccagga

SEQ ID NO: 48166 - DNA, 20 bp, synthetic construct
  misc_feature 1..20: note = CRISPR gRNA sequence
  source 1..20: mol_type = other DNA
ggaggctgaagtcccaggaa

SEQ ID NO: 48167 - DNA, 20 bp, synthetic construct
  misc_feature 1..20: note = CRISPR gRNA sequence
  source 1..20: mol_type = other DNA
aggaagggcctcgactcaca

SEQ ID NO: 48168 - DNA, 20 bp, synthetic construct
  misc_feature 1..20: note = CRISPR gRNA sequence
  source 1..20: mol_type = other DNA
gaagggcctcgactcacaca

SEQ ID NO: 48169 - DNA, 20 bp, synthetic construct
  misc_feature 1..20: note = CRISPR gRNA sequence
  source 1..20: mol_type = other DNA
agggcctcgactcacacaga

SEQ ID NO: 48170 - DNA, 20 bp, synthetic construct
  misc_feature 1..20: note = CRISPR gRNA sequence
  source 1..20: mol_type = other DNA
gagccccatcaccccatgtt

SEQ ID NO: 48171 - DNA, 20 bp, synthetic construct
  misc_feature 1..20: note = CRISPR gRNA sequence
  source 1..20: mol_type = other DNA
catcaccccatgttgagtga

SEQ ID NO: 48172 - DNA, 20 bp, synthetic construct
  misc_feature 1..20: note = CRISPR gRNA sequence
  source 1..20: mol_type = other DNA
gagtgacagctcctaaccct

SEQ ID NO: 48173 - DNA, 20 bp, synthetic construct
  misc_feature 1..20: note = CRISPR gRNA sequence
  source 1..20: mol_type = other DNA
cctaacccttggcttctgtt

SEQ ID NO: 48174 - DNA, 20 bp, synthetic construct
  misc_feature 1..20: note = CRISPR gRNA sequence
  source 1..20: mol_type = other DNA
ctaacccttggcttctgttt

SEQ ID NO: 48175 - DNA, 20 bp, synthetic construct
  misc_feature 1..20: note = CRISPR gRNA sequence
  source 1..20: mol_type = other DNA
acactcttacatcctgtctt

SEQ ID NO: 48176 - DNA, 20 bp, synthetic construct
  misc_feature 1..20: note = CRISPR gRNA sequence
  source 1..20: mol_type = other DNA
cactcttacatcctgtcttt

SEQ ID NO: 48177 - DNA, 20 bp, synthetic construct
  misc_feature 1..20: note = CRISPR gRNA sequence
  source 1..20: mol_type = other DNA
atcctgtctttgggtccccc

SEQ ID NO: 48178 - DNA, 20 bp, synthetic construct
  misc_feature 1..20: note = CRISPR gRNA sequence
  source 1..20: mol_type = other DNA
ctttgggtcccccaagcttc

SEQ ID NO: 48179 - DNA, 20 bp, synthetic construct
  misc_feature 1..20: note = CRISPR gRNA sequence
  source 1..20: mol_type = other DNA
tttgggtcccccaagcttct

SEQ ID NO: 48180 - DNA, 20 bp, synthetic construct
  misc_feature 1..20: note = CRISPR gRNA sequence
  source 1..20: mol_type = other DNA
tcccccaagcttctaggccc

SEQ ID NO: 48181 - DNA, 20 bp, synthetic construct
  misc_feature 1..20: note = CRISPR gRNA sequence
  source 1..20: mol_type = other DNA
cccccaagcttctaggcccc

SEQ ID NO: 48182 - DNA, 20 bp, synthetic construct
  misc_feature 1..20: note = CRISPR gRNA sequence
  source 1..20: mol_type = other DNA
taggccccaggttgtttaca

SEQ ID NO: 48183 - DNA, 20 bp, synthetic construct
  misc_feature 1..20: note = CRISPR gRNA sequence
  source 1..20: mol_type = other DNA
cccaggttgtttacacagtg

SEQ ID NO: 48184 - DNA, 20 bp, synthetic construct
  misc_feature 1..20: note = CRISPR gRNA sequence
  source 1..20: mol_type = other DNA
aggttgtttacacagtgtag

SEQ ID NO: 48185 - DNA, 20 bp, synthetic construct
  misc_feature 1..20: note = CRISPR gRNA sequence
  source 1..20: mol_type = other DNA
ttgtttacacagtgtagaag

SEQ ID NO: 48186 - DNA, 20 bp, synthetic construct
  misc_feature 1..20: note = CRISPR gRNA sequence
  source 1..20: mol_type = other DNA
tgtttacacagtgtagaagt

SEQ ID NO: 48187 - DNA, 20 bp, synthetic construct
  misc_feature 1..20: note = CRISPR gRNA sequence
  source 1..20: mol_type = other DNA
acacagtgtagaagtgggtg

SEQ ID NO: 48188 - DNA, 20 bp, synthetic construct
  misc_feature 1..20: note = CRISPR gRNA sequence
  source 1..20: mol_type = other DNA
cacagtgtagaagtgggtga

SEQ ID NO: 48189 - DNA, 20 bp, synthetic construct
  misc_feature 1..20: note = CRISPR gRNA sequence
  source 1..20: mol_type = other DNA
cagtgtagaagtgggtgaag

SEQ ID NO: 48190 - DNA, 20 bp, synthetic construct
  misc_feature 1..20: note = CRISPR gRNA sequence
  source 1..20: mol_type = other DNA
tagaagtgggtgaaggagat

SEQ ID NO: 48191 - DNA, 20 bp, synthetic construct
  misc_feature 1..20: note = CRISPR gRNA sequence
  source 1..20: mol_type = other DNA
tgggtgaaggagatgagatg

SEQ ID NO: 48192 - DNA, 20 bp, synthetic construct
  misc_feature 1..20: note = CRISPR gRNA sequence
  source 1..20: mol_type = other DNA
gtgaaggagatgagatgaag

SEQ ID NO: 48193 - DNA, 20 bp, synthetic construct
  misc_feature 1..20: note = CRISPR gRNA sequence
  source 1..20: mol_type = other DNA
ggagatgagatgaagaagca

SEQ ID NO: 48194 - DNA, 20 bp, synthetic construct
  misc_feature 1..20: note = CRISPR gRNA sequence
  source 1..20: mol_type = other DNA
gagatgagatgaagaagcaa

SEQ ID NO: 48195 - DNA, 20 bp, synthetic construct
  misc_feature 1..20: note = CRISPR gRNA sequence
  source 1..20: mol_type = other DNA
agatgagatgaagaagcaaa

SEQ ID NO: 48196 - DNA, 20 bp, synthetic construct
  misc_feature 1..20: note = CRISPR gRNA sequence
  source 1..20: mol_type = other DNA
gaagaagcaaagggcgtgct

SEQ ID NO: 48197 - DNA, 20 bp, synthetic construct
  misc_feature 1..20: note = CRISPR gRNA sequence
  source 1..20: mol_type = other DNA
aagaagcaaagggcgtgctc

SEQ ID NO: 48198 - DNA, 20 bp, synthetic construct
  misc_feature 1..20: note = CRISPR gRNA sequence
  source 1..20: mol_type = other DNA
aagcaaagggcgtgctcagg

SEQ ID NO: 48199 - DNA, 20 bp, synthetic construct
  misc_feature 1..20: note = CRISPR gRNA sequence
  source 1..20: mol_type = other DNA
cttgcccttgtcatctttcc

SEQ ID NO: 48200 - DNA, 20 bp, synthetic construct
  misc_feature 1..20: note = CRISPR gRNA sequence
  source 1..20: mol_type = other DNA
tttcccggccaaaattgtcc

SEQ ID NO: 48201 - DNA, 20 bp, synthetic construct
  misc_feature 1..20: note = CRISPR gRNA sequence
  source 1..20: mol_type = other DNA
ttcccggccaaaattgtcct

SEQ ID NO: 48202 - DNA, 20 bp, synthetic construct
  misc_feature 1..20: note = CRISPR gRNA sequence
  source 1..20: mol_type = other DNA
ggccaaaattgtcctgggtc

SEQ ID NO: 48203 - DNA, 20 bp, synthetic construct
  misc_feature 1..20: note = CRISPR gRNA sequence
  source 1..20: mol_type = other DNA
gccaaaattgtcctgggtct

SEQ ID NO: 48204 - DNA, 20 bp, synthetic construct
  misc_feature 1..20: note = CRISPR gRNA sequence
  source 1..20: mol_type = other DNA
ccaaaattgtcctgggtctg

SEQ ID NO: 48205 - DNA, 20 bp, synthetic construct
  misc_feature 1..20: note = CRISPR gRNA sequence
  source 1..20: mol_type = other DNA
caaaattgtcctgggtctgg

SEQ ID NO: 48206 - DNA, 20 bp, synthetic construct
  misc_feature 1..20: note = CRISPR gRNA sequence
  source 1..20: mol_type = other DNA
aattgtcctgggtctggggg

SEQ ID NO: 48207 - DNA, 20 bp, synthetic construct
  misc_feature 1..20: note = CRISPR gRNA sequence
  source 1..20: mol_type = other DNA
tcctgggtctgggggcagaa

SEQ ID NO: 48208 - DNA, 20 bp, synthetic construct
  misc_feature 1..20: note = CRISPR gRNA sequence
  source 1..20: mol_type = other DNA
cctgggtctgggggcagaat

SEQ ID NO: 48209 - DNA, 20 bp, synthetic construct
  misc_feature 1..20: note = CRISPR gRNA sequence
  source 1..20: mol_type = other DNA
gcagaatgggcaactcactc

SEQ ID NO: 48210 - DNA, 20 bp, synthetic construct
  misc_feature 1..20: note = CRISPR gRNA sequence
  source 1..20: mol_type = other DNA
gcaactcactccagctcctc

SEQ ID NO: 48211 - DNA, 20 bp, synthetic construct
  misc_feature 1..20: note = CRISPR gRNA sequence
  source 1..20: mol_type = other DNA
caactcactccagctcctct

SEQ ID NO: 48212 - DNA, 20 bp, synthetic construct
  misc_feature 1..20: note = CRISPR gRNA sequence
  source 1..20: mol_type = other DNA
tcactccagctcctctaggc

SEQ ID NO: 48213 - DNA, 20 bp, synthetic construct
  misc_feature 1..20: note = CRISPR gRNA sequence
  source 1..20: mol_type = other DNA
ctccagctcctctaggctgg

SEQ ID NO: 48214 - DNA, 20 bp, synthetic construct
  misc_feature 1..20: note = CRISPR gRNA sequence
  source 1..20: mol_type = other DNA
cagctcctctaggctggtgg

SEQ ID NO: 48215 - DNA, 20 bp, synthetic construct
  misc_feature 1..20: note = CRISPR gRNA sequence
  source 1..20: mol_type = other DNA
tctaggctggtggcagccct

SEQ ID NO: 48216 - DNA, 20 bp, synthetic construct
  misc_feature 1..20: note = CRISPR gRNA sequence
  source 1..20: mol_type = other DNA
taggctggtggcagccctga

SEQ ID NO: 48217 - DNA, 20 bp, synthetic construct
  misc_feature 1..20: note = CRISPR gRNA sequence
  source 1..20: mol_type = other DNA
ggtggcagccctgagagcct

SEQ ID NO: 48218 - DNA, 20 bp, synthetic construct
  misc_feature 1..20: note = CRISPR gRNA sequence
  source 1..20: mol_type = other DNA
gcagccctgagagcctcaga

SEQ ID NO: 48219 - DNA, 20 bp, synthetic construct
  misc_feature 1..20: note = CRISPR gRNA sequence
  source 1..20: mol_type = other DNA
cagccctgagagcctcagaa

SEQ ID NO: 48220 - DNA, 20 bp, synthetic construct
  misc_feature 1..20: note = CRISPR gRNA sequence
  source 1..20: mol_type = other DNA
ccctgagagcctcagaaagg

SEQ ID NO: 48221 - DNA, 20 bp, synthetic construct
  misc_feature 1..20: note = CRISPR gRNA sequence
  source 1..20: mol_type = other DNA
tgagagcctcagaaaggtgg

SEQ ID NO: 48222 - DNA, 20 bp, synthetic construct
  misc_feature 1..20: note = CRISPR gRNA sequence
  source 1..20: mol_type = other DNA
tcaccgatactgttcctgtt

SEQ ID NO: 48223 - DNA, 20 bp, synthetic construct
  misc_feature 1..20: note = CRISPR gRNA sequence
  source 1..20: mol_type = other DNA
gatactgttcctgttcagtc

SEQ ID NO: 48224 - DNA, 20 bp, synthetic construct
  misc_feature 1..20: note = CRISPR gRNA sequence
  source 1..20: mol_type = other DNA
tgttcctgttcagtctggaa

SEQ ID NO: 48225 - DNA, 20 bp, synthetic construct
  misc_feature 1..20: note = CRISPR gRNA sequence
  source 1..20: mol_type = other DNA
tcctgttcagtctggaaaag

SEQ ID NO: 48226 - DNA, 20 bp, synthetic construct
  misc_feature 1..20: note = CRISPR gRNA sequence
  source 1..20: mol_type = other DNA
cctgttcagtctggaaaagc

SEQ ID NO: 48227 - DNA, 20 bp, synthetic construct
  misc_feature 1..20: note = CRISPR gRNA sequence
  source 1..20: mol_type = other DNA
ctgttcagtctggaaaagca

SEQ ID NO: 48228 - DNA, 20 bp, synthetic construct
  misc_feature 1..20: note = CRISPR gRNA sequence
  source 1..20: mol_type = other DNA
cagtctggaaaagcagggaa

SEQ ID NO: 48229 - DNA, 20 bp, synthetic construct
  misc_feature 1..20: note = CRISPR gRNA sequence
  source 1..20: mol_type = other DNA
ggaaaagcagggaatagacc

SEQ ID NO: 48230 - DNA, 20 bp, synthetic construct
  misc_feature 1..20: note = CRISPR gRNA sequence
  source 1..20: mol_type = other DNA
aaaagcagggaatagaccaa

SEQ ID NO: 48231 - DNA, 20 bp, synthetic construct
  misc_feature 1..20: note = CRISPR gRNA sequence
  source 1..20: mol_type = other DNA
aaagcagggaatagaccaag

SEQ ID NO: 48232 - DNA, 20 bp, synthetic construct
  misc_feature 1..20: note = CRISPR gRNA sequence
  source 1..20: mol_type = other DNA
ggaatagaccaagaggcttt

SEQ ID NO: 48233 - DNA, 20 bp, synthetic construct
  misc_feature 1..20: note = CRISPR gRNA sequence
  source 1..20: mol_type = other DNA
gaatagaccaagaggctttc

SEQ ID NO: 48234 - DNA, 20 bp, synthetic construct
  misc_feature 1..20: note = CRISPR gRNA sequence
  source 1..20: mol_type = other DNA
atagaccaagaggctttcag

SEQ ID NO: 48235 - DNA, 20 bp, synthetic construct
  misc_feature 1..20: note = CRISPR gRNA sequence
  source 1..20: mol_type = other DNA
aagaggctttcaggagctta

SEQ ID NO: 48236 - DNA, 20 bp, synthetic construct
  misc_feature 1..20: note = CRISPR gRNA sequence
  source 1..20: mol_type = other DNA
agaggctttcaggagcttaa

SEQ ID NO: 48237 - DNA, 20 bp, synthetic construct
  misc_feature 1..20: note = CRISPR gRNA sequence
  source 1..20: mol_type = other DNA
caggagcttaaaggcctttg

SEQ ID NO: 48238 - DNA, 20 bp, synthetic construct
  misc_feature 1..20: note = CRISPR gRNA sequence
  source 1..20: mol_type = other DNA
aggagcttaaaggcctttgc

SEQ ID NO: 48239 - DNA, 20 bp, synthetic construct
  misc_feature 1..20: note = CRISPR gRNA sequence
  source 1..20: mol_type = other DNA
gcctttgcaggtgctgtgct

SEQ ID NO: 48240 - DNA, 20 bp, synthetic construct
  misc_feature 1..20: note = CRISPR gRNA sequence
  source 1..20: mol_type = other DNA
gtgctgtgctaagaactcta

SEQ ID NO: 48241 - DNA, 20 bp, synthetic construct
  misc_feature 1..20: note = CRISPR gRNA sequence
  source 1..20: mol_type = other DNA
taagaactctacagtttgca

SEQ ID NO: 48242 - DNA, 20 bp, synthetic construct
  misc_feature 1..20: note = CRISPR gRNA sequence
  source 1..20: mol_type = other DNA
tttgcaaagccttacacgcc

SEQ ID NO: 48243 - DNA, 20 bp, synthetic construct
  misc_feature 1..20: note = CRISPR gRNA sequence
  source 1..20: mol_type = other DNA
ttgcaaagccttacacgccc

SEQ ID NO: 48244 - DNA, 20 bp, synthetic construct
  misc_feature 1..20: note = CRISPR gRNA sequence
  source 1..20: mol_type = other DNA
acgcccaggaattcatatgc

SEQ ID NO: 48245 - DNA, 20 bp, synthetic construct
  misc_feature 1..20: note = CRISPR gRNA sequence
  source 1..20: mol_type = other DNA
cccaggaattcatatgctgg

SEQ ID NO: 48246 - DNA, 20 bp, synthetic construct
  misc_feature 1..20: note = CRISPR gRNA sequence
  source 1..20: mol_type = other DNA
tatgctggtagcaaaacttc

SEQ ID NO: 48247 - DNA, 20 bp, synthetic construct
  misc_feature 1..20: note = CRISPR gRNA sequence
  source 1..20: mol_type = other DNA
atgctggtagcaaaacttct

SEQ ID NO: 48248 - DNA, 20 bp, synthetic construct
  misc_feature 1..20: note = CRISPR gRNA sequence
  source 1..20: mol_type = other DNA
tgctggtagcaaaacttctg

SEQ ID NO: 48249 - DNA, 20 bp, synthetic construct
  misc_feature 1..20: note = CRISPR gRNA sequence
  source 1..20: mol_type = other DNA
gctggtagcaaaacttctgg

SEQ ID NO: 48250 - DNA, 20 bp, synthetic construct
  misc_feature 1..20: note = CRISPR gRNA sequence
  source 1..20: mol_type = other DNA
agcaaaacttctgggggtca

SEQ ID NO: 48251 - DNA, 20 bp, synthetic construct
  misc_feature 1..20: note = CRISPR gRNA sequence
  source 1..20: mol_type = other DNA
aaaacttctgggggtcatgg

SEQ ID NO: 48252 - DNA, 20 bp, synthetic construct
  misc_feature 1..20: note = CRISPR gRNA sequence
  source 1..20: mol_type = other DNA
aaacttctgggggtcatggc

SEQ ID NO: 48253 - DNA, 20 bp, synthetic construct
  misc_feature 1..20: note = CRISPR gRNA sequence
  source 1..20: mol_type = other DNA
cttctgggggtcatggcagg

SEQ ID NO: 48254 - DNA, 20 bp, synthetic construct
  misc_feature 1..20: note = CRISPR gRNA sequence
  source 1..20: mol_type = other DNA
ttctgggggtcatggcaggt

SEQ ID NO: 48255 - DNA, 20 bp, synthetic construct
  misc_feature 1..20: note = CRISPR gRNA sequence
  source 1..20: mol_type = other DNA
tctgggggtcatggcaggtg

SEQ ID NO: 48256 - DNA, 20 bp, synthetic construct
  misc_feature 1..20: note = CRISPR gRNA sequence
  source 1..20: mol_type = other DNA
tgggggtcatggcaggtggg

SEQ ID NO: 48257 - DNA, 20 bp, synthetic construct
  misc_feature 1..20: note = CRISPR gRNA sequence
  source 1..20: mol_type = other DNA
gggtcatggcaggtggggag

SEQ ID NO: 48258 - DNA, 20 bp, synthetic construct
  misc_feature 1..20: note = CRISPR gRNA sequence
  source 1..20: mol_type = other DNA
catggcaggtggggagtggt

SEQ ID NO: 48259 - DNA, 20 bp, synthetic construct
  misc_feature 1..20: note = CRISPR gRNA sequence
  source 1..20: mol_type = other DNA
gcaggtggggagtggtgagc

SEQ ID NO: 48260 - DNA, 20 bp, synthetic construct
  misc_feature 1..20: note = CRISPR gRNA sequence
  source 1..20: mol_type = other DNA
caggtggggagtggtgagca

SEQ ID NO: 48261 - DNA, 20 bp, synthetic construct
  misc_feature 1..20: note = CRISPR gRNA sequence
  source 1..20: mol_type = other DNA
gtggggagtggtgagcaagg

SEQ ID NO: 48262 - DNA, 20 bp, synthetic construct
  misc_feature 1..20: note = CRISPR gRNA sequence
  source 1..20: mol_type = other DNA
tggggagtggtgagcaaggt

SEQ ID NO: 48263 - DNA, 20 bp, synthetic construct
  misc_feature 1..20: note = CRISPR gRNA sequence
  source 1..20: mol_type = other DNA
aaggtgggaattattgtccc

SEQ ID NO: 48264 - DNA, 20 bp, synthetic construct
  misc_feature 1..20: note = CRISPR gRNA sequence
  source 1..20: mol_type = other DNA
gaattattgtccccagtgtc

SEQ ID NO: 48265 - DNA, 20 bp, synthetic construct
  misc_feature 1..20: note = CRISPR gRNA sequence
  source 1..20: mol_type = other DNA
aattattgtccccagtgtcc

SEQ ID NO: 48266 - DNA, 20 bp, synthetic construct
  misc_feature 1..20: note = CRISPR gRNA sequence
  source 1..20: mol_type = other DNA
attgtccccagtgtccaggt

SEQ ID NO: 48267 - DNA, 20 bp, synthetic construct
  misc_feature 1..20: note = CRISPR gRNA sequence
  source 1..20: mol_type = other DNA
gtgtccaggtgagaaaactt

SEQ ID NO: 48268 - DNA, 20 bp, synthetic construct
  misc_feature 1..20: note = CRISPR gRNA sequence
  source 1..20: mol_type = other DNA
gtccaggtgagaaaacttga

SEQ ID NO: 48269 - DNA, 20 bp, synthetic construct
  misc_feature 1..20: note = CRISPR gRNA sequence
  source 1..20: mol_type = other DNA
aggtgagaaaacttgagagc

SEQ ID NO: 48270 - DNA, 20 bp, synthetic construct
  misc_feature 1..20: note = CRISPR gRNA sequence
  source 1..20: mol_type = other DNA
tgagaaaacttgagagccag

SEQ ID NO: 48271 - DNA, 20 bp, synthetic construct
  misc_feature 1..20: note = CRISPR gRNA sequence
  source 1..20: mol_type = other DNA
aaaacttgagagccagcagt

SEQ ID NO: 48272 - DNA, 20 bp, synthetic construct
  misc_feature 1..20: note = CRISPR gRNA sequence
  source 1..20: mol_type = other DNA
agccagcagtgagctgtgac

SEQ ID NO: 48273 - DNA, 20 bp, synthetic construct
  misc_feature 1..20: note = CRISPR gRNA sequence
  source 1..20: mol_type = other DNA
agcagtgagctgtgactggc

SEQ ID NO: 48274 - DNA, 20 bp, synthetic construct
  misc_feature 1..20: note = CRISPR gRNA sequence
  source 1..20: mol_type = other DNA
cagtgagctgtgactggcca

SEQ ID NO: 48275 - DNA, 20 bp, synthetic construct
  misc_feature 1..20: note = CRISPR gRNA sequence
  source 1..20: mol_type = other DNA
gctgtgactggccagagact

SEQ ID NO: 48276 - DNA, 20 bp, synthetic construct
  misc_feature 1..20: note = CRISPR gRNA sequence
  source 1..20: mol_type = other DNA
ctgtgactggccagagactt

SEQ ID NO: 48277 - DNA, 20 bp, synthetic construct
  misc_feature 1..20: note = CRISPR gRNA sequence
  source 1..20: mol_type = other DNA
tgtgactggccagagactta

SEQ ID NO: 48278 - DNA, 20 bp, synthetic construct
  misc_feature 1..20: note = CRISPR gRNA sequence
  source 1..20: mol_type = other DNA
gccagagacttagggacttg

SEQ ID NO: 48279 - DNA, 20 bp, synthetic construct
  misc_feature 1..20: note = CRISPR gRNA sequence
  source 1..20: mol_type = other DNA
ccagagacttagggacttgc

SEQ ID NO: 48280 - DNA, 20 bp, synthetic construct
  misc_feature 1..20: note = CRISPR gRNA sequence
  source 1..20: mol_type = other DNA
agacttagggacttgcaggc

SEQ ID NO: 48281 - DNA, 20 bp, synthetic construct
  misc_feature 1..20: note = CRISPR gRNA sequence
  source 1..20: mol_type = other DNA
gacttagggacttgcaggct

SEQ ID NO: 48282 - DNA, 20 bp, synthetic construct
  misc_feature 1..20: note = CRISPR gRNA sequence
  source 1..20: mol_type = other DNA
ttagggacttgcaggctggg

SEQ ID NO: 48283 - DNA, 20 bp, synthetic construct
  misc_feature 1..20: note = CRISPR gRNA sequence
  source 1..20: mol_type = other DNA
aggctgggtggaaacaaatc

SEQ ID NO: 48284 - DNA, 20 bp, synthetic construct
  misc_feature 1..20: note = CRISPR gRNA sequence
  source 1..20: mol_type = other DNA
gctgggtggaaacaaatcca

SEQ ID NO: 48285 - DNA, 20 bp, synthetic construct
  misc_feature 1..20: note = CRISPR gRNA sequence
  source 1..20: mol_type = other DNA
ggaaacaaatccagagcccc

SEQ ID NO: 48286 - DNA, 20 bp, synthetic construct
  misc_feature 1..20: note = CRISPR gRNA sequence
  source 1..20: mol_type = other DNA
caaatccagagcccctggcc

SEQ ID NO: 48287 - DNA, 20 bp, synthetic construct
  misc_feature 1..20: note = CRISPR gRNA sequence
  source 1..20: mol_type = other DNA
aaatccagagcccctggccc

SEQ ID NO: 48288 - DNA, 20 bp, synthetic construct
  misc_feature 1..20: note = CRISPR gRNA sequence
  source 1..20: mol_type = other DNA
atccagagcccctggcccag

SEQ ID NO: 48289 - DNA, 20 bp, synthetic construct
  misc_feature 1..20: note = CRISPR gRNA sequence
  source 1..20: mol_type = other DNA
tccagagcccctggcccagg

SEQ ID NO: 48290 - DNA, 20 bp, synthetic construct
  misc_feature 1..20: note = CRISPR gRNA sequence
  source 1..20: mol_type = other DNA
cagagcccctggcccaggag

SEQ ID NO: 48291 - DNA, 20 bp, synthetic construct
  misc_feature 1..20: note = CRISPR gRNA sequence
  source 1..20: mol_type = other DNA
agtctctacatttctttgcc

SEQ ID NO: 48292 - DNA, 20 bp, synthetic construct
  misc_feature 1..20: note = CRISPR gRNA sequence
  source 1..20: mol_type = other DNA
ttctttgccaagcttcacct

SEQ ID NO: 48293 - DNA, 20 bp, synthetic construct
  misc_feature 1..20: note = CRISPR gRNA sequence
  source 1..20: mol_type = other DNA
cttcacctcagcctctgtgt

SEQ ID NO: 48294 - DNA, 20 bp, synthetic construct
  misc_feature 1..20: note = CRISPR gRNA sequence
  source 1..20: mol_type = other DNA
ttcacctcagcctctgtgtc

SEQ ID NO: 48295 - DNA, 20 bp, synthetic construct
  misc_feature 1..20: note = CRISPR gRNA sequence
  source 1..20: mol_type = other DNA
tcacctcagcctctgtgtca

SEQ ID NO: 48296 - DNA, 20 bp, synthetic construct
  misc_feature 1..20: note = CRISPR gRNA sequence
  source 1..20: mol_type = other DNA
gcctctgtgtcagggatctc

SEQ ID NO: 48297 - DNA, 20 bp, synthetic construct
  misc_feature 1..20: note = CRISPR gRNA sequence
  source 1..20: mol_type = other DNA
cctctgtgtcagggatctcc

SEQ ID NO: 48298 - DNA, 20 bp, synthetic construct
  misc_feature 1..20: note = CRISPR gRNA sequence
  source 1..20: mol_type = other DNA
tgtgtcagggatctccgggc

SEQ ID NO: 48299 - DNA, 20 bp, synthetic construct
  misc_feature 1..20: note = CRISPR gRNA sequence
  source 1..20: mol_type = other DNA
cagggatctccgggctggcc

SEQ ID NO: 48300 - DNA, 20 bp, synthetic construct
  misc_feature 1..20: note = CRISPR gRNA sequence
  source 1..20: mol_type = other DNA
ggctgaatgccactttcacg

SEQ ID NO: 48301 - DNA, 20 bp, synthetic construct
  misc_feature 1..20: note = CRISPR gRNA sequence
  source 1..20: mol_type = other DNA
gctgaatgccactttcacgt

SEQ ID NO: 48302 - DNA, 20 bp, synthetic construct
  misc_feature 1..20: note = CRISPR gRNA sequence
  source 1..20: mol_type = other DNA
gtgggattctctgattcacg

SEQ ID NO: 48303 - DNA, 20 bp, synthetic construct
  misc_feature 1..20: note = CRISPR gRNA sequence
  source 1..20: mol_type = other DNA
attctctgattcacgcagat

SEQ ID NO: 48304 - DNA, 20 bp, synthetic construct
  misc_feature 1..20: note = CRISPR gRNA sequence
  source 1..20: mol_type = other DNA
gattcacgcagatcagttct

SEQ ID NO: 48305 - DNA, 20 bp, synthetic construct
  misc_feature 1..20: note = CRISPR gRNA sequence
  source 1..20: mol_type = other DNA
attcacgcagatcagttctc

SEQ ID NO: 48306 - DNA, 20 bp, synthetic construct
  misc_feature 1..20: note = CRISPR gRNA sequence
  source 1..20: mol_type = other DNA
ttcacgcagatcagttctca

SEQ ID NO: 48307 - DNA, 20 bp, synthetic construct
  misc_feature 1..20: note = CRISPR gRNA sequence
  source 1..20: mol_type = other DNA
tcacgcagatcagttctcag

SEQ ID NO: 48308 - DNA, 20 bp, synthetic construct
  misc_feature 1..20: note = CRISPR gRNA sequence
  source 1..20: mol_type = other DNA
tgtgttctcatccatgcaaa

SEQ ID NO: 48309 - DNA, 20 bp, synthetic construct
  misc_feature 1..20: note = CRISPR gRNA sequence
  source 1..20: mol_type = other DNA
gttctcatccatgcaaatgg

SEQ ID NO: 48310 - DNA, 20 bp, synthetic construct
  misc_feature 1..20: note = CRISPR gRNA sequence
  source 1..20: mol_type = other DNA
ttctcatccatgcaaatggt

SEQ ID NO: 48311 - DNA, 20 bp, synthetic construct
  misc_feature 1..20: note = CRISPR gRNA sequence
  source 1..20: mol_type = other DNA
ggtaggtttttccttaaacc

SEQ ID NO: 48312 - DNA, 20 bp, synthetic construct
  misc_feature 1..20: note = CRISPR gRNA sequence
  source 1..20: mol_type = other DNA
gtaggtttttccttaaaccc

SEQ ID NO: 48313 - DNA, 20 bp, synthetic construct
  misc_feature 1..20: note = CRISPR gRNA sequence
  source 1..20: mol_type = other DNA
taggtttttccttaaaccca

SEQ ID NO: 48314 - DNA, 20 bp, synthetic construct
  misc_feature 1..20: note = CRISPR gRNA sequence
  source 1..20: mol_type = other DNA
cccagggtattgtctttact

SEQ ID NO: 48315 - DNA, 20 bp, synthetic construct
  misc_feature 1..20: note = CRISPR gRNA sequence
  source 1..20: mol_type = other DNA
agccctgaccttgctctgcc

SEQ ID NO: 48316 - DNA, 20 bp, synthetic construct
  misc_feature 1..20: note = CRISPR gRNA sequence
  source 1..20: mol_type = other DNA
gccctgaccttgctctgcct

SEQ ID NO: 48317 - DNA, 20 bp, synthetic construct
  misc_feature 1..20: note = CRISPR gRNA sequence
  source 1..20: mol_type = other DNA
ctgaccttgctctgcctggg

SEQ ID NO: 48318 - DNA, 20 bp, synthetic construct
  misc_feature 1..20: note = CRISPR gRNA sequence
  source 1..20: mol_type = other DNA
tgaccttgctctgcctgggt

SEQ ID NO: 48319 - DNA, 20 bp, synthetic construct
  misc_feature 1..20: note = CRISPR gRNA sequence
  source 1..20: mol_type = other DNA
gggtaggaaaaaacaataaa

SEQ ID NO: 48320 - DNA, 20 bp, synthetic construct
  misc_feature 1..20: note = CRISPR gRNA sequence
  source 1..20: mol_type = other DNA
ggaaaaaacaataaatagct

SEQ ID NO: 48321 - DNA, 20 bp, synthetic construct
  misc_feature 1..20: note = CRISPR gRNA sequence
  source 1..20: mol_type = other DNA
gaaaaaacaataaatagctg

SEQ ID NO: 48322 - DNA, 20 bp, synthetic construct
  misc_feature 1..20: note = CRISPR gRNA sequence
  source 1..20: mol_type = other DNA
caataaatagctgaggcaaa

SEQ ID NO: 48323 - DNA, 20 bp, synthetic construct
  misc_feature 1..20: note = CRISPR gRNA sequence
  source 1..20: mol_type = other DNA
atagctgaggcaaatggtct

SEQ ID NO: 48324 - DNA, 20 bp, synthetic construct
  misc_feature 1..20: note = CRISPR gRNA sequence
  source 1..20: mol_type = other DNA
ggcaaatggtcttagcccct

SEQ ID NO: 48325 - DNA, 20 bp, synthetic construct
  misc_feature 1..20: note = CRISPR gRNA sequence
  source 1..20: mol_type = other DNA
gcaaatggtcttagcccctt

SEQ ID NO: 48326 - DNA, 20 bp, synthetic construct
  misc_feature 1..20: note = CRISPR gRNA sequence
  source 1..20: mol_type = other DNA
aatggtcttagccccttggg

SEQ ID NO: 48327 - DNA, 20 bp, synthetic construct
  misc_feature 1..20: note = CRISPR gRNA sequence
  source 1..20: mol_type = other DNA
ttttgcaaattaaattttaa

SEQ ID NO: 48328 - DNA, 20 bp, synthetic construct
  misc_feature 1..20: note = CRISPR gRNA sequence
  source 1..20: mol_type = other DNA
tttgcaaattaaattttaat

SEQ ID NO: 48329 - DNA, 20 bp, synthetic construct
  misc_feature 1..20: note = CRISPR gRNA sequence
  source 1..20: mol_type = other DNA
ttgcaaattaaattttaatg

SEQ ID NO: 48330 - DNA, 20 bp, synthetic construct
  misc_feature 1..20: note = CRISPR gRNA sequence
  source 1..20: mol_type = other DNA
aaattaaattttaatggggc

SEQ ID NO: 48331 - DNA, 20 bp, synthetic construct
  misc_feature 1..20: note = CRISPR gRNA sequence
  source 1..20: mol_type = other DNA
aattaaattttaatggggct

SEQ ID NO: 48332 - DNA, 20 bp, synthetic construct
  misc_feature 1..20: note = CRISPR gRNA sequence
  source 1..20: mol_type = other DNA
ttaaattttaatggggctgg

SEQ ID NO: 48333 - DNA, 20 bp, synthetic construct
  misc_feature 1..20: note = CRISPR gRNA sequence
  source 1..20: mol_type = other DNA
aattttaatggggctgggag

SEQ ID NO: 48334 - DNA, 20 bp, synthetic construct
  misc_feature 1..20: note = CRISPR gRNA sequence
  source 1..20: mol_type = other DNA
tttaatggggctgggagcag

SEQ ID NO: 48335 - DNA, 20 bp, synthetic construct
  misc_feature 1..20: note = CRISPR gRNA sequence
  source 1..20: mol_type = other DNA
gtggttcacacctgtattcc

SEQ ID NO: 48336 - DNA, 20 bp, synthetic construct
  misc_feature 1..20: note = CRISPR gRNA sequence
  source 1..20: mol_type = other DNA
acctgtattcccagcacttt

SEQ ID NO: 48337 - DNA, 20 bp, synthetic construct
  misc_feature 1..20: note = CRISPR gRNA sequence
  source 1..20: mol_type = other DNA
ctgtattcccagcactttcg

SEQ ID NO: 48338 - DNA, 20 bp, synthetic construct
  misc_feature 1..20: note = CRISPR gRNA sequence
  source 1..20: mol_type = other DNA
ttcccagcactttcggagtc

SEQ ID NO: 48339 - DNA, 20 bp, synthetic construct
  misc_feature 1..20: note = CRISPR gRNA sequence
  source 1..20: mol_type = other DNA
tcccagcactttcggagtct

SEQ ID NO: 48340 - DNA, 20 bp, synthetic construct
  misc_feature 1..20: note = CRISPR gRNA sequence
  source 1..20: mol_type = other DNA
cagcactttcggagtctagg

SEQ ID NO: 48341 - DNA, 20 bp, synthetic construct
  misc_feature 1..20: note = CRISPR gRNA sequence
  source 1..20: mol_type = other DNA
agcactttcggagtctaggc

SEQ ID NO: 48342 - DNA, 20 bp, synthetic construct
  misc_feature 1..20: note = CRISPR gRNA sequence
  source 1..20: mol_type = other DNA
actttcggagtctaggcagg

SEQ ID NO: 48343 - DNA, 20 bp, synthetic construct
  misc_feature 1..20: note = CRISPR gRNA sequence
  source 1..20: mol_type = other DNA
tctaggcaggtggatcattt

SEQ ID NO: 48344 - DNA, 20 bp, synthetic construct
  misc_feature 1..20: note = CRISPR gRNA sequence
  source 1..20: mol_type = other DNA
ctaggcaggtggatcatttg

SEQ ID NO: 48345 - DNA, 20 bp, synthetic construct
  misc_feature 1..20: note = CRISPR gRNA sequence
  source 1..20: mol_type = other DNA
gcaggtggatcatttgaggt

SEQ ID NO: 48346 - DNA, 20 bp, synthetic construct
  misc_feature 1..20: note = CRISPR gRNA sequence
  source 1..20: mol_type = other DNA
caggtggatcatttgaggtc

SEQ ID NO: 48347 - DNA, 20 bp, synthetic construct
  misc_feature 1..20: note = CRISPR gRNA sequence
  source 1..20: mol_type = other DNA
aggtggatcatttgaggtca

SEQ ID NO: 48348 - DNA, 20 bp, synthetic construct
  misc_feature 1..20: note = CRISPR gRNA sequence
  source 1..20: mol_type = other DNA
ggtggatcatttgaggtcag

SEQ ID NO: 48349 - DNA, 20 bp, synthetic construct
  misc_feature 1..20: note = CRISPR gRNA sequence
  source 1..20: mol_type = other DNA
tcatttgaggtcaggggttc

SEQ ID NO: 48350 - DNA, 20 bp, synthetic construct
  misc_feature 1..20: note = CRISPR gRNA sequence
  source 1..20: mol_type = other DNA
tgaggtcaggggttcgagac

SEQ ID NO: 48351 - DNA, 20 bp, synthetic construct
  misc_feature 1..20: note = CRISPR gRNA sequence
  source 1..20: mol_type = other DNA
tcaggggttcgagaccagcc

SEQ ID NO: 48352 - DNA, 20 bp, synthetic construct
  misc_feature 1..20: note = CRISPR gRNA sequence
  source 1..20: mol_type = other DNA
cgagaccagcccggccaaca

SEQ ID NO: 48353 - DNA, 20 bp, synthetic construct
  misc_feature 1..20: note = CRISPR gRNA sequence
  source 1..20: mol_type = other DNA
aaaaatatacaaaaattatc

SEQ ID NO: 48354 - DNA, 20 bp, synthetic construct
  misc_feature 1..20: note = CRISPR gRNA sequence
  source 1..20: mol_type = other DNA
aaaatatacaaaaattatct

SEQ ID NO: 48355 - DNA, 20 bp, synthetic construct
  misc_feature 1..20: note = CRISPR gRNA sequence
  source 1..20: mol_type = other DNA
atacaaaaattatctgggcg

SEQ ID NO: 48356 - DNA, 20 bp, synthetic construct
  misc_feature 1..20: note = CRISPR gRNA sequence
  source 1..20: mol_type = other DNA
caaaaattatctgggcgtgg

SEQ ID NO: 48357 - DNA, 20 bp, synthetic construct
  misc_feature 1..20: note = CRISPR gRNA sequence
  source 1..20: mol_type = other DNA
gtggtgcatacctgtaatcc

SEQ ID NO: 48358 - DNA, 20 bp, synthetic construct
  misc_feature 1..20: note = CRISPR gRNA sequence
  source 1..20: mol_type = other DNA
tacctgtaatcccagctact

SEQ ID NO: 48359 - DNA, 20 bp, synthetic construct
  misc_feature 1..20: note = CRISPR gRNA sequence
  source 1..20: mol_type = other DNA
acctgtaatcccagctactt

SEQ ID NO: 48360 - DNA, 20 bp, synthetic construct
  misc_feature 1..20: note = CRISPR gRNA sequence
  source 1..20: mol_type = other DNA
tgtaatcccagctacttggg

SEQ ID NO: 48361 - DNA, 20 bp, synthetic construct
  misc_feature 1..20: note = CRISPR gRNA sequence
  source 1..20: mol_type = other DNA
tcccagctacttgggcggct

SEQ ID NO: 48362 - DNA, 20 bp, synthetic construct
  misc_feature 1..20: note = CRISPR gRNA sequence
  source 1..20: mol_type = other DNA
cccagctacttgggcggctg

SEQ ID NO: 48363 - DNA, 20 bp, synthetic construct
  misc_feature 1..20: note = CRISPR gRNA sequence
  source 1..20: mol_type = other DNA
tacttgggcggctgaggcac

SEQ ID NO: 48364 - DNA, 20 bp, synthetic construct
  misc_feature 1..20: note = CRISPR gRNA sequence
  source 1..20: mol_type = other DNA
gcaccagaatcgcttgaacc

SEQ ID NO: 48365 - DNA, 20 bp, synthetic construct
  misc_feature 1..20: note = CRISPR gRNA sequence
  source 1..20: mol_type = other DNA
caccagaatcgcttgaaccc

SEQ ID NO: 48366 - DNA, 20 bp, synthetic construct
  misc_feature 1..20: note = CRISPR gRNA sequence
  source 1..20: mol_type = other DNA
ccagaatcgcttgaacccag

SEQ ID NO: 48367 - DNA, 20 bp, synthetic construct
  misc_feature 1..20: note = CRISPR gRNA sequence
  source 1..20: mol_type = other DNA
cagaatcgcttgaacccagg

SEQ ID NO: 48368 - DNA, 20 bp, synthetic construct
  misc_feature 1..20: note = CRISPR gRNA sequence
  source 1..20: mol_type = other DNA
aatcgcttgaacccaggagg

SEQ ID NO: 48369 - DNA, 20 bp, synthetic construct
  misc_feature 1..20: note = CRISPR gRNA sequence
  source 1..20: mol_type = other DNA
tcgcttgaacccaggaggca

SEQ ID NO: 48370 - DNA, 20 bp, synthetic construct
  misc_feature 1..20: note = CRISPR gRNA sequence
  source 1..20: mol_type = other DNA
cgcttgaacccaggaggcag

SEQ ID NO: 48371 - DNA, 20 bp, synthetic construct
  misc_feature 1..20: note = CRISPR gRNA sequence
  source 1..20: mol_type = other DNA
aacccaggaggcagaggttg

SEQ ID NO: 48372 - DNA, 20 bp, synthetic construct
  misc_feature 1..20: note = CRISPR gRNA sequence
  source 1..20: mol_type = other DNA
aggaggcagaggttgcagtg

SEQ ID NO: 48373 - DNA, 20 bp, synthetic construct
  misc_feature 1..20: note = CRISPR gRNA sequence
  source 1..20: mol_type = other DNA
ggcagaggttgcagtgaagt

SEQ ID NO: 48374 - DNA, 20 bp, synthetic construct
  misc_feature 1..20: note = CRISPR gRNA sequence
  source 1..20: mol_type = other DNA
gagatcatgccactgcactc

SEQ ID NO: 48375 - DNA, 20 bp, synthetic construct
  misc_feature 1..20: note = CRISPR gRNA sequence
  source 1..20: mol_type = other DNA
catgccactgcactccagcc

SEQ ID NO: 48376 - DNA, 20 bp, synthetic construct
  misc_feature 1..20: note = CRISPR gRNA sequence
  source 1..20: mol_type = other DNA
atgccactgcactccagcct

SEQ ID NO: 48377 - DNA, 20 bp, synthetic construct
  misc_feature 1..20: note = CRISPR gRNA sequence
  source 1..20: mol_type = other DNA
ctgcactccagcctgggcga

SEQ ID NO: 48378 - DNA, 20 bp, synthetic construct
  misc_feature 1..20: note = CRISPR gRNA sequence
  source 1..20: mol_type = other DNA
gcactccagcctgggcgaca

SEQ ID NO: 48379 - DNA, 20 bp, synthetic construct
  misc_feature 1..20: note = CRISPR gRNA sequence
  source 1..20: mol_type = other DNA
tccagcctgggcgacagagt

SEQ ID NO: 48380 - DNA, 20 bp, synthetic construct
  misc_feature 1..20: note = CRISPR gRNA sequence
  source 1..20: mol_type = other DNA
ctcaaaaaataaaaataaaa

SEQ ID NO: 48381 - DNA, 20 bp, synthetic construct
  misc_feature 1..20: note = CRISPR gRNA sequence
  source 1..20: mol_type = other DNA
aataaataaatacactttaa

SEQ ID NO: 48382 - DNA, 20 bp, synthetic construct
  misc_feature 1..20: note = CRISPR gRNA sequence
  source 1..20: mol_type = other DNA
cactttaatggatcaccttt

SEQ ID NO: 48383 - DNA, 20 bp, synthetic construct
  misc_feature 1..20: note = CRISPR gRNA sequence
  source 1..20: mol_type = other DNA
acctttcagtaaattaattt

SEQ ID NO: 48384 - DNA, 20 bp, synthetic construct
  misc_feature 1..20: note = CRISPR gRNA sequence
  source 1..20: mol_type = other DNA
cctttcagtaaattaatttt

SEQ ID NO: 48385 - DNA, 20 bp, synthetic construct
  misc_feature 1..20: note = CRISPR gRNA sequence
  source 1..20: mol_type = other DNA
taaattaattttgggtgaaa

SEQ ID NO: 48386 - DNA, 20 bp, synthetic construct
  misc_feature 1..20: note = CRISPR gRNA sequence
  source 1..20: mol_type = other DNA
tccaatatgatataacctcc

SEQ ID NO: 48387 - DNA, 20 bp, synthetic construct
  misc_feature 1..20: note = CRISPR gRNA sequence
  source 1..20: mol_type = other DNA
ctacctactctgctctgccc

SEQ ID NO: 48388 - DNA, 20 bp, synthetic construct
  misc_feature 1..20: note = CRISPR gRNA sequence
  source 1..20: mol_type = other DNA
tacctactctgctctgcccg

SEQ ID NO: 48389 - DNA, 20 bp, synthetic construct
  misc_feature 1..20: note = CRISPR gRNA sequence
  source 1..20: mol_type = other DNA
ctactctgctctgcccgagg

SEQ ID NO: 48390 - DNA, 20 bp, synthetic construct
  misc_feature 1..20: note = CRISPR gRNA sequence
  source 1..20: mol_type = other DNA
tactctgctctgcccgaggt

SEQ ID NO: 48391 - DNA, 20 bp, synthetic construct
  misc_feature 1..20: note = CRISPR gRNA sequence
  source 1..20: mol_type = other DNA
actctgctctgcccgaggta

SEQ ID NO: 48392 - DNA, 20 bp, synthetic construct
  misc_feature 1..20: note = CRISPR gRNA sequence
  source 1..20: mol_type = other DNA
ctctgctctgcccgaggtag

SEQ ID NO: 48393 - DNA, 20 bp, synthetic construct
  misc_feature 1..20: note = CRISPR gRNA sequence
  source 1..20: mol_type = other DNA
tctgctctgcccgaggtagg

SEQ ID NO: 48394 - DNA, 20 bp, synthetic construct
  misc_feature 1..20: note = CRISPR gRNA sequence
  source 1..20: mol_type = other DNA
gctctgcccgaggtaggggg

SEQ ID NO: 48395 - DNA, 20 bp, synthetic construct
  misc_feature 1..20: note = CRISPR gRNA sequence
  source 1..20: mol_type = other DNA
ctctgcccgaggtagggggt

SEQ ID NO: 48396 - DNA, 20 bp, synthetic construct
  misc_feature 1..20: note = CRISPR gRNA sequence
  source 1..20: mol_type = other DNA
ctgcccgaggtagggggtag

SEQ ID NO: 48397 - DNA, 20 bp, synthetic construct
  misc_feature 1..20: note = CRISPR gRNA sequence
  source 1..20: mol_type = other DNA
tgcccgaggtagggggtagg

SEQ ID NO: 48398 - DNA, 20 bp, synthetic construct
  misc_feature 1..20: note = CRISPR gRNA sequence
  source 1..20: mol_type = other DNA
tagggggtaggaggtgtact

SEQ ID NO: 48399 - DNA, 20 bp, synthetic construct
  misc_feature 1..20: note = CRISPR gRNA sequence
  source 1..20: mol_type = other DNA
ggtgtacttggatataaaca

SEQ ID NO: 48400 - DNA, 20 bp, synthetic construct
  misc_feature 1..20: note = CRISPR gRNA sequence
  source 1..20: mol_type = other DNA
caatgctttgtgtcactgct

SEQ ID NO: 48401 - DNA, 20 bp, synthetic construct
  misc_feature 1..20: note = CRISPR gRNA sequence
  source 1..20: mol_type = other DNA
tcactgcttggatttgtttt

SEQ ID NO: 48402 - DNA, 20 bp, synthetic construct
  misc_feature 1..20: note = CRISPR gRNA sequence
  source 1..20: mol_type = other DNA
ttggatttgtttttagtcac

SEQ ID NO: 48403 - DNA, 20 bp, synthetic construct
  misc_feature 1..20: note = CRISPR gRNA sequence
  source 1..20: mol_type = other DNA
gttttgaaaaatcacattga

SEQ ID NO: 48404 - DNA, 20 bp, synthetic construct
  misc_feature 1..20: note = CRISPR gRNA sequence
  source 1..20: mol_type = other DNA
tgaaaaatcacattgaaagt

SEQ ID NO: 48405 - DNA, 20 bp, synthetic construct
  misc_feature 1..20: note = CRISPR gRNA sequence
  source 1..20: mol_type = other DNA
agtgtcatgtttatttatcc

SEQ ID NO: 48406 - DNA, 20 bp, synthetic construct
  misc_feature 1..20: note = CRISPR gRNA sequence
  source 1..20: mol_type = other DNA
gtcatgtttatttatcctag

SEQ ID NO: 48407 - DNA, 20 bp, synthetic construct
  misc_feature 1..20: note = CRISPR gRNA sequence
  source 1..20: mol_type = other DNA
atgtttatttatcctagcag

SEQ ID NO: 48408 - DNA, 20 bp, synthetic construct
  misc_feature 1..20: note = CRISPR gRNA sequence
  source 1..20: mol_type = other DNA
tgtttatttatcctagcagc

SEQ ID NO: 48409 - DNA, 20 bp, synthetic construct
  misc_feature 1..20: note = CRISPR gRNA sequence
  source 1..20: mol_type = other DNA
gtttatttatcctagcagca

SEQ ID NO: 48410 - DNA, 20 bp, synthetic construct
  misc_feature 1..20: note = CRISPR gRNA sequence
  source 1..20: mol_type = other DNA
ttatttatcctagcagcagg

SEQ ID NO: 48411 - DNA, 20 bp, synthetic construct
  misc_feature 1..20: note = CRISPR gRNA sequence
  source 1..20: mol_type = other DNA
cagcagggagtgaaatcaca

SEQ ID NO: 48412 - DNA, 20 bp, synthetic construct
  misc_feature 1..20: note = CRISPR gRNA sequence
  source 1..20: mol_type = other DNA
agcagggagtgaaatcacaa

SEQ ID NO: 48413 - DNA, 20 bp, synthetic construct
  misc_feature 1..20: note = CRISPR gRNA sequence
  source 1..20: mol_type = other DNA
gcagggagtgaaatcacaaa

SEQ ID NO: 48414 - DNA, 20 bp, synthetic construct
  misc_feature 1..20: note = CRISPR gRNA sequence
  source 1..20: mol_type = other DNA
agggagtgaaatcacaaagg

SEQ ID NO: 48415 - DNA, 20 bp, synthetic construct
  misc_feature 1..20: note = CRISPR gRNA sequence
  source 1..20: mol_type = other DNA
gtgaaatcacaaagggagtg

SEQ ID NO: 48416 - DNA, 20 bp, synthetic construct
  misc_feature 1..20: note = CRISPR gRNA sequence
  source 1..20: mol_type = other DNA
tgaaatcacaaagggagtgt

SEQ ID NO: 48417 - DNA, 20 bp, synthetic construct
  misc_feature 1..20: note = CRISPR gRNA sequence
  source 1..20: mol_type = other DNA
aatcacaaagggagtgtagg

SEQ ID NO: 48418 - DNA, 20 bp, synthetic construct
  misc_feature 1..20: note = CRISPR gRNA sequence
  source 1..20: mol_type = other DNA
atcacaaagggagtgtagga

SEQ ID NO: 48419 - DNA, 20 bp, synthetic construct
  misc_feature 1..20: note = CRISPR gRNA sequence
  source 1..20: mol_type = other DNA
gtaggaaggccaccccatct

SEQ ID NO: 48420 - DNA, 20 bp, synthetic construct
  misc_feature 1..20: note = CRISPR gRNA sequence
  source 1..20: mol_type = other DNA
aaggccaccccatctgagtc

SEQ ID NO: 48421 - DNA, 20 bp, synthetic construct
  misc_feature 1..20: note = CRISPR gRNA sequence
  source 1..20: mol_type = other DNA
gtctagacccacactactca

SEQ ID NO: 48422 - DNA, 20 bp, synthetic construct
  misc_feature 1..20: note = CRISPR gRNA sequence
  source 1..20: mol_type = other DNA
actactcaaagtgctgaccg

SEQ ID NO: 48423 - DNA, 20 bp, synthetic construct
  misc_feature 1..20: note = CRISPR gRNA sequence
  source 1..20: mol_type = other DNA
aaagtgctgaccgtggcccc

SEQ ID NO: 48424 - DNA, 20 bp, synthetic construct
  misc_feature 1..20: note = CRISPR gRNA sequence
  source 1..20: mol_type = other DNA
cccccagaattgataccacc

SEQ ID NO: 48425 - DNA, 20 bp, synthetic construct
  misc_feature 1..20: note = CRISPR gRNA sequence
  source 1..20: mol_type = other DNA
ccagaattgataccacccgg

SEQ ID NO: 48426 - DNA, 20 bp, synthetic construct
  misc_feature 1..20: note = CRISPR gRNA sequence
  source 1..20: mol_type = other DNA
gataccacccggaagcttgt

SEQ ID NO: 48427 - DNA, 20 bp, synthetic construct
  misc_feature 1..20: note = CRISPR gRNA sequence
  source 1..20: mol_type = other DNA
cggaagcttgttagaaaatg

SEQ ID NO: 48428 - DNA, 20 bp, synthetic construct
  misc_feature 1..20: note = CRISPR gRNA sequence
  source 1..20: mol_type = other DNA
gaagcttgttagaaaatgca

SEQ ID NO: 48429 - DNA, 20 bp, synthetic construct
  misc_feature 1..20: note = CRISPR gRNA sequence
  source 1..20: mol_type = other DNA
gttagaaaatgcagagtctg

SEQ ID NO: 48430 - DNA, 20 bp, synthetic construct
  misc_feature 1..20: note = CRISPR gRNA sequence
  source 1..20: mol_type = other DNA
gaaaatgcagagtctgaagc

SEQ ID NO: 48431 - DNA, 20 bp, synthetic construct
  misc_feature 1..20: note = CRISPR gRNA sequence
  source 1..20: mol_type = other DNA
aaaatgcagagtctgaagcc

SEQ ID NO: 48432 - DNA, 20 bp, synthetic construct
  misc_feature 1..20: note = CRISPR gRNA sequence
  source 1..20: mol_type = other DNA
gcagagtctgaagccaggcg

SEQ ID NO: 48433 - DNA, 20 bp, synthetic construct
  misc_feature 1..20: note = CRISPR gRNA sequence
  source 1..20: mol_type = other DNA
gagtctgaagccaggcgtgg

SEQ ID NO: 48434 - DNA, 20 bp, synthetic construct
  misc_feature 1..20: note = CRISPR gRNA sequence
  source 1..20: mol_type = other DNA
gtggctcacgcctgtaatcc

SEQ ID NO: 48435 - DNA, 20 bp, synthetic construct
  misc_feature 1..20: note = CRISPR gRNA sequence
  source 1..20: mol_type = other DNA
cgcctgtaatcccagcactt

SEQ ID NO: 48436 - DNA, 20 bp, synthetic construct
  misc_feature 1..20: note = CRISPR gRNA sequence
  source 1..20: mol_type = other DNA
gcctgtaatcccagcacttt

SEQ ID NO: 48437 - DNA, 20 bp, synthetic construct
  misc_feature 1..20: note = CRISPR gRNA sequence
  source 1..20: mol_type = other DNA
ctgtaatcccagcactttgg

SEQ ID NO: 48438 - DNA, 20 bp, synthetic construct
  misc_feature 1..20: note = CRISPR gRNA sequence
  source 1..20: mol_type = other DNA
tgtaatcccagcactttggg

SEQ ID NO: 48439 - DNA, 20 bp, synthetic construct
  misc_feature 1..20: note = CRISPR gRNA sequence
  source 1..20: mol_type = other DNA
tcccagcactttgggaggcc

SEQ ID NO: 48440 - DNA, 20 bp, synthetic construct
  misc_feature 1..20: note = CRISPR gRNA sequence
  source 1..20: mol_type = other DNA
cccagcactttgggaggccg

SEQ ID NO: 48441 - DNA, 20 bp, synthetic construct
  misc_feature 1..20: note = CRISPR gRNA sequence
  source 1..20: mol_type = other DNA
agcactttgggaggccgagg

SEQ ID NO: 48442 - DNA, 20 bp, synthetic construct
  misc_feature 1..20: note = CRISPR gRNA sequence
  source 1..20: mol_type = other DNA
gcactttgggaggccgaggt

SEQ ID NO: 48443 - DNA, 20 bp, synthetic construct
  misc_feature 1..20: note = CRISPR gRNA sequence
  source 1..20: mol_type = other DNA
ctttgggaggccgaggtggg

SEQ ID NO: 48444 - DNA, 20 bp, synthetic construct
  misc_feature 1..20: note = CRISPR gRNA sequence
  source 1..20: mol_type = other DNA
ccgaggtgggcagatcacct

SEQ ID NO: 48445 - DNA, 20 bp, synthetic construct
  misc_feature 1..20: note = CRISPR gRNA sequence
  source 1..20: mol_type = other DNA
cgaggtgggcagatcacctg

SEQ ID NO: 48446 - DNA, 20 bp, synthetic construct
  misc_feature 1..20: note = CRISPR gRNA sequence
  source 1..20: mol_type = other DNA
gtgggcagatcacctgaggt

SEQ ID NO: 48447 - DNA, 20 bp, synthetic construct
  misc_feature 1..20: note = CRISPR gRNA sequence
  source 1..20: mol_type = other DNA
tcacctgaggttggacgttc

SEQ ID NO: 48448 - DNA, 20 bp, synthetic construct
  misc_feature 1..20: note = CRISPR gRNA sequence
  source 1..20: mol_type = other DNA
tgaggttggacgttcaagac

SEQ ID NO: 48449 - DNA, 20 bp, synthetic construct
  misc_feature 1..20: note = CRISPR gRNA sequence
  source 1..20: mol_type = other DNA
caagaccagcctgaccaaca

SEQ ID NO: 48450 - DNA, 20 bp, synthetic construct
  misc_feature 1..20: note = CRISPR gRNA sequence
  source 1..20: mol_type = other DNA
agaccagcctgaccaacatg

SEQ ID NO: 48451 - DNA, 20 bp, synthetic construct
  misc_feature 1..20: note = CRISPR gRNA sequence
  source 1..20: mol_type = other DNA
tctaccaaaaatacaaaaat

SEQ ID NO: 48452 - DNA, 20 bp, synthetic construct
  misc_feature 1..20: note = CRISPR gRNA sequence
  source 1..20: mol_type = other DNA
ccaaaaatacaaaaattagc

SEQ ID NO: 48453 - DNA, 20 bp, synthetic construct
  misc_feature 1..20: note = CRISPR gRNA sequence
  source 1..20: mol_type = other DNA
caaaaatacaaaaattagcc

SEQ ID NO: 48454 - DNA, 20 bp, synthetic construct
  misc_feature 1..20: note = CRISPR gRNA sequence
  source 1..20: mol_type = other DNA
atacaaaaattagccgggcg

SEQ ID NO: 48455 - DNA, 20 bp, synthetic construct
  misc_feature 1..20: note = CRISPR gRNA sequence
  source 1..20: mol_type = other DNA
caaaaattagccgggcgtgg

SEQ ID NO: 48456 - DNA, 20 bp, synthetic construct
  misc_feature 1..20: note = CRISPR gRNA sequence
  source 1..20: mol_type = other DNA
gtggcacatgcctataatcc

SEQ ID NO: 48457 - DNA, 20 bp, synthetic construct
  misc_feature 1..20: note = CRISPR gRNA sequence
  source 1..20: mol_type = other DNA
tgcctataatcccggctact

SEQ ID NO: 48458 - DNA, 20 bp, synthetic construct
  misc_feature 1..20: note = CRISPR gRNA sequence
  source 1..20: mol_type = other DNA
gcctataatcccggctactc

SEQ ID NO: 48459 - DNA, 20 bp, synthetic construct
  misc_feature 1..20: note = CRISPR gRNA sequence
  source 1..20: mol_type = other DNA
ctataatcccggctactcgg

SEQ ID NO: 48460 - DNA, 20 bp, synthetic construct
  misc_feature 1..20: note = CRISPR gRNA sequence
  source 1..20: mol_type = other DNA
tataatcccggctactcggg

SEQ ID NO: 48461 - DNA, 20 bp, synthetic construct
  misc_feature 1..20: note = CRISPR gRNA sequence
  source 1..20: mol_type = other DNA
tcccggctactcgggaggct

SEQ ID NO: 48462 - DNA, 20 bp, synthetic construct
  misc_feature 1..20: note = CRISPR gRNA sequence
  source 1..20: mol_type = other DNA
cccggctactcgggaggctg

SEQ ID NO: 48463 - DNA, 20 bp, synthetic construct
  misc_feature 1..20: note = CRISPR gRNA sequence
  source 1..20: mol_type = other DNA
ggctactcgggaggctgagg

SEQ ID NO: 48464 - DNA, 20 bp, synthetic construct
  misc_feature 1..20: note = CRISPR gRNA sequence
  source 1..20: mol_type = other DNA
gctactcgggaggctgaggc

SEQ ID NO: 48465 - DNA, 20 bp, synthetic construct
  misc_feature 1..20: note = CRISPR gRNA sequence
  source 1..20: mol_type = other DNA
tactcgggaggctgaggcag

SEQ ID NO: 48466 - DNA, 20 bp, synthetic construct
  misc_feature 1..20: note = CRISPR gRNA sequence
  source 1..20: mol_type = other DNA
gcaggagaatcgcttgaacc

SEQ ID NO: 48467 - DNA, 20 bp, synthetic construct
  misc_feature 1..20: note = CRISPR gRNA sequence
  source 1..20: mol_type = other DNA
caggagaatcgcttgaaccc

SEQ ID NO: 48468 - DNA, 20 bp, synthetic construct
  misc_feature 1..20: note = CRISPR gRNA sequence
  source 1..20: mol_type = other DNA
ggagaatcgcttgaacccgg

SEQ ID NO: 48469 - DNA, 20 bp, synthetic construct
  misc_feature 1..20: note = CRISPR gRNA sequence
  source 1..20: mol_type = other DNA
gagaatcgcttgaacccggg

SEQ ID NO: 48470 - DNA, 20 bp, synthetic construct
  misc_feature 1..20: note = CRISPR gRNA sequence
  source 1..20: mol_type = other DNA
aatcgcttgaacccgggagg

SEQ ID NO: 48471 - DNA, 20 bp, synthetic construct
  misc_feature 1..20: note = CRISPR gRNA sequence
  source 1..20: mol_type = other DNA
tcgcttgaacccgggaggcg

SEQ ID NO: 48472 - DNA, 20 bp, synthetic construct
  misc_feature 1..20: note = CRISPR gRNA sequence
  source 1..20: mol_type = other DNA
cgcttgaacccgggaggcgg

SEQ ID NO: 48473 - DNA, 20 bp, synthetic construct
  misc_feature 1..20: note = CRISPR gRNA sequence
  source 1..20: mol_type = other DNA
aacccgggaggcggaggttg

SEQ ID NO: 48474 - DNA, 20 bp, synthetic construct
  misc_feature 1..20: note = CRISPR gRNA sequence
  source 1..20: mol_type = other DNA
cgggaggcggaggttgcagt

SEQ ID NO: 48475 - DNA, 20 bp, synthetic construct
  misc_feature 1..20: note = CRISPR gRNA sequence
  source 1..20: mol_type = other DNA
ggcggaggttgcagtgagct

SEQ ID NO: 48476 - DNA, 20 bp, synthetic construct
  misc_feature 1..20: note = CRISPR gRNA sequence
  source 1..20: mol_type = other DNA
gagattgtgccattgcactc

SEQ ID NO: 48477 - DNA, 20 bp, synthetic construct
  misc_feature 1..20: note = CRISPR gRNA sequence
  source 1..20: mol_type = other DNA
tgtgccattgcactccagcc

SEQ ID NO: 48478 - DNA, 20 bp, synthetic construct
  misc_feature 1..20: note = CRISPR gRNA sequence
  source 1..20: mol_type = other DNA
gtgccattgcactccagcct

SEQ ID NO: 48479 - DNA, 20 bp, synthetic construct
  misc_feature 1..20: note = CRISPR gRNA sequence
  source 1..20: mol_type = other DNA
tgcactccagcctgggcaac

SEQ ID NO: 48480 - DNA, 20 bp, synthetic construct
  misc_feature 1..20: note = CRISPR gRNA sequence
  source 1..20: mol_type = other DNA
cactccagcctgggcaacaa

SEQ ID NO: 48481 - DNA, 20 bp, synthetic construct
  misc_feature 1..20: note = CRISPR gRNA sequence
  source 1..20: mol_type = other DNA
caaaaacaaacaaacaaaaa

SEQ ID NO: 48482 - DNA, 20 bp, synthetic construct
  misc_feature 1..20: note = CRISPR gRNA sequence
  source 1..20: mol_type = other DNA
caaacaaaaaaagaaatgct

SEQ ID NO: 48483 - DNA, 20 bp, synthetic construct
  misc_feature 1..20: note = CRISPR gRNA sequence
  source 1..20: mol_type = other DNA
aaaaaaagaaatgctaagtt

SEQ ID NO: 48484 - DNA, 20 bp, synthetic construct
  misc_feature 1..20: note = CRISPR gRNA sequence
  source 1..20: mol_type = other DNA
aaaaaagaaatgctaagttt

SEQ ID NO: 48485 - DNA, 20 bp, synthetic construct
  misc_feature 1..20: note = CRISPR gRNA sequence
  source 1..20: mol_type = other DNA
taagtttgggtgcaacgcct

SEQ ID NO: 48486 - DNA, 20 bp, synthetic construct
  misc_feature 1..20: note = CRISPR gRNA sequence
  source 1..20: mol_type = other DNA
aagtttgggtgcaacgcctt

SEQ ID NO: 48487 - DNA, 20 bp, synthetic construct
  misc_feature 1..20: note = CRISPR gRNA sequence
  source 1..20: mol_type = other DNA
ggtgcaacgccttaggcctg

SEQ ID NO: 48488 - DNA, 20 bp, synthetic construct
  misc_feature 1..20: note = CRISPR gRNA sequence
  source 1..20: mol_type = other DNA
acgccttaggcctgtagtcc

SEQ ID NO: 48489 - DNA, 20 bp, synthetic construct
  misc_feature 1..20: note = CRISPR gRNA sequence
  source 1..20: mol_type = other DNA
ggcctgtagtcccagctgct

SEQ ID NO: 48490 - DNA, 20 bp, synthetic construct
  misc_feature 1..20: note = CRISPR gRNA sequence
  source 1..20: mol_type = other DNA
gcctgtagtcccagctgctt

SEQ ID NO: 48491 - DNA, 20 bp, synthetic construct
  misc_feature 1..20: note = CRISPR gRNA sequence
  source 1..20: mol_type = other DNA
ctgtagtcccagctgcttag

SEQ ID NO: 48492 - DNA, 20 bp, synthetic construct
  misc_feature 1..20: note = CRISPR gRNA sequence
  source 1..20: mol_type = other DNA
tgtagtcccagctgcttagg

SEQ ID NO: 48493 - DNA, 20 bp, synthetic construct
  misc_feature 1..20: note = CRISPR gRNA sequence
  source 1..20: mol_type = other DNA
gtagtcccagctgcttagga

SEQ ID NO: 48494 - DNA, 20 bp, synthetic construct
  misc_feature 1..20: note = CRISPR gRNA sequence
  source 1..20: mol_type = other DNA
tcccagctgcttaggagggt

SEQ ID NO: 48495 - DNA, 20 bp, synthetic construct
  misc_feature 1..20: note = CRISPR gRNA sequence
  source 1..20: mol_type = other DNA
cccagctgcttaggagggtg

SEQ ID NO: 48496 - DNA, 20 bp, synthetic construct
  misc_feature 1..20: note = CRISPR gRNA sequence
  source 1..20: mol_type = other DNA
agctgcttaggagggtgagg

SEQ ID NO: 48497 - DNA, 20 bp, synthetic construct
  misc_feature 1..20: note = CRISPR gRNA sequence
  source 1..20: mol_type = other DNA
gctgcttaggagggtgaggc

SEQ ID NO: 48498 - DNA, 20 bp, synthetic construct
  misc_feature 1..20: note = CRISPR gRNA sequence
  source 1..20: mol_type = other DNA
tgcttaggagggtgaggcag

SEQ ID NO: 48499 - DNA, 20 bp, synthetic construct
  misc_feature 1..20: note = CRISPR gRNA sequence
  source 1..20: mol_type = other DNA
gcttaggagggtgaggcagg

SEQ ID NO: 48500 - DNA, 20 bp, synthetic construct
  misc_feature 1..20: note = CRISPR gRNA sequence
  source 1..20: mol_type = other DNA
gcaggaggatcacgttcgcc

SEQ ID NO: 48501 - DNA, 20 bp, synthetic construct
  misc_feature 1..20: note = CRISPR gRNA sequence
  source 1..20: mol_type = other DNA
caggaggatcacgttcgccc

SEQ ID NO: 48502 - DNA, 20 bp, synthetic construct
  misc_feature 1..20: note = CRISPR gRNA sequence
  source 1..20: mol_type = other DNA
ggaggatcacgttcgcccag

SEQ ID NO: 48503 - DNA, 20 bp, synthetic construct
  misc_feature 1..20: note = CRISPR gRNA sequence
  source 1..20: mol_type = other DNA
tcacgttcgcccaggagttt

SEQ ID NO: 48504 - DNA, 20 bp, synthetic construct
  misc_feature 1..20: note = CRISPR gRNA sequence
  source 1..20: mol_type = other DNA
cacgttcgcccaggagtttg

SEQ ID NO: 48505 - DNA, 20 bp, synthetic construct
  misc_feature 1..20: note = CRISPR gRNA sequence
  source 1..20: mol_type = other DNA
cgcccaggagtttgaggctg

SEQ ID NO: 48506 - DNA, 20 bp, synthetic construct
  misc_feature 1..20: note = CRISPR gRNA sequence
  source 1..20: mol_type = other DNA
tgtgcattgccactgcactc

SEQ ID NO: 48507 - DNA, 20 bp, synthetic construct
  misc_feature 1..20: note = CRISPR gRNA sequence
  source 1..20: mol_type = other DNA
attgccactgcactccagcc

SEQ ID NO: 48508 - DNA, 20 bp, synthetic construct
  misc_feature 1..20: note = CRISPR gRNA sequence
  source 1..20: mol_type = other DNA
ttgccactgcactccagcct

SEQ ID NO: 48509 - DNA, 20 bp, synthetic construct
  misc_feature 1..20: note = CRISPR gRNA sequence
  source 1..20: mol_type = other DNA
gcactccagcctgggccaca

SEQ ID NO: 48510 - DNA, 20 bp, synthetic construct
  misc_feature 1..20: note = CRISPR gRNA sequence
  source 1..20: mol_type = other DNA
tccagcctgggccacacagt

SEQ ID NO: 48511 - DNA, 20 bp, synthetic construct
  misc_feature 1..20: note = CRISPR gRNA sequence
  source 1..20: mol_type = other DNA
ccagcctgggccacacagtg

SEQ ID NO: 48512 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 48513 - DNA, 20 bp, synthetic construct
  misc_feature 1..20: note = CRISPR gRNA sequence
  source 1..20: mol_type = other DNA
aaaaaaaaaaaaaaaaagca

SEQ ID NO: 48514 - DNA, 20 bp, synthetic construct
  misc_feature 1..20: note = CRISPR gRNA sequence
  source 1..20: mol_type = other DNA
aaaaaaaaaaaagcacagtc

SEQ ID NO: 48515 - DNA, 20 bp, synthetic construct
  misc_feature 1..20: note = CRISPR gRNA sequence
  source 1..20: mol_type = other DNA
aaaaaaaaaaagcacagtct

SEQ ID NO: 48516 - DNA, 20 bp, synthetic construct
  misc_feature 1..20: note = CRISPR gRNA sequence
  source 1..20: mol_type = other DNA
aaaaaaaagcacagtctagg

SEQ ID NO: 48517 - DNA, 20 bp, synthetic construct
  misc_feature 1..20: note = CRISPR gRNA sequence
  source 1..20: mol_type = other DNA
gcacagtctaggcagaattc

SEQ ID NO: 48518 - DNA, 20 bp, synthetic construct
  misc_feature 1..20: note = CRISPR gRNA sequence
  source 1..20: mol_type = other DNA
tctaggcagaattccagacc

SEQ ID NO: 48519 - DNA, 20 bp, synthetic construct
  misc_feature 1..20: note = CRISPR gRNA sequence
  source 1..20: mol_type = other DNA
ctaggcagaattccagacct

SEQ ID NO: 48520 - DNA, 20 bp, synthetic construct
  misc_feature 1..20: note = CRISPR gRNA sequence
  source 1..20: mol_type = other DNA
taggcagaattccagacctg

SEQ ID NO: 48521 - DNA, 20 bp, synthetic construct
  misc_feature 1..20: note = CRISPR gRNA sequence
  source 1..20: mol_type = other DNA
gaattccagacctggggaat

SEQ ID NO: 48522 - DNA, 20 bp, synthetic construct
  misc_feature 1..20: note = CRISPR gRNA sequence
  source 1..20: mol_type = other DNA
cagacctggggaatcagaat

SEQ ID NO: 48523 - DNA, 20 bp, synthetic construct
  misc_feature 1..20: note = CRISPR gRNA sequence
  source 1..20: mol_type = other DNA
atcagaatgagcattttaac

SEQ ID NO: 48524 - DNA, 20 bp, synthetic construct
  misc_feature 1..20: note = CRISPR gRNA sequence
  source 1..20: mol_type = other DNA
cagaatgagcattttaacaa

SEQ ID NO: 48525 - DNA, 20 bp, synthetic construct
  misc_feature 1..20: note = CRISPR gRNA sequence
  source 1..20: mol_type = other DNA
tgagcattttaacaagagcc

SEQ ID NO: 48526 - DNA, 20 bp, synthetic construct
  misc_feature 1..20: note = CRISPR gRNA sequence
  source 1..20: mol_type = other DNA
gagcattttaacaagagccc

SEQ ID NO: 48527 - DNA, 20 bp, synthetic construct
  misc_feature 1..20: note = CRISPR gRNA sequence
  source 1..20: mol_type = other DNA
agcattttaacaagagccca

SEQ ID NO: 48528 - DNA, 20 bp, synthetic construct
  misc_feature 1..20: note = CRISPR gRNA sequence
  source 1..20: mol_type = other DNA
gtgaactgtgtgtgtgcctc

SEQ ID NO: 48529 - DNA, 20 bp, synthetic construct
  misc_feature 1..20: note = CRISPR gRNA sequence
  source 1..20: mol_type = other DNA
tgaactgtgtgtgtgcctca

SEQ ID NO: 48530 - DNA, 20 bp, synthetic construct
  misc_feature 1..20: note = CRISPR gRNA sequence
  source 1..20: mol_type = other DNA
gaactgtgtgtgtgcctcaa

SEQ ID NO: 48531 - DNA, 20 bp, synthetic construct
  misc_feature 1..20: note = CRISPR gRNA sequence
  source 1..20: mol_type = other DNA
tcaagggttgttctacgacg

SEQ ID NO: 48532 - DNA, 20 bp, synthetic construct
  misc_feature 1..20: note = CRISPR gRNA sequence
  source 1..20: mol_type = other DNA
caagggttgttctacgacgt

SEQ ID NO: 48533 - DNA, 20 bp, synthetic construct
  misc_feature 1..20: note = CRISPR gRNA sequence
  source 1..20: mol_type = other DNA
ttgttctacgacgtgggcct

SEQ ID NO: 48534 - DNA, 20 bp, synthetic construct
  misc_feature 1..20: note = CRISPR gRNA sequence
  source 1..20: mol_type = other DNA
cgacgtgggcctaagccctt

SEQ ID NO: 48535 - DNA, 20 bp, synthetic construct
  misc_feature 1..20: note = CRISPR gRNA sequence
  source 1..20: mol_type = other DNA
gacgtgggcctaagcccttt

SEQ ID NO: 48536 - DNA, 20 bp, synthetic construct
  misc_feature 1..20: note = CRISPR gRNA sequence
  source 1..20: mol_type = other DNA
ctttaggccacttttgtaac

SEQ ID NO: 48537 - DNA, 20 bp, synthetic construct
  misc_feature 1..20: note = CRISPR gRNA sequence
  source 1..20: mol_type = other DNA
tttaggccacttttgtaacc

SEQ ID NO: 48538 - DNA, 20 bp, synthetic construct
  misc_feature 1..20: note = CRISPR gRNA sequence
  source 1..20: mol_type = other DNA
taggccacttttgtaaccag

SEQ ID NO: 48539 - DNA, 20 bp, synthetic construct
  misc_feature 1..20: note = CRISPR gRNA sequence
  source 1..20: mol_type = other DNA
aggccacttttgtaaccagg

SEQ ID NO: 48540 - DNA, 20 bp, synthetic construct
  misc_feature 1..20: note = CRISPR gRNA sequence
  source 1..20: mol_type = other DNA
ccacttttgtaaccaggagg

SEQ ID NO: 48541 - DNA, 20 bp, synthetic construct
  misc_feature 1..20: note = CRISPR gRNA sequence
  source 1..20: mol_type = other DNA
tgtaaccaggaggaagctga

SEQ ID NO: 48542 - DNA, 20 bp, synthetic construct
  misc_feature 1..20: note = CRISPR gRNA sequence
  source 1..20: mol_type = other DNA
caggaggaagctgatggcat

SEQ ID NO: 48543 - DNA, 20 bp, synthetic construct
  misc_feature 1..20: note = CRISPR gRNA sequence
  source 1..20: mol_type = other DNA
gaggaagctgatggcattag

SEQ ID NO: 48544 - DNA, 20 bp, synthetic construct
  misc_feature 1..20: note = CRISPR gRNA sequence
  source 1..20: mol_type = other DNA
aggaagctgatggcattaga

SEQ ID NO: 48545 - DNA, 20 bp, synthetic construct
  misc_feature 1..20: note = CRISPR gRNA sequence
  source 1..20: mol_type = other DNA
agctgatggcattagaaggc

SEQ ID NO: 48546 - DNA, 20 bp, synthetic construct
  misc_feature 1..20: note = CRISPR gRNA sequence
  source 1..20: mol_type = other DNA
ctgatggcattagaaggcaa

SEQ ID NO: 48547 - DNA, 20 bp, synthetic construct
  misc_feature 1..20: note = CRISPR gRNA sequence
  source 1..20: mol_type = other DNA
atggcattagaaggcaagag

SEQ ID NO: 48548 - DNA, 20 bp, synthetic construct
  misc_feature 1..20: note = CRISPR gRNA sequence
  source 1..20: mol_type = other DNA
gcattagaaggcaagagcag

SEQ ID NO: 48549 - DNA, 20 bp, synthetic construct
  misc_feature 1..20: note = CRISPR gRNA sequence
  source 1..20: mol_type = other DNA
cattagaaggcaagagcagt

SEQ ID NO: 48550 - DNA, 20 bp, synthetic construct
  misc_feature 1..20: note = CRISPR gRNA sequence
  source 1..20: mol_type = other DNA
aagagcagtgggcacccacc

SEQ ID NO: 48551 - DNA, 20 bp, synthetic construct
  misc_feature 1..20: note = CRISPR gRNA sequence
  source 1..20: mol_type = other DNA
agagcagtgggcacccacct

SEQ ID NO: 48552 - DNA, 20 bp, synthetic construct
  misc_feature 1..20: note = CRISPR gRNA sequence
  source 1..20: mol_type = other DNA
agcagtgggcacccacctgg

SEQ ID NO: 48553 - DNA, 20 bp, synthetic construct
  misc_feature 1..20: note = CRISPR gRNA sequence
  source 1..20: mol_type = other DNA
gcagtgggcacccacctggg

SEQ ID NO: 48554 - DNA, 20 bp, synthetic construct
  misc_feature 1..20: note = CRISPR gRNA sequence
  source 1..20: mol_type = other DNA
cagtgggcacccacctggga

SEQ ID NO: 48555 - DNA, 20 bp, synthetic construct
  misc_feature 1..20: note = CRISPR gRNA sequence
  source 1..20: mol_type = other DNA
ggcacccacctgggagggca

SEQ ID NO: 48556 - DNA, 20 bp, synthetic construct
  misc_feature 1..20: note = CRISPR gRNA sequence
  source 1..20: mol_type = other DNA
gcacccacctgggagggcac

SEQ ID NO: 48557 - DNA, 20 bp, synthetic construct
  misc_feature 1..20: note = CRISPR gRNA sequence
  source 1..20: mol_type = other DNA
cacccacctgggagggcaca

SEQ ID NO: 48558 - DNA, 20 bp, synthetic construct
  misc_feature 1..20: note = CRISPR gRNA sequence
  source 1..20: mol_type = other DNA
cacctgggagggcacaggga

SEQ ID NO: 48559 - DNA, 20 bp, synthetic construct
  misc_feature 1..20: note = CRISPR gRNA sequence
  source 1..20: mol_type = other DNA
acctgggagggcacagggat

SEQ ID NO: 48560 - DNA, 20 bp, synthetic construct
  misc_feature 1..20: note = CRISPR gRNA sequence
  source 1..20: mol_type = other DNA
ggagggcacagggatgggcc

SEQ ID NO: 48561 - DNA, 20 bp, synthetic construct
  misc_feature 1..20: note = CRISPR gRNA sequence
  source 1..20: mol_type = other DNA
gagggcacagggatgggcct

SEQ ID NO: 48562 - DNA, 20 bp, synthetic construct
  misc_feature 1..20: note = CRISPR gRNA sequence
  source 1..20: mol_type = other DNA
gggcacagggatgggcctgg

SEQ ID NO: 48563 - DNA, 20 bp, synthetic construct
  misc_feature 1..20: note = CRISPR gRNA sequence
  source 1..20: mol_type = other DNA
ggcacagggatgggcctggg

SEQ ID NO: 48564 - DNA, 20 bp, synthetic construct
  misc_feature 1..20: note = CRISPR gRNA sequence
  source 1..20: mol_type = other DNA
gcacagggatgggcctggga

SEQ ID NO: 48565 - DNA, 20 bp, synthetic construct
  misc_feature 1..20: note = CRISPR gRNA sequence
  source 1..20: mol_type = other DNA
gggcctgggagggatccgca

SEQ ID NO: 48566 - DNA, 20 bp, synthetic construct
  misc_feature 1..20: note = CRISPR gRNA sequence
  source 1..20: mol_type = other DNA
ggcctgggagggatccgcaa

SEQ ID NO: 48567 - DNA, 20 bp, synthetic construct
  misc_feature 1..20: note = CRISPR gRNA sequence
  source 1..20: mol_type = other DNA
gggatccgcaaaggatcccc

SEQ ID NO: 48568 - DNA, 20 bp, synthetic construct
  misc_feature 1..20: note = CRISPR gRNA sequence
  source 1..20: mol_type = other DNA
ggatccgcaaaggatcccct

SEQ ID NO: 48569 - DNA, 20 bp, synthetic construct
  misc_feature 1..20: note = CRISPR gRNA sequence
  source 1..20: mol_type = other DNA
atccgcaaaggatcccctgg

SEQ ID NO: 48570 - DNA, 20 bp, synthetic construct
  misc_feature 1..20: note = CRISPR gRNA sequence
  source 1..20: mol_type = other DNA
tccgcaaaggatcccctggg

SEQ ID NO: 48571 - DNA, 20 bp, synthetic construct
  misc_feature 1..20: note = CRISPR gRNA sequence
  source 1..20: mol_type = other DNA
gcaaaggatcccctgggagg

SEQ ID NO: 48572 - DNA, 20 bp, synthetic construct
  misc_feature 1..20: note = CRISPR gRNA sequence
  source 1..20: mol_type = other DNA
gatcccctgggaggtggcct

SEQ ID NO: 48573 - DNA, 20 bp, synthetic construct
  misc_feature 1..20: note = CRISPR gRNA sequence
  source 1..20: mol_type = other DNA
aggtggcctcagtgcttccc

SEQ ID NO: 48574 - DNA, 20 bp, synthetic construct
  misc_feature 1..20: note = CRISPR gRNA sequence
  source 1..20: mol_type = other DNA
cctcagtgcttccctggatg

SEQ ID NO: 48575 - DNA, 20 bp, synthetic construct
  misc_feature 1..20: note = CRISPR gRNA sequence
  source 1..20: mol_type = other DNA
ccctggatgtggtcccaact

SEQ ID NO: 48576 - DNA, 20 bp, synthetic construct
  misc_feature 1..20: note = CRISPR gRNA sequence
  source 1..20: mol_type = other DNA
tggatgtggtcccaactgag

SEQ ID NO: 48577 - DNA, 20 bp, synthetic construct
  misc_feature 1..20: note = CRISPR gRNA sequence
  source 1..20: mol_type = other DNA
ggatgtggtcccaactgagt

SEQ ID NO: 48578 - DNA, 20 bp, synthetic construct
  misc_feature 1..20: note = CRISPR gRNA sequence
  source 1..20: mol_type = other DNA
tgtggtcccaactgagtggg

SEQ ID NO: 48579 - DNA, 20 bp, synthetic construct
  misc_feature 1..20: note = CRISPR gRNA sequence
  source 1..20: mol_type = other DNA
tttcttcccactcattccca

SEQ ID NO: 48580 - DNA, 20 bp, synthetic construct
  misc_feature 1..20: note = CRISPR gRNA sequence
  source 1..20: mol_type = other DNA
ttcttcccactcattcccat

SEQ ID NO: 48581 - DNA, 20 bp, synthetic construct
  misc_feature 1..20: note = CRISPR gRNA sequence
  source 1..20: mol_type = other DNA
tcttcccactcattcccatg

SEQ ID NO: 48582 - DNA, 20 bp, synthetic construct
  misc_feature 1..20: note = CRISPR gRNA sequence
  source 1..20: mol_type = other DNA
ctcattcccatggggccgct

SEQ ID NO: 48583 - DNA, 20 bp, synthetic construct
  misc_feature 1..20: note = CRISPR gRNA sequence
  source 1..20: mol_type = other DNA
ggccgctcggtcactcacct

SEQ ID NO: 48584 - DNA, 20 bp, synthetic construct
  misc_feature 1..20: note = CRISPR gRNA sequence
  source 1..20: mol_type = other DNA
gccgctcggtcactcacctg

SEQ ID NO: 48585 - DNA, 20 bp, synthetic construct
  misc_feature 1..20: note = CRISPR gRNA sequence
  source 1..20: mol_type = other DNA
gtcactcacctgaggctctg

SEQ ID NO: 48586 - DNA, 20 bp, synthetic construct
  misc_feature 1..20: note = CRISPR gRNA sequence
  source 1..20: mol_type = other DNA
tcactcacctgaggctctgc

SEQ ID NO: 48587 - DNA, 20 bp, synthetic construct
  misc_feature 1..20: note = CRISPR gRNA sequence
  source 1..20: mol_type = other DNA
ctcacctgaggctctgcagg

SEQ ID NO: 48588 - DNA, 20 bp, synthetic construct
  misc_feature 1..20: note = CRISPR gRNA sequence
  source 1..20: mol_type = other DNA
tcacctgaggctctgcaggc

SEQ ID NO: 48589 - DNA, 20 bp, synthetic construct
  misc_feature 1..20: note = CRISPR gRNA sequence
  source 1..20: mol_type = other DNA
ggctctgcaggcaggtcatc

SEQ ID NO: 48590 - DNA, 20 bp, synthetic construct
  misc_feature 1..20: note = CRISPR gRNA sequence
  source 1..20: mol_type = other DNA
tgcaggcaggtcatctggct

SEQ ID NO: 48591 - DNA, 20 bp, synthetic construct
  misc_feature 1..20: note = CRISPR gRNA sequence
  source 1..20: mol_type = other DNA
ggtcatctggcttagtctgt

SEQ ID NO: 48592 - DNA, 20 bp, synthetic construct
  misc_feature 1..20: note = CRISPR gRNA sequence
  source 1..20: mol_type = other DNA
atctggcttagtctgtgagt

SEQ ID NO: 48593 - DNA, 20 bp, synthetic construct
  misc_feature 1..20: note = CRISPR gRNA sequence
  source 1..20: mol_type = other DNA
ggcttagtctgtgagtaagc

SEQ ID NO: 48594 - DNA, 20 bp, synthetic construct
  misc_feature 1..20: note = CRISPR gRNA sequence
  source 1..20: mol_type = other DNA
gcttagtctgtgagtaagca

SEQ ID NO: 48595 - DNA, 20 bp, synthetic construct
  misc_feature 1..20: note = CRISPR gRNA sequence
  source 1..20: mol_type = other DNA
gtctgtgagtaagcaaggcc

SEQ ID NO: 48596 - DNA, 20 bp, synthetic construct
  misc_feature 1..20: note = CRISPR gRNA sequence
  source 1..20: mol_type = other DNA
tctgtgagtaagcaaggcca

SEQ ID NO: 48597 - DNA, 20 bp, synthetic construct
  misc_feature 1..20: note = CRISPR gRNA sequence
  source 1..20: mol_type = other DNA
gtgagtaagcaaggccaagg

SEQ ID NO: 48598 - DNA, 20 bp, synthetic construct
  misc_feature 1..20: note = CRISPR gRNA sequence
  source 1..20: mol_type = other DNA
gagtaagcaaggccaaggtg

SEQ ID NO: 48599 - DNA, 20 bp, synthetic construct
  misc_feature 1..20: note = CRISPR gRNA sequence
  source 1..20: mol_type = other DNA
aaggccaaggtggagctgtt

SEQ ID NO: 48600 - DNA, 20 bp, synthetic construct
  misc_feature 1..20: note = CRISPR gRNA sequence
  source 1..20: mol_type = other DNA
gccaaggtggagctgttcag

SEQ ID NO: 48601 - DNA, 20 bp, synthetic construct
  misc_feature 1..20: note = CRISPR gRNA sequence
  source 1..20: mol_type = other DNA
aaggtggagctgttcagcag

SEQ ID NO: 48602 - DNA, 20 bp, synthetic construct
  misc_feature 1..20: note = CRISPR gRNA sequence
  source 1..20: mol_type = other DNA
aggtggagctgttcagcaga

SEQ ID NO: 48603 - DNA, 20 bp, synthetic construct
  misc_feature 1..20: note = CRISPR gRNA sequence
  source 1..20: mol_type = other DNA
ctgttcagcagaaggtgact

SEQ ID NO: 48604 - DNA, 20 bp, synthetic construct
  misc_feature 1..20: note = CRISPR gRNA sequence
  source 1..20: mol_type = other DNA
tgttcagcagaaggtgactg

SEQ ID NO: 48605 - DNA, 20 bp, synthetic construct
  misc_feature 1..20: note = CRISPR gRNA sequence
  source 1..20: mol_type = other DNA
cagcagaaggtgactgaggc

SEQ ID NO: 48606 - DNA, 20 bp, synthetic construct
  misc_feature 1..20: note = CRISPR gRNA sequence
  source 1..20: mol_type = other DNA
gcagaaggtgactgaggctg

SEQ ID NO: 48607 - DNA, 20 bp, synthetic construct
  misc_feature 1..20: note = CRISPR gRNA sequence
  source 1..20: mol_type = other DNA
gaaggtgactgaggctggag

SEQ ID NO: 48608 - DNA, 20 bp, synthetic construct
  misc_feature 1..20: note = CRISPR gRNA sequence
  source 1..20: mol_type = other DNA
aggtgactgaggctggagaa

SEQ ID NO: 48609 - DNA, 20 bp, synthetic construct
  misc_feature 1..20: note = CRISPR gRNA sequence
  source 1..20: mol_type = other DNA
ggtgactgaggctggagaag

SEQ ID NO: 48610 - DNA, 20 bp, synthetic construct
  misc_feature 1..20: note = CRISPR gRNA sequence
  source 1..20: mol_type = other DNA
tgactgaggctggagaagag

SEQ ID NO: 48611 - DNA, 20 bp, synthetic construct
  misc_feature 1..20: note = CRISPR gRNA sequence
  source 1..20: mol_type = other DNA
gactgaggctggagaagagg

SEQ ID NO: 48612 - DNA, 20 bp, synthetic construct
  misc_feature 1..20: note = CRISPR gRNA sequence
  source 1..20: mol_type = other DNA
gaggctggagaagaggaggc

SEQ ID NO: 48613 - DNA, 20 bp, synthetic construct
  misc_feature 1..20: note = CRISPR gRNA sequence
  source 1..20: mol_type = other DNA
aggctggagaagaggaggcc

SEQ ID NO: 48614 - DNA, 20 bp, synthetic construct
  misc_feature 1..20: note = CRISPR gRNA sequence
  source 1..20: mol_type = other DNA
ggccaggtgaacttgacatc

SEQ ID NO: 48615 - DNA, 20 bp, synthetic construct
  misc_feature 1..20: note = CRISPR gRNA sequence
  source 1..20: mol_type = other DNA
gccaggtgaacttgacatct

SEQ ID NO: 48616 - DNA, 20 bp, synthetic construct
  misc_feature 1..20: note = CRISPR gRNA sequence
  source 1..20: mol_type = other DNA
ccaggtgaacttgacatctg

SEQ ID NO: 48617 - DNA, 20 bp, synthetic construct
  misc_feature 1..20: note = CRISPR gRNA sequence
  source 1..20: mol_type = other DNA
caggtgaacttgacatctgg

SEQ ID NO: 48618 - DNA, 20 bp, synthetic construct
  misc_feature 1..20: note = CRISPR gRNA sequence
  source 1..20: mol_type = other DNA
gtgaacttgacatctggggg

SEQ ID NO: 48619 - DNA, 20 bp, synthetic construct
  misc_feature 1..20: note = CRISPR gRNA sequence
  source 1..20: mol_type = other DNA
tgaacttgacatctgggggt

SEQ ID NO: 48620 - DNA, 20 bp, synthetic construct
  misc_feature 1..20: note = CRISPR gRNA sequence
  source 1..20: mol_type = other DNA
gaacttgacatctgggggtg

SEQ ID NO: 48621 - DNA, 20 bp, synthetic construct
  misc_feature 1..20: note = CRISPR gRNA sequence
  source 1..20: mol_type = other DNA
tctgggggtggggcactgtc

SEQ ID NO: 48622 - DNA, 20 bp, synthetic construct
  misc_feature 1..20: note = CRISPR gRNA sequence
  source 1..20: mol_type = other DNA
gggtggggcactgtccagtc

SEQ ID NO: 48623 - DNA, 20 bp, synthetic construct
  misc_feature 1..20: note = CRISPR gRNA sequence
  source 1..20: mol_type = other DNA
ggtggggcactgtccagtct

SEQ ID NO: 48624 - DNA, 20 bp, synthetic construct
  misc_feature 1..20: note = CRISPR gRNA sequence
  source 1..20: mol_type = other DNA
gtggggcactgtccagtctg

SEQ ID NO: 48625 - DNA, 20 bp, synthetic construct
  misc_feature 1..20: note = CRISPR gRNA sequence
  source 1..20: mol_type = other DNA
tggggcactgtccagtctgg

SEQ ID NO: 48626 - DNA, 20 bp, synthetic construct
  misc_feature 1..20: note = CRISPR gRNA sequence
  source 1..20: mol_type = other DNA
actgtccagtctgggggtct

SEQ ID NO: 48627 - DNA, 20 bp, synthetic construct
  misc_feature 1..20: note = CRISPR gRNA sequence
  source 1..20: mol_type = other DNA
ctgtccagtctgggggtctg

SEQ ID NO: 48628 - DNA, 20 bp, synthetic construct
  misc_feature 1..20: note = CRISPR gRNA sequence
  source 1..20: mol_type = other DNA
gggtctgaggcctctgtgct

SEQ ID NO: 48629 - DNA, 20 bp, synthetic construct
  misc_feature 1..20: note = CRISPR gRNA sequence
  source 1..20: mol_type = other DNA
ctgaggcctctgtgcttagc

SEQ ID NO: 48630 - DNA, 20 bp, synthetic construct
  misc_feature 1..20: note = CRISPR gRNA sequence
  source 1..20: mol_type = other DNA
gcctctgtgcttagcaagcc

SEQ ID NO: 48631 - DNA, 20 bp, synthetic construct
  misc_feature 1..20: note = CRISPR gRNA sequence
  source 1..20: mol_type = other DNA
cctctgtgcttagcaagcct

SEQ ID NO: 48632 - DNA, 20 bp, synthetic construct
  misc_feature 1..20: note = CRISPR gRNA sequence
  source 1..20: mol_type = other DNA
ctctgtgcttagcaagccta

SEQ ID NO: 48633 - DNA, 20 bp, synthetic construct
  misc_feature 1..20: note = CRISPR gRNA sequence
  source 1..20: mol_type = other DNA
tagcaagcctagggacctcc

SEQ ID NO: 48634 - DNA, 20 bp, synthetic construct
  misc_feature 1..20: note = CRISPR gRNA sequence
  source 1..20: mol_type = other DNA
aagcctagggacctccaaga

SEQ ID NO: 48635 - DNA, 20 bp, synthetic construct
  misc_feature 1..20: note = CRISPR gRNA sequence
  source 1..20: mol_type = other DNA
gacagccacttatatccaca

SEQ ID NO: 48636 - DNA, 20 bp, synthetic construct
  misc_feature 1..20: note = CRISPR gRNA sequence
  source 1..20: mol_type = other DNA
ttctacaaaatgaactgtac

SEQ ID NO: 48637 - DNA, 20 bp, synthetic construct
  misc_feature 1..20: note = CRISPR gRNA sequence
  source 1..20: mol_type = other DNA
tctacaaaatgaactgtact

SEQ ID NO: 48638 - DNA, 20 bp, synthetic construct
  misc_feature 1..20: note = CRISPR gRNA sequence
  source 1..20: mol_type = other DNA
tacaaaatgaactgtactgg

SEQ ID NO: 48639 - DNA, 20 bp, synthetic construct
  misc_feature 1..20: note = CRISPR gRNA sequence
  source 1..20: mol_type = other DNA
acaaaatgaactgtactggg

SEQ ID NO: 48640 - DNA, 20 bp, synthetic construct
  misc_feature 1..20: note = CRISPR gRNA sequence
  source 1..20: mol_type = other DNA
gtttctctgcatgaattact

SEQ ID NO: 48641 - DNA, 20 bp, synthetic construct
  misc_feature 1..20: note = CRISPR gRNA sequence
  source 1..20: mol_type = other DNA
tttctctgcatgaattactg

SEQ ID NO: 48642 - DNA, 20 bp, synthetic construct
  misc_feature 1..20: note = CRISPR gRNA sequence
  source 1..20: mol_type = other DNA
tctgcatgaattactgaggt

SEQ ID NO: 48643 - DNA, 20 bp, synthetic construct
  misc_feature 1..20: note = CRISPR gRNA sequence
  source 1..20: mol_type = other DNA
ctgcatgaattactgaggtc

SEQ ID NO: 48644 - DNA, 20 bp, synthetic construct
  misc_feature 1..20: note = CRISPR gRNA sequence
  source 1..20: mol_type = other DNA
catgaattactgaggtcagg

SEQ ID NO: 48645 - DNA, 20 bp, synthetic construct
  misc_feature 1..20: note = CRISPR gRNA sequence
  source 1..20: mol_type = other DNA
atgaattactgaggtcaggc

SEQ ID NO: 48646 - DNA, 20 bp, synthetic construct
  misc_feature 1..20: note = CRISPR gRNA sequence
  source 1..20: mol_type = other DNA
aattactgaggtcaggcagg

SEQ ID NO: 48647 - DNA, 20 bp, synthetic construct
  misc_feature 1..20: note = CRISPR gRNA sequence
  source 1..20: mol_type = other DNA
tactgaggtcaggcaggcag

SEQ ID NO: 48648 - DNA, 20 bp, synthetic construct
  misc_feature 1..20: note = CRISPR gRNA sequence
  source 1..20: mol_type = other DNA
gttctatgttctgaaccaca

SEQ ID NO: 48649 - DNA, 20 bp, synthetic construct
  misc_feature 1..20: note = CRISPR gRNA sequence
  source 1..20: mol_type = other DNA
tgttctgaaccacatggacc

SEQ ID NO: 48650 - DNA, 20 bp, synthetic construct
  misc_feature 1..20: note = CRISPR gRNA sequence
  source 1..20: mol_type = other DNA
agactaatgatccgtaataa

SEQ ID NO: 48651 - DNA, 20 bp, synthetic construct
  misc_feature 1..20: note = CRISPR gRNA sequence
  source 1..20: mol_type = other DNA
ctaatgatccgtaataatgg

SEQ ID NO: 48652 - DNA, 20 bp, synthetic construct
  misc_feature 1..20: note = CRISPR gRNA sequence
  source 1..20: mol_type = other DNA
cacacattgatcataaaatg

SEQ ID NO: 48653 - DNA, 20 bp, synthetic construct
  misc_feature 1..20: note = CRISPR gRNA sequence
  source 1..20: mol_type = other DNA
acacattgatcataaaatgt

SEQ ID NO: 48654 - DNA, 20 bp, synthetic construct
  misc_feature 1..20: note = CRISPR gRNA sequence
  source 1..20: mol_type = other DNA
cataaaatgtgggccaaact

SEQ ID NO: 48655 - DNA, 20 bp, synthetic construct
  misc_feature 1..20: note = CRISPR gRNA sequence
  source 1..20: mol_type = other DNA
ataaaatgtgggccaaactc

SEQ ID NO: 48656 - DNA, 20 bp, synthetic construct
  misc_feature 1..20: note = CRISPR gRNA sequence
  source 1..20: mol_type = other DNA
taaaatgtgggccaaactca

SEQ ID NO: 48657 - DNA, 20 bp, synthetic construct
  misc_feature 1..20: note = CRISPR gRNA sequence
  source 1..20: mol_type = other DNA
tgtgggccaaactcagggct

SEQ ID NO: 48658 - DNA, 20 bp, synthetic construct
  misc_feature 1..20: note = CRISPR gRNA sequence
  source 1..20: mol_type = other DNA
gtgggccaaactcagggctt

SEQ ID NO: 48659 - DNA, 20 bp, synthetic construct
  misc_feature 1..20: note = CRISPR gRNA sequence
  source 1..20: mol_type = other DNA
tgggccaaactcagggcttg

SEQ ID NO: 48660 - DNA, 20 bp, synthetic construct
  misc_feature 1..20: note = CRISPR gRNA sequence
  source 1..20: mol_type = other DNA
actcagggcttggggccatc

SEQ ID NO: 48661 - DNA, 20 bp, synthetic construct
  misc_feature 1..20: note = CRISPR gRNA sequence
  source 1..20: mol_type = other DNA
agggcttggggccatctgga

SEQ ID NO: 48662 - DNA, 20 bp, synthetic construct
  misc_feature 1..20: note = CRISPR gRNA sequence
  source 1..20: mol_type = other DNA
gggcttggggccatctggaa

SEQ ID NO: 48663 - DNA, 20 bp, synthetic construct
  misc_feature 1..20: note = CRISPR gRNA sequence
  source 1..20: mol_type = other DNA
cttggggccatctggaaagg

SEQ ID NO: 48664 - DNA, 20 bp, synthetic construct
  misc_feature 1..20: note = CRISPR gRNA sequence
  source 1..20: mol_type = other DNA
ttggggccatctggaaaggt

SEQ ID NO: 48665 - DNA, 20 bp, synthetic construct
  misc_feature 1..20: note = CRISPR gRNA sequence
  source 1..20: mol_type = other DNA
ttattatcgtccccatttta

SEQ ID NO: 48666 - DNA, 20 bp, synthetic construct
  misc_feature 1..20: note = CRISPR gRNA sequence
  source 1..20: mol_type = other DNA
tattatcgtccccattttac

SEQ ID NO: 48667 - DNA, 20 bp, synthetic construct
  misc_feature 1..20: note = CRISPR gRNA sequence
  source 1..20: mol_type = other DNA
atcgtccccattttacaggt

SEQ ID NO: 48668 - DNA, 20 bp, synthetic construct
  misc_feature 1..20: note = CRISPR gRNA sequence
  source 1..20: mol_type = other DNA
tcgtccccattttacaggtg

SEQ ID NO: 48669 - DNA, 20 bp, synthetic construct
  misc_feature 1..20: note = CRISPR gRNA sequence
  source 1..20: mol_type = other DNA
ttttacaggtgaggaacacc

SEQ ID NO: 48670 - DNA, 20 bp, synthetic construct
  misc_feature 1..20: note = CRISPR gRNA sequence
  source 1..20: mol_type = other DNA
tttacaggtgaggaacacca

SEQ ID NO: 48671 - DNA, 20 bp, synthetic construct
  misc_feature 1..20: note = CRISPR gRNA sequence
  source 1..20: mol_type = other DNA
aggtgaggaacaccaaggtt

SEQ ID NO: 48672 - DNA, 20 bp, synthetic construct
  misc_feature 1..20: note = CRISPR gRNA sequence
  source 1..20: mol_type = other DNA
gtgaggaacaccaaggttca

SEQ ID NO: 48673 - DNA, 20 bp, synthetic construct
  misc_feature 1..20: note = CRISPR gRNA sequence
  source 1..20: mol_type = other DNA
gaggaacaccaaggttcaga

SEQ ID NO: 48674 - DNA, 20 bp, synthetic construct
  misc_feature 1..20: note = CRISPR gRNA sequence
  source 1..20: mol_type = other DNA
aacaccaaggttcagagagt

SEQ ID NO: 48675 - DNA, 20 bp, synthetic construct
  misc_feature 1..20: note = CRISPR gRNA sequence
  source 1..20: mol_type = other DNA
caccaaggttcagagagtta

SEQ ID NO: 48676 - DNA, 20 bp, synthetic construct
  misc_feature 1..20: note = CRISPR gRNA sequence
  source 1..20: mol_type = other DNA
gagagttagagaacttgctt

SEQ ID NO: 48677 - DNA, 20 bp, synthetic construct
  misc_feature 1..20: note = CRISPR gRNA sequence
  source 1..20: mol_type = other DNA
agagttagagaacttgctta

SEQ ID NO: 48678 - DNA, 20 bp, synthetic construct
  misc_feature 1..20: note = CRISPR gRNA sequence
  source 1..20: mol_type = other DNA
cttgcttaaggtcatacaca

SEQ ID NO: 48679 - DNA, 20 bp, synthetic construct
  misc_feature 1..20: note = CRISPR gRNA sequence
  source 1..20: mol_type = other DNA
gcttaaggtcatacacaaag

SEQ ID NO: 48680 - DNA, 20 bp, synthetic construct
  misc_feature 1..20: note = CRISPR gRNA sequence
  source 1..20: mol_type = other DNA
catacacaaagtggctgctt

SEQ ID NO: 48681 - DNA, 20 bp, synthetic construct
  misc_feature 1..20: note = CRISPR gRNA sequence
  source 1..20: mol_type = other DNA
atacacaaagtggctgcttc

SEQ ID NO: 48682 - DNA, 20 bp, synthetic construct
  misc_feature 1..20: note = CRISPR gRNA sequence
  source 1..20: mol_type = other DNA
caaagtggctgcttcaggaa

SEQ ID NO: 48683 - DNA, 20 bp, synthetic construct
  misc_feature 1..20: note = CRISPR gRNA sequence
  source 1..20: mol_type = other DNA
aggaacagaaccaaaaacta

SEQ ID NO: 48684 - DNA, 20 bp, synthetic construct
  misc_feature 1..20: note = CRISPR gRNA sequence
  source 1..20: mol_type = other DNA
actatagaactcccattcct

SEQ ID NO: 48685 - DNA, 20 bp, synthetic construct
  misc_feature 1..20: note = CRISPR gRNA sequence
  source 1..20: mol_type = other DNA
agccccaaccatatgtgacc

SEQ ID NO: 48686 - DNA, 20 bp, synthetic construct
  misc_feature 1..20: note = CRISPR gRNA sequence
  source 1..20: mol_type = other DNA
gccccaaccatatgtgaccc

SEQ ID NO: 48687 - DNA, 20 bp, synthetic construct
  misc_feature 1..20: note = CRISPR gRNA sequence
  source 1..20: mol_type = other DNA
gacccaggcgattgtacttc

SEQ ID NO: 48688 - DNA, 20 bp, synthetic construct
  misc_feature 1..20: note = CRISPR gRNA sequence
  source 1..20: mol_type = other DNA
cccaggcgattgtacttcta

SEQ ID NO: 48689 - DNA, 20 bp, synthetic construct
  misc_feature 1..20: note = CRISPR gRNA sequence
  source 1..20: mol_type = other DNA
ccaggcgattgtacttctag

SEQ ID NO: 48690 - DNA, 20 bp, synthetic construct
  misc_feature 1..20: note = CRISPR gRNA sequence
  source 1..20: mol_type = other DNA
attgtacttctagaggcccc

SEQ ID NO: 48691 - DNA, 20 bp, synthetic construct
  misc_feature 1..20: note = CRISPR gRNA sequence
  source 1..20: mol_type = other DNA
acttctagaggcccccagcc

SEQ ID NO: 48692 - DNA, 20 bp, synthetic construct
  misc_feature 1..20: note = CRISPR gRNA sequence
  source 1..20: mol_type = other DNA
cttctagaggcccccagcct

SEQ ID NO: 48693 - DNA, 20 bp, synthetic construct
  misc_feature 1..20: note = CRISPR gRNA sequence
  source 1..20: mol_type = other DNA
ctagaggcccccagcctagg

SEQ ID NO: 48694 - DNA, 20 bp, synthetic construct
  misc_feature 1..20: note = CRISPR gRNA sequence
  source 1..20: mol_type = other DNA
tagaggcccccagcctaggc

SEQ ID NO: 48695 - DNA, 20 bp, synthetic construct
  misc_feature 1..20: note = CRISPR gRNA sequence
  source 1..20: mol_type = other DNA
gaggcccccagcctaggcag

SEQ ID NO: 48696 - DNA, 20 bp, synthetic construct
  misc_feature 1..20: note = CRISPR gRNA sequence
  source 1..20: mol_type = other DNA
ggcccccagcctaggcagga

SEQ ID NO: 48697 - DNA, 20 bp, synthetic construct
  misc_feature 1..20: note = CRISPR gRNA sequence
  source 1..20: mol_type = other DNA
gcccccagcctaggcaggag

SEQ ID NO: 48698 - DNA, 20 bp, synthetic construct
  misc_feature 1..20: note = CRISPR gRNA sequence
  source 1..20: mol_type = other DNA
ccccagcctaggcaggagag

SEQ ID NO: 48699 - DNA, 20 bp, synthetic construct
  misc_feature 1..20: note = CRISPR gRNA sequence
  source 1..20: mol_type = other DNA
gcaggagaggagaataacaa

SEQ ID NO: 48700 - DNA, 20 bp, synthetic construct
  misc_feature 1..20: note = CRISPR gRNA sequence
  source 1..20: mol_type = other DNA
gagaggagaataacaatagc

SEQ ID NO: 48701 - DNA, 20 bp, synthetic construct
  misc_feature 1..20: note = CRISPR gRNA sequence
  source 1..20: mol_type = other DNA
ataacaatagctagcacttg

SEQ ID NO: 48702 - DNA, 20 bp, synthetic construct
  misc_feature 1..20: note = CRISPR gRNA sequence
  source 1..20: mol_type = other DNA
aacaatagctagcacttgta

SEQ ID NO: 48703 - DNA, 20 bp, synthetic construct
  misc_feature 1..20: note = CRISPR gRNA sequence
  source 1..20: mol_type = other DNA
tgtagagtgtgaactctgac

SEQ ID NO: 48704 - DNA, 20 bp, synthetic construct
  misc_feature 1..20: note = CRISPR gRNA sequence
  source 1..20: mol_type = other DNA
gtgaactctgaccagactct

SEQ ID NO: 48705 - DNA, 20 bp, synthetic construct
  misc_feature 1..20: note = CRISPR gRNA sequence
  source 1..20: mol_type = other DNA
tttaatactcacaacaaccg

SEQ ID NO: 48706 - DNA, 20 bp, synthetic construct
  misc_feature 1..20: note = CRISPR gRNA sequence
  source 1..20: mol_type = other DNA
aatactcacaacaaccgtag

SEQ ID NO: 48707 - DNA, 20 bp, synthetic construct
  misc_feature 1..20: note = CRISPR gRNA sequence
  source 1..20: mol_type = other DNA
atactcacaacaaccgtagc

SEQ ID NO: 48708 - DNA, 20 bp, synthetic construct
  misc_feature 1..20: note = CRISPR gRNA sequence
  source 1..20: mol_type = other DNA
tactcacaacaaccgtagca

SEQ ID NO: 48709 - DNA, 20 bp, synthetic construct
  misc_feature 1..20: note = CRISPR gRNA sequence
  source 1..20: mol_type = other DNA
actcacaacaaccgtagcag

SEQ ID NO: 48710 - DNA, 20 bp, synthetic construct
  misc_feature 1..20: note = CRISPR gRNA sequence
  source 1..20: mol_type = other DNA
tcacaacaaccgtagcaggg

SEQ ID NO: 48711 - DNA, 20 bp, synthetic construct
  misc_feature 1..20: note = CRISPR gRNA sequence
  source 1..20: mol_type = other DNA
ggagattgctcttatcctca

SEQ ID NO: 48712 - DNA, 20 bp, synthetic construct
  misc_feature 1..20: note = CRISPR gRNA sequence
  source 1..20: mol_type = other DNA
ttgctcttatcctcaaagtt

SEQ ID NO: 48713 - DNA, 20 bp, synthetic construct
  misc_feature 1..20: note = CRISPR gRNA sequence
  source 1..20: mol_type = other DNA
cttatcctcaaagttaagat

SEQ ID NO: 48714 - DNA, 20 bp, synthetic construct
  misc_feature 1..20: note = CRISPR gRNA sequence
  source 1..20: mol_type = other DNA
ttatcctcaaagttaagatg

SEQ ID NO: 48715 - DNA, 20 bp, synthetic construct
  misc_feature 1..20: note = CRISPR gRNA sequence
  source 1..20: mol_type = other DNA
atcctcaaagttaagatgag

SEQ ID NO: 48716 - DNA, 20 bp, synthetic construct
  misc_feature 1..20: note = CRISPR gRNA sequence
  source 1..20: mol_type = other DNA
tcctcaaagttaagatgagg

SEQ ID NO: 48717 - DNA, 20 bp, synthetic construct
  misc_feature 1..20: note = CRISPR gRNA sequence
  source 1..20: mol_type = other DNA
aagttaagatgaggaggcca

SEQ ID NO: 48718 - DNA, 20 bp, synthetic construct
  misc_feature 1..20: note = CRISPR gRNA sequence
  source 1..20: mol_type = other DNA
aagatgaggaggccaaagaa

SEQ ID NO: 48719 - DNA, 20 bp, synthetic construct
  misc_feature 1..20: note = CRISPR gRNA sequence
  source 1..20: mol_type = other DNA
gatgaggaggccaaagaaca

SEQ ID NO: 48720 - DNA, 20 bp, synthetic construct
  misc_feature 1..20: note = CRISPR gRNA sequence
  source 1..20: mol_type = other DNA
tgaggaggccaaagaacaga

SEQ ID NO: 48721 - DNA, 20 bp, synthetic construct
  misc_feature 1..20: note = CRISPR gRNA sequence
  source 1..20: mol_type = other DNA
gaggaggccaaagaacagag

SEQ ID NO: 48722 - DNA, 20 bp, synthetic construct
  misc_feature 1..20: note = CRISPR gRNA sequence
  source 1..20: mol_type = other DNA
ggccaaagaacagagaggct

SEQ ID NO: 48723 - DNA, 20 bp, synthetic construct
  misc_feature 1..20: note = CRISPR gRNA sequence
  source 1..20: mol_type = other DNA
gccaaagaacagagaggctg

SEQ ID NO: 48724 - DNA, 20 bp, synthetic construct
  misc_feature 1..20: note = CRISPR gRNA sequence
  source 1..20: mol_type = other DNA
ccaaagaacagagaggctga

SEQ ID NO: 48725 - DNA, 20 bp, synthetic construct
  misc_feature 1..20: note = CRISPR gRNA sequence
  source 1..20: mol_type = other DNA
gaacagagaggctgagggac

SEQ ID NO: 48726 - DNA, 20 bp, synthetic construct
  misc_feature 1..20: note = CRISPR gRNA sequence
  source 1..20: mol_type = other DNA
agaggctgagggactggcac

SEQ ID NO: 48727 - DNA, 20 bp, synthetic construct
  misc_feature 1..20: note = CRISPR gRNA sequence
  source 1..20: mol_type = other DNA
ctggcacgagttcacacatt

SEQ ID NO: 48728 - DNA, 20 bp, synthetic construct
  misc_feature 1..20: note = CRISPR gRNA sequence
  source 1..20: mol_type = other DNA
cgagttcacacattaagaaa

SEQ ID NO: 48729 - DNA, 20 bp, synthetic construct
  misc_feature 1..20: note = CRISPR gRNA sequence
  source 1..20: mol_type = other DNA
cacacattaagaaacagaac

SEQ ID NO: 48730 - DNA, 20 bp, synthetic construct
  misc_feature 1..20: note = CRISPR gRNA sequence
  source 1..20: mol_type = other DNA
cattaagaaacagaactggc

SEQ ID NO: 48731 - DNA, 20 bp, synthetic construct
  misc_feature 1..20: note = CRISPR gRNA sequence
  source 1..20: mol_type = other DNA
attaagaaacagaactggct

SEQ ID NO: 48732 - DNA, 20 bp, synthetic construct
  misc_feature 1..20: note = CRISPR gRNA sequence
  source 1..20: mol_type = other DNA
acagaactggctgggcgcaa

SEQ ID NO: 48733 - DNA, 20 bp, synthetic construct
  misc_feature 1..20: note = CRISPR gRNA sequence
  source 1..20: mol_type = other DNA
atggctcatgcctgtaatcc

SEQ ID NO: 48734 - DNA, 20 bp, synthetic construct
  misc_feature 1..20: note = CRISPR gRNA sequence
  source 1..20: mol_type = other DNA
tggctcatgcctgtaatccc

SEQ ID NO: 48735 - DNA, 20 bp, synthetic construct
  misc_feature 1..20: note = CRISPR gRNA sequence
  source 1..20: mol_type = other DNA
ctgtaatcccaggactttgt

SEQ ID NO: 48736 - DNA, 20 bp, synthetic construct
  misc_feature 1..20: note = CRISPR gRNA sequence
  source 1..20: mol_type = other DNA
tgtaatcccaggactttgtg

SEQ ID NO: 48737 - DNA, 20 bp, synthetic construct
  misc_feature 1..20: note = CRISPR gRNA sequence
  source 1..20: mol_type = other DNA
tcccaggactttgtgaggcc

SEQ ID NO: 48738 - DNA, 20 bp, synthetic construct
  misc_feature 1..20: note = CRISPR gRNA sequence
  source 1..20: mol_type = other DNA
cccaggactttgtgaggcca

SEQ ID NO: 48739 - DNA, 20 bp, synthetic construct
  misc_feature 1..20: note = CRISPR gRNA sequence
  source 1..20: mol_type = other DNA
aggactttgtgaggccaagg

SEQ ID NO: 48740 - DNA, 20 bp, synthetic construct
  misc_feature 1..20: note = CRISPR gRNA sequence
  source 1..20: mol_type = other DNA
ggactttgtgaggccaaggc

SEQ ID NO: 48741 - DNA, 20 bp, synthetic construct
  misc_feature 1..20: note = CRISPR gRNA sequence
  source 1..20: mol_type = other DNA
ccaaggcgggtgaatcacct

SEQ ID NO: 48742 - DNA, 20 bp, synthetic construct
  misc_feature 1..20: note = CRISPR gRNA sequence
  source 1..20: mol_type = other DNA
caaggcgggtgaatcacctg

SEQ ID NO: 48743 - DNA, 20 bp, synthetic construct
  misc_feature 1..20: note = CRISPR gRNA sequence
  source 1..20: mol_type = other DNA
gcgggtgaatcacctgaggt

SEQ ID NO: 48744 - DNA, 20 bp, synthetic construct
  misc_feature 1..20: note = CRISPR gRNA sequence
  source 1..20: mol_type = other DNA
cgggtgaatcacctgaggtc

SEQ ID NO: 48745 - DNA, 20 bp, synthetic construct
  misc_feature 1..20: note = CRISPR gRNA sequence
  source 1..20: mol_type = other DNA
ggtgaatcacctgaggtcag

SEQ ID NO: 48746 - DNA, 20 bp, synthetic construct
  misc_feature 1..20: note = CRISPR gRNA sequence
  source 1..20: mol_type = other DNA
tcacctgaggtcaggagttc

SEQ ID NO: 48747 - DNA, 20 bp, synthetic construct
  misc_feature 1..20: note = CRISPR gRNA sequence
  source 1..20: mol_type = other DNA
tgaggtcaggagttcgagac

SEQ ID NO: 48748 - DNA, 20 bp, synthetic construct
  misc_feature 1..20: note = CRISPR gRNA sequence
  source 1..20: mol_type = other DNA
tcaggagttcgagaccagcc

SEQ ID NO: 48749 - DNA, 20 bp, synthetic construct
  misc_feature 1..20: note = CRISPR gRNA sequence
  source 1..20: mol_type = other DNA
cgagaccagcctggccaaca

SEQ ID NO: 48750 - DNA, 20 bp, synthetic construct
  misc_feature 1..20: note = CRISPR gRNA sequence
  source 1..20: mol_type = other DNA
aaccccatctccactaaaaa

SEQ ID NO: 48751 - DNA, 20 bp, synthetic construct
  misc_feature 1..20: note = CRISPR gRNA sequence
  source 1..20: mol_type = other DNA
tccactaaaaatagaaaaat

SEQ ID NO: 48752 - DNA, 20 bp, synthetic construct
  misc_feature 1..20: note = CRISPR gRNA sequence
  source 1..20: mol_type = other DNA
ctaaaaatagaaaaattagc

SEQ ID NO: 48753 - DNA, 20 bp, synthetic construct
  misc_feature 1..20: note = CRISPR gRNA sequence
  source 1..20: mol_type = other DNA
taaaaatagaaaaattagct

SEQ ID NO: 48754 - DNA, 20 bp, synthetic construct
  misc_feature 1..20: note = CRISPR gRNA sequence
  source 1..20: mol_type = other DNA
atagaaaaattagctgggcc

SEQ ID NO: 48755 - DNA, 20 bp, synthetic construct
  misc_feature 1..20: note = CRISPR gRNA sequence
  source 1..20: mol_type = other DNA
gaaaaattagctgggcctgg

SEQ ID NO: 48756 - DNA, 20 bp, synthetic construct
  misc_feature 1..20: note = CRISPR gRNA sequence
  source 1..20: mol_type = other DNA
gtggcatgtgcctgtaatgc

SEQ ID NO: 48757 - DNA, 20 bp, synthetic construct
  misc_feature 1..20: note = CRISPR gRNA sequence
  source 1..20: mol_type = other DNA
tgcctgtaatgccagctact

SEQ ID NO: 48758 - DNA, 20 bp, synthetic construct
  misc_feature 1..20: note = CRISPR gRNA sequence
  source 1..20: mol_type = other DNA
gcctgtaatgccagctactt

SEQ ID NO: 48759 - DNA, 20 bp, synthetic construct
  misc_feature 1..20: note = CRISPR gRNA sequence
  source 1..20: mol_type = other DNA
ctgtaatgccagctacttgg

SEQ ID NO: 48760 - DNA, 20 bp, synthetic construct
  misc_feature 1..20: note = CRISPR gRNA sequence
  source 1..20: mol_type = other DNA
tgtaatgccagctacttggg

SEQ ID NO: 48761 - DNA, 20 bp, synthetic construct
  misc_feature 1..20: note = CRISPR gRNA sequence
  source 1..20: mol_type = other DNA
tgccagctacttgggaggct

SEQ ID NO: 48762 - DNA, 20 bp, synthetic construct
  misc_feature 1..20: note = CRISPR gRNA sequence
  source 1..20: mol_type = other DNA
gccagctacttgggaggctg

SEQ ID NO: 48763 - DNA, 20 bp, synthetic construct
  misc_feature 1..20: note = CRISPR gRNA sequence
  source 1..20: mol_type = other DNA
agctacttgggaggctgagg

SEQ ID NO: 48764 - DNA, 20 bp, synthetic construct
  misc_feature 1..20: note = CRISPR gRNA sequence
  source 1..20: mol_type = other DNA
gctacttgggaggctgaggc

SEQ ID NO: 48765 - DNA, 20 bp, synthetic construct
  misc_feature 1..20: note = CRISPR gRNA sequence
  source 1..20: mol_type = other DNA
tacttgggaggctgaggcag

SEQ ID NO: 48766 - DNA, 20 bp, synthetic construct
  misc_feature 1..20: note = CRISPR gRNA sequence
  source 1..20: mol_type = other DNA
acttgggaggctgaggcagg

SEQ ID NO: 48767 - DNA, 20 bp, synthetic construct
  misc_feature 1..20: note = CRISPR gRNA sequence
  source 1..20: mol_type = other DNA
cttgggaggctgaggcagga

SEQ ID NO: 48768 - DNA, 20 bp, synthetic construct
  misc_feature 1..20: note = CRISPR gRNA sequence
  source 1..20: mol_type = other DNA
gcaggagggttgcttgaacc

SEQ ID NO: 48769 - DNA, 20 bp, synthetic construct
  misc_feature 1..20: note = CRISPR gRNA sequence
  source 1..20: mol_type = other DNA
caggagggttgcttgaaccc

SEQ ID NO: 48770 - DNA, 20 bp, synthetic construct
  misc_feature 1..20: note = CRISPR gRNA sequence
  source 1..20: mol_type = other DNA
ggagggttgcttgaacccgg

SEQ ID NO: 48771 - DNA, 20 bp, synthetic construct
  misc_feature 1..20: note = CRISPR gRNA sequence
  source 1..20: mol_type = other DNA
gagggttgcttgaacccggg

SEQ ID NO: 48772 - DNA, 20 bp, synthetic construct
  misc_feature 1..20: note = CRISPR gRNA sequence
  source 1..20: mol_type = other DNA
ggttgcttgaacccgggagg

SEQ ID NO: 48773 - DNA, 20 bp, synthetic construct
  misc_feature 1..20: note = CRISPR gRNA sequence
  source 1..20: mol_type = other DNA
ttgcttgaacccgggaggcg

SEQ ID NO: 48774 - DNA, 20 bp, synthetic construct
  misc_feature 1..20: note = CRISPR gRNA sequence
  source 1..20: mol_type = other DNA
tgcttgaacccgggaggcgg

SEQ ID NO: 48775 - DNA, 20 bp, synthetic construct
  misc_feature 1..20: note = CRISPR gRNA sequence
  source 1..20: mol_type = other DNA
aacccgggaggcggaggttg

SEQ ID NO: 48776 - DNA, 20 bp, synthetic construct
  misc_feature 1..20: note = CRISPR gRNA sequence
  source 1..20: mol_type = other DNA
cgggaggcggaggttgcagt

SEQ ID NO: 48777 - DNA, 20 bp, synthetic construct
  misc_feature 1..20: note = CRISPR gRNA sequence
  source 1..20: mol_type = other DNA
ggcggaggttgcagtgagcc

SEQ ID NO: 48778 - DNA, 20 bp, synthetic construct
  misc_feature 1..20: note = CRISPR gRNA sequence
  source 1..20: mol_type = other DNA
aagactgtgccactgcactc

SEQ ID NO: 48779 - DNA, 20 bp, synthetic construct
  misc_feature 1..20: note = CRISPR gRNA sequence
  source 1..20: mol_type = other DNA
tgtgccactgcactccagcc

SEQ ID NO: 48780 - DNA, 20 bp, synthetic construct
  misc_feature 1..20: note = CRISPR gRNA sequence
  source 1..20: mol_type = other DNA
gtgccactgcactccagcct

SEQ ID NO: 48781 - DNA, 20 bp, synthetic construct
  misc_feature 1..20: note = CRISPR gRNA sequence
  source 1..20: mol_type = other DNA
ctgcactccagcctgggcaa

SEQ ID NO: 48782 - DNA, 20 bp, synthetic construct
  misc_feature 1..20: note = CRISPR gRNA sequence
  source 1..20: mol_type = other DNA
gcactccagcctgggcaacg

SEQ ID NO: 48783 - DNA, 20 bp, synthetic construct
  misc_feature 1..20: note = CRISPR gRNA sequence
  source 1..20: mol_type = other DNA
actccagcctgggcaacgga

SEQ ID NO: 48784 - DNA, 20 bp, synthetic construct
  misc_feature 1..20: note = CRISPR gRNA sequence
  source 1..20: mol_type = other DNA
tccagcctgggcaacggaga

SEQ ID NO: 48785 - DNA, 20 bp, synthetic construct
  misc_feature 1..20: note = CRISPR gRNA sequence
  source 1..20: mol_type = other DNA
cctgggcaacggagagagac

SEQ ID NO: 48786 - DNA, 20 bp, synthetic construct
  misc_feature 1..20: note = CRISPR gRNA sequence
  source 1..20: mol_type = other DNA
ctgggcaacggagagagact

SEQ ID NO: 48787 - DNA, 20 bp, synthetic construct
  misc_feature 1..20: note = CRISPR gRNA sequence
  source 1..20: mol_type = other DNA
aaataaataaataataaaat

SEQ ID NO: 48788 - DNA, 20 bp, synthetic construct
  misc_feature 1..20: note = CRISPR gRNA sequence
  source 1..20: mol_type = other DNA
ataaataaataataaaataa

SEQ ID NO: 48789 - DNA, 20 bp, synthetic construct
  misc_feature 1..20: note = CRISPR gRNA sequence
  source 1..20: mol_type = other DNA
taaataaataataaaataag

SEQ ID NO: 48790 - DNA, 20 bp, synthetic construct
  misc_feature 1..20: note = CRISPR gRNA sequence
  source 1..20: mol_type = other DNA
ataaataataaaataagagg

SEQ ID NO: 48791 - DNA, 20 bp, synthetic construct
  misc_feature 1..20: note = CRISPR gRNA sequence
  source 1..20: mol_type = other DNA
aataataaaataagaggcag

SEQ ID NO: 48792 - DNA, 20 bp, synthetic construct
  misc_feature 1..20: note = CRISPR gRNA sequence
  source 1..20: mol_type = other DNA
aaaataagaggcagaagcaa

SEQ ID NO: 48793 - DNA, 20 bp, synthetic construct
  misc_feature 1..20: note = CRISPR gRNA sequence
  source 1..20: mol_type = other DNA
taagaggcagaagcaaaaga

SEQ ID NO: 48794 - DNA, 20 bp, synthetic construct
  misc_feature 1..20: note = CRISPR gRNA sequence
  source 1..20: mol_type = other DNA
caaaagatggtcaactgtct

SEQ ID NO: 48795 - DNA, 20 bp, synthetic construct
  misc_feature 1..20: note = CRISPR gRNA sequence
  source 1..20: mol_type = other DNA
agatggtcaactgtcttggt

SEQ ID NO: 48796 - DNA, 20 bp, synthetic construct
  misc_feature 1..20: note = CRISPR gRNA sequence
  source 1..20: mol_type = other DNA
gtcaactgtcttggttggct

SEQ ID NO: 48797 - DNA, 20 bp, synthetic construct
  misc_feature 1..20: note = CRISPR gRNA sequence
  source 1..20: mol_type = other DNA
ctgtcttggttggctcagaa

SEQ ID NO: 48798 - DNA, 20 bp, synthetic construct
  misc_feature 1..20: note = CRISPR gRNA sequence
  source 1..20: mol_type = other DNA
tcttggttggctcagaacag

SEQ ID NO: 48799 - DNA, 20 bp, synthetic construct
  misc_feature 1..20: note = CRISPR gRNA sequence
  source 1..20: mol_type = other DNA
ttggttggctcagaacagaa

SEQ ID NO: 48800 - DNA, 20 bp, synthetic construct
  misc_feature 1..20: note = CRISPR gRNA sequence
  source 1..20: mol_type = other DNA
cagaacagaagagtttttcc

SEQ ID NO: 48801 - DNA, 20 bp, synthetic construct
  misc_feature 1..20: note = CRISPR gRNA sequence
  source 1..20: mol_type = other DNA
agaagagtttttcctggatg

SEQ ID NO: 48802 - DNA, 20 bp, synthetic construct
  misc_feature 1..20: note = CRISPR gRNA sequence
  source 1..20: mol_type = other DNA
gaagagtttttcctggatgt

SEQ ID NO: 48803 - DNA, 20 bp, synthetic construct
  misc_feature 1..20: note = CRISPR gRNA sequence
  source 1..20: mol_type = other DNA
ttttcctggatgtgggactt

SEQ ID NO: 48804 - DNA, 20 bp, synthetic construct
  misc_feature 1..20: note = CRISPR gRNA sequence
  source 1..20: mol_type = other DNA
tttcctggatgtgggacttt

SEQ ID NO: 48805 - DNA, 20 bp, synthetic construct
  misc_feature 1..20: note = CRISPR gRNA sequence
  source 1..20: mol_type = other DNA
tgggactttgggtgccaaaa

SEQ ID NO: 48806 - DNA, 20 bp, synthetic construct
  misc_feature 1..20: note = CRISPR gRNA sequence
  source 1..20: mol_type = other DNA
gggactttgggtgccaaaat

SEQ ID NO: 48807 - DNA, 20 bp, synthetic construct
  misc_feature 1..20: note = CRISPR gRNA sequence
  source 1..20: mol_type = other DNA
ggactttgggtgccaaaatg

SEQ ID NO: 48808 - DNA, 20 bp, synthetic construct
  misc_feature 1..20: note = CRISPR gRNA sequence
  source 1..20: mol_type = other DNA
tttgggtgccaaaatgggga

SEQ ID NO: 48809 - DNA, 20 bp, synthetic construct
  misc_feature 1..20: note = CRISPR gRNA sequence
  source 1..20: mol_type = other DNA
gccaaaatggggaaagctcc

SEQ ID NO: 48810 - DNA, 20 bp, synthetic construct
  misc_feature 1..20: note = CRISPR gRNA sequence
  source 1..20: mol_type = other DNA
ggggaaagctccaagcaaac

SEQ ID NO: 48811 - DNA, 20 bp, synthetic construct
  misc_feature 1..20: note = CRISPR gRNA sequence
  source 1..20: mol_type = other DNA
gaaagctccaagcaaactgg

SEQ ID NO: 48812 - DNA, 20 bp, synthetic construct
  misc_feature 1..20: note = CRISPR gRNA sequence
  source 1..20: mol_type = other DNA
tccaagcaaactggaagtgt

SEQ ID NO: 48813 - DNA, 20 bp, synthetic construct
  misc_feature 1..20: note = CRISPR gRNA sequence
  source 1..20: mol_type = other DNA
gaagtgtcagttaccccacc

SEQ ID NO: 48814 - DNA, 20 bp, synthetic construct
  misc_feature 1..20: note = CRISPR gRNA sequence
  source 1..20: mol_type = other DNA
agtgtcagttaccccaccca

SEQ ID NO: 48815 - DNA, 20 bp, synthetic construct
  misc_feature 1..20: note = CRISPR gRNA sequence
  source 1..20: mol_type = other DNA
accccacccagagttgaacc

SEQ ID NO: 48816 - DNA, 20 bp, synthetic construct
  misc_feature 1..20: note = CRISPR gRNA sequence
  source 1..20: mol_type = other DNA
ccccacccagagttgaaccc

SEQ ID NO: 48817 - DNA, 20 bp, synthetic construct
  misc_feature 1..20: note = CRISPR gRNA sequence
  source 1..20: mol_type = other DNA
cacccagagttgaacccagg

SEQ ID NO: 48818 - DNA, 20 bp, synthetic construct
  misc_feature 1..20: note = CRISPR gRNA sequence
  source 1..20: mol_type = other DNA
cagagttgaacccaggcagt

SEQ ID NO: 48819 - DNA, 20 bp, synthetic construct
  misc_feature 1..20: note = CRISPR gRNA sequence
  source 1..20: mol_type = other DNA
agagttgaacccaggcagtg

SEQ ID NO: 48820 - DNA, 20 bp, synthetic construct
  misc_feature 1..20: note = CRISPR gRNA sequence
  source 1..20: mol_type = other DNA
caggcagtgaggctcctaac

SEQ ID NO: 48821 - DNA, 20 bp, synthetic construct
  misc_feature 1..20: note = CRISPR gRNA sequence
  source 1..20: mol_type = other DNA
aggcagtgaggctcctaact

SEQ ID NO: 48822 - DNA, 20 bp, synthetic construct
  misc_feature 1..20: note = CRISPR gRNA sequence
  source 1..20: mol_type = other DNA
ggcagtgaggctcctaacta

SEQ ID NO: 48823 - DNA, 20 bp, synthetic construct
  misc_feature 1..20: note = CRISPR gRNA sequence
  source 1..20: mol_type = other DNA
tgctcctacccactccatca

SEQ ID NO: 48824 - DNA, 20 bp, synthetic construct
  misc_feature 1..20: note = CRISPR gRNA sequence
  source 1..20: mol_type = other DNA
gctcctacccactccatcac

SEQ ID NO: 48825 - DNA, 20 bp, synthetic construct
  misc_feature 1..20: note = CRISPR gRNA sequence
  source 1..20: mol_type = other DNA
cccactccatcacaggtata

SEQ ID NO: 48826 - DNA, 20 bp, synthetic construct
  misc_feature 1..20: note = CRISPR gRNA sequence
  source 1..20: mol_type = other DNA
ctccatcacaggtatacagc

SEQ ID NO: 48827 - DNA, 20 bp, synthetic construct
  misc_feature 1..20: note = CRISPR gRNA sequence
  source 1..20: mol_type = other DNA
catcacaggtatacagctgg

SEQ ID NO: 48828 - DNA, 20 bp, synthetic construct
  misc_feature 1..20: note = CRISPR gRNA sequence
  source 1..20: mol_type = other DNA
cacaggtatacagctggaag

SEQ ID NO: 48829 - DNA, 20 bp, synthetic construct
  misc_feature 1..20: note = CRISPR gRNA sequence
  source 1..20: mol_type = other DNA
tacagctggaagaagctgac

SEQ ID NO: 48830 - DNA, 20 bp, synthetic construct
  misc_feature 1..20: note = CRISPR gRNA sequence
  source 1..20: mol_type = other DNA
ggaagaagctgactggattt

SEQ ID NO: 48831 - DNA, 20 bp, synthetic construct
  misc_feature 1..20: note = CRISPR gRNA sequence
  source 1..20: mol_type = other DNA
gaagaagctgactggatttg

SEQ ID NO: 48832 - DNA, 20 bp, synthetic construct
  misc_feature 1..20: note = CRISPR gRNA sequence
  source 1..20: mol_type = other DNA
aagaagctgactggatttga

SEQ ID NO: 48833 - DNA, 20 bp, synthetic construct
  misc_feature 1..20: note = CRISPR gRNA sequence
  source 1..20: mol_type = other DNA
gatttgagggtaactgcctg

SEQ ID NO: 48834 - DNA, 20 bp, synthetic construct
  misc_feature 1..20: note = CRISPR gRNA sequence
  source 1..20: mol_type = other DNA
atttgagggtaactgcctgt

SEQ ID NO: 48835 - DNA, 20 bp, synthetic construct
  misc_feature 1..20: note = CRISPR gRNA sequence
  source 1..20: mol_type = other DNA
tttgagggtaactgcctgtg

SEQ ID NO: 48836 - DNA, 20 bp, synthetic construct
  misc_feature 1..20: note = CRISPR gRNA sequence
  source 1..20: mol_type = other DNA
tgagggtaactgcctgtggg

SEQ ID NO: 48837 - DNA, 20 bp, synthetic construct
  misc_feature 1..20: note = CRISPR gRNA sequence
  source 1..20: mol_type = other DNA
tgcctgtggggagttacact

SEQ ID NO: 48838 - DNA, 20 bp, synthetic construct
  misc_feature 1..20: note = CRISPR gRNA sequence
  source 1..20: mol_type = other DNA
ggagttacacttggaaatga

SEQ ID NO: 48839 - DNA, 20 bp, synthetic construct
  misc_feature 1..20: note = CRISPR gRNA sequence
  source 1..20: mol_type = other DNA
cacttggaaatgacagatct

SEQ ID NO: 48840 - DNA, 20 bp, synthetic construct
  misc_feature 1..20: note = CRISPR gRNA sequence
  source 1..20: mol_type = other DNA
tggaaatgacagatctgaga

SEQ ID NO: 48841 - DNA, 20 bp, synthetic construct
  misc_feature 1..20: note = CRISPR gRNA sequence
  source 1..20: mol_type = other DNA
ggaaatgacagatctgagat

SEQ ID NO: 48842 - DNA, 20 bp, synthetic construct
  misc_feature 1..20: note = CRISPR gRNA sequence
  source 1..20: mol_type = other DNA
aatgacagatctgagatggg

SEQ ID NO: 48843 - DNA, 20 bp, synthetic construct
  misc_feature 1..20: note = CRISPR gRNA sequence
  source 1..20: mol_type = other DNA
tgacagatctgagatgggaa

SEQ ID NO: 48844 - DNA, 20 bp, synthetic construct
  misc_feature 1..20: note = CRISPR gRNA sequence
  source 1..20: mol_type = other DNA
ctgagatgggaagagacctc

SEQ ID NO: 48845 - DNA, 20 bp, synthetic construct
  misc_feature 1..20: note = CRISPR gRNA sequence
  source 1..20: mol_type = other DNA
tgagatgggaagagacctcc

SEQ ID NO: 48846 - DNA, 20 bp, synthetic construct
  misc_feature 1..20: note = CRISPR gRNA sequence
  source 1..20: mol_type = other DNA
gacgatccatccccttcctt

SEQ ID NO: 48847 - DNA, 20 bp, synthetic construct
  misc_feature 1..20: note = CRISPR gRNA sequence
  source 1..20: mol_type = other DNA
atccatccccttccttcgga

SEQ ID NO: 48848 - DNA, 20 bp, synthetic construct
  misc_feature 1..20: note = CRISPR gRNA sequence
  source 1..20: mol_type = other DNA
tccatccccttccttcggac

SEQ ID NO: 48849 - DNA, 20 bp, synthetic construct
  misc_feature 1..20: note = CRISPR gRNA sequence
  source 1..20: mol_type = other DNA
ccatccccttccttcggaca

SEQ ID NO: 48850 - DNA, 20 bp, synthetic construct
  misc_feature 1..20: note = CRISPR gRNA sequence
  source 1..20: mol_type = other DNA
tccccttccttcggacaggg

SEQ ID NO: 48851 - DNA, 20 bp, synthetic construct
  misc_feature 1..20: note = CRISPR gRNA sequence
  source 1..20: mol_type = other DNA
gacagggaagatattatgcc

SEQ ID NO: 48852 - DNA, 20 bp, synthetic construct
  misc_feature 1..20: note = CRISPR gRNA sequence
  source 1..20: mol_type = other DNA
aagatattatgcccagttta

SEQ ID NO: 48853 - DNA, 20 bp, synthetic construct
  misc_feature 1..20: note = CRISPR gRNA sequence
  source 1..20: mol_type = other DNA
tattatgcccagtttacaga

SEQ ID NO: 48854 - DNA, 20 bp, synthetic construct
  misc_feature 1..20: note = CRISPR gRNA sequence
  source 1..20: mol_type = other DNA
attatgcccagtttacagat

SEQ ID NO: 48855 - DNA, 20 bp, synthetic construct
  misc_feature 1..20: note = CRISPR gRNA sequence
  source 1..20: mol_type = other DNA
ttatgcccagtttacagata

SEQ ID NO: 48856 - DNA, 20 bp, synthetic construct
  misc_feature 1..20: note = CRISPR gRNA sequence
  source 1..20: mol_type = other DNA
agtttacagatagggcaact

SEQ ID NO: 48857 - DNA, 20 bp, synthetic construct
  misc_feature 1..20: note = CRISPR gRNA sequence
  source 1..20: mol_type = other DNA
gtttacagatagggcaacta

SEQ ID NO: 48858 - DNA, 20 bp, synthetic construct
  misc_feature 1..20: note = CRISPR gRNA sequence
  source 1..20: mol_type = other DNA
tacagatagggcaactaagg

SEQ ID NO: 48859 - DNA, 20 bp, synthetic construct
  misc_feature 1..20: note = CRISPR gRNA sequence
  source 1..20: mol_type = other DNA
agatagggcaactaaggcag

SEQ ID NO: 48860 - DNA, 20 bp, synthetic construct
  misc_feature 1..20: note = CRISPR gRNA sequence
  source 1..20: mol_type = other DNA
gatagggcaactaaggcagc

SEQ ID NO: 48861 - DNA, 20 bp, synthetic construct
  misc_feature 1..20: note = CRISPR gRNA sequence
  source 1..20: mol_type = other DNA
tagggcaactaaggcagcag

SEQ ID NO: 48862 - DNA, 20 bp, synthetic construct
  misc_feature 1..20: note = CRISPR gRNA sequence
  source 1..20: mol_type = other DNA
agggcaactaaggcagcagg

SEQ ID NO: 48863 - DNA, 20 bp, synthetic construct
  misc_feature 1..20: note = CRISPR gRNA sequence
  source 1..20: mol_type = other DNA
caactaaggcagcaggaggt

SEQ ID NO: 48864 - DNA, 20 bp, synthetic construct
  misc_feature 1..20: note = CRISPR gRNA sequence
  source 1..20: mol_type = other DNA
aactaaggcagcaggaggta

SEQ ID NO: 48865 - DNA, 20 bp, synthetic construct
  misc_feature 1..20: note = CRISPR gRNA sequence
  source 1..20: mol_type = other DNA
ctaaggcagcaggaggtaag

SEQ ID NO: 48866 - DNA, 20 bp, synthetic construct
  misc_feature 1..20: note = CRISPR gRNA sequence
  source 1..20: mol_type = other DNA
aggcagcaggaggtaaggag

SEQ ID NO: 48867 - DNA, 20 bp, synthetic construct
  misc_feature 1..20: note = CRISPR gRNA sequence
  source 1..20: mol_type = other DNA
aggaggtaaggagcagcaca

SEQ ID NO: 48868 - DNA, 20 bp, synthetic construct
  misc_feature 1..20: note = CRISPR gRNA sequence
  source 1..20: mol_type = other DNA
aaggagcagcacatggtgcc

SEQ ID NO: 48869 - DNA, 20 bp, synthetic construct
  misc_feature 1..20: note = CRISPR gRNA sequence
  source 1..20: mol_type = other DNA
aggagcagcacatggtgcct

SEQ ID NO: 48870 - DNA, 20 bp, synthetic construct
  misc_feature 1..20: note = CRISPR gRNA sequence
  source 1..20: mol_type = other DNA
gcacatggtgcctgggaaat

SEQ ID NO: 48871 - DNA, 20 bp, synthetic construct
  misc_feature 1..20: note = CRISPR gRNA sequence
  source 1..20: mol_type = other DNA
cacatggtgcctgggaaatc

SEQ ID NO: 48872 - DNA, 20 bp, synthetic construct
  misc_feature 1..20: note = CRISPR gRNA sequence
  source 1..20: mol_type = other DNA
catggtgcctgggaaatcag

SEQ ID NO: 48873 - DNA, 20 bp, synthetic construct
  misc_feature 1..20: note = CRISPR gRNA sequence
  source 1..20: mol_type = other DNA
atggtgcctgggaaatcagg

SEQ ID NO: 48874 - DNA, 20 bp, synthetic construct
  misc_feature 1..20: note = CRISPR gRNA sequence
  source 1..20: mol_type = other DNA
gtgcctgggaaatcaggagg

SEQ ID NO: 48875 - DNA, 20 bp, synthetic construct
  misc_feature 1..20: note = CRISPR gRNA sequence
  source 1..20: mol_type = other DNA
gggaaatcaggaggaagaaa

SEQ ID NO: 48876 - DNA, 20 bp, synthetic construct
  misc_feature 1..20: note = CRISPR gRNA sequence
  source 1..20: mol_type = other DNA
ggaaatcaggaggaagaaaa

SEQ ID NO: 48877 - DNA, 20 bp, synthetic construct
  misc_feature 1..20: note = CRISPR gRNA sequence
  source 1..20: mol_type = other DNA
aggaggaagaaaaaggcccc

SEQ ID NO: 48878 - DNA, 20 bp, synthetic construct
  misc_feature 1..20: note = CRISPR gRNA sequence
  source 1..20: mol_type = other DNA
ggaggaagaaaaaggccccc

SEQ ID NO: 48879 - DNA, 20 bp, synthetic construct
  misc_feature 1..20: note = CRISPR gRNA sequence
  source 1..20: mol_type = other DNA
gaggaagaaaaaggccccca

SEQ ID NO: 48880 - DNA, 20 bp, synthetic construct
  misc_feature 1..20: note = CRISPR gRNA sequence
  source 1..20: mol_type = other DNA
aggaagaaaaaggcccccag

SEQ ID NO: 48881 - DNA, 20 bp, synthetic construct
  misc_feature 1..20: note = CRISPR gRNA sequence
  source 1..20: mol_type = other DNA
gaaaaaggcccccaggggca

SEQ ID NO: 48882 - DNA, 20 bp, synthetic construct
  misc_feature 1..20: note = CRISPR gRNA sequence
  source 1..20: mol_type = other DNA
ggatgaatctgtcctgtccc

SEQ ID NO: 48883 - DNA, 20 bp, synthetic construct
  misc_feature 1..20: note = CRISPR gRNA sequence
  source 1..20: mol_type = other DNA
aatctgtcctgtccccggcc

SEQ ID NO: 48884 - DNA, 20 bp, synthetic construct
  misc_feature 1..20: note = CRISPR gRNA sequence
  source 1..20: mol_type = other DNA
atctgtcctgtccccggccc

SEQ ID NO: 48885 - DNA, 20 bp, synthetic construct
  misc_feature 1..20: note = CRISPR gRNA sequence
  source 1..20: mol_type = other DNA
ctgtccccggcccaggtgcc

SEQ ID NO: 48886 - DNA, 20 bp, synthetic construct
  misc_feature 1..20: note = CRISPR gRNA sequence
  source 1..20: mol_type = other DNA
cccggcccaggtgcccagct

SEQ ID NO: 48887 - DNA, 20 bp, synthetic construct
  misc_feature 1..20: note = CRISPR gRNA sequence
  source 1..20: mol_type = other DNA
tatttgtcgaatgcatgaat

SEQ ID NO: 48888 - DNA, 20 bp, synthetic construct
  misc_feature 1..20: note = CRISPR gRNA sequence
  source 1..20: mol_type = other DNA
gagccaatgaatgacctcac

SEQ ID NO: 48889 - DNA, 20 bp, synthetic construct
  misc_feature 1..20: note = CRISPR gRNA sequence
  source 1..20: mol_type = other DNA
agccaatgaatgacctcact

SEQ ID NO: 48890 - DNA, 20 bp, synthetic construct
  misc_feature 1..20: note = CRISPR gRNA sequence
  source 1..20: mol_type = other DNA
gcctccaatcccctaaataa

SEQ ID NO: 48891 - DNA, 20 bp, synthetic construct
  misc_feature 1..20: note = CRISPR gRNA sequence
  source 1..20: mol_type = other DNA
atcccctaaataaaagcttc

SEQ ID NO: 48892 - DNA, 20 bp, synthetic construct
  misc_feature 1..20: note = CRISPR gRNA sequence
  source 1..20: mol_type = other DNA
ccctaaataaaagcttccag

SEQ ID NO: 48893 - DNA, 20 bp, synthetic construct
  misc_feature 1..20: note = CRISPR gRNA sequence
  source 1..20: mol_type = other DNA
cctaaataaaagcttccaga

SEQ ID NO: 48894 - DNA, 20 bp, synthetic construct
  misc_feature 1..20: note = CRISPR gRNA sequence
  source 1..20: mol_type = other DNA
ataaaagcttccagaaggct

SEQ ID NO: 48895 - DNA, 20 bp, synthetic construct
  misc_feature 1..20: note = CRISPR gRNA sequence
  source 1..20: mol_type = other DNA
agcttccagaaggctgagcc

SEQ ID NO: 48896 - DNA, 20 bp, synthetic construct
  misc_feature 1..20: note = CRISPR gRNA sequence
  source 1..20: mol_type = other DNA
cagaaggctgagccgagatg

SEQ ID NO: 48897 - DNA, 20 bp, synthetic construct
  misc_feature 1..20: note = CRISPR gRNA sequence
  source 1..20: mol_type = other DNA
agaaggctgagccgagatgc

SEQ ID NO: 48898 - DNA, 20 bp, synthetic construct
  misc_feature 1..20: note = CRISPR gRNA sequence
  source 1..20: mol_type = other DNA
tgagccgagatgcaggtaca

SEQ ID NO: 48899 - DNA, 20 bp, synthetic construct
  misc_feature 1..20: note = CRISPR gRNA sequence
  source 1..20: mol_type = other DNA
ccgagatgcaggtacatgga

SEQ ID NO: 48900 - DNA, 20 bp, synthetic construct
  misc_feature 1..20: note = CRISPR gRNA sequence
  source 1..20: mol_type = other DNA
agatgcaggtacatggacag

SEQ ID NO: 48901 - DNA, 20 bp, synthetic construct
  misc_feature 1..20: note = CRISPR gRNA sequence
  source 1..20: mol_type = other DNA
gatgcaggtacatggacagt

SEQ ID NO: 48902 - DNA, 20 bp, synthetic construct
  misc_feature 1..20: note = CRISPR gRNA sequence
  source 1..20: mol_type = other DNA
aggtacatggacagtgggca

SEQ ID NO: 48903 - DNA, 20 bp, synthetic construct
  misc_feature 1..20: note = CRISPR gRNA sequence
  source 1..20: mol_type = other DNA
atggacagtgggcaaagaaa

SEQ ID NO: 48904 - DNA, 20 bp, synthetic construct
  misc_feature 1..20: note = CRISPR gRNA sequence
  source 1..20: mol_type = other DNA
cagtgggcaaagaaacagac

SEQ ID NO: 48905 - DNA, 20 bp, synthetic construct
  misc_feature 1..20: note = CRISPR gRNA sequence
  source 1..20: mol_type = other DNA
gggcaaagaaacagaccagt

SEQ ID NO: 48906 - DNA, 20 bp, synthetic construct
  misc_feature 1..20: note = CRISPR gRNA sequence
  source 1..20: mol_type = other DNA
gaaacagaccagtgagacga

SEQ ID NO: 48907 - DNA, 20 bp, synthetic construct
  misc_feature 1..20: note = CRISPR gRNA sequence
  source 1..20: mol_type = other DNA
aaacagaccagtgagacgac

SEQ ID NO: 48908 - DNA, 20 bp, synthetic construct
  misc_feature 1..20: note = CRISPR gRNA sequence
  source 1..20: mol_type = other DNA
acagaccagtgagacgacag

SEQ ID NO: 48909 - DNA, 20 bp, synthetic construct
  misc_feature 1..20: note = CRISPR gRNA sequence
  source 1..20: mol_type = other DNA
cagaccagtgagacgacagg

SEQ ID NO: 48910 - DNA, 20 bp, synthetic construct
  misc_feature 1..20: note = CRISPR gRNA sequence
  source 1..20: mol_type = other DNA
agaccagtgagacgacagga

SEQ ID NO: 48911 - DNA, 20 bp, synthetic construct
  misc_feature 1..20: note = CRISPR gRNA sequence
  source 1..20: mol_type = other DNA
gagacgacaggagggccctg

SEQ ID NO: 48912 - DNA, 20 bp, synthetic construct
  misc_feature 1..20: note = CRISPR gRNA sequence
  source 1..20: mol_type = other DNA
acaggagggccctgtggtca

SEQ ID NO: 48913 - DNA, 20 bp, synthetic construct
  misc_feature 1..20: note = CRISPR gRNA sequence
  source 1..20: mol_type = other DNA
caggagggccctgtggtcaa

SEQ ID NO: 48914 - DNA, 20 bp, synthetic construct
  misc_feature 1..20: note = CRISPR gRNA sequence
  source 1..20: mol_type = other DNA
cttttacctgatcctctccc

SEQ ID NO: 48915 - DNA, 20 bp, synthetic construct
  misc_feature 1..20: note = CRISPR gRNA sequence
  source 1..20: mol_type = other DNA
ttttacctgatcctctcccc

SEQ ID NO: 48916 - DNA, 20 bp, synthetic construct
  misc_feature 1..20: note = CRISPR gRNA sequence
  source 1..20: mol_type = other DNA
cctgatcctctccccaggac

SEQ ID NO: 48917 - DNA, 20 bp, synthetic construct
  misc_feature 1..20: note = CRISPR gRNA sequence
  source 1..20: mol_type = other DNA
tcctctccccaggacaagca

SEQ ID NO: 48918 - DNA, 20 bp, synthetic construct
  misc_feature 1..20: note = CRISPR gRNA sequence
  source 1..20: mol_type = other DNA
ctctccccaggacaagcaaa

SEQ ID NO: 48919 - DNA, 20 bp, synthetic construct
  misc_feature 1..20: note = CRISPR gRNA sequence
  source 1..20: mol_type = other DNA
tctccccaggacaagcaaag

SEQ ID NO: 48920 - DNA, 20 bp, synthetic construct
  misc_feature 1..20: note = CRISPR gRNA sequence
  source 1..20: mol_type = other DNA
ctccccaggacaagcaaaga

SEQ ID NO: 48921 - DNA, 20 bp, synthetic construct
  misc_feature 1..20: note = CRISPR gRNA sequence
  source 1..20: mol_type = other DNA
caggacaagcaaagagggac

SEQ ID NO: 48922 - DNA, 20 bp, synthetic construct
  misc_feature 1..20: note = CRISPR gRNA sequence
  source 1..20: mol_type = other DNA
gacaagcaaagagggacaag

SEQ ID NO: 48923 - DNA, 20 bp, synthetic construct
  misc_feature 1..20: note = CRISPR gRNA sequence
  source 1..20: mol_type = other DNA
aagcaaagagggacaagcgg

SEQ ID NO: 48924 - DNA, 20 bp, synthetic construct
  misc_feature 1..20: note = CRISPR gRNA sequence
  source 1..20: mol_type = other DNA
agcggaagaatttcaatgtt

SEQ ID NO: 48925 - DNA, 20 bp, synthetic construct
  misc_feature 1..20: note = CRISPR gRNA sequence
  source 1..20: mol_type = other DNA
gcggaagaatttcaatgtta

SEQ ID NO: 48926 - DNA, 20 bp, synthetic construct
  misc_feature 1..20: note = CRISPR gRNA sequence
  source 1..20: mol_type = other DNA
cggaagaatttcaatgttaa

SEQ ID NO: 48927 - DNA, 20 bp, synthetic construct
  misc_feature 1..20: note = CRISPR gRNA sequence
  source 1..20: mol_type = other DNA
ggaagaatttcaatgttaag

SEQ ID NO: 48928 - DNA, 20 bp, synthetic construct
  misc_feature 1..20: note = CRISPR gRNA sequence
  source 1..20: mol_type = other DNA
tttcaatgttaaggggcaaa

SEQ ID NO: 48929 - DNA, 20 bp, synthetic construct
  misc_feature 1..20: note = CRISPR gRNA sequence
  source 1..20: mol_type = other DNA
gttaaggggcaaaaagtcaa

SEQ ID NO: 48930 - DNA, 20 bp, synthetic construct
  misc_feature 1..20: note = CRISPR gRNA sequence
  source 1..20: mol_type = other DNA
ttaaggggcaaaaagtcaaa

SEQ ID NO: 48931 - DNA, 20 bp, synthetic construct
  misc_feature 1..20: note = CRISPR gRNA sequence
  source 1..20: mol_type = other DNA
aaagtcaaaaggctactttc

SEQ ID NO: 48932 - DNA, 20 bp, synthetic construct
  misc_feature 1..20: note = CRISPR gRNA sequence
  source 1..20: mol_type = other DNA
agctgaattcaaaacatatg

SEQ ID NO: 48933 - DNA, 20 bp, synthetic construct
  misc_feature 1..20: note = CRISPR gRNA sequence
  source 1..20: mol_type = other DNA
catatgtagaaaaaaaaatc

SEQ ID NO: 48934 - DNA, 20 bp, synthetic construct
  misc_feature 1..20: note = CRISPR gRNA sequence
  source 1..20: mol_type = other DNA
tatgtagaaaaaaaaatctg

SEQ ID NO: 48935 - DNA, 20 bp, synthetic construct
  misc_feature 1..20: note = CRISPR gRNA sequence
  source 1..20: mol_type = other DNA
aaaattcacaaaccgttcaa

SEQ ID NO: 48936 - DNA, 20 bp, synthetic construct
  misc_feature 1..20: note = CRISPR gRNA sequence
  source 1..20: mol_type = other DNA
attcacaaaccgttcaacag

SEQ ID NO: 48937 - DNA, 20 bp, synthetic construct
  misc_feature 1..20: note = CRISPR gRNA sequence
  source 1..20: mol_type = other DNA
ccgttcaacagaagttttct

SEQ ID NO: 48938 - DNA, 20 bp, synthetic construct
  misc_feature 1..20: note = CRISPR gRNA sequence
  source 1..20: mol_type = other DNA
cgttcaacagaagttttctc

SEQ ID NO: 48939 - DNA, 20 bp, synthetic construct
  misc_feature 1..20: note = CRISPR gRNA sequence
  source 1..20: mol_type = other DNA
gttcaacagaagttttctca

SEQ ID NO: 48940 - DNA, 20 bp, synthetic construct
  misc_feature 1..20: note = CRISPR gRNA sequence
  source 1..20: mol_type = other DNA
ttcaacagaagttttctcag

SEQ ID NO: 48941 - DNA, 20 bp, synthetic construct
  misc_feature 1..20: note = CRISPR gRNA sequence
  source 1..20: mol_type = other DNA
tcaacagaagttttctcagg

SEQ ID NO: 48942 - DNA, 20 bp, synthetic construct
  misc_feature 1..20: note = CRISPR gRNA sequence
  source 1..20: mol_type = other DNA
ttctcagggggtgtcatccc

SEQ ID NO: 48943 - DNA, 20 bp, synthetic construct
  misc_feature 1..20: note = CRISPR gRNA sequence
  source 1..20: mol_type = other DNA
tctcagggggtgtcatcccc

SEQ ID NO: 48944 - DNA, 20 bp, synthetic construct
  misc_feature 1..20: note = CRISPR gRNA sequence
  source 1..20: mol_type = other DNA
ctcagggggtgtcatccccg

SEQ ID NO: 48945 - DNA, 20 bp, synthetic construct
  misc_feature 1..20: note = CRISPR gRNA sequence
  source 1..20: mol_type = other DNA
tgttatttgttacatatttc

SEQ ID NO: 48946 - DNA, 20 bp, synthetic construct
  misc_feature 1..20: note = CRISPR gRNA sequence
  source 1..20: mol_type = other DNA
atttgttacatatttctaga

SEQ ID NO: 48947 - DNA, 20 bp, synthetic construct
  misc_feature 1..20: note = CRISPR gRNA sequence
  source 1..20: mol_type = other DNA
gttacatatttctagaaaga

SEQ ID NO: 48948 - DNA, 20 bp, synthetic construct
  misc_feature 1..20: note = CRISPR gRNA sequence
  source 1..20: mol_type = other DNA
ctagaaagatggaacttttt

SEQ ID NO: 48949 - DNA, 20 bp, synthetic construct
  misc_feature 1..20: note = CRISPR gRNA sequence
  source 1..20: mol_type = other DNA
gatggaacttttttggtcat

SEQ ID NO: 48950 - DNA, 20 bp, synthetic construct
  misc_feature 1..20: note = CRISPR gRNA sequence
  source 1..20: mol_type = other DNA
acttttttggtcatcagaaa

SEQ ID NO: 48951 - DNA, 20 bp, synthetic construct
  misc_feature 1..20: note = CRISPR gRNA sequence
  source 1..20: mol_type = other DNA
tttggtcatcagaaaaagtt

SEQ ID NO: 48952 - DNA, 20 bp, synthetic construct
  misc_feature 1..20: note = CRISPR gRNA sequence
  source 1..20: mol_type = other DNA
tggtcatcagaaaaagttaa

SEQ ID NO: 48953 - DNA, 20 bp, synthetic construct
  misc_feature 1..20: note = CRISPR gRNA sequence
  source 1..20: mol_type = other DNA
agaaaaagttaagagatgaa

SEQ ID NO: 48954 - DNA, 20 bp, synthetic construct
  misc_feature 1..20: note = CRISPR gRNA sequence
  source 1..20: mol_type = other DNA
aaaagttaagagatgaaaag

SEQ ID NO: 48955 - DNA, 20 bp, synthetic construct
  misc_feature 1..20: note = CRISPR gRNA sequence
  source 1..20: mol_type = other DNA
agttaagagatgaaaagcag

SEQ ID NO: 48956 - DNA, 20 bp, synthetic construct
  misc_feature 1..20: note = CRISPR gRNA sequence
  source 1..20: mol_type = other DNA
attctgttaaattttctgtc

SEQ ID NO: 48957 - DNA, 20 bp, synthetic construct
  misc_feature 1..20: note = CRISPR gRNA sequence
  source 1..20: mol_type = other DNA
ctgtccagatactgtctaaa

SEQ ID NO: 48958 - DNA, 20 bp, synthetic construct
  misc_feature 1..20: note = CRISPR gRNA sequence
  source 1..20: mol_type = other DNA
tgtccagatactgtctaaac

SEQ ID NO: 48959 - DNA, 20 bp, synthetic construct
  misc_feature 1..20: note = CRISPR gRNA sequence
  source 1..20: mol_type = other DNA
tgtctaaacaggaatctgtg

SEQ ID NO: 48960 - DNA, 20 bp, synthetic construct
  misc_feature 1..20: note = CRISPR gRNA sequence
  source 1..20: mol_type = other DNA
gtctaaacaggaatctgtgc

SEQ ID NO: 48961 - DNA, 20 bp, synthetic construct
  misc_feature 1..20: note = CRISPR gRNA sequence
  source 1..20: mol_type = other DNA
aaacaggaatctgtgcagga

SEQ ID NO: 48962 - DNA, 20 bp, synthetic construct
  misc_feature 1..20: note = CRISPR gRNA sequence
  source 1..20: mol_type = other DNA
aacaggaatctgtgcaggac

SEQ ID NO: 48963 - DNA, 20 bp, synthetic construct
  misc_feature 1..20: note = CRISPR gRNA sequence
  source 1..20: mol_type = other DNA
acaggaatctgtgcaggacg

SEQ ID NO: 48964 - DNA, 20 bp, synthetic construct
  misc_feature 1..20: note = CRISPR gRNA sequence
  source 1..20: mol_type = other DNA
caggacggggacctgtcttt

SEQ ID NO: 48965 - DNA, 20 bp, synthetic construct
  misc_feature 1..20: note = CRISPR gRNA sequence
  source 1..20: mol_type = other DNA
ggggacctgtcttttagact

SEQ ID NO: 48966 - DNA, 20 bp, synthetic construct
  misc_feature 1..20: note = CRISPR gRNA sequence
  source 1..20: mol_type = other DNA
gggacctgtcttttagactg

SEQ ID NO: 48967 - DNA, 20 bp, synthetic construct
  misc_feature 1..20: note = CRISPR gRNA sequence
  source 1..20: mol_type = other DNA
ttttagactgaggctgtttc

SEQ ID NO: 48968 - DNA, 20 bp, synthetic construct
  misc_feature 1..20: note = CRISPR gRNA sequence
  source 1..20: mol_type = other DNA
aggctgtttctggcatttct

SEQ ID NO: 48969 - DNA, 20 bp, synthetic construct
  misc_feature 1..20: note = CRISPR gRNA sequence
  source 1..20: mol_type = other DNA
aatttgatgacttcaaatta

SEQ ID NO: 48970 - DNA, 20 bp, synthetic construct
  misc_feature 1..20: note = CRISPR gRNA sequence
  source 1..20: mol_type = other DNA
atttgatgacttcaaattat

SEQ ID NO: 48971 - DNA, 20 bp, synthetic construct
  misc_feature 1..20: note = CRISPR gRNA sequence
  source 1..20: mol_type = other DNA
tttgatgacttcaaattatg

SEQ ID NO: 48972 - DNA, 20 bp, synthetic construct
  misc_feature 1..20: note = CRISPR gRNA sequence
  source 1..20: mol_type = other DNA
ttgatgacttcaaattatgg

SEQ ID NO: 48973 - DNA, 20 bp, synthetic construct
  misc_feature 1..20: note = CRISPR gRNA sequence
  source 1..20: mol_type = other DNA
gatgacttcaaattatgggg

SEQ ID NO: 48974 - DNA, 20 bp, synthetic construct
  misc_feature 1..20: note = CRISPR gRNA sequence
  source 1..20: mol_type = other DNA
tgacttcaaattatggggga

SEQ ID NO: 48975 - DNA, 20 bp, synthetic construct
  misc_feature 1..20: note = CRISPR gRNA sequence
  source 1..20: mol_type = other DNA
cttcaaattatgggggagag

SEQ ID NO: 48976 - DNA, 20 bp, synthetic construct
  misc_feature 1..20: note = CRISPR gRNA sequence
  source 1..20: mol_type = other DNA
attatgggggagagtagtaa

SEQ ID NO: 48977 - DNA, 20 bp, synthetic construct
  misc_feature 1..20: note = CRISPR gRNA sequence
  source 1..20: mol_type = other DNA
gggagagtagtaaaagctgc

SEQ ID NO: 48978 - DNA, 20 bp, synthetic construct
  misc_feature 1..20: note = CRISPR gRNA sequence
  source 1..20: mol_type = other DNA
agtaaaagctgccagttacc

SEQ ID NO: 48979 - DNA, 20 bp, synthetic construct
  misc_feature 1..20: note = CRISPR gRNA sequence
  source 1..20: mol_type = other DNA
gtaaaagctgccagttacca

SEQ ID NO: 48980 - DNA, 20 bp, synthetic construct
  misc_feature 1..20: note = CRISPR gRNA sequence
  source 1..20: mol_type = other DNA
agttaccaaggaaacaactg

SEQ ID NO: 48981 - DNA, 20 bp, synthetic construct
  misc_feature 1..20: note = CRISPR gRNA sequence
  source 1..20: mol_type = other DNA
gaaacaactgtagacaaatg

SEQ ID NO: 48982 - DNA, 20 bp, synthetic construct
  misc_feature 1..20: note = CRISPR gRNA sequence
  source 1..20: mol_type = other DNA
acaactgtagacaaatgtag

SEQ ID NO: 48983 - DNA, 20 bp, synthetic construct
  misc_feature 1..20: note = CRISPR gRNA sequence
  source 1..20: mol_type = other DNA
acaaatgtagtggacatctg

SEQ ID NO: 48984 - DNA, 20 bp, synthetic construct
  misc_feature 1..20: note = CRISPR gRNA sequence
  source 1..20: mol_type = other DNA
tctgtagatttttttctgcc

SEQ ID NO: 48985 - DNA, 20 bp, synthetic construct
  misc_feature 1..20: note = CRISPR gRNA sequence
  source 1..20: mol_type = other DNA
tgtagatttttttctgccca

SEQ ID NO: 48986 - DNA, 20 bp, synthetic construct
  misc_feature 1..20: note = CRISPR gRNA sequence
  source 1..20: mol_type = other DNA
tcctgaaataccacccctct

SEQ ID NO: 48987 - DNA, 20 bp, synthetic construct
  misc_feature 1..20: note = CRISPR gRNA sequence
  source 1..20: mol_type = other DNA
aaataccacccctctaagtc

SEQ ID NO: 48988 - DNA, 20 bp, synthetic construct
  misc_feature 1..20: note = CRISPR gRNA sequence
  source 1..20: mol_type = other DNA
taccacccctctaagtccag

SEQ ID NO: 48989 - DNA, 20 bp, synthetic construct
  misc_feature 1..20: note = CRISPR gRNA sequence
  source 1..20: mol_type = other DNA
acccctctaagtccagaaga

SEQ ID NO: 48990 - DNA, 20 bp, synthetic construct
  misc_feature 1..20: note = CRISPR gRNA sequence
  source 1..20: mol_type = other DNA
cccctctaagtccagaagat

SEQ ID NO: 48991 - DNA, 20 bp, synthetic construct
  misc_feature 1..20: note = CRISPR gRNA sequence
  source 1..20: mol_type = other DNA
ccctctaagtccagaagata

SEQ ID NO: 48992 - DNA, 20 bp, synthetic construct
  misc_feature 1..20: note = CRISPR gRNA sequence
  source 1..20: mol_type = other DNA
agatagggtgtgcatgcgcc

SEQ ID NO: 48993 - DNA, 20 bp, synthetic construct
  misc_feature 1..20: note = CRISPR gRNA sequence
  source 1..20: mol_type = other DNA
gatagggtgtgcatgcgccc

SEQ ID NO: 48994 - DNA, 20 bp, synthetic construct
  misc_feature 1..20: note = CRISPR gRNA sequence
  source 1..20: mol_type = other DNA
ggtgtgcatgcgcccaggtc

SEQ ID NO: 48995 - DNA, 20 bp, synthetic construct
  misc_feature 1..20: note = CRISPR gRNA sequence
  source 1..20: mol_type = other DNA
tgcatgcgcccaggtctggc

SEQ ID NO: 48996 - DNA, 20 bp, synthetic construct
  misc_feature 1..20: note = CRISPR gRNA sequence
  source 1..20: mol_type = other DNA
tgcgcccaggtctggccagt

SEQ ID NO: 48997 - DNA, 20 bp, synthetic construct
  misc_feature 1..20: note = CRISPR gRNA sequence
  source 1..20: mol_type = other DNA
gcgcccaggtctggccagtg

SEQ ID NO: 48998 - DNA, 20 bp, synthetic construct
  misc_feature 1..20: note = CRISPR gRNA sequence
  source 1..20: mol_type = other DNA
gcccaggtctggccagtgag

SEQ ID NO: 48999 - DNA, 20 bp, synthetic construct
  misc_feature 1..20: note = CRISPR gRNA sequence
  source 1..20: mol_type = other DNA
aggagaatattttgtgctca

SEQ ID NO: 49000 - DNA, 20 bp, synthetic construct
  misc_feature 1..20: note = CRISPR gRNA sequence
  source 1..20: mol_type = other DNA
atattttgtgctcacagcca

SEQ ID NO: 49001 - DNA, 20 bp, synthetic construct
  misc_feature 1..20: note = CRISPR gRNA sequence
  source 1..20: mol_type = other DNA
cacagccacagtgattgctt

SEQ ID NO: 49002 - DNA, 20 bp, synthetic construct
  misc_feature 1..20: note = CRISPR gRNA sequence
  source 1..20: mol_type = other DNA
acagccacagtgattgcttt

SEQ ID NO: 49003 - DNA, 20 bp, synthetic construct
  misc_feature 1..20: note = CRISPR gRNA sequence
  source 1..20: mol_type = other DNA
cagccacagtgattgcttta

SEQ ID NO: 49004 - DNA, 20 bp, synthetic construct
  misc_feature 1..20: note = CRISPR gRNA sequence
  source 1..20: mol_type = other DNA
ccacagtgattgctttaggg

SEQ ID NO: 49005 - DNA, 20 bp, synthetic construct
  misc_feature 1..20: note = CRISPR gRNA sequence
  source 1..20: mol_type = other DNA
cacagtgattgctttagggt

SEQ ID NO: 49006 - DNA, 20 bp, synthetic construct
  misc_feature 1..20: note = CRISPR gRNA sequence
  source 1..20: mol_type = other DNA
acagtgattgctttagggtg

SEQ ID NO: 49007 - DNA, 20 bp, synthetic construct
  misc_feature 1..20: note = CRISPR gRNA sequence
  source 1..20: mol_type = other DNA
gtgattgctttagggtgggg

SEQ ID NO: 49008 - DNA, 20 bp, synthetic construct
  misc_feature 1..20: note = CRISPR gRNA sequence
  source 1..20: mol_type = other DNA
tgattgctttagggtggggc

SEQ ID NO: 49009 - DNA, 20 bp, synthetic construct
  misc_feature 1..20: note = CRISPR gRNA sequence
  source 1..20: mol_type = other DNA
tagggtggggcaggtgactc

SEQ ID NO: 49010 - DNA, 20 bp, synthetic construct
  misc_feature 1..20: note = CRISPR gRNA sequence
  source 1..20: mol_type = other DNA
gtggggcaggtgactcaagc

SEQ ID NO: 49011 - DNA, 20 bp, synthetic construct
  misc_feature 1..20: note = CRISPR gRNA sequence
  source 1..20: mol_type = other DNA
gcaggtgactcaagctagtc

SEQ ID NO: 49012 - DNA, 20 bp, synthetic construct
  misc_feature 1..20: note = CRISPR gRNA sequence
  source 1..20: mol_type = other DNA
gtgactcaagctagtccagt

SEQ ID NO: 49013 - DNA, 20 bp, synthetic construct
  misc_feature 1..20: note = CRISPR gRNA sequence
  source 1..20: mol_type = other DNA
caagctagtccagtgagact

SEQ ID NO: 49014 - DNA, 20 bp, synthetic construct
  misc_feature 1..20: note = CRISPR gRNA sequence
  source 1..20: mol_type = other DNA
tagtccagtgagactcagtc

SEQ ID NO: 49015 - DNA, 20 bp, synthetic construct
  misc_feature 1..20: note = CRISPR gRNA sequence
  source 1..20: mol_type = other DNA
agtccagtgagactcagtct

SEQ ID NO: 49016 - DNA, 20 bp, synthetic construct
  misc_feature 1..20: note = CRISPR gRNA sequence
  source 1..20: mol_type = other DNA
aggaccttttgttgtaacca

SEQ ID NO: 49017 - DNA, 20 bp, synthetic construct
  misc_feature 1..20: note = CRISPR gRNA sequence
  source 1..20: mol_type = other DNA
gaccttttgttgtaaccaca

SEQ ID NO: 49018 - DNA, 20 bp, synthetic construct
  misc_feature 1..20: note = CRISPR gRNA sequence
  source 1..20: mol_type = other DNA
ccttttgttgtaaccacaga

SEQ ID NO: 49019 - DNA, 20 bp, synthetic construct
  misc_feature 1..20: note = CRISPR gRNA sequence
  source 1..20: mol_type = other DNA
tgttgtaaccacagagagaa

SEQ ID NO: 49020 - DNA, 20 bp, synthetic construct
  misc_feature 1..20: note = CRISPR gRNA sequence
  source 1..20: mol_type = other DNA
aatggtactccctttccact

SEQ ID NO: 49021 - DNA, 20 bp, synthetic construct
  misc_feature 1..20: note = CRISPR gRNA sequence
  source 1..20: mol_type = other DNA
tactccctttccactaagct

SEQ ID NO: 49022 - DNA, 20 bp, synthetic construct
  misc_feature 1..20: note = CRISPR gRNA sequence
  source 1..20: mol_type = other DNA
ctccctttccactaagctga

SEQ ID NO: 49023 - DNA, 20 bp, synthetic construct
  misc_feature 1..20: note = CRISPR gRNA sequence
  source 1..20: mol_type = other DNA
ctttccactaagctgagaga

SEQ ID NO: 49024 - DNA, 20 bp, synthetic construct
  misc_feature 1..20: note = CRISPR gRNA sequence
  source 1..20: mol_type = other DNA
ccactaagctgagagaaagt

SEQ ID NO: 49025 - DNA, 20 bp, synthetic construct
  misc_feature 1..20: note = CRISPR gRNA sequence
  source 1..20: mol_type = other DNA
gctgagagaaagtaagcctg

SEQ ID NO: 49026 - DNA, 20 bp, synthetic construct
  misc_feature 1..20: note = CRISPR gRNA sequence
  source 1..20: mol_type = other DNA
ctgagagaaagtaagcctgc

SEQ ID NO: 49027 - DNA, 20 bp, synthetic construct
  misc_feature 1..20: note = CRISPR gRNA sequence
  source 1..20: mol_type = other DNA
agaaagtaagcctgcaggtg

SEQ ID NO: 49028 - DNA, 20 bp, synthetic construct
  misc_feature 1..20: note = CRISPR gRNA sequence
  source 1..20: mol_type = other DNA
gaaagtaagcctgcaggtgc

SEQ ID NO: 49029 - DNA, 20 bp, synthetic construct
  misc_feature 1..20: note = CRISPR gRNA sequence
  source 1..20: mol_type = other DNA
aaagtaagcctgcaggtgca

SEQ ID NO: 49030 - DNA, 20 bp, synthetic construct
  misc_feature 1..20: note = CRISPR gRNA sequence
  source 1..20: mol_type = other DNA
taagcctgcaggtgcaggga

SEQ ID NO: 49031 - DNA, 20 bp, synthetic construct
  misc_feature 1..20: note = CRISPR gRNA sequence
  source 1..20: mol_type = other DNA
ggtgcagggatggcctgcct

SEQ ID NO: 49032 - DNA, 20 bp, synthetic construct
  misc_feature 1..20: note = CRISPR gRNA sequence
  source 1..20: mol_type = other DNA
gcagggatggcctgcctgag

SEQ ID NO: 49033 - DNA, 20 bp, synthetic construct
  misc_feature 1..20: note = CRISPR gRNA sequence
  source 1..20: mol_type = other DNA
cagggatggcctgcctgaga

SEQ ID NO: 49034 - DNA, 20 bp, synthetic construct
  misc_feature 1..20: note = CRISPR gRNA sequence
  source 1..20: mol_type = other DNA
ggatggcctgcctgagaagg

SEQ ID NO: 49035 - DNA, 20 bp, synthetic construct
  misc_feature 1..20: note = CRISPR gRNA sequence
  source 1..20: mol_type = other DNA
gcctgcctgagaaggaagcc

SEQ ID NO: 49036 - DNA, 20 bp, synthetic construct
  misc_feature 1..20: note = CRISPR gRNA sequence
  source 1..20: mol_type = other DNA
cctgcctgagaaggaagcca

SEQ ID NO: 49037 - DNA, 20 bp, synthetic construct
  misc_feature 1..20: note = CRISPR gRNA sequence
  source 1..20: mol_type = other DNA
gcctgagaaggaagccaagg

SEQ ID NO: 49038 - DNA, 20 bp, synthetic construct
  misc_feature 1..20: note = CRISPR gRNA sequence
  source 1..20: mol_type = other DNA
gagaaggaagccaaggtgga

SEQ ID NO: 49039 - DNA, 20 bp, synthetic construct
  misc_feature 1..20: note = CRISPR gRNA sequence
  source 1..20: mol_type = other DNA
gaaggaagccaaggtggaca

SEQ ID NO: 49040 - DNA, 20 bp, synthetic construct
  misc_feature 1..20: note = CRISPR gRNA sequence
  source 1..20: mol_type = other DNA
gaagccaaggtggacagaga

SEQ ID NO: 49041 - DNA, 20 bp, synthetic construct
  misc_feature 1..20: note = CRISPR gRNA sequence
  source 1..20: mol_type = other DNA
agccaaggtggacagagaaa

SEQ ID NO: 49042 - DNA, 20 bp, synthetic construct
  misc_feature 1..20: note = CRISPR gRNA sequence
  source 1..20: mol_type = other DNA
aaggtggacagagaaagagt

SEQ ID NO: 49043 - DNA, 20 bp, synthetic construct
  misc_feature 1..20: note = CRISPR gRNA sequence
  source 1..20: mol_type = other DNA
aggtggacagagaaagagta

SEQ ID NO: 49044 - DNA, 20 bp, synthetic construct
  misc_feature 1..20: note = CRISPR gRNA sequence
  source 1..20: mol_type = other DNA
ggtggacagagaaagagtaa

SEQ ID NO: 49045 - DNA, 20 bp, synthetic construct
  misc_feature 1..20: note = CRISPR gRNA sequence
  source 1..20: mol_type = other DNA
gacagagaaagagtaagggc

SEQ ID NO: 49046 - DNA, 20 bp, synthetic construct
  misc_feature 1..20: note = CRISPR gRNA sequence
  source 1..20: mol_type = other DNA
cagagaaagagtaagggcca

SEQ ID NO: 49047 - DNA, 20 bp, synthetic construct
  misc_feature 1..20: note = CRISPR gRNA sequence
  source 1..20: mol_type = other DNA
aaagagtaagggccagagtg

SEQ ID NO: 49048 - DNA, 20 bp, synthetic construct
  misc_feature 1..20: note = CRISPR gRNA sequence
  source 1..20: mol_type = other DNA
agggccagagtgaagtgtgt

SEQ ID NO: 49049 - DNA, 20 bp, synthetic construct
  misc_feature 1..20: note = CRISPR gRNA sequence
  source 1..20: mol_type = other DNA
ggccagagtgaagtgtgtga

SEQ ID NO: 49050 - DNA, 20 bp, synthetic construct
  misc_feature 1..20: note = CRISPR gRNA sequence
  source 1..20: mol_type = other DNA
ccagagtgaagtgtgtgaga

SEQ ID NO: 49051 - DNA, 20 bp, synthetic construct
  misc_feature 1..20: note = CRISPR gRNA sequence
  source 1..20: mol_type = other DNA
gagtgaagtgtgtgagagag

SEQ ID NO: 49052 - DNA, 20 bp, synthetic construct
  misc_feature 1..20: note = CRISPR gRNA sequence
  source 1..20: mol_type = other DNA
agagagaagcctgacaaata

SEQ ID NO: 49053 - DNA, 20 bp, synthetic construct
  misc_feature 1..20: note = CRISPR gRNA sequence
  source 1..20: mol_type = other DNA
cctgacaaatatagaacccc

SEQ ID NO: 49054 - DNA, 20 bp, synthetic construct
  misc_feature 1..20: note = CRISPR gRNA sequence
  source 1..20: mol_type = other DNA
aaatatagaacccctggatc

SEQ ID NO: 49055 - DNA, 20 bp, synthetic construct
  misc_feature 1..20: note = CRISPR gRNA sequence
  source 1..20: mol_type = other DNA
cctggatccagctgtgcctg

SEQ ID NO: 49056 - DNA, 20 bp, synthetic construct
  misc_feature 1..20: note = CRISPR gRNA sequence
  source 1..20: mol_type = other DNA
ccagctgtgcctgaagtcat

SEQ ID NO: 49057 - DNA, 20 bp, synthetic construct
  misc_feature 1..20: note = CRISPR gRNA sequence
  source 1..20: mol_type = other DNA
ctcgtaattttccatgacat

SEQ ID NO: 49058 - DNA, 20 bp, synthetic construct
  misc_feature 1..20: note = CRISPR gRNA sequence
  source 1..20: mol_type = other DNA
aagccaatatatttctgtct

SEQ ID NO: 49059 - DNA, 20 bp, synthetic construct
  misc_feature 1..20: note = CRISPR gRNA sequence
  source 1..20: mol_type = other DNA
tttctgtcttggattgcttt

SEQ ID NO: 49060 - DNA, 20 bp, synthetic construct
  misc_feature 1..20: note = CRISPR gRNA sequence
  source 1..20: mol_type = other DNA
gtattctgtttcctatgacc

SEQ ID NO: 49061 - DNA, 20 bp, synthetic construct
  misc_feature 1..20: note = CRISPR gRNA sequence
  source 1..20: mol_type = other DNA
tattctgtttcctatgacca

SEQ ID NO: 49062 - DNA, 20 bp, synthetic construct
  misc_feature 1..20: note = CRISPR gRNA sequence
  source 1..20: mol_type = other DNA
cctatgaccaaggttcttgc

SEQ ID NO: 49063 - DNA, 20 bp, synthetic construct
  misc_feature 1..20: note = CRISPR gRNA sequence
  source 1..20: mol_type = other DNA
ccaaggttcttgctggcact

SEQ ID NO: 49064 - DNA, 20 bp, synthetic construct
  misc_feature 1..20: note = CRISPR gRNA sequence
  source 1..20: mol_type = other DNA
ttcttgctggcactgagatc

SEQ ID NO: 49065 - DNA, 20 bp, synthetic construct
  misc_feature 1..20: note = CRISPR gRNA sequence
  source 1..20: mol_type = other DNA
gctggcactgagatccagaa

SEQ ID NO: 49066 - DNA, 20 bp, synthetic construct
  misc_feature 1..20: note = CRISPR gRNA sequence
  source 1..20: mol_type = other DNA
gcactgagatccagaataga

SEQ ID NO: 49067 - DNA, 20 bp, synthetic construct
  misc_feature 1..20: note = CRISPR gRNA sequence
  source 1..20: mol_type = other DNA
agatccagaatagaaagtaa

SEQ ID NO: 49068 - DNA, 20 bp, synthetic construct
  misc_feature 1..20: note = CRISPR gRNA sequence
  source 1..20: mol_type = other DNA
gatccagaatagaaagtaaa

SEQ ID NO: 49069 - DNA, 20 bp, synthetic construct
  misc_feature 1..20: note = CRISPR gRNA sequence
  source 1..20: mol_type = other DNA
tagaaagtaaaaggtcatgt

SEQ ID NO: 49070 - DNA, 20 bp, synthetic construct
  misc_feature 1..20: note = CRISPR gRNA sequence
  source 1..20: mol_type = other DNA
agaaagtaaaaggtcatgta

SEQ ID NO: 49071 - DNA, 20 bp, synthetic construct
  misc_feature 1..20: note = CRISPR gRNA sequence
  source 1..20: mol_type = other DNA
gaaagtaaaaggtcatgtaa

SEQ ID NO: 49072 - DNA, 20 bp, synthetic construct
  misc_feature 1..20: note = CRISPR gRNA sequence
  source 1..20: mol_type = other DNA
aaaggtcatgtaagggcatt

SEQ ID NO: 49073 - DNA, 20 bp, synthetic construct
  misc_feature 1..20: note = CRISPR gRNA sequence
  source 1..20: mol_type = other DNA
gtaagggcattcagctcacc

SEQ ID NO: 49074 - DNA, 20 bp, synthetic construct
  misc_feature 1..20: note = CRISPR gRNA sequence
  source 1..20: mol_type = other DNA
taagggcattcagctcacct

SEQ ID NO: 49075 - DNA, 20 bp, synthetic construct
  misc_feature 1..20: note = CRISPR gRNA sequence
  source 1..20: mol_type = other DNA
tcagctcacctgggtccatc

SEQ ID NO: 49076 - DNA, 20 bp, synthetic construct
  misc_feature 1..20: note = CRISPR gRNA sequence
  source 1..20: mol_type = other DNA
cctgggtccatccagaaaca

SEQ ID NO: 49077 - DNA, 20 bp, synthetic construct
  misc_feature 1..20: note = CRISPR gRNA sequence
  source 1..20: mol_type = other DNA
gggtccatccagaaacatgg

SEQ ID NO: 49078 - DNA, 20 bp, synthetic construct
  misc_feature 1..20: note = CRISPR gRNA sequence
  source 1..20: mol_type = other DNA
ttgtgttcacaaaacatgca

SEQ ID NO: 49079 - DNA, 20 bp, synthetic construct
  misc_feature 1..20: note = CRISPR gRNA sequence
  source 1..20: mol_type = other DNA
tgtgttcacaaaacatgcaa

SEQ ID NO: 49080 - DNA, 20 bp, synthetic construct
  misc_feature 1..20: note = CRISPR gRNA sequence
  source 1..20: mol_type = other DNA
acaaaacatgcaaaggttcc

SEQ ID NO: 49081 - DNA, 20 bp, synthetic construct
  misc_feature 1..20: note = CRISPR gRNA sequence
  source 1..20: mol_type = other DNA
caaaacatgcaaaggttcct

SEQ ID NO: 49082 - DNA, 20 bp, synthetic construct
  misc_feature 1..20: note = CRISPR gRNA sequence
  source 1..20: mol_type = other DNA
catgctactcactgaccatg

SEQ ID NO: 49083 - DNA, 20 bp, synthetic construct
  misc_feature 1..20: note = CRISPR gRNA sequence
  source 1..20: mol_type = other DNA
ctcactgaccatgcagcact

SEQ ID NO: 49084 - DNA, 20 bp, synthetic construct
  misc_feature 1..20: note = CRISPR gRNA sequence
  source 1..20: mol_type = other DNA
aaccactcccaccactcact

SEQ ID NO: 49085 - DNA, 20 bp, synthetic construct
  misc_feature 1..20: note = CRISPR gRNA sequence
  source 1..20: mol_type = other DNA
accaccatcactacttactc

SEQ ID NO: 49086 - DNA, 20 bp, synthetic construct
  misc_feature 1..20: note = CRISPR gRNA sequence
  source 1..20: mol_type = other DNA
actacttactccagcctctt

SEQ ID NO: 49087 - DNA, 20 bp, synthetic construct
  misc_feature 1..20: note = CRISPR gRNA sequence
  source 1..20: mol_type = other DNA
tttagcatccatttcccctc

SEQ ID NO: 49088 - DNA, 20 bp, synthetic construct
  misc_feature 1..20: note = CRISPR gRNA sequence
  source 1..20: mol_type = other DNA
ttagcatccatttcccctca

SEQ ID NO: 49089 - DNA, 20 bp, synthetic construct
  misc_feature 1..20: note = CRISPR gRNA sequence
  source 1..20: mol_type = other DNA
tagcatccatttcccctcaa

SEQ ID NO: 49090 - DNA, 20 bp, synthetic construct
  misc_feature 1..20: note = CRISPR gRNA sequence
  source 1..20: mol_type = other DNA
ttcccctcaagggccctcat

SEQ ID NO: 49091 - DNA, 20 bp, synthetic construct
  misc_feature 1..20: note = CRISPR gRNA sequence
  source 1..20: mol_type = other DNA
aagggccctcatcagcgcct

SEQ ID NO: 49092 - DNA, 20 bp, synthetic construct
  misc_feature 1..20: note = CRISPR gRNA sequence
  source 1..20: mol_type = other DNA
ctcctcatcaaattgattgt

SEQ ID NO: 49093 - DNA, 20 bp, synthetic construct
  misc_feature 1..20: note = CRISPR gRNA sequence
  source 1..20: mol_type = other DNA
catcaaattgattgttagac

SEQ ID NO: 49094 - DNA, 20 bp, synthetic construct
  misc_feature 1..20: note = CRISPR gRNA sequence
  source 1..20: mol_type = other DNA
attgattgttagacaagctg

SEQ ID NO: 49095 - DNA, 20 bp, synthetic construct
  misc_feature 1..20: note = CRISPR gRNA sequence
  source 1..20: mol_type = other DNA
gattgttagacaagctgcag

SEQ ID NO: 49096 - DNA, 20 bp, synthetic construct
  misc_feature 1..20: note = CRISPR gRNA sequence
  source 1..20: mol_type = other DNA
ttagacaagctgcagaagac

SEQ ID NO: 49097 - DNA, 20 bp, synthetic construct
  misc_feature 1..20: note = CRISPR gRNA sequence
  source 1..20: mol_type = other DNA
tagacaagctgcagaagacc

SEQ ID NO: 49098 - DNA, 20 bp, synthetic construct
  misc_feature 1..20: note = CRISPR gRNA sequence
  source 1..20: mol_type = other DNA
acaagctgcagaagaccagg

SEQ ID NO: 49099 - DNA, 20 bp, synthetic construct
  misc_feature 1..20: note = CRISPR gRNA sequence
  source 1..20: mol_type = other DNA
aagctgcagaagaccaggca

SEQ ID NO: 49100 - DNA, 20 bp, synthetic construct
  misc_feature 1..20: note = CRISPR gRNA sequence
  source 1..20: mol_type = other DNA
agctgcagaagaccaggcag

SEQ ID NO: 49101 - DNA, 20 bp, synthetic construct
  misc_feature 1..20: note = CRISPR gRNA sequence
  source 1..20: mol_type = other DNA
gcagaagaccaggcagaggc

SEQ ID NO: 49102 - DNA, 20 bp, synthetic construct
  misc_feature 1..20: note = CRISPR gRNA sequence
  source 1..20: mol_type = other DNA
cagaagaccaggcagaggca

SEQ ID NO: 49103 - DNA, 20 bp, synthetic construct
  misc_feature 1..20: note = CRISPR gRNA sequence
  source 1..20: mol_type = other DNA
agaagaccaggcagaggcaa

SEQ ID NO: 49104 - DNA, 20 bp, synthetic construct
  misc_feature 1..20: note = CRISPR gRNA sequence
  source 1..20: mol_type = other DNA
gaccaggcagaggcaagggt

SEQ ID NO: 49105 - DNA, 20 bp, synthetic construct
  misc_feature 1..20: note = CRISPR gRNA sequence
  source 1..20: mol_type = other DNA
ggcagaggcaagggttagcg

SEQ ID NO: 49106 - DNA, 20 bp, synthetic construct
  misc_feature 1..20: note = CRISPR gRNA sequence
  source 1..20: mol_type = other DNA
aagggttagcgcagcctgcc

SEQ ID NO: 49107 - DNA, 20 bp, synthetic construct
  misc_feature 1..20: note = CRISPR gRNA sequence
  source 1..20: mol_type = other DNA
tagcgcagcctgcccagccc

SEQ ID NO: 49108 - DNA, 20 bp, synthetic construct
  misc_feature 1..20: note = CRISPR gRNA sequence
  source 1..20: mol_type = other DNA
gcgcagcctgcccagccctg

SEQ ID NO: 49109 - DNA, 20 bp, synthetic construct
  misc_feature 1..20: note = CRISPR gRNA sequence
  source 1..20: mol_type = other DNA
gcctgcccagccctggagct

SEQ ID NO: 49110 - DNA, 20 bp, synthetic construct
  misc_feature 1..20: note = CRISPR gRNA sequence
  source 1..20: mol_type = other DNA
ctggagctgagctgtcctgt

SEQ ID NO: 49111 - DNA, 20 bp, synthetic construct
  misc_feature 1..20: note = CRISPR gRNA sequence
  source 1..20: mol_type = other DNA
ccctctcctgctctgtcccc

SEQ ID NO: 49112 - DNA, 20 bp, synthetic construct
  misc_feature 1..20: note = CRISPR gRNA sequence
  source 1..20: mol_type = other DNA
cctctcctgctctgtcccct

SEQ ID NO: 49113 - DNA, 20 bp, synthetic construct
  misc_feature 1..20: note = CRISPR gRNA sequence
  source 1..20: mol_type = other DNA
tctcctgctctgtcccctgg

SEQ ID NO: 49114 - DNA, 20 bp, synthetic construct
  misc_feature 1..20: note = CRISPR gRNA sequence
  source 1..20: mol_type = other DNA
ctcctgctctgtcccctggg

SEQ ID NO: 49115 - DNA, 20 bp, synthetic construct
  misc_feature 1..20: note = CRISPR gRNA sequence
  source 1..20: mol_type = other DNA
aactctgcatctgcatgccc

SEQ ID NO: 49116 - DNA, 20 bp, synthetic construct
  misc_feature 1..20: note = CRISPR gRNA sequence
  source 1..20: mol_type = other DNA
actctgcatctgcatgccct

SEQ ID NO: 49117 - DNA, 20 bp, synthetic construct
  misc_feature 1..20: note = CRISPR gRNA sequence
  source 1..20: mol_type = other DNA
cctgggccaccctcgctgtc

SEQ ID NO: 49118 - DNA, 20 bp, synthetic construct
  misc_feature 1..20: note = CRISPR gRNA sequence
  source 1..20: mol_type = other DNA
ctgggccaccctcgctgtcc

SEQ ID NO: 49119 - DNA, 20 bp, synthetic construct
  misc_feature 1..20: note = CRISPR gRNA sequence
  source 1..20: mol_type = other DNA
ctcgctgtccaggttcccca

SEQ ID NO: 49120 - DNA, 20 bp, synthetic construct
  misc_feature 1..20: note = CRISPR gRNA sequence
  source 1..20: mol_type = other DNA
tcgctgtccaggttccccat

SEQ ID NO: 49121 - DNA, 20 bp, synthetic construct
  misc_feature 1..20: note = CRISPR gRNA sequence
  source 1..20: mol_type = other DNA
aggttccccatgggtatccc

SEQ ID NO: 49122 - DNA, 20 bp, synthetic construct
  misc_feature 1..20: note = CRISPR gRNA sequence
  source 1..20: mol_type = other DNA
cccatgggtatccctagctc

SEQ ID NO: 49123 - DNA, 20 bp, synthetic construct
  misc_feature 1..20: note = CRISPR gRNA sequence
  source 1..20: mol_type = other DNA
ccatgggtatccctagctcc

SEQ ID NO: 49124 - DNA, 20 bp, synthetic construct
  misc_feature 1..20: note = CRISPR gRNA sequence
  source 1..20: mol_type = other DNA
catgggtatccctagctcca

SEQ ID NO: 49125 - DNA, 20 bp, synthetic construct
  misc_feature 1..20: note = CRISPR gRNA sequence
  source 1..20: mol_type = other DNA
gtatccctagctccagggct

SEQ ID NO: 49126 - DNA, 20 bp, synthetic construct
  misc_feature 1..20: note = CRISPR gRNA sequence
  source 1..20: mol_type = other DNA
tatccctagctccagggctc

SEQ ID NO: 49127 - DNA, 20 bp, synthetic construct
  misc_feature 1..20: note = CRISPR gRNA sequence
  source 1..20: mol_type = other DNA
tagctccagggctcaggctc

SEQ ID NO: 49128 - DNA, 20 bp, synthetic construct
  misc_feature 1..20: note = CRISPR gRNA sequence
  source 1..20: mol_type = other DNA
agctccagggctcaggctct

SEQ ID NO: 49129 - DNA, 20 bp, synthetic construct
  misc_feature 1..20: note = CRISPR gRNA sequence
  source 1..20: mol_type = other DNA
tccagggctcaggctctggg

SEQ ID NO: 49130 - DNA, 20 bp, synthetic construct
  misc_feature 1..20: note = CRISPR gRNA sequence
  source 1..20: mol_type = other DNA
ccagggctcaggctctgggt

SEQ ID NO: 49131 - DNA, 20 bp, synthetic construct
  misc_feature 1..20: note = CRISPR gRNA sequence
  source 1..20: mol_type = other DNA
caggctctgggtaggcatga

SEQ ID NO: 49132 - DNA, 20 bp, synthetic construct
  misc_feature 1..20: note = CRISPR gRNA sequence
  source 1..20: mol_type = other DNA
ctgggtaggcatgatagtca

SEQ ID NO: 49133 - DNA, 20 bp, synthetic construct
  misc_feature 1..20: note = CRISPR gRNA sequence
  source 1..20: mol_type = other DNA
gtaggcatgatagtcacagc

SEQ ID NO: 49134 - DNA, 20 bp, synthetic construct
  misc_feature 1..20: note = CRISPR gRNA sequence
  source 1..20: mol_type = other DNA
catgatagtcacagctggcc

SEQ ID NO: 49135 - DNA, 20 bp, synthetic construct
  misc_feature 1..20: note = CRISPR gRNA sequence
  source 1..20: mol_type = other DNA
tagtcacagctggcccagct

SEQ ID NO: 49136 - DNA, 20 bp, synthetic construct
  misc_feature 1..20: note = CRISPR gRNA sequence
  source 1..20: mol_type = other DNA
ccagctgagaaactatgccc

SEQ ID NO: 49137 - DNA, 20 bp, synthetic construct
  misc_feature 1..20: note = CRISPR gRNA sequence
  source 1..20: mol_type = other DNA
gagaaactatgccctggatg

SEQ ID NO: 49138 - DNA, 20 bp, synthetic construct
  misc_feature 1..20: note = CRISPR gRNA sequence
  source 1..20: mol_type = other DNA
agaaactatgccctggatga

SEQ ID NO: 49139 - DNA, 20 bp, synthetic construct
  misc_feature 1..20: note = CRISPR gRNA sequence
  source 1..20: mol_type = other DNA
tatgccctggatgaaggctg

SEQ ID NO: 49140 - DNA, 20 bp, synthetic construct
  misc_feature 1..20: note = CRISPR gRNA sequence
  source 1..20: mol_type = other DNA
tgccctggatgaaggctgca

SEQ ID NO: 49141 - DNA, 20 bp, synthetic construct
  misc_feature 1..20: note = CRISPR gRNA sequence
  source 1..20: mol_type = other DNA
ccctggatgaaggctgcaga

SEQ ID NO: 49142 - DNA, 20 bp, synthetic construct
  misc_feature 1..20: note = CRISPR gRNA sequence
  source 1..20: mol_type = other DNA
cctggatgaaggctgcagag

SEQ ID NO: 49143 - DNA, 20 bp, synthetic construct
  misc_feature 1..20: note = CRISPR gRNA sequence
  source 1..20: mol_type = other DNA
ggatgaaggctgcagagagg

SEQ ID NO: 49144 - DNA, 20 bp, synthetic construct
  misc_feature 1..20: note = CRISPR gRNA sequence
  source 1..20: mol_type = other DNA
gaaggctgcagagaggaagc

SEQ ID NO: 49145 - DNA, 20 bp, synthetic construct
  misc_feature 1..20: note = CRISPR gRNA sequence
  source 1..20: mol_type = other DNA
aaggctgcagagaggaagct

SEQ ID NO: 49146 - DNA, 20 bp, synthetic construct
  misc_feature 1..20: note = CRISPR gRNA sequence
  source 1..20: mol_type = other DNA
aggctgcagagaggaagctg

SEQ ID NO: 49147 - DNA, 20 bp, synthetic construct
  misc_feature 1..20: note = CRISPR gRNA sequence
  source 1..20: mol_type = other DNA
ggctgcagagaggaagctgg

SEQ ID NO: 49148 - DNA, 20 bp, synthetic construct
  misc_feature 1..20: note = CRISPR gRNA sequence
  source 1..20: mol_type = other DNA
cagagaggaagctgggggac

SEQ ID NO: 49149 - DNA, 20 bp, synthetic construct
  misc_feature 1..20: note = CRISPR gRNA sequence
  source 1..20: mol_type = other DNA
agagaggaagctgggggact

SEQ ID NO: 49150 - DNA, 20 bp, synthetic construct
  misc_feature 1..20: note = CRISPR gRNA sequence
  source 1..20: mol_type = other DNA
gagaggaagctgggggacta

SEQ ID NO: 49151 - DNA, 20 bp, synthetic construct
  misc_feature 1..20: note = CRISPR gRNA sequence
  source 1..20: mol_type = other DNA
acacacaccctcttgttctt

SEQ ID NO: 49152 - DNA, 20 bp, synthetic construct
  misc_feature 1..20: note = CRISPR gRNA sequence
  source 1..20: mol_type = other DNA
ttgttcttcagccctctccg

SEQ ID NO: 49153 - DNA, 20 bp, synthetic construct
  misc_feature 1..20: note = CRISPR gRNA sequence
  source 1..20: mol_type = other DNA
tctccgtagcctgactccca

SEQ ID NO: 49154 - DNA, 20 bp, synthetic construct
  misc_feature 1..20: note = CRISPR gRNA sequence
  source 1..20: mol_type = other DNA
cgtagcctgactcccacagc

SEQ ID NO: 49155 - DNA, 20 bp, synthetic construct
  misc_feature 1..20: note = CRISPR gRNA sequence
  source 1..20: mol_type = other DNA
cctgactcccacagccagcc

SEQ ID NO: 49156 - DNA, 20 bp, synthetic construct
  misc_feature 1..20: note = CRISPR gRNA sequence
  source 1..20: mol_type = other DNA
gactcccacagccagcccag

SEQ ID NO: 49157 - DNA, 20 bp, synthetic construct
  misc_feature 1..20: note = CRISPR gRNA sequence
  source 1..20: mol_type = other DNA
ctcccacagccagcccagca

SEQ ID NO: 49158 - DNA, 20 bp, synthetic construct
  misc_feature 1..20: note = CRISPR gRNA sequence
  source 1..20: mol_type = other DNA
cacagccagcccagcagagc

SEQ ID NO: 49159 - DNA, 20 bp, synthetic construct
  misc_feature 1..20: note = CRISPR gRNA sequence
  source 1..20: mol_type = other DNA
acagccagcccagcagagca

SEQ ID NO: 49160 - DNA, 20 bp, synthetic construct
  misc_feature 1..20: note = CRISPR gRNA sequence
  source 1..20: mol_type = other DNA
cccagcagagcaaggctcat

SEQ ID NO: 49161 - DNA, 20 bp, synthetic construct
  misc_feature 1..20: note = CRISPR gRNA sequence
  source 1..20: mol_type = other DNA
gctcatgagccccattttca

SEQ ID NO: 49162 - DNA, 20 bp, synthetic construct
  misc_feature 1..20: note = CRISPR gRNA sequence
  source 1..20: mol_type = other DNA
tgagccccattttcatagat

SEQ ID NO: 49163 - DNA, 20 bp, synthetic construct
  misc_feature 1..20: note = CRISPR gRNA sequence
  source 1..20: mol_type = other DNA
gagccccattttcatagata

SEQ ID NO: 49164 - DNA, 20 bp, synthetic construct
  misc_feature 1..20: note = CRISPR gRNA sequence
  source 1..20: mol_type = other DNA
tttcatagataaggcaatca

SEQ ID NO: 49165 - DNA, 20 bp, synthetic construct
  misc_feature 1..20: note = CRISPR gRNA sequence
  source 1..20: mol_type = other DNA
tagataaggcaatcaaagcc

SEQ ID NO: 49166 - DNA, 20 bp, synthetic construct
  misc_feature 1..20: note = CRISPR gRNA sequence
  source 1..20: mol_type = other DNA
gataaggcaatcaaagccca

SEQ ID NO: 49167 - DNA, 20 bp, synthetic construct
  misc_feature 1..20: note = CRISPR gRNA sequence
  source 1..20: mol_type = other DNA
aaggcaatcaaagcccagag

SEQ ID NO: 49168 - DNA, 20 bp, synthetic construct
  misc_feature 1..20: note = CRISPR gRNA sequence
  source 1..20: mol_type = other DNA
aatcaaagcccagagtggaa

SEQ ID NO: 49169 - DNA, 20 bp, synthetic construct
  misc_feature 1..20: note = CRISPR gRNA sequence
  source 1..20: mol_type = other DNA
gagtggaacagccatgccca

SEQ ID NO: 49170 - DNA, 20 bp, synthetic construct
  misc_feature 1..20: note = CRISPR gRNA sequence
  source 1..20: mol_type = other DNA
catgcccacagcccctctgt

SEQ ID NO: 49171 - DNA, 20 bp, synthetic construct
  misc_feature 1..20: note = CRISPR gRNA sequence
  source 1..20: mol_type = other DNA
cccacagcccctctgtgagt

SEQ ID NO: 49172 - DNA, 20 bp, synthetic construct
  misc_feature 1..20: note = CRISPR gRNA sequence
  source 1..20: mol_type = other DNA
acagcccctctgtgagtcag

SEQ ID NO: 49173 - DNA, 20 bp, synthetic construct
  misc_feature 1..20: note = CRISPR gRNA sequence
  source 1..20: mol_type = other DNA
tgtgagtcagtggcgaaatt

SEQ ID NO: 49174 - DNA, 20 bp, synthetic construct
  misc_feature 1..20: note = CRISPR gRNA sequence
  source 1..20: mol_type = other DNA
cgaaattcagaccaaaactg

SEQ ID NO: 49175 - DNA, 20 bp, synthetic construct
  misc_feature 1..20: note = CRISPR gRNA sequence
  source 1..20: mol_type = other DNA
ctgtggtgctcttccttccc

SEQ ID NO: 49176 - DNA, 20 bp, synthetic construct
  misc_feature 1..20: note = CRISPR gRNA sequence
  source 1..20: mol_type = other DNA
tgtggtgctcttccttcccc

SEQ ID NO: 49177 - DNA, 20 bp, synthetic construct
  misc_feature 1..20: note = CRISPR gRNA sequence
  source 1..20: mol_type = other DNA
ttccttccccaggccacacc

SEQ ID NO: 49178 - DNA, 20 bp, synthetic construct
  misc_feature 1..20: note = CRISPR gRNA sequence
  source 1..20: mol_type = other DNA
ccagaactgctgcacttcat

SEQ ID NO: 49179 - DNA, 20 bp, synthetic construct
  misc_feature 1..20: note = CRISPR gRNA sequence
  source 1..20: mol_type = other DNA
cagaactgctgcacttcatc

SEQ ID NO: 49180 - DNA, 20 bp, synthetic construct
  misc_feature 1..20: note = CRISPR gRNA sequence
  source 1..20: mol_type = other DNA
agaactgctgcacttcatca

SEQ ID NO: 49181 - DNA, 20 bp, synthetic construct
  misc_feature 1..20: note = CRISPR gRNA sequence
  source 1..20: mol_type = other DNA
gaactgctgcacttcatcag

SEQ ID NO: 49182 - DNA, 20 bp, synthetic construct
  misc_feature 1..20: note = CRISPR gRNA sequence
  source 1..20: mol_type = other DNA
ctgctgcacttcatcagggg

SEQ ID NO: 49183 - DNA, 20 bp, synthetic construct
  misc_feature 1..20: note = CRISPR gRNA sequence
  source 1..20: mol_type = other DNA
tgctgcacttcatcagggga

SEQ ID NO: 49184 - DNA, 20 bp, synthetic construct
  misc_feature 1..20: note = CRISPR gRNA sequence
  source 1..20: mol_type = other DNA
gctgcacttcatcaggggaa

SEQ ID NO: 49185 - DNA, 20 bp, synthetic construct
  misc_feature 1..20: note = CRISPR gRNA sequence
  source 1..20: mol_type = other DNA
ttcatcaggggaagggtcat

SEQ ID NO: 49186 - DNA, 20 bp, synthetic construct
  misc_feature 1..20: note = CRISPR gRNA sequence
  source 1..20: mol_type = other DNA
aggggaagggtcattggttg

SEQ ID NO: 49187 - DNA, 20 bp, synthetic construct
  misc_feature 1..20: note = CRISPR gRNA sequence
  source 1..20: mol_type = other DNA
tcttctccacccctcaccct

SEQ ID NO: 49188 - DNA, 20 bp, synthetic construct
  misc_feature 1..20: note = CRISPR gRNA sequence
  source 1..20: mol_type = other DNA
ctccacccctcaccctcagc

SEQ ID NO: 49189 - DNA, 20 bp, synthetic construct
  misc_feature 1..20: note = CRISPR gRNA sequence
  source 1..20: mol_type = other DNA
tccacccctcaccctcagct

SEQ ID NO: 49190 - DNA, 20 bp, synthetic construct
  misc_feature 1..20: note = CRISPR gRNA sequence
  source 1..20: mol_type = other DNA
ctccactctgcaactcactc

SEQ ID NO: 49191 - DNA, 20 bp, synthetic construct
  misc_feature 1..20: note = CRISPR gRNA sequence
  source 1..20: mol_type = other DNA
caactcactccagctcctcc

SEQ ID NO: 49192 - DNA, 20 bp, synthetic construct
  misc_feature 1..20: note = CRISPR gRNA sequence
  source 1..20: mol_type = other DNA
ctcactccagctcctccaag

SEQ ID NO: 49193 - DNA, 20 bp, synthetic construct
  misc_feature 1..20: note = CRISPR gRNA sequence
  source 1..20: mol_type = other DNA
actccagctcctccaagtgg

SEQ ID NO: 49194 - DNA, 20 bp, synthetic construct
  misc_feature 1..20: note = CRISPR gRNA sequence
  source 1..20: mol_type = other DNA
ccagctcctccaagtggtgg

SEQ ID NO: 49195 - DNA, 20 bp, synthetic construct
  misc_feature 1..20: note = CRISPR gRNA sequence
  source 1..20: mol_type = other DNA
gctcctccaagtggtggcag

SEQ ID NO: 49196 - DNA, 20 bp, synthetic construct
  misc_feature 1..20: note = CRISPR gRNA sequence
  source 1..20: mol_type = other DNA
tccaagtggtggcagtggcc

SEQ ID NO: 49197 - DNA, 20 bp, synthetic construct
  misc_feature 1..20: note = CRISPR gRNA sequence
  source 1..20: mol_type = other DNA
gtggtggcagtggcccagac

SEQ ID NO: 49198 - DNA, 20 bp, synthetic construct
  misc_feature 1..20: note = CRISPR gRNA sequence
  source 1..20: mol_type = other DNA
cagtggcccagaccagatgc

SEQ ID NO: 49199 - DNA, 20 bp, synthetic construct
  misc_feature 1..20: note = CRISPR gRNA sequence
  source 1..20: mol_type = other DNA
agtggcccagaccagatgcc

SEQ ID NO: 49200 - DNA, 20 bp, synthetic construct
  misc_feature 1..20: note = CRISPR gRNA sequence
  source 1..20: mol_type = other DNA
ggcccagaccagatgccagg

SEQ ID NO: 49201 - DNA, 20 bp, synthetic construct
  misc_feature 1..20: note = CRISPR gRNA sequence
  source 1..20: mol_type = other DNA
gcccagaccagatgccaggt

SEQ ID NO: 49202 - DNA, 20 bp, synthetic construct
  misc_feature 1..20: note = CRISPR gRNA sequence
  source 1..20: mol_type = other DNA
agaccagatgccaggtgggc

SEQ ID NO: 49203 - DNA, 20 bp, synthetic construct
  misc_feature 1..20: note = CRISPR gRNA sequence
  source 1..20: mol_type = other DNA
gaccagatgccaggtgggcg

SEQ ID NO: 49204 - DNA, 20 bp, synthetic construct
  misc_feature 1..20: note = CRISPR gRNA sequence
  source 1..20: mol_type = other DNA
tgccaggtgggcgaggccct

SEQ ID NO: 49205 - DNA, 20 bp, synthetic construct
  misc_feature 1..20: note = CRISPR gRNA sequence
  source 1..20: mol_type = other DNA
cgaggccctcggtgctcaca

SEQ ID NO: 49206 - DNA, 20 bp, synthetic construct
  misc_feature 1..20: note = CRISPR gRNA sequence
  source 1..20: mol_type = other DNA
gccctcggtgctcacacagc

SEQ ID NO: 49207 - DNA, 20 bp, synthetic construct
  misc_feature 1..20: note = CRISPR gRNA sequence
  source 1..20: mol_type = other DNA
cctcggtgctcacacagctg

SEQ ID NO: 49208 - DNA, 20 bp, synthetic construct
  misc_feature 1..20: note = CRISPR gRNA sequence
  source 1..20: mol_type = other DNA
ctcggtgctcacacagctgg

SEQ ID NO: 49209 - DNA, 20 bp, synthetic construct
  misc_feature 1..20: note = CRISPR gRNA sequence
  source 1..20: mol_type = other DNA
gtgctcacacagctggaggt

SEQ ID NO: 49210 - DNA, 20 bp, synthetic construct
  misc_feature 1..20: note = CRISPR gRNA sequence
  source 1..20: mol_type = other DNA
cacacagctggaggtcagcc

SEQ ID NO: 49211 - DNA, 20 bp, synthetic construct
  misc_feature 1..20: note = CRISPR gRNA sequence
  source 1..20: mol_type = other DNA
acagctggaggtcagcctgg

SEQ ID NO: 49212 - DNA, 20 bp, synthetic construct
  misc_feature 1..20: note = CRISPR gRNA sequence
  source 1..20: mol_type = other DNA
cagctggaggtcagcctggt

SEQ ID NO: 49213 - DNA, 20 bp, synthetic construct
  misc_feature 1..20: note = CRISPR gRNA sequence
  source 1..20: mol_type = other DNA
agctggaggtcagcctggtg

SEQ ID NO: 49214 - DNA, 20 bp, synthetic construct
  misc_feature 1..20: note = CRISPR gRNA sequence
  source 1..20: mol_type = other DNA
gctggaggtcagcctggtgg

SEQ ID NO: 49215 - DNA, 20 bp, synthetic construct
  misc_feature 1..20: note = CRISPR gRNA sequence
  source 1..20: mol_type = other DNA
ggtcagcctggtgggggtca

SEQ ID NO: 49216 - DNA, 20 bp, synthetic construct
  misc_feature 1..20: note = CRISPR gRNA sequence
  source 1..20: mol_type = other DNA
gtcagcctggtgggggtcaa

SEQ ID NO: 49217 - DNA, 20 bp, synthetic construct
  misc_feature 1..20: note = CRISPR gRNA sequence
  source 1..20: mol_type = other DNA
tcagcctggtgggggtcaaa

SEQ ID NO: 49218 - DNA, 20 bp, synthetic construct
  misc_feature 1..20: note = CRISPR gRNA sequence
  source 1..20: mol_type = other DNA
tggtgggggtcaaagggcaa

SEQ ID NO: 49219 - DNA, 20 bp, synthetic construct
  misc_feature 1..20: note = CRISPR gRNA sequence
  source 1..20: mol_type = other DNA
ggtgggggtcaaagggcaac

SEQ ID NO: 49220 - DNA, 20 bp, synthetic construct
  misc_feature 1..20: note = CRISPR gRNA sequence
  source 1..20: mol_type = other DNA
ggggtcaaagggcaacaggt

SEQ ID NO: 49221 - DNA, 20 bp, synthetic construct
  misc_feature 1..20: note = CRISPR gRNA sequence
  source 1..20: mol_type = other DNA
gggtcaaagggcaacaggtc

SEQ ID NO: 49222 - DNA, 20 bp, synthetic construct
  misc_feature 1..20: note = CRISPR gRNA sequence
  source 1..20: mol_type = other DNA
tcaaagggcaacaggtcagg

SEQ ID NO: 49223 - DNA, 20 bp, synthetic construct
  misc_feature 1..20: note = CRISPR gRNA sequence
  source 1..20: mol_type = other DNA
caaagggcaacaggtcaggc

SEQ ID NO: 49224 - DNA, 20 bp, synthetic construct
  misc_feature 1..20: note = CRISPR gRNA sequence
  source 1..20: mol_type = other DNA
aagggcaacaggtcaggcag

SEQ ID NO: 49225 - DNA, 20 bp, synthetic construct
  misc_feature 1..20: note = CRISPR gRNA sequence
  source 1..20: mol_type = other DNA
aggtcaggcaggagccgccc

SEQ ID NO: 49226 - DNA, 20 bp, synthetic construct
  misc_feature 1..20: note = CRISPR gRNA sequence
  source 1..20: mol_type = other DNA
ggtcaggcaggagccgccct

SEQ ID NO: 49227 - DNA, 20 bp, synthetic construct
  misc_feature 1..20: note = CRISPR gRNA sequence
  source 1..20: mol_type = other DNA
gcaggagccgccctgggtct

SEQ ID NO: 49228 - DNA, 20 bp, synthetic construct
  misc_feature 1..20: note = CRISPR gRNA sequence
  source 1..20: mol_type = other DNA
caggagccgccctgggtctt

SEQ ID NO: 49229 - DNA, 20 bp, synthetic construct
  misc_feature 1..20: note = CRISPR gRNA sequence
  source 1..20: mol_type = other DNA
ggagccgccctgggtcttgg

SEQ ID NO: 49230 - DNA, 20 bp, synthetic construct
  misc_feature 1..20: note = CRISPR gRNA sequence
  source 1..20: mol_type = other DNA
gtcttgggagctctgaatgc

SEQ ID NO: 49231 - DNA, 20 bp, synthetic construct
  misc_feature 1..20: note = CRISPR gRNA sequence
  source 1..20: mol_type = other DNA
ttgggagctctgaatgctgg

SEQ ID NO: 49232 - DNA, 20 bp, synthetic construct
  misc_feature 1..20: note = CRISPR gRNA sequence
  source 1..20: mol_type = other DNA
ggagctctgaatgctggtgg

SEQ ID NO: 49233 - DNA, 20 bp, synthetic construct
  misc_feature 1..20: note = CRISPR gRNA sequence
  source 1..20: mol_type = other DNA
agctctgaatgctggtggca

SEQ ID NO: 49234 - DNA, 20 bp, synthetic construct
  misc_feature 1..20: note = CRISPR gRNA sequence
  source 1..20: mol_type = other DNA
gctctgaatgctggtggcag

SEQ ID NO: 49235 - DNA, 20 bp, synthetic construct
  misc_feature 1..20: note = CRISPR gRNA sequence
  source 1..20: mol_type = other DNA
ctctgaatgctggtggcaga

SEQ ID NO: 49236 - DNA, 20 bp, synthetic construct
  misc_feature 1..20: note = CRISPR gRNA sequence
  source 1..20: mol_type = other DNA
gaatgctggtggcagagggc

SEQ ID NO: 49237 - DNA, 20 bp, synthetic construct
  misc_feature 1..20: note = CRISPR gRNA sequence
  source 1..20: mol_type = other DNA
aatgctggtggcagagggca

SEQ ID NO: 49238 - DNA, 20 bp, synthetic construct
  misc_feature 1..20: note = CRISPR gRNA sequence
  source 1..20: mol_type = other DNA
ggtggcagagggcaaggatg

SEQ ID NO: 49239 - DNA, 20 bp, synthetic construct
  misc_feature 1..20: note = CRISPR gRNA sequence
  source 1..20: mol_type = other DNA
gtggcagagggcaaggatgt

SEQ ID NO: 49240 - DNA, 20 bp, synthetic construct
  misc_feature 1..20: note = CRISPR gRNA sequence
  source 1..20: mol_type = other DNA
tggcagagggcaaggatgtg

SEQ ID NO: 49241 - DNA, 20 bp, synthetic construct
  misc_feature 1..20: note = CRISPR gRNA sequence
  source 1..20: mol_type = other DNA
cagagggcaaggatgtgggg

SEQ ID NO: 49242 - DNA, 20 bp, synthetic construct
  misc_feature 1..20: note = CRISPR gRNA sequence
  source 1..20: mol_type = other DNA
agagggcaaggatgtggggt

SEQ ID NO: 49243 - DNA, 20 bp, synthetic construct
  misc_feature 1..20: note = CRISPR gRNA sequence
  source 1..20: mol_type = other DNA
gagggcaaggatgtggggta

SEQ ID NO: 49244 - DNA, 20 bp, synthetic construct
  misc_feature 1..20: note = CRISPR gRNA sequence
  source 1..20: mol_type = other DNA
aaggatgtggggtagggatg

SEQ ID NO: 49245 - DNA, 20 bp, synthetic construct
  misc_feature 1..20: note = CRISPR gRNA sequence
  source 1..20: mol_type = other DNA
gatgtggggtagggatgtgg

SEQ ID NO: 49246 - DNA, 20 bp, synthetic construct
  misc_feature 1..20: note = CRISPR gRNA sequence
  source 1..20: mol_type = other DNA
atgtggggtagggatgtggc

SEQ ID NO: 49247 - DNA, 20 bp, synthetic construct
  misc_feature 1..20: note = CRISPR gRNA sequence
  source 1..20: mol_type = other DNA
agggatgtggcgggcaatgt

SEQ ID NO: 49248 - DNA, 20 bp, synthetic construct
  misc_feature 1..20: note = CRISPR gRNA sequence
  source 1..20: mol_type = other DNA
gggatgtggcgggcaatgtg

SEQ ID NO: 49249 - DNA, 20 bp, synthetic construct
  misc_feature 1..20: note = CRISPR gRNA sequence
  source 1..20: mol_type = other DNA
gatgtggcgggcaatgtgag

SEQ ID NO: 49250 - DNA, 20 bp, synthetic construct
  misc_feature 1..20: note = CRISPR gRNA sequence
  source 1..20: mol_type = other DNA
tcttccaccatgaactcatt

SEQ ID NO: 49251 - DNA, 20 bp, synthetic construct
  misc_feature 1..20: note = CRISPR gRNA sequence
  source 1..20: mol_type = other DNA
atgaactcattaagccacca

SEQ ID NO: 49252 - DNA, 20 bp, synthetic construct
  misc_feature 1..20: note = CRISPR gRNA sequence
  source 1..20: mol_type = other DNA
gaactcattaagccaccaca

SEQ ID NO: 49253 - DNA, 20 bp, synthetic construct
  misc_feature 1..20: note = CRISPR gRNA sequence
  source 1..20: mol_type = other DNA
cattaagccaccacagagct

SEQ ID NO: 49254 - DNA, 20 bp, synthetic construct
  misc_feature 1..20: note = CRISPR gRNA sequence
  source 1..20: mol_type = other DNA
taagccaccacagagcttgg

SEQ ID NO: 49255 - DNA, 20 bp, synthetic construct
  misc_feature 1..20: note = CRISPR gRNA sequence
  source 1..20: mol_type = other DNA
gccaccacagagcttggaag

SEQ ID NO: 49256 - DNA, 20 bp, synthetic construct
  misc_feature 1..20: note = CRISPR gRNA sequence
  source 1..20: mol_type = other DNA
accacagagcttggaagcag

SEQ ID NO: 49257 - DNA, 20 bp, synthetic construct
  misc_feature 1..20: note = CRISPR gRNA sequence
  source 1..20: mol_type = other DNA
agagcttggaagcagaagca

SEQ ID NO: 49258 - DNA, 20 bp, synthetic construct
  misc_feature 1..20: note = CRISPR gRNA sequence
  source 1..20: mol_type = other DNA
ttggaagcagaagcatggac

SEQ ID NO: 49259 - DNA, 20 bp, synthetic construct
  misc_feature 1..20: note = CRISPR gRNA sequence
  source 1..20: mol_type = other DNA
agcagaagcatggactagtt

SEQ ID NO: 49260 - DNA, 20 bp, synthetic construct
  misc_feature 1..20: note = CRISPR gRNA sequence
  source 1..20: mol_type = other DNA
gttcagtatttcctaaaccg

SEQ ID NO: 49261 - DNA, 20 bp, synthetic construct
  misc_feature 1..20: note = CRISPR gRNA sequence
  source 1..20: mol_type = other DNA
tttcctaaaccgcagtcatt

SEQ ID NO: 49262 - DNA, 20 bp, synthetic construct
  misc_feature 1..20: note = CRISPR gRNA sequence
  source 1..20: mol_type = other DNA
ttcctaaaccgcagtcattc

SEQ ID NO: 49263 - DNA, 20 bp, synthetic construct
  misc_feature 1..20: note = CRISPR gRNA sequence
  source 1..20: mol_type = other DNA
ctaaaccgcagtcattcagg

SEQ ID NO: 49264 - DNA, 20 bp, synthetic construct
  misc_feature 1..20: note = CRISPR gRNA sequence
  source 1..20: mol_type = other DNA
aggtagcaacttcacaactt

SEQ ID NO: 49265 - DNA, 20 bp, synthetic construct
  misc_feature 1..20: note = CRISPR gRNA sequence
  source 1..20: mol_type = other DNA
agcaacttcacaacttaagc

SEQ ID NO: 49266 - DNA, 20 bp, synthetic construct
  misc_feature 1..20: note = CRISPR gRNA sequence
  source 1..20: mol_type = other DNA
gcaacttcacaacttaagcc

SEQ ID NO: 49267 - DNA, 20 bp, synthetic construct
  misc_feature 1..20: note = CRISPR gRNA sequence
  source 1..20: mol_type = other DNA
ttcacaacttaagccaggat

SEQ ID NO: 49268 - DNA, 20 bp, synthetic construct
  misc_feature 1..20: note = CRISPR gRNA sequence
  source 1..20: mol_type = other DNA
tcacaacttaagccaggatt

SEQ ID NO: 49269 - DNA, 20 bp, synthetic construct
  misc_feature 1..20: note = CRISPR gRNA sequence
  source 1..20: mol_type = other DNA
gccaggattaggtatcactg

SEQ ID NO: 49270 - DNA, 20 bp, synthetic construct
  misc_feature 1..20: note = CRISPR gRNA sequence
  source 1..20: mol_type = other DNA
gattaggtatcactgtagtt

SEQ ID NO: 49271 - DNA, 20 bp, synthetic construct
  misc_feature 1..20: note = CRISPR gRNA sequence
  source 1..20: mol_type = other DNA
aggtatcactgtagtttagc

SEQ ID NO: 49272 - DNA, 20 bp, synthetic construct
  misc_feature 1..20: note = CRISPR gRNA sequence
  source 1..20: mol_type = other DNA
ttacaaactctgcatcttta

SEQ ID NO: 49273 - DNA, 20 bp, synthetic construct
  misc_feature 1..20: note = CRISPR gRNA sequence
  source 1..20: mol_type = other DNA
catctttaaagcaaatactg

SEQ ID NO: 49274 - DNA, 20 bp, synthetic construct
  misc_feature 1..20: note = CRISPR gRNA sequence
  source 1..20: mol_type = other DNA
ctttaaagcaaatactgaag

SEQ ID NO: 49275 - DNA, 20 bp, synthetic construct
  misc_feature 1..20: note = CRISPR gRNA sequence
  source 1..20: mol_type = other DNA
caaatactgaagaagtgtca

SEQ ID NO: 49276 - DNA, 20 bp, synthetic construct
  misc_feature 1..20: note = CRISPR gRNA sequence
  source 1..20: mol_type = other DNA
tcaaagatctctctgtccta

SEQ ID NO: 49277 - DNA, 20 bp, synthetic construct
  misc_feature 1..20: note = CRISPR gRNA sequence
  source 1..20: mol_type = other DNA
aaagatctctctgtcctaaa

SEQ ID NO: 49278 - DNA, 20 bp, synthetic construct
  misc_feature 1..20: note = CRISPR gRNA sequence
  source 1..20: mol_type = other DNA
ttttatttatttattttttg

SEQ ID NO: 49279 - DNA, 20 bp, synthetic construct
  misc_feature 1..20: note = CRISPR gRNA sequence
  source 1..20: mol_type = other DNA
ttatttatttattttttgta

SEQ ID NO: 49280 - DNA, 20 bp, synthetic construct
  misc_feature 1..20: note = CRISPR gRNA sequence
  source 1..20: mol_type = other DNA
ttatttattttttgtagaga

SEQ ID NO: 49281 - DNA, 20 bp, synthetic construct
  misc_feature 1..20: note = CRISPR gRNA sequence
  source 1..20: mol_type = other DNA
tatttattttttgtagagat

SEQ ID NO: 49282 - DNA, 20 bp, synthetic construct
  misc_feature 1..20: note = CRISPR gRNA sequence
  source 1..20: mol_type = other DNA
atttattttttgtagagatg

SEQ ID NO: 49283 - DNA, 20 bp, synthetic construct
  misc_feature 1..20: note = CRISPR gRNA sequence
  source 1..20: mol_type = other DNA
tttattttttgtagagatgg

SEQ ID NO: 49284 - DNA, 20 bp, synthetic construct
  misc_feature 1..20: note = CRISPR gRNA sequence
  source 1..20: mol_type = other DNA
attttttgtagagatggggg

SEQ ID NO: 49285 - DNA, 20 bp, synthetic construct
  misc_feature 1..20: note = CRISPR gRNA sequence
  source 1..20: mol_type = other DNA
ggtggtctcgctatgttgct

SEQ ID NO: 49286 - DNA, 20 bp, synthetic construct
  misc_feature 1..20: note = CRISPR gRNA sequence
  source 1..20: mol_type = other DNA
gtggtctcgctatgttgctc

SEQ ID NO: 49287 - DNA, 20 bp, synthetic construct
  misc_feature 1..20: note = CRISPR gRNA sequence
  source 1..20: mol_type = other DNA
tctcgctatgttgctcaggc

SEQ ID NO: 49288 - DNA, 20 bp, synthetic construct
  misc_feature 1..20: note = CRISPR gRNA sequence
  source 1..20: mol_type = other DNA
tcaggctggtgtcgaactcc

SEQ ID NO: 49289 - DNA, 20 bp, synthetic construct
  misc_feature 1..20: note = CRISPR gRNA sequence
  source 1..20: mol_type = other DNA
caggctggtgtcgaactccc

SEQ ID NO: 49290 - DNA, 20 bp, synthetic construct
  misc_feature 1..20: note = CRISPR gRNA sequence
  source 1..20: mol_type = other DNA
ggtgtcgaactcccgggctc

SEQ ID NO: 49291 - DNA, 20 bp, synthetic construct
  misc_feature 1..20: note = CRISPR gRNA sequence
  source 1..20: mol_type = other DNA
ctcaagcgatttttcctcct

SEQ ID NO: 49292 - DNA, 20 bp, synthetic construct
  misc_feature 1..20: note = CRISPR gRNA sequence
  source 1..20: mol_type = other DNA
atttttcctcctcggcctcc

SEQ ID NO: 49293 - DNA, 20 bp, synthetic construct
  misc_feature 1..20: note = CRISPR gRNA sequence
  source 1..20: mol_type = other DNA
ttttcctcctcggcctccca

SEQ ID NO: 49294 - DNA, 20 bp, synthetic construct
  misc_feature 1..20: note = CRISPR gRNA sequence
  source 1..20: mol_type = other DNA
tcctcggcctcccagagtgc

SEQ ID NO: 49295 - DNA, 20 bp, synthetic construct
  misc_feature 1..20: note = CRISPR gRNA sequence
  source 1..20: mol_type = other DNA
cctcggcctcccagagtgct

SEQ ID NO: 49296 - DNA, 20 bp, synthetic construct
  misc_feature 1..20: note = CRISPR gRNA sequence
  source 1..20: mol_type = other DNA
tcccagagtgctgggattac

SEQ ID NO: 49297 - DNA, 20 bp, synthetic construct
  misc_feature 1..20: note = CRISPR gRNA sequence
  source 1..20: mol_type = other DNA
agtgctgggattacaagctt

SEQ ID NO: 49298 - DNA, 20 bp, synthetic construct
  misc_feature 1..20: note = CRISPR gRNA sequence
  source 1..20: mol_type = other DNA
caagcttgagccactgttcc

SEQ ID NO: 49299 - DNA, 20 bp, synthetic construct
  misc_feature 1..20: note = CRISPR gRNA sequence
  source 1..20: mol_type = other DNA
tgagccactgttcccagccc

SEQ ID NO: 49300 - DNA, 20 bp, synthetic construct
  misc_feature 1..20: note = CRISPR gRNA sequence
  source 1..20: mol_type = other DNA
agccactgttcccagcccaa

SEQ ID NO: 49301 - DNA, 20 bp, synthetic construct
  misc_feature 1..20: note = CRISPR gRNA sequence
  source 1..20: mol_type = other DNA
ccagcccaagagtttcttct

SEQ ID NO: 49302 - DNA, 20 bp, synthetic construct
  misc_feature 1..20: note = CRISPR gRNA sequence
  source 1..20: mol_type = other DNA
gagtttcttcttggtgtaat

SEQ ID NO: 49303 - DNA, 20 bp, synthetic construct
  misc_feature 1..20: note = CRISPR gRNA sequence
  source 1..20: mol_type = other DNA
ttcttcttggtgtaatcagt

SEQ ID NO: 49304 - DNA, 20 bp, synthetic construct
  misc_feature 1..20: note = CRISPR gRNA sequence
  source 1..20: mol_type = other DNA
tcttggtgtaatcagttaga

SEQ ID NO: 49305 - DNA, 20 bp, synthetic construct
  misc_feature 1..20: note = CRISPR gRNA sequence
  source 1..20: mol_type = other DNA
ttagatggaaataaaatgta

SEQ ID NO: 49306 - DNA, 20 bp, synthetic construct
  misc_feature 1..20: note = CRISPR gRNA sequence
  source 1..20: mol_type = other DNA
atggaaataaaatgtaaagt

SEQ ID NO: 49307 - DNA, 20 bp, synthetic construct
  misc_feature 1..20: note = CRISPR gRNA sequence
  source 1..20: mol_type = other DNA
tggaaataaaatgtaaagtt

SEQ ID NO: 49308 - DNA, 20 bp, synthetic construct
  misc_feature 1..20: note = CRISPR gRNA sequence
  source 1..20: mol_type = other DNA
aataaaatgtaaagttagga

SEQ ID NO: 49309 - DNA, 20 bp, synthetic construct
  misc_feature 1..20: note = CRISPR gRNA sequence
  source 1..20: mol_type = other DNA
tcatgctgattcatcgattt

SEQ ID NO: 49310 - DNA, 20 bp, synthetic construct
  misc_feature 1..20: note = CRISPR gRNA sequence
  source 1..20: mol_type = other DNA
gctgattcatcgatttaagt

SEQ ID NO: 49311 - DNA, 20 bp, synthetic construct
  misc_feature 1..20: note = CRISPR gRNA sequence
  source 1..20: mol_type = other DNA
atttaagtaagatttattaa

SEQ ID NO: 49312 - DNA, 20 bp, synthetic construct
  misc_feature 1..20: note = CRISPR gRNA sequence
  source 1..20: mol_type = other DNA
ggctgctaaaatttgccaat

SEQ ID NO: 49313 - DNA, 20 bp, synthetic construct
  misc_feature 1..20: note = CRISPR gRNA sequence
  source 1..20: mol_type = other DNA
ctgctaaaatttgccaatga

SEQ ID NO: 49314 - DNA, 20 bp, synthetic construct
  misc_feature 1..20: note = CRISPR gRNA sequence
  source 1..20: mol_type = other DNA
aaatttgccaatgagagttt

SEQ ID NO: 49315 - DNA, 20 bp, synthetic construct
  misc_feature 1..20: note = CRISPR gRNA sequence
  source 1..20: mol_type = other DNA
aatttgccaatgagagtttg

SEQ ID NO: 49316 - DNA, 20 bp, synthetic construct
  misc_feature 1..20: note = CRISPR gRNA sequence
  source 1..20: mol_type = other DNA
ttgccaatgagagtttgagg

SEQ ID NO: 49317 - DNA, 20 bp, synthetic construct
  misc_feature 1..20: note = CRISPR gRNA sequence
  source 1..20: mol_type = other DNA
agacttaatacataatctta

SEQ ID NO: 49318 - DNA, 20 bp, synthetic construct
  misc_feature 1..20: note = CRISPR gRNA sequence
  source 1..20: mol_type = other DNA
cataatctatgttgattaca

SEQ ID NO: 49319 - DNA, 20 bp, synthetic construct
  misc_feature 1..20: note = CRISPR gRNA sequence
  source 1..20: mol_type = other DNA
ataatctatgttgattacaa

SEQ ID NO: 49320 - DNA, 20 bp, synthetic construct
  misc_feature 1..20: note = CRISPR gRNA sequence
  source 1..20: mol_type = other DNA
taatctatgttgattacaaa

SEQ ID NO: 49321 - DNA, 20 bp, synthetic construct
  misc_feature 1..20: note = CRISPR gRNA sequence
  source 1..20: mol_type = other DNA
ctatgttgattacaaaggga

SEQ ID NO: 49322 - DNA, 20 bp, synthetic construct
  misc_feature 1..20: note = CRISPR gRNA sequence
  source 1..20: mol_type = other DNA
gttgattacaaagggaaagt

SEQ ID NO: 49323 - DNA, 20 bp, synthetic construct
  misc_feature 1..20: note = CRISPR gRNA sequence
  source 1..20: mol_type = other DNA
gggaaagttagtaaatttgc

SEQ ID NO: 49324 - DNA, 20 bp, synthetic construct
  misc_feature 1..20: note = CRISPR gRNA sequence
  source 1..20: mol_type = other DNA
aaagttagtaaatttgcaag

SEQ ID NO: 49325 - DNA, 20 bp, synthetic construct
  misc_feature 1..20: note = CRISPR gRNA sequence
  source 1..20: mol_type = other DNA
agttagtaaatttgcaagtg

SEQ ID NO: 49326 - DNA, 20 bp, synthetic construct
  misc_feature 1..20: note = CRISPR gRNA sequence
  source 1..20: mol_type = other DNA
ttagtaaatttgcaagtgga

SEQ ID NO: 49327 - DNA, 20 bp, synthetic construct
  misc_feature 1..20: note = CRISPR gRNA sequence
  source 1..20: mol_type = other DNA
aatttgcaagtggagagacc

SEQ ID NO: 49328 - DNA, 20 bp, synthetic construct
  misc_feature 1..20: note = CRISPR gRNA sequence
  source 1..20: mol_type = other DNA
ttgcaagtggagagacctgg

SEQ ID NO: 49329 - DNA, 20 bp, synthetic construct
  misc_feature 1..20: note = CRISPR gRNA sequence
  source 1..20: mol_type = other DNA
cctggcagacaccactgtca

SEQ ID NO: 49330 - DNA, 20 bp, synthetic construct
  misc_feature 1..20: note = CRISPR gRNA sequence
  source 1..20: mol_type = other DNA
ctggcagacaccactgtcac

SEQ ID NO: 49331 - DNA, 20 bp, synthetic construct
  misc_feature 1..20: note = CRISPR gRNA sequence
  source 1..20: mol_type = other DNA
accactgtcacaggtgatca

SEQ ID NO: 49332 - DNA, 20 bp, synthetic construct
  misc_feature 1..20: note = CRISPR gRNA sequence
  source 1..20: mol_type = other DNA
gtgatcacagttaacatcac

SEQ ID NO: 49333 - DNA, 20 bp, synthetic construct
  misc_feature 1..20: note = CRISPR gRNA sequence
  source 1..20: mol_type = other DNA
acagttaacatcactagccc

SEQ ID NO: 49334 - DNA, 20 bp, synthetic construct
  misc_feature 1..20: note = CRISPR gRNA sequence
  source 1..20: mol_type = other DNA
cagttaacatcactagcccg

SEQ ID NO: 49335 - DNA, 20 bp, synthetic construct
  misc_feature 1..20: note = CRISPR gRNA sequence
  source 1..20: mol_type = other DNA
tgacacatcatgtgccccga

SEQ ID NO: 49336 - DNA, 20 bp, synthetic construct
  misc_feature 1..20: note = CRISPR gRNA sequence
  source 1..20: mol_type = other DNA
cacatcatgtgccccgatgg

SEQ ID NO: 49337 - DNA, 20 bp, synthetic construct
  misc_feature 1..20: note = CRISPR gRNA sequence
  source 1..20: mol_type = other DNA
acatcatgtgccccgatgga

SEQ ID NO: 49338 - DNA, 20 bp, synthetic construct
  misc_feature 1..20: note = CRISPR gRNA sequence
  source 1..20: mol_type = other DNA
cgatggaaggcacgataaca

SEQ ID NO: 49339 - DNA, 20 bp, synthetic construct
  misc_feature 1..20: note = CRISPR gRNA sequence
  source 1..20: mol_type = other DNA
ctgtgtgatattcctgccca

SEQ ID NO: 49340 - DNA, 20 bp, synthetic construct
  misc_feature 1..20: note = CRISPR gRNA sequence
  source 1..20: mol_type = other DNA
tgtgtgatattcctgcccaa

SEQ ID NO: 49341 - DNA, 20 bp, synthetic construct
  misc_feature 1..20: note = CRISPR gRNA sequence
  source 1..20: mol_type = other DNA
gtgtgatattcctgcccaaa

SEQ ID NO: 49342 - DNA, 20 bp, synthetic construct
  misc_feature 1..20: note = CRISPR gRNA sequence
  source 1..20: mol_type = other DNA
tgatattcctgcccaaaggg

SEQ ID NO: 49343 - DNA, 20 bp, synthetic construct
  misc_feature 1..20: note = CRISPR gRNA sequence
  source 1..20: mol_type = other DNA
cagactctaactctaaacat

SEQ ID NO: 49344 - DNA, 20 bp, synthetic construct
  misc_feature 1..20: note = CRISPR gRNA sequence
  source 1..20: mol_type = other DNA
agactctaactctaaacatg

SEQ ID NO: 49345 - DNA, 20 bp, synthetic construct
  misc_feature 1..20: note = CRISPR gRNA sequence
  source 1..20: mol_type = other DNA
ctctaaacatgaggaaacat

SEQ ID NO: 49346 - DNA, 20 bp, synthetic construct
  misc_feature 1..20: note = CRISPR gRNA sequence
  source 1..20: mol_type = other DNA
aggaaacattggacaaaccc

SEQ ID NO: 49347 - DNA, 20 bp, synthetic construct
  misc_feature 1..20: note = CRISPR gRNA sequence
  source 1..20: mol_type = other DNA
aaacattggacaaacccaag

SEQ ID NO: 49348 - DNA, 20 bp, synthetic construct
  misc_feature 1..20: note = CRISPR gRNA sequence
  source 1..20: mol_type = other DNA
cattggacaaacccaagtgg

SEQ ID NO: 49349 - DNA, 20 bp, synthetic construct
  misc_feature 1..20: note = CRISPR gRNA sequence
  source 1..20: mol_type = other DNA
attggacaaacccaagtgga

SEQ ID NO: 49350 - DNA, 20 bp, synthetic construct
  misc_feature 1..20: note = CRISPR gRNA sequence
  source 1..20: mol_type = other DNA
aggacattctataaaataac

SEQ ID NO: 49351 - DNA, 20 bp, synthetic construct
  misc_feature 1..20: note = CRISPR gRNA sequence
  source 1..20: mol_type = other DNA
aataactggcctgtaaatgt

SEQ ID NO: 49352 - DNA, 20 bp, synthetic construct
  misc_feature 1..20: note = CRISPR gRNA sequence
  source 1..20: mol_type = other DNA
taactggcctgtaaatgtca

SEQ ID NO: 49353 - DNA, 20 bp, synthetic construct
  misc_feature 1..20: note = CRISPR gRNA sequence
  source 1..20: mol_type = other DNA
tgtcagagacaatgctatga

SEQ ID NO: 49354 - DNA, 20 bp, synthetic construct
  misc_feature 1..20: note = CRISPR gRNA sequence
  source 1..20: mol_type = other DNA
agacaatgctatgaaagaca

SEQ ID NO: 49355 - DNA, 20 bp, synthetic construct
  misc_feature 1..20: note = CRISPR gRNA sequence
  source 1..20: mol_type = other DNA
caatgctatgaaagacaaag

SEQ ID NO: 49356 - DNA, 20 bp, synthetic construct
  misc_feature 1..20: note = CRISPR gRNA sequence
  source 1..20: mol_type = other DNA
aatgctatgaaagacaaaga

SEQ ID NO: 49357 - DNA, 20 bp, synthetic construct
  misc_feature 1..20: note = CRISPR gRNA sequence
  source 1..20: mol_type = other DNA
atgctatgaaagacaaagaa

SEQ ID NO: 49358 - DNA, 20 bp, synthetic construct
  misc_feature 1..20: note = CRISPR gRNA sequence
  source 1..20: mol_type = other DNA
atgaaagacaaagaagggcc

SEQ ID NO: 49359 - DNA, 20 bp, synthetic construct
  misc_feature 1..20: note = CRISPR gRNA sequence
  source 1..20: mol_type = other DNA
tgaaagacaaagaagggcca

SEQ ID NO: 49360 - DNA, 20 bp, synthetic construct
  misc_feature 1..20: note = CRISPR gRNA sequence
  source 1..20: mol_type = other DNA
gaagggccaaggacgtgttc

SEQ ID NO: 49361 - DNA, 20 bp, synthetic construct
  misc_feature 1..20: note = CRISPR gRNA sequence
  source 1..20: mol_type = other DNA
caaggacgtgttccagattg

SEQ ID NO: 49362 - DNA, 20 bp, synthetic construct
  misc_feature 1..20: note = CRISPR gRNA sequence
  source 1..20: mol_type = other DNA
aaggacgtgttccagattga

SEQ ID NO: 49363 - DNA, 20 bp, synthetic construct
  misc_feature 1..20: note = CRISPR gRNA sequence
  source 1..20: mol_type = other DNA
ggacgtgttccagattgaag

SEQ ID NO: 49364 - DNA, 20 bp, synthetic construct
  misc_feature 1..20: note = CRISPR gRNA sequence
  source 1..20: mol_type = other DNA
ccagattgaaggagacacta

SEQ ID NO: 49365 - DNA, 20 bp, synthetic construct
  misc_feature 1..20: note = CRISPR gRNA sequence
  source 1..20: mol_type = other DNA
agattgaaggagacactaaa

SEQ ID NO: 49366 - DNA, 20 bp, synthetic construct
  misc_feature 1..20: note = CRISPR gRNA sequence
  source 1..20: mol_type = other DNA
ctaaagagatgacactaaat

SEQ ID NO: 49367 - DNA, 20 bp, synthetic construct
  misc_feature 1..20: note = CRISPR gRNA sequence
  source 1..20: mol_type = other DNA
ctaaatgagacgtgtgatcc

SEQ ID NO: 49368 - DNA, 20 bp, synthetic construct
  misc_feature 1..20: note = CRISPR gRNA sequence
  source 1..20: mol_type = other DNA
tgagacgtgtgatcctggat

SEQ ID NO: 49369 - DNA, 20 bp, synthetic construct
  misc_feature 1..20: note = CRISPR gRNA sequence
  source 1..20: mol_type = other DNA
tcctggattggatccacaac

SEQ ID NO: 49370 - DNA, 20 bp, synthetic construct
  misc_feature 1..20: note = CRISPR gRNA sequence
  source 1..20: mol_type = other DNA
cctggattggatccacaact

SEQ ID NO: 49371 - DNA, 20 bp, synthetic construct
  misc_feature 1..20: note = CRISPR gRNA sequence
  source 1..20: mol_type = other DNA
aactgggaaaaaaatgcaat

SEQ ID NO: 49372 - DNA, 20 bp, synthetic construct
  misc_feature 1..20: note = CRISPR gRNA sequence
  source 1..20: mol_type = other DNA
aatgcaataagcaacattat

SEQ ID NO: 49373 - DNA, 20 bp, synthetic construct
  misc_feature 1..20: note = CRISPR gRNA sequence
  source 1..20: mol_type = other DNA
atgcaataagcaacattatt

SEQ ID NO: 49374 - DNA, 20 bp, synthetic construct
  misc_feature 1..20: note = CRISPR gRNA sequence
  source 1..20: mol_type = other DNA
gcaataagcaacattattgg

SEQ ID NO: 49375 - DNA, 20 bp, synthetic construct
  misc_feature 1..20: note = CRISPR gRNA sequence
  source 1..20: mol_type = other DNA
agcaacattattgggagaac

SEQ ID NO: 49376 - DNA, 20 bp, synthetic construct
  misc_feature 1..20: note = CRISPR gRNA sequence
  source 1..20: mol_type = other DNA
acattattgggagaactggt

SEQ ID NO: 49377 - DNA, 20 bp, synthetic construct
  misc_feature 1..20: note = CRISPR gRNA sequence
  source 1..20: mol_type = other DNA
attgggagaactggtgagat

SEQ ID NO: 49378 - DNA, 20 bp, synthetic construct
  misc_feature 1..20: note = CRISPR gRNA sequence
  source 1..20: mol_type = other DNA
tgggagaactggtgagattg

SEQ ID NO: 49379 - DNA, 20 bp, synthetic construct
  misc_feature 1..20: note = CRISPR gRNA sequence
  source 1..20: mol_type = other DNA
tgagattggagtataaactg

SEQ ID NO: 49380 - DNA, 20 bp, synthetic construct
  misc_feature 1..20: note = CRISPR gRNA sequence
  source 1..20: mol_type = other DNA
ttggagtataaactgtagtt

SEQ ID NO: 49381 - DNA, 20 bp, synthetic construct
  misc_feature 1..20: note = CRISPR gRNA sequence
  source 1..20: mol_type = other DNA
ataaactgtagttgagataa

SEQ ID NO: 49382 - DNA, 20 bp, synthetic construct
  misc_feature 1..20: note = CRISPR gRNA sequence
  source 1..20: mol_type = other DNA
aactgtagttgagataatag

SEQ ID NO: 49383 - DNA, 20 bp, synthetic construct
  misc_feature 1..20: note = CRISPR gRNA sequence
  source 1..20: mol_type = other DNA
tgtatcaatgtcacatttcc

SEQ ID NO: 49384 - DNA, 20 bp, synthetic construct
  misc_feature 1..20: note = CRISPR gRNA sequence
  source 1..20: mol_type = other DNA
cctggattttataattttac

SEQ ID NO: 49385 - DNA, 20 bp, synthetic construct
  misc_feature 1..20: note = CRISPR gRNA sequence
  source 1..20: mol_type = other DNA
tttataattttactggatta

SEQ ID NO: 49386 - DNA, 20 bp, synthetic construct
  misc_feature 1..20: note = CRISPR gRNA sequence
  source 1..20: mol_type = other DNA
ataattttactggattatgg

SEQ ID NO: 49387 - DNA, 20 bp, synthetic construct
  misc_feature 1..20: note = CRISPR gRNA sequence
  source 1..20: mol_type = other DNA
aattttactggattatggaa

SEQ ID NO: 49388 - DNA, 20 bp, synthetic construct
  misc_feature 1..20: note = CRISPR gRNA sequence
  source 1..20: mol_type = other DNA
gaagagaatgtccttatttc

SEQ ID NO: 49389 - DNA, 20 bp, synthetic construct
  misc_feature 1..20: note = CRISPR gRNA sequence
  source 1..20: mol_type = other DNA
caaattcgctgaaatgttaa

SEQ ID NO: 49390 - DNA, 20 bp, synthetic construct
  misc_feature 1..20: note = CRISPR gRNA sequence
  source 1..20: mol_type = other DNA
aaattcgctgaaatgttaac

SEQ ID NO: 49391 - DNA, 20 bp, synthetic construct
  misc_feature 1..20: note = CRISPR gRNA sequence
  source 1..20: mol_type = other DNA
cgctgaaatgttaacgggta

SEQ ID NO: 49392 - DNA, 20 bp, synthetic construct
  misc_feature 1..20: note = CRISPR gRNA sequence
  source 1..20: mol_type = other DNA
gctgaaatgttaacgggtaa

SEQ ID NO: 49393 - DNA, 20 bp, synthetic construct
  misc_feature 1..20: note = CRISPR gRNA sequence
  source 1..20: mol_type = other DNA
ctgaaatgttaacgggtaaa

SEQ ID NO: 49394 - DNA, 20 bp, synthetic construct
  misc_feature 1..20: note = CRISPR gRNA sequence
  source 1..20: mol_type = other DNA
gattacaacttacttctaaa

SEQ ID NO: 49395 - DNA, 20 bp, synthetic construct
  misc_feature 1..20: note = CRISPR gRNA sequence
  source 1..20: mol_type = other DNA
caacttacttctaaatggtt

SEQ ID NO: 49396 - DNA, 20 bp, synthetic construct
  misc_feature 1..20: note = CRISPR gRNA sequence
  source 1..20: mol_type = other DNA
tacttctaaatggttcagaa

SEQ ID NO: 49397 - DNA, 20 bp, synthetic construct
  misc_feature 1..20: note = CRISPR gRNA sequence
  source 1..20: mol_type = other DNA
acttctaaatggttcagaaa

SEQ ID NO: 49398 - DNA, 20 bp, synthetic construct
  misc_feature 1..20: note = CRISPR gRNA sequence
  source 1..20: mol_type = other DNA
ttctaaatggttcagaaaag

SEQ ID NO: 49399 - DNA, 20 bp, synthetic construct
  misc_feature 1..20: note = CRISPR gRNA sequence
  source 1..20: mol_type = other DNA
ctaaatggttcagaaaagga

SEQ ID NO: 49400 - DNA, 20 bp, synthetic construct
  misc_feature 1..20: note = CRISPR gRNA sequence
  source 1..20: mol_type = other DNA
aaatggttcagaaaaggaga

SEQ ID NO: 49401 - DNA, 20 bp, synthetic construct
  misc_feature 1..20: note = CRISPR gRNA sequence
  source 1..20: mol_type = other DNA
aatggttcagaaaaggagag

SEQ ID NO: 49402 - DNA, 20 bp, synthetic construct
  misc_feature 1..20: note = CRISPR gRNA sequence
  source 1..20: mol_type = other DNA
atggttcagaaaaggagaga

SEQ ID NO: 49403 - DNA, 20 bp, synthetic construct
  misc_feature 1..20: note = CRISPR gRNA sequence
  source 1..20: mol_type = other DNA
ggttcagaaaaggagagagg

SEQ ID NO: 49404 - DNA, 20 bp, synthetic construct
  misc_feature 1..20: note = CRISPR gRNA sequence
  source 1..20: mol_type = other DNA
ttcagaaaaggagagaggga

SEQ ID NO: 49405 - DNA, 20 bp, synthetic construct
  misc_feature 1..20: note = CRISPR gRNA sequence
  source 1..20: mol_type = other DNA
cagaaaaggagagagggaga

SEQ ID NO: 49406 - DNA, 20 bp, synthetic construct
  misc_feature 1..20: note = CRISPR gRNA sequence
  source 1..20: mol_type = other DNA
aggagagagggagagagtga

SEQ ID NO: 49407 - DNA, 20 bp, synthetic construct
  misc_feature 1..20: note = CRISPR gRNA sequence
  source 1..20: mol_type = other DNA
agagggagagagtgaaagaa

SEQ ID NO: 49408 - DNA, 20 bp, synthetic construct
  misc_feature 1..20: note = CRISPR gRNA sequence
  source 1..20: mol_type = other DNA
gagggagagagtgaaagaaa

SEQ ID NO: 49409 - DNA, 20 bp, synthetic construct
  misc_feature 1..20: note = CRISPR gRNA sequence
  source 1..20: mol_type = other DNA
agggagagagtgaaagaaaa

SEQ ID NO: 49410 - DNA, 20 bp, synthetic construct
  misc_feature 1..20: note = CRISPR gRNA sequence
  source 1..20: mol_type = other DNA
ggagagagtgaaagaaaagg

SEQ ID NO: 49411 - DNA, 20 bp, synthetic construct
  misc_feature 1..20: note = CRISPR gRNA sequence
  source 1..20: mol_type = other DNA
gagagagtgaaagaaaaggg

SEQ ID NO: 49412 - DNA, 20 bp, synthetic construct
  misc_feature 1..20: note = CRISPR gRNA sequence
  source 1..20: mol_type = other DNA
agagtgaaagaaaagggagg

SEQ ID NO: 49413 - DNA, 20 bp, synthetic construct
  misc_feature 1..20: note = CRISPR gRNA sequence
  source 1..20: mol_type = other DNA
gagtgaaagaaaagggaggt

SEQ ID NO: 49414 - DNA, 20 bp, synthetic construct
  misc_feature 1..20: note = CRISPR gRNA sequence
  source 1..20: mol_type = other DNA
gaaagaaaagggaggtggga

SEQ ID NO: 49415 - DNA, 20 bp, synthetic construct
  misc_feature 1..20: note = CRISPR gRNA sequence
  source 1..20: mol_type = other DNA
agaaaagggaggtgggaaag

SEQ ID NO: 49416 - DNA, 20 bp, synthetic construct
  misc_feature 1..20: note = CRISPR gRNA sequence
  source 1..20: mol_type = other DNA
gaaaagggaggtgggaaaga

SEQ ID NO: 49417 - DNA, 20 bp, synthetic construct
  misc_feature 1..20: note = CRISPR gRNA sequence
  source 1..20: mol_type = other DNA
aaagggaggtgggaaagaag

SEQ ID NO: 49418 - DNA, 20 bp, synthetic construct
  misc_feature 1..20: note = CRISPR gRNA sequence
  source 1..20: mol_type = other DNA
aagggaggtgggaaagaagg

SEQ ID NO: 49419 - DNA, 20 bp, synthetic construct
  misc_feature 1..20: note = CRISPR gRNA sequence
  source 1..20: mol_type = other DNA
agggaggtgggaaagaagga

SEQ ID NO: 49420 - DNA, 20 bp, synthetic construct
  misc_feature 1..20: note = CRISPR gRNA sequence
  source 1..20: mol_type = other DNA
ggaggtgggaaagaaggagg

SEQ ID NO: 49421 - DNA, 20 bp, synthetic construct
  misc_feature 1..20: note = CRISPR gRNA sequence
  source 1..20: mol_type = other DNA
gaggtgggaaagaaggaggg

SEQ ID NO: 49422 - DNA, 20 bp, synthetic construct
  misc_feature 1..20: note = CRISPR gRNA sequence
  source 1..20: mol_type = other DNA
aggtgggaaagaaggaggga

SEQ ID NO: 49423 - DNA, 20 bp, synthetic construct
  misc_feature 1..20: note = CRISPR gRNA sequence
  source 1..20: mol_type = other DNA
tgggaaagaaggagggaggg

SEQ ID NO: 49424 - DNA, 20 bp, synthetic construct
  misc_feature 1..20: note = CRISPR gRNA sequence
  source 1..20: mol_type = other DNA
gaaggagggagggaagaaat

SEQ ID NO: 49425 - DNA, 20 bp, synthetic construct
  misc_feature 1..20: note = CRISPR gRNA sequence
  source 1..20: mol_type = other DNA
agggaagaaatgagcaaatg

SEQ ID NO: 49426 - DNA, 20 bp, synthetic construct
  misc_feature 1..20: note = CRISPR gRNA sequence
  source 1..20: mol_type = other DNA
gaaatgagcaaatgtggaaa

SEQ ID NO: 49427 - DNA, 20 bp, synthetic construct
  misc_feature 1..20: note = CRISPR gRNA sequence
  source 1..20: mol_type = other DNA
gagcaaatgtggaaaaagat

SEQ ID NO: 49428 - DNA, 20 bp, synthetic construct
  misc_feature 1..20: note = CRISPR gRNA sequence
  source 1..20: mol_type = other DNA
aatgtggaaaaagattggca

SEQ ID NO: 49429 - DNA, 20 bp, synthetic construct
  misc_feature 1..20: note = CRISPR gRNA sequence
  source 1..20: mol_type = other DNA
atgtggaaaaagattggcaa

SEQ ID NO: 49430 - DNA, 20 bp, synthetic construct
  misc_feature 1..20: note = CRISPR gRNA sequence
  source 1..20: mol_type = other DNA
tgtggaaaaagattggcaaa

SEQ ID NO: 49431 - DNA, 20 bp, synthetic construct
  misc_feature 1..20: note = CRISPR gRNA sequence
  source 1..20: mol_type = other DNA
ttgttctttttttttttttt

SEQ ID NO: 49432 - DNA, 20 bp, synthetic construct
  misc_feature 1..20: note = CRISPR gRNA sequence
  source 1..20: mol_type = other DNA
ttttttttttttcggaaacc

SEQ ID NO: 49433 - DNA, 20 bp, synthetic construct
  misc_feature 1..20: note = CRISPR gRNA sequence
  source 1..20: mol_type = other DNA
ccgagcctcgctctgtcacc

SEQ ID NO: 49434 - DNA, 20 bp, synthetic construct
  misc_feature 1..20: note = CRISPR gRNA sequence
  source 1..20: mol_type = other DNA
cgagcctcgctctgtcacct

SEQ ID NO: 49435 - DNA, 20 bp, synthetic construct
  misc_feature 1..20: note = CRISPR gRNA sequence
  source 1..20: mol_type = other DNA
cctcgctctgtcacctaggc

SEQ ID NO: 49436 - DNA, 20 bp, synthetic construct
  misc_feature 1..20: note = CRISPR gRNA sequence
  source 1..20: mol_type = other DNA
tcgctctgtcacctaggcta

SEQ ID NO: 49437 - DNA, 20 bp, synthetic construct
  misc_feature 1..20: note = CRISPR gRNA sequence
  source 1..20: mol_type = other DNA
ctgtcacctaggctagagtg

SEQ ID NO: 49438 - DNA, 20 bp, synthetic construct
  misc_feature 1..20: note = CRISPR gRNA sequence
  source 1..20: mol_type = other DNA
tcacctaggctagagtgcag

SEQ ID NO: 49439 - DNA, 20 bp, synthetic construct
  misc_feature 1..20: note = CRISPR gRNA sequence
  source 1..20: mol_type = other DNA
agagtgcagtggcacaatct

SEQ ID NO: 49440 - DNA, 20 bp, synthetic construct
  misc_feature 1..20: note = CRISPR gRNA sequence
  source 1..20: mol_type = other DNA
atcttggctcactgtaacct

SEQ ID NO: 49441 - DNA, 20 bp, synthetic construct
  misc_feature 1..20: note = CRISPR gRNA sequence
  source 1..20: mol_type = other DNA
tcactgtaacctcagcctcc

SEQ ID NO: 49442 - DNA, 20 bp, synthetic construct
  misc_feature 1..20: note = CRISPR gRNA sequence
  source 1..20: mol_type = other DNA
cactgtaacctcagcctccc

SEQ ID NO: 49443 - DNA, 20 bp, synthetic construct
  misc_feature 1..20: note = CRISPR gRNA sequence
  source 1..20: mol_type = other DNA
aacctcagcctcccgggttc

SEQ ID NO: 49444 - DNA, 20 bp, synthetic construct
  misc_feature 1..20: note = CRISPR gRNA sequence
  source 1..20: mol_type = other DNA
ttcaagcaattcttgtgcct

SEQ ID NO: 49445 - DNA, 20 bp, synthetic construct
  misc_feature 1..20: note = CRISPR gRNA sequence
  source 1..20: mol_type = other DNA
ttgtgcctcagcctcccaat

SEQ ID NO: 49446 - DNA, 20 bp, synthetic construct
  misc_feature 1..20: note = CRISPR gRNA sequence
  source 1..20: mol_type = other DNA
gcctcagcctcccaattagc

SEQ ID NO: 49447 - DNA, 20 bp, synthetic construct
  misc_feature 1..20: note = CRISPR gRNA sequence
  source 1..20: mol_type = other DNA
cctcagcctcccaattagct

SEQ ID NO: 49448 - DNA, 20 bp, synthetic construct
  misc_feature 1..20: note = CRISPR gRNA sequence
  source 1..20: mol_type = other DNA
ctcccaattagctgggatta

SEQ ID NO: 49449 - DNA, 20 bp, synthetic construct
  misc_feature 1..20: note = CRISPR gRNA sequence
  source 1..20: mol_type = other DNA
tcccaattagctgggattac

SEQ ID NO: 49450 - DNA, 20 bp, synthetic construct
  misc_feature 1..20: note = CRISPR gRNA sequence
  source 1..20: mol_type = other DNA
caggcatgcaccaccatgcc

SEQ ID NO: 49451 - DNA, 20 bp, synthetic construct
  misc_feature 1..20: note = CRISPR gRNA sequence
  source 1..20: mol_type = other DNA
cagctaatttttttgtattt

SEQ ID NO: 49452 - DNA, 20 bp, synthetic construct
  misc_feature 1..20: note = CRISPR gRNA sequence
  source 1..20: mol_type = other DNA
ctaatttttttgtattttag

SEQ ID NO: 49453 - DNA, 20 bp, synthetic construct
  misc_feature 1..20: note = CRISPR gRNA sequence
  source 1..20: mol_type = other DNA
aatttttttgtattttagta

SEQ ID NO: 49454 - DNA, 20 bp, synthetic construct
  misc_feature 1..20: note = CRISPR gRNA sequence
  source 1..20: mol_type = other DNA
tttttgtattttagtagaga

SEQ ID NO: 49455 - DNA, 20 bp, synthetic construct
  misc_feature 1..20: note = CRISPR gRNA sequence
  source 1..20: mol_type = other DNA
ttttgtattttagtagagac

SEQ ID NO: 49456 - DNA, 20 bp, synthetic construct
  misc_feature 1..20: note = CRISPR gRNA sequence
  source 1..20: mol_type = other DNA
tttgtattttagtagagacg

SEQ ID NO: 49457 - DNA, 20 bp, synthetic construct
  misc_feature 1..20: note = CRISPR gRNA sequence
  source 1..20: mol_type = other DNA
cggggtttcaccgtgttgtc

SEQ ID NO: 49458 - DNA, 20 bp, synthetic construct
  misc_feature 1..20: note = CRISPR gRNA sequence
  source 1..20: mol_type = other DNA
ggggtttcaccgtgttgtcc

SEQ ID NO: 49459 - DNA, 20 bp, synthetic construct
  misc_feature 1..20: note = CRISPR gRNA sequence
  source 1..20: mol_type = other DNA
gggtttcaccgtgttgtcca

SEQ ID NO: 49460 - DNA, 20 bp, synthetic construct
  misc_feature 1..20: note = CRISPR gRNA sequence
  source 1..20: mol_type = other DNA
tttcaccgtgttgtccaggg

SEQ ID NO: 49461 - DNA, 20 bp, synthetic construct
  misc_feature 1..20: note = CRISPR gRNA sequence
  source 1..20: mol_type = other DNA
cagggtggtctcgaattcct

SEQ ID NO: 49462 - DNA, 20 bp, synthetic construct
  misc_feature 1..20: note = CRISPR gRNA sequence
  source 1..20: mol_type = other DNA
tggtctcgaattcctgagct

SEQ ID NO: 49463 - DNA, 20 bp, synthetic construct
  misc_feature 1..20: note = CRISPR gRNA sequence
  source 1..20: mol_type = other DNA
ggtctcgaattcctgagctc

SEQ ID NO: 49464 - DNA, 20 bp, synthetic construct
  misc_feature 1..20: note = CRISPR gRNA sequence
  source 1..20: mol_type = other DNA
ctcaggcaatccacctgcct

SEQ ID NO: 49465 - DNA, 20 bp, synthetic construct
  misc_feature 1..20: note = CRISPR gRNA sequence
  source 1..20: mol_type = other DNA
ccacctgcctcggcctccca

SEQ ID NO: 49466 - DNA, 20 bp, synthetic construct
  misc_feature 1..20: note = CRISPR gRNA sequence
  source 1..20: mol_type = other DNA
gcctcggcctcccaaagtgc

SEQ ID NO: 49467 - DNA, 20 bp, synthetic construct
  misc_feature 1..20: note = CRISPR gRNA sequence
  source 1..20: mol_type = other DNA
cctcggcctcccaaagtgct

SEQ ID NO: 49468 - DNA, 20 bp, synthetic construct
  misc_feature 1..20: note = CRISPR gRNA sequence
  source 1..20: mol_type = other DNA
ctcccaaagtgctaggatta

SEQ ID NO: 49469 - DNA, 20 bp, synthetic construct
  misc_feature 1..20: note = CRISPR gRNA sequence
  source 1..20: mol_type = other DNA
agtgctaggattacagacat

SEQ ID NO: 49470 - DNA, 20 bp, synthetic construct
  misc_feature 1..20: note = CRISPR gRNA sequence
  source 1..20: mol_type = other DNA
cagacatgagccaccacgcc

SEQ ID NO: 49471 - DNA, 20 bp, synthetic construct
  misc_feature 1..20: note = CRISPR gRNA sequence
  source 1..20: mol_type = other DNA
gagccaccacgcccagctct

SEQ ID NO: 49472 - DNA, 20 bp, synthetic construct
  misc_feature 1..20: note = CRISPR gRNA sequence
  source 1..20: mol_type = other DNA
agccaccacgcccagctcta

SEQ ID NO: 49473 - DNA, 20 bp, synthetic construct
  misc_feature 1..20: note = CRISPR gRNA sequence
  source 1..20: mol_type = other DNA
gccaccacgcccagctctaa

SEQ ID NO: 49474 - DNA, 20 bp, synthetic construct
  misc_feature 1..20: note = CRISPR gRNA sequence
  source 1..20: mol_type = other DNA
cccagctctaagggtgaatt

SEQ ID NO: 49475 - DNA, 20 bp, synthetic construct
  misc_feature 1..20: note = CRISPR gRNA sequence
  source 1..20: mol_type = other DNA
ccagctctaagggtgaattt

SEQ ID NO: 49476 - DNA, 20 bp, synthetic construct
  misc_feature 1..20: note = CRISPR gRNA sequence
  source 1..20: mol_type = other DNA
taagggtgaatttgggtaaa

SEQ ID NO: 49477 - DNA, 20 bp, synthetic construct
  misc_feature 1..20: note = CRISPR gRNA sequence
  source 1..20: mol_type = other DNA
gaatttgggtaaatggcaca

SEQ ID NO: 49478 - DNA, 20 bp, synthetic construct
  misc_feature 1..20: note = CRISPR gRNA sequence
  source 1..20: mol_type = other DNA
tttgggtaaatggcacacag

SEQ ID NO: 49479 - DNA, 20 bp, synthetic construct
  misc_feature 1..20: note = CRISPR gRNA sequence
  source 1..20: mol_type = other DNA
aaatggcacacagcagttct

SEQ ID NO: 49480 - DNA, 20 bp, synthetic construct
  misc_feature 1..20: note = CRISPR gRNA sequence
  source 1..20: mol_type = other DNA
gtcttcttgaaactttgtgt

SEQ ID NO: 49481 - DNA, 20 bp, synthetic construct
  misc_feature 1..20: note = CRISPR gRNA sequence
  source 1..20: mol_type = other DNA
tgaaactttgtgttagttcg

SEQ ID NO: 49482 - DNA, 20 bp, synthetic construct
  misc_feature 1..20: note = CRISPR gRNA sequence
  source 1..20: mol_type = other DNA
ttagttcgcagttattttaa

SEQ ID NO: 49483 - DNA, 20 bp, synthetic construct
  misc_feature 1..20: note = CRISPR gRNA sequence
  source 1..20: mol_type = other DNA
ttttaaaagaaaaacaatga

SEQ ID NO: 49484 - DNA, 20 bp, synthetic construct
  misc_feature 1..20: note = CRISPR gRNA sequence
  source 1..20: mol_type = other DNA
ttaaaagaaaaacaatgaaa

SEQ ID NO: 49485 - DNA, 20 bp, synthetic construct
  misc_feature 1..20: note = CRISPR gRNA sequence
  source 1..20: mol_type = other DNA
aacaatgaaagagtgttaaa

SEQ ID NO: 49486 - DNA, 20 bp, synthetic construct
  misc_feature 1..20: note = CRISPR gRNA sequence
  source 1..20: mol_type = other DNA
acaatgaaagagtgttaaaa

SEQ ID NO: 49487 - DNA, 20 bp, synthetic construct
  misc_feature 1..20: note = CRISPR gRNA sequence
  source 1..20: mol_type = other DNA
caatgaaagagtgttaaaaa

SEQ ID NO: 49488 - DNA, 20 bp, synthetic construct
  misc_feature 1..20: note = CRISPR gRNA sequence
  source 1..20: mol_type = other DNA
ggaacaactttcttgccatg

SEQ ID NO: 49489 - DNA, 20 bp, synthetic construct
  misc_feature 1..20: note = CRISPR gRNA sequence
  source 1..20: mol_type = other DNA
ccatgtggctcaatgttcct

SEQ ID NO: 49490 - DNA, 20 bp, synthetic construct
  misc_feature 1..20: note = CRISPR gRNA sequence
  source 1..20: mol_type = other DNA
catgtggctcaatgttccta

SEQ ID NO: 49491 - DNA, 20 bp, synthetic construct
  misc_feature 1..20: note = CRISPR gRNA sequence
  source 1..20: mol_type = other DNA
cctaaggtcatgtttacgac

SEQ ID NO: 49492 - DNA, 20 bp, synthetic construct
  misc_feature 1..20: note = CRISPR gRNA sequence
  source 1..20: mol_type = other DNA
ctaaggtcatgtttacgact

SEQ ID NO: 49493 - DNA, 20 bp, synthetic construct
  misc_feature 1..20: note = CRISPR gRNA sequence
  source 1..20: mol_type = other DNA
gtacccctaaaaatcatctc

SEQ ID NO: 49494 - DNA, 20 bp, synthetic construct
  misc_feature 1..20: note = CRISPR gRNA sequence
  source 1..20: mol_type = other DNA
tacccctaaaaatcatctcc

SEQ ID NO: 49495 - DNA, 20 bp, synthetic construct
  misc_feature 1..20: note = CRISPR gRNA sequence
  source 1..20: mol_type = other DNA
acccctaaaaatcatctcca

SEQ ID NO: 49496 - DNA, 20 bp, synthetic construct
  misc_feature 1..20: note = CRISPR gRNA sequence
  source 1..20: mol_type = other DNA
atcatctccagggccacctg

SEQ ID NO: 49497 - DNA, 20 bp, synthetic construct
  misc_feature 1..20: note = CRISPR gRNA sequence
  source 1..20: mol_type = other DNA
ccacctgtggtttgtgtcca

SEQ ID NO: 49498 - DNA, 20 bp, synthetic construct
  misc_feature 1..20: note = CRISPR gRNA sequence
  source 1..20: mol_type = other DNA
acctgtggtttgtgtccaca

SEQ ID NO: 49499 - DNA, 20 bp, synthetic construct
  misc_feature 1..20: note = CRISPR gRNA sequence
  source 1..20: mol_type = other DNA
gtggtttgtgtccacagagt

SEQ ID NO: 49500 - DNA, 20 bp, synthetic construct
  misc_feature 1..20: note = CRISPR gRNA sequence
  source 1..20: mol_type = other DNA
tgtgtccacagagtaagaca

SEQ ID NO: 49501 - DNA, 20 bp, synthetic construct
  misc_feature 1..20: note = CRISPR gRNA sequence
  source 1..20: mol_type = other DNA
tgtccacagagtaagacaca

SEQ ID NO: 49502 - DNA, 20 bp, synthetic construct
  misc_feature 1..20: note = CRISPR gRNA sequence
  source 1..20: mol_type = other DNA
cacagagtaagacacagagt

SEQ ID NO: 49503 - DNA, 20 bp, synthetic construct
  misc_feature 1..20: note = CRISPR gRNA sequence
  source 1..20: mol_type = other DNA
cagagtaagacacagagtaa

SEQ ID NO: 49504 - DNA, 20 bp, synthetic construct
  misc_feature 1..20: note = CRISPR gRNA sequence
  source 1..20: mol_type = other DNA
acacagagtaagagtcctct

SEQ ID NO: 49505 - DNA, 20 bp, synthetic construct
  misc_feature 1..20: note = CRISPR gRNA sequence
  source 1..20: mol_type = other DNA
gagtaagagtcctctgagcc

SEQ ID NO: 49506 - DNA, 20 bp, synthetic construct
  misc_feature 1..20: note = CRISPR gRNA sequence
  source 1..20: mol_type = other DNA
agtaagagtcctctgagccc

SEQ ID NO: 49507 - DNA, 20 bp, synthetic construct
  misc_feature 1..20: note = CRISPR gRNA sequence
  source 1..20: mol_type = other DNA
gtaagagtcctctgagccca

SEQ ID NO: 49508 - DNA, 20 bp, synthetic construct
  misc_feature 1..20: note = CRISPR gRNA sequence
  source 1..20: mol_type = other DNA
gagtcctctgagcccagggc

SEQ ID NO: 49509 - DNA, 20 bp, synthetic construct
  misc_feature 1..20: note = CRISPR gRNA sequence
  source 1..20: mol_type = other DNA
agtcctctgagcccagggct

SEQ ID NO: 49510 - DNA, 20 bp, synthetic construct
  misc_feature 1..20: note = CRISPR gRNA sequence
  source 1..20: mol_type = other DNA
gagcccagggctgggaataa

SEQ ID NO: 49511 - DNA, 20 bp, synthetic construct
  misc_feature 1..20: note = CRISPR gRNA sequence
  source 1..20: mol_type = other DNA
agcccagggctgggaataac

SEQ ID NO: 49512 - DNA, 20 bp, synthetic construct
  misc_feature 1..20: note = CRISPR gRNA sequence
  source 1..20: mol_type = other DNA
cccagggctgggaataacgg

SEQ ID NO: 49513 - DNA, 20 bp, synthetic construct
  misc_feature 1..20: note = CRISPR gRNA sequence
  source 1..20: mol_type = other DNA
ccagggctgggaataacggg

SEQ ID NO: 49514 - DNA, 20 bp, synthetic construct
  misc_feature 1..20: note = CRISPR gRNA sequence
  source 1..20: mol_type = other DNA
ctgggaataacgggaggtgt

SEQ ID NO: 49515 - DNA, 20 bp, synthetic construct
  misc_feature 1..20: note = CRISPR gRNA sequence
  source 1..20: mol_type = other DNA
tgggaataacgggaggtgtc

SEQ ID NO: 49516 - DNA, 20 bp, synthetic construct
  misc_feature 1..20: note = CRISPR gRNA sequence
  source 1..20: mol_type = other DNA
gggaataacgggaggtgtca

SEQ ID NO: 49517 - DNA, 20 bp, synthetic construct
  misc_feature 1..20: note = CRISPR gRNA sequence
  source 1..20: mol_type = other DNA
aataacgggaggtgtcaggg

SEQ ID NO: 49518 - DNA, 20 bp, synthetic construct
  misc_feature 1..20: note = CRISPR gRNA sequence
  source 1..20: mol_type = other DNA
ataacgggaggtgtcagggc

SEQ ID NO: 49519 - DNA, 20 bp, synthetic construct
  misc_feature 1..20: note = CRISPR gRNA sequence
  source 1..20: mol_type = other DNA
taacgggaggtgtcagggca

SEQ ID NO: 49520 - DNA, 20 bp, synthetic construct
  misc_feature 1..20: note = CRISPR gRNA sequence
  source 1..20: mol_type = other DNA
cgggaggtgtcagggcaggg

SEQ ID NO: 49521 - DNA, 20 bp, synthetic construct
  misc_feature 1..20: note = CRISPR gRNA sequence
  source 1..20: mol_type = other DNA
ggaggtgtcagggcagggca

SEQ ID NO: 49522 - DNA, 20 bp, synthetic construct
  misc_feature 1..20: note = CRISPR gRNA sequence
  source 1..20: mol_type = other DNA
cagggcagggcagagctgca

SEQ ID NO: 49523 - DNA, 20 bp, synthetic construct
  misc_feature 1..20: note = CRISPR gRNA sequence
  source 1..20: mol_type = other DNA
agggcagggcagagctgcaa

SEQ ID NO: 49524 - DNA, 20 bp, synthetic construct
  misc_feature 1..20: note = CRISPR gRNA sequence
  source 1..20: mol_type = other DNA
gggcagggcagagctgcaaa

SEQ ID NO: 49525 - DNA, 20 bp, synthetic construct
  misc_feature 1..20: note = CRISPR gRNA sequence
  source 1..20: mol_type = other DNA
ggcagggcagagctgcaaag

SEQ ID NO: 49526 - DNA, 20 bp, synthetic construct
  misc_feature 1..20: note = CRISPR gRNA sequence
  source 1..20: mol_type = other DNA
gcagagctgcaaaggggact

SEQ ID NO: 49527 - DNA, 20 bp, synthetic construct
  misc_feature 1..20: note = CRISPR gRNA sequence
  source 1..20: mol_type = other DNA
tctacataccgaaatgtctt

SEQ ID NO: 49528 - DNA, 20 bp, synthetic construct
  misc_feature 1..20: note = CRISPR gRNA sequence
  source 1..20: mol_type = other DNA
ataccgaaatgtcttcagct

SEQ ID NO: 49529 - DNA, 20 bp, synthetic construct
  misc_feature 1..20: note = CRISPR gRNA sequence
  source 1..20: mol_type = other DNA
accgaaatgtcttcagctca

SEQ ID NO: 49530 - DNA, 20 bp, synthetic construct
  misc_feature 1..20: note = CRISPR gRNA sequence
  source 1..20: mol_type = other DNA
cgaaatgtcttcagctcaga

SEQ ID NO: 49531 - DNA, 20 bp, synthetic construct
  misc_feature 1..20: note = CRISPR gRNA sequence
  source 1..20: mol_type = other DNA
gaaatgtcttcagctcagag

SEQ ID NO: 49532 - DNA, 20 bp, synthetic construct
  misc_feature 1..20: note = CRISPR gRNA sequence
  source 1..20: mol_type = other DNA
aaatgtcttcagctcagaga

SEQ ID NO: 49533 - DNA, 20 bp, synthetic construct
  misc_feature 1..20: note = CRISPR gRNA sequence
  source 1..20: mol_type = other DNA
gtcttcagctcagagaggga

SEQ ID NO: 49534 - DNA, 20 bp, synthetic construct
  misc_feature 1..20: note = CRISPR gRNA sequence
  source 1..20: mol_type = other DNA
ttcagctcagagagggacag

SEQ ID NO: 49535 - DNA, 20 bp, synthetic construct
  misc_feature 1..20: note = CRISPR gRNA sequence
  source 1..20: mol_type = other DNA
tcagctcagagagggacagc

SEQ ID NO: 49536 - DNA, 20 bp, synthetic construct
  misc_feature 1..20: note = CRISPR gRNA sequence
  source 1..20: mol_type = other DNA
agctcagagagggacagcag

SEQ ID NO: 49537 - DNA, 20 bp, synthetic construct
  misc_feature 1..20: note = CRISPR gRNA sequence
  source 1..20: mol_type = other DNA
gctcagagagggacagcagg

SEQ ID NO: 49538 - DNA, 20 bp, synthetic construct
  misc_feature 1..20: note = CRISPR gRNA sequence
  source 1..20: mol_type = other DNA
agggacagcaggaggctctg

SEQ ID NO: 49539 - DNA, 20 bp, synthetic construct
  misc_feature 1..20: note = CRISPR gRNA sequence
  source 1..20: mol_type = other DNA
gacagcaggaggctctgcag

SEQ ID NO: 49540 - DNA, 20 bp, synthetic construct
  misc_feature 1..20: note = CRISPR gRNA sequence
  source 1..20: mol_type = other DNA
agcaggaggctctgcagcag

SEQ ID NO: 49541 - DNA, 20 bp, synthetic construct
  misc_feature 1..20: note = CRISPR gRNA sequence
  source 1..20: mol_type = other DNA
gcaggaggctctgcagcagc

SEQ ID NO: 49542 - DNA, 20 bp, synthetic construct
  misc_feature 1..20: note = CRISPR gRNA sequence
  source 1..20: mol_type = other DNA
caggaggctctgcagcagca

SEQ ID NO: 49543 - DNA, 20 bp, synthetic construct
  misc_feature 1..20: note = CRISPR gRNA sequence
  source 1..20: mol_type = other DNA
gctctgcagcagcagggaac

SEQ ID NO: 49544 - DNA, 20 bp, synthetic construct
  misc_feature 1..20: note = CRISPR gRNA sequence
  source 1..20: mol_type = other DNA
aactggcatcatcgtcctca

SEQ ID NO: 49545 - DNA, 20 bp, synthetic construct
  misc_feature 1..20: note = CRISPR gRNA sequence
  source 1..20: mol_type = other DNA
ctggcatcatcgtcctcaca

SEQ ID NO: 49546 - DNA, 20 bp, synthetic construct
  misc_feature 1..20: note = CRISPR gRNA sequence
  source 1..20: mol_type = other DNA
tggcatcatcgtcctcacag

SEQ ID NO: 49547 - DNA, 20 bp, synthetic construct
  misc_feature 1..20: note = CRISPR gRNA sequence
  source 1..20: mol_type = other DNA
gtcctcacagaggttaacct

SEQ ID NO: 49548 - DNA, 20 bp, synthetic construct
  misc_feature 1..20: note = CRISPR gRNA sequence
  source 1..20: mol_type = other DNA
cacagaggttaacctgagac

SEQ ID NO: 49549 - DNA, 20 bp, synthetic construct
  misc_feature 1..20: note = CRISPR gRNA sequence
  source 1..20: mol_type = other DNA
ttaacctgagacaagctgaa

SEQ ID NO: 49550 - DNA, 20 bp, synthetic construct
  misc_feature 1..20: note = CRISPR gRNA sequence
  source 1..20: mol_type = other DNA
taacctgagacaagctgaaa

SEQ ID NO: 49551 - DNA, 20 bp, synthetic construct
  misc_feature 1..20: note = CRISPR gRNA sequence
  source 1..20: mol_type = other DNA
gagacaagctgaaaaggtcc

SEQ ID NO: 49552 - DNA, 20 bp, synthetic construct
  misc_feature 1..20: note = CRISPR gRNA sequence
  source 1..20: mol_type = other DNA
agacaagctgaaaaggtcca

SEQ ID NO: 49553 - DNA, 20 bp, synthetic construct
  misc_feature 1..20: note = CRISPR gRNA sequence
  source 1..20: mol_type = other DNA
gaaaaggtccaaggatattc

SEQ ID NO: 49554 - DNA, 20 bp, synthetic construct
  misc_feature 1..20: note = CRISPR gRNA sequence
  source 1..20: mol_type = other DNA
aaaggtccaaggatattcta

SEQ ID NO: 49555 - DNA, 20 bp, synthetic construct
  misc_feature 1..20: note = CRISPR gRNA sequence
  source 1..20: mol_type = other DNA
aaggtccaaggatattctag

SEQ ID NO: 49556 - DNA, 20 bp, synthetic construct
  misc_feature 1..20: note = CRISPR gRNA sequence
  source 1..20: mol_type = other DNA
aaggatattctagaggattt

SEQ ID NO: 49557 - DNA, 20 bp, synthetic construct
  misc_feature 1..20: note = CRISPR gRNA sequence
  source 1..20: mol_type = other DNA
aggatattctagaggatttc

SEQ ID NO: 49558 - DNA, 20 bp, synthetic construct
  misc_feature 1..20: note = CRISPR gRNA sequence
  source 1..20: mol_type = other DNA
tattctagaggatttcaggc

SEQ ID NO: 49559 - DNA, 20 bp, synthetic construct
  misc_feature 1..20: note = CRISPR gRNA sequence
  source 1..20: mol_type = other DNA
atttcaggctggacacacct

SEQ ID NO: 49560 - DNA, 20 bp, synthetic construct
  misc_feature 1..20: note = CRISPR gRNA sequence
  source 1..20: mol_type = other DNA
ttcaggctggacacacctca

SEQ ID NO: 49561 - DNA, 20 bp, synthetic construct
  misc_feature 1..20: note = CRISPR gRNA sequence
  source 1..20: mol_type = other DNA
tcaggctggacacacctcag

SEQ ID NO: 49562 - DNA, 20 bp, synthetic construct
  misc_feature 1..20: note = CRISPR gRNA sequence
  source 1..20: mol_type = other DNA
acctcagaggtcatcacatc

SEQ ID NO: 49563 - DNA, 20 bp, synthetic construct
  misc_feature 1..20: note = CRISPR gRNA sequence
  source 1..20: mol_type = other DNA
tcagaggtcatcacatccag

SEQ ID NO: 49564 - DNA, 20 bp, synthetic construct
  misc_feature 1..20: note = CRISPR gRNA sequence
  source 1..20: mol_type = other DNA
cagaggtcatcacatccaga

SEQ ID NO: 49565 - DNA, 20 bp, synthetic construct
  misc_feature 1..20: note = CRISPR gRNA sequence
  source 1..20: mol_type = other DNA
agaggtcatcacatccagaa

SEQ ID NO: 49566 - DNA, 20 bp, synthetic construct
  misc_feature 1..20: note = CRISPR gRNA sequence
  source 1..20: mol_type = other DNA
gaggtcatcacatccagaag

SEQ ID NO: 49567 - DNA, 20 bp, synthetic construct
  misc_feature 1..20: note = CRISPR gRNA sequence
  source 1..20: mol_type = other DNA
aggtcatcacatccagaagg

SEQ ID NO: 49568 - DNA, 20 bp, synthetic construct
  misc_feature 1..20: note = CRISPR gRNA sequence
  source 1..20: mol_type = other DNA
cacatccagaagggggtgcc

SEQ ID NO: 49569 - DNA, 20 bp, synthetic construct
  misc_feature 1..20: note = CRISPR gRNA sequence
  source 1..20: mol_type = other DNA
catccagaagggggtgccaa

SEQ ID NO: 49570 - DNA, 20 bp, synthetic construct
  misc_feature 1..20: note = CRISPR gRNA sequence
  source 1..20: mol_type = other DNA
tccagaagggggtgccaaga

SEQ ID NO: 49571 - DNA, 20 bp, synthetic construct
  misc_feature 1..20: note = CRISPR gRNA sequence
  source 1..20: mol_type = other DNA
ccagaagggggtgccaagag

SEQ ID NO: 49572 - DNA, 20 bp, synthetic construct
  misc_feature 1..20: note = CRISPR gRNA sequence
  source 1..20: mol_type = other DNA
agaagggggtgccaagagag

SEQ ID NO: 49573 - DNA, 20 bp, synthetic construct
  misc_feature 1..20: note = CRISPR gRNA sequence
  source 1..20: mol_type = other DNA
agggggtgccaagagaggag

SEQ ID NO: 49574 - DNA, 20 bp, synthetic construct
  misc_feature 1..20: note = CRISPR gRNA sequence
  source 1..20: mol_type = other DNA
gggggtgccaagagaggaga

SEQ ID NO: 49575 - DNA, 20 bp, synthetic construct
  misc_feature 1..20: note = CRISPR gRNA sequence
  source 1..20: mol_type = other DNA
ggggtgccaagagaggagaa

SEQ ID NO: 49576 - DNA, 20 bp, synthetic construct
  misc_feature 1..20: note = CRISPR gRNA sequence
  source 1..20: mol_type = other DNA
gggtgccaagagaggagaag

SEQ ID NO: 49577 - DNA, 20 bp, synthetic construct
  misc_feature 1..20: note = CRISPR gRNA sequence
  source 1..20: mol_type = other DNA
gagaggagaaggggccaccc

SEQ ID NO: 49578 - DNA, 20 bp, synthetic construct
  misc_feature 1..20: note = CRISPR gRNA sequence
  source 1..20: mol_type = other DNA
gaggagaaggggccacccaa

SEQ ID NO: 49579 - DNA, 20 bp, synthetic construct
  misc_feature 1..20: note = CRISPR gRNA sequence
  source 1..20: mol_type = other DNA
ggccacccaagagctcccct

SEQ ID NO: 49580 - DNA, 20 bp, synthetic construct
  misc_feature 1..20: note = CRISPR gRNA sequence
  source 1..20: mol_type = other DNA
agagctcccctgagccaccc

SEQ ID NO: 49581 - DNA, 20 bp, synthetic construct
  misc_feature 1..20: note = CRISPR gRNA sequence
  source 1..20: mol_type = other DNA
gagctcccctgagccaccct

SEQ ID NO: 49582 - DNA, 20 bp, synthetic construct
  misc_feature 1..20: note = CRISPR gRNA sequence
  source 1..20: mol_type = other DNA
agctcccctgagccaccctg

SEQ ID NO: 49583 - DNA, 20 bp, synthetic construct
  misc_feature 1..20: note = CRISPR gRNA sequence
  source 1..20: mol_type = other DNA
gggctctccctcccctccac

SEQ ID NO: 49584 - DNA, 20 bp, synthetic construct
  misc_feature 1..20: note = CRISPR gRNA sequence
  source 1..20: mol_type = other DNA
ctccctcccctccactggcc

SEQ ID NO: 49585 - DNA, 20 bp, synthetic construct
  misc_feature 1..20: note = CRISPR gRNA sequence
  source 1..20: mol_type = other DNA
agtgtgattttctcctgcac

SEQ ID NO: 49586 - DNA, 20 bp, synthetic construct
  misc_feature 1..20: note = CRISPR gRNA sequence
  source 1..20: mol_type = other DNA
gtgtgattttctcctgcaca

SEQ ID NO: 49587 - DNA, 20 bp, synthetic construct
  misc_feature 1..20: note = CRISPR gRNA sequence
  source 1..20: mol_type = other DNA
tgattttctcctgcacaagg

SEQ ID NO: 49588 - DNA, 20 bp, synthetic construct
  misc_feature 1..20: note = CRISPR gRNA sequence
  source 1..20: mol_type = other DNA
tttctcctgcacaaggaagt

SEQ ID NO: 49589 - DNA, 20 bp, synthetic construct
  misc_feature 1..20: note = CRISPR gRNA sequence
  source 1..20: mol_type = other DNA
gcacaaggaagtgagaatgc

SEQ ID NO: 49590 - DNA, 20 bp, synthetic construct
  misc_feature 1..20: note = CRISPR gRNA sequence
  source 1..20: mol_type = other DNA
cacaaggaagtgagaatgcc

SEQ ID NO: 49591 - DNA, 20 bp, synthetic construct
  misc_feature 1..20: note = CRISPR gRNA sequence
  source 1..20: mol_type = other DNA
acaaggaagtgagaatgcca

SEQ ID NO: 49592 - DNA, 20 bp, synthetic construct
  misc_feature 1..20: note = CRISPR gRNA sequence
  source 1..20: mol_type = other DNA
gagaatgccagggtcacaca

SEQ ID NO: 49593 - DNA, 20 bp, synthetic construct
  misc_feature 1..20: note = CRISPR gRNA sequence
  source 1..20: mol_type = other DNA
tgccagggtcacacatggcc

SEQ ID NO: 49594 - DNA, 20 bp, synthetic construct
  misc_feature 1..20: note = CRISPR gRNA sequence
  source 1..20: mol_type = other DNA
ccagggtcacacatggcctg

SEQ ID NO: 49595 - DNA, 20 bp, synthetic construct
  misc_feature 1..20: note = CRISPR gRNA sequence
  source 1..20: mol_type = other DNA
gggtcacacatggcctggag

SEQ ID NO: 49596 - DNA, 20 bp, synthetic construct
  misc_feature 1..20: note = CRISPR gRNA sequence
  source 1..20: mol_type = other DNA
ggtcacacatggcctggagt

SEQ ID NO: 49597 - DNA, 20 bp, synthetic construct
  misc_feature 1..20: note = CRISPR gRNA sequence
  source 1..20: mol_type = other DNA
acatggcctggagtaggtac

SEQ ID NO: 49598 - DNA, 20 bp, synthetic construct
  misc_feature 1..20: note = CRISPR gRNA sequence
  source 1..20: mol_type = other DNA
catggcctggagtaggtacc

SEQ ID NO: 49599 - DNA, 20 bp, synthetic construct
  misc_feature 1..20: note = CRISPR gRNA sequence
  source 1..20: mol_type = other DNA
atggcctggagtaggtacca

SEQ ID NO: 49600 - DNA, 20 bp, synthetic construct
  misc_feature 1..20: note = CRISPR gRNA sequence
  source 1..20: mol_type = other DNA
gagtaggtaccagggtcaac

SEQ ID NO: 49601 - DNA, 20 bp, synthetic construct
  misc_feature 1..20: note = CRISPR gRNA sequence
  source 1..20: mol_type = other DNA
gtaggtaccagggtcaacca

SEQ ID NO: 49602 - DNA, 20 bp, synthetic construct
  misc_feature 1..20: note = CRISPR gRNA sequence
  source 1..20: mol_type = other DNA
ccagggtcaaccagagaact

SEQ ID NO: 49603 - DNA, 20 bp, synthetic construct
  misc_feature 1..20: note = CRISPR gRNA sequence
  source 1..20: mol_type = other DNA
cagggtcaaccagagaactc

SEQ ID NO: 49604 - DNA, 20 bp, synthetic construct
  misc_feature 1..20: note = CRISPR gRNA sequence
  source 1..20: mol_type = other DNA
agggtcaaccagagaactca

SEQ ID NO: 49605 - DNA, 20 bp, synthetic construct
  misc_feature 1..20: note = CRISPR gRNA sequence
  source 1..20: mol_type = other DNA
agagaactcagggccccaca

SEQ ID NO: 49606 - DNA, 20 bp, synthetic construct
  misc_feature 1..20: note = CRISPR gRNA sequence
  source 1..20: mol_type = other DNA
agaactcagggccccacaca

SEQ ID NO: 49607 - DNA, 20 bp, synthetic construct
  misc_feature 1..20: note = CRISPR gRNA sequence
  source 1..20: mol_type = other DNA
agggccccacacagagtttc

SEQ ID NO: 49608 - DNA, 20 bp, synthetic construct
  misc_feature 1..20: note = CRISPR gRNA sequence
  source 1..20: mol_type = other DNA
gggccccacacagagtttcc

SEQ ID NO: 49609 - DNA, 20 bp, synthetic construct
  misc_feature 1..20: note = CRISPR gRNA sequence
  source 1..20: mol_type = other DNA
gagtttccaggcgctgacct

SEQ ID NO: 49610 - DNA, 20 bp, synthetic construct
  misc_feature 1..20: note = CRISPR gRNA sequence
  source 1..20: mol_type = other DNA
ggcgctgacctgagctgctg

SEQ ID NO: 49611 - DNA, 20 bp, synthetic construct
  misc_feature 1..20: note = CRISPR gRNA sequence
  source 1..20: mol_type = other DNA
tgacctgagctgctgcagcc

SEQ ID NO: 49612 - DNA, 20 bp, synthetic construct
  misc_feature 1..20: note = CRISPR gRNA sequence
  source 1..20: mol_type = other DNA
agcctggcacatgtctccat

SEQ ID NO: 49613 - DNA, 20 bp, synthetic construct
  misc_feature 1..20: note = CRISPR gRNA sequence
  source 1..20: mol_type = other DNA
gtctccatcagctgcccgac

SEQ ID NO: 49614 - DNA, 20 bp, synthetic construct
  misc_feature 1..20: note = CRISPR gRNA sequence
  source 1..20: mol_type = other DNA
tccatcagctgcccgacaag

SEQ ID NO: 49615 - DNA, 20 bp, synthetic construct
  misc_feature 1..20: note = CRISPR gRNA sequence
  source 1..20: mol_type = other DNA
ccatcagctgcccgacaaga

SEQ ID NO: 49616 - DNA, 20 bp, synthetic construct
  misc_feature 1..20: note = CRISPR gRNA sequence
  source 1..20: mol_type = other DNA
gctgcccgacaagaaggctg

SEQ ID NO: 49617 - DNA, 20 bp, synthetic construct
  misc_feature 1..20: note = CRISPR gRNA sequence
  source 1..20: mol_type = other DNA
gcccgacaagaaggctgtgg

SEQ ID NO: 49618 - DNA, 20 bp, synthetic construct
  misc_feature 1..20: note = CRISPR gRNA sequence
  source 1..20: mol_type = other DNA
cccgacaagaaggctgtggt

SEQ ID NO: 49619 - DNA, 20 bp, synthetic construct
  misc_feature 1..20: note = CRISPR gRNA sequence
  source 1..20: mol_type = other DNA
agaaggctgtggtgggctcc

SEQ ID NO: 49620 - DNA, 20 bp, synthetic construct
  misc_feature 1..20: note = CRISPR gRNA sequence
  source 1..20: mol_type = other DNA
gaaggctgtggtgggctcca

SEQ ID NO: 49621 - DNA, 20 bp, synthetic construct
  misc_feature 1..20: note = CRISPR gRNA sequence
  source 1..20: mol_type = other DNA
tgtggtgggctccaaggtca

SEQ ID NO: 49622 - DNA, 20 bp, synthetic construct
  misc_feature 1..20: note = CRISPR gRNA sequence
  source 1..20: mol_type = other DNA
gtgggctccaaggtcacagt

SEQ ID NO: 49623 - DNA, 20 bp, synthetic construct
  misc_feature 1..20: note = CRISPR gRNA sequence
  source 1..20: mol_type = other DNA
aaggtcacagtgagccaacc

SEQ ID NO: 49624 - DNA, 20 bp, synthetic construct
  misc_feature 1..20: note = CRISPR gRNA sequence
  source 1..20: mol_type = other DNA
acagtgagccaacctggaca

SEQ ID NO: 49625 - DNA, 20 bp, synthetic construct
  misc_feature 1..20: note = CRISPR gRNA sequence
  source 1..20: mol_type = other DNA
tgagccaacctggacacaga

SEQ ID NO: 49626 - DNA, 20 bp, synthetic construct
  misc_feature 1..20: note = CRISPR gRNA sequence
  source 1..20: mol_type = other DNA
gagccaacctggacacagac

SEQ ID NO: 49627 - DNA, 20 bp, synthetic construct
  misc_feature 1..20: note = CRISPR gRNA sequence
  source 1..20: mol_type = other DNA
agccaacctggacacagaca

SEQ ID NO: 49628 - DNA, 20 bp, synthetic construct
  misc_feature 1..20: note = CRISPR gRNA sequence
  source 1..20: mol_type = other DNA
ccaacctggacacagacagg

SEQ ID NO: 49629 - DNA, 20 bp, synthetic construct
  misc_feature 1..20: note = CRISPR gRNA sequence
  source 1..20: mol_type = other DNA
ggacacagacagggagacga

SEQ ID NO: 49630 - DNA, 20 bp, synthetic construct
  misc_feature 1..20: note = CRISPR gRNA sequence
  source 1..20: mol_type = other DNA
agacagggagacgacagttt

SEQ ID NO: 49631 - DNA, 20 bp, synthetic construct
  misc_feature 1..20: note = CRISPR gRNA sequence
  source 1..20: mol_type = other DNA
gacgacagttttggaacatc

SEQ ID NO: 49632 - DNA, 20 bp, synthetic construct
  misc_feature 1..20: note = CRISPR gRNA sequence
  source 1..20: mol_type = other DNA
cagttttggaacatctagtc

SEQ ID NO: 49633 - DNA, 20 bp, synthetic construct
  misc_feature 1..20: note = CRISPR gRNA sequence
  source 1..20: mol_type = other DNA
ggaacatctagtccagtatg

SEQ ID NO: 49634 - DNA, 20 bp, synthetic construct
  misc_feature 1..20: note = CRISPR gRNA sequence
  source 1..20: mol_type = other DNA
gaacatctagtccagtatgt

SEQ ID NO: 49635 - DNA, 20 bp, synthetic construct
  misc_feature 1..20: note = CRISPR gRNA sequence
  source 1..20: mol_type = other DNA
ctagtccagtatgtgggatt

SEQ ID NO: 49636 - DNA, 20 bp, synthetic construct
  misc_feature 1..20: note = CRISPR gRNA sequence
  source 1..20: mol_type = other DNA
gggattcagtatctgcctgc

SEQ ID NO: 49637 - DNA, 20 bp, synthetic construct
  misc_feature 1..20: note = CRISPR gRNA sequence
  source 1..20: mol_type = other DNA
ggattcagtatctgcctgca

SEQ ID NO: 49638 - DNA, 20 bp, synthetic construct
  misc_feature 1..20: note = CRISPR gRNA sequence
  source 1..20: mol_type = other DNA
attcagtatctgcctgcaag

SEQ ID NO: 49639 - DNA, 20 bp, synthetic construct
  misc_feature 1..20: note = CRISPR gRNA sequence
  source 1..20: mol_type = other DNA
atctgcctgcaaggagctta

SEQ ID NO: 49640 - DNA, 20 bp, synthetic construct
  misc_feature 1..20: note = CRISPR gRNA sequence
  source 1..20: mol_type = other DNA
cctgcaaggagcttatggtg

SEQ ID NO: 49641 - DNA, 20 bp, synthetic construct
  misc_feature 1..20: note = CRISPR gRNA sequence
  source 1..20: mol_type = other DNA
ctgcaaggagcttatggtgt

SEQ ID NO: 49642 - DNA, 20 bp, synthetic construct
  misc_feature 1..20: note = CRISPR gRNA sequence
  source 1..20: mol_type = other DNA
tgcaaggagcttatggtgta

SEQ ID NO: 49643 - DNA, 20 bp, synthetic construct
  misc_feature 1..20: note = CRISPR gRNA sequence
  source 1..20: mol_type = other DNA
gcaaggagcttatggtgtag

SEQ ID NO: 49644 - DNA, 20 bp, synthetic construct
  misc_feature 1..20: note = CRISPR gRNA sequence
  source 1..20: mol_type = other DNA
aaataaatgctgatcaaatg

SEQ ID NO: 49645 - DNA, 20 bp, synthetic construct
  misc_feature 1..20: note = CRISPR gRNA sequence
  source 1..20: mol_type = other DNA
gctgatcaaatgaagtccta

SEQ ID NO: 49646 - DNA, 20 bp, synthetic construct
  misc_feature 1..20: note = CRISPR gRNA sequence
  source 1..20: mol_type = other DNA
acagtttgctattcacttat

SEQ ID NO: 49647 - DNA, 20 bp, synthetic construct
  misc_feature 1..20: note = CRISPR gRNA sequence
  source 1..20: mol_type = other DNA
gtttgctattcacttatgag

SEQ ID NO: 49648 - DNA, 20 bp, synthetic construct
  misc_feature 1..20: note = CRISPR gRNA sequence
  source 1..20: mol_type = other DNA
tattcacttatgagaagtgc

SEQ ID NO: 49649 - DNA, 20 bp, synthetic construct
  misc_feature 1..20: note = CRISPR gRNA sequence
  source 1..20: mol_type = other DNA
attcacttatgagaagtgct

SEQ ID NO: 49650 - DNA, 20 bp, synthetic construct
  misc_feature 1..20: note = CRISPR gRNA sequence
  source 1..20: mol_type = other DNA
cacttatgagaagtgctagg

SEQ ID NO: 49651 - DNA, 20 bp, synthetic construct
  misc_feature 1..20: note = CRISPR gRNA sequence
  source 1..20: mol_type = other DNA
ttatgagaagtgctaggaag

SEQ ID NO: 49652 - DNA, 20 bp, synthetic construct
  misc_feature 1..20: note = CRISPR gRNA sequence
  source 1..20: mol_type = other DNA
tatgagaagtgctaggaagc

SEQ ID NO: 49653 - DNA, 20 bp, synthetic construct
  misc_feature 1..20: note = CRISPR gRNA sequence
  source 1..20: mol_type = other DNA
tgagaagtgctaggaagcag

SEQ ID NO: 49654 - DNA, 20 bp, synthetic construct
  misc_feature 1..20: note = CRISPR gRNA sequence
  source 1..20: mol_type = other DNA
agtgctaggaagcaggagtc

SEQ ID NO: 49655 - DNA, 20 bp, synthetic construct
  misc_feature 1..20: note = CRISPR gRNA sequence
  source 1..20: mol_type = other DNA
ctaggaagcaggagtccaga

SEQ ID NO: 49656 - DNA, 20 bp, synthetic construct
  misc_feature 1..20: note = CRISPR gRNA sequence
  source 1..20: mol_type = other DNA
taggaagcaggagtccagat

SEQ ID NO: 49657 - DNA, 20 bp, synthetic construct
  misc_feature 1..20: note = CRISPR gRNA sequence
  source 1..20: mol_type = other DNA
aggaagcaggagtccagatg

SEQ ID NO: 49658 - DNA, 20 bp, synthetic construct
  misc_feature 1..20: note = CRISPR gRNA sequence
  source 1..20: mol_type = other DNA
aagcaggagtccagatgggg

SEQ ID NO: 49659 - DNA, 20 bp, synthetic construct
  misc_feature 1..20: note = CRISPR gRNA sequence
  source 1..20: mol_type = other DNA
aggagtccagatggggcagc

SEQ ID NO: 49660 - DNA, 20 bp, synthetic construct
  misc_feature 1..20: note = CRISPR gRNA sequence
  source 1..20: mol_type = other DNA
tccagatggggcagctggta

SEQ ID NO: 49661 - DNA, 20 bp, synthetic construct
  misc_feature 1..20: note = CRISPR gRNA sequence
  source 1..20: mol_type = other DNA
gggcagctggtatggttgtg

SEQ ID NO: 49662 - DNA, 20 bp, synthetic construct
  misc_feature 1..20: note = CRISPR gRNA sequence
  source 1..20: mol_type = other DNA
ggcagctggtatggttgtgc

SEQ ID NO: 49663 - DNA, 20 bp, synthetic construct
  misc_feature 1..20: note = CRISPR gRNA sequence
  source 1..20: mol_type = other DNA
gtgcaggttgttcaccgcac

SEQ ID NO: 49664 - DNA, 20 bp, synthetic construct
  misc_feature 1..20: note = CRISPR gRNA sequence
  source 1..20: mol_type = other DNA
tgcaggttgttcaccgcaca

SEQ ID NO: 49665 - DNA, 20 bp, synthetic construct
  misc_feature 1..20: note = CRISPR gRNA sequence
  source 1..20: mol_type = other DNA
gttcaccgcacaaggacaca

SEQ ID NO: 49666 - DNA, 20 bp, synthetic construct
  misc_feature 1..20: note = CRISPR gRNA sequence
  source 1..20: mol_type = other DNA
ccgcacaaggacacacagcc

SEQ ID NO: 49667 - DNA, 20 bp, synthetic construct
  misc_feature 1..20: note = CRISPR gRNA sequence
  source 1..20: mol_type = other DNA
cgcacaaggacacacagccg

SEQ ID NO: 49668 - DNA, 20 bp, synthetic construct
  misc_feature 1..20: note = CRISPR gRNA sequence
  source 1..20: mol_type = other DNA
cacaaggacacacagccgag

SEQ ID NO: 49669 - DNA, 20 bp, synthetic construct
  misc_feature 1..20: note = CRISPR gRNA sequence
  source 1..20: mol_type = other DNA
acaaggacacacagccgagg

SEQ ID NO: 49670 - DNA, 20 bp, synthetic construct
  misc_feature 1..20: note = CRISPR gRNA sequence
  source 1..20: mol_type = other DNA
ggacacacagccgaggaggt

SEQ ID NO: 49671 - DNA, 20 bp, synthetic construct
  misc_feature 1..20: note = CRISPR gRNA sequence
  source 1..20: mol_type = other DNA
gacacacagccgaggaggtg

SEQ ID NO: 49672 - DNA, 20 bp, synthetic construct
  misc_feature 1..20: note = CRISPR gRNA sequence
  source 1..20: mol_type = other DNA
cacagccgaggaggtgaggt

SEQ ID NO: 49673 - DNA, 20 bp, synthetic construct
  misc_feature 1..20: note = CRISPR gRNA sequence
  source 1..20: mol_type = other DNA
acagccgaggaggtgaggtg

SEQ ID NO: 49674 - DNA, 20 bp, synthetic construct
  misc_feature 1..20: note = CRISPR gRNA sequence
  source 1..20: mol_type = other DNA
cgaggaggtgaggtgaggct

SEQ ID NO: 49675 - DNA, 20 bp, synthetic construct
  misc_feature 1..20: note = CRISPR gRNA sequence
  source 1..20: mol_type = other DNA
tcctaccatgctctatttcc

SEQ ID NO: 49676 - DNA, 20 bp, synthetic construct
  misc_feature 1..20: note = CRISPR gRNA sequence
  source 1..20: mol_type = other DNA
tttcccagaatgtacacatg

SEQ ID NO: 49677 - DNA, 20 bp, synthetic construct
  misc_feature 1..20: note = CRISPR gRNA sequence
  source 1..20: mol_type = other DNA
ttcccagaatgtacacatgc

SEQ ID NO: 49678 - DNA, 20 bp, synthetic construct
  misc_feature 1..20: note = CRISPR gRNA sequence
  source 1..20: mol_type = other DNA
tcccagaatgtacacatgca

SEQ ID NO: 49679 - DNA, 20 bp, synthetic construct
  misc_feature 1..20: note = CRISPR gRNA sequence
  source 1..20: mol_type = other DNA
gcagggctgcatccactcaa

SEQ ID NO: 49680 - DNA, 20 bp, synthetic construct
  misc_feature 1..20: note = CRISPR gRNA sequence
  source 1..20: mol_type = other DNA
cagggctgcatccactcaaa

SEQ ID NO: 49681 - DNA, 20 bp, synthetic construct
  misc_feature 1..20: note = CRISPR gRNA sequence
  source 1..20: mol_type = other DNA
agggctgcatccactcaaaa

SEQ ID NO: 49682 - DNA, 20 bp, synthetic construct
  misc_feature 1..20: note = CRISPR gRNA sequence
  source 1..20: mol_type = other DNA
atttcccaaactgtgccata

SEQ ID NO: 49683 - DNA, 20 bp, synthetic construct
  misc_feature 1..20: note = CRISPR gRNA sequence
  source 1..20: mol_type = other DNA
caaactgtgccatatggatt

SEQ ID NO: 49684 - DNA, 20 bp, synthetic construct
  misc_feature 1..20: note = CRISPR gRNA sequence
  source 1..20: mol_type = other DNA
aactgtgccatatggattta

SEQ ID NO: 49685 - DNA, 20 bp, synthetic construct
  misc_feature 1..20: note = CRISPR gRNA sequence
  source 1..20: mol_type = other DNA
actgtgccatatggatttag

SEQ ID NO: 49686 - DNA, 20 bp, synthetic construct
  misc_feature 1..20: note = CRISPR gRNA sequence
  source 1..20: mol_type = other DNA
atttagaggtgctgtgaatc

SEQ ID NO: 49687 - DNA, 20 bp, synthetic construct
  misc_feature 1..20: note = CRISPR gRNA sequence
  source 1..20: mol_type = other DNA
tttagaggtgctgtgaatcc

SEQ ID NO: 49688 - DNA, 20 bp, synthetic construct
  misc_feature 1..20: note = CRISPR gRNA sequence
  source 1..20: mol_type = other DNA
ttagaggtgctgtgaatcca

SEQ ID NO: 49689 - DNA, 20 bp, synthetic construct
  misc_feature 1..20: note = CRISPR gRNA sequence
  source 1..20: mol_type = other DNA
ctgtgaatccagggatctat

SEQ ID NO: 49690 - DNA, 20 bp, synthetic construct
  misc_feature 1..20: note = CRISPR gRNA sequence
  source 1..20: mol_type = other DNA
gtgaatccagggatctataa

SEQ ID NO: 49691 - DNA, 20 bp, synthetic construct
  misc_feature 1..20: note = CRISPR gRNA sequence
  source 1..20: mol_type = other DNA
aatccagggatctataagag

SEQ ID NO: 49692 - DNA, 20 bp, synthetic construct
  misc_feature 1..20: note = CRISPR gRNA sequence
  source 1..20: mol_type = other DNA
ggatctataagagtggataa

SEQ ID NO: 49693 - DNA, 20 bp, synthetic construct
  misc_feature 1..20: note = CRISPR gRNA sequence
  source 1..20: mol_type = other DNA
tctataagagtggataatgg

SEQ ID NO: 49694 - DNA, 20 bp, synthetic construct
  misc_feature 1..20: note = CRISPR gRNA sequence
  source 1..20: mol_type = other DNA
gataatggaagtgtttgact

SEQ ID NO: 49695 - DNA, 20 bp, synthetic construct
  misc_feature 1..20: note = CRISPR gRNA sequence
  source 1..20: mol_type = other DNA
ggaagtgtttgactaagcct

SEQ ID NO: 49696 - DNA, 20 bp, synthetic construct
  misc_feature 1..20: note = CRISPR gRNA sequence
  source 1..20: mol_type = other DNA
gaagtgtttgactaagcctt

SEQ ID NO: 49697 - DNA, 20 bp, synthetic construct
  misc_feature 1..20: note = CRISPR gRNA sequence
  source 1..20: mol_type = other DNA
aagtgtttgactaagccttg

SEQ ID NO: 49698 - DNA, 20 bp, synthetic construct
  misc_feature 1..20: note = CRISPR gRNA sequence
  source 1..20: mol_type = other DNA
tttgactaagccttggggtc

SEQ ID NO: 49699 - DNA, 20 bp, synthetic construct
  misc_feature 1..20: note = CRISPR gRNA sequence
  source 1..20: mol_type = other DNA
ttgactaagccttggggtcc

SEQ ID NO: 49700 - DNA, 20 bp, synthetic construct
  misc_feature 1..20: note = CRISPR gRNA sequence
  source 1..20: mol_type = other DNA
tgactaagccttggggtcca

SEQ ID NO: 49701 - DNA, 20 bp, synthetic construct
  misc_feature 1..20: note = CRISPR gRNA sequence
  source 1..20: mol_type = other DNA
gactaagccttggggtccag

SEQ ID NO: 49702 - DNA, 20 bp, synthetic construct
  misc_feature 1..20: note = CRISPR gRNA sequence
  source 1..20: mol_type = other DNA
actaagccttggggtccagg

SEQ ID NO: 49703 - DNA, 20 bp, synthetic construct
  misc_feature 1..20: note = CRISPR gRNA sequence
  source 1..20: mol_type = other DNA
ggggtccagggggcctccct

SEQ ID NO: 49704 - DNA, 20 bp, synthetic construct
  misc_feature 1..20: note = CRISPR gRNA sequence
  source 1..20: mol_type = other DNA
gggtccagggggcctccctg

SEQ ID NO: 49705 - DNA, 20 bp, synthetic construct
  misc_feature 1..20: note = CRISPR gRNA sequence
  source 1..20: mol_type = other DNA
tccagggggcctccctgagg

SEQ ID NO: 49706 - DNA, 20 bp, synthetic construct
  misc_feature 1..20: note = CRISPR gRNA sequence
  source 1..20: mol_type = other DNA
agggggcctccctgaggtgg

SEQ ID NO: 49707 - DNA, 20 bp, synthetic construct
  misc_feature 1..20: note = CRISPR gRNA sequence
  source 1..20: mol_type = other DNA
tccctgaggtggtggcattt

SEQ ID NO: 49708 - DNA, 20 bp, synthetic construct
  misc_feature 1..20: note = CRISPR gRNA sequence
  source 1..20: mol_type = other DNA
gaggtggtggcatttaagct

SEQ ID NO: 49709 - DNA, 20 bp, synthetic construct
  misc_feature 1..20: note = CRISPR gRNA sequence
  source 1..20: mol_type = other DNA
tggcatttaagctgagacct

SEQ ID NO: 49710 - DNA, 20 bp, synthetic construct
  misc_feature 1..20: note = CRISPR gRNA sequence
  source 1..20: mol_type = other DNA
ggcatttaagctgagacctg

SEQ ID NO: 49711 - DNA, 20 bp, synthetic construct
  misc_feature 1..20: note = CRISPR gRNA sequence
  source 1..20: mol_type = other DNA
gcatttaagctgagacctga

SEQ ID NO: 49712 - DNA, 20 bp, synthetic construct
  misc_feature 1..20: note = CRISPR gRNA sequence
  source 1..20: mol_type = other DNA
taagctgagacctgagggat

SEQ ID NO: 49713 - DNA, 20 bp, synthetic construct
  misc_feature 1..20: note = CRISPR gRNA sequence
  source 1..20: mol_type = other DNA
aagctgagacctgagggatg

SEQ ID NO: 49714 - DNA, 20 bp, synthetic construct
  misc_feature 1..20: note = CRISPR gRNA sequence
  source 1..20: mol_type = other DNA
gctgagacctgagggatgag

SEQ ID NO: 49715 - DNA, 20 bp, synthetic construct
  misc_feature 1..20: note = CRISPR gRNA sequence
  source 1..20: mol_type = other DNA
ctgagacctgagggatgagg

SEQ ID NO: 49716 - DNA, 20 bp, synthetic construct
  misc_feature 1..20: note = CRISPR gRNA sequence
  source 1..20: mol_type = other DNA
gagacctgagggatgaggag

SEQ ID NO: 49717 - DNA, 20 bp, synthetic construct
  misc_feature 1..20: note = CRISPR gRNA sequence
  source 1..20: mol_type = other DNA
cctgagggatgaggaggagt

SEQ ID NO: 49718 - DNA, 20 bp, synthetic construct
  misc_feature 1..20: note = CRISPR gRNA sequence
  source 1..20: mol_type = other DNA
ctgagggatgaggaggagtt

SEQ ID NO: 49719 - DNA, 20 bp, synthetic construct
  misc_feature 1..20: note = CRISPR gRNA sequence
  source 1..20: mol_type = other DNA
agggatgaggaggagttagg

SEQ ID NO: 49720 - DNA, 20 bp, synthetic construct
  misc_feature 1..20: note = CRISPR gRNA sequence
  source 1..20: mol_type = other DNA
gggatgaggaggagttaggc

SEQ ID NO: 49721 - DNA, 20 bp, synthetic construct
  misc_feature 1..20: note = CRISPR gRNA sequence
  source 1..20: mol_type = other DNA
gaggaggagttaggcaggtg

SEQ ID NO: 49722 - DNA, 20 bp, synthetic construct
  misc_feature 1..20: note = CRISPR gRNA sequence
  source 1..20: mol_type = other DNA
gaggagttaggcaggtgaag

SEQ ID NO: 49723 - DNA, 20 bp, synthetic construct
  misc_feature 1..20: note = CRISPR gRNA sequence
  source 1..20: mol_type = other DNA
aggagttaggcaggtgaagc

SEQ ID NO: 49724 - DNA, 20 bp, synthetic construct
  misc_feature 1..20: note = CRISPR gRNA sequence
  source 1..20: mol_type = other DNA
agttaggcaggtgaagcagg

SEQ ID NO: 49725 - DNA, 20 bp, synthetic construct
  misc_feature 1..20: note = CRISPR gRNA sequence
  source 1..20: mol_type = other DNA
gttaggcaggtgaagcaggt

SEQ ID NO: 49726 - DNA, 20 bp, synthetic construct
  misc_feature 1..20: note = CRISPR gRNA sequence
  source 1..20: mol_type = other DNA
aggtgaagcaggtaggcgtg

SEQ ID NO: 49727 - DNA, 20 bp, synthetic construct
  misc_feature 1..20: note = CRISPR gRNA sequence
  source 1..20: mol_type = other DNA
gtgaagcaggtaggcgtgaa

SEQ ID NO: 49728 - DNA, 20 bp, synthetic construct
  misc_feature 1..20: note = CRISPR gRNA sequence
  source 1..20: mol_type = other DNA
taggcgtgaagagaacattc

SEQ ID NO: 49729 - DNA, 20 bp, synthetic construct
  misc_feature 1..20: note = CRISPR gRNA sequence
  source 1..20: mol_type = other DNA
aggcgtgaagagaacattct

SEQ ID NO: 49730 - DNA, 20 bp, synthetic construct
  misc_feature 1..20: note = CRISPR gRNA sequence
  source 1..20: mol_type = other DNA
cgtgaagagaacattctggg

SEQ ID NO: 49731 - DNA, 20 bp, synthetic construct
  misc_feature 1..20: note = CRISPR gRNA sequence
  source 1..20: mol_type = other DNA
tgaagagaacattctgggca

SEQ ID NO: 49732 - DNA, 20 bp, synthetic construct
  misc_feature 1..20: note = CRISPR gRNA sequence
  source 1..20: mol_type = other DNA
aagagaacattctgggcaga

SEQ ID NO: 49733 - DNA, 20 bp, synthetic construct
  misc_feature 1..20: note = CRISPR gRNA sequence
  source 1..20: mol_type = other DNA
aacattctgggcagagagca

SEQ ID NO: 49734 - DNA, 20 bp, synthetic construct
  misc_feature 1..20: note = CRISPR gRNA sequence
  source 1..20: mol_type = other DNA
acagcctgtgcaaatgccct

SEQ ID NO: 49735 - DNA, 20 bp, synthetic construct
  misc_feature 1..20: note = CRISPR gRNA sequence
  source 1..20: mol_type = other DNA
cagcctgtgcaaatgcccta

SEQ ID NO: 49736 - DNA, 20 bp, synthetic construct
  misc_feature 1..20: note = CRISPR gRNA sequence
  source 1..20: mol_type = other DNA
gtgcaaatgccctaaggtct

SEQ ID NO: 49737 - DNA, 20 bp, synthetic construct
  misc_feature 1..20: note = CRISPR gRNA sequence
  source 1..20: mol_type = other DNA
aaatgccctaaggtctaagc

SEQ ID NO: 49738 - DNA, 20 bp, synthetic construct
  misc_feature 1..20: note = CRISPR gRNA sequence
  source 1..20: mol_type = other DNA
gccctaaggtctaagcaaga

SEQ ID NO: 49739 - DNA, 20 bp, synthetic construct
  misc_feature 1..20: note = CRISPR gRNA sequence
  source 1..20: mol_type = other DNA
ggtctaagcaagatggtgtt

SEQ ID NO: 49740 - DNA, 20 bp, synthetic construct
  misc_feature 1..20: note = CRISPR gRNA sequence
  source 1..20: mol_type = other DNA
gtctaagcaagatggtgttc

SEQ ID NO: 49741 - DNA, 20 bp, synthetic construct
  misc_feature 1..20: note = CRISPR gRNA sequence
  source 1..20: mol_type = other DNA
tctaagcaagatggtgttcg

SEQ ID NO: 49742 - DNA, 20 bp, synthetic construct
  misc_feature 1..20: note = CRISPR gRNA sequence
  source 1..20: mol_type = other DNA
gatggtgttcggggaactga

SEQ ID NO: 49743 - DNA, 20 bp, synthetic construct
  misc_feature 1..20: note = CRISPR gRNA sequence
  source 1..20: mol_type = other DNA
ttcggggaactgaaagttca

SEQ ID NO: 49744 - DNA, 20 bp, synthetic construct
  misc_feature 1..20: note = CRISPR gRNA sequence
  source 1..20: mol_type = other DNA
tcggggaactgaaagttcat

SEQ ID NO: 49745 - DNA, 20 bp, synthetic construct
  misc_feature 1..20: note = CRISPR gRNA sequence
  source 1..20: mol_type = other DNA
cggggaactgaaagttcatg

SEQ ID NO: 49746 - DNA, 20 bp, synthetic construct
  misc_feature 1..20: note = CRISPR gRNA sequence
  source 1..20: mol_type = other DNA
ggggaactgaaagttcatgg

SEQ ID NO: 49747 - DNA, 20 bp, synthetic construct
  misc_feature 1..20: note = CRISPR gRNA sequence
  source 1..20: mol_type = other DNA
tgaaagttcatgggggtgac

SEQ ID NO: 49748 - DNA, 20 bp, synthetic construct
  misc_feature 1..20: note = CRISPR gRNA sequence
  source 1..20: mol_type = other DNA
aaagttcatgggggtgactg

SEQ ID NO: 49749 - DNA, 20 bp, synthetic construct
  misc_feature 1..20: note = CRISPR gRNA sequence
  source 1..20: mol_type = other DNA
tcatgggggtgactggagct

SEQ ID NO: 49750 - DNA, 20 bp, synthetic construct
  misc_feature 1..20: note = CRISPR gRNA sequence
  source 1..20: mol_type = other DNA
ggggtgactggagctgagac

SEQ ID NO: 49751 - DNA, 20 bp, synthetic construct
  misc_feature 1..20: note = CRISPR gRNA sequence
  source 1..20: mol_type = other DNA
gggtgactggagctgagact

SEQ ID NO: 49752 - DNA, 20 bp, synthetic construct
  misc_feature 1..20: note = CRISPR gRNA sequence
  source 1..20: mol_type = other DNA
ggtgactggagctgagactg

SEQ ID NO: 49753 - DNA, 20 bp, synthetic construct
  misc_feature 1..20: note = CRISPR gRNA sequence
  source 1..20: mol_type = other DNA
ctggagctgagactggggcc

SEQ ID NO: 49754 - DNA, 20 bp, synthetic construct
  misc_feature 1..20: note = CRISPR gRNA sequence
  source 1..20: mol_type = other DNA
ggagctgagactggggcctg

SEQ ID NO: 49755 - DNA, 20 bp, synthetic construct
  misc_feature 1..20: note = CRISPR gRNA sequence
  source 1..20: mol_type = other DNA
gctgagactggggcctggag

SEQ ID NO: 49756 - DNA, 20 bp, synthetic construct
  misc_feature 1..20: note = CRISPR gRNA sequence
  source 1..20: mol_type = other DNA
ctgagactggggcctggagt

SEQ ID NO: 49757 - DNA, 20 bp, synthetic construct
  misc_feature 1..20: note = CRISPR gRNA sequence
  source 1..20: mol_type = other DNA
tgagactggggcctggagtg

SEQ ID NO: 49758 - DNA, 20 bp, synthetic construct
  misc_feature 1..20: note = CRISPR gRNA sequence
  source 1..20: mol_type = other DNA
ggagtggggctgaaacgcct

SEQ ID NO: 49759 - DNA, 20 bp, synthetic construct
  misc_feature 1..20: note = CRISPR gRNA sequence
  source 1..20: mol_type = other DNA
gtggggctgaaacgcctcag

SEQ ID NO: 49760 - DNA, 20 bp, synthetic construct
  misc_feature 1..20: note = CRISPR gRNA sequence
  source 1..20: mol_type = other DNA
gggctgaaacgcctcagaag

SEQ ID NO: 49761 - DNA, 20 bp, synthetic construct
  misc_feature 1..20: note = CRISPR gRNA sequence
  source 1..20: mol_type = other DNA
ggctgaaacgcctcagaagt

SEQ ID NO: 49762 - DNA, 20 bp, synthetic construct
  misc_feature 1..20: note = CRISPR gRNA sequence
  source 1..20: mol_type = other DNA
gaaacgcctcagaagtgggt

SEQ ID NO: 49763 - DNA, 20 bp, synthetic construct
  misc_feature 1..20: note = CRISPR gRNA sequence
  source 1..20: mol_type = other DNA
cgcctcagaagtgggttggt

SEQ ID NO: 49764 - DNA, 20 bp, synthetic construct
  misc_feature 1..20: note = CRISPR gRNA sequence
  source 1..20: mol_type = other DNA
gtgggttggtcagacctctg

SEQ ID NO: 49765 - DNA, 20 bp, synthetic construct
  misc_feature 1..20: note = CRISPR gRNA sequence
  source 1..20: mol_type = other DNA
agacctctgtagcctgtgta

SEQ ID NO: 49766 - DNA, 20 bp, synthetic construct
  misc_feature 1..20: note = CRISPR gRNA sequence
  source 1..20: mol_type = other DNA
tgtaaagacttcgaacccct

SEQ ID NO: 49767 - DNA, 20 bp, synthetic construct
  misc_feature 1..20: note = CRISPR gRNA sequence
  source 1..20: mol_type = other DNA
gtaaagacttcgaaccccta

SEQ ID NO: 49768 - DNA, 20 bp, synthetic construct
  misc_feature 1..20: note = CRISPR gRNA sequence
  source 1..20: mol_type = other DNA
cttcgaacccctaaggtctc

SEQ ID NO: 49769 - DNA, 20 bp, synthetic construct
  misc_feature 1..20: note = CRISPR gRNA sequence
  source 1..20: mol_type = other DNA
ttcgaacccctaaggtctct

SEQ ID NO: 49770 - DNA, 20 bp, synthetic construct
  misc_feature 1..20: note = CRISPR gRNA sequence
  source 1..20: mol_type = other DNA
gaacccctaaggtctctggg

SEQ ID NO: 49771 - DNA, 20 bp, synthetic construct
  misc_feature 1..20: note = CRISPR gRNA sequence
  source 1..20: mol_type = other DNA
aacccctaaggtctctgggc

SEQ ID NO: 49772 - DNA, 20 bp, synthetic construct
  misc_feature 1..20: note = CRISPR gRNA sequence
  source 1..20: mol_type = other DNA
acccctaaggtctctgggca

SEQ ID NO: 49773 - DNA, 20 bp, synthetic construct
  misc_feature 1..20: note = CRISPR gRNA sequence
  source 1..20: mol_type = other DNA
cctaaggtctctgggcaggg

SEQ ID NO: 49774 - DNA, 20 bp, synthetic construct
  misc_feature 1..20: note = CRISPR gRNA sequence
  source 1..20: mol_type = other DNA
ctgggcagggtggtgaatat

SEQ ID NO: 49775 - DNA, 20 bp, synthetic construct
  misc_feature 1..20: note = CRISPR gRNA sequence
  source 1..20: mol_type = other DNA
gcagggtggtgaatattggt

SEQ ID NO: 49776 - DNA, 20 bp, synthetic construct
  misc_feature 1..20: note = CRISPR gRNA sequence
  source 1..20: mol_type = other DNA
gggtggtgaatattggtcag

SEQ ID NO: 49777 - DNA, 20 bp, synthetic construct
  misc_feature 1..20: note = CRISPR gRNA sequence
  source 1..20: mol_type = other DNA
tggtgaatattggtcagaag

SEQ ID NO: 49778 - DNA, 20 bp, synthetic construct
  misc_feature 1..20: note = CRISPR gRNA sequence
  source 1..20: mol_type = other DNA
ccctgccccctccccaacac

SEQ ID NO: 49779 - DNA, 20 bp, synthetic construct
  misc_feature 1..20: note = CRISPR gRNA sequence
  source 1..20: mol_type = other DNA
cccaacaccagcccctgcct

SEQ ID NO: 49780 - DNA, 20 bp, synthetic construct
  misc_feature 1..20: note = CRISPR gRNA sequence
  source 1..20: mol_type = other DNA
ccaacaccagcccctgcctt

SEQ ID NO: 49781 - DNA, 20 bp, synthetic construct
  misc_feature 1..20: note = CRISPR gRNA sequence
  source 1..20: mol_type = other DNA
caacaccagcccctgccttg

SEQ ID NO: 49782 - DNA, 20 bp, synthetic construct
  misc_feature 1..20: note = CRISPR gRNA sequence
  source 1..20: mol_type = other DNA
agcccctgccttggggtccc

SEQ ID NO: 49783 - DNA, 20 bp, synthetic construct
  misc_feature 1..20: note = CRISPR gRNA sequence
  source 1..20: mol_type = other DNA
tgccttggggtccctggtgc

SEQ ID NO: 49784 - DNA, 20 bp, synthetic construct
  misc_feature 1..20: note = CRISPR gRNA sequence
  source 1..20: mol_type = other DNA
gccttggggtccctggtgct

SEQ ID NO: 49785 - DNA, 20 bp, synthetic construct
  misc_feature 1..20: note = CRISPR gRNA sequence
  source 1..20: mol_type = other DNA
cctggtgctgggtcccacct

SEQ ID NO: 49786 - DNA, 20 bp, synthetic construct
  misc_feature 1..20: note = CRISPR gRNA sequence
  source 1..20: mol_type = other DNA
tgggtcccacctgagtgcca

SEQ ID NO: 49787 - DNA, 20 bp, synthetic construct
  misc_feature 1..20: note = CRISPR gRNA sequence
  source 1..20: mol_type = other DNA
cacctgagtgccacagcttc

SEQ ID NO: 49788 - DNA, 20 bp, synthetic construct
  misc_feature 1..20: note = CRISPR gRNA sequence
  source 1..20: mol_type = other DNA
cagcttctggattctcttcc

SEQ ID NO: 49789 - DNA, 20 bp, synthetic construct
  misc_feature 1..20: note = CRISPR gRNA sequence
  source 1..20: mol_type = other DNA
ttctggattctcttcctggc

SEQ ID NO: 49790 - DNA, 20 bp, synthetic construct
  misc_feature 1..20: note = CRISPR gRNA sequence
  source 1..20: mol_type = other DNA
tctggattctcttcctggcg

SEQ ID NO: 49791 - DNA, 20 bp, synthetic construct
  misc_feature 1..20: note = CRISPR gRNA sequence
  source 1..20: mol_type = other DNA
tcttcctggcgaggaaattc

SEQ ID NO: 49792 - DNA, 20 bp, synthetic construct
  misc_feature 1..20: note = CRISPR gRNA sequence
  source 1..20: mol_type = other DNA
cctggcgaggaaattccagc

SEQ ID NO: 49793 - DNA, 20 bp, synthetic construct
  misc_feature 1..20: note = CRISPR gRNA sequence
  source 1..20: mol_type = other DNA
gaggaaattccagctggaca

SEQ ID NO: 49794 - DNA, 20 bp, synthetic construct
  misc_feature 1..20: note = CRISPR gRNA sequence
  source 1..20: mol_type = other DNA
ggaaattccagctggacaca

SEQ ID NO: 49795 - DNA, 20 bp, synthetic construct
  misc_feature 1..20: note = CRISPR gRNA sequence
  source 1..20: mol_type = other DNA
gctggacacagagctgctgc

SEQ ID NO: 49796 - DNA, 20 bp, synthetic construct
  misc_feature 1..20: note = CRISPR gRNA sequence
  source 1..20: mol_type = other DNA
ctggacacagagctgctgct

SEQ ID NO: 49797 - DNA, 20 bp, synthetic construct
  misc_feature 1..20: note = CRISPR gRNA sequence
  source 1..20: mol_type = other DNA
acagagctgctgctgggtct

SEQ ID NO: 49798 - DNA, 20 bp, synthetic construct
  misc_feature 1..20: note = CRISPR gRNA sequence
  source 1..20: mol_type = other DNA
agagctgctgctgggtctcg

SEQ ID NO: 49799 - DNA, 20 bp, synthetic construct
  misc_feature 1..20: note = CRISPR gRNA sequence
  source 1..20: mol_type = other DNA
tgctgggtctcggagatgct

SEQ ID NO: 49800 - DNA, 20 bp, synthetic construct
  misc_feature 1..20: note = CRISPR gRNA sequence
  source 1..20: mol_type = other DNA
gctgggtctcggagatgctg

SEQ ID NO: 49801 - DNA, 20 bp, synthetic construct
  misc_feature 1..20: note = CRISPR gRNA sequence
  source 1..20: mol_type = other DNA
tgggtctcggagatgctgag

SEQ ID NO: 49802 - DNA, 20 bp, synthetic construct
  misc_feature 1..20: note = CRISPR gRNA sequence
  source 1..20: mol_type = other DNA
tctcggagatgctgaggagt

SEQ ID NO: 49803 - DNA, 20 bp, synthetic construct
  misc_feature 1..20: note = CRISPR gRNA sequence
  source 1..20: mol_type = other DNA
cggagatgctgaggagtgag

SEQ ID NO: 49804 - DNA, 20 bp, synthetic construct
  misc_feature 1..20: note = CRISPR gRNA sequence
  source 1..20: mol_type = other DNA
gagtgagcagtaaccaacgt

SEQ ID NO: 49805 - DNA, 20 bp, synthetic construct
  misc_feature 1..20: note = CRISPR gRNA sequence
  source 1..20: mol_type = other DNA
agtgagcagtaaccaacgtg

SEQ ID NO: 49806 - DNA, 20 bp, synthetic construct
  misc_feature 1..20: note = CRISPR gRNA sequence
  source 1..20: mol_type = other DNA
agcagtaaccaacgtgaggt

SEQ ID NO: 49807 - DNA, 20 bp, synthetic construct
  misc_feature 1..20: note = CRISPR gRNA sequence
  source 1..20: mol_type = other DNA
gcagtaaccaacgtgaggtc

SEQ ID NO: 49808 - DNA, 20 bp, synthetic construct
  misc_feature 1..20: note = CRISPR gRNA sequence
  source 1..20: mol_type = other DNA
gtaaccaacgtgaggtcggg

SEQ ID NO: 49809 - DNA, 20 bp, synthetic construct
  misc_feature 1..20: note = CRISPR gRNA sequence
  source 1..20: mol_type = other DNA
tgaggtcgggcagccttccc

SEQ ID NO: 49810 - DNA, 20 bp, synthetic construct
  misc_feature 1..20: note = CRISPR gRNA sequence
  source 1..20: mol_type = other DNA
aggtcgggcagccttccccg

SEQ ID NO: 49811 - DNA, 20 bp, synthetic construct
  misc_feature 1..20: note = CRISPR gRNA sequence
  source 1..20: mol_type = other DNA
ggtcgggcagccttccccgg

SEQ ID NO: 49812 - DNA, 20 bp, synthetic construct
  misc_feature 1..20: note = CRISPR gRNA sequence
  source 1..20: mol_type = other DNA
gtcgggcagccttccccgga

SEQ ID NO: 49813 - DNA, 20 bp, synthetic construct
  misc_feature 1..20: note = CRISPR gRNA sequence
  source 1..20: mol_type = other DNA
gcagccttccccggagggcc

SEQ ID NO: 49814 - DNA, 20 bp, synthetic construct
  misc_feature 1..20: note = CRISPR gRNA sequence
  source 1..20: mol_type = other DNA
ccttccccggagggcctagc

SEQ ID NO: 49815 - DNA, 20 bp, synthetic construct
  misc_feature 1..20: note = CRISPR gRNA sequence
  source 1..20: mol_type = other DNA
cggagggcctagctggcacc

SEQ ID NO: 49816 - DNA, 20 bp, synthetic construct
  misc_feature 1..20: note = CRISPR gRNA sequence
  source 1..20: mol_type = other DNA
ggagggcctagctggcacct

SEQ ID NO: 49817 - DNA, 20 bp, synthetic construct
  misc_feature 1..20: note = CRISPR gRNA sequence
  source 1..20: mol_type = other DNA
tagctggcacctgggctgcc

SEQ ID NO: 49818 - DNA, 20 bp, synthetic construct
  misc_feature 1..20: note = CRISPR gRNA sequence
  source 1..20: mol_type = other DNA
ctctgaactctcactttgcc

SEQ ID NO: 49819 - DNA, 20 bp, synthetic construct
  misc_feature 1..20: note = CRISPR gRNA sequence
  source 1..20: mol_type = other DNA
tctgaactctcactttgcct

SEQ ID NO: 49820 - DNA, 20 bp, synthetic construct
  misc_feature 1..20: note = CRISPR gRNA sequence
  source 1..20: mol_type = other DNA
tgggtccccttctcccctgc

SEQ ID NO: 49821 - DNA, 20 bp, synthetic construct
  misc_feature 1..20: note = CRISPR gRNA sequence
  source 1..20: mol_type = other DNA
gggtccccttctcccctgcc

SEQ ID NO: 49822 - DNA, 20 bp, synthetic construct
  misc_feature 1..20: note = CRISPR gRNA sequence
  source 1..20: mol_type = other DNA
ggtccccttctcccctgcca

SEQ ID NO: 49823 - DNA, 20 bp, synthetic construct
  misc_feature 1..20: note = CRISPR gRNA sequence
  source 1..20: mol_type = other DNA
ccttctcccctgccagggac

SEQ ID NO: 49824 - DNA, 20 bp, synthetic construct
  misc_feature 1..20: note = CRISPR gRNA sequence
  source 1..20: mol_type = other DNA
tcccctgccagggaccagct

SEQ ID NO: 49825 - DNA, 20 bp, synthetic construct
  misc_feature 1..20: note = CRISPR gRNA sequence
  source 1..20: mol_type = other DNA
cccctgccagggaccagctt

SEQ ID NO: 49826 - DNA, 20 bp, synthetic construct
  misc_feature 1..20: note = CRISPR gRNA sequence
  source 1..20: mol_type = other DNA
gccagggaccagcttaggac

SEQ ID NO: 49827 - DNA, 20 bp, synthetic construct
  misc_feature 1..20: note = CRISPR gRNA sequence
  source 1..20: mol_type = other DNA
gggaccagcttaggactgga

SEQ ID NO: 49828 - DNA, 20 bp, synthetic construct
  misc_feature 1..20: note = CRISPR gRNA sequence
  source 1..20: mol_type = other DNA
accagcttaggactggaaag

SEQ ID NO: 49829 - DNA, 20 bp, synthetic construct
  misc_feature 1..20: note = CRISPR gRNA sequence
  source 1..20: mol_type = other DNA
ccagcttaggactggaaagt

SEQ ID NO: 49830 - DNA, 20 bp, synthetic construct
  misc_feature 1..20: note = CRISPR gRNA sequence
  source 1..20: mol_type = other DNA
tggaaagtaggtgcttccgt

SEQ ID NO: 49831 - DNA, 20 bp, synthetic construct
  misc_feature 1..20: note = CRISPR gRNA sequence
  source 1..20: mol_type = other DNA
tgagtcacacacaatacccc

SEQ ID NO: 49832 - DNA, 20 bp, synthetic construct
  misc_feature 1..20: note = CRISPR gRNA sequence
  source 1..20: mol_type = other DNA
gtcacacacaataccccaag

SEQ ID NO: 49833 - DNA, 20 bp, synthetic construct
  misc_feature 1..20: note = CRISPR gRNA sequence
  source 1..20: mol_type = other DNA
tttcttttttttttttttta

SEQ ID NO: 49834 - DNA, 20 bp, synthetic construct
  misc_feature 1..20: note = CRISPR gRNA sequence
  source 1..20: mol_type = other DNA
tctttttttttttttttaaa

SEQ ID NO: 49835 - DNA, 20 bp, synthetic construct
  misc_feature 1..20: note = CRISPR gRNA sequence
  source 1..20: mol_type = other DNA
tttttttttttttaaagaga

SEQ ID NO: 49836 - DNA, 20 bp, synthetic construct
  misc_feature 1..20: note = CRISPR gRNA sequence
  source 1..20: mol_type = other DNA
ttttttttttttaaagagac

SEQ ID NO: 49837 - DNA, 20 bp, synthetic construct
  misc_feature 1..20: note = CRISPR gRNA sequence
  source 1..20: mol_type = other DNA
tttttttttttaaagagaca

SEQ ID NO: 49838 - DNA, 20 bp, synthetic construct
  misc_feature 1..20: note = CRISPR gRNA sequence
  source 1..20: mol_type = other DNA
agagacagggtcttgctctg

SEQ ID NO: 49839 - DNA, 20 bp, synthetic construct
  misc_feature 1..20: note = CRISPR gRNA sequence
  source 1..20: mol_type = other DNA
cagggtcttgctctgtagcc

SEQ ID NO: 49840 - DNA, 20 bp, synthetic construct
  misc_feature 1..20: note = CRISPR gRNA sequence
  source 1..20: mol_type = other DNA
agggtcttgctctgtagccc

SEQ ID NO: 49841 - DNA, 20 bp, synthetic construct
  misc_feature 1..20: note = CRISPR gRNA sequence
  source 1..20: mol_type = other DNA
ttgctctgtagcccaggctg

SEQ ID NO: 49842 - DNA, 20 bp, synthetic construct
  misc_feature 1..20: note = CRISPR gRNA sequence
  source 1..20: mol_type = other DNA
ctgtagcccaggctgaagtg

SEQ ID NO: 49843 - DNA, 20 bp, synthetic construct
  misc_feature 1..20: note = CRISPR gRNA sequence
  source 1..20: mol_type = other DNA
tagcccaggctgaagtgcag

SEQ ID NO: 49844 - DNA, 20 bp, synthetic construct
  misc_feature 1..20: note = CRISPR gRNA sequence
  source 1..20: mol_type = other DNA
cccaggctgaagtgcagtgg

SEQ ID NO: 49845 - DNA, 20 bp, synthetic construct
  misc_feature 1..20: note = CRISPR gRNA sequence
  source 1..20: mol_type = other DNA
ccaggctgaagtgcagtggt

SEQ ID NO: 49846 - DNA, 20 bp, synthetic construct
  misc_feature 1..20: note = CRISPR gRNA sequence
  source 1..20: mol_type = other DNA
tgcagtggtgggcacgatca

SEQ ID NO: 49847 - DNA, 20 bp, synthetic construct
  misc_feature 1..20: note = CRISPR gRNA sequence
  source 1..20: mol_type = other DNA
ggcacgatcatagctcactg

SEQ ID NO: 49848 - DNA, 20 bp, synthetic construct
  misc_feature 1..20: note = CRISPR gRNA sequence
  source 1..20: mol_type = other DNA
ctcactgcagccttgaactc

SEQ ID NO: 49849 - DNA, 20 bp, synthetic construct
  misc_feature 1..20: note = CRISPR gRNA sequence
  source 1..20: mol_type = other DNA
tcactgcagccttgaactct

SEQ ID NO: 49850 - DNA, 20 bp, synthetic construct
  misc_feature 1..20: note = CRISPR gRNA sequence
  source 1..20: mol_type = other DNA
cagccttgaactctgggctt

SEQ ID NO: 49851 - DNA, 20 bp, synthetic construct
  misc_feature 1..20: note = CRISPR gRNA sequence
  source 1..20: mol_type = other DNA
cttcagtgatcctcctgcct

SEQ ID NO: 49852 - DNA, 20 bp, synthetic construct
  misc_feature 1..20: note = CRISPR gRNA sequence
  source 1..20: mol_type = other DNA
cctcctgcctcggcctccca

SEQ ID NO: 49853 - DNA, 20 bp, synthetic construct
  misc_feature 1..20: note = CRISPR gRNA sequence
  source 1..20: mol_type = other DNA
gcctcggcctcccaaagtgc

SEQ ID NO: 49854 - DNA, 20 bp, synthetic construct
  misc_feature 1..20: note = CRISPR gRNA sequence
  source 1..20: mol_type = other DNA
cctcggcctcccaaagtgct

SEQ ID NO: 49855 - DNA, 20 bp, synthetic construct
  misc_feature 1..20: note = CRISPR gRNA sequence
  source 1..20: mol_type = other DNA
ctcggcctcccaaagtgctg

SEQ ID NO: 49856 - DNA, 20 bp, synthetic construct
  misc_feature 1..20: note = CRISPR gRNA sequence
  source 1..20: mol_type = other DNA
ctcccaaagtgctggggtta

SEQ ID NO: 49857 - DNA, 20 bp, synthetic construct
  misc_feature 1..20: note = CRISPR gRNA sequence
  source 1..20: mol_type = other DNA
tcccaaagtgctggggttac

SEQ ID NO: 49858 - DNA, 20 bp, synthetic construct
  misc_feature 1..20: note = CRISPR gRNA sequence
  source 1..20: mol_type = other DNA
agtgctggggttacaggcgt

SEQ ID NO: 49859 - DNA, 20 bp, synthetic construct
  misc_feature 1..20: note = CRISPR gRNA sequence
  source 1..20: mol_type = other DNA
caggcgtgagccaccgcgcc

SEQ ID NO: 49860 - DNA, 20 bp, synthetic construct
  misc_feature 1..20: note = CRISPR gRNA sequence
  source 1..20: mol_type = other DNA
tggcccttttcaacaattta

SEQ ID NO: 49861 - DNA, 20 bp, synthetic construct
  misc_feature 1..20: note = CRISPR gRNA sequence
  source 1..20: mol_type = other DNA
ttcaacaatttaaagttaat

SEQ ID NO: 49862 - DNA, 20 bp, synthetic construct
  misc_feature 1..20: note = CRISPR gRNA sequence
  source 1..20: mol_type = other DNA
tttaaagttaataagttgat

SEQ ID NO: 49863 - DNA, 20 bp, synthetic construct
  misc_feature 1..20: note = CRISPR gRNA sequence
  source 1..20: mol_type = other DNA
aataagttgataagcctttt

SEQ ID NO: 49864 - DNA, 20 bp, synthetic construct
  misc_feature 1..20: note = CRISPR gRNA sequence
  source 1..20: mol_type = other DNA
taagccttttcagaccatga

SEQ ID NO: 49865 - DNA, 20 bp, synthetic construct
  misc_feature 1..20: note = CRISPR gRNA sequence
  source 1..20: mol_type = other DNA
ccttttcagaccatgacaga

SEQ ID NO: 49866 - DNA, 20 bp, synthetic construct
  misc_feature 1..20: note = CRISPR gRNA sequence
  source 1..20: mol_type = other DNA
agaccatgacagaaagccat

SEQ ID NO: 49867 - DNA, 20 bp, synthetic construct
  misc_feature 1..20: note = CRISPR gRNA sequence
  source 1..20: mol_type = other DNA
accatgacagaaagccatta

SEQ ID NO: 49868 - DNA, 20 bp, synthetic construct
  misc_feature 1..20: note = CRISPR gRNA sequence
  source 1..20: mol_type = other DNA
ccatgacagaaagccattag

SEQ ID NO: 49869 - DNA, 20 bp, synthetic construct
  misc_feature 1..20: note = CRISPR gRNA sequence
  source 1..20: mol_type = other DNA
catgacagaaagccattaga

SEQ ID NO: 49870 - DNA, 20 bp, synthetic construct
  misc_feature 1..20: note = CRISPR gRNA sequence
  source 1..20: mol_type = other DNA
gaaagccattagagggatcc

SEQ ID NO: 49871 - DNA, 20 bp, synthetic construct
  misc_feature 1..20: note = CRISPR gRNA sequence
  source 1..20: mol_type = other DNA
aaagccattagagggatcca

SEQ ID NO: 49872 - DNA, 20 bp, synthetic construct
  misc_feature 1..20: note = CRISPR gRNA sequence
  source 1..20: mol_type = other DNA
aagccattagagggatccaa

SEQ ID NO: 49873 - DNA, 20 bp, synthetic construct
  misc_feature 1..20: note = CRISPR gRNA sequence
  source 1..20: mol_type = other DNA
ccattagagggatccaaggg

SEQ ID NO: 49874 - DNA, 20 bp, synthetic construct
  misc_feature 1..20: note = CRISPR gRNA sequence
  source 1..20: mol_type = other DNA
gagggatccaagggcagttc

SEQ ID NO: 49875 - DNA, 20 bp, synthetic construct
  misc_feature 1..20: note = CRISPR gRNA sequence
  source 1..20: mol_type = other DNA
gggcagttccagaattttct

SEQ ID NO: 49876 - DNA, 20 bp, synthetic construct
  misc_feature 1..20: note = CRISPR gRNA sequence
  source 1..20: mol_type = other DNA
ggcagttccagaattttctg

SEQ ID NO: 49877 - DNA, 20 bp, synthetic construct
  misc_feature 1..20: note = CRISPR gRNA sequence
  source 1..20: mol_type = other DNA
gcagttccagaattttctga

SEQ ID NO: 49878 - DNA, 20 bp, synthetic construct
  misc_feature 1..20: note = CRISPR gRNA sequence
  source 1..20: mol_type = other DNA
agttccagaattttctgagg

SEQ ID NO: 49879 - DNA, 20 bp, synthetic construct
  misc_feature 1..20: note = CRISPR gRNA sequence
  source 1..20: mol_type = other DNA
gttccagaattttctgaggg

SEQ ID NO: 49880 - DNA, 20 bp, synthetic construct
  misc_feature 1..20: note = CRISPR gRNA sequence
  source 1..20: mol_type = other DNA
ttccagaattttctgaggga

SEQ ID NO: 49881 - DNA, 20 bp, synthetic construct
  misc_feature 1..20: note = CRISPR gRNA sequence
  source 1..20: mol_type = other DNA
tccagaattttctgagggag

SEQ ID NO: 49882 - DNA, 20 bp, synthetic construct
  misc_feature 1..20: note = CRISPR gRNA sequence
  source 1..20: mol_type = other DNA
attttctgagggaggggcac

SEQ ID NO: 49883 - DNA, 20 bp, synthetic construct
  misc_feature 1..20: note = CRISPR gRNA sequence
  source 1..20: mol_type = other DNA
ttttctgagggaggggcaca

SEQ ID NO: 49884 - DNA, 20 bp, synthetic construct
  misc_feature 1..20: note = CRISPR gRNA sequence
  source 1..20: mol_type = other DNA
agggaggggcacaaggacca

SEQ ID NO: 49885 - DNA, 20 bp, synthetic construct
  misc_feature 1..20: note = CRISPR gRNA sequence
  source 1..20: mol_type = other DNA
ggggcacaaggaccacagtg

SEQ ID NO: 49886 - DNA, 20 bp, synthetic construct
  misc_feature 1..20: note = CRISPR gRNA sequence
  source 1..20: mol_type = other DNA
gcacaaggaccacagtgtgg

SEQ ID NO: 49887 - DNA, 20 bp, synthetic construct
  misc_feature 1..20: note = CRISPR gRNA sequence
  source 1..20: mol_type = other DNA
caaggaccacagtgtggtgg

SEQ ID NO: 49888 - DNA, 20 bp, synthetic construct
  misc_feature 1..20: note = CRISPR gRNA sequence
  source 1..20: mol_type = other DNA
aaggaccacagtgtggtgga

SEQ ID NO: 49889 - DNA, 20 bp, synthetic construct
  misc_feature 1..20: note = CRISPR gRNA sequence
  source 1..20: mol_type = other DNA
aggaccacagtgtggtggaa

SEQ ID NO: 49890 - DNA, 20 bp, synthetic construct
  misc_feature 1..20: note = CRISPR gRNA sequence
  source 1..20: mol_type = other DNA
accacagtgtggtggaaggg

SEQ ID NO: 49891 - DNA, 20 bp, synthetic construct
  misc_feature 1..20: note = CRISPR gRNA sequence
  source 1..20: mol_type = other DNA
ccacagtgtggtggaagggt

SEQ ID NO: 49892 - DNA, 20 bp, synthetic construct
  misc_feature 1..20: note = CRISPR gRNA sequence
  source 1..20: mol_type = other DNA
cacagtgtggtggaagggtg

SEQ ID NO: 49893 - DNA, 20 bp, synthetic construct
  misc_feature 1..20: note = CRISPR gRNA sequence
  source 1..20: mol_type = other DNA
agtgtggtggaagggtgggg

SEQ ID NO: 49894 - DNA, 20 bp, synthetic construct
  misc_feature 1..20: note = CRISPR gRNA sequence
  source 1..20: mol_type = other DNA
gtgtggtggaagggtggggt

SEQ ID NO: 49895 - DNA, 20 bp, synthetic construct
  misc_feature 1..20: note = CRISPR gRNA sequence
  source 1..20: mol_type = other DNA
tgtggtggaagggtggggta

SEQ ID NO: 49896 - DNA, 20 bp, synthetic construct
  misc_feature 1..20: note = CRISPR gRNA sequence
  source 1..20: mol_type = other DNA
gtggtggaagggtggggtag

SEQ ID NO: 49897 - DNA, 20 bp, synthetic construct
  misc_feature 1..20: note = CRISPR gRNA sequence
  source 1..20: mol_type = other DNA
ggtggggtaggggatgtgtc

SEQ ID NO: 49898 - DNA, 20 bp, synthetic construct
  misc_feature 1..20: note = CRISPR gRNA sequence
  source 1..20: mol_type = other DNA
tggggtaggggatgtgtctg

SEQ ID NO: 49899 - DNA, 20 bp, synthetic construct
  misc_feature 1..20: note = CRISPR gRNA sequence
  source 1..20: mol_type = other DNA
ggagtctgcatttgcgctct

SEQ ID NO: 49900 - DNA, 20 bp, synthetic construct
  misc_feature 1..20: note = CRISPR gRNA sequence
  source 1..20: mol_type = other DNA
tcacttgaatgttatgttca

SEQ ID NO: 49901 - DNA, 20 bp, synthetic construct
  misc_feature 1..20: note = CRISPR gRNA sequence
  source 1..20: mol_type = other DNA
cacttgaatgttatgttcat

SEQ ID NO: 49902 - DNA, 20 bp, synthetic construct
  misc_feature 1..20: note = CRISPR gRNA sequence
  source 1..20: mol_type = other DNA
acttgaatgttatgttcatg

SEQ ID NO: 49903 - DNA, 20 bp, synthetic construct
  misc_feature 1..20: note = CRISPR gRNA sequence
  source 1..20: mol_type = other DNA
ttatgttcatggggtgctta

SEQ ID NO: 49904 - DNA, 20 bp, synthetic construct
  misc_feature 1..20: note = CRISPR gRNA sequence
  source 1..20: mol_type = other DNA
tatgttcatggggtgcttat

SEQ ID NO: 49905 - DNA, 20 bp, synthetic construct
  misc_feature 1..20: note = CRISPR gRNA sequence
  source 1..20: mol_type = other DNA
atgttcatggggtgcttatg

SEQ ID NO: 49906 - DNA, 20 bp, synthetic construct
  misc_feature 1..20: note = CRISPR gRNA sequence
  source 1..20: mol_type = other DNA
gttcatggggtgcttatggg

SEQ ID NO: 49907 - DNA, 20 bp, synthetic construct
  misc_feature 1..20: note = CRISPR gRNA sequence
  source 1..20: mol_type = other DNA
tcatggggtgcttatgggga

SEQ ID NO: 49908 - DNA, 20 bp, synthetic construct
  misc_feature 1..20: note = CRISPR gRNA sequence
  source 1..20: mol_type = other DNA
catggggtgcttatggggag

SEQ ID NO: 49909 - DNA, 20 bp, synthetic construct
  misc_feature 1..20: note = CRISPR gRNA sequence
  source 1..20: mol_type = other DNA
atggggtgcttatggggaga

SEQ ID NO: 49910 - DNA, 20 bp, synthetic construct
  misc_feature 1..20: note = CRISPR gRNA sequence
  source 1..20: mol_type = other DNA
tgcttatggggagagggcta

SEQ ID NO: 49911 - DNA, 20 bp, synthetic construct
  misc_feature 1..20: note = CRISPR gRNA sequence
  source 1..20: mol_type = other DNA
gcttatggggagagggctat

SEQ ID NO: 49912 - DNA, 20 bp, synthetic construct
  misc_feature 1..20: note = CRISPR gRNA sequence
  source 1..20: mol_type = other DNA
ttatggggagagggctatgg

SEQ ID NO: 49913 - DNA, 20 bp, synthetic construct
  misc_feature 1..20: note = CRISPR gRNA sequence
  source 1..20: mol_type = other DNA
gagggctatgggagattata

SEQ ID NO: 49914 - DNA, 20 bp, synthetic construct
  misc_feature 1..20: note = CRISPR gRNA sequence
  source 1..20: mol_type = other DNA
atgggagattataaagtccc

SEQ ID NO: 49915 - DNA, 20 bp, synthetic construct
  misc_feature 1..20: note = CRISPR gRNA sequence
  source 1..20: mol_type = other DNA
gggagattataaagtcccca

SEQ ID NO: 49916 - DNA, 20 bp, synthetic construct
  misc_feature 1..20: note = CRISPR gRNA sequence
  source 1..20: mol_type = other DNA
agcatccccttgctcactcc

SEQ ID NO: 49917 - DNA, 20 bp, synthetic construct
  misc_feature 1..20: note = CRISPR gRNA sequence
  source 1..20: mol_type = other DNA
catccccttgctcactcctg

SEQ ID NO: 49918 - DNA, 20 bp, synthetic construct
  misc_feature 1..20: note = CRISPR gRNA sequence
  source 1..20: mol_type = other DNA
atccccttgctcactcctgg

SEQ ID NO: 49919 - DNA, 20 bp, synthetic construct
  misc_feature 1..20: note = CRISPR gRNA sequence
  source 1..20: mol_type = other DNA
ccccttgctcactcctggag

SEQ ID NO: 49920 - DNA, 20 bp, synthetic construct
  misc_feature 1..20: note = CRISPR gRNA sequence
  source 1..20: mol_type = other DNA
ccttgctcactcctggagga

SEQ ID NO: 49921 - DNA, 20 bp, synthetic construct
  misc_feature 1..20: note = CRISPR gRNA sequence
  source 1..20: mol_type = other DNA
tgctcactcctggaggagag

SEQ ID NO: 49922 - DNA, 20 bp, synthetic construct
  misc_feature 1..20: note = CRISPR gRNA sequence
  source 1..20: mol_type = other DNA
gctcactcctggaggagaga

SEQ ID NO: 49923 - DNA, 20 bp, synthetic construct
  misc_feature 1..20: note = CRISPR gRNA sequence
  source 1..20: mol_type = other DNA
cactcctggaggagagaagg

SEQ ID NO: 49924 - DNA, 20 bp, synthetic construct
  misc_feature 1..20: note = CRISPR gRNA sequence
  source 1..20: mol_type = other DNA
tcctggaggagagaaggaag

SEQ ID NO: 49925 - DNA, 20 bp, synthetic construct
  misc_feature 1..20: note = CRISPR gRNA sequence
  source 1..20: mol_type = other DNA
tggaggagagaaggaagaag

SEQ ID NO: 49926 - DNA, 20 bp, synthetic construct
  misc_feature 1..20: note = CRISPR gRNA sequence
  source 1..20: mol_type = other DNA
ggaggagagaaggaagaagc

SEQ ID NO: 49927 - DNA, 20 bp, synthetic construct
  misc_feature 1..20: note = CRISPR gRNA sequence
  source 1..20: mol_type = other DNA
gaggagagaaggaagaagca

SEQ ID NO: 49928 - DNA, 20 bp, synthetic construct
  misc_feature 1..20: note = CRISPR gRNA sequence
  source 1..20: mol_type = other DNA
gagagaaggaagaagcaggg

SEQ ID NO: 49929 - DNA, 20 bp, synthetic construct
  misc_feature 1..20: note = CRISPR gRNA sequence
  source 1..20: mol_type = other DNA
agagaaggaagaagcagggc

SEQ ID NO: 49930 - DNA, 20 bp, synthetic construct
  misc_feature 1..20: note = CRISPR gRNA sequence
  source 1..20: mol_type = other DNA
aagaagcagggcaggctgtg

SEQ ID NO: 49931 - DNA, 20 bp, synthetic construct
  misc_feature 1..20: note = CRISPR gRNA sequence
  source 1..20: mol_type = other DNA
agcagggcaggctgtgtggc

SEQ ID NO: 49932 - DNA, 20 bp, synthetic construct
  misc_feature 1..20: note = CRISPR gRNA sequence
  source 1..20: mol_type = other DNA
gcaggctgtgtggctggtga

SEQ ID NO: 49933 - DNA, 20 bp, synthetic construct
  misc_feature 1..20: note = CRISPR gRNA sequence
  source 1..20: mol_type = other DNA
ctgtgtggctggtgacagta

SEQ ID NO: 49934 - DNA, 20 bp, synthetic construct
  misc_feature 1..20: note = CRISPR gRNA sequence
  source 1..20: mol_type = other DNA
tgtggctggtgacagtacag

SEQ ID NO: 49935 - DNA, 20 bp, synthetic construct
  misc_feature 1..20: note = CRISPR gRNA sequence
  source 1..20: mol_type = other DNA
cagtacagcagacatcttta

SEQ ID NO: 49936 - DNA, 20 bp, synthetic construct
  misc_feature 1..20: note = CRISPR gRNA sequence
  source 1..20: mol_type = other DNA
agtacagcagacatctttac

SEQ ID NO: 49937 - DNA, 20 bp, synthetic construct
  misc_feature 1..20: note = CRISPR gRNA sequence
  source 1..20: mol_type = other DNA
gcagacatctttacaggctc

SEQ ID NO: 49938 - DNA, 20 bp, synthetic construct
  misc_feature 1..20: note = CRISPR gRNA sequence
  source 1..20: mol_type = other DNA
tccagttcttgtaatcctcc

SEQ ID NO: 49939 - DNA, 20 bp, synthetic construct
  misc_feature 1..20: note = CRISPR gRNA sequence
  source 1..20: mol_type = other DNA
gtaatcctcccagccctgca

SEQ ID NO: 49940 - DNA, 20 bp, synthetic construct
  misc_feature 1..20: note = CRISPR gRNA sequence
  source 1..20: mol_type = other DNA
taatcctcccagccctgcaa

SEQ ID NO: 49941 - DNA, 20 bp, synthetic construct
  misc_feature 1..20: note = CRISPR gRNA sequence
  source 1..20: mol_type = other DNA
aatcctcccagccctgcaaa

SEQ ID NO: 49942 - DNA, 20 bp, synthetic construct
  misc_feature 1..20: note = CRISPR gRNA sequence
  source 1..20: mol_type = other DNA
gccctgcaaagggccgtaat

SEQ ID NO: 49943 - DNA, 20 bp, synthetic construct
  misc_feature 1..20: note = CRISPR gRNA sequence
  source 1..20: mol_type = other DNA
ggccgtaattagactctttt

SEQ ID NO: 49944 - DNA, 20 bp, synthetic construct
  misc_feature 1..20: note = CRISPR gRNA sequence
  source 1..20: mol_type = other DNA
ccgtaattagactcttttaa

SEQ ID NO: 49945 - DNA, 20 bp, synthetic construct
  misc_feature 1..20: note = CRISPR gRNA sequence
  source 1..20: mol_type = other DNA
taattagactcttttaagag

SEQ ID NO: 49946 - DNA, 20 bp, synthetic construct
  misc_feature 1..20: note = CRISPR gRNA sequence
  source 1..20: mol_type = other DNA
aattagactcttttaagagc

SEQ ID NO: 49947 - DNA, 20 bp, synthetic construct
  misc_feature 1..20: note = CRISPR gRNA sequence
  source 1..20: mol_type = other DNA
ttagactcttttaagagcag

SEQ ID NO: 49948 - DNA, 20 bp, synthetic construct
  misc_feature 1..20: note = CRISPR gRNA sequence
  source 1..20: mol_type = other DNA
tagactcttttaagagcagg

SEQ ID NO: 49949 - DNA, 20 bp, synthetic construct
  misc_feature 1..20: note = CRISPR gRNA sequence
  source 1..20: mol_type = other DNA
tcttttaagagcaggaggtt

SEQ ID NO: 49950 - DNA, 20 bp, synthetic construct
  misc_feature 1..20: note = CRISPR gRNA sequence
  source 1..20: mol_type = other DNA
cttttaagagcaggaggttg

SEQ ID NO: 49951 - DNA, 20 bp, synthetic construct
  misc_feature 1..20: note = CRISPR gRNA sequence
  source 1..20: mol_type = other DNA
taagagcaggaggttgaggt

SEQ ID NO: 49952 - DNA, 20 bp, synthetic construct
  misc_feature 1..20: note = CRISPR gRNA sequence
  source 1..20: mol_type = other DNA
agagcaggaggttgaggtca

SEQ ID NO: 49953 - DNA, 20 bp, synthetic construct
  misc_feature 1..20: note = CRISPR gRNA sequence
  source 1..20: mol_type = other DNA
agcaggaggttgaggtcaga

SEQ ID NO: 49954 - DNA, 20 bp, synthetic construct
  misc_feature 1..20: note = CRISPR gRNA sequence
  source 1..20: mol_type = other DNA
aggttgaggtcagagagaca

SEQ ID NO: 49955 - DNA, 20 bp, synthetic construct
  misc_feature 1..20: note = CRISPR gRNA sequence
  source 1..20: mol_type = other DNA
aggtcagagagacacagtaa

SEQ ID NO: 49956 - DNA, 20 bp, synthetic construct
  misc_feature 1..20: note = CRISPR gRNA sequence
  source 1..20: mol_type = other DNA
ggtcagagagacacagtaat

SEQ ID NO: 49957 - DNA, 20 bp, synthetic construct
  misc_feature 1..20: note = CRISPR gRNA sequence
  source 1..20: mol_type = other DNA
acacagtaatgggctccaac

SEQ ID NO: 49958 - DNA, 20 bp, synthetic construct
  misc_feature 1..20: note = CRISPR gRNA sequence
  source 1..20: mol_type = other DNA
agtaatgggctccaaccagt

SEQ ID NO: 49959 - DNA, 20 bp, synthetic construct
  misc_feature 1..20: note = CRISPR gRNA sequence
  source 1..20: mol_type = other DNA
gctccaaccagtaagtgact

SEQ ID NO: 49960 - DNA, 20 bp, synthetic construct
  misc_feature 1..20: note = CRISPR gRNA sequence
  source 1..20: mol_type = other DNA
caaccagtaagtgactgagt

SEQ ID NO: 49961 - DNA, 20 bp, synthetic construct
  misc_feature 1..20: note = CRISPR gRNA sequence
  source 1..20: mol_type = other DNA
aaccagtaagtgactgagtt

SEQ ID NO: 49962 - DNA, 20 bp, synthetic construct
  misc_feature 1..20: note = CRISPR gRNA sequence
  source 1..20: mol_type = other DNA
actgagttgggatctgaaca

SEQ ID NO: 49963 - DNA, 20 bp, synthetic construct
  misc_feature 1..20: note = CRISPR gRNA sequence
  source 1..20: mol_type = other DNA
gttgggatctgaacatagct

SEQ ID NO: 49964 - DNA, 20 bp, synthetic construct
  misc_feature 1..20: note = CRISPR gRNA sequence
  source 1..20: mol_type = other DNA
gggatctgaacatagctgag

SEQ ID NO: 49965 - DNA, 20 bp, synthetic construct
  misc_feature 1..20: note = CRISPR gRNA sequence
  source 1..20: mol_type = other DNA
ggatctgaacatagctgagt

SEQ ID NO: 49966 - DNA, 20 bp, synthetic construct
  misc_feature 1..20: note = CRISPR gRNA sequence
  source 1..20: mol_type = other DNA
gatgctaaaacctttgctat

SEQ ID NO: 49967 - DNA, 20 bp, synthetic construct
  misc_feature 1..20: note = CRISPR gRNA sequence
  source 1..20: mol_type = other DNA
gtgtgtcattgtgttatttc

SEQ ID NO: 49968 - DNA, 20 bp, synthetic construct
  misc_feature 1..20: note = CRISPR gRNA sequence
  source 1..20: mol_type = other DNA
cattgtgttatttctggttg

SEQ ID NO: 49969 - DNA, 20 bp, synthetic construct
  misc_feature 1..20: note = CRISPR gRNA sequence
  source 1..20: mol_type = other DNA
ttgtgttatttctggttgaa

SEQ ID NO: 49970 - DNA, 20 bp, synthetic construct
  misc_feature 1..20: note = CRISPR gRNA sequence
  source 1..20: mol_type = other DNA
ataatgtgtgttactgcatc

SEQ ID NO: 49971 - DNA, 20 bp, synthetic construct
  misc_feature 1..20: note = CRISPR gRNA sequence
  source 1..20: mol_type = other DNA
taatgtgtgttactgcatct

SEQ ID NO: 49972 - DNA, 20 bp, synthetic construct
  misc_feature 1..20: note = CRISPR gRNA sequence
  source 1..20: mol_type = other DNA
aatgtgtgttactgcatctg

SEQ ID NO: 49973 - DNA, 20 bp, synthetic construct
  misc_feature 1..20: note = CRISPR gRNA sequence
  source 1..20: mol_type = other DNA
atgtgtgttactgcatctgg

SEQ ID NO: 49974 - DNA, 20 bp, synthetic construct
  misc_feature 1..20: note = CRISPR gRNA sequence
  source 1..20: mol_type = other DNA
tgtgtgttactgcatctggg

SEQ ID NO: 49975 - DNA, 20 bp, synthetic construct
  misc_feature 1..20: note = CRISPR gRNA sequence
  source 1..20: mol_type = other DNA
gcatctggggggccacttcc

SEQ ID NO: 49976 - DNA, 20 bp, synthetic construct
  misc_feature 1..20: note = CRISPR gRNA sequence
  source 1..20: mol_type = other DNA
gggggccacttccaagcaac

SEQ ID NO: 49977 - DNA, 20 bp, synthetic construct
  misc_feature 1..20: note = CRISPR gRNA sequence
  source 1..20: mol_type = other DNA
ccacttccaagcaaccagcg

SEQ ID NO: 49978 - DNA, 20 bp, synthetic construct
  misc_feature 1..20: note = CRISPR gRNA sequence
  source 1..20: mol_type = other DNA
aagcaaccagcgtggactcc

SEQ ID NO: 49979 - DNA, 20 bp, synthetic construct
  misc_feature 1..20: note = CRISPR gRNA sequence
  source 1..20: mol_type = other DNA
gactcccagccatgtctgcc

SEQ ID NO: 49980 - DNA, 20 bp, synthetic construct
  misc_feature 1..20: note = CRISPR gRNA sequence
  source 1..20: mol_type = other DNA
ccatgtctgcctggatccaa

SEQ ID NO: 49981 - DNA, 20 bp, synthetic construct
  misc_feature 1..20: note = CRISPR gRNA sequence
  source 1..20: mol_type = other DNA
atagccctttgttttgattc

SEQ ID NO: 49982 - DNA, 20 bp, synthetic construct
  misc_feature 1..20: note = CRISPR gRNA sequence
  source 1..20: mol_type = other DNA
tagccctttgttttgattct

SEQ ID NO: 49983 - DNA, 20 bp, synthetic construct
  misc_feature 1..20: note = CRISPR gRNA sequence
  source 1..20: mol_type = other DNA
agccctttgttttgattctg

SEQ ID NO: 49984 - DNA, 20 bp, synthetic construct
  misc_feature 1..20: note = CRISPR gRNA sequence
  source 1..20: mol_type = other DNA
gatgtcttcctctgacactg

SEQ ID NO: 49985 - DNA, 20 bp, synthetic construct
  misc_feature 1..20: note = CRISPR gRNA sequence
  source 1..20: mol_type = other DNA
ctgtggcttgactactgcac

SEQ ID NO: 49986 - DNA, 20 bp, synthetic construct
  misc_feature 1..20: note = CRISPR gRNA sequence
  source 1..20: mol_type = other DNA
cactagtcccaacaaatgtg

SEQ ID NO: 49987 - DNA, 20 bp, synthetic construct
  misc_feature 1..20: note = CRISPR gRNA sequence
  source 1..20: mol_type = other DNA
gtagcccctcacatatgccc

SEQ ID NO: 49988 - DNA, 20 bp, synthetic construct
  misc_feature 1..20: note = CRISPR gRNA sequence
  source 1..20: mol_type = other DNA
tagcccctcacatatgcccc

SEQ ID NO: 49989 - DNA, 20 bp, synthetic construct
  misc_feature 1..20: note = CRISPR gRNA sequence
  source 1..20: mol_type = other DNA
gcccctcacatatgccccag

SEQ ID NO: 49990 - DNA, 20 bp, synthetic construct
  misc_feature 1..20: note = CRISPR gRNA sequence
  source 1..20: mol_type = other DNA
cccaggagctcctgctaccc

SEQ ID NO: 49991 - DNA, 20 bp, synthetic construct
  misc_feature 1..20: note = CRISPR gRNA sequence
  source 1..20: mol_type = other DNA
ccaggagctcctgctaccct

SEQ ID NO: 49992 - DNA, 20 bp, synthetic construct
  misc_feature 1..20: note = CRISPR gRNA sequence
  source 1..20: mol_type = other DNA
caggagctcctgctaccctg

SEQ ID NO: 49993 - DNA, 20 bp, synthetic construct
  misc_feature 1..20: note = CRISPR gRNA sequence
  source 1..20: mol_type = other DNA
ctcctgctaccctggggaca

SEQ ID NO: 49994 - DNA, 20 bp, synthetic construct
  misc_feature 1..20: note = CRISPR gRNA sequence
  source 1..20: mol_type = other DNA
accctggggacatggaaaac

SEQ ID NO: 49995 - DNA, 20 bp, synthetic construct
  misc_feature 1..20: note = CRISPR gRNA sequence
  source 1..20: mol_type = other DNA
tggggacatggaaaactagc

SEQ ID NO: 49996 - DNA, 20 bp, synthetic construct
  misc_feature 1..20: note = CRISPR gRNA sequence
  source 1..20: mol_type = other DNA
tggaaaactagctggtgaca

SEQ ID NO: 49997 - DNA, 20 bp, synthetic construct
  misc_feature 1..20: note = CRISPR gRNA sequence
  source 1..20: mol_type = other DNA
gtgacacagctattacccca

SEQ ID NO: 49998 - DNA, 20 bp, synthetic construct
  misc_feature 1..20: note = CRISPR gRNA sequence
  source 1..20: mol_type = other DNA
tgacacagctattaccccac

SEQ ID NO: 49999 - DNA, 20 bp, synthetic construct
  misc_feature 1..20: note = CRISPR gRNA sequence
  source 1..20: mol_type = other DNA
cagctattaccccacaggat

SEQ ID NO: 50000 - DNA, 20 bp, synthetic construct
  misc_feature 1..20: note = CRISPR gRNA sequence
  source 1..20: mol_type = other DNA
agctattaccccacaggatg

SEQ ID NO: 50001 - DNA, 20 bp, synthetic construct
  misc_feature 1..20: note = CRISPR gRNA sequence
  source 1..20: mol_type = other DNA
gctattaccccacaggatga

SEQ ID NO: 50002 - DNA, 20 bp, synthetic construct
  misc_feature 1..20: note = CRISPR gRNA sequence
  source 1..20: mol_type = other DNA
attaccccacaggatgaggg

SEQ ID NO: 50003 - DNA, 20 bp, synthetic construct
  misc_feature 1..20: note = CRISPR gRNA sequence
  source 1..20: mol_type = other DNA
ttaccccacaggatgaggga

SEQ ID NO: 50004 - DNA, 20 bp, synthetic construct
  misc_feature 1..20: note = CRISPR gRNA sequence
  source 1..20: mol_type = other DNA
ccacaggatgagggaaggtc

SEQ ID NO: 50005 - DNA, 20 bp, synthetic construct
  misc_feature 1..20: note = CRISPR gRNA sequence
  source 1..20: mol_type = other DNA
cacaggatgagggaaggtca

SEQ ID NO: 50006 - DNA, 20 bp, synthetic construct
  misc_feature 1..20: note = CRISPR gRNA sequence
  source 1..20: mol_type = other DNA
gatgagggaaggtcaaggaa

SEQ ID NO: 50007 - DNA, 20 bp, synthetic construct
  misc_feature 1..20: note = CRISPR gRNA sequence
  source 1..20: mol_type = other DNA
aaaagtcccaatgcttatga

SEQ ID NO: 50008 - DNA, 20 bp, synthetic construct
  misc_feature 1..20: note = CRISPR gRNA sequence
  source 1..20: mol_type = other DNA
cccaatgcttatgaaagatg

SEQ ID NO: 50009 - DNA, 20 bp, synthetic construct
  misc_feature 1..20: note = CRISPR gRNA sequence
  source 1..20: mol_type = other DNA
atgaaagatgaagaattcca

SEQ ID NO: 50010 - DNA, 20 bp, synthetic construct
  misc_feature 1..20: note = CRISPR gRNA sequence
  source 1..20: mol_type = other DNA
tgaaagatgaagaattccaa

SEQ ID NO: 50011 - DNA, 20 bp, synthetic construct
  misc_feature 1..20: note = CRISPR gRNA sequence
  source 1..20: mol_type = other DNA
gaaagatgaagaattccaaa

SEQ ID NO: 50012 - DNA, 20 bp, synthetic construct
  misc_feature 1..20: note = CRISPR gRNA sequence
  source 1..20: mol_type = other DNA
aaagatgaagaattccaaag

SEQ ID NO: 50013 - DNA, 20 bp, synthetic construct
  misc_feature 1..20: note = CRISPR gRNA sequence
  source 1..20: mol_type = other DNA
ttccaaaggggcctcttctc

SEQ ID NO: 50014 - DNA, 20 bp, synthetic construct
  misc_feature 1..20: note = CRISPR gRNA sequence
  source 1..20: mol_type = other DNA
tctctggactcacctgattt

SEQ ID NO: 50015 - DNA, 20 bp, synthetic construct
  misc_feature 1..20: note = CRISPR gRNA sequence
  source 1..20: mol_type = other DNA
tgatttcagtgacactgcct

SEQ ID NO: 50016 - DNA, 20 bp, synthetic construct
  misc_feature 1..20: note = CRISPR gRNA sequence
  source 1..20: mol_type = other DNA
gatttcagtgacactgcctg

SEQ ID NO: 50017 - DNA, 20 bp, synthetic construct
  misc_feature 1..20: note = CRISPR gRNA sequence
  source 1..20: mol_type = other DNA
cagtgacactgcctgaggcc

SEQ ID NO: 50018 - DNA, 20 bp, synthetic construct
  misc_feature 1..20: note = CRISPR gRNA sequence
  source 1..20: mol_type = other DNA
agtgacactgcctgaggcct

SEQ ID NO: 50019 - DNA, 20 bp, synthetic construct
  misc_feature 1..20: note = CRISPR gRNA sequence
  source 1..20: mol_type = other DNA
cactgcctgaggcctgggcg

SEQ ID NO: 50020 - DNA, 20 bp, synthetic construct
  misc_feature 1..20: note = CRISPR gRNA sequence
  source 1..20: mol_type = other DNA
gcctgggcgcagacttctaa

SEQ ID NO: 50021 - DNA, 20 bp, synthetic construct
  misc_feature 1..20: note = CRISPR gRNA sequence
  source 1..20: mol_type = other DNA
cctgggcgcagacttctaac

SEQ ID NO: 50022 - DNA, 20 bp, synthetic construct
  misc_feature 1..20: note = CRISPR gRNA sequence
  source 1..20: mol_type = other DNA
ctgggcgcagacttctaaca

SEQ ID NO: 50023 - DNA, 20 bp, synthetic construct
  misc_feature 1..20: note = CRISPR gRNA sequence
  source 1..20: mol_type = other DNA
gggcgcagacttctaacagg

SEQ ID NO: 50024 - DNA, 20 bp, synthetic construct
  misc_feature 1..20: note = CRISPR gRNA sequence
  source 1..20: mol_type = other DNA
gcgcagacttctaacaggga

SEQ ID NO: 50025 - DNA, 20 bp, synthetic construct
  misc_feature 1..20: note = CRISPR gRNA sequence
  source 1..20: mol_type = other DNA
ttctaacagggagagaaccc

SEQ ID NO: 50026 - DNA, 20 bp, synthetic construct
  misc_feature 1..20: note = CRISPR gRNA sequence
  source 1..20: mol_type = other DNA
accctggctctgtccgccca

SEQ ID NO: 50027 - DNA, 20 bp, synthetic construct
  misc_feature 1..20: note = CRISPR gRNA sequence
  source 1..20: mol_type = other DNA
acggctcctgcaccctgtca

SEQ ID NO: 50028 - DNA, 20 bp, synthetic construct
  misc_feature 1..20: note = CRISPR gRNA sequence
  source 1..20: mol_type = other DNA
gctcctgcaccctgtcacag

SEQ ID NO: 50029 - DNA, 20 bp, synthetic construct
  misc_feature 1..20: note = CRISPR gRNA sequence
  source 1..20: mol_type = other DNA
ctcctgcaccctgtcacaga

SEQ ID NO: 50030 - DNA, 20 bp, synthetic construct
  misc_feature 1..20: note = CRISPR gRNA sequence
  source 1..20: mol_type = other DNA
tcctgcaccctgtcacagaa

SEQ ID NO: 50031 - DNA, 20 bp, synthetic construct
  misc_feature 1..20: note = CRISPR gRNA sequence
  source 1..20: mol_type = other DNA
cctgcaccctgtcacagaag

SEQ ID NO: 50032 - DNA, 20 bp, synthetic construct
  misc_feature 1..20: note = CRISPR gRNA sequence
  source 1..20: mol_type = other DNA
ccctgtcacagaaggggaca

SEQ ID NO: 50033 - DNA, 20 bp, synthetic construct
  misc_feature 1..20: note = CRISPR gRNA sequence
  source 1..20: mol_type = other DNA
tcacagaaggggacacagat

SEQ ID NO: 50034 - DNA, 20 bp, synthetic construct
  misc_feature 1..20: note = CRISPR gRNA sequence
  source 1..20: mol_type = other DNA
cacagaaggggacacagata

SEQ ID NO: 50035 - DNA, 20 bp, synthetic construct
  misc_feature 1..20: note = CRISPR gRNA sequence
  source 1..20: mol_type = other DNA
gacacagataaggccccccc

SEQ ID NO: 50036 - DNA, 20 bp, synthetic construct
  misc_feature 1..20: note = CRISPR gRNA sequence
  source 1..20: mol_type = other DNA
acacagataaggccccccca

SEQ ID NO: 50037 - DNA, 20 bp, synthetic construct
  misc_feature 1..20: note = CRISPR gRNA sequence
  source 1..20: mol_type = other DNA
agataaggcccccccaaggt

SEQ ID NO: 50038 - DNA, 20 bp, synthetic construct
  misc_feature 1..20: note = CRISPR gRNA sequence
  source 1..20: mol_type = other DNA
taaggcccccccaaggtgag

SEQ ID NO: 50039 - DNA, 20 bp, synthetic construct
  misc_feature 1..20: note = CRISPR gRNA sequence
  source 1..20: mol_type = other DNA
ggcccccccaaggtgagcag

SEQ ID NO: 50040 - DNA, 20 bp, synthetic construct
  misc_feature 1..20: note = CRISPR gRNA sequence
  source 1..20: mol_type = other DNA
caaggtgagcagcagacaat

SEQ ID NO: 50041 - DNA, 20 bp, synthetic construct
  misc_feature 1..20: note = CRISPR gRNA sequence
  source 1..20: mol_type = other DNA
cagacaatcagcacacatga

SEQ ID NO: 50042 - DNA, 20 bp, synthetic construct
  misc_feature 1..20: note = CRISPR gRNA sequence
  source 1..20: mol_type = other DNA
agacaatcagcacacatgac

SEQ ID NO: 50043 - DNA, 20 bp, synthetic construct
  misc_feature 1..20: note = CRISPR gRNA sequence
  source 1..20: mol_type = other DNA
gacaatcagcacacatgacg

SEQ ID NO: 50044 - DNA, 20 bp, synthetic construct
  misc_feature 1..20: note = CRISPR gRNA sequence
  source 1..20: mol_type = other DNA
atcagcacacatgacggggc

SEQ ID NO: 50045 - DNA, 20 bp, synthetic construct
  misc_feature 1..20: note = CRISPR gRNA sequence
  source 1..20: mol_type = other DNA
tcagcacacatgacggggcc

SEQ ID NO: 50046 - DNA, 20 bp, synthetic construct
  misc_feature 1..20: note = CRISPR gRNA sequence
  source 1..20: mol_type = other DNA
cagcacacatgacggggccg

SEQ ID NO: 50047 - DNA, 20 bp, synthetic construct
  misc_feature 1..20: note = CRISPR gRNA sequence
  source 1..20: mol_type = other DNA
agcacacatgacggggccgg

SEQ ID NO: 50048 - DNA, 20 bp, synthetic construct
  misc_feature 1..20: note = CRISPR gRNA sequence
  source 1..20: mol_type = other DNA
cacacatgacggggccgggg

SEQ ID NO: 50049 - DNA, 20 bp, synthetic construct
  misc_feature 1..20: note = CRISPR gRNA sequence
  source 1..20: mol_type = other DNA
acacatgacggggccggggg

SEQ ID NO: 50050 - DNA, 20 bp, synthetic construct
  misc_feature 1..20: note = CRISPR gRNA sequence
  source 1..20: mol_type = other DNA
acatgacggggccgggggag

SEQ ID NO: 50051 - DNA, 20 bp, synthetic construct
  misc_feature 1..20: note = CRISPR gRNA sequence
  source 1..20: mol_type = other DNA
ggggccgggggaggagtgtc

SEQ ID NO: 50052 - DNA, 20 bp, synthetic construct
  misc_feature 1..20: note = CRISPR gRNA sequence
  source 1..20: mol_type = other DNA
gggccgggggaggagtgtca

SEQ ID NO: 50053 - DNA, 20 bp, synthetic construct
  misc_feature 1..20: note = CRISPR gRNA sequence
  source 1..20: mol_type = other DNA
ggccgggggaggagtgtcaa

SEQ ID NO: 50054 - DNA, 20 bp, synthetic construct
  misc_feature 1..20: note = CRISPR gRNA sequence
  source 1..20: mol_type = other DNA
gccgggggaggagtgtcaag

SEQ ID NO: 50055 - DNA, 20 bp, synthetic construct
  misc_feature 1..20: note = CRISPR gRNA sequence
  source 1..20: mol_type = other DNA
ccgggggaggagtgtcaagg

SEQ ID NO: 50056 - DNA, 20 bp, synthetic construct
  misc_feature 1..20: note = CRISPR gRNA sequence
  source 1..20: mol_type = other DNA
cgggggaggagtgtcaaggg

SEQ ID NO: 50057 - DNA, 20 bp, synthetic construct
  misc_feature 1..20: note = CRISPR gRNA sequence
  source 1..20: mol_type = other DNA
gggggaggagtgtcaagggg

SEQ ID NO: 50058 - DNA, 20 bp, synthetic construct
  misc_feature 1..20: note = CRISPR gRNA sequence
  source 1..20: mol_type = other DNA
ggagtgtcaagggggggacc

SEQ ID NO: 50059 - DNA, 20 bp, synthetic construct
  misc_feature 1..20: note = CRISPR gRNA sequence
  source 1..20: mol_type = other DNA
agtgtcaagggggggaccta

SEQ ID NO: 50060 - DNA, 20 bp, synthetic construct
  misc_feature 1..20: note = CRISPR gRNA sequence
  source 1..20: mol_type = other DNA
gtgtcaagggggggacctag

SEQ ID NO: 50061 - DNA, 20 bp, synthetic construct
  misc_feature 1..20: note = CRISPR gRNA sequence
  source 1..20: mol_type = other DNA
gggggacctagaggcttttt

SEQ ID NO: 50062 - DNA, 20 bp, synthetic construct
  misc_feature 1..20: note = CRISPR gRNA sequence
  source 1..20: mol_type = other DNA
ttaaaactataaaattatac

SEQ ID NO: 50063 - DNA, 20 bp, synthetic construct
  misc_feature 1..20: note = CRISPR gRNA sequence
  source 1..20: mol_type = other DNA
aaactataaaattatacaag

SEQ ID NO: 50064 - DNA, 20 bp, synthetic construct
  misc_feature 1..20: note = CRISPR gRNA sequence
  source 1..20: mol_type = other DNA
aactataaaattatacaagt

SEQ ID NO: 50065 - DNA, 20 bp, synthetic construct
  misc_feature 1..20: note = CRISPR gRNA sequence
  source 1..20: mol_type = other DNA
aagtaggcatcaatctaaaa

SEQ ID NO: 50066 - DNA, 20 bp, synthetic construct
  misc_feature 1..20: note = CRISPR gRNA sequence
  source 1..20: mol_type = other DNA
agtaggcatcaatctaaaaa

SEQ ID NO: 50067 - DNA, 20 bp, synthetic construct
  misc_feature 1..20: note = CRISPR gRNA sequence
  source 1..20: mol_type = other DNA
tattgttgtgacaatccaaa

SEQ ID NO: 50068 - DNA, 20 bp, synthetic construct
  misc_feature 1..20: note = CRISPR gRNA sequence
  source 1..20: mol_type = other DNA
tcttatcttattttattttt

SEQ ID NO: 50069 - DNA, 20 bp, synthetic construct
  misc_feature 1..20: note = CRISPR gRNA sequence
  source 1..20: mol_type = other DNA
atcttattttatttttgaga

SEQ ID NO: 50070 - DNA, 20 bp, synthetic construct
  misc_feature 1..20: note = CRISPR gRNA sequence
  source 1..20: mol_type = other DNA
cttattttatttttgagaca

SEQ ID NO: 50071 - DNA, 20 bp, synthetic construct
  misc_feature 1..20: note = CRISPR gRNA sequence
  source 1..20: mol_type = other DNA
agagttttgctcttgttgcc

SEQ ID NO: 50072 - DNA, 20 bp, synthetic construct
  misc_feature 1..20: note = CRISPR gRNA sequence
  source 1..20: mol_type = other DNA
tttgctcttgttgcccagac

SEQ ID NO: 50073 - DNA, 20 bp, synthetic construct
  misc_feature 1..20: note = CRISPR gRNA sequence
  source 1..20: mol_type = other DNA
tgctcttgttgcccagactg

SEQ ID NO: 50074 - DNA, 20 bp, synthetic construct
  misc_feature 1..20: note = CRISPR gRNA sequence
  source 1..20: mol_type = other DNA
ttgcccagactggagtgcaa

SEQ ID NO: 50075 - DNA, 20 bp, synthetic construct
  misc_feature 1..20: note = CRISPR gRNA sequence
  source 1..20: mol_type = other DNA
ggagtgcaatggcatgatct

SEQ ID NO: 50076 - DNA, 20 bp, synthetic construct
  misc_feature 1..20: note = CRISPR gRNA sequence
  source 1..20: mol_type = other DNA
tcactgcaacctctgcctcc

SEQ ID NO: 50077 - DNA, 20 bp, synthetic construct
  misc_feature 1..20: note = CRISPR gRNA sequence
  source 1..20: mol_type = other DNA
cactgcaacctctgcctcct

SEQ ID NO: 50078 - DNA, 20 bp, synthetic construct
  misc_feature 1..20: note = CRISPR gRNA sequence
  source 1..20: mol_type = other DNA
aacctctgcctcctgggttc

SEQ ID NO: 50079 - DNA, 20 bp, synthetic construct
  misc_feature 1..20: note = CRISPR gRNA sequence
  source 1..20: mol_type = other DNA
ttcaagcgattctcctgcct

SEQ ID NO: 50080 - DNA, 20 bp, synthetic construct
  misc_feature 1..20: note = CRISPR gRNA sequence
  source 1..20: mol_type = other DNA
ttctcctgcctcagcctccc

SEQ ID NO: 50081 - DNA, 20 bp, synthetic construct
  misc_feature 1..20: note = CRISPR gRNA sequence
  source 1..20: mol_type = other DNA
tcctgcctcagcctcccaag

SEQ ID NO: 50082 - DNA, 20 bp, synthetic construct
  misc_feature 1..20: note = CRISPR gRNA sequence
  source 1..20: mol_type = other DNA
gcctcagcctcccaagtagc

SEQ ID NO: 50083 - DNA, 20 bp, synthetic construct
  misc_feature 1..20: note = CRISPR gRNA sequence
  source 1..20: mol_type = other DNA
cctcagcctcccaagtagct

SEQ ID NO: 50084 - DNA, 20 bp, synthetic construct
  misc_feature 1..20: note = CRISPR gRNA sequence
  source 1..20: mol_type = other DNA
ctcccaagtagctgggatta

SEQ ID NO: 50085 - DNA, 20 bp, synthetic construct
  misc_feature 1..20: note = CRISPR gRNA sequence
  source 1..20: mol_type = other DNA
tcccaagtagctgggattac

SEQ ID NO: 50086 - DNA, 20 bp, synthetic construct
  misc_feature 1..20: note = CRISPR gRNA sequence
  source 1..20: mol_type = other DNA
caggcatgcgccaccacgcc

SEQ ID NO: 50087 - DNA, 20 bp, synthetic construct
  misc_feature 1..20: note = CRISPR gRNA sequence
  source 1..20: mol_type = other DNA
ctggctaatttttgtatttt

SEQ ID NO: 50088 - DNA, 20 bp, synthetic construct
  misc_feature 1..20: note = CRISPR gRNA sequence
  source 1..20: mol_type = other DNA
gctaatttttgtatttttag

SEQ ID NO: 50089 - DNA, 20 bp, synthetic construct
  misc_feature 1..20: note = CRISPR gRNA sequence
  source 1..20: mol_type = other DNA
taatttttgtatttttagta

SEQ ID NO: 50090 - DNA, 20 bp, synthetic construct
  misc_feature 1..20: note = CRISPR gRNA sequence
  source 1..20: mol_type = other DNA
ttttgtatttttagtagaga

SEQ ID NO: 50091 - DNA, 20 bp, synthetic construct
  misc_feature 1..20: note = CRISPR gRNA sequence
  source 1..20: mol_type = other DNA
tttgtatttttagtagagat

SEQ ID NO: 50092 - DNA, 20 bp, synthetic construct
  misc_feature 1..20: note = CRISPR gRNA sequence
  source 1..20: mol_type = other DNA
ttgtatttttagtagagatg

SEQ ID NO: 50093 - DNA, 20 bp, synthetic construct
  misc_feature 1..20: note = CRISPR gRNA sequence
  source 1..20: mol_type = other DNA
gagatggggtttcaccatgt

SEQ ID NO: 50094 - DNA, 20 bp, synthetic construct
  misc_feature 1..20: note = CRISPR gRNA sequence
  source 1..20: mol_type = other DNA
tggggtttcaccatgttggt

SEQ ID NO: 50095 - DNA, 20 bp, synthetic construct
  misc_feature 1..20: note = CRISPR gRNA sequence
  source 1..20: mol_type = other DNA
ggggtttcaccatgttggtc

SEQ ID NO: 50096 - DNA, 20 bp, synthetic construct
  misc_feature 1..20: note = CRISPR gRNA sequence
  source 1..20: mol_type = other DNA
tttcaccatgttggtcaggc

SEQ ID NO: 50097 - DNA, 20 bp, synthetic construct
  misc_feature 1..20: note = CRISPR gRNA sequence
  source 1..20: mol_type = other DNA
ggtcttgaactcctgacctc

SEQ ID NO: 50098 - DNA, 20 bp, synthetic construct
  misc_feature 1..20: note = CRISPR gRNA sequence
  source 1..20: mol_type = other DNA
ctcaagtgatccacctgcct

SEQ ID NO: 50099 - DNA, 20 bp, synthetic construct
  misc_feature 1..20: note = CRISPR gRNA sequence
  source 1..20: mol_type = other DNA
ccacctgcctcggcctccca

SEQ ID NO: 50100 - DNA, 20 bp, synthetic construct
  misc_feature 1..20: note = CRISPR gRNA sequence
  source 1..20: mol_type = other DNA
gcctcggcctcccaaagtgc

SEQ ID NO: 50101 - DNA, 20 bp, synthetic construct
  misc_feature 1..20: note = CRISPR gRNA sequence
  source 1..20: mol_type = other DNA
cctcggcctcccaaagtgct

SEQ ID NO: 50102 - DNA, 20 bp, synthetic construct
  misc_feature 1..20: note = CRISPR gRNA sequence
  source 1..20: mol_type = other DNA
ctcccaaagtgctgggatta

SEQ ID NO: 50103 - DNA, 20 bp, synthetic construct
  misc_feature 1..20: note = CRISPR gRNA sequence
  source 1..20: mol_type = other DNA
tcccaaagtgctgggattac

SEQ ID NO: 50104 - DNA, 20 bp, synthetic construct
  misc_feature 1..20: note = CRISPR gRNA sequence
  source 1..20: mol_type = other DNA
agtgctgggattacaggcgt

SEQ ID NO: 50105 - DNA, 20 bp, synthetic construct
  misc_feature 1..20: note = CRISPR gRNA sequence
  source 1..20: mol_type = other DNA
acaggcgtgagccactgcac

SEQ ID NO: 50106 - DNA, 20 bp, synthetic construct
  misc_feature 1..20: note = CRISPR gRNA sequence
  source 1..20: mol_type = other DNA
caggcgtgagccactgcact

SEQ ID NO: 50107 - DNA, 20 bp, synthetic construct
  misc_feature 1..20: note = CRISPR gRNA sequence
  source 1..20: mol_type = other DNA
cactgggccactgatatttt

SEQ ID NO: 50108 - DNA, 20 bp, synthetic construct
  misc_feature 1..20: note = CRISPR gRNA sequence
  source 1..20: mol_type = other DNA
ccactgatatttttagattt

SEQ ID NO: 50109 - DNA, 20 bp, synthetic construct
  misc_feature 1..20: note = CRISPR gRNA sequence
  source 1..20: mol_type = other DNA
gatatttttagatttaagaa

SEQ ID NO: 50110 - DNA, 20 bp, synthetic construct
  misc_feature 1..20: note = CRISPR gRNA sequence
  source 1..20: mol_type = other DNA
tcacataatgttacatcaca

SEQ ID NO: 50111 - DNA, 20 bp, synthetic construct
  misc_feature 1..20: note = CRISPR gRNA sequence
  source 1..20: mol_type = other DNA
cacataatgttacatcacaa

SEQ ID NO: 50112 - DNA, 20 bp, synthetic construct
  misc_feature 1..20: note = CRISPR gRNA sequence
  source 1..20: mol_type = other DNA
taatgttacatcacaaaggt

SEQ ID NO: 50113 - DNA, 20 bp, synthetic construct
  misc_feature 1..20: note = CRISPR gRNA sequence
  source 1..20: mol_type = other DNA
aatgttacatcacaaaggta

SEQ ID NO: 50114 - DNA, 20 bp, synthetic construct
  misc_feature 1..20: note = CRISPR gRNA sequence
  source 1..20: mol_type = other DNA
ccaattttgcatttcaaaaa

SEQ ID NO: 50115 - DNA, 20 bp, synthetic construct
  misc_feature 1..20: note = CRISPR gRNA sequence
  source 1..20: mol_type = other DNA
caattttgcatttcaaaaaa

SEQ ID NO: 50116 - DNA, 20 bp, synthetic construct
  misc_feature 1..20: note = CRISPR gRNA sequence
  source 1..20: mol_type = other DNA
tttgcatttcaaaaaaagga

SEQ ID NO: 50117 - DNA, 20 bp, synthetic construct
  misc_feature 1..20: note = CRISPR gRNA sequence
  source 1..20: mol_type = other DNA
ttcaaaaaaaggaaagtatt

SEQ ID NO: 50118 - DNA, 20 bp, synthetic construct
  misc_feature 1..20: note = CRISPR gRNA sequence
  source 1..20: mol_type = other DNA
caaaaaaaggaaagtatttg

SEQ ID NO: 50119 - DNA, 20 bp, synthetic construct
  misc_feature 1..20: note = CRISPR gRNA sequence
  source 1..20: mol_type = other DNA
ggaaagtatttggagaaaaa

SEQ ID NO: 50120 - DNA, 20 bp, synthetic construct
  misc_feature 1..20: note = CRISPR gRNA sequence
  source 1..20: mol_type = other DNA
gtatttggagaaaaaaagtg

SEQ ID NO: 50121 - DNA, 20 bp, synthetic construct
  misc_feature 1..20: note = CRISPR gRNA sequence
  source 1..20: mol_type = other DNA
ttggagaaaaaaagtgtgga

SEQ ID NO: 50122 - DNA, 20 bp, synthetic construct
  misc_feature 1..20: note = CRISPR gRNA sequence
  source 1..20: mol_type = other DNA
aaaaaaagtgtggaaagaaa

SEQ ID NO: 50123 - DNA, 20 bp, synthetic construct
  misc_feature 1..20: note = CRISPR gRNA sequence
  source 1..20: mol_type = other DNA
aaaaaagtgtggaaagaaac

SEQ ID NO: 50124 - DNA, 20 bp, synthetic construct
  misc_feature 1..20: note = CRISPR gRNA sequence
  source 1..20: mol_type = other DNA
aaaaagtgtggaaagaaaca

SEQ ID NO: 50125 - DNA, 20 bp, synthetic construct
  misc_feature 1..20: note = CRISPR gRNA sequence
  source 1..20: mol_type = other DNA
aaagtgtggaaagaaacagg

SEQ ID NO: 50126 - DNA, 20 bp, synthetic construct
  misc_feature 1..20: note = CRISPR gRNA sequence
  source 1..20: mol_type = other DNA
agtgtggaaagaaacaggga

SEQ ID NO: 50127 - DNA, 20 bp, synthetic construct
  misc_feature 1..20: note = CRISPR gRNA sequence
  source 1..20: mol_type = other DNA
tgtggaaagaaacagggaga

SEQ ID NO: 50128 - DNA, 20 bp, synthetic construct
  misc_feature 1..20: note = CRISPR gRNA sequence
  source 1..20: mol_type = other DNA
gaaacagggagagagatgtg

SEQ ID NO: 50129 - DNA, 20 bp, synthetic construct
  misc_feature 1..20: note = CRISPR gRNA sequence
  source 1..20: mol_type = other DNA
agagagatgtgtggaaaaca

SEQ ID NO: 50130 - DNA, 20 bp, synthetic construct
  misc_feature 1..20: note = CRISPR gRNA sequence
  source 1..20: mol_type = other DNA
gagagatgtgtggaaaacat

SEQ ID NO: 50131 - DNA, 20 bp, synthetic construct
  misc_feature 1..20: note = CRISPR gRNA sequence
  source 1..20: mol_type = other DNA
gaaaatatattaaatgttca

SEQ ID NO: 50132 - DNA, 20 bp, synthetic construct
  misc_feature 1..20: note = CRISPR gRNA sequence
  source 1..20: mol_type = other DNA
aatatattaaatgttcatgg

SEQ ID NO: 50133 - DNA, 20 bp, synthetic construct
  misc_feature 1..20: note = CRISPR gRNA sequence
  source 1..20: mol_type = other DNA
aatgttcatggtggttgttt

SEQ ID NO: 50134 - DNA, 20 bp, synthetic construct
  misc_feature 1..20: note = CRISPR gRNA sequence
  source 1..20: mol_type = other DNA
atggtggttgtttaagatga

SEQ ID NO: 50135 - DNA, 20 bp, synthetic construct
  misc_feature 1..20: note = CRISPR gRNA sequence
  source 1..20: mol_type = other DNA
taagatgatagaattctcat

SEQ ID NO: 50136 - DNA, 20 bp, synthetic construct
  misc_feature 1..20: note = CRISPR gRNA sequence
  source 1..20: mol_type = other DNA
atgcatgtgcattaatttga

SEQ ID NO: 50137 - DNA, 20 bp, synthetic construct
  misc_feature 1..20: note = CRISPR gRNA sequence
  source 1..20: mol_type = other DNA
catgtgcattaatttgaaag

SEQ ID NO: 50138 - DNA, 20 bp, synthetic construct
  misc_feature 1..20: note = CRISPR gRNA sequence
  source 1..20: mol_type = other DNA
atgtgcattaatttgaaagt

SEQ ID NO: 50139 - DNA, 20 bp, synthetic construct
  misc_feature 1..20: note = CRISPR gRNA sequence
  source 1..20: mol_type = other DNA
ttaatttgaaagtaggaaaa

SEQ ID NO: 50140 - DNA, 20 bp, synthetic construct
  misc_feature 1..20: note = CRISPR gRNA sequence
  source 1..20: mol_type = other DNA
aatttgaaagtaggaaaaaa

SEQ ID NO: 50141 - DNA, 20 bp, synthetic construct
  misc_feature 1..20: note = CRISPR gRNA sequence
  source 1..20: mol_type = other DNA
aagtaggaaaaaagagaatt

SEQ ID NO: 50142 - DNA, 20 bp, synthetic construct
  misc_feature 1..20: note = CRISPR gRNA sequence
  source 1..20: mol_type = other DNA
agtcaaatattactgcttta

SEQ ID NO: 50143 - DNA, 20 bp, synthetic construct
  misc_feature 1..20: note = CRISPR gRNA sequence
  source 1..20: mol_type = other DNA
aaagttatgctgaattttta

SEQ ID NO: 50144 - DNA, 20 bp, synthetic construct
  misc_feature 1..20: note = CRISPR gRNA sequence
  source 1..20: mol_type = other DNA
ctattttctttatgtatttc

SEQ ID NO: 50145 - DNA, 20 bp, synthetic construct
  misc_feature 1..20: note = CRISPR gRNA sequence
  source 1..20: mol_type = other DNA
ttttttatttttattttttg

SEQ ID NO: 50146 - DNA, 20 bp, synthetic construct
  misc_feature 1..20: note = CRISPR gRNA sequence
  source 1..20: mol_type = other DNA
atttttattttttgtagata

SEQ ID NO: 50147 - DNA, 20 bp, synthetic construct
  misc_feature 1..20: note = CRISPR gRNA sequence
  source 1..20: mol_type = other DNA
tttttattttttgtagatat

SEQ ID NO: 50148 - DNA, 20 bp, synthetic construct
  misc_feature 1..20: note = CRISPR gRNA sequence
  source 1..20: mol_type = other DNA
ttttattttttgtagatatg

SEQ ID NO: 50149 - DNA, 20 bp, synthetic construct
  misc_feature 1..20: note = CRISPR gRNA sequence
  source 1..20: mol_type = other DNA
tggggttttgccatgttgtc

SEQ ID NO: 50150 - DNA, 20 bp, synthetic construct
  misc_feature 1..20: note = CRISPR gRNA sequence
  source 1..20: mol_type = other DNA
ggggttttgccatgttgtcc

SEQ ID NO: 50151 - DNA, 20 bp, synthetic construct
  misc_feature 1..20: note = CRISPR gRNA sequence
  source 1..20: mol_type = other DNA
ttttgccatgttgtccaggc

SEQ ID NO: 50152 - DNA, 20 bp, synthetic construct
  misc_feature 1..20: note = CRISPR gRNA sequence
  source 1..20: mol_type = other DNA
caggctggtcttgaacgcct

SEQ ID NO: 50153 - DNA, 20 bp, synthetic construct
  misc_feature 1..20: note = CRISPR gRNA sequence
  source 1..20: mol_type = other DNA
ctcaaacaatctgcccacct

SEQ ID NO: 50154 - DNA, 20 bp, synthetic construct
  misc_feature 1..20: note = CRISPR gRNA sequence
  source 1..20: mol_type = other DNA
ctgcccacctcagcctccca

SEQ ID NO: 50155 - DNA, 20 bp, synthetic construct
  misc_feature 1..20: note = CRISPR gRNA sequence
  source 1..20: mol_type = other DNA
acctcagcctcccaaagtgt

SEQ ID NO: 50156 - DNA, 20 bp, synthetic construct
  misc_feature 1..20: note = CRISPR gRNA sequence
  source 1..20: mol_type = other DNA
cctcagcctcccaaagtgtt

SEQ ID NO: 50157 - DNA, 20 bp, synthetic construct
  misc_feature 1..20: note = CRISPR gRNA sequence
  source 1..20: mol_type = other DNA
ctcccaaagtgttgggatta

SEQ ID NO: 50158 - DNA, 20 bp, synthetic construct
  misc_feature 1..20: note = CRISPR gRNA sequence
  source 1..20: mol_type = other DNA
tcccaaagtgttgggattac

SEQ ID NO: 50159 - DNA, 20 bp, synthetic construct
  misc_feature 1..20: note = CRISPR gRNA sequence
  source 1..20: mol_type = other DNA
cccccaaccaatattatttt

SEQ ID NO: 50160 - DNA, 20 bp, synthetic construct
  misc_feature 1..20: note = CRISPR gRNA sequence
  source 1..20: mol_type = other DNA
accaatattatttttagact

SEQ ID NO: 50161 - DNA, 20 bp, synthetic construct
  misc_feature 1..20: note = CRISPR gRNA sequence
  source 1..20: mol_type = other DNA
tattatttttagactaagaa

SEQ ID NO: 50162 - DNA, 20 bp, synthetic construct
  misc_feature 1..20: note = CRISPR gRNA sequence
  source 1..20: mol_type = other DNA
tttatttgaaaatgttattt

SEQ ID NO: 50163 - DNA, 20 bp, synthetic construct
  misc_feature 1..20: note = CRISPR gRNA sequence
  source 1..20: mol_type = other DNA
tttgaaaatgttattttggc

SEQ ID NO: 50164 - DNA, 20 bp, synthetic construct
  misc_feature 1..20: note = CRISPR gRNA sequence
  source 1..20: mol_type = other DNA
ttgaaaatgttattttggct

SEQ ID NO: 50165 - DNA, 20 bp, synthetic construct
  misc_feature 1..20: note = CRISPR gRNA sequence
  source 1..20: mol_type = other DNA
aatgttattttggctgggtg

SEQ ID NO: 50166 - DNA, 20 bp, synthetic construct
  misc_feature 1..20: note = CRISPR gRNA sequence
  source 1..20: mol_type = other DNA
gttattttggctgggtgcag

SEQ ID NO: 50167 - DNA, 20 bp, synthetic construct
  misc_feature 1..20: note = CRISPR gRNA sequence
  source 1..20: mol_type = other DNA
gtggctcacacctgtaatcc

SEQ ID NO: 50168 - DNA, 20 bp, synthetic construct
  misc_feature 1..20: note = CRISPR gRNA sequence
  source 1..20: mol_type = other DNA
cacctgtaatcccagcactt

SEQ ID NO: 50169 - DNA, 20 bp, synthetic construct
  misc_feature 1..20: note = CRISPR gRNA sequence
  source 1..20: mol_type = other DNA
acctgtaatcccagcacttt

SEQ ID NO: 50170 - DNA, 20 bp, synthetic construct
  misc_feature 1..20: note = CRISPR gRNA sequence
  source 1..20: mol_type = other DNA
ctgtaatcccagcactttgg

SEQ ID NO: 50171 - DNA, 20 bp, synthetic construct
  misc_feature 1..20: note = CRISPR gRNA sequence
  source 1..20: mol_type = other DNA
tgtaatcccagcactttggg

SEQ ID NO: 50172 - DNA, 20 bp, synthetic construct
  misc_feature 1..20: note = CRISPR gRNA sequence
  source 1..20: mol_type = other DNA
tcccagcactttgggaggct

SEQ ID NO: 50173 - DNA, 20 bp, synthetic construct
  misc_feature 1..20: note = CRISPR gRNA sequence
  source 1..20: mol_type = other DNA
cccagcactttgggaggctg

SEQ ID NO: 50174 - DNA, 20 bp, synthetic construct
  misc_feature 1..20: note = CRISPR gRNA sequence
  source 1..20: mol_type = other DNA
agcactttgggaggctgagg

SEQ ID NO: 50175 - DNA, 20 bp, synthetic construct
  misc_feature 1..20: note = CRISPR gRNA sequence
  source 1..20: mol_type = other DNA
gcactttgggaggctgaggt

SEQ ID NO: 50176 - DNA, 20 bp, synthetic construct
  misc_feature 1..20: note = CRISPR gRNA sequence
  source 1..20: mol_type = other DNA
cactttgggaggctgaggtg

SEQ ID NO: 50177 - DNA, 20 bp, synthetic construct
  misc_feature 1..20: note = CRISPR gRNA sequence
  source 1..20: mol_type = other DNA
actttgggaggctgaggtgg

SEQ ID NO: 50178 - DNA, 20 bp, synthetic construct
  misc_feature 1..20: note = CRISPR gRNA sequence
  source 1..20: mol_type = other DNA
ctttgggaggctgaggtggg

SEQ ID NO: 50179 - DNA, 20 bp, synthetic construct
  misc_feature 1..20: note = CRISPR gRNA sequence
  source 1..20: mol_type = other DNA
ggctgaggtggggggatcac

SEQ ID NO: 50180 - DNA, 20 bp, synthetic construct
  misc_feature 1..20: note = CRISPR gRNA sequence
  source 1..20: mol_type = other DNA
gctgaggtggggggatcacg

SEQ ID NO: 50181 - DNA, 20 bp, synthetic construct
  misc_feature 1..20: note = CRISPR gRNA sequence
  source 1..20: mol_type = other DNA
aggtggggggatcacgaggt

SEQ ID NO: 50182 - DNA, 20 bp, synthetic construct
  misc_feature 1..20: note = CRISPR gRNA sequence
  source 1..20: mol_type = other DNA
ggtggggggatcacgaggtc

SEQ ID NO: 50183 - DNA, 20 bp, synthetic construct
  misc_feature 1..20: note = CRISPR gRNA sequence
  source 1..20: mol_type = other DNA
tggggggatcacgaggtcag

SEQ ID NO: 50184 - DNA, 20 bp, synthetic construct
  misc_feature 1..20: note = CRISPR gRNA sequence
  source 1..20: mol_type = other DNA
gatcacgaggtcaggagatc

SEQ ID NO: 50185 - DNA, 20 bp, synthetic construct
  misc_feature 1..20: note = CRISPR gRNA sequence
  source 1..20: mol_type = other DNA
tcaggagatcgagaccatcc

SEQ ID NO: 50186 - DNA, 20 bp, synthetic construct
  misc_feature 1..20: note = CRISPR gRNA sequence
  source 1..20: mol_type = other DNA
cgagaccatcctggctaaca

SEQ ID NO: 50187 - DNA, 20 bp, synthetic construct
  misc_feature 1..20: note = CRISPR gRNA sequence
  source 1..20: mol_type = other DNA
ctactaaaaatacaaaacat

SEQ ID NO: 50188 - DNA, 20 bp, synthetic construct
  misc_feature 1..20: note = CRISPR gRNA sequence
  source 1..20: mol_type = other DNA
taaaaatacaaaacattagt

SEQ ID NO: 50189 - DNA, 20 bp, synthetic construct
  misc_feature 1..20: note = CRISPR gRNA sequence
  source 1..20: mol_type = other DNA
aaaaatacaaaacattagtc

SEQ ID NO: 50190 - DNA, 20 bp, synthetic construct
  misc_feature 1..20: note = CRISPR gRNA sequence
  source 1..20: mol_type = other DNA
tacaaaacattagtcaggcg

SEQ ID NO: 50191 - DNA, 20 bp, synthetic construct
  misc_feature 1..20: note = CRISPR gRNA sequence
  source 1..20: mol_type = other DNA
aaaacattagtcaggcgtgg

SEQ ID NO: 50192 - DNA, 20 bp, synthetic construct
  misc_feature 1..20: note = CRISPR gRNA sequence
  source 1..20: mol_type = other DNA
acattagtcaggcgtggtgg

SEQ ID NO: 50193 - DNA, 20 bp, synthetic construct
  misc_feature 1..20: note = CRISPR gRNA sequence
  source 1..20: mol_type = other DNA
cattagtcaggcgtggtggc

SEQ ID NO: 50194 - DNA, 20 bp, synthetic construct
  misc_feature 1..20: note = CRISPR gRNA sequence
  source 1..20: mol_type = other DNA
ggcgtggtggcgggcacctg

SEQ ID NO: 50195 - DNA, 20 bp, synthetic construct
  misc_feature 1..20: note = CRISPR gRNA sequence
  source 1..20: mol_type = other DNA
gtggcgggcacctgtagtcc

SEQ ID NO: 50196 - DNA, 20 bp, synthetic construct
  misc_feature 1..20: note = CRISPR gRNA sequence
  source 1..20: mol_type = other DNA
acctgtagtcccagctactc

SEQ ID NO: 50197 - DNA, 20 bp, synthetic construct
  misc_feature 1..20: note = CRISPR gRNA sequence
  source 1..20: mol_type = other DNA
ctgtagtcccagctactctg

SEQ ID NO: 50198 - DNA, 20 bp, synthetic construct
  misc_feature 1..20: note = CRISPR gRNA sequence
  source 1..20: mol_type = other DNA
tgtagtcccagctactctgg

SEQ ID NO: 50199 - DNA, 20 bp, synthetic construct
  misc_feature 1..20: note = CRISPR gRNA sequence
  source 1..20: mol_type = other DNA
tcccagctactctggaggct

SEQ ID NO: 50200 - DNA, 20 bp, synthetic construct
  misc_feature 1..20: note = CRISPR gRNA sequence
  source 1..20: mol_type = other DNA
cccagctactctggaggctg

SEQ ID NO: 50201 - DNA, 20 bp, synthetic construct
  misc_feature 1..20: note = CRISPR gRNA sequence
  source 1..20: mol_type = other DNA
agctactctggaggctgagg

SEQ ID NO: 50202 - DNA, 20 bp, synthetic construct
  misc_feature 1..20: note = CRISPR gRNA sequence
  source 1..20: mol_type = other DNA
gctactctggaggctgaggc

SEQ ID NO: 50203 - DNA, 20 bp, synthetic construct
  misc_feature 1..20: note = CRISPR gRNA sequence
  source 1..20: mol_type = other DNA
tactctggaggctgaggcag

SEQ ID NO: 50204 - DNA, 20 bp, synthetic construct
  misc_feature 1..20: note = CRISPR gRNA sequence
  source 1..20: mol_type = other DNA
tggaggctgaggcaggagaa

SEQ ID NO: 50205 - DNA, 20 bp, synthetic construct
  misc_feature 1..20: note = CRISPR gRNA sequence
  source 1..20: mol_type = other DNA
gcaggagaatggcgtgaacc

SEQ ID NO: 50206 - DNA, 20 bp, synthetic construct
  misc_feature 1..20: note = CRISPR gRNA sequence
  source 1..20: mol_type = other DNA
caggagaatggcgtgaaccc

SEQ ID NO: 50207 - DNA, 20 bp, synthetic construct
  misc_feature 1..20: note = CRISPR gRNA sequence
  source 1..20: mol_type = other DNA
ggagaatggcgtgaacccag

SEQ ID NO: 50208 - DNA, 20 bp, synthetic construct
  misc_feature 1..20: note = CRISPR gRNA sequence
  source 1..20: mol_type = other DNA
gagaatggcgtgaacccagg

SEQ ID NO: 50209 - DNA, 20 bp, synthetic construct
  misc_feature 1..20: note = CRISPR gRNA sequence
  source 1..20: mol_type = other DNA
aatggcgtgaacccaggagg

SEQ ID NO: 50210 - DNA, 20 bp, synthetic construct
  misc_feature 1..20: note = CRISPR gRNA sequence
  source 1..20: mol_type = other DNA
tggcgtgaacccaggaggcg

SEQ ID NO: 50211 - DNA, 20 bp, synthetic construct
  misc_feature 1..20: note = CRISPR gRNA sequence
  source 1..20: mol_type = other DNA
aacccaggaggcggagcttg

SEQ ID NO: 50212 - DNA, 20 bp, synthetic construct
  misc_feature 1..20: note = CRISPR gRNA sequence
  source 1..20: mol_type = other DNA
caggaggcggagcttgcagt

SEQ ID NO: 50213 - DNA, 20 bp, synthetic construct
  misc_feature 1..20: note = CRISPR gRNA sequence
  source 1..20: mol_type = other DNA
ggcggagcttgcagtgagcc

SEQ ID NO: 50214 - DNA, 20 bp, synthetic construct
  misc_feature 1..20: note = CRISPR gRNA sequence
  source 1..20: mol_type = other DNA
cgcaccactgcactccaacc

SEQ ID NO: 50215 - DNA, 20 bp, synthetic construct
  misc_feature 1..20: note = CRISPR gRNA sequence
  source 1..20: mol_type = other DNA
gcaccactgcactccaacct

SEQ ID NO: 50216 - DNA, 20 bp, synthetic construct
  misc_feature 1..20: note = CRISPR gRNA sequence
  source 1..20: mol_type = other DNA
ctgcactccaacctgggcaa

SEQ ID NO: 50217 - DNA, 20 bp, synthetic construct
  misc_feature 1..20: note = CRISPR gRNA sequence
  source 1..20: mol_type = other DNA
gcactccaacctgggcaaca

SEQ ID NO: 50218 - DNA, 20 bp, synthetic construct
  misc_feature 1..20: note = CRISPR gRNA sequence
  source 1..20: mol_type = other DNA
tccaacctgggcaacagagc

SEQ ID NO: 50219 - DNA, 20 bp, synthetic construct
  misc_feature 1..20: note = CRISPR gRNA sequence
  source 1..20: mol_type = other DNA
gactccgtctcaaaaaaaaa

SEQ ID NO: 50220 - DNA, 20 bp, synthetic construct
  misc_feature 1..20: note = CRISPR gRNA sequence
  source 1..20: mol_type = other DNA
tcaaaaaaaaaaagttattt

SEQ ID NO: 50221 - DNA, 20 bp, synthetic construct
  misc_feature 1..20: note = CRISPR gRNA sequence
  source 1..20: mol_type = other DNA
caaaaaaaaaaagttatttt

SEQ ID NO: 50222 - DNA, 20 bp, synthetic construct
  misc_feature 1..20: note = CRISPR gRNA sequence
  source 1..20: mol_type = other DNA
aaaagttattttgggtgctc

SEQ ID NO: 50223 - DNA, 20 bp, synthetic construct
  misc_feature 1..20: note = CRISPR gRNA sequence
  source 1..20: mol_type = other DNA
tttgggtgctctagcaattc

SEQ ID NO: 50224 - DNA, 20 bp, synthetic construct
  misc_feature 1..20: note = CRISPR gRNA sequence
  source 1..20: mol_type = other DNA
tatataaccaaaataattga

SEQ ID NO: 50225 - DNA, 20 bp, synthetic construct
  misc_feature 1..20: note = CRISPR gRNA sequence
  source 1..20: mol_type = other DNA
taaccaaaataattgaaagc

SEQ ID NO: 50226 - DNA, 20 bp, synthetic construct
  misc_feature 1..20: note = CRISPR gRNA sequence
  source 1..20: mol_type = other DNA
aaccaaaataattgaaagct

SEQ ID NO: 50227 - DNA, 20 bp, synthetic construct
  misc_feature 1..20: note = CRISPR gRNA sequence
  source 1..20: mol_type = other DNA
aattgaaagctgggactttc

SEQ ID NO: 50228 - DNA, 20 bp, synthetic construct
  misc_feature 1..20: note = CRISPR gRNA sequence
  source 1..20: mol_type = other DNA
gaaagctgggactttctggc

SEQ ID NO: 50229 - DNA, 20 bp, synthetic construct
  misc_feature 1..20: note = CRISPR gRNA sequence
  source 1..20: mol_type = other DNA
aaagctgggactttctggct

SEQ ID NO: 50230 - DNA, 20 bp, synthetic construct
  misc_feature 1..20: note = CRISPR gRNA sequence
  source 1..20: mol_type = other DNA
tgggactttctggctgggca

SEQ ID NO: 50231 - DNA, 20 bp, synthetic construct
  misc_feature 1..20: note = CRISPR gRNA sequence
  source 1..20: mol_type = other DNA
gactttctggctgggcatgg

SEQ ID NO: 50232 - DNA, 20 bp, synthetic construct
  misc_feature 1..20: note = CRISPR gRNA sequence
  source 1..20: mol_type = other DNA
tgggcatggtggctcacgcc

SEQ ID NO: 50233 - DNA, 20 bp, synthetic construct
  misc_feature 1..20: note = CRISPR gRNA sequence
  source 1..20: mol_type = other DNA
gtggctcacgcctagcactt

SEQ ID NO: 50234 - DNA, 20 bp, synthetic construct
  misc_feature 1..20: note = CRISPR gRNA sequence
  source 1..20: mol_type = other DNA
tggctcacgcctagcacttt

SEQ ID NO: 50235 - DNA, 20 bp, synthetic construct
  misc_feature 1..20: note = CRISPR gRNA sequence
  source 1..20: mol_type = other DNA
gctcacgcctagcactttgg

SEQ ID NO: 50236 - DNA, 20 bp, synthetic construct
  misc_feature 1..20: note = CRISPR gRNA sequence
  source 1..20: mol_type = other DNA
ctcacgcctagcactttggg

SEQ ID NO: 50237 - DNA, 20 bp, synthetic construct
  misc_feature 1..20: note = CRISPR gRNA sequence
  source 1..20: mol_type = other DNA
gcctagcactttgggaggct

SEQ ID NO: 50238 - DNA, 20 bp, synthetic construct
  misc_feature 1..20: note = CRISPR gRNA sequence
  source 1..20: mol_type = other DNA
cctagcactttgggaggctg

SEQ ID NO: 50239 - DNA, 20 bp, synthetic construct
  misc_feature 1..20: note = CRISPR gRNA sequence
  source 1..20: mol_type = other DNA
agcactttgggaggctgagg

SEQ ID NO: 50240 - DNA, 20 bp, synthetic construct
  misc_feature 1..20: note = CRISPR gRNA sequence
  source 1..20: mol_type = other DNA
gcactttgggaggctgaggt

SEQ ID NO: 50241 - DNA, 20 bp, synthetic construct
  misc_feature 1..20: note = CRISPR gRNA sequence
  source 1..20: mol_type = other DNA
actttgggaggctgaggtgg

SEQ ID NO: 50242 - DNA, 20 bp, synthetic construct
  misc_feature 1..20: note = CRISPR gRNA sequence
  source 1..20: mol_type = other DNA
ctttgggaggctgaggtggg

SEQ ID NO: 50243 - DNA, 20 bp, synthetic construct
  misc_feature 1..20: note = CRISPR gRNA sequence
  source 1..20: mol_type = other DNA
ctgaggtgggaggatcactt

SEQ ID NO: 50244 - DNA, 20 bp, synthetic construct
  misc_feature 1..20: note = CRISPR gRNA sequence
  source 1..20: mol_type = other DNA
gtgggaggatcacttgagct

SEQ ID NO: 50245 - DNA, 20 bp, synthetic construct
  misc_feature 1..20: note = CRISPR gRNA sequence
  source 1..20: mol_type = other DNA
tgggaggatcacttgagctc

SEQ ID NO: 50246 - DNA, 20 bp, synthetic construct
  misc_feature 1..20: note = CRISPR gRNA sequence
  source 1..20: mol_type = other DNA
ggaggatcacttgagctcag

SEQ ID NO: 50247 - DNA, 20 bp, synthetic construct
  misc_feature 1..20: note = CRISPR gRNA sequence
  source 1..20: mol_type = other DNA
tcacttgagctcaggagatc

SEQ ID NO: 50248 - DNA, 20 bp, synthetic construct
  misc_feature 1..20: note = CRISPR gRNA sequence
  source 1..20: mol_type = other DNA
tcaggagatcaagatcatcc

SEQ ID NO: 50249 - DNA, 20 bp, synthetic construct
  misc_feature 1..20: note = CRISPR gRNA sequence
  source 1..20: mol_type = other DNA
caggagatcaagatcatcct

SEQ ID NO: 50250 - DNA, 20 bp, synthetic construct
  misc_feature 1..20: note = CRISPR gRNA sequence
  source 1..20: mol_type = other DNA
caagatcatcctgggcaaaa

SEQ ID NO: 50251 - DNA, 20 bp, synthetic construct
  misc_feature 1..20: note = CRISPR gRNA sequence
  source 1..20: mol_type = other DNA
atcatcctgggcaaaacagt

SEQ ID NO: 50252 - DNA, 20 bp, synthetic construct
  misc_feature 1..20: note = CRISPR gRNA sequence
  source 1..20: mol_type = other DNA
aataaaataatatttaaaaa

SEQ ID NO: 50253 - DNA, 20 bp, synthetic construct
  misc_feature 1..20: note = CRISPR gRNA sequence
  source 1..20: mol_type = other DNA
aaataatatttaaaaaaaga

SEQ ID NO: 50254 - DNA, 20 bp, synthetic construct
  misc_feature 1..20: note = CRISPR gRNA sequence
  source 1..20: mol_type = other DNA
taatatttaaaaaaagaaag

SEQ ID NO: 50255 - DNA, 20 bp, synthetic construct
  misc_feature 1..20: note = CRISPR gRNA sequence
  source 1..20: mol_type = other DNA
aatatttaaaaaaagaaagc

SEQ ID NO: 50256 - DNA, 20 bp, synthetic construct
  misc_feature 1..20: note = CRISPR gRNA sequence
  source 1..20: mol_type = other DNA
atatttaaaaaaagaaagca

SEQ ID NO: 50257 - DNA, 20 bp, synthetic construct
  misc_feature 1..20: note = CRISPR gRNA sequence
  source 1..20: mol_type = other DNA
agaaagcagggactgtcaat

SEQ ID NO: 50258 - DNA, 20 bp, synthetic construct
  misc_feature 1..20: note = CRISPR gRNA sequence
  source 1..20: mol_type = other DNA
gaaagcagggactgtcaatt

SEQ ID NO: 50259 - DNA, 20 bp, synthetic construct
  misc_feature 1..20: note = CRISPR gRNA sequence
  source 1..20: mol_type = other DNA
ctgtcaattgggcacttgaa

SEQ ID NO: 50260 - DNA, 20 bp, synthetic construct
  misc_feature 1..20: note = CRISPR gRNA sequence
  source 1..20: mol_type = other DNA
ggcacttgaatggacaaccc

SEQ ID NO: 50261 - DNA, 20 bp, synthetic construct
  misc_feature 1..20: note = CRISPR gRNA sequence
  source 1..20: mol_type = other DNA
acaacccaagtgtcaattga

SEQ ID NO: 50262 - DNA, 20 bp, synthetic construct
  misc_feature 1..20: note = CRISPR gRNA sequence
  source 1..20: mol_type = other DNA
ccaagtgtcaattgatggat

SEQ ID NO: 50263 - DNA, 20 bp, synthetic construct
  misc_feature 1..20: note = CRISPR gRNA sequence
  source 1..20: mol_type = other DNA
agtgtcaattgatggataag

SEQ ID NO: 50264 - DNA, 20 bp, synthetic construct
  misc_feature 1..20: note = CRISPR gRNA sequence
  source 1..20: mol_type = other DNA
ataagtggatacacaaaatg

SEQ ID NO: 50265 - DNA, 20 bp, synthetic construct
  misc_feature 1..20: note = CRISPR gRNA sequence
  source 1..20: mol_type = other DNA
aatgtggtccatccacacaa

SEQ ID NO: 50266 - DNA, 20 bp, synthetic construct
  misc_feature 1..20: note = CRISPR gRNA sequence
  source 1..20: mol_type = other DNA
ccacacaatggaatattatg

SEQ ID NO: 50267 - DNA, 20 bp, synthetic construct
  misc_feature 1..20: note = CRISPR gRNA sequence
  source 1..20: mol_type = other DNA
aatattatgcagccttaaaa

SEQ ID NO: 50268 - DNA, 20 bp, synthetic construct
  misc_feature 1..20: note = CRISPR gRNA sequence
  source 1..20: mol_type = other DNA
atattatgcagccttaaaaa

SEQ ID NO: 50269 - DNA, 20 bp, synthetic construct
  misc_feature 1..20: note = CRISPR gRNA sequence
  source 1..20: mol_type = other DNA
tatgcagccttaaaaaagga

SEQ ID NO: 50270 - DNA, 20 bp, synthetic construct
  misc_feature 1..20: note = CRISPR gRNA sequence
  source 1..20: mol_type = other DNA
atgcagccttaaaaaaggaa

SEQ ID NO: 50271 - DNA, 20 bp, synthetic construct
  misc_feature 1..20: note = CRISPR gRNA sequence
  source 1..20: mol_type = other DNA
tgcagccttaaaaaaggaaa

SEQ ID NO: 50272 - DNA, 20 bp, synthetic construct
  misc_feature 1..20: note = CRISPR gRNA sequence
  source 1..20: mol_type = other DNA
gccttaaaaaaggaaagggc

SEQ ID NO: 50273 - DNA, 20 bp, synthetic construct
  misc_feature 1..20: note = CRISPR gRNA sequence
  source 1..20: mol_type = other DNA
ccttaaaaaaggaaagggct

SEQ ID NO: 50274 - DNA, 20 bp, synthetic construct
  misc_feature 1..20: note = CRISPR gRNA sequence
  source 1..20: mol_type = other DNA
aaaaaggaaagggctgggtg

SEQ ID NO: 50275 - DNA, 20 bp, synthetic construct
  misc_feature 1..20: note = CRISPR gRNA sequence
  source 1..20: mol_type = other DNA
aaggaaagggctgggtgtgg

SEQ ID NO: 50276 - DNA, 20 bp, synthetic construct
  misc_feature 1..20: note = CRISPR gRNA sequence
  source 1..20: mol_type = other DNA
gtggctcatgcctgtaatcc

SEQ ID NO: 50277 - DNA, 20 bp, synthetic construct
  misc_feature 1..20: note = CRISPR gRNA sequence
  source 1..20: mol_type = other DNA
tgcctgtaatcccagcactt

SEQ ID NO: 50278 - DNA, 20 bp, synthetic construct
  misc_feature 1..20: note = CRISPR gRNA sequence
  source 1..20: mol_type = other DNA
ctgtaatcccagcactttgg

SEQ ID NO: 50279 - DNA, 20 bp, synthetic construct
  misc_feature 1..20: note = CRISPR gRNA sequence
  source 1..20: mol_type = other DNA
tgtaatcccagcactttgga

SEQ ID NO: 50280 - DNA, 20 bp, synthetic construct
  misc_feature 1..20: note = CRISPR gRNA sequence
  source 1..20: mol_type = other DNA
agcactttggaaggccgaaa

SEQ ID NO: 50281 - DNA, 20 bp, synthetic construct
  misc_feature 1..20: note = CRISPR gRNA sequence
  source 1..20: mol_type = other DNA
gcactttggaaggccgaaac

SEQ ID NO: 50282 - DNA, 20 bp, synthetic construct
  misc_feature 1..20: note = CRISPR gRNA sequence
  source 1..20: mol_type = other DNA
ctttggaaggccgaaacggg

SEQ ID NO: 50283 - DNA, 20 bp, synthetic construct
  misc_feature 1..20: note = CRISPR gRNA sequence
  source 1..20: mol_type = other DNA
ccgaaacgggcagatcatct

SEQ ID NO: 50284 - DNA, 20 bp, synthetic construct
  misc_feature 1..20: note = CRISPR gRNA sequence
  source 1..20: mol_type = other DNA
cgaaacgggcagatcatctg

SEQ ID NO: 50285 - DNA, 20 bp, synthetic construct
  misc_feature 1..20: note = CRISPR gRNA sequence
  source 1..20: mol_type = other DNA
acgggcagatcatctgaggt

SEQ ID NO: 50286 - DNA, 20 bp, synthetic construct
  misc_feature 1..20: note = CRISPR gRNA sequence
  source 1..20: mol_type = other DNA
cgggcagatcatctgaggtc

SEQ ID NO: 50287 - DNA, 20 bp, synthetic construct
  misc_feature 1..20: note = CRISPR gRNA sequence
  source 1..20: mol_type = other DNA
ggcagatcatctgaggtcag

SEQ ID NO: 50288 - DNA, 20 bp, synthetic construct
  misc_feature 1..20: note = CRISPR gRNA sequence
  source 1..20: mol_type = other DNA
tcatctgaggtcaggagttc

SEQ ID NO: 50289 - DNA, 20 bp, synthetic construct
  misc_feature 1..20: note = CRISPR gRNA sequence
  source 1..20: mol_type = other DNA
tgaggtcaggagttcgagac

SEQ ID NO: 50290 - DNA, 20 bp, synthetic construct
  misc_feature 1..20: note = CRISPR gRNA sequence
  source 1..20: mol_type = other DNA
cgagaccagcctcgccaaca

SEQ ID NO: 50291 - DNA, 20 bp, synthetic construct
  misc_feature 1..20: note = CRISPR gRNA sequence
  source 1..20: mol_type = other DNA
acaaaaatacaaaaaaaaat

SEQ ID NO: 50292 - DNA, 20 bp, synthetic construct
  misc_feature 1..20: note = CRISPR gRNA sequence
  source 1..20: mol_type = other DNA
aaatacaaaaaaaaattagc

SEQ ID NO: 50293 - DNA, 20 bp, synthetic construct
  misc_feature 1..20: note = CRISPR gRNA sequence
  source 1..20: mol_type = other DNA
aatacaaaaaaaaattagct

SEQ ID NO: 50294 - DNA, 20 bp, synthetic construct
  misc_feature 1..20: note = CRISPR gRNA sequence
  source 1..20: mol_type = other DNA
aaaaaaaaattagctgggtg

SEQ ID NO: 50295 - DNA, 20 bp, synthetic construct
  misc_feature 1..20: note = CRISPR gRNA sequence
  source 1..20: mol_type = other DNA
aaaaaattagctgggtgtgg

SEQ ID NO: 50296 - DNA, 20 bp, synthetic construct
  misc_feature 1..20: note = CRISPR gRNA sequence
  source 1..20: mol_type = other DNA
aaattagctgggtgtggtgg

SEQ ID NO: 50297 - DNA, 20 bp, synthetic construct
  misc_feature 1..20: note = CRISPR gRNA sequence
  source 1..20: mol_type = other DNA
aattagctgggtgtggtggc

SEQ ID NO: 50298 - DNA, 20 bp, synthetic construct
  misc_feature 1..20: note = CRISPR gRNA sequence
  source 1..20: mol_type = other DNA
gtggcgggcgcctgtaatcc

SEQ ID NO: 50299 - DNA, 20 bp, synthetic construct
  misc_feature 1..20: note = CRISPR gRNA sequence
  source 1..20: mol_type = other DNA
gcctgtaatcccagctactc

SEQ ID NO: 50300 - DNA, 20 bp, synthetic construct
  misc_feature 1..20: note = CRISPR gRNA sequence
  source 1..20: mol_type = other DNA
ctgtaatcccagctactccg

SEQ ID NO: 50301 - DNA, 20 bp, synthetic construct
  misc_feature 1..20: note = CRISPR gRNA sequence
  source 1..20: mol_type = other DNA
tgtaatcccagctactccgg

SEQ ID NO: 50302 - DNA, 20 bp, synthetic construct
  misc_feature 1..20: note = CRISPR gRNA sequence
  source 1..20: mol_type = other DNA
tcccagctactccggaggct

SEQ ID NO: 50303 - DNA, 20 bp, synthetic construct
  misc_feature 1..20: note = CRISPR gRNA sequence
  source 1..20: mol_type = other DNA
cccagctactccggaggctg

SEQ ID NO: 50304 - DNA, 20 bp, synthetic construct
  misc_feature 1..20: note = CRISPR gRNA sequence
  source 1..20: mol_type = other DNA
agctactccggaggctgagg

SEQ ID NO: 50305 - DNA, 20 bp, synthetic construct
  misc_feature 1..20: note = CRISPR gRNA sequence
  source 1..20: mol_type = other DNA
gctactccggaggctgaggc

SEQ ID NO: 50306 - DNA, 20 bp, synthetic construct
  misc_feature 1..20: note = CRISPR gRNA sequence
  source 1..20: mol_type = other DNA
tactccggaggctgaggcag

SEQ ID NO: 50307 - DNA, 20 bp, synthetic construct
  misc_feature 1..20: note = CRISPR gRNA sequence
  source 1..20: mol_type = other DNA
caggagaatcgcttgaaccc

SEQ ID NO: 50308 - DNA, 20 bp, synthetic construct
  misc_feature 1..20: note = CRISPR gRNA sequence
  source 1..20: mol_type = other DNA
ggagaatcgcttgaacccaa

SEQ ID NO: 50309 - DNA, 20 bp, synthetic construct
  misc_feature 1..20: note = CRISPR gRNA sequence
  source 1..20: mol_type = other DNA
gagaatcgcttgaacccaag

SEQ ID NO: 50310 - DNA, 20 bp, synthetic construct
  misc_feature 1..20: note = CRISPR gRNA sequence
  source 1..20: mol_type = other DNA
aatcgcttgaacccaagagg

SEQ ID NO: 50311 - DNA, 20 bp, synthetic construct
  misc_feature 1..20: note = CRISPR gRNA sequence
  source 1..20: mol_type = other DNA
tcgcttgaacccaagaggtg

SEQ ID NO: 50312 - DNA, 20 bp, synthetic construct
  misc_feature 1..20: note = CRISPR gRNA sequence
  source 1..20: mol_type = other DNA
cgcttgaacccaagaggtgg

SEQ ID NO: 50313 - DNA, 20 bp, synthetic construct
  misc_feature 1..20: note = CRISPR gRNA sequence
  source 1..20: mol_type = other DNA
gcttgaacccaagaggtgga

SEQ ID NO: 50314 - DNA, 20 bp, synthetic construct
  misc_feature 1..20: note = CRISPR gRNA sequence
  source 1..20: mol_type = other DNA
aacccaagaggtggagggtg

SEQ ID NO: 50315 - DNA, 20 bp, synthetic construct
  misc_feature 1..20: note = CRISPR gRNA sequence
  source 1..20: mol_type = other DNA
caagaggtggagggtgcagt

SEQ ID NO: 50316 - DNA, 20 bp, synthetic construct
  misc_feature 1..20: note = CRISPR gRNA sequence
  source 1..20: mol_type = other DNA
ggtggagggtgcagtgagct

SEQ ID NO: 50317 - DNA, 20 bp, synthetic construct
  misc_feature 1..20: note = CRISPR gRNA sequence
  source 1..20: mol_type = other DNA
gggtgcagtgagctgagatc

SEQ ID NO: 50318 - DNA, 20 bp, synthetic construct
  misc_feature 1..20: note = CRISPR gRNA sequence
  source 1..20: mol_type = other DNA
gcagtgagctgagatcgagc

SEQ ID NO: 50319 - DNA, 20 bp, synthetic construct
  misc_feature 1..20: note = CRISPR gRNA sequence
  source 1..20: mol_type = other DNA
gagatcgagccagtgcactc

SEQ ID NO: 50320 - DNA, 20 bp, synthetic construct
  misc_feature 1..20: note = CRISPR gRNA sequence
  source 1..20: mol_type = other DNA
cgagccagtgcactccagcc

SEQ ID NO: 50321 - DNA, 20 bp, synthetic construct
  misc_feature 1..20: note = CRISPR gRNA sequence
  source 1..20: mol_type = other DNA
gagccagtgcactccagccc

SEQ ID NO: 50322 - DNA, 20 bp, synthetic construct
  misc_feature 1..20: note = CRISPR gRNA sequence
  source 1..20: mol_type = other DNA
tgcactccagcccaggtgac

SEQ ID NO: 50323 - DNA, 20 bp, synthetic construct
  misc_feature 1..20: note = CRISPR gRNA sequence
  source 1..20: mol_type = other DNA
cactccagcccaggtgacaa

SEQ ID NO: 50324 - DNA, 20 bp, synthetic construct
  misc_feature 1..20: note = CRISPR gRNA sequence
  source 1..20: mol_type = other DNA
ccagcccaggtgacaagagt

SEQ ID NO: 50325 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 50326 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 50327 - DNA, 20 bp, synthetic construct
  misc_feature 1..20: note = CRISPR gRNA sequence
  source 1..20: mol_type = other DNA
aaaaaaaaaaaaaaaaaagg

SEQ ID NO: 50328 - DNA, 20 bp, synthetic construct
  misc_feature 1..20: note = CRISPR gRNA sequence
  source 1..20: mol_type = other DNA
aaaaaaaaaaaaaaaaagga

SEQ ID NO: 50329 - DNA, 20 bp, synthetic construct
  misc_feature 1..20: note = CRISPR gRNA sequence
  source 1..20: mol_type = other DNA
aaaaaaaaaaaaaggaagga

SEQ ID NO: 50330 - DNA, 20 bp, synthetic construct
  misc_feature 1..20: note = CRISPR gRNA sequence
  source 1..20: mol_type = other DNA
aaaggaaggaaagtctgaca

SEQ ID NO: 50331 - DNA, 20 bp, synthetic construct
  misc_feature 1..20: note = CRISPR gRNA sequence
  source 1..20: mol_type = other DNA
acgctgcaacatgaatgaac

SEQ ID NO: 50332 - DNA, 20 bp, synthetic construct
  misc_feature 1..20: note = CRISPR gRNA sequence
  source 1..20: mol_type = other DNA
gctgcaacatgaatgaacca

SEQ ID NO: 50333 - DNA, 20 bp, synthetic construct
  misc_feature 1..20: note = CRISPR gRNA sequence
  source 1..20: mol_type = other DNA
ctgcaacatgaatgaaccag

SEQ ID NO: 50334 - DNA, 20 bp, synthetic construct
  misc_feature 1..20: note = CRISPR gRNA sequence
  source 1..20: mol_type = other DNA
gacattatgcccaatgaaat

SEQ ID NO: 50335 - DNA, 20 bp, synthetic construct
  misc_feature 1..20: note = CRISPR gRNA sequence
  source 1..20: mol_type = other DNA
ttatgcccaatgaaatgagc

SEQ ID NO: 50336 - DNA, 20 bp, synthetic construct
  misc_feature 1..20: note = CRISPR gRNA sequence
  source 1..20: mol_type = other DNA
tgaaatgagccagtcacaaa

SEQ ID NO: 50337 - DNA, 20 bp, synthetic construct
  misc_feature 1..20: note = CRISPR gRNA sequence
  source 1..20: mol_type = other DNA
cagtcacaaaaagacaaata

SEQ ID NO: 50338 - DNA, 20 bp, synthetic construct
  misc_feature 1..20: note = CRISPR gRNA sequence
  source 1..20: mol_type = other DNA
ctccactcatataaactatt

SEQ ID NO: 50339 - DNA, 20 bp, synthetic construct
  misc_feature 1..20: note = CRISPR gRNA sequence
  source 1..20: mol_type = other DNA
ccactcatataaactattta

SEQ ID NO: 50340 - DNA, 20 bp, synthetic construct
  misc_feature 1..20: note = CRISPR gRNA sequence
  source 1..20: mol_type = other DNA
ctcatataaactatttagag

SEQ ID NO: 50341 - DNA, 20 bp, synthetic construct
  misc_feature 1..20: note = CRISPR gRNA sequence
  source 1..20: mol_type = other DNA
atttagagcagtccaattca

SEQ ID NO: 50342 - DNA, 20 bp, synthetic construct
  misc_feature 1..20: note = CRISPR gRNA sequence
  source 1..20: mol_type = other DNA
ttagagcagtccaattcata

SEQ ID NO: 50343 - DNA, 20 bp, synthetic construct
  misc_feature 1..20: note = CRISPR gRNA sequence
  source 1..20: mol_type = other DNA
agcagtccaattcatagaga

SEQ ID NO: 50344 - DNA, 20 bp, synthetic construct
  misc_feature 1..20: note = CRISPR gRNA sequence
  source 1..20: mol_type = other DNA
gtccaattcatagagacaga

SEQ ID NO: 50345 - DNA, 20 bp, synthetic construct
  misc_feature 1..20: note = CRISPR gRNA sequence
  source 1..20: mol_type = other DNA
caattcatagagacagaaag

SEQ ID NO: 50346 - DNA, 20 bp, synthetic construct
  misc_feature 1..20: note = CRISPR gRNA sequence
  source 1..20: mol_type = other DNA
catagagacagaaagcagaa

SEQ ID NO: 50347 - DNA, 20 bp, synthetic construct
  misc_feature 1..20: note = CRISPR gRNA sequence
  source 1..20: mol_type = other DNA
agagacagaaagcagaatgg

SEQ ID NO: 50348 - DNA, 20 bp, synthetic construct
  misc_feature 1..20: note = CRISPR gRNA sequence
  source 1..20: mol_type = other DNA
gaaagcagaatggtggttgc

SEQ ID NO: 50349 - DNA, 20 bp, synthetic construct
  misc_feature 1..20: note = CRISPR gRNA sequence
  source 1..20: mol_type = other DNA
aaagcagaatggtggttgcc

SEQ ID NO: 50350 - DNA, 20 bp, synthetic construct
  misc_feature 1..20: note = CRISPR gRNA sequence
  source 1..20: mol_type = other DNA
aagcagaatggtggttgcca

SEQ ID NO: 50351 - DNA, 20 bp, synthetic construct
  misc_feature 1..20: note = CRISPR gRNA sequence
  source 1..20: mol_type = other DNA
agcagaatggtggttgccag

SEQ ID NO: 50352 - DNA, 20 bp, synthetic construct
  misc_feature 1..20: note = CRISPR gRNA sequence
  source 1..20: mol_type = other DNA
gaatggtggttgccaggggc

SEQ ID NO: 50353 - DNA, 20 bp, synthetic construct
  misc_feature 1..20: note = CRISPR gRNA sequence
  source 1..20: mol_type = other DNA
aatggtggttgccaggggct

SEQ ID NO: 50354 - DNA, 20 bp, synthetic construct
  misc_feature 1..20: note = CRISPR gRNA sequence
  source 1..20: mol_type = other DNA
atggtggttgccaggggctg

SEQ ID NO: 50355 - DNA, 20 bp, synthetic construct
  misc_feature 1..20: note = CRISPR gRNA sequence
  source 1..20: mol_type = other DNA
gtggttgccaggggctgggg

SEQ ID NO: 50356 - DNA, 20 bp, synthetic construct
  misc_feature 1..20: note = CRISPR gRNA sequence
  source 1..20: mol_type = other DNA
tggttgccaggggctggggt

SEQ ID NO: 50357 - DNA, 20 bp, synthetic construct
  misc_feature 1..20: note = CRISPR gRNA sequence
  source 1..20: mol_type = other DNA
ggttgccaggggctggggta

SEQ ID NO: 50358 - DNA, 20 bp, synthetic construct
  misc_feature 1..20: note = CRISPR gRNA sequence
  source 1..20: mol_type = other DNA
gttgccaggggctggggtag

SEQ ID NO: 50359 - DNA, 20 bp, synthetic construct
  misc_feature 1..20: note = CRISPR gRNA sequence
  source 1..20: mol_type = other DNA
ttgccaggggctggggtagg

SEQ ID NO: 50360 - DNA, 20 bp, synthetic construct
  misc_feature 1..20: note = CRISPR gRNA sequence
  source 1..20: mol_type = other DNA
tgccaggggctggggtaggg

SEQ ID NO: 50361 - DNA, 20 bp, synthetic construct
  misc_feature 1..20: note = CRISPR gRNA sequence
  source 1..20: mol_type = other DNA
gggctggggtaggggggaaa

SEQ ID NO: 50362 - DNA, 20 bp, synthetic construct
  misc_feature 1..20: note = CRISPR gRNA sequence
  source 1..20: mol_type = other DNA
ggctggggtaggggggaaat

SEQ ID NO: 50363 - DNA, 20 bp, synthetic construct
  misc_feature 1..20: note = CRISPR gRNA sequence
  source 1..20: mol_type = other DNA
gctggggtaggggggaaatg

SEQ ID NO: 50364 - DNA, 20 bp, synthetic construct
  misc_feature 1..20: note = CRISPR gRNA sequence
  source 1..20: mol_type = other DNA
ggaaatggggtgttgtttaa

SEQ ID NO: 50365 - DNA, 20 bp, synthetic construct
  misc_feature 1..20: note = CRISPR gRNA sequence
  source 1..20: mol_type = other DNA
gaaatggggtgttgtttaat

SEQ ID NO: 50366 - DNA, 20 bp, synthetic construct
  misc_feature 1..20: note = CRISPR gRNA sequence
  source 1..20: mol_type = other DNA
aaatggggtgttgtttaatg

SEQ ID NO: 50367 - DNA, 20 bp, synthetic construct
  misc_feature 1..20: note = CRISPR gRNA sequence
  source 1..20: mol_type = other DNA
ggggtgttgtttaatgggga

SEQ ID NO: 50368 - DNA, 20 bp, synthetic construct
  misc_feature 1..20: note = CRISPR gRNA sequence
  source 1..20: mol_type = other DNA
ggtgttgtttaatggggata

SEQ ID NO: 50369 - DNA, 20 bp, synthetic construct
  misc_feature 1..20: note = CRISPR gRNA sequence
  source 1..20: mol_type = other DNA
gtttaatggggatagagatt

SEQ ID NO: 50370 - DNA, 20 bp, synthetic construct
  misc_feature 1..20: note = CRISPR gRNA sequence
  source 1..20: mol_type = other DNA
ggatagagattcagttttgc

SEQ ID NO: 50371 - DNA, 20 bp, synthetic construct
  misc_feature 1..20: note = CRISPR gRNA sequence
  source 1..20: mol_type = other DNA
atagagattcagttttgcaa

SEQ ID NO: 50372 - DNA, 20 bp, synthetic construct
  misc_feature 1..20: note = CRISPR gRNA sequence
  source 1..20: mol_type = other DNA
tagagattcagttttgcaag

SEQ ID NO: 50373 - DNA, 20 bp, synthetic construct
  misc_feature 1..20: note = CRISPR gRNA sequence
  source 1..20: mol_type = other DNA
attcagttttgcaagaggaa

SEQ ID NO: 50374 - DNA, 20 bp, synthetic construct
  misc_feature 1..20: note = CRISPR gRNA sequence
  source 1..20: mol_type = other DNA
tcagttttgcaagaggaaaa

SEQ ID NO: 50375 - DNA, 20 bp, synthetic construct
  misc_feature 1..20: note = CRISPR gRNA sequence
  source 1..20: mol_type = other DNA
ttgcaagaggaaaagagttc

SEQ ID NO: 50376 - DNA, 20 bp, synthetic construct
  misc_feature 1..20: note = CRISPR gRNA sequence
  source 1..20: mol_type = other DNA
gcaagaggaaaagagttccg

SEQ ID NO: 50377 - DNA, 20 bp, synthetic construct
  misc_feature 1..20: note = CRISPR gRNA sequence
  source 1..20: mol_type = other DNA
aggaaaagagttccggagat

SEQ ID NO: 50378 - DNA, 20 bp, synthetic construct
  misc_feature 1..20: note = CRISPR gRNA sequence
  source 1..20: mol_type = other DNA
cggagattggccgtacaaaa

SEQ ID NO: 50379 - DNA, 20 bp, synthetic construct
  misc_feature 1..20: note = CRISPR gRNA sequence
  source 1..20: mol_type = other DNA
agattggccgtacaaaaaag

SEQ ID NO: 50380 - DNA, 20 bp, synthetic construct
  misc_feature 1..20: note = CRISPR gRNA sequence
  source 1..20: mol_type = other DNA
atgtacttaacactcctgaa

SEQ ID NO: 50381 - DNA, 20 bp, synthetic construct
  misc_feature 1..20: note = CRISPR gRNA sequence
  source 1..20: mol_type = other DNA
acactcctgaatggtacact

SEQ ID NO: 50382 - DNA, 20 bp, synthetic construct
  misc_feature 1..20: note = CRISPR gRNA sequence
  source 1..20: mol_type = other DNA
tggtacacttagaaatgatt

SEQ ID NO: 50383 - DNA, 20 bp, synthetic construct
  misc_feature 1..20: note = CRISPR gRNA sequence
  source 1..20: mol_type = other DNA
acacttagaaatgattaaga

SEQ ID NO: 50384 - DNA, 20 bp, synthetic construct
  misc_feature 1..20: note = CRISPR gRNA sequence
  source 1..20: mol_type = other DNA
gtattttataataattttta

SEQ ID NO: 50385 - DNA, 20 bp, synthetic construct
  misc_feature 1..20: note = CRISPR gRNA sequence
  source 1..20: mol_type = other DNA
tattttataataatttttac

SEQ ID NO: 50386 - DNA, 20 bp, synthetic construct
  misc_feature 1..20: note = CRISPR gRNA sequence
  source 1..20: mol_type = other DNA
ataatttttacaggttattt

SEQ ID NO: 50387 - DNA, 20 bp, synthetic construct
  misc_feature 1..20: note = CRISPR gRNA sequence
  source 1..20: mol_type = other DNA
taatttttacaggttatttt

SEQ ID NO: 50388 - DNA, 20 bp, synthetic construct
  misc_feature 1..20: note = CRISPR gRNA sequence
  source 1..20: mol_type = other DNA
aatttttacaggttattttg

SEQ ID NO: 50389 - DNA, 20 bp, synthetic construct
  misc_feature 1..20: note = CRISPR gRNA sequence
  source 1..20: mol_type = other DNA
ttacaggttattttggggaa

SEQ ID NO: 50390 - DNA, 20 bp, synthetic construct
  misc_feature 1..20: note = CRISPR gRNA sequence
  source 1..20: mol_type = other DNA
aggttattttggggaacagt

SEQ ID NO: 50391 - DNA, 20 bp, synthetic construct
  misc_feature 1..20: note = CRISPR gRNA sequence
  source 1..20: mol_type = other DNA
tttggggaacagtcagttct

SEQ ID NO: 50392 - DNA, 20 bp, synthetic construct
  misc_feature 1..20: note = CRISPR gRNA sequence
  source 1..20: mol_type = other DNA
ttggggaacagtcagttctt

SEQ ID NO: 50393 - DNA, 20 bp, synthetic construct
  misc_feature 1..20: note = CRISPR gRNA sequence
  source 1..20: mol_type = other DNA
agttcttaggtgccttgtca

SEQ ID NO: 50394 - DNA, 20 bp, synthetic construct
  misc_feature 1..20: note = CRISPR gRNA sequence
  source 1..20: mol_type = other DNA
gttcttaggtgccttgtcac

SEQ ID NO: 50395 - DNA, 20 bp, synthetic construct
  misc_feature 1..20: note = CRISPR gRNA sequence
  source 1..20: mol_type = other DNA
gccttgtcacaggctgcaat

SEQ ID NO: 50396 - DNA, 20 bp, synthetic construct
  misc_feature 1..20: note = CRISPR gRNA sequence
  source 1..20: mol_type = other DNA
ttgtcacaggctgcaatgag

SEQ ID NO: 50397 - DNA, 20 bp, synthetic construct
  misc_feature 1..20: note = CRISPR gRNA sequence
  source 1..20: mol_type = other DNA
aggctgcaatgagaagtgca

SEQ ID NO: 50398 - DNA, 20 bp, synthetic construct
  misc_feature 1..20: note = CRISPR gRNA sequence
  source 1..20: mol_type = other DNA
tgagaagtgcacagctctgt

SEQ ID NO: 50399 - DNA, 20 bp, synthetic construct
  misc_feature 1..20: note = CRISPR gRNA sequence
  source 1..20: mol_type = other DNA
cacagctctgtcggtgacgt

SEQ ID NO: 50400 - DNA, 20 bp, synthetic construct
  misc_feature 1..20: note = CRISPR gRNA sequence
  source 1..20: mol_type = other DNA
tgtcggtgacgtaagttttt

SEQ ID NO: 50401 - DNA, 20 bp, synthetic construct
  misc_feature 1..20: note = CRISPR gRNA sequence
  source 1..20: mol_type = other DNA
gtcggtgacgtaagtttttt

SEQ ID NO: 50402 - DNA, 20 bp, synthetic construct
  misc_feature 1..20: note = CRISPR gRNA sequence
  source 1..20: mol_type = other DNA
aaacatgaaactgaatgtca

SEQ ID NO: 50403 - DNA, 20 bp, synthetic construct
  misc_feature 1..20: note = CRISPR gRNA sequence
  source 1..20: mol_type = other DNA
acatgaaactgaatgtcatg

SEQ ID NO: 50404 - DNA, 20 bp, synthetic construct
  misc_feature 1..20: note = CRISPR gRNA sequence
  source 1..20: mol_type = other DNA
gagccttttgatctaacgtc

SEQ ID NO: 50405 - DNA, 20 bp, synthetic construct
  misc_feature 1..20: note = CRISPR gRNA sequence
  source 1..20: mol_type = other DNA
ttgatctaacgtccagtttc

SEQ ID NO: 50406 - DNA, 20 bp, synthetic construct
  misc_feature 1..20: note = CRISPR gRNA sequence
  source 1..20: mol_type = other DNA
tgatctaacgtccagtttcc

SEQ ID NO: 50407 - DNA, 20 bp, synthetic construct
  misc_feature 1..20: note = CRISPR gRNA sequence
  source 1..20: mol_type = other DNA
ctaacgtccagtttccagga

SEQ ID NO: 50408 - DNA, 20 bp, synthetic construct
  misc_feature 1..20: note = CRISPR gRNA sequence
  source 1..20: mol_type = other DNA
cgtccagtttccaggaaagt

SEQ ID NO: 50409 - DNA, 20 bp, synthetic construct
  misc_feature 1..20: note = CRISPR gRNA sequence
  source 1..20: mol_type = other DNA
gtccagtttccaggaaagtc

SEQ ID NO: 50410 - DNA, 20 bp, synthetic construct
  misc_feature 1..20: note = CRISPR gRNA sequence
  source 1..20: mol_type = other DNA
tccagtttccaggaaagtcg

SEQ ID NO: 50411 - DNA, 20 bp, synthetic construct
  misc_feature 1..20: note = CRISPR gRNA sequence
  source 1..20: mol_type = other DNA
gtttccaggaaagtcggggt

SEQ ID NO: 50412 - DNA, 20 bp, synthetic construct
  misc_feature 1..20: note = CRISPR gRNA sequence
  source 1..20: mol_type = other DNA
ttccaggaaagtcggggtta

SEQ ID NO: 50413 - DNA, 20 bp, synthetic construct
  misc_feature 1..20: note = CRISPR gRNA sequence
  source 1..20: mol_type = other DNA
tccaggaaagtcggggttag

SEQ ID NO: 50414 - DNA, 20 bp, synthetic construct
  misc_feature 1..20: note = CRISPR gRNA sequence
  source 1..20: mol_type = other DNA
aacacgtgccatgacatcat

SEQ ID NO: 50415 - DNA, 20 bp, synthetic construct
  misc_feature 1..20: note = CRISPR gRNA sequence
  source 1..20: mol_type = other DNA
cgtgccatgacatcatgaga

SEQ ID NO: 50416 - DNA, 20 bp, synthetic construct
  misc_feature 1..20: note = CRISPR gRNA sequence
  source 1..20: mol_type = other DNA
tgacatcatgagaaagccac

SEQ ID NO: 50417 - DNA, 20 bp, synthetic construct
  misc_feature 1..20: note = CRISPR gRNA sequence
  source 1..20: mol_type = other DNA
acatcatgagaaagccacca

SEQ ID NO: 50418 - DNA, 20 bp, synthetic construct
  misc_feature 1..20: note = CRISPR gRNA sequence
  source 1..20: mol_type = other DNA
catgagaaagccaccagagt

SEQ ID NO: 50419 - DNA, 20 bp, synthetic construct
  misc_feature 1..20: note = CRISPR gRNA sequence
  source 1..20: mol_type = other DNA
atgagaaagccaccagagtc

SEQ ID NO: 50420 - DNA, 20 bp, synthetic construct
  misc_feature 1..20: note = CRISPR gRNA sequence
  source 1..20: mol_type = other DNA
gagaaagccaccagagtcag

SEQ ID NO: 50421 - DNA, 20 bp, synthetic construct
  misc_feature 1..20: note = CRISPR gRNA sequence
  source 1..20: mol_type = other DNA
aaagccaccagagtcaggag

SEQ ID NO: 50422 - DNA, 20 bp, synthetic construct
  misc_feature 1..20: note = CRISPR gRNA sequence
  source 1..20: mol_type = other DNA
aagccaccagagtcaggagc

SEQ ID NO: 50423 - DNA, 20 bp, synthetic construct
  misc_feature 1..20: note = CRISPR gRNA sequence
  source 1..20: mol_type = other DNA
caccagagtcaggagcagga

SEQ ID NO: 50424 - DNA, 20 bp, synthetic construct
  misc_feature 1..20: note = CRISPR gRNA sequence
  source 1..20: mol_type = other DNA
gtcaggagcaggacagtctg

SEQ ID NO: 50425 - DNA, 20 bp, synthetic construct
  misc_feature 1..20: note = CRISPR gRNA sequence
  source 1..20: mol_type = other DNA
aggacagtctgcagtacaca

SEQ ID NO: 50426 - DNA, 20 bp, synthetic construct
  misc_feature 1..20: note = CRISPR gRNA sequence
  source 1..20: mol_type = other DNA
acagttgctgattttgtcaa

SEQ ID NO: 50427 - DNA, 20 bp, synthetic construct
  misc_feature 1..20: note = CRISPR gRNA sequence
  source 1..20: mol_type = other DNA
caacagacactgacatgaaa

SEQ ID NO: 50428 - DNA, 20 bp, synthetic construct
  misc_feature 1..20: note = CRISPR gRNA sequence
  source 1..20: mol_type = other DNA
agacactgacatgaaacaga

SEQ ID NO: 50429 - DNA, 20 bp, synthetic construct
  misc_feature 1..20: note = CRISPR gRNA sequence
  source 1..20: mol_type = other DNA
tgacatgaaacagaaagctg

SEQ ID NO: 50430 - DNA, 20 bp, synthetic construct
  misc_feature 1..20: note = CRISPR gRNA sequence
  source 1..20: mol_type = other DNA
atgaaacagaaagctgtggt

SEQ ID NO: 50431 - DNA, 20 bp, synthetic construct
  misc_feature 1..20: note = CRISPR gRNA sequence
  source 1..20: mol_type = other DNA
tgaaacagaaagctgtggtg

SEQ ID NO: 50432 - DNA, 20 bp, synthetic construct
  misc_feature 1..20: note = CRISPR gRNA sequence
  source 1..20: mol_type = other DNA
gaaacagaaagctgtggtga

SEQ ID NO: 50433 - DNA, 20 bp, synthetic construct
  misc_feature 1..20: note = CRISPR gRNA sequence
  source 1..20: mol_type = other DNA
aaacagaaagctgtggtgag

SEQ ID NO: 50434 - DNA, 20 bp, synthetic construct
  misc_feature 1..20: note = CRISPR gRNA sequence
  source 1..20: mol_type = other DNA
agaaagctgtggtgagggga

SEQ ID NO: 50435 - DNA, 20 bp, synthetic construct
  misc_feature 1..20: note = CRISPR gRNA sequence
  source 1..20: mol_type = other DNA
gaaagctgtggtgaggggat

SEQ ID NO: 50436 - DNA, 20 bp, synthetic construct
  misc_feature 1..20: note = CRISPR gRNA sequence
  source 1..20: mol_type = other DNA
aaagctgtggtgaggggatg

SEQ ID NO: 50437 - DNA, 20 bp, synthetic construct
  misc_feature 1..20: note = CRISPR gRNA sequence
  source 1..20: mol_type = other DNA
aagctgtggtgaggggatgg

SEQ ID NO: 50438 - DNA, 20 bp, synthetic construct
  misc_feature 1..20: note = CRISPR gRNA sequence
  source 1..20: mol_type = other DNA
ctgtggtgaggggatggggg

SEQ ID NO: 50439 - DNA, 20 bp, synthetic construct
  misc_feature 1..20: note = CRISPR gRNA sequence
  source 1..20: mol_type = other DNA
ggatgggggcagtgatgccg

SEQ ID NO: 50440 - DNA, 20 bp, synthetic construct
  misc_feature 1..20: note = CRISPR gRNA sequence
  source 1..20: mol_type = other DNA
gatgggggcagtgatgccgc

SEQ ID NO: 50441 - DNA, 20 bp, synthetic construct
  misc_feature 1..20: note = CRISPR gRNA sequence
  source 1..20: mol_type = other DNA
ggggcagtgatgccgcaggt

SEQ ID NO: 50442 - DNA, 20 bp, synthetic construct
  misc_feature 1..20: note = CRISPR gRNA sequence
  source 1..20: mol_type = other DNA
gcagtgatgccgcaggttag

SEQ ID NO: 50443 - DNA, 20 bp, synthetic construct
  misc_feature 1..20: note = CRISPR gRNA sequence
  source 1..20: mol_type = other DNA
agtgatgccgcaggttagaa

SEQ ID NO: 50444 - DNA, 20 bp, synthetic construct
  misc_feature 1..20: note = CRISPR gRNA sequence
  source 1..20: mol_type = other DNA
atgccgcaggttagaagagt

SEQ ID NO: 50445 - DNA, 20 bp, synthetic construct
  misc_feature 1..20: note = CRISPR gRNA sequence
  source 1..20: mol_type = other DNA
ccgcaggttagaagagtcag

SEQ ID NO: 50446 - DNA, 20 bp, synthetic construct
  misc_feature 1..20: note = CRISPR gRNA sequence
  source 1..20: mol_type = other DNA
atcgccatcccgtgcaaatg

SEQ ID NO: 50447 - DNA, 20 bp, synthetic construct
  misc_feature 1..20: note = CRISPR gRNA sequence
  source 1..20: mol_type = other DNA
catcccgtgcaaatgcagac

SEQ ID NO: 50448 - DNA, 20 bp, synthetic construct
  misc_feature 1..20: note = CRISPR gRNA sequence
  source 1..20: mol_type = other DNA
caaatgcagaccagatgtga

SEQ ID NO: 50449 - DNA, 20 bp, synthetic construct
  misc_feature 1..20: note = CRISPR gRNA sequence
  source 1..20: mol_type = other DNA
agaccagatgtgacagatcc

SEQ ID NO: 50450 - DNA, 20 bp, synthetic construct
  misc_feature 1..20: note = CRISPR gRNA sequence
  source 1..20: mol_type = other DNA
tgacagatcctggatcccaa

SEQ ID NO: 50451 - DNA, 20 bp, synthetic construct
  misc_feature 1..20: note = CRISPR gRNA sequence
  source 1..20: mol_type = other DNA
agatcctggatcccaaaagc

SEQ ID NO: 50452 - DNA, 20 bp, synthetic construct
  misc_feature 1..20: note = CRISPR gRNA sequence
  source 1..20: mol_type = other DNA
caaaagccagctgtcttatc

SEQ ID NO: 50453 - DNA, 20 bp, synthetic construct
  misc_feature 1..20: note = CRISPR gRNA sequence
  source 1..20: mol_type = other DNA
aaaagccagctgtcttatct

SEQ ID NO: 50454 - DNA, 20 bp, synthetic construct
  misc_feature 1..20: note = CRISPR gRNA sequence
  source 1..20: mol_type = other DNA
aaagccagctgtcttatctg

SEQ ID NO: 50455 - DNA, 20 bp, synthetic construct
  misc_feature 1..20: note = CRISPR gRNA sequence
  source 1..20: mol_type = other DNA
aagccagctgtcttatctgg

SEQ ID NO: 50456 - DNA, 20 bp, synthetic construct
  misc_feature 1..20: note = CRISPR gRNA sequence
  source 1..20: mol_type = other DNA
ctgtcttatctgggggacaa

SEQ ID NO: 50457 - DNA, 20 bp, synthetic construct
  misc_feature 1..20: note = CRISPR gRNA sequence
  source 1..20: mol_type = other DNA
tgtcttatctgggggacaat

SEQ ID NO: 50458 - DNA, 20 bp, synthetic construct
  misc_feature 1..20: note = CRISPR gRNA sequence
  source 1..20: mol_type = other DNA
gtcttatctgggggacaatg

SEQ ID NO: 50459 - DNA, 20 bp, synthetic construct
  misc_feature 1..20: note = CRISPR gRNA sequence
  source 1..20: mol_type = other DNA
gggggacaatggggacattt

SEQ ID NO: 50460 - DNA, 20 bp, synthetic construct
  misc_feature 1..20: note = CRISPR gRNA sequence
  source 1..20: mol_type = other DNA
acaatggggacattttagat

SEQ ID NO: 50461 - DNA, 20 bp, synthetic construct
  misc_feature 1..20: note = CRISPR gRNA sequence
  source 1..20: mol_type = other DNA
ggggacattttagattagac

SEQ ID NO: 50462 - DNA, 20 bp, synthetic construct
  misc_feature 1..20: note = CRISPR gRNA sequence
  source 1..20: mol_type = other DNA
gggacattttagattagact

SEQ ID NO: 50463 - DNA, 20 bp, synthetic construct
  misc_feature 1..20: note = CRISPR gRNA sequence
  source 1..20: mol_type = other DNA
acattttagattagactagg

SEQ ID NO: 50464 - DNA, 20 bp, synthetic construct
  misc_feature 1..20: note = CRISPR gRNA sequence
  source 1..20: mol_type = other DNA
actaggtagtacccgacact

SEQ ID NO: 50465 - DNA, 20 bp, synthetic construct
  misc_feature 1..20: note = CRISPR gRNA sequence
  source 1..20: mol_type = other DNA
ctaggtagtacccgacacta

SEQ ID NO: 50466 - DNA, 20 bp, synthetic construct
  misc_feature 1..20: note = CRISPR gRNA sequence
  source 1..20: mol_type = other DNA
acactaaggaatcgctaact

SEQ ID NO: 50467 - DNA, 20 bp, synthetic construct
  misc_feature 1..20: note = CRISPR gRNA sequence
  source 1..20: mol_type = other DNA
gaatcgctaactgagtttct

SEQ ID NO: 50468 - DNA, 20 bp, synthetic construct
  misc_feature 1..20: note = CRISPR gRNA sequence
  source 1..20: mol_type = other DNA
aatcgctaactgagtttctt

SEQ ID NO: 50469 - DNA, 20 bp, synthetic construct
  misc_feature 1..20: note = CRISPR gRNA sequence
  source 1..20: mol_type = other DNA
gagtttcttaggtgtcctga

SEQ ID NO: 50470 - DNA, 20 bp, synthetic construct
  misc_feature 1..20: note = CRISPR gRNA sequence
  source 1..20: mol_type = other DNA
aaaaaaatgtccttattttt

SEQ ID NO: 50471 - DNA, 20 bp, synthetic construct
  misc_feature 1..20: note = CRISPR gRNA sequence
  source 1..20: mol_type = other DNA
aaaaatgtccttattttttg

SEQ ID NO: 50472 - DNA, 20 bp, synthetic construct
  misc_feature 1..20: note = CRISPR gRNA sequence
  source 1..20: mol_type = other DNA
ccttattttttggagcttca

SEQ ID NO: 50473 - DNA, 20 bp, synthetic construct
  misc_feature 1..20: note = CRISPR gRNA sequence
  source 1..20: mol_type = other DNA
gagcttcacggtgaaatatt

SEQ ID NO: 50474 - DNA, 20 bp, synthetic construct
  misc_feature 1..20: note = CRISPR gRNA sequence
  source 1..20: mol_type = other DNA
agcttcacggtgaaatattt

SEQ ID NO: 50475 - DNA, 20 bp, synthetic construct
  misc_feature 1..20: note = CRISPR gRNA sequence
  source 1..20: mol_type = other DNA
cttcacggtgaaatatttag

SEQ ID NO: 50476 - DNA, 20 bp, synthetic construct
  misc_feature 1..20: note = CRISPR gRNA sequence
  source 1..20: mol_type = other DNA
ggtgaaatatttaggagtga

SEQ ID NO: 50477 - DNA, 20 bp, synthetic construct
  misc_feature 1..20: note = CRISPR gRNA sequence
  source 1..20: mol_type = other DNA
atttaggagtgatggattat

SEQ ID NO: 50478 - DNA, 20 bp, synthetic construct
  misc_feature 1..20: note = CRISPR gRNA sequence
  source 1..20: mol_type = other DNA
tttaggagtgatggattatg

SEQ ID NO: 50479 - DNA, 20 bp, synthetic construct
  misc_feature 1..20: note = CRISPR gRNA sequence
  source 1..20: mol_type = other DNA
taacttacttgaaaccgctt

SEQ ID NO: 50480 - DNA, 20 bp, synthetic construct
  misc_feature 1..20: note = CRISPR gRNA sequence
  source 1..20: mol_type = other DNA
agctgaaataaaaataaaaa

SEQ ID NO: 50481 - DNA, 20 bp, synthetic construct
  misc_feature 1..20: note = CRISPR gRNA sequence
  source 1..20: mol_type = other DNA
tgaaataaaaataaaaatag

SEQ ID NO: 50482 - DNA, 20 bp, synthetic construct
  misc_feature 1..20: note = CRISPR gRNA sequence
  source 1..20: mol_type = other DNA
aatagaagcaaatataaaaa

SEQ ID NO: 50483 - DNA, 20 bp, synthetic construct
  misc_feature 1..20: note = CRISPR gRNA sequence
  source 1..20: mol_type = other DNA
gtatgaacaactgtcaaacc

SEQ ID NO: 50484 - DNA, 20 bp, synthetic construct
  misc_feature 1..20: note = CRISPR gRNA sequence
  source 1..20: mol_type = other DNA
tatgaacaactgtcaaacct

SEQ ID NO: 50485 - DNA, 20 bp, synthetic construct
  misc_feature 1..20: note = CRISPR gRNA sequence
  source 1..20: mol_type = other DNA
caactgtcaaacctaggttc

SEQ ID NO: 50486 - DNA, 20 bp, synthetic construct
  misc_feature 1..20: note = CRISPR gRNA sequence
  source 1..20: mol_type = other DNA
aactgtcaaacctaggttct

SEQ ID NO: 50487 - DNA, 20 bp, synthetic construct
  misc_feature 1..20: note = CRISPR gRNA sequence
  source 1..20: mol_type = other DNA
tcaaacctaggttctgggaa

SEQ ID NO: 50488 - DNA, 20 bp, synthetic construct
  misc_feature 1..20: note = CRISPR gRNA sequence
  source 1..20: mol_type = other DNA
caaacctaggttctgggaat

SEQ ID NO: 50489 - DNA, 20 bp, synthetic construct
  misc_feature 1..20: note = CRISPR gRNA sequence
  source 1..20: mol_type = other DNA
aacctaggttctgggaatag

SEQ ID NO: 50490 - DNA, 20 bp, synthetic construct
  misc_feature 1..20: note = CRISPR gRNA sequence
  source 1..20: mol_type = other DNA
aaaaattattctttctactt

SEQ ID NO: 50491 - DNA, 20 bp, synthetic construct
  misc_feature 1..20: note = CRISPR gRNA sequence
  source 1..20: mol_type = other DNA
cttcggtatcttctttttct

SEQ ID NO: 50492 - DNA, 20 bp, synthetic construct
  misc_feature 1..20: note = CRISPR gRNA sequence
  source 1..20: mol_type = other DNA
tgagtgttttaaaatgatca

SEQ ID NO: 50493 - DNA, 20 bp, synthetic construct
  misc_feature 1..20: note = CRISPR gRNA sequence
  source 1..20: mol_type = other DNA
tttaaaatgatcatagtgaa

SEQ ID NO: 50494 - DNA, 20 bp, synthetic construct
  misc_feature 1..20: note = CRISPR gRNA sequence
  source 1..20: mol_type = other DNA
aaatgatcatagtgaacaga

SEQ ID NO: 50495 - DNA, 20 bp, synthetic construct
  misc_feature 1..20: note = CRISPR gRNA sequence
  source 1..20: mol_type = other DNA
atcatagtgaacagacagac

SEQ ID NO: 50496 - DNA, 20 bp, synthetic construct
  misc_feature 1..20: note = CRISPR gRNA sequence
  source 1..20: mol_type = other DNA
gacagacaagaacttcgttt

SEQ ID NO: 50497 - DNA, 20 bp, synthetic construct
  misc_feature 1..20: note = CRISPR gRNA sequence
  source 1..20: mol_type = other DNA
tttcagtttatttttgtcct

SEQ ID NO: 50498 - DNA, 20 bp, synthetic construct
  misc_feature 1..20: note = CRISPR gRNA sequence
  source 1..20: mol_type = other DNA
gtttatttttgtcctcagtt

SEQ ID NO: 50499 - DNA, 20 bp, synthetic construct
  misc_feature 1..20: note = CRISPR gRNA sequence
  source 1..20: mol_type = other DNA
tctttttttcttaaatccca

SEQ ID NO: 50500 - DNA, 20 bp, synthetic construct
  misc_feature 1..20: note = CRISPR gRNA sequence
  source 1..20: mol_type = other DNA
ttttcttaaatcccaaagca

SEQ ID NO: 50501 - DNA, 20 bp, synthetic construct
  misc_feature 1..20: note = CRISPR gRNA sequence
  source 1..20: mol_type = other DNA
tttcttaaatcccaaagcac

SEQ ID NO: 50502 - DNA, 20 bp, synthetic construct
  misc_feature 1..20: note = CRISPR gRNA sequence
  source 1..20: mol_type = other DNA
aatcccaaagcacaggcctc

SEQ ID NO: 50503 - DNA, 20 bp, synthetic construct
  misc_feature 1..20: note = CRISPR gRNA sequence
  source 1..20: mol_type = other DNA
caaagcacaggcctccagtg

SEQ ID NO: 50504 - DNA, 20 bp, synthetic construct
  misc_feature 1..20: note = CRISPR gRNA sequence
  source 1..20: mol_type = other DNA
aaagcacaggcctccagtgt

SEQ ID NO: 50505 - DNA, 20 bp, synthetic construct
  misc_feature 1..20: note = CRISPR gRNA sequence
  source 1..20: mol_type = other DNA
aagcacaggcctccagtgtg

SEQ ID NO: 50506 - DNA, 20 bp, synthetic construct
  misc_feature 1..20: note = CRISPR gRNA sequence
  source 1..20: mol_type = other DNA
cacaggcctccagtgtgggg

SEQ ID NO: 50507 - DNA, 20 bp, synthetic construct
  misc_feature 1..20: note = CRISPR gRNA sequence
  source 1..20: mol_type = other DNA
acaggcctccagtgtgggga

SEQ ID NO: 50508 - DNA, 20 bp, synthetic construct
  misc_feature 1..20: note = CRISPR gRNA sequence
  source 1..20: mol_type = other DNA
gcctccagtgtggggaagga

SEQ ID NO: 50509 - DNA, 20 bp, synthetic construct
  misc_feature 1..20: note = CRISPR gRNA sequence
  source 1..20: mol_type = other DNA
cagtttctctgtgtgccttg

SEQ ID NO: 50510 - DNA, 20 bp, synthetic construct
  misc_feature 1..20: note = CRISPR gRNA sequence
  source 1..20: mol_type = other DNA
gtttctctgtgtgccttgtg

SEQ ID NO: 50511 - DNA, 20 bp, synthetic construct
  misc_feature 1..20: note = CRISPR gRNA sequence
  source 1..20: mol_type = other DNA
tgtgtgccttgtggagtctc

SEQ ID NO: 50512 - DNA, 20 bp, synthetic construct
  misc_feature 1..20: note = CRISPR gRNA sequence
  source 1..20: mol_type = other DNA
gtgtgccttgtggagtctct

SEQ ID NO: 50513 - DNA, 20 bp, synthetic construct
  misc_feature 1..20: note = CRISPR gRNA sequence
  source 1..20: mol_type = other DNA
gccttgtggagtctctggga

SEQ ID NO: 50514 - DNA, 20 bp, synthetic construct
  misc_feature 1..20: note = CRISPR gRNA sequence
  source 1..20: mol_type = other DNA
tgtggagtctctgggacaga

SEQ ID NO: 50515 - DNA, 20 bp, synthetic construct
  misc_feature 1..20: note = CRISPR gRNA sequence
  source 1..20: mol_type = other DNA
gagtctctgggacagatgga

SEQ ID NO: 50516 - DNA, 20 bp, synthetic construct
  misc_feature 1..20: note = CRISPR gRNA sequence
  source 1..20: mol_type = other DNA
agtctctgggacagatggac

SEQ ID NO: 50517 - DNA, 20 bp, synthetic construct
  misc_feature 1..20: note = CRISPR gRNA sequence
  source 1..20: mol_type = other DNA
gtctctgggacagatggaca

SEQ ID NO: 50518 - DNA, 20 bp, synthetic construct
  misc_feature 1..20: note = CRISPR gRNA sequence
  source 1..20: mol_type = other DNA
acagatggacagggtttgct

SEQ ID NO: 50519 - DNA, 20 bp, synthetic construct
  misc_feature 1..20: note = CRISPR gRNA sequence
  source 1..20: mol_type = other DNA
cagatggacagggtttgctc

SEQ ID NO: 50520 - DNA, 20 bp, synthetic construct
  misc_feature 1..20: note = CRISPR gRNA sequence
  source 1..20: mol_type = other DNA
agatggacagggtttgctca

SEQ ID NO: 50521 - DNA, 20 bp, synthetic construct
  misc_feature 1..20: note = CRISPR gRNA sequence
  source 1..20: mol_type = other DNA
gacagggtttgctcagggtc

SEQ ID NO: 50522 - DNA, 20 bp, synthetic construct
  misc_feature 1..20: note = CRISPR gRNA sequence
  source 1..20: mol_type = other DNA
gggtttgctcagggtccaga

SEQ ID NO: 50523 - DNA, 20 bp, synthetic construct
  misc_feature 1..20: note = CRISPR gRNA sequence
  source 1..20: mol_type = other DNA
tttgctcagggtccagatgg

SEQ ID NO: 50524 - DNA, 20 bp, synthetic construct
  misc_feature 1..20: note = CRISPR gRNA sequence
  source 1..20: mol_type = other DNA
ttgctcagggtccagatggc

SEQ ID NO: 50525 - DNA, 20 bp, synthetic construct
  misc_feature 1..20: note = CRISPR gRNA sequence
  source 1..20: mol_type = other DNA
tgctcagggtccagatggca

SEQ ID NO: 50526 - DNA, 20 bp, synthetic construct
  misc_feature 1..20: note = CRISPR gRNA sequence
  source 1..20: mol_type = other DNA
gggtccagatggcagggttg

SEQ ID NO: 50527 - DNA, 20 bp, synthetic construct
  misc_feature 1..20: note = CRISPR gRNA sequence
  source 1..20: mol_type = other DNA
ggtccagatggcagggttgt

SEQ ID NO: 50528 - DNA, 20 bp, synthetic construct
  misc_feature 1..20: note = CRISPR gRNA sequence
  source 1..20: mol_type = other DNA
agatggcagggttgtgggta

SEQ ID NO: 50529 - DNA, 20 bp, synthetic construct
  misc_feature 1..20: note = CRISPR gRNA sequence
  source 1..20: mol_type = other DNA
gatggcagggttgtgggtac

SEQ ID NO: 50530 - DNA, 20 bp, synthetic construct
  misc_feature 1..20: note = CRISPR gRNA sequence
  source 1..20: mol_type = other DNA
ttgtgggtacaggaaatgac

SEQ ID NO: 50531 - DNA, 20 bp, synthetic construct
  misc_feature 1..20: note = CRISPR gRNA sequence
  source 1..20: mol_type = other DNA
tgtgggtacaggaaatgact

SEQ ID NO: 50532 - DNA, 20 bp, synthetic construct
  misc_feature 1..20: note = CRISPR gRNA sequence
  source 1..20: mol_type = other DNA
gtgggtacaggaaatgactg

SEQ ID NO: 50533 - DNA, 20 bp, synthetic construct
  misc_feature 1..20: note = CRISPR gRNA sequence
  source 1..20: mol_type = other DNA
aatgactggggccatgatcc

SEQ ID NO: 50534 - DNA, 20 bp, synthetic construct
  misc_feature 1..20: note = CRISPR gRNA sequence
  source 1..20: mol_type = other DNA
atgactggggccatgatcct

SEQ ID NO: 50535 - DNA, 20 bp, synthetic construct
  misc_feature 1..20: note = CRISPR gRNA sequence
  source 1..20: mol_type = other DNA
tgactggggccatgatcctg

SEQ ID NO: 50536 - DNA, 20 bp, synthetic construct
  misc_feature 1..20: note = CRISPR gRNA sequence
  source 1..20: mol_type = other DNA
gactggggccatgatcctgg

SEQ ID NO: 50537 - DNA, 20 bp, synthetic construct
  misc_feature 1..20: note = CRISPR gRNA sequence
  source 1..20: mol_type = other DNA
atcctgggggcctcttactc

SEQ ID NO: 50538 - DNA, 20 bp, synthetic construct
  misc_feature 1..20: note = CRISPR gRNA sequence
  source 1..20: mol_type = other DNA
ccctgctcccattcatgcca

SEQ ID NO: 50539 - DNA, 20 bp, synthetic construct
  misc_feature 1..20: note = CRISPR gRNA sequence
  source 1..20: mol_type = other DNA
attcatgccatggcccctcc

SEQ ID NO: 50540 - DNA, 20 bp, synthetic construct
  misc_feature 1..20: note = CRISPR gRNA sequence
  source 1..20: mol_type = other DNA
tcatgccatggcccctcccg

SEQ ID NO: 50541 - DNA, 20 bp, synthetic construct
  misc_feature 1..20: note = CRISPR gRNA sequence
  source 1..20: mol_type = other DNA
catgccatggcccctcccgg

SEQ ID NO: 50542 - DNA, 20 bp, synthetic construct
  misc_feature 1..20: note = CRISPR gRNA sequence
  source 1..20: mol_type = other DNA
gccatggcccctcccggagg

SEQ ID NO: 50543 - DNA, 20 bp, synthetic construct
  misc_feature 1..20: note = CRISPR gRNA sequence
  source 1..20: mol_type = other DNA
atggcccctcccggaggcag

SEQ ID NO: 50544 - DNA, 20 bp, synthetic construct
  misc_feature 1..20: note = CRISPR gRNA sequence
  source 1..20: mol_type = other DNA
tggcccctcccggaggcagc

SEQ ID NO: 50545 - DNA, 20 bp, synthetic construct
  misc_feature 1..20: note = CRISPR gRNA sequence
  source 1..20: mol_type = other DNA
ggcccctcccggaggcagcg

SEQ ID NO: 50546 - DNA, 20 bp, synthetic construct
  misc_feature 1..20: note = CRISPR gRNA sequence
  source 1..20: mol_type = other DNA
gcccctcccggaggcagcgg

SEQ ID NO: 50547 - DNA, 20 bp, synthetic construct
  misc_feature 1..20: note = CRISPR gRNA sequence
  source 1..20: mol_type = other DNA
ccctcccggaggcagcgggg

SEQ ID NO: 50548 - DNA, 20 bp, synthetic construct
  misc_feature 1..20: note = CRISPR gRNA sequence
  source 1..20: mol_type = other DNA
cctcccggaggcagcggggg

SEQ ID NO: 50549 - DNA, 20 bp, synthetic construct
  misc_feature 1..20: note = CRISPR gRNA sequence
  source 1..20: mol_type = other DNA
tcccggaggcagcgggggag

SEQ ID NO: 50550 - DNA, 20 bp, synthetic construct
  misc_feature 1..20: note = CRISPR gRNA sequence
  source 1..20: mol_type = other DNA
cccggaggcagcgggggagg

SEQ ID NO: 50551 - DNA, 20 bp, synthetic construct
  misc_feature 1..20: note = CRISPR gRNA sequence
  source 1..20: mol_type = other DNA
cagcgggggaggaggtacct

SEQ ID NO: 50552 - DNA, 20 bp, synthetic construct
  misc_feature 1..20: note = CRISPR gRNA sequence
  source 1..20: mol_type = other DNA
agcgggggaggaggtacctg

SEQ ID NO: 50553 - DNA, 20 bp, synthetic construct
  misc_feature 1..20: note = CRISPR gRNA sequence
  source 1..20: mol_type = other DNA
aggaggtacctgaggctgaa

SEQ ID NO: 50554 - DNA, 20 bp, synthetic construct
  misc_feature 1..20: note = CRISPR gRNA sequence
  source 1..20: mol_type = other DNA
cctgaggctgaacagccctg

SEQ ID NO: 50555 - DNA, 20 bp, synthetic construct
  misc_feature 1..20: note = CRISPR gRNA sequence
  source 1..20: mol_type = other DNA
ctgaggctgaacagccctgc

SEQ ID NO: 50556 - DNA, 20 bp, synthetic construct
  misc_feature 1..20: note = CRISPR gRNA sequence
  source 1..20: mol_type = other DNA
gccctgcgggtcgccccacc

SEQ ID NO: 50557 - DNA, 20 bp, synthetic construct
  misc_feature 1..20: note = CRISPR gRNA sequence
  source 1..20: mol_type = other DNA
gcgggtcgccccaccaagct

SEQ ID NO: 50558 - DNA, 20 bp, synthetic construct
  misc_feature 1..20: note = CRISPR gRNA sequence
  source 1..20: mol_type = other DNA
cgggtcgccccaccaagctc

SEQ ID NO: 50559 - DNA, 20 bp, synthetic construct
  misc_feature 1..20: note = CRISPR gRNA sequence
  source 1..20: mol_type = other DNA
ggtcgccccaccaagctcag

SEQ ID NO: 50560 - DNA, 20 bp, synthetic construct
  misc_feature 1..20: note = CRISPR gRNA sequence
  source 1..20: mol_type = other DNA
gtcgccccaccaagctcagg

SEQ ID NO: 50561 - DNA, 20 bp, synthetic construct
  misc_feature 1..20: note = CRISPR gRNA sequence
  source 1..20: mol_type = other DNA
ccccaccaagctcaggagga

SEQ ID NO: 50562 - DNA, 20 bp, synthetic construct
  misc_feature 1..20: note = CRISPR gRNA sequence
  source 1..20: mol_type = other DNA
accaagctcaggaggatggc

SEQ ID NO: 50563 - DNA, 20 bp, synthetic construct
  misc_feature 1..20: note = CRISPR gRNA sequence
  source 1..20: mol_type = other DNA
ggaggatggccagctgcttc

SEQ ID NO: 50564 - DNA, 20 bp, synthetic construct
  misc_feature 1..20: note = CRISPR gRNA sequence
  source 1..20: mol_type = other DNA
atggccagctgcttctggcc

SEQ ID NO: 50565 - DNA, 20 bp, synthetic construct
  misc_feature 1..20: note = CRISPR gRNA sequence
  source 1..20: mol_type = other DNA
tggccagctgcttctggccc

SEQ ID NO: 50566 - DNA, 20 bp, synthetic construct
  misc_feature 1..20: note = CRISPR gRNA sequence
  source 1..20: mol_type = other DNA
ccagctgcttctggcccagg

SEQ ID NO: 50567 - DNA, 20 bp, synthetic construct
  misc_feature 1..20: note = CRISPR gRNA sequence
  source 1..20: mol_type = other DNA
gcttctggcccaggcagcac

SEQ ID NO: 50568 - DNA, 20 bp, synthetic construct
  misc_feature 1..20: note = CRISPR gRNA sequence
  source 1..20: mol_type = other DNA
cttctggcccaggcagcact

SEQ ID NO: 50569 - DNA, 20 bp, synthetic construct
  misc_feature 1..20: note = CRISPR gRNA sequence
  source 1..20: mol_type = other DNA
tggcccaggcagcactgggt

SEQ ID NO: 50570 - DNA, 20 bp, synthetic construct
  misc_feature 1..20: note = CRISPR gRNA sequence
  source 1..20: mol_type = other DNA
caggcagcactgggtcagcc

SEQ ID NO: 50571 - DNA, 20 bp, synthetic construct
  misc_feature 1..20: note = CRISPR gRNA sequence
  source 1..20: mol_type = other DNA
ggcagcactgggtcagcctg

SEQ ID NO: 50572 - DNA, 20 bp, synthetic construct
  misc_feature 1..20: note = CRISPR gRNA sequence
  source 1..20: mol_type = other DNA
gcactgggtcagcctggaga

SEQ ID NO: 50573 - DNA, 20 bp, synthetic construct
  misc_feature 1..20: note = CRISPR gRNA sequence
  source 1..20: mol_type = other DNA
actgggtcagcctggagaca

SEQ ID NO: 50574 - DNA, 20 bp, synthetic construct
  misc_feature 1..20: note = CRISPR gRNA sequence
  source 1..20: mol_type = other DNA
ctgggtcagcctggagacag

SEQ ID NO: 50575 - DNA, 20 bp, synthetic construct
  misc_feature 1..20: note = CRISPR gRNA sequence
  source 1..20: mol_type = other DNA
gtcagcctggagacagaggt

SEQ ID NO: 50576 - DNA, 20 bp, synthetic construct
  misc_feature 1..20: note = CRISPR gRNA sequence
  source 1..20: mol_type = other DNA
ggagacagaggtcagtcact

SEQ ID NO: 50577 - DNA, 20 bp, synthetic construct
  misc_feature 1..20: note = CRISPR gRNA sequence
  source 1..20: mol_type = other DNA
gagacagaggtcagtcactg

SEQ ID NO: 50578 - DNA, 20 bp, synthetic construct
  misc_feature 1..20: note = CRISPR gRNA sequence
  source 1..20: mol_type = other DNA
acagaggtcagtcactgagg

SEQ ID NO: 50579 - DNA, 20 bp, synthetic construct
  misc_feature 1..20: note = CRISPR gRNA sequence
  source 1..20: mol_type = other DNA
gtcagtcactgaggtggctc

SEQ ID NO: 50580 - DNA, 20 bp, synthetic construct
  misc_feature 1..20: note = CRISPR gRNA sequence
  source 1..20: mol_type = other DNA
agtcactgaggtggctctgg

SEQ ID NO: 50581 - DNA, 20 bp, synthetic construct
  misc_feature 1..20: note = CRISPR gRNA sequence
  source 1..20: mol_type = other DNA
gtcactgaggtggctctggc

SEQ ID NO: 50582 - DNA, 20 bp, synthetic construct
  misc_feature 1..20: note = CRISPR gRNA sequence
  source 1..20: mol_type = other DNA
tcactgaggtggctctggca

SEQ ID NO: 50583 - DNA, 20 bp, synthetic construct
  misc_feature 1..20: note = CRISPR gRNA sequence
  source 1..20: mol_type = other DNA
ccacccctctgctgtcctca

SEQ ID NO: 50584 - DNA, 20 bp, synthetic construct
  misc_feature 1..20: note = CRISPR gRNA sequence
  source 1..20: mol_type = other DNA
cacccctctgctgtcctcac

SEQ ID NO: 50585 - DNA, 20 bp, synthetic construct
  misc_feature 1..20: note = CRISPR gRNA sequence
  source 1..20: mol_type = other DNA
cctctgctgtcctcacgggc

SEQ ID NO: 50586 - DNA, 20 bp, synthetic construct
  misc_feature 1..20: note = CRISPR gRNA sequence
  source 1..20: mol_type = other DNA
ctctgctgtcctcacgggct

SEQ ID NO: 50587 - DNA, 20 bp, synthetic construct
  misc_feature 1..20: note = CRISPR gRNA sequence
  source 1..20: mol_type = other DNA
tgctgtcctcacgggctggg

SEQ ID NO: 50588 - DNA, 20 bp, synthetic construct
  misc_feature 1..20: note = CRISPR gRNA sequence
  source 1..20: mol_type = other DNA
gctgtcctcacgggctgggt

SEQ ID NO: 50589 - DNA, 20 bp, synthetic construct
  misc_feature 1..20: note = CRISPR gRNA sequence
  source 1..20: mol_type = other DNA
gctgggtgggtcactcacgt

SEQ ID NO: 50590 - DNA, 20 bp, synthetic construct
  misc_feature 1..20: note = CRISPR gRNA sequence
  source 1..20: mol_type = other DNA
gtcactcacgtgagctccgt

SEQ ID NO: 50591 - DNA, 20 bp, synthetic construct
  misc_feature 1..20: note = CRISPR gRNA sequence
  source 1..20: mol_type = other DNA
cacgtgagctccgtcagctg

SEQ ID NO: 50592 - DNA, 20 bp, synthetic construct
  misc_feature 1..20: note = CRISPR gRNA sequence
  source 1..20: mol_type = other DNA
acgtgagctccgtcagctgc

SEQ ID NO: 50593 - DNA, 20 bp, synthetic construct
  misc_feature 1..20: note = CRISPR gRNA sequence
  source 1..20: mol_type = other DNA
cgtgagctccgtcagctgca

SEQ ID NO: 50594 - DNA, 20 bp, synthetic construct
  misc_feature 1..20: note = CRISPR gRNA sequence
  source 1..20: mol_type = other DNA
tcagctgcagggacttgctc

SEQ ID NO: 50595 - DNA, 20 bp, synthetic construct
  misc_feature 1..20: note = CRISPR gRNA sequence
  source 1..20: mol_type = other DNA
ctgcagggacttgctcaagc

SEQ ID NO: 50596 - DNA, 20 bp, synthetic construct
  misc_feature 1..20: note = CRISPR gRNA sequence
  source 1..20: mol_type = other DNA
cagggacttgctcaagccgg

SEQ ID NO: 50597 - DNA, 20 bp, synthetic construct
  misc_feature 1..20: note = CRISPR gRNA sequence
  source 1..20: mol_type = other DNA
gacttgctcaagccggtggc

SEQ ID NO: 50598 - DNA, 20 bp, synthetic construct
  misc_feature 1..20: note = CRISPR gRNA sequence
  source 1..20: mol_type = other DNA
gctcaagccggtggccagcc

SEQ ID NO: 50599 - DNA, 20 bp, synthetic construct
  misc_feature 1..20: note = CRISPR gRNA sequence
  source 1..20: mol_type = other DNA
gccagcctggacacgtgctc

SEQ ID NO: 50600 - DNA, 20 bp, synthetic construct
  misc_feature 1..20: note = CRISPR gRNA sequence
  source 1..20: mol_type = other DNA
gcctggacacgtgctctggc

SEQ ID NO: 50601 - DNA, 20 bp, synthetic construct
  misc_feature 1..20: note = CRISPR gRNA sequence
  source 1..20: mol_type = other DNA
tggacacgtgctctggccgg

SEQ ID NO: 50602 - DNA, 20 bp, synthetic construct
  misc_feature 1..20: note = CRISPR gRNA sequence
  source 1..20: mol_type = other DNA
ggccggaagctgcactcact

SEQ ID NO: 50603 - DNA, 20 bp, synthetic construct
  misc_feature 1..20: note = CRISPR gRNA sequence
  source 1..20: mol_type = other DNA
aagctgcactcacttagcct

SEQ ID NO: 50604 - DNA, 20 bp, synthetic construct
  misc_feature 1..20: note = CRISPR gRNA sequence
  source 1..20: mol_type = other DNA
agctgcactcacttagcctg

SEQ ID NO: 50605 - DNA, 20 bp, synthetic construct
  misc_feature 1..20: note = CRISPR gRNA sequence
  source 1..20: mol_type = other DNA
gctgcactcacttagcctga

SEQ ID NO: 50606 - DNA, 20 bp, synthetic construct
  misc_feature 1..20: note = CRISPR gRNA sequence
  source 1..20: mol_type = other DNA
gcactcacttagcctgaggg

SEQ ID NO: 50607 - DNA, 20 bp, synthetic construct
  misc_feature 1..20: note = CRISPR gRNA sequence
  source 1..20: mol_type = other DNA
tcacttagcctgagggcaga

SEQ ID NO: 50608 - DNA, 20 bp, synthetic construct
  misc_feature 1..20: note = CRISPR gRNA sequence
  source 1..20: mol_type = other DNA
ttagcctgagggcagaaagc

SEQ ID NO: 50609 - DNA, 20 bp, synthetic construct
  misc_feature 1..20: note = CRISPR gRNA sequence
  source 1..20: mol_type = other DNA
tagcctgagggcagaaagcc

SEQ ID NO: 50610 - DNA, 20 bp, synthetic construct
  misc_feature 1..20: note = CRISPR gRNA sequence
  source 1..20: mol_type = other DNA
agcctgagggcagaaagcca

SEQ ID NO: 50611 - DNA, 20 bp, synthetic construct
  misc_feature 1..20: note = CRISPR gRNA sequence
  source 1..20: mol_type = other DNA
ctgagggcagaaagccaggg

SEQ ID NO: 50612 - DNA, 20 bp, synthetic construct
  misc_feature 1..20: note = CRISPR gRNA sequence
  source 1..20: mol_type = other DNA
gagggcagaaagccagggca

SEQ ID NO: 50613 - DNA, 20 bp, synthetic construct
  misc_feature 1..20: note = CRISPR gRNA sequence
  source 1..20: mol_type = other DNA
cagaaagccagggcagagcc

SEQ ID NO: 50614 - DNA, 20 bp, synthetic construct
  misc_feature 1..20: note = CRISPR gRNA sequence
  source 1..20: mol_type = other DNA
agaaagccagggcagagcct

SEQ ID NO: 50615 - DNA, 20 bp, synthetic construct
  misc_feature 1..20: note = CRISPR gRNA sequence
  source 1..20: mol_type = other DNA
agccagggcagagcctgggt

SEQ ID NO: 50616 - DNA, 20 bp, synthetic construct
  misc_feature 1..20: note = CRISPR gRNA sequence
  source 1..20: mol_type = other DNA
gccagggcagagcctgggtg

SEQ ID NO: 50617 - DNA, 20 bp, synthetic construct
  misc_feature 1..20: note = CRISPR gRNA sequence
  source 1..20: mol_type = other DNA
cagagcctgggtgaggcctg

SEQ ID NO: 50618 - DNA, 20 bp, synthetic construct
  misc_feature 1..20: note = CRISPR gRNA sequence
  source 1..20: mol_type = other DNA
agagcctgggtgaggcctgt

SEQ ID NO: 50619 - DNA, 20 bp, synthetic construct
  misc_feature 1..20: note = CRISPR gRNA sequence
  source 1..20: mol_type = other DNA
ggcctgtgggcactgctgct

SEQ ID NO: 50620 - DNA, 20 bp, synthetic construct
  misc_feature 1..20: note = CRISPR gRNA sequence
  source 1..20: mol_type = other DNA
actgctgctcagcttcatct

SEQ ID NO: 50621 - DNA, 20 bp, synthetic construct
  misc_feature 1..20: note = CRISPR gRNA sequence
  source 1..20: mol_type = other DNA
agcttcatctcagcctccct

SEQ ID NO: 50622 - DNA, 20 bp, synthetic construct
  misc_feature 1..20: note = CRISPR gRNA sequence
  source 1..20: mol_type = other DNA
gcttcatctcagcctccctg

SEQ ID NO: 50623 - DNA, 20 bp, synthetic construct
  misc_feature 1..20: note = CRISPR gRNA sequence
  source 1..20: mol_type = other DNA
cttcatctcagcctccctga

SEQ ID NO: 50624 - DNA, 20 bp, synthetic construct
  misc_feature 1..20: note = CRISPR gRNA sequence
  source 1..20: mol_type = other DNA
cagcctccctgagggcctat

SEQ ID NO: 50625 - DNA, 20 bp, synthetic construct
  misc_feature 1..20: note = CRISPR gRNA sequence
  source 1..20: mol_type = other DNA
agcctccctgagggcctatt

SEQ ID NO: 50626 - DNA, 20 bp, synthetic construct
  misc_feature 1..20: note = CRISPR gRNA sequence
  source 1..20: mol_type = other DNA
gcctccctgagggcctattg

SEQ ID NO: 50627 - DNA, 20 bp, synthetic construct
  misc_feature 1..20: note = CRISPR gRNA sequence
  source 1..20: mol_type = other DNA
cctccctgagggcctattgg

SEQ ID NO: 50628 - DNA, 20 bp, synthetic construct
  misc_feature 1..20: note = CRISPR gRNA sequence
  source 1..20: mol_type = other DNA
tccctgagggcctattgggg

SEQ ID NO: 50629 - DNA, 20 bp, synthetic construct
  misc_feature 1..20: note = CRISPR gRNA sequence
  source 1..20: mol_type = other DNA
tgggggagcatcccacctct

SEQ ID NO: 50630 - DNA, 20 bp, synthetic construct
  misc_feature 1..20: note = CRISPR gRNA sequence
  source 1..20: mol_type = other DNA
gggggagcatcccacctctg

SEQ ID NO: 50631 - DNA, 20 bp, synthetic construct
  misc_feature 1..20: note = CRISPR gRNA sequence
  source 1..20: mol_type = other DNA
ggggagcatcccacctctga

SEQ ID NO: 50632 - DNA, 20 bp, synthetic construct
  misc_feature 1..20: note = CRISPR gRNA sequence
  source 1..20: mol_type = other DNA
gcatcccacctctgagggca

SEQ ID NO: 50633 - DNA, 20 bp, synthetic construct
  misc_feature 1..20: note = CRISPR gRNA sequence
  source 1..20: mol_type = other DNA
catcccacctctgagggcaa

SEQ ID NO: 50634 - DNA, 20 bp, synthetic construct
  misc_feature 1..20: note = CRISPR gRNA sequence
  source 1..20: mol_type = other DNA
cacctctgagggcaaaggcc

SEQ ID NO: 50635 - DNA, 20 bp, synthetic construct
  misc_feature 1..20: note = CRISPR gRNA sequence
  source 1..20: mol_type = other DNA
cctctgagggcaaaggcctg

SEQ ID NO: 50636 - DNA, 20 bp, synthetic construct
  misc_feature 1..20: note = CRISPR gRNA sequence
  source 1..20: mol_type = other DNA
ctgagggcaaaggcctggag

SEQ ID NO: 50637 - DNA, 20 bp, synthetic construct
  misc_feature 1..20: note = CRISPR gRNA sequence
  source 1..20: mol_type = other DNA
tgagggcaaaggcctggagc

SEQ ID NO: 50638 - DNA, 20 bp, synthetic construct
  misc_feature 1..20: note = CRISPR gRNA sequence
  source 1..20: mol_type = other DNA
gagggcaaaggcctggagca

SEQ ID NO: 50639 - DNA, 20 bp, synthetic construct
  misc_feature 1..20: note = CRISPR gRNA sequence
  source 1..20: mol_type = other DNA
aaaggcctggagcagggcct

SEQ ID NO: 50640 - DNA, 20 bp, synthetic construct
  misc_feature 1..20: note = CRISPR gRNA sequence
  source 1..20: mol_type = other DNA
aggcctggagcagggcctga

SEQ ID NO: 50641 - DNA, 20 bp, synthetic construct
  misc_feature 1..20: note = CRISPR gRNA sequence
  source 1..20: mol_type = other DNA
ggcctggagcagggcctgag

SEQ ID NO: 50642 - DNA, 20 bp, synthetic construct
  misc_feature 1..20: note = CRISPR gRNA sequence
  source 1..20: mol_type = other DNA
ggcctgagaggccaaatatg

SEQ ID NO: 50643 - DNA, 20 bp, synthetic construct
  misc_feature 1..20: note = CRISPR gRNA sequence
  source 1..20: mol_type = other DNA
caaatatgcagctcctgctc

SEQ ID NO: 50644 - DNA, 20 bp, synthetic construct
  misc_feature 1..20: note = CRISPR gRNA sequence
  source 1..20: mol_type = other DNA
aaatatgcagctcctgctct

SEQ ID NO: 50645 - DNA, 20 bp, synthetic construct
  misc_feature 1..20: note = CRISPR gRNA sequence
  source 1..20: mol_type = other DNA
atatgcagctcctgctctgg

SEQ ID NO: 50646 - DNA, 20 bp, synthetic construct
  misc_feature 1..20: note = CRISPR gRNA sequence
  source 1..20: mol_type = other DNA
ctgggagcttcctgtctctt

SEQ ID NO: 50647 - DNA, 20 bp, synthetic construct
  misc_feature 1..20: note = CRISPR gRNA sequence
  source 1..20: mol_type = other DNA
tgggagcttcctgtctcttt

SEQ ID NO: 50648 - DNA, 20 bp, synthetic construct
  misc_feature 1..20: note = CRISPR gRNA sequence
  source 1..20: mol_type = other DNA
gggagcttcctgtctctttg

SEQ ID NO: 50649 - DNA, 20 bp, synthetic construct
  misc_feature 1..20: note = CRISPR gRNA sequence
  source 1..20: mol_type = other DNA
gagcttcctgtctctttggg

SEQ ID NO: 50650 - DNA, 20 bp, synthetic construct
  misc_feature 1..20: note = CRISPR gRNA sequence
  source 1..20: mol_type = other DNA
agcttcctgtctctttgggg

SEQ ID NO: 50651 - DNA, 20 bp, synthetic construct
  misc_feature 1..20: note = CRISPR gRNA sequence
  source 1..20: mol_type = other DNA
gaacctcccacaccccctgt

SEQ ID NO: 50652 - DNA, 20 bp, synthetic construct
  misc_feature 1..20: note = CRISPR gRNA sequence
  source 1..20: mol_type = other DNA
ctcccacaccccctgtaaga

SEQ ID NO: 50653 - DNA, 20 bp, synthetic construct
  misc_feature 1..20: note = CRISPR gRNA sequence
  source 1..20: mol_type = other DNA
caccccctgtaagaaagtat

SEQ ID NO: 50654 - DNA, 20 bp, synthetic construct
  misc_feature 1..20: note = CRISPR gRNA sequence
  source 1..20: mol_type = other DNA
accccctgtaagaaagtatt

SEQ ID NO: 50655 - DNA, 20 bp, synthetic construct
  misc_feature 1..20: note = CRISPR gRNA sequence
  source 1..20: mol_type = other DNA
cccctgtaagaaagtattag

SEQ ID NO: 50656 - DNA, 20 bp, synthetic construct
  misc_feature 1..20: note = CRISPR gRNA sequence
  source 1..20: mol_type = other DNA
tgtaagaaagtattaggagt

SEQ ID NO: 50657 - DNA, 20 bp, synthetic construct
  misc_feature 1..20: note = CRISPR gRNA sequence
  source 1..20: mol_type = other DNA
agtattaggagtaagttatt

SEQ ID NO: 50658 - DNA, 20 bp, synthetic construct
  misc_feature 1..20: note = CRISPR gRNA sequence
  source 1..20: mol_type = other DNA
gtattaggagtaagttattt

SEQ ID NO: 50659 - DNA, 20 bp, synthetic construct
  misc_feature 1..20: note = CRISPR gRNA sequence
  source 1..20: mol_type = other DNA
tattaggagtaagttattta

SEQ ID NO: 50660 - DNA, 20 bp, synthetic construct
  misc_feature 1..20: note = CRISPR gRNA sequence
  source 1..20: mol_type = other DNA
ttaggagtaagttatttagg

SEQ ID NO: 50661 - DNA, 20 bp, synthetic construct
  misc_feature 1..20: note = CRISPR gRNA sequence
  source 1..20: mol_type = other DNA
taggagtaagttatttaggg

SEQ ID NO: 50662 - DNA, 20 bp, synthetic construct
  misc_feature 1..20: note = CRISPR gRNA sequence
  source 1..20: mol_type = other DNA
ttatttagggaggctgactc

SEQ ID NO: 50663 - DNA, 20 bp, synthetic construct
  misc_feature 1..20: note = CRISPR gRNA sequence
  source 1..20: mol_type = other DNA
tatttagggaggctgactct

SEQ ID NO: 50664 - DNA, 20 bp, synthetic construct
  misc_feature 1..20: note = CRISPR gRNA sequence
  source 1..20: mol_type = other DNA
tagggaggctgactctaggt

SEQ ID NO: 50665 - DNA, 20 bp, synthetic construct
  misc_feature 1..20: note = CRISPR gRNA sequence
  source 1..20: mol_type = other DNA
agggaggctgactctaggtc

SEQ ID NO: 50666 - DNA, 20 bp, synthetic construct
  misc_feature 1..20: note = CRISPR gRNA sequence
  source 1..20: mol_type = other DNA
ctctaggtcaggcactgtgc

SEQ ID NO: 50667 - DNA, 20 bp, synthetic construct
  misc_feature 1..20: note = CRISPR gRNA sequence
  source 1..20: mol_type = other DNA
tcaggcactgtgccagcctc

SEQ ID NO: 50668 - DNA, 20 bp, synthetic construct
  misc_feature 1..20: note = CRISPR gRNA sequence
  source 1..20: mol_type = other DNA
caggcactgtgccagcctct

SEQ ID NO: 50669 - DNA, 20 bp, synthetic construct
  misc_feature 1..20: note = CRISPR gRNA sequence
  source 1..20: mol_type = other DNA
tgtgccagcctctgggtgca

SEQ ID NO: 50670 - DNA, 20 bp, synthetic construct
  misc_feature 1..20: note = CRISPR gRNA sequence
  source 1..20: mol_type = other DNA
gtgccagcctctgggtgcat

SEQ ID NO: 50671 - DNA, 20 bp, synthetic construct
  misc_feature 1..20: note = CRISPR gRNA sequence
  source 1..20: mol_type = other DNA
gggacttcctgccttacccg

SEQ ID NO: 50672 - DNA, 20 bp, synthetic construct
  misc_feature 1..20: note = CRISPR gRNA sequence
  source 1..20: mol_type = other DNA
ggacttcctgccttacccgc

SEQ ID NO: 50673 - DNA, 20 bp, synthetic construct
  misc_feature 1..20: note = CRISPR gRNA sequence
  source 1..20: mol_type = other DNA
gacttcctgccttacccgca

SEQ ID NO: 50674 - DNA, 20 bp, synthetic construct
  misc_feature 1..20: note = CRISPR gRNA sequence
  source 1..20: mol_type = other DNA
agggtctcctttaattctca

SEQ ID NO: 50675 - DNA, 20 bp, synthetic construct
  misc_feature 1..20: note = CRISPR gRNA sequence
  source 1..20: mol_type = other DNA
ttaattctcatagcaccaat

SEQ ID NO: 50676 - DNA, 20 bp, synthetic construct
  misc_feature 1..20: note = CRISPR gRNA sequence
  source 1..20: mol_type = other DNA
aattctcatagcaccaatta

SEQ ID NO: 50677 - DNA, 20 bp, synthetic construct
  misc_feature 1..20: note = CRISPR gRNA sequence
  source 1..20: mol_type = other DNA
attctcatagcaccaattag

SEQ ID NO: 50678 - DNA, 20 bp, synthetic construct
  misc_feature 1..20: note = CRISPR gRNA sequence
  source 1..20: mol_type = other DNA
ctcatagcaccaattagagg

SEQ ID NO: 50679 - DNA, 20 bp, synthetic construct
  misc_feature 1..20: note = CRISPR gRNA sequence
  source 1..20: mol_type = other DNA
tcatagcaccaattagaggt

SEQ ID NO: 50680 - DNA, 20 bp, synthetic construct
  misc_feature 1..20: note = CRISPR gRNA sequence
  source 1..20: mol_type = other DNA
catagcaccaattagaggtg

SEQ ID NO: 50681 - DNA, 20 bp, synthetic construct
  misc_feature 1..20: note = CRISPR gRNA sequence
  source 1..20: mol_type = other DNA
gtggggaaactgactaaccc

SEQ ID NO: 50682 - DNA, 20 bp, synthetic construct
  misc_feature 1..20: note = CRISPR gRNA sequence
  source 1..20: mol_type = other DNA
tggggaaactgactaaccca

SEQ ID NO: 50683 - DNA, 20 bp, synthetic construct
  misc_feature 1..20: note = CRISPR gRNA sequence
  source 1..20: mol_type = other DNA
ctgactaacccaaggacaca

SEQ ID NO: 50684 - DNA, 20 bp, synthetic construct
  misc_feature 1..20: note = CRISPR gRNA sequence
  source 1..20: mol_type = other DNA
actaacccaaggacacacag

SEQ ID NO: 50685 - DNA, 20 bp, synthetic construct
  misc_feature 1..20: note = CRISPR gRNA sequence
  source 1..20: mol_type = other DNA
cccaaggacacacagcagat

SEQ ID NO: 50686 - DNA, 20 bp, synthetic construct
  misc_feature 1..20: note = CRISPR gRNA sequence
  source 1..20: mol_type = other DNA
aggacacacagcagataaga

SEQ ID NO: 50687 - DNA, 20 bp, synthetic construct
  misc_feature 1..20: note = CRISPR gRNA sequence
  source 1..20: mol_type = other DNA
acacacagcagataagaaag

SEQ ID NO: 50688 - DNA, 20 bp, synthetic construct
  misc_feature 1..20: note = CRISPR gRNA sequence
  source 1..20: mol_type = other DNA
cacacagcagataagaaaga

SEQ ID NO: 50689 - DNA, 20 bp, synthetic construct
  misc_feature 1..20: note = CRISPR gRNA sequence
  source 1..20: mol_type = other DNA
acacagcagataagaaagaa

SEQ ID NO: 50690 - DNA, 20 bp, synthetic construct
  misc_feature 1..20: note = CRISPR gRNA sequence
  source 1..20: mol_type = other DNA
cagcagataagaaagaaggg

SEQ ID NO: 50691 - DNA, 20 bp, synthetic construct
  misc_feature 1..20: note = CRISPR gRNA sequence
  source 1..20: mol_type = other DNA
taagaaagaagggcagaatc

SEQ ID NO: 50692 - DNA, 20 bp, synthetic construct
  misc_feature 1..20: note = CRISPR gRNA sequence
  source 1..20: mol_type = other DNA
ggcagaatctggtttccatc

SEQ ID NO: 50693 - DNA, 20 bp, synthetic construct
  misc_feature 1..20: note = CRISPR gRNA sequence
  source 1..20: mol_type = other DNA
gcagaatctggtttccatcc

SEQ ID NO: 50694 - DNA, 20 bp, synthetic construct
  misc_feature 1..20: note = CRISPR gRNA sequence
  source 1..20: mol_type = other DNA
aatctggtttccatccaggt

SEQ ID NO: 50695 - DNA, 20 bp, synthetic construct
  misc_feature 1..20: note = CRISPR gRNA sequence
  source 1..20: mol_type = other DNA
catccaggtcagtctgactg

SEQ ID NO: 50696 - DNA, 20 bp, synthetic construct
  misc_feature 1..20: note = CRISPR gRNA sequence
  source 1..20: mol_type = other DNA
tcagtctgactgcagacccc

SEQ ID NO: 50697 - DNA, 20 bp, synthetic construct
  misc_feature 1..20: note = CRISPR gRNA sequence
  source 1..20: mol_type = other DNA
taaccactgccttactctcc

SEQ ID NO: 50698 - DNA, 20 bp, synthetic construct
  misc_feature 1..20: note = CRISPR gRNA sequence
  source 1..20: mol_type = other DNA
actgccttactctcccggac

SEQ ID NO: 50699 - DNA, 20 bp, synthetic construct
  misc_feature 1..20: note = CRISPR gRNA sequence
  source 1..20: mol_type = other DNA
ttactctcccggaccagcac

SEQ ID NO: 50700 - DNA, 20 bp, synthetic construct
  misc_feature 1..20: note = CRISPR gRNA sequence
  source 1..20: mol_type = other DNA
ctcccggaccagcactggct

SEQ ID NO: 50701 - DNA, 20 bp, synthetic construct
  misc_feature 1..20: note = CRISPR gRNA sequence
  source 1..20: mol_type = other DNA
ccagcactggctgagctccc

SEQ ID NO: 50702 - DNA, 20 bp, synthetic construct
  misc_feature 1..20: note = CRISPR gRNA sequence
  source 1..20: mol_type = other DNA
cagcactggctgagctccct

SEQ ID NO: 50703 - DNA, 20 bp, synthetic construct
  misc_feature 1..20: note = CRISPR gRNA sequence
  source 1..20: mol_type = other DNA
agcactggctgagctccctg

SEQ ID NO: 50704 - DNA, 20 bp, synthetic construct
  misc_feature 1..20: note = CRISPR gRNA sequence
  source 1..20: mol_type = other DNA
cactggctgagctccctggg

SEQ ID NO: 50705 - DNA, 20 bp, synthetic construct
  misc_feature 1..20: note = CRISPR gRNA sequence
  source 1..20: mol_type = other DNA
actggctgagctccctgggg

SEQ ID NO: 50706 - DNA, 20 bp, synthetic construct
  misc_feature 1..20: note = CRISPR gRNA sequence
  source 1..20: mol_type = other DNA
ctggctgagctccctgggga

SEQ ID NO: 50707 - DNA, 20 bp, synthetic construct
  misc_feature 1..20: note = CRISPR gRNA sequence
  source 1..20: mol_type = other DNA
ggctgagctccctggggagg

SEQ ID NO: 50708 - DNA, 20 bp, synthetic construct
  misc_feature 1..20: note = CRISPR gRNA sequence
  source 1..20: mol_type = other DNA
gctgagctccctggggaggg

SEQ ID NO: 50709 - DNA, 20 bp, synthetic construct
  misc_feature 1..20: note = CRISPR gRNA sequence
  source 1..20: mol_type = other DNA
cctggggagggaggtgtgcc

SEQ ID NO: 50710 - DNA, 20 bp, synthetic construct
  misc_feature 1..20: note = CRISPR gRNA sequence
  source 1..20: mol_type = other DNA
ctggggagggaggtgtgcct

SEQ ID NO: 50711 - DNA, 20 bp, synthetic construct
  misc_feature 1..20: note = CRISPR gRNA sequence
  source 1..20: mol_type = other DNA
ggtgtgcctgggattctccg

SEQ ID NO: 50712 - DNA, 20 bp, synthetic construct
  misc_feature 1..20: note = CRISPR gRNA sequence
  source 1..20: mol_type = other DNA
gtgtgcctgggattctccgt

SEQ ID NO: 50713 - DNA, 20 bp, synthetic construct
  misc_feature 1..20: note = CRISPR gRNA sequence
  source 1..20: mol_type = other DNA
tgtgcctgggattctccgtg

SEQ ID NO: 50714 - DNA, 20 bp, synthetic construct
  misc_feature 1..20: note = CRISPR gRNA sequence
  source 1..20: mol_type = other DNA
ctccgtggggctctgctgtc

SEQ ID NO: 50715 - DNA, 20 bp, synthetic construct
  misc_feature 1..20: note = CRISPR gRNA sequence
  source 1..20: mol_type = other DNA
tccgtggggctctgctgtcc

SEQ ID NO: 50716 - DNA, 20 bp, synthetic construct
  misc_feature 1..20: note = CRISPR gRNA sequence
  source 1..20: mol_type = other DNA
gctctgctgtccaggcatct

SEQ ID NO: 50717 - DNA, 20 bp, synthetic construct
  misc_feature 1..20: note = CRISPR gRNA sequence
  source 1..20: mol_type = other DNA
ctgtccaggcatctcagccc

SEQ ID NO: 50718 - DNA, 20 bp, synthetic construct
  misc_feature 1..20: note = CRISPR gRNA sequence
  source 1..20: mol_type = other DNA
tgtccaggcatctcagccct

SEQ ID NO: 50719 - DNA, 20 bp, synthetic construct
  misc_feature 1..20: note = CRISPR gRNA sequence
  source 1..20: mol_type = other DNA
ccaggcatctcagccctggg

SEQ ID NO: 50720 - DNA, 20 bp, synthetic construct
  misc_feature 1..20: note = CRISPR gRNA sequence
  source 1..20: mol_type = other DNA
gcatctcagccctgggtggc

SEQ ID NO: 50721 - DNA, 20 bp, synthetic construct
  misc_feature 1..20: note = CRISPR gRNA sequence
  source 1..20: mol_type = other DNA
tctcagccctgggtggccag

SEQ ID NO: 50722 - DNA, 20 bp, synthetic construct
  misc_feature 1..20: note = CRISPR gRNA sequence
  source 1..20: mol_type = other DNA
agccctgggtggccagcaga

SEQ ID NO: 50723 - DNA, 20 bp, synthetic construct
  misc_feature 1..20: note = CRISPR gRNA sequence
  source 1..20: mol_type = other DNA
gccctgggtggccagcagac

SEQ ID NO: 50724 - DNA, 20 bp, synthetic construct
  misc_feature 1..20: note = CRISPR gRNA sequence
  source 1..20: mol_type = other DNA
gggtggccagcagacgggcc

SEQ ID NO: 50725 - DNA, 20 bp, synthetic construct
  misc_feature 1..20: note = CRISPR gRNA sequence
  source 1..20: mol_type = other DNA
gccagcagacgggcccagcc

SEQ ID NO: 50726 - DNA, 20 bp, synthetic construct
  misc_feature 1..20: note = CRISPR gRNA sequence
  source 1..20: mol_type = other DNA
agacgggcccagccaagtga

SEQ ID NO: 50727 - DNA, 20 bp, synthetic construct
  misc_feature 1..20: note = CRISPR gRNA sequence
  source 1..20: mol_type = other DNA
gacgggcccagccaagtgaa

SEQ ID NO: 50728 - DNA, 20 bp, synthetic construct
  misc_feature 1..20: note = CRISPR gRNA sequence
  source 1..20: mol_type = other DNA
acgggcccagccaagtgaaa

SEQ ID NO: 50729 - DNA, 20 bp, synthetic construct
  misc_feature 1..20: note = CRISPR gRNA sequence
  source 1..20: mol_type = other DNA
cccagccaagtgaaagggcc

SEQ ID NO: 50730 - DNA, 20 bp, synthetic construct
  misc_feature 1..20: note = CRISPR gRNA sequence
  source 1..20: mol_type = other DNA
tgaaagggcccagtgaacct

SEQ ID NO: 50731 - DNA, 20 bp, synthetic construct
  misc_feature 1..20: note = CRISPR gRNA sequence
  source 1..20: mol_type = other DNA
gaaagggcccagtgaacctc

SEQ ID NO: 50732 - DNA, 20 bp, synthetic construct
  misc_feature 1..20: note = CRISPR gRNA sequence
  source 1..20: mol_type = other DNA
aaagggcccagtgaacctcg

SEQ ID NO: 50733 - DNA, 20 bp, synthetic construct
  misc_feature 1..20: note = CRISPR gRNA sequence
  source 1..20: mol_type = other DNA
gggcccagtgaacctcgggg

SEQ ID NO: 50734 - DNA, 20 bp, synthetic construct
  misc_feature 1..20: note = CRISPR gRNA sequence
  source 1..20: mol_type = other DNA
tcggggcagttcactctgat

SEQ ID NO: 50735 - DNA, 20 bp, synthetic construct
  misc_feature 1..20: note = CRISPR gRNA sequence
  source 1..20: mol_type = other DNA
cggggcagttcactctgatg

SEQ ID NO: 50736 - DNA, 20 bp, synthetic construct
  misc_feature 1..20: note = CRISPR gRNA sequence
  source 1..20: mol_type = other DNA
ggcagttcactctgatgagg

SEQ ID NO: 50737 - DNA, 20 bp, synthetic construct
  misc_feature 1..20: note = CRISPR gRNA sequence
  source 1..20: mol_type = other DNA
gcagttcactctgatgaggc

SEQ ID NO: 50738 - DNA, 20 bp, synthetic construct
  misc_feature 1..20: note = CRISPR gRNA sequence
  source 1..20: mol_type = other DNA
cagttcactctgatgaggca

SEQ ID NO: 50739 - DNA, 20 bp, synthetic construct
  misc_feature 1..20: note = CRISPR gRNA sequence
  source 1..20: mol_type = other DNA
ctctgatgaggcagggctgc

SEQ ID NO: 50740 - DNA, 20 bp, synthetic construct
  misc_feature 1..20: note = CRISPR gRNA sequence
  source 1..20: mol_type = other DNA
tctgatgaggcagggctgct

SEQ ID NO: 50741 - DNA, 20 bp, synthetic construct
  misc_feature 1..20: note = CRISPR gRNA sequence
  source 1..20: mol_type = other DNA
cagggctgctgggatacttc

SEQ ID NO: 50742 - DNA, 20 bp, synthetic construct
  misc_feature 1..20: note = CRISPR gRNA sequence
  source 1..20: mol_type = other DNA
agggctgctgggatacttcc

SEQ ID NO: 50743 - DNA, 20 bp, synthetic construct
  misc_feature 1..20: note = CRISPR gRNA sequence
  source 1..20: mol_type = other DNA
ggctgctgggatacttccag

SEQ ID NO: 50744 - DNA, 20 bp, synthetic construct
  misc_feature 1..20: note = CRISPR gRNA sequence
  source 1..20: mol_type = other DNA
gctgctgggatacttccagg

SEQ ID NO: 50745 - DNA, 20 bp, synthetic construct
  misc_feature 1..20: note = CRISPR gRNA sequence
  source 1..20: mol_type = other DNA
ctgctgggatacttccagga

SEQ ID NO: 50746 - DNA, 20 bp, synthetic construct
  misc_feature 1..20: note = CRISPR gRNA sequence
  source 1..20: mol_type = other DNA
tgctgggatacttccaggag

SEQ ID NO: 50747 - DNA, 20 bp, synthetic construct
  misc_feature 1..20: note = CRISPR gRNA sequence
  source 1..20: mol_type = other DNA
tccaggaggggctgatgttt

SEQ ID NO: 50748 - DNA, 20 bp, synthetic construct
  misc_feature 1..20: note = CRISPR gRNA sequence
  source 1..20: mol_type = other DNA
ggaggggctgatgtttgagc

SEQ ID NO: 50749 - DNA, 20 bp, synthetic construct
  misc_feature 1..20: note = CRISPR gRNA sequence
  source 1..20: mol_type = other DNA
gaggggctgatgtttgagct

SEQ ID NO: 50750 - DNA, 20 bp, synthetic construct
  misc_feature 1..20: note = CRISPR gRNA sequence
  source 1..20: mol_type = other DNA
gatgtttgagctgggtgtta

SEQ ID NO: 50751 - DNA, 20 bp, synthetic construct
  misc_feature 1..20: note = CRISPR gRNA sequence
  source 1..20: mol_type = other DNA
atgtttgagctgggtgttaa

SEQ ID NO: 50752 - DNA, 20 bp, synthetic construct
  misc_feature 1..20: note = CRISPR gRNA sequence
  source 1..20: mol_type = other DNA
tgagctgggtgttaaaggat

SEQ ID NO: 50753 - DNA, 20 bp, synthetic construct
  misc_feature 1..20: note = CRISPR gRNA sequence
  source 1..20: mol_type = other DNA
gagctgggtgttaaaggatt

SEQ ID NO: 50754 - DNA, 20 bp, synthetic construct
  misc_feature 1..20: note = CRISPR gRNA sequence
  source 1..20: mol_type = other DNA
gctgggtgttaaaggattgg

SEQ ID NO: 50755 - DNA, 20 bp, synthetic construct
  misc_feature 1..20: note = CRISPR gRNA sequence
  source 1..20: mol_type = other DNA
ggattgggagaattttatct

SEQ ID NO: 50756 - DNA, 20 bp, synthetic construct
  misc_feature 1..20: note = CRISPR gRNA sequence
  source 1..20: mol_type = other DNA
gggagaattttatctcagaa

SEQ ID NO: 50757 - DNA, 20 bp, synthetic construct
  misc_feature 1..20: note = CRISPR gRNA sequence
  source 1..20: mol_type = other DNA
ggagaattttatctcagaaa

SEQ ID NO: 50758 - DNA, 20 bp, synthetic construct
  misc_feature 1..20: note = CRISPR gRNA sequence
  source 1..20: mol_type = other DNA
aattttatctcagaaaaggc

SEQ ID NO: 50759 - DNA, 20 bp, synthetic construct
  misc_feature 1..20: note = CRISPR gRNA sequence
  source 1..20: mol_type = other DNA
attttatctcagaaaaggca

SEQ ID NO: 50760 - DNA, 20 bp, synthetic construct
  misc_feature 1..20: note = CRISPR gRNA sequence
  source 1..20: mol_type = other DNA
ttatctcagaaaaggcaagg

SEQ ID NO: 50761 - DNA, 20 bp, synthetic construct
  misc_feature 1..20: note = CRISPR gRNA sequence
  source 1..20: mol_type = other DNA
atctcagaaaaggcaaggaa

SEQ ID NO: 50762 - DNA, 20 bp, synthetic construct
  misc_feature 1..20: note = CRISPR gRNA sequence
  source 1..20: mol_type = other DNA
aaggcaaggaagagaatgtt

SEQ ID NO: 50763 - DNA, 20 bp, synthetic construct
  misc_feature 1..20: note = CRISPR gRNA sequence
  source 1..20: mol_type = other DNA
aaggaagagaatgttgagct

SEQ ID NO: 50764 - DNA, 20 bp, synthetic construct
  misc_feature 1..20: note = CRISPR gRNA sequence
  source 1..20: mol_type = other DNA
agagaatgttgagctgagtg

SEQ ID NO: 50765 - DNA, 20 bp, synthetic construct
  misc_feature 1..20: note = CRISPR gRNA sequence
  source 1..20: mol_type = other DNA
tgttgagctgagtgcggtgt

SEQ ID NO: 50766 - DNA, 20 bp, synthetic construct
  misc_feature 1..20: note = CRISPR gRNA sequence
  source 1..20: mol_type = other DNA
tgagctgagtgcggtgtgag

SEQ ID NO: 50767 - DNA, 20 bp, synthetic construct
  misc_feature 1..20: note = CRISPR gRNA sequence
  source 1..20: mol_type = other DNA
agctgagtgcggtgtgagca

SEQ ID NO: 50768 - DNA, 20 bp, synthetic construct
  misc_feature 1..20: note = CRISPR gRNA sequence
  source 1..20: mol_type = other DNA
gctgagtgcggtgtgagcag

SEQ ID NO: 50769 - DNA, 20 bp, synthetic construct
  misc_feature 1..20: note = CRISPR gRNA sequence
  source 1..20: mol_type = other DNA
gagtgcggtgtgagcagagg

SEQ ID NO: 50770 - DNA, 20 bp, synthetic construct
  misc_feature 1..20: note = CRISPR gRNA sequence
  source 1..20: mol_type = other DNA
gtgcggtgtgagcagaggca

SEQ ID NO: 50771 - DNA, 20 bp, synthetic construct
  misc_feature 1..20: note = CRISPR gRNA sequence
  source 1..20: mol_type = other DNA
gagcagaggcagagaatctt

SEQ ID NO: 50772 - DNA, 20 bp, synthetic construct
  misc_feature 1..20: note = CRISPR gRNA sequence
  source 1..20: mol_type = other DNA
agcagaggcagagaatcttc

SEQ ID NO: 50773 - DNA, 20 bp, synthetic construct
  misc_feature 1..20: note = CRISPR gRNA sequence
  source 1..20: mol_type = other DNA
agaggcagagaatcttcagg

SEQ ID NO: 50774 - DNA, 20 bp, synthetic construct
  misc_feature 1..20: note = CRISPR gRNA sequence
  source 1..20: mol_type = other DNA
gaggcagagaatcttcaggc

SEQ ID NO: 50775 - DNA, 20 bp, synthetic construct
  misc_feature 1..20: note = CRISPR gRNA sequence
  source 1..20: mol_type = other DNA
aggcagagaatcttcaggca

SEQ ID NO: 50776 - DNA, 20 bp, synthetic construct
  misc_feature 1..20: note = CRISPR gRNA sequence
  source 1..20: mol_type = other DNA
tcttcaggcagggcttgatc

SEQ ID NO: 50777 - DNA, 20 bp, synthetic construct
  misc_feature 1..20: note = CRISPR gRNA sequence
  source 1..20: mol_type = other DNA
cttcaggcagggcttgatct

SEQ ID NO: 50778 - DNA, 20 bp, synthetic construct
  misc_feature 1..20: note = CRISPR gRNA sequence
  source 1..20: mol_type = other DNA
tcaggcagggcttgatctag

SEQ ID NO: 50779 - DNA, 20 bp, synthetic construct
  misc_feature 1..20: note = CRISPR gRNA sequence
  source 1..20: mol_type = other DNA
gggcttgatctaggagcaaa

SEQ ID NO: 50780 - DNA, 20 bp, synthetic construct
  misc_feature 1..20: note = CRISPR gRNA sequence
  source 1..20: mol_type = other DNA
tgatctaggagcaaatagtg

SEQ ID NO: 50781 - DNA, 20 bp, synthetic construct
  misc_feature 1..20: note = CRISPR gRNA sequence
  source 1..20: mol_type = other DNA
gatctaggagcaaatagtga

SEQ ID NO: 50782 - DNA, 20 bp, synthetic construct
  misc_feature 1..20: note = CRISPR gRNA sequence
  source 1..20: mol_type = other DNA
ggagcaaatagtgaaggtta

SEQ ID NO: 50783 - DNA, 20 bp, synthetic construct
  misc_feature 1..20: note = CRISPR gRNA sequence
  source 1..20: mol_type = other DNA
gtgtgtgtgtgttgtgtatg

SEQ ID NO: 50784 - DNA, 20 bp, synthetic construct
  misc_feature 1..20: note = CRISPR gRNA sequence
  source 1..20: mol_type = other DNA
tgttgtgtatgtggtatttg

SEQ ID NO: 50785 - DNA, 20 bp, synthetic construct
  misc_feature 1..20: note = CRISPR gRNA sequence
  source 1..20: mol_type = other DNA
gttgtgtatgtggtatttgt

SEQ ID NO: 50786 - DNA, 20 bp, synthetic construct
  misc_feature 1..20: note = CRISPR gRNA sequence
  source 1..20: mol_type = other DNA
tggtatttgtaggtattatg

SEQ ID NO: 50787 - DNA, 20 bp, synthetic construct
  misc_feature 1..20: note = CRISPR gRNA sequence
  source 1..20: mol_type = other DNA
gtgctgtatttgtaatgtgc

SEQ ID NO: 50788 - DNA, 20 bp, synthetic construct
  misc_feature 1..20: note = CRISPR gRNA sequence
  source 1..20: mol_type = other DNA
tgctgtatttgtaatgtgcc

SEQ ID NO: 50789 - DNA, 20 bp, synthetic construct
  misc_feature 1..20: note = CRISPR gRNA sequence
  source 1..20: mol_type = other DNA
taatgtgccaggtatgtatg

SEQ ID NO: 50790 - DNA, 20 bp, synthetic construct
  misc_feature 1..20: note = CRISPR gRNA sequence
  source 1..20: mol_type = other DNA
aatgtgccaggtatgtatgt

SEQ ID NO: 50791 - DNA, 20 bp, synthetic construct
  misc_feature 1..20: note = CRISPR gRNA sequence
  source 1..20: mol_type = other DNA
atgtgccaggtatgtatgtg

SEQ ID NO: 50792 - DNA, 20 bp, synthetic construct
  misc_feature 1..20: note = CRISPR gRNA sequence
  source 1..20: mol_type = other DNA
tgtgccaggtatgtatgtgg

SEQ ID NO: 50793 - DNA, 20 bp, synthetic construct
  misc_feature 1..20: note = CRISPR gRNA sequence
  source 1..20: mol_type = other DNA
gtgccaggtatgtatgtggg

SEQ ID NO: 50794 - DNA, 20 bp, synthetic construct
  misc_feature 1..20: note = CRISPR gRNA sequence
  source 1..20: mol_type = other DNA
atgtggggggtttgtttttg

SEQ ID NO: 50795 - DNA, 20 bp, synthetic construct
  misc_feature 1..20: note = CRISPR gRNA sequence
  source 1..20: mol_type = other DNA
tgtggggggtttgtttttgt

SEQ ID NO: 50796 - DNA, 20 bp, synthetic construct
  misc_feature 1..20: note = CRISPR gRNA sequence
  source 1..20: mol_type = other DNA
gtggggggtttgtttttgtg

SEQ ID NO: 50797 - DNA, 20 bp, synthetic construct
  misc_feature 1..20: note = CRISPR gRNA sequence
  source 1..20: mol_type = other DNA
tgtggggtgtgtgtattgtg

SEQ ID NO: 50798 - DNA, 20 bp, synthetic construct
  misc_feature 1..20: note = CRISPR gRNA sequence
  source 1..20: mol_type = other DNA
tgtgtattgtgtggtgtgtg

SEQ ID NO: 50799 - DNA, 20 bp, synthetic construct
  misc_feature 1..20: note = CRISPR gRNA sequence
  source 1..20: mol_type = other DNA
gtggtgtatgtgtgtgtatg

SEQ ID NO: 50800 - DNA, 20 bp, synthetic construct
  misc_feature 1..20: note = CRISPR gRNA sequence
  source 1..20: mol_type = other DNA
gtgtgtatgtggtatgtgta

SEQ ID NO: 50801 - DNA, 20 bp, synthetic construct
  misc_feature 1..20: note = CRISPR gRNA sequence
  source 1..20: mol_type = other DNA
tgtggtatgtgtatggtatg

SEQ ID NO: 50802 - DNA, 20 bp, synthetic construct
  misc_feature 1..20: note = CRISPR gRNA sequence
  source 1..20: mol_type = other DNA
tgtgtgttgtgtgtgctgtg

SEQ ID NO: 50803 - DNA, 20 bp, synthetic construct
  misc_feature 1..20: note = CRISPR gRNA sequence
  source 1..20: mol_type = other DNA
tgtgtgtgctgcgtgctgtg

SEQ ID NO: 50804 - DNA, 20 bp, synthetic construct
  misc_feature 1..20: note = CRISPR gRNA sequence
  source 1..20: mol_type = other DNA
tgcgtgctgtgtggtgtgtt

SEQ ID NO: 50805 - DNA, 20 bp, synthetic construct
  misc_feature 1..20: note = CRISPR gRNA sequence
  source 1..20: mol_type = other DNA
gcgtgctgtgtggtgtgttt

SEQ ID NO: 50806 - DNA, 20 bp, synthetic construct
  misc_feature 1..20: note = CRISPR gRNA sequence
  source 1..20: mol_type = other DNA
gtggtgtgtttgggtgtgct

SEQ ID NO: 50807 - DNA, 20 bp, synthetic construct
  misc_feature 1..20: note = CRISPR gRNA sequence
  source 1..20: mol_type = other DNA
gggtgtgcttggtgtatctg

SEQ ID NO: 50808 - DNA, 20 bp, synthetic construct
  misc_feature 1..20: note = CRISPR gRNA sequence
  source 1..20: mol_type = other DNA
cttggtgtatctgtggtata

SEQ ID NO: 50809 - DNA, 20 bp, synthetic construct
  misc_feature 1..20: note = CRISPR gRNA sequence
  source 1..20: mol_type = other DNA
ttggtgtatctgtggtatat

SEQ ID NO: 50810 - DNA, 20 bp, synthetic construct
  misc_feature 1..20: note = CRISPR gRNA sequence
  source 1..20: mol_type = other DNA
tgtatctgtggtatatgggt

SEQ ID NO: 50811 - DNA, 20 bp, synthetic construct
  misc_feature 1..20: note = CRISPR gRNA sequence
  source 1..20: mol_type = other DNA
gtggtatatgggttggtgtg

SEQ ID NO: 50812 - DNA, 20 bp, synthetic construct
  misc_feature 1..20: note = CRISPR gRNA sequence
  source 1..20: mol_type = other DNA
tggtatatgggttggtgtgt

SEQ ID NO: 50813 - DNA, 20 bp, synthetic construct
  misc_feature 1..20: note = CRISPR gRNA sequence
  source 1..20: mol_type = other DNA
ggtatatgggttggtgtgta

SEQ ID NO: 50814 - DNA, 20 bp, synthetic construct
  misc_feature 1..20: note = CRISPR gRNA sequence
  source 1..20: mol_type = other DNA
tggtgtgtagggcgtgtgtg

SEQ ID NO: 50815 - DNA, 20 bp, synthetic construct
  misc_feature 1..20: note = CRISPR gRNA sequence
  source 1..20: mol_type = other DNA
tgtagggcgtgtgtgtggtg

SEQ ID NO: 50816 - DNA, 20 bp, synthetic construct
  misc_feature 1..20: note = CRISPR gRNA sequence
  source 1..20: mol_type = other DNA
gtagggcgtgtgtgtggtgt

SEQ ID NO: 50817 - DNA, 20 bp, synthetic construct
  misc_feature 1..20: note = CRISPR gRNA sequence
  source 1..20: mol_type = other DNA
tagggcgtgtgtgtggtgtg

SEQ ID NO: 50818 - DNA, 20 bp, synthetic construct
  misc_feature 1..20: note = CRISPR gRNA sequence
  source 1..20: mol_type = other DNA
agggcgtgtgtgtggtgtgg

SEQ ID NO: 50819 - DNA, 20 bp, synthetic construct
  misc_feature 1..20: note = CRISPR gRNA sequence
  source 1..20: mol_type = other DNA
ggcgtgtgtgtggtgtgggg

SEQ ID NO: 50820 - DNA, 20 bp, synthetic construct
  misc_feature 1..20: note = CRISPR gRNA sequence
  source 1..20: mol_type = other DNA
gcgtgtgtgtggtgtggggg

SEQ ID NO: 50821 - DNA, 20 bp, synthetic construct
  misc_feature 1..20: note = CRISPR gRNA sequence
  source 1..20: mol_type = other DNA
tgtgtgtggtgtgggggagg

SEQ ID NO: 50822 - DNA, 20 bp, synthetic construct
  misc_feature 1..20: note = CRISPR gRNA sequence
  source 1..20: mol_type = other DNA
gtgtgtggtgtgggggaggt

SEQ ID NO: 50823 - DNA, 20 bp, synthetic construct
  misc_feature 1..20: note = CRISPR gRNA sequence
  source 1..20: mol_type = other DNA
tgtggtgtgggggaggtggg

SEQ ID NO: 50824 - DNA, 20 bp, synthetic construct
  misc_feature 1..20: note = CRISPR gRNA sequence
  source 1..20: mol_type = other DNA
gtggtgtgggggaggtggga

SEQ ID NO: 50825 - DNA, 20 bp, synthetic construct
  misc_feature 1..20: note = CRISPR gRNA sequence
  source 1..20: mol_type = other DNA
gggggaggtgggaaggaaca

SEQ ID NO: 50826 - DNA, 20 bp, synthetic construct
  misc_feature 1..20: note = CRISPR gRNA sequence
  source 1..20: mol_type = other DNA
ggaggtgggaaggaacatgg

SEQ ID NO: 50827 - DNA, 20 bp, synthetic construct
  misc_feature 1..20: note = CRISPR gRNA sequence
  source 1..20: mol_type = other DNA
ggtgggaaggaacatggtgg

SEQ ID NO: 50828 - DNA, 20 bp, synthetic construct
  misc_feature 1..20: note = CRISPR gRNA sequence
  source 1..20: mol_type = other DNA
gtgggaaggaacatggtgga

SEQ ID NO: 50829 - DNA, 20 bp, synthetic construct
  misc_feature 1..20: note = CRISPR gRNA sequence
  source 1..20: mol_type = other DNA
aggaacatggtggaaggtga

SEQ ID NO: 50830 - DNA, 20 bp, synthetic construct
  misc_feature 1..20: note = CRISPR gRNA sequence
  source 1..20: mol_type = other DNA
acatggtggaaggtgacagt

SEQ ID NO: 50831 - DNA, 20 bp, synthetic construct
  misc_feature 1..20: note = CRISPR gRNA sequence
  source 1..20: mol_type = other DNA
gtggaaggtgacagttggat

SEQ ID NO: 50832 - DNA, 20 bp, synthetic construct
  misc_feature 1..20: note = CRISPR gRNA sequence
  source 1..20: mol_type = other DNA
tgacagttggatcagactgt

SEQ ID NO: 50833 - DNA, 20 bp, synthetic construct
  misc_feature 1..20: note = CRISPR gRNA sequence
  source 1..20: mol_type = other DNA
gacagttggatcagactgtg

SEQ ID NO: 50834 - DNA, 20 bp, synthetic construct
  misc_feature 1..20: note = CRISPR gRNA sequence
  source 1..20: mol_type = other DNA
acagttggatcagactgtga

SEQ ID NO: 50835 - DNA, 20 bp, synthetic construct
  misc_feature 1..20: note = CRISPR gRNA sequence
  source 1..20: mol_type = other DNA
agttggatcagactgtgagg

SEQ ID NO: 50836 - DNA, 20 bp, synthetic construct
  misc_feature 1..20: note = CRISPR gRNA sequence
  source 1..20: mol_type = other DNA
tggatcagactgtgagggag

SEQ ID NO: 50837 - DNA, 20 bp, synthetic construct
  misc_feature 1..20: note = CRISPR gRNA sequence
  source 1..20: mol_type = other DNA
gactgtgagggagaagatgc

SEQ ID NO: 50838 - DNA, 20 bp, synthetic construct
  misc_feature 1..20: note = CRISPR gRNA sequence
  source 1..20: mol_type = other DNA
actgtgagggagaagatgct

SEQ ID NO: 50839 - DNA, 20 bp, synthetic construct
  misc_feature 1..20: note = CRISPR gRNA sequence
  source 1..20: mol_type = other DNA
ctgtgagggagaagatgcta

SEQ ID NO: 50840 - DNA, 20 bp, synthetic construct
  misc_feature 1..20: note = CRISPR gRNA sequence
  source 1..20: mol_type = other DNA
agggactttgaacttcaccc

SEQ ID NO: 50841 - DNA, 20 bp, synthetic construct
  misc_feature 1..20: note = CRISPR gRNA sequence
  source 1..20: mol_type = other DNA
gggactttgaacttcaccct

SEQ ID NO: 50842 - DNA, 20 bp, synthetic construct
  misc_feature 1..20: note = CRISPR gRNA sequence
  source 1..20: mol_type = other DNA
ggactttgaacttcaccctg

SEQ ID NO: 50843 - DNA, 20 bp, synthetic construct
  misc_feature 1..20: note = CRISPR gRNA sequence
  source 1..20: mol_type = other DNA
gaacttcaccctggggttaa

SEQ ID NO: 50844 - DNA, 20 bp, synthetic construct
  misc_feature 1..20: note = CRISPR gRNA sequence
  source 1..20: mol_type = other DNA
aacttcaccctggggttaat

SEQ ID NO: 50845 - DNA, 20 bp, synthetic construct
  misc_feature 1..20: note = CRISPR gRNA sequence
  source 1..20: mol_type = other DNA
acttcaccctggggttaatg

SEQ ID NO: 50846 - DNA, 20 bp, synthetic construct
  misc_feature 1..20: note = CRISPR gRNA sequence
  source 1..20: mol_type = other DNA
ttcaccctggggttaatggg

SEQ ID NO: 50847 - DNA, 20 bp, synthetic construct
  misc_feature 1..20: note = CRISPR gRNA sequence
  source 1..20: mol_type = other DNA
ggggttaatggggagccact

SEQ ID NO: 50848 - DNA, 20 bp, synthetic construct
  misc_feature 1..20: note = CRISPR gRNA sequence
  source 1..20: mol_type = other DNA
gggttaatggggagccactg

SEQ ID NO: 50849 - DNA, 20 bp, synthetic construct
  misc_feature 1..20: note = CRISPR gRNA sequence
  source 1..20: mol_type = other DNA
ggttaatggggagccactga

SEQ ID NO: 50850 - DNA, 20 bp, synthetic construct
  misc_feature 1..20: note = CRISPR gRNA sequence
  source 1..20: mol_type = other DNA
gttaatggggagccactgag

SEQ ID NO: 50851 - DNA, 20 bp, synthetic construct
  misc_feature 1..20: note = CRISPR gRNA sequence
  source 1..20: mol_type = other DNA
tggggagccactgaggggca

SEQ ID NO: 50852 - DNA, 20 bp, synthetic construct
  misc_feature 1..20: note = CRISPR gRNA sequence
  source 1..20: mol_type = other DNA
gggagccactgaggggcaca

SEQ ID NO: 50853 - DNA, 20 bp, synthetic construct
  misc_feature 1..20: note = CRISPR gRNA sequence
  source 1..20: mol_type = other DNA
agccactgaggggcacagag

SEQ ID NO: 50854 - DNA, 20 bp, synthetic construct
  misc_feature 1..20: note = CRISPR gRNA sequence
  source 1..20: mol_type = other DNA
cactgaggggcacagagtag

SEQ ID NO: 50855 - DNA, 20 bp, synthetic construct
  misc_feature 1..20: note = CRISPR gRNA sequence
  source 1..20: mol_type = other DNA
ctgaggggcacagagtagca

SEQ ID NO: 50856 - DNA, 20 bp, synthetic construct
  misc_feature 1..20: note = CRISPR gRNA sequence
  source 1..20: mol_type = other DNA
tgaggggcacagagtagcag

SEQ ID NO: 50857 - DNA, 20 bp, synthetic construct
  misc_feature 1..20: note = CRISPR gRNA sequence
  source 1..20: mol_type = other DNA
gaggggcacagagtagcaga

SEQ ID NO: 50858 - DNA, 20 bp, synthetic construct
  misc_feature 1..20: note = CRISPR gRNA sequence
  source 1..20: mol_type = other DNA
aggggcacagagtagcagag

SEQ ID NO: 50859 - DNA, 20 bp, synthetic construct
  misc_feature 1..20: note = CRISPR gRNA sequence
  source 1..20: mol_type = other DNA
gagtagcagaggggcactgt

SEQ ID NO: 50860 - DNA, 20 bp, synthetic construct
  misc_feature 1..20: note = CRISPR gRNA sequence
  source 1..20: mol_type = other DNA
actgtcagatgtgtgttgtg

SEQ ID NO: 50861 - DNA, 20 bp, synthetic construct
  misc_feature 1..20: note = CRISPR gRNA sequence
  source 1..20: mol_type = other DNA
gtgtgttgtgaagatccctc

SEQ ID NO: 50862 - DNA, 20 bp, synthetic construct
  misc_feature 1..20: note = CRISPR gRNA sequence
  source 1..20: mol_type = other DNA
tgtgttgtgaagatccctct

SEQ ID NO: 50863 - DNA, 20 bp, synthetic construct
  misc_feature 1..20: note = CRISPR gRNA sequence
  source 1..20: mol_type = other DNA
gtgttgtgaagatccctctg

SEQ ID NO: 50864 - DNA, 20 bp, synthetic construct
  misc_feature 1..20: note = CRISPR gRNA sequence
  source 1..20: mol_type = other DNA
tgttgtgaagatccctctgg

SEQ ID NO: 50865 - DNA, 20 bp, synthetic construct
  misc_feature 1..20: note = CRISPR gRNA sequence
  source 1..20: mol_type = other DNA
gaagatccctctgggggctg

SEQ ID NO: 50866 - DNA, 20 bp, synthetic construct
  misc_feature 1..20: note = CRISPR gRNA sequence
  source 1..20: mol_type = other DNA
agatccctctgggggctgtg

SEQ ID NO: 50867 - DNA, 20 bp, synthetic construct
  misc_feature 1..20: note = CRISPR gRNA sequence
  source 1..20: mol_type = other DNA
tctgggggctgtggagtgaa

SEQ ID NO: 50868 - DNA, 20 bp, synthetic construct
  misc_feature 1..20: note = CRISPR gRNA sequence
  source 1..20: mol_type = other DNA
tgggggctgtggagtgaatg

SEQ ID NO: 50869 - DNA, 20 bp, synthetic construct
  misc_feature 1..20: note = CRISPR gRNA sequence
  source 1..20: mol_type = other DNA
gggggctgtggagtgaatgg

SEQ ID NO: 50870 - DNA, 20 bp, synthetic construct
  misc_feature 1..20: note = CRISPR gRNA sequence
  source 1..20: mol_type = other DNA
ggggctgtggagtgaatgga

SEQ ID NO: 50871 - DNA, 20 bp, synthetic construct
  misc_feature 1..20: note = CRISPR gRNA sequence
  source 1..20: mol_type = other DNA
gggctgtggagtgaatggag

SEQ ID NO: 50872 - DNA, 20 bp, synthetic construct
  misc_feature 1..20: note = CRISPR gRNA sequence
  source 1..20: mol_type = other DNA
gctgtggagtgaatggaggg

SEQ ID NO: 50873 - DNA, 20 bp, synthetic construct
  misc_feature 1..20: note = CRISPR gRNA sequence
  source 1..20: mol_type = other DNA
ctgtggagtgaatggagggg

SEQ ID NO: 50874 - DNA, 20 bp, synthetic construct
  misc_feature 1..20: note = CRISPR gRNA sequence
  source 1..20: mol_type = other DNA
gtggagtgaatggaggggag

SEQ ID NO: 50875 - DNA, 20 bp, synthetic construct
  misc_feature 1..20: note = CRISPR gRNA sequence
  source 1..20: mol_type = other DNA
tggagtgaatggaggggagg

SEQ ID NO: 50876 - DNA, 20 bp, synthetic construct
  misc_feature 1..20: note = CRISPR gRNA sequence
  source 1..20: mol_type = other DNA
tggaggggaggaggcctgat

SEQ ID NO: 50877 - DNA, 20 bp, synthetic construct
  misc_feature 1..20: note = CRISPR gRNA sequence
  source 1..20: mol_type = other DNA
ggaggaggcctgataagatg

SEQ ID NO: 50878 - DNA, 20 bp, synthetic construct
  misc_feature 1..20: note = CRISPR gRNA sequence
  source 1..20: mol_type = other DNA
gaggaggcctgataagatgc

SEQ ID NO: 50879 - DNA, 20 bp, synthetic construct
  misc_feature 1..20: note = CRISPR gRNA sequence
  source 1..20: mol_type = other DNA
aggaggcctgataagatgca

SEQ ID NO: 50880 - DNA, 20 bp, synthetic construct
  misc_feature 1..20: note = CRISPR gRNA sequence
  source 1..20: mol_type = other DNA
gcctgataagatgcagggat

SEQ ID NO: 50881 - DNA, 20 bp, synthetic construct
  misc_feature 1..20: note = CRISPR gRNA sequence
  source 1..20: mol_type = other DNA
ataagatgcagggatcagtt

SEQ ID NO: 50882 - DNA, 20 bp, synthetic construct
  misc_feature 1..20: note = CRISPR gRNA sequence
  source 1..20: mol_type = other DNA
aagatgcagggatcagtttg

SEQ ID NO: 50883 - DNA, 20 bp, synthetic construct
  misc_feature 1..20: note = CRISPR gRNA sequence
  source 1..20: mol_type = other DNA
agatgcagggatcagtttgg

SEQ ID NO: 50884 - DNA, 20 bp, synthetic construct
  misc_feature 1..20: note = CRISPR gRNA sequence
  source 1..20: mol_type = other DNA
cagtttggaggccctgttca

SEQ ID NO: 50885 - DNA, 20 bp, synthetic construct
  misc_feature 1..20: note = CRISPR gRNA sequence
  source 1..20: mol_type = other DNA
ggaggccctgttcacagctg

SEQ ID NO: 50886 - DNA, 20 bp, synthetic construct
  misc_feature 1..20: note = CRISPR gRNA sequence
  source 1..20: mol_type = other DNA
gccctgttcacagctgaagt

SEQ ID NO: 50887 - DNA, 20 bp, synthetic construct
  misc_feature 1..20: note = CRISPR gRNA sequence
  source 1..20: mol_type = other DNA
cagctgaagtaagacatgta

SEQ ID NO: 50888 - DNA, 20 bp, synthetic construct
  misc_feature 1..20: note = CRISPR gRNA sequence
  source 1..20: mol_type = other DNA
agctgaagtaagacatgtaa

SEQ ID NO: 50889 - DNA, 20 bp, synthetic construct
  misc_feature 1..20: note = CRISPR gRNA sequence
  source 1..20: mol_type = other DNA
agtaagacatgtaaaggaac

SEQ ID NO: 50890 - DNA, 20 bp, synthetic construct
  misc_feature 1..20: note = CRISPR gRNA sequence
  source 1..20: mol_type = other DNA
acatgtaaaggaactggccg

SEQ ID NO: 50891 - DNA, 20 bp, synthetic construct
  misc_feature 1..20: note = CRISPR gRNA sequence
  source 1..20: mol_type = other DNA
tgtaaaggaactggccgtgg

SEQ ID NO: 50892 - DNA, 20 bp, synthetic construct
  misc_feature 1..20: note = CRISPR gRNA sequence
  source 1..20: mol_type = other DNA
aaggaactggccgtggcagt

SEQ ID NO: 50893 - DNA, 20 bp, synthetic construct
  misc_feature 1..20: note = CRISPR gRNA sequence
  source 1..20: mol_type = other DNA
aactggccgtggcagtgagt

SEQ ID NO: 50894 - DNA, 20 bp, synthetic construct
  misc_feature 1..20: note = CRISPR gRNA sequence
  source 1..20: mol_type = other DNA
actggccgtggcagtgagtc

SEQ ID NO: 50895 - DNA, 20 bp, synthetic construct
  misc_feature 1..20: note = CRISPR gRNA sequence
  source 1..20: mol_type = other DNA
ctggccgtggcagtgagtca

SEQ ID NO: 50896 - DNA, 20 bp, synthetic construct
  misc_feature 1..20: note = CRISPR gRNA sequence
  source 1..20: mol_type = other DNA
tggcagtgagtcagggctac

SEQ ID NO: 50897 - DNA, 20 bp, synthetic construct
  misc_feature 1..20: note = CRISPR gRNA sequence
  source 1..20: mol_type = other DNA
ggcagtgagtcagggctacc

SEQ ID NO: 50898 - DNA, 20 bp, synthetic construct
  misc_feature 1..20: note = CRISPR gRNA sequence
  source 1..20: mol_type = other DNA
gcagtgagtcagggctacca

SEQ ID NO: 50899 - DNA, 20 bp, synthetic construct
  misc_feature 1..20: note = CRISPR gRNA sequence
  source 1..20: mol_type = other DNA
cagtgagtcagggctaccag

SEQ ID NO: 50900 - DNA, 20 bp, synthetic construct
  misc_feature 1..20: note = CRISPR gRNA sequence
  source 1..20: mol_type = other DNA
aataataataataataataa

SEQ ID NO: 50901 - DNA, 20 bp, synthetic construct
  misc_feature 1..20: note = CRISPR gRNA sequence
  source 1..20: mol_type = other DNA
acagttacaataactgctga

SEQ ID NO: 50902 - DNA, 20 bp, synthetic construct
  misc_feature 1..20: note = CRISPR gRNA sequence
  source 1..20: mol_type = other DNA
actgctgacagcactcccat

SEQ ID NO: 50903 - DNA, 20 bp, synthetic construct
  misc_feature 1..20: note = CRISPR gRNA sequence
  source 1..20: mol_type = other DNA
ctgacagcactcccatgagc

SEQ ID NO: 50904 - DNA, 20 bp, synthetic construct
  misc_feature 1..20: note = CRISPR gRNA sequence
  source 1..20: mol_type = other DNA
ccatgagccagaccttttcc

SEQ ID NO: 50905 - DNA, 20 bp, synthetic construct
  misc_feature 1..20: note = CRISPR gRNA sequence
  source 1..20: mol_type = other DNA
ttaatcctcacaataaccct

SEQ ID NO: 50906 - DNA, 20 bp, synthetic construct
  misc_feature 1..20: note = CRISPR gRNA sequence
  source 1..20: mol_type = other DNA
taatcctcacaataacccta

SEQ ID NO: 50907 - DNA, 20 bp, synthetic construct
  misc_feature 1..20: note = CRISPR gRNA sequence
  source 1..20: mol_type = other DNA
aatcctcacaataaccctaa

SEQ ID NO: 50908 - DNA, 20 bp, synthetic construct
  misc_feature 1..20: note = CRISPR gRNA sequence
  source 1..20: mol_type = other DNA
atcctcacaataaccctaag

SEQ ID NO: 50909 - DNA, 20 bp, synthetic construct
  misc_feature 1..20: note = CRISPR gRNA sequence
  source 1..20: mol_type = other DNA
ctcacaataaccctaagggg

SEQ ID NO: 50910 - DNA, 20 bp, synthetic construct
  misc_feature 1..20: note = CRISPR gRNA sequence
  source 1..20: mol_type = other DNA
tcacaataaccctaaggggt

SEQ ID NO: 50911 - DNA, 20 bp, synthetic construct
  misc_feature 1..20: note = CRISPR gRNA sequence
  source 1..20: mol_type = other DNA
ttatccccattttacttgtc

SEQ ID NO: 50912 - DNA, 20 bp, synthetic construct
  misc_feature 1..20: note = CRISPR gRNA sequence
  source 1..20: mol_type = other DNA
tatccccattttacttgtcc

SEQ ID NO: 50913 - DNA, 20 bp, synthetic construct
  misc_feature 1..20: note = CRISPR gRNA sequence
  source 1..20: mol_type = other DNA
atccccattttacttgtcca

SEQ ID NO: 50914 - DNA, 20 bp, synthetic construct
  misc_feature 1..20: note = CRISPR gRNA sequence
  source 1..20: mol_type = other DNA
tttacttgtccagggccaca

SEQ ID NO: 50915 - DNA, 20 bp, synthetic construct
  misc_feature 1..20: note = CRISPR gRNA sequence
  source 1..20: mol_type = other DNA
cttgtccagggccacatagc

SEQ ID NO: 50916 - DNA, 20 bp, synthetic construct
  misc_feature 1..20: note = CRISPR gRNA sequence
  source 1..20: mol_type = other DNA
tccagggccacatagctggt

SEQ ID NO: 50917 - DNA, 20 bp, synthetic construct
  misc_feature 1..20: note = CRISPR gRNA sequence
  source 1..20: mol_type = other DNA
agggccacatagctggtaag

SEQ ID NO: 50918 - DNA, 20 bp, synthetic construct
  misc_feature 1..20: note = CRISPR gRNA sequence
  source 1..20: mol_type = other DNA
gccacatagctggtaagtgg

SEQ ID NO: 50919 - DNA, 20 bp, synthetic construct
  misc_feature 1..20: note = CRISPR gRNA sequence
  source 1..20: mol_type = other DNA
atagctggtaagtggcagat

SEQ ID NO: 50920 - DNA, 20 bp, synthetic construct
  misc_feature 1..20: note = CRISPR gRNA sequence
  source 1..20: mol_type = other DNA
tagctggtaagtggcagatc

SEQ ID NO: 50921 - DNA, 20 bp, synthetic construct
  misc_feature 1..20: note = CRISPR gRNA sequence
  source 1..20: mol_type = other DNA
agctggtaagtggcagatca

SEQ ID NO: 50922 - DNA, 20 bp, synthetic construct
  misc_feature 1..20: note = CRISPR gRNA sequence
  source 1..20: mol_type = other DNA
gcagatcagggatttatttt

SEQ ID NO: 50923 - DNA, 20 bp, synthetic construct
  misc_feature 1..20: note = CRISPR gRNA sequence
  source 1..20: mol_type = other DNA
atcagggatttattttcagt

SEQ ID NO: 50924 - DNA, 20 bp, synthetic construct
  misc_feature 1..20: note = CRISPR gRNA sequence
  source 1..20: mol_type = other DNA
aaatctttaaccgtgacact

SEQ ID NO: 50925 - DNA, 20 bp, synthetic construct
  misc_feature 1..20: note = CRISPR gRNA sequence
  source 1..20: mol_type = other DNA
tctttaaccgtgacactcag

SEQ ID NO: 50926 - DNA, 20 bp, synthetic construct
  misc_feature 1..20: note = CRISPR gRNA sequence
  source 1..20: mol_type = other DNA
ccgtgacactcagaagcctc

SEQ ID NO: 50927 - DNA, 20 bp, synthetic construct
  misc_feature 1..20: note = CRISPR gRNA sequence
  source 1..20: mol_type = other DNA
cgtgacactcagaagcctca

SEQ ID NO: 50928 - DNA, 20 bp, synthetic construct
  misc_feature 1..20: note = CRISPR gRNA sequence
  source 1..20: mol_type = other DNA
ctcagaagcctcaaggcctg

SEQ ID NO: 50929 - DNA, 20 bp, synthetic construct
  misc_feature 1..20: note = CRISPR gRNA sequence
  source 1..20: mol_type = other DNA
gaagcctcaaggcctgtagt

SEQ ID NO: 50930 - DNA, 20 bp, synthetic construct
  misc_feature 1..20: note = CRISPR gRNA sequence
  source 1..20: mol_type = other DNA
aagcctcaaggcctgtagtc

SEQ ID NO: 50931 - DNA, 20 bp, synthetic construct
  misc_feature 1..20: note = CRISPR gRNA sequence
  source 1..20: mol_type = other DNA
caaggcctgtagtcaggaca

SEQ ID NO: 50932 - DNA, 20 bp, synthetic construct
  misc_feature 1..20: note = CRISPR gRNA sequence
  source 1..20: mol_type = other DNA
gcctgtagtcaggacatggc

SEQ ID NO: 50933 - DNA, 20 bp, synthetic construct
  misc_feature 1..20: note = CRISPR gRNA sequence
  source 1..20: mol_type = other DNA
cctgtagtcaggacatggca

SEQ ID NO: 50934 - DNA, 20 bp, synthetic construct
  misc_feature 1..20: note = CRISPR gRNA sequence
  source 1..20: mol_type = other DNA
gtagtcaggacatggcaagg

SEQ ID NO: 50935 - DNA, 20 bp, synthetic construct
  misc_feature 1..20: note = CRISPR gRNA sequence
  source 1..20: mol_type = other DNA
agtcaggacatggcaaggaa

SEQ ID NO: 50936 - DNA, 20 bp, synthetic construct
  misc_feature 1..20: note = CRISPR gRNA sequence
  source 1..20: mol_type = other DNA
catggcaaggaagagaatgt

SEQ ID NO: 50937 - DNA, 20 bp, synthetic construct
  misc_feature 1..20: note = CRISPR gRNA sequence
  source 1..20: mol_type = other DNA
atggcaaggaagagaatgtt

SEQ ID NO: 50938 - DNA, 20 bp, synthetic construct
  misc_feature 1..20: note = CRISPR gRNA sequence
  source 1..20: mol_type = other DNA
aaggaagagaatgttgggct

SEQ ID NO: 50939 - DNA, 20 bp, synthetic construct
  misc_feature 1..20: note = CRISPR gRNA sequence
  source 1..20: mol_type = other DNA
aagagaatgttgggctgagt

SEQ ID NO: 50940 - DNA, 20 bp, synthetic construct
  misc_feature 1..20: note = CRISPR gRNA sequence
  source 1..20: mol_type = other DNA
agagaatgttgggctgagtt

SEQ ID NO: 50941 - DNA, 20 bp, synthetic construct
  misc_feature 1..20: note = CRISPR gRNA sequence
  source 1..20: mol_type = other DNA
atgttgggctgagttgggct

SEQ ID NO: 50942 - DNA, 20 bp, synthetic construct
  misc_feature 1..20: note = CRISPR gRNA sequence
  source 1..20: mol_type = other DNA
tgttgggctgagttgggctt

SEQ ID NO: 50943 - DNA, 20 bp, synthetic construct
  misc_feature 1..20: note = CRISPR gRNA sequence
  source 1..20: mol_type = other DNA
gggctgagttgggcttagga

SEQ ID NO: 50944 - DNA, 20 bp, synthetic construct
  misc_feature 1..20: note = CRISPR gRNA sequence
  source 1..20: mol_type = other DNA
ctgagttgggcttaggatgg

SEQ ID NO: 50945 - DNA, 20 bp, synthetic construct
  misc_feature 1..20: note = CRISPR gRNA sequence
  source 1..20: mol_type = other DNA
tgagttgggcttaggatggt

SEQ ID NO: 50946 - DNA, 20 bp, synthetic construct
  misc_feature 1..20: note = CRISPR gRNA sequence
  source 1..20: mol_type = other DNA
tgggcttaggatggtgggct

SEQ ID NO: 50947 - DNA, 20 bp, synthetic construct
  misc_feature 1..20: note = CRISPR gRNA sequence
  source 1..20: mol_type = other DNA
ggcttaggatggtgggctaa

SEQ ID NO: 50948 - DNA, 20 bp, synthetic construct
  misc_feature 1..20: note = CRISPR gRNA sequence
  source 1..20: mol_type = other DNA
gcttaggatggtgggctaag

SEQ ID NO: 50949 - DNA, 20 bp, synthetic construct
  misc_feature 1..20: note = CRISPR gRNA sequence
  source 1..20: mol_type = other DNA
gatggtgggctaagaggcac

SEQ ID NO: 50950 - DNA, 20 bp, synthetic construct
  misc_feature 1..20: note = CRISPR gRNA sequence
  source 1..20: mol_type = other DNA
agaggcacaagttcaatgcc

SEQ ID NO: 50951 - DNA, 20 bp, synthetic construct
  misc_feature 1..20: note = CRISPR gRNA sequence
  source 1..20: mol_type = other DNA
gaggcacaagttcaatgcca

SEQ ID NO: 50952 - DNA, 20 bp, synthetic construct
  misc_feature 1..20: note = CRISPR gRNA sequence
  source 1..20: mol_type = other DNA
caagttcaatgccaaggccc

SEQ ID NO: 50953 - DNA, 20 bp, synthetic construct
  misc_feature 1..20: note = CRISPR gRNA sequence
  source 1..20: mol_type = other DNA
tcaatgccaaggccctggct

SEQ ID NO: 50954 - DNA, 20 bp, synthetic construct
  misc_feature 1..20: note = CRISPR gRNA sequence
  source 1..20: mol_type = other DNA
gccaaggccctggctgagac

SEQ ID NO: 50955 - DNA, 20 bp, synthetic construct
  misc_feature 1..20: note = CRISPR gRNA sequence
  source 1..20: mol_type = other DNA
caaggccctggctgagactg

SEQ ID NO: 50956 - DNA, 20 bp, synthetic construct
  misc_feature 1..20: note = CRISPR gRNA sequence
  source 1..20: mol_type = other DNA
ctggctgagactggagttac

SEQ ID NO: 50957 - DNA, 20 bp, synthetic construct
  misc_feature 1..20: note = CRISPR gRNA sequence
  source 1..20: mol_type = other DNA
tggctgagactggagttacc

SEQ ID NO: 50958 - DNA, 20 bp, synthetic construct
  misc_feature 1..20: note = CRISPR gRNA sequence
  source 1..20: mol_type = other DNA
ggctgagactggagttacca

SEQ ID NO: 50959 - DNA, 20 bp, synthetic construct
  misc_feature 1..20: note = CRISPR gRNA sequence
  source 1..20: mol_type = other DNA
gactggagttaccagggcat

SEQ ID NO: 50960 - DNA, 20 bp, synthetic construct
  misc_feature 1..20: note = CRISPR gRNA sequence
  source 1..20: mol_type = other DNA
actggagttaccagggcatc

SEQ ID NO: 50961 - DNA, 20 bp, synthetic construct
  misc_feature 1..20: note = CRISPR gRNA sequence
  source 1..20: mol_type = other DNA
ctggagttaccagggcatcg

SEQ ID NO: 50962 - DNA, 20 bp, synthetic construct
  misc_feature 1..20: note = CRISPR gRNA sequence
  source 1..20: mol_type = other DNA
tggagttaccagggcatcgg

SEQ ID NO: 50963 - DNA, 20 bp, synthetic construct
  misc_feature 1..20: note = CRISPR gRNA sequence
  source 1..20: mol_type = other DNA
agttaccagggcatcggggg

SEQ ID NO: 50964 - DNA, 20 bp, synthetic construct
  misc_feature 1..20: note = CRISPR gRNA sequence
  source 1..20: mol_type = other DNA
cagggcatcgggggcagatc

SEQ ID NO: 50965 - DNA, 20 bp, synthetic construct
  misc_feature 1..20: note = CRISPR gRNA sequence
  source 1..20: mol_type = other DNA
gggcatcgggggcagatctg

SEQ ID NO: 50966 - DNA, 20 bp, synthetic construct
  misc_feature 1..20: note = CRISPR gRNA sequence
  source 1..20: mol_type = other DNA
ggcatcgggggcagatctgg

SEQ ID NO: 50967 - DNA, 20 bp, synthetic construct
  misc_feature 1..20: note = CRISPR gRNA sequence
  source 1..20: mol_type = other DNA
cgggggcagatctggaggaa

SEQ ID NO: 50968 - DNA, 20 bp, synthetic construct
  misc_feature 1..20: note = CRISPR gRNA sequence
  source 1..20: mol_type = other DNA
cagatctggaggaacagacc

SEQ ID NO: 50969 - DNA, 20 bp, synthetic construct
  misc_feature 1..20: note = CRISPR gRNA sequence
  source 1..20: mol_type = other DNA
agatctggaggaacagaccc

SEQ ID NO: 50970 - DNA, 20 bp, synthetic construct
  misc_feature 1..20: note = CRISPR gRNA sequence
  source 1..20: mol_type = other DNA
tctggaggaacagacccagg

SEQ ID NO: 50971 - DNA, 20 bp, synthetic construct
  misc_feature 1..20: note = CRISPR gRNA sequence
  source 1..20: mol_type = other DNA
gaggaacagacccaggcagt

SEQ ID NO: 50972 - DNA, 20 bp, synthetic construct
  misc_feature 1..20: note = CRISPR gRNA sequence
  source 1..20: mol_type = other DNA
agacccaggcagtgagcttg

SEQ ID NO: 50973 - DNA, 20 bp, synthetic construct
  misc_feature 1..20: note = CRISPR gRNA sequence
  source 1..20: mol_type = other DNA
gagcttgaagctgctctcta

SEQ ID NO: 50974 - DNA, 20 bp, synthetic construct
  misc_feature 1..20: note = CRISPR gRNA sequence
  source 1..20: mol_type = other DNA
agcttgaagctgctctctaa

SEQ ID NO: 50975 - DNA, 20 bp, synthetic construct
  misc_feature 1..20: note = CRISPR gRNA sequence
  source 1..20: mol_type = other DNA
cttgaagctgctctctaaag

SEQ ID NO: 50976 - DNA, 20 bp, synthetic construct
  misc_feature 1..20: note = CRISPR gRNA sequence
  source 1..20: mol_type = other DNA
ttgaagctgctctctaaagg

SEQ ID NO: 50977 - DNA, 20 bp, synthetic construct
  misc_feature 1..20: note = CRISPR gRNA sequence
  source 1..20: mol_type = other DNA
gaagctgctctctaaaggag

SEQ ID NO: 50978 - DNA, 20 bp, synthetic construct
  misc_feature 1..20: note = CRISPR gRNA sequence
  source 1..20: mol_type = other DNA
agctgctctctaaaggagga

SEQ ID NO: 50979 - DNA, 20 bp, synthetic construct
  misc_feature 1..20: note = CRISPR gRNA sequence
  source 1..20: mol_type = other DNA
gctgctctctaaaggaggag

SEQ ID NO: 50980 - DNA, 20 bp, synthetic construct
  misc_feature 1..20: note = CRISPR gRNA sequence
  source 1..20: mol_type = other DNA
ctgctctctaaaggaggaga

SEQ ID NO: 50981 - DNA, 20 bp, synthetic construct
  misc_feature 1..20: note = CRISPR gRNA sequence
  source 1..20: mol_type = other DNA
ctctaaaggaggagagggcc

SEQ ID NO: 50982 - DNA, 20 bp, synthetic construct
  misc_feature 1..20: note = CRISPR gRNA sequence
  source 1..20: mol_type = other DNA
tctaaaggaggagagggccc

SEQ ID NO: 50983 - DNA, 20 bp, synthetic construct
  misc_feature 1..20: note = CRISPR gRNA sequence
  source 1..20: mol_type = other DNA
ctaaaggaggagagggccca

SEQ ID NO: 50984 - DNA, 20 bp, synthetic construct
  misc_feature 1..20: note = CRISPR gRNA sequence
  source 1..20: mol_type = other DNA
aaggaggagagggcccaggg

SEQ ID NO: 50985 - DNA, 20 bp, synthetic construct
  misc_feature 1..20: note = CRISPR gRNA sequence
  source 1..20: mol_type = other DNA
ggaggagagggcccagggaa

SEQ ID NO: 50986 - DNA, 20 bp, synthetic construct
  misc_feature 1..20: note = CRISPR gRNA sequence
  source 1..20: mol_type = other DNA
gaggagagggcccagggaag

SEQ ID NO: 50987 - DNA, 20 bp, synthetic construct
  misc_feature 1..20: note = CRISPR gRNA sequence
  source 1..20: mol_type = other DNA
aggagagggcccagggaaga

SEQ ID NO: 50988 - DNA, 20 bp, synthetic construct
  misc_feature 1..20: note = CRISPR gRNA sequence
  source 1..20: mol_type = other DNA
ggagagggcccagggaagag

SEQ ID NO: 50989 - DNA, 20 bp, synthetic construct
  misc_feature 1..20: note = CRISPR gRNA sequence
  source 1..20: mol_type = other DNA
gagagggcccagggaagagg

SEQ ID NO: 50990 - DNA, 20 bp, synthetic construct
  misc_feature 1..20: note = CRISPR gRNA sequence
  source 1..20: mol_type = other DNA
gcccagggaagagggggcca

SEQ ID NO: 50991 - DNA, 20 bp, synthetic construct
  misc_feature 1..20: note = CRISPR gRNA sequence
  source 1..20: mol_type = other DNA
ccagggaagagggggccatg

SEQ ID NO: 50992 - DNA, 20 bp, synthetic construct
  misc_feature 1..20: note = CRISPR gRNA sequence
  source 1..20: mol_type = other DNA
cagggaagagggggccatgg

SEQ ID NO: 50993 - DNA, 20 bp, synthetic construct
  misc_feature 1..20: note = CRISPR gRNA sequence
  source 1..20: mol_type = other DNA
gggggccatggaggccgcca

SEQ ID NO: 50994 - DNA, 20 bp, synthetic construct
  misc_feature 1..20: note = CRISPR gRNA sequence
  source 1..20: mol_type = other DNA
ggggccatggaggccgccat

SEQ ID NO: 50995 - DNA, 20 bp, synthetic construct
  misc_feature 1..20: note = CRISPR gRNA sequence
  source 1..20: mol_type = other DNA
gggccatggaggccgccata

SEQ ID NO: 50996 - DNA, 20 bp, synthetic construct
  misc_feature 1..20: note = CRISPR gRNA sequence
  source 1..20: mol_type = other DNA
catggaggccgccatagggt

SEQ ID NO: 50997 - DNA, 20 bp, synthetic construct
  misc_feature 1..20: note = CRISPR gRNA sequence
  source 1..20: mol_type = other DNA
tcccctgtcccatcaccctg

SEQ ID NO: 50998 - DNA, 20 bp, synthetic construct
  misc_feature 1..20: note = CRISPR gRNA sequence
  source 1..20: mol_type = other DNA
cccctgtcccatcaccctgc

SEQ ID NO: 50999 - DNA, 20 bp, synthetic construct
  misc_feature 1..20: note = CRISPR gRNA sequence
  source 1..20: mol_type = other DNA
ccctgtcccatcaccctgca

SEQ ID NO: 51000 - DNA, 20 bp, synthetic construct
  misc_feature 1..20: note = CRISPR gRNA sequence
  source 1..20: mol_type = other DNA
tcaccctgcagggattacct

SEQ ID NO: 51001 - DNA, 20 bp, synthetic construct
  misc_feature 1..20: note = CRISPR gRNA sequence
  source 1..20: mol_type = other DNA
ggattacctgagtgtcttcc

SEQ ID NO: 51002 - DNA, 20 bp, synthetic construct
  misc_feature 1..20: note = CRISPR gRNA sequence
  source 1..20: mol_type = other DNA
acctgagtgtcttcccagcc

SEQ ID NO: 51003 - DNA, 20 bp, synthetic construct
  misc_feature 1..20: note = CRISPR gRNA sequence
  source 1..20: mol_type = other DNA
cttcccagcctggtcctctc

SEQ ID NO: 51004 - DNA, 20 bp, synthetic construct
  misc_feature 1..20: note = CRISPR gRNA sequence
  source 1..20: mol_type = other DNA
tcccagcctggtcctctctg

SEQ ID NO: 51005 - DNA, 20 bp, synthetic construct
  misc_feature 1..20: note = CRISPR gRNA sequence
  source 1..20: mol_type = other DNA
cagcctggtcctctctggag

SEQ ID NO: 51006 - DNA, 20 bp, synthetic construct
  misc_feature 1..20: note = CRISPR gRNA sequence
  source 1..20: mol_type = other DNA
cctctctggagaagtgaatc

SEQ ID NO: 51007 - DNA, 20 bp, synthetic construct
  misc_feature 1..20: note = CRISPR gRNA sequence
  source 1..20: mol_type = other DNA
ctctggagaagtgaatccgg

SEQ ID NO: 51008 - DNA, 20 bp, synthetic construct
  misc_feature 1..20: note = CRISPR gRNA sequence
  source 1..20: mol_type = other DNA
gtgaatccggaagctctgct

SEQ ID NO: 51009 - DNA, 20 bp, synthetic construct
  misc_feature 1..20: note = CRISPR gRNA sequence
  source 1..20: mol_type = other DNA
gaatccggaagctctgctca

SEQ ID NO: 51010 - DNA, 20 bp, synthetic construct
  misc_feature 1..20: note = CRISPR gRNA sequence
  source 1..20: mol_type = other DNA
cggaagctctgctcagagcc

SEQ ID NO: 51011 - DNA, 20 bp, synthetic construct
  misc_feature 1..20: note = CRISPR gRNA sequence
  source 1..20: mol_type = other DNA
ggaagctctgctcagagccc

SEQ ID NO: 51012 - DNA, 20 bp, synthetic construct
  misc_feature 1..20: note = CRISPR gRNA sequence
  source 1..20: mol_type = other DNA
tctgctcagagcccaggctg

SEQ ID NO: 51013 - DNA, 20 bp, synthetic construct
  misc_feature 1..20: note = CRISPR gRNA sequence
  source 1..20: mol_type = other DNA
tgctcagagcccaggctgca

SEQ ID NO: 51014 - DNA, 20 bp, synthetic construct
  misc_feature 1..20: note = CRISPR gRNA sequence
  source 1..20: mol_type = other DNA
ctcagagcccaggctgcaga

SEQ ID NO: 51015 - DNA, 20 bp, synthetic construct
  misc_feature 1..20: note = CRISPR gRNA sequence
  source 1..20: mol_type = other DNA
agagcccaggctgcagagag

SEQ ID NO: 51016 - DNA, 20 bp, synthetic construct
  misc_feature 1..20: note = CRISPR gRNA sequence
  source 1..20: mol_type = other DNA
gagcccaggctgcagagaga

SEQ ID NO: 51017 - DNA, 20 bp, synthetic construct
  misc_feature 1..20: note = CRISPR gRNA sequence
  source 1..20: mol_type = other DNA
agcccaggctgcagagagaa

SEQ ID NO: 51018 - DNA, 20 bp, synthetic construct
  misc_feature 1..20: note = CRISPR gRNA sequence
  source 1..20: mol_type = other DNA
aggctgcagagagaagggcc

SEQ ID NO: 51019 - DNA, 20 bp, synthetic construct
  misc_feature 1..20: note = CRISPR gRNA sequence
  source 1..20: mol_type = other DNA
ggctgcagagagaagggcct

SEQ ID NO: 51020 - DNA, 20 bp, synthetic construct
  misc_feature 1..20: note = CRISPR gRNA sequence
  source 1..20: mol_type = other DNA
gctgcagagagaagggcctg

SEQ ID NO: 51021 - DNA, 20 bp, synthetic construct
  misc_feature 1..20: note = CRISPR gRNA sequence
  source 1..20: mol_type = other DNA
gcagagagaagggcctgggg

SEQ ID NO: 51022 - DNA, 20 bp, synthetic construct
  misc_feature 1..20: note = CRISPR gRNA sequence
  source 1..20: mol_type = other DNA
gagaagggcctggggaagca

SEQ ID NO: 51023 - DNA, 20 bp, synthetic construct
  misc_feature 1..20: note = CRISPR gRNA sequence
  source 1..20: mol_type = other DNA
gcctggggaagcacggtgcc

SEQ ID NO: 51024 - DNA, 20 bp, synthetic construct
  misc_feature 1..20: note = CRISPR gRNA sequence
  source 1..20: mol_type = other DNA
agcacggtgcccagacatgc

SEQ ID NO: 51025 - DNA, 20 bp, synthetic construct
  misc_feature 1..20: note = CRISPR gRNA sequence
  source 1..20: mol_type = other DNA
gcccagacatgccagcttcc

SEQ ID NO: 51026 - DNA, 20 bp, synthetic construct
  misc_feature 1..20: note = CRISPR gRNA sequence
  source 1..20: mol_type = other DNA
cccagacatgccagcttcct

SEQ ID NO: 51027 - DNA, 20 bp, synthetic construct
  misc_feature 1..20: note = CRISPR gRNA sequence
  source 1..20: mol_type = other DNA
atgccagcttcctaggcacc

SEQ ID NO: 51028 - DNA, 20 bp, synthetic construct
  misc_feature 1..20: note = CRISPR gRNA sequence
  source 1..20: mol_type = other DNA
tgccagcttcctaggcacct

SEQ ID NO: 51029 - DNA, 20 bp, synthetic construct
  misc_feature 1..20: note = CRISPR gRNA sequence
  source 1..20: mol_type = other DNA
gccagcttcctaggcaccta

SEQ ID NO: 51030 - DNA, 20 bp, synthetic construct
  misc_feature 1..20: note = CRISPR gRNA sequence
  source 1..20: mol_type = other DNA
ctaggcacctagggcaccca

SEQ ID NO: 51031 - DNA, 20 bp, synthetic construct
  misc_feature 1..20: note = CRISPR gRNA sequence
  source 1..20: mol_type = other DNA
taggcacctagggcacccac

SEQ ID NO: 51032 - DNA, 20 bp, synthetic construct
  misc_feature 1..20: note = CRISPR gRNA sequence
  source 1..20: mol_type = other DNA
aggcacctagggcacccaca

SEQ ID NO: 51033 - DNA, 20 bp, synthetic construct
  misc_feature 1..20: note = CRISPR gRNA sequence
  source 1..20: mol_type = other DNA
cctagggcacccacagggca

SEQ ID NO: 51034 - DNA, 20 bp, synthetic construct
  misc_feature 1..20: note = CRISPR gRNA sequence
  source 1..20: mol_type = other DNA
tagggcacccacagggcaca

SEQ ID NO: 51035 - DNA, 20 bp, synthetic construct
  misc_feature 1..20: note = CRISPR gRNA sequence
  source 1..20: mol_type = other DNA
gggcacccacagggcacaga

SEQ ID NO: 51036 - DNA, 20 bp, synthetic construct
  misc_feature 1..20: note = CRISPR gRNA sequence
  source 1..20: mol_type = other DNA
ggcacccacagggcacagag

SEQ ID NO: 51037 - DNA, 20 bp, synthetic construct
  misc_feature 1..20: note = CRISPR gRNA sequence
  source 1..20: mol_type = other DNA
gcacccacagggcacagaga

SEQ ID NO: 51038 - DNA, 20 bp, synthetic construct
  misc_feature 1..20: note = CRISPR gRNA sequence
  source 1..20: mol_type = other DNA
cccacagggcacagagaggg

SEQ ID NO: 51039 - DNA, 20 bp, synthetic construct
  misc_feature 1..20: note = CRISPR gRNA sequence
  source 1..20: mol_type = other DNA
acagggcacagagagggaag

SEQ ID NO: 51040 - DNA, 20 bp, synthetic construct
  misc_feature 1..20: note = CRISPR gRNA sequence
  source 1..20: mol_type = other DNA
cagggcacagagagggaagc

SEQ ID NO: 51041 - DNA, 20 bp, synthetic construct
  misc_feature 1..20: note = CRISPR gRNA sequence
  source 1..20: mol_type = other DNA
agggcacagagagggaagcg

SEQ ID NO: 51042 - DNA, 20 bp, synthetic construct
  misc_feature 1..20: note = CRISPR gRNA sequence
  source 1..20: mol_type = other DNA
ggaagcggggctgcacccac

SEQ ID NO: 51043 - DNA, 20 bp, synthetic construct
  misc_feature 1..20: note = CRISPR gRNA sequence
  source 1..20: mol_type = other DNA
gaagcggggctgcacccaca

SEQ ID NO: 51044 - DNA, 20 bp, synthetic construct
  misc_feature 1..20: note = CRISPR gRNA sequence
  source 1..20: mol_type = other DNA
ggggctgcacccacaaggac

SEQ ID NO: 51045 - DNA, 20 bp, synthetic construct
  misc_feature 1..20: note = CRISPR gRNA sequence
  source 1..20: mol_type = other DNA
gggctgcacccacaaggaca

SEQ ID NO: 51046 - DNA, 20 bp, synthetic construct
  misc_feature 1..20: note = CRISPR gRNA sequence
  source 1..20: mol_type = other DNA
ggctgcacccacaaggacaa

SEQ ID NO: 51047 - DNA, 20 bp, synthetic construct
  misc_feature 1..20: note = CRISPR gRNA sequence
  source 1..20: mol_type = other DNA
ctgcacccacaaggacaagg

SEQ ID NO: 51048 - DNA, 20 bp, synthetic construct
  misc_feature 1..20: note = CRISPR gRNA sequence
  source 1..20: mol_type = other DNA
tgcacccacaaggacaaggg

SEQ ID NO: 51049 - DNA, 20 bp, synthetic construct
  misc_feature 1..20: note = CRISPR gRNA sequence
  source 1..20: mol_type = other DNA
cccacaaggacaagggagga

SEQ ID NO: 51050 - DNA, 20 bp, synthetic construct
  misc_feature 1..20: note = CRISPR gRNA sequence
  source 1..20: mol_type = other DNA
cacaaggacaagggaggatg

SEQ ID NO: 51051 - DNA, 20 bp, synthetic construct
  misc_feature 1..20: note = CRISPR gRNA sequence
  source 1..20: mol_type = other DNA
acaaggacaagggaggatgg

SEQ ID NO: 51052 - DNA, 20 bp, synthetic construct
  misc_feature 1..20: note = CRISPR gRNA sequence
  source 1..20: mol_type = other DNA
acaagggaggatggaggcct

SEQ ID NO: 51053 - DNA, 20 bp, synthetic construct
  misc_feature 1..20: note = CRISPR gRNA sequence
  source 1..20: mol_type = other DNA
gaggatggaggcctcagaac

SEQ ID NO: 51054 - DNA, 20 bp, synthetic construct
  misc_feature 1..20: note = CRISPR gRNA sequence
  source 1..20: mol_type = other DNA
ggatggaggcctcagaacca

SEQ ID NO: 51055 - DNA, 20 bp, synthetic construct
  misc_feature 1..20: note = CRISPR gRNA sequence
  source 1..20: mol_type = other DNA
gatggaggcctcagaaccag

SEQ ID NO: 51056 - DNA, 20 bp, synthetic construct
  misc_feature 1..20: note = CRISPR gRNA sequence
  source 1..20: mol_type = other DNA
tggaggcctcagaaccagag

SEQ ID NO: 51057 - DNA, 20 bp, synthetic construct
  misc_feature 1..20: note = CRISPR gRNA sequence
  source 1..20: mol_type = other DNA
gacccccaaactcattctgt

SEQ ID NO: 51058 - DNA, 20 bp, synthetic construct
  misc_feature 1..20: note = CRISPR gRNA sequence
  source 1..20: mol_type = other DNA
ccaaactcattctgtgagca

SEQ ID NO: 51059 - DNA, 20 bp, synthetic construct
  misc_feature 1..20: note = CRISPR gRNA sequence
  source 1..20: mol_type = other DNA
tctgtgagcatggcaatacc

SEQ ID NO: 51060 - DNA, 20 bp, synthetic construct
  misc_feature 1..20: note = CRISPR gRNA sequence
  source 1..20: mol_type = other DNA
tacctggccttcccacccca

SEQ ID NO: 51061 - DNA, 20 bp, synthetic construct
  misc_feature 1..20: note = CRISPR gRNA sequence
  source 1..20: mol_type = other DNA
ttcccaccccatggcctcca

SEQ ID NO: 51062 - DNA, 20 bp, synthetic construct
  misc_feature 1..20: note = CRISPR gRNA sequence
  source 1..20: mol_type = other DNA
catggcctccatggtcccca

SEQ ID NO: 51063 - DNA, 20 bp, synthetic construct
  misc_feature 1..20: note = CRISPR gRNA sequence
  source 1..20: mol_type = other DNA
tccatggtccccatggcacc

SEQ ID NO: 51064 - DNA, 20 bp, synthetic construct
  misc_feature 1..20: note = CRISPR gRNA sequence
  source 1..20: mol_type = other DNA
ccatggtccccatggcaccc

SEQ ID NO: 51065 - DNA, 20 bp, synthetic construct
  misc_feature 1..20: note = CRISPR gRNA sequence
  source 1..20: mol_type = other DNA
tccccatggcacccgggcat

SEQ ID NO: 51066 - DNA, 20 bp, synthetic construct
  misc_feature 1..20: note = CRISPR gRNA sequence
  source 1..20: mol_type = other DNA
ccccatggcacccgggcatc

SEQ ID NO: 51067 - DNA, 20 bp, synthetic construct
  misc_feature 1..20: note = CRISPR gRNA sequence
  source 1..20: mol_type = other DNA
cccatggcacccgggcatca

SEQ ID NO: 51068 - DNA, 20 bp, synthetic construct
  misc_feature 1..20: note = CRISPR gRNA sequence
  source 1..20: mol_type = other DNA
ccatggcacccgggcatcag

SEQ ID NO: 51069 - DNA, 20 bp, synthetic construct
  misc_feature 1..20: note = CRISPR gRNA sequence
  source 1..20: mol_type = other DNA
ggcacccgggcatcagggga

SEQ ID NO: 51070 - DNA, 20 bp, synthetic construct
  misc_feature 1..20: note = CRISPR gRNA sequence
  source 1..20: mol_type = other DNA
agaaattatgatcccatgcc

SEQ ID NO: 51071 - DNA, 20 bp, synthetic construct
  misc_feature 1..20: note = CRISPR gRNA sequence
  source 1..20: mol_type = other DNA
gaaattatgatcccatgccc

SEQ ID NO: 51072 - DNA, 20 bp, synthetic construct
  misc_feature 1..20: note = CRISPR gRNA sequence
  source 1..20: mol_type = other DNA
tcccatgcccaggaaaccct

SEQ ID NO: 51073 - DNA, 20 bp, synthetic construct
  misc_feature 1..20: note = CRISPR gRNA sequence
  source 1..20: mol_type = other DNA
gcccaggaaaccctgagatt

SEQ ID NO: 51074 - DNA, 20 bp, synthetic construct
  misc_feature 1..20: note = CRISPR gRNA sequence
  source 1..20: mol_type = other DNA
ccaggaaaccctgagattca

SEQ ID NO: 51075 - DNA, 20 bp, synthetic construct
  misc_feature 1..20: note = CRISPR gRNA sequence
  source 1..20: mol_type = other DNA
gaaaccctgagattcagaga

SEQ ID NO: 51076 - DNA, 20 bp, synthetic construct
  misc_feature 1..20: note = CRISPR gRNA sequence
  source 1..20: mol_type = other DNA
aaaccctgagattcagagaa

SEQ ID NO: 51077 - DNA, 20 bp, synthetic construct
  misc_feature 1..20: note = CRISPR gRNA sequence
  source 1..20: mol_type = other DNA
ccctgagattcagagaaagg

SEQ ID NO: 51078 - DNA, 20 bp, synthetic construct
  misc_feature 1..20: note = CRISPR gRNA sequence
  source 1..20: mol_type = other DNA
ctgagattcagagaaaggca

SEQ ID NO: 51079 - DNA, 20 bp, synthetic construct
  misc_feature 1..20: note = CRISPR gRNA sequence
  source 1..20: mol_type = other DNA
tgagattcagagaaaggcag

SEQ ID NO: 51080 - DNA, 20 bp, synthetic construct
  misc_feature 1..20: note = CRISPR gRNA sequence
  source 1..20: mol_type = other DNA
agaaaggcagaggttgctcc

SEQ ID NO: 51081 - DNA, 20 bp, synthetic construct
  misc_feature 1..20: note = CRISPR gRNA sequence
  source 1..20: mol_type = other DNA
agaggttgctccaagccacc

SEQ ID NO: 51082 - DNA, 20 bp, synthetic construct
  misc_feature 1..20: note = CRISPR gRNA sequence
  source 1..20: mol_type = other DNA
gttgctccaagccacccaga

SEQ ID NO: 51083 - DNA, 20 bp, synthetic construct
  misc_feature 1..20: note = CRISPR gRNA sequence
  source 1..20: mol_type = other DNA
gctccaagccacccagatgg

SEQ ID NO: 51084 - DNA, 20 bp, synthetic construct
  misc_feature 1..20: note = CRISPR gRNA sequence
  source 1..20: mol_type = other DNA
ctccaagccacccagatgga

SEQ ID NO: 51085 - DNA, 20 bp, synthetic construct
  misc_feature 1..20: note = CRISPR gRNA sequence
  source 1..20: mol_type = other DNA
cacccagatggaaggccaca

SEQ ID NO: 51086 - DNA, 20 bp, synthetic construct
  misc_feature 1..20: note = CRISPR gRNA sequence
  source 1..20: mol_type = other DNA
agatggaaggccacaaagtg

SEQ ID NO: 51087 - DNA, 20 bp, synthetic construct
  misc_feature 1..20: note = CRISPR gRNA sequence
  source 1..20: mol_type = other DNA
gatggaaggccacaaagtgt

SEQ ID NO: 51088 - DNA, 20 bp, synthetic construct
  misc_feature 1..20: note = CRISPR gRNA sequence
  source 1..20: mol_type = other DNA
tgccttgcttctcccatcat

SEQ ID NO: 51089 - DNA, 20 bp, synthetic construct
  misc_feature 1..20: note = CRISPR gRNA sequence
  source 1..20: mol_type = other DNA
ttgcttctcccatcatcagc

SEQ ID NO: 51090 - DNA, 20 bp, synthetic construct
  misc_feature 1..20: note = CRISPR gRNA sequence
  source 1..20: mol_type = other DNA
tgcttctcccatcatcagcc

SEQ ID NO: 51091 - DNA, 20 bp, synthetic construct
  misc_feature 1..20: note = CRISPR gRNA sequence
  source 1..20: mol_type = other DNA
gcttctcccatcatcagcca

SEQ ID NO: 51092 - DNA, 20 bp, synthetic construct
  misc_feature 1..20: note = CRISPR gRNA sequence
  source 1..20: mol_type = other DNA
cttctcccatcatcagccag

SEQ ID NO: 51093 - DNA, 20 bp, synthetic construct
  misc_feature 1..20: note = CRISPR gRNA sequence
  source 1..20: mol_type = other DNA
catcagccaggggcacctgt

SEQ ID NO: 51094 - DNA, 20 bp, synthetic construct
  misc_feature 1..20: note = CRISPR gRNA sequence
  source 1..20: mol_type = other DNA
agccaggggcacctgttggc

SEQ ID NO: 51095 - DNA, 20 bp, synthetic construct
  misc_feature 1..20: note = CRISPR gRNA sequence
  source 1..20: mol_type = other DNA
caggggcacctgttggccag

SEQ ID NO: 51096 - DNA, 20 bp, synthetic construct
  misc_feature 1..20: note = CRISPR gRNA sequence
  source 1..20: mol_type = other DNA
ggcacctgttggccagcaga

SEQ ID NO: 51097 - DNA, 20 bp, synthetic construct
  misc_feature 1..20: note = CRISPR gRNA sequence
  source 1..20: mol_type = other DNA
gcacctgttggccagcagaa

SEQ ID NO: 51098 - DNA, 20 bp, synthetic construct
  misc_feature 1..20: note = CRISPR gRNA sequence
  source 1..20: mol_type = other DNA
cacctgttggccagcagaaa

SEQ ID NO: 51099 - DNA, 20 bp, synthetic construct
  misc_feature 1..20: note = CRISPR gRNA sequence
  source 1..20: mol_type = other DNA
acctgttggccagcagaaag

SEQ ID NO: 51100 - DNA, 20 bp, synthetic construct
  misc_feature 1..20: note = CRISPR gRNA sequence
  source 1..20: mol_type = other DNA
gccagcagaaaggggctttt

SEQ ID NO: 51101 - DNA, 20 bp, synthetic construct
  misc_feature 1..20: note = CRISPR gRNA sequence
  source 1..20: mol_type = other DNA
ccagcagaaaggggcttttc

SEQ ID NO: 51102 - DNA, 20 bp, synthetic construct
  misc_feature 1..20: note = CRISPR gRNA sequence
  source 1..20: mol_type = other DNA
cagcagaaaggggcttttcg

SEQ ID NO: 51103 - DNA, 20 bp, synthetic construct
  misc_feature 1..20: note = CRISPR gRNA sequence
  source 1..20: mol_type = other DNA
caacatccccttacttcact

SEQ ID NO: 51104 - DNA, 20 bp, synthetic construct
  misc_feature 1..20: note = CRISPR gRNA sequence
  source 1..20: mol_type = other DNA
aacatccccttacttcactg

SEQ ID NO: 51105 - DNA, 20 bp, synthetic construct
  misc_feature 1..20: note = CRISPR gRNA sequence
  source 1..20: mol_type = other DNA
cttacttcactgaggcctcc

SEQ ID NO: 51106 - DNA, 20 bp, synthetic construct
  misc_feature 1..20: note = CRISPR gRNA sequence
  source 1..20: mol_type = other DNA
actgaggcctcccggacacg

SEQ ID NO: 51107 - DNA, 20 bp, synthetic construct
  misc_feature 1..20: note = CRISPR gRNA sequence
  source 1..20: mol_type = other DNA
ctgaggcctcccggacacgt

SEQ ID NO: 51108 - DNA, 20 bp, synthetic construct
  misc_feature 1..20: note = CRISPR gRNA sequence
  source 1..20: mol_type = other DNA
aggcctcccggacacgtggg

SEQ ID NO: 51109 - DNA, 20 bp, synthetic construct
  misc_feature 1..20: note = CRISPR gRNA sequence
  source 1..20: mol_type = other DNA
ggcctcccggacacgtgggc

SEQ ID NO: 51110 - DNA, 20 bp, synthetic construct
  misc_feature 1..20: note = CRISPR gRNA sequence
  source 1..20: mol_type = other DNA
cctcccggacacgtgggcag

SEQ ID NO: 51111 - DNA, 20 bp, synthetic construct
  misc_feature 1..20: note = CRISPR gRNA sequence
  source 1..20: mol_type = other DNA
ctcccggacacgtgggcagg

SEQ ID NO: 51112 - DNA, 20 bp, synthetic construct
  misc_feature 1..20: note = CRISPR gRNA sequence
  source 1..20: mol_type = other DNA
tcccggacacgtgggcagga

SEQ ID NO: 51113 - DNA, 20 bp, synthetic construct
  misc_feature 1..20: note = CRISPR gRNA sequence
  source 1..20: mol_type = other DNA
cggacacgtgggcaggaggg

SEQ ID NO: 51114 - DNA, 20 bp, synthetic construct
  misc_feature 1..20: note = CRISPR gRNA sequence
  source 1..20: mol_type = other DNA
gggcaggagggcagtgtctc

SEQ ID NO: 51115 - DNA, 20 bp, synthetic construct
  misc_feature 1..20: note = CRISPR gRNA sequence
  source 1..20: mol_type = other DNA
caggagggcagtgtctccag

SEQ ID NO: 51116 - DNA, 20 bp, synthetic construct
  misc_feature 1..20: note = CRISPR gRNA sequence
  source 1..20: mol_type = other DNA
aggagggcagtgtctccagc

SEQ ID NO: 51117 - DNA, 20 bp, synthetic construct
  misc_feature 1..20: note = CRISPR gRNA sequence
  source 1..20: mol_type = other DNA
ggcagtgtctccagcaggta

SEQ ID NO: 51118 - DNA, 20 bp, synthetic construct
  misc_feature 1..20: note = CRISPR gRNA sequence
  source 1..20: mol_type = other DNA
gcagtgtctccagcaggtac

SEQ ID NO: 51119 - DNA, 20 bp, synthetic construct
  misc_feature 1..20: note = CRISPR gRNA sequence
  source 1..20: mol_type = other DNA
cagtgtctccagcaggtaca

SEQ ID NO: 51120 - DNA, 20 bp, synthetic construct
  misc_feature 1..20: note = CRISPR gRNA sequence
  source 1..20: mol_type = other DNA
caggtacagggcactttcct

SEQ ID NO: 51121 - DNA, 20 bp, synthetic construct
  misc_feature 1..20: note = CRISPR gRNA sequence
  source 1..20: mol_type = other DNA
tgagaaatgctgttgtgact

SEQ ID NO: 51122 - DNA, 20 bp, synthetic construct
  misc_feature 1..20: note = CRISPR gRNA sequence
  source 1..20: mol_type = other DNA
aatgctgttgtgactcagac

SEQ ID NO: 51123 - DNA, 20 bp, synthetic construct
  misc_feature 1..20: note = CRISPR gRNA sequence
  source 1..20: mol_type = other DNA
gctgttgtgactcagactag

SEQ ID NO: 51124 - DNA, 20 bp, synthetic construct
  misc_feature 1..20: note = CRISPR gRNA sequence
  source 1..20: mol_type = other DNA
ctgttgtgactcagactaga

SEQ ID NO: 51125 - DNA, 20 bp, synthetic construct
  misc_feature 1..20: note = CRISPR gRNA sequence
  source 1..20: mol_type = other DNA
tgttgtgactcagactagaa

SEQ ID NO: 51126 - DNA, 20 bp, synthetic construct
  misc_feature 1..20: note = CRISPR gRNA sequence
  source 1..20: mol_type = other DNA
gactcagactagaagggaaa

SEQ ID NO: 51127 - DNA, 20 bp, synthetic construct
  misc_feature 1..20: note = CRISPR gRNA sequence
  source 1..20: mol_type = other DNA
ctcagactagaagggaaatg

SEQ ID NO: 51128 - DNA, 20 bp, synthetic construct
  misc_feature 1..20: note = CRISPR gRNA sequence
  source 1..20: mol_type = other DNA
actagaagggaaatggagat

SEQ ID NO: 51129 - DNA, 20 bp, synthetic construct
  misc_feature 1..20: note = CRISPR gRNA sequence
  source 1..20: mol_type = other DNA
aagggaaatggagatgagaa

SEQ ID NO: 51130 - DNA, 20 bp, synthetic construct
  misc_feature 1..20: note = CRISPR gRNA sequence
  source 1..20: mol_type = other DNA
agggaaatggagatgagaat

SEQ ID NO: 51131 - DNA, 20 bp, synthetic construct
  misc_feature 1..20: note = CRISPR gRNA sequence
  source 1..20: mol_type = other DNA
ggaaatggagatgagaatgg

SEQ ID NO: 51132 - DNA, 20 bp, synthetic construct
  misc_feature 1..20: note = CRISPR gRNA sequence
  source 1..20: mol_type = other DNA
atggagatgagaatgggagt

SEQ ID NO: 51133 - DNA, 20 bp, synthetic construct
  misc_feature 1..20: note = CRISPR gRNA sequence
  source 1..20: mol_type = other DNA
tggagatgagaatgggagtg

SEQ ID NO: 51134 - DNA, 20 bp, synthetic construct
  misc_feature 1..20: note = CRISPR gRNA sequence
  source 1..20: mol_type = other DNA
ggagatgagaatgggagtga

SEQ ID NO: 51135 - DNA, 20 bp, synthetic construct
  misc_feature 1..20: note = CRISPR gRNA sequence
  source 1..20: mol_type = other DNA
gatgagaatgggagtgaggg

SEQ ID NO: 51136 - DNA, 20 bp, synthetic construct
  misc_feature 1..20: note = CRISPR gRNA sequence
  source 1..20: mol_type = other DNA
atgagaatgggagtgagggc

SEQ ID NO: 51137 - DNA, 20 bp, synthetic construct
  misc_feature 1..20: note = CRISPR gRNA sequence
  source 1..20: mol_type = other DNA
gagtgagggcaggacctcct

SEQ ID NO: 51138 - DNA, 20 bp, synthetic construct
  misc_feature 1..20: note = CRISPR gRNA sequence
  source 1..20: mol_type = other DNA
gtgagggcaggacctccttg

SEQ ID NO: 51139 - DNA, 20 bp, synthetic construct
  misc_feature 1..20: note = CRISPR gRNA sequence
  source 1..20: mol_type = other DNA
gacctccttggagccctgcc

SEQ ID NO: 51140 - DNA, 20 bp, synthetic construct
  misc_feature 1..20: note = CRISPR gRNA sequence
  source 1..20: mol_type = other DNA
agccccctccatctcccttc

SEQ ID NO: 51141 - DNA, 20 bp, synthetic construct
  misc_feature 1..20: note = CRISPR gRNA sequence
  source 1..20: mol_type = other DNA
cccttccagctgtcatttcc

SEQ ID NO: 51142 - DNA, 20 bp, synthetic construct
  misc_feature 1..20: note = CRISPR gRNA sequence
  source 1..20: mol_type = other DNA
ttccagctgtcatttccaag

SEQ ID NO: 51143 - DNA, 20 bp, synthetic construct
  misc_feature 1..20: note = CRISPR gRNA sequence
  source 1..20: mol_type = other DNA
ccagctgtcatttccaagaa

SEQ ID NO: 51144 - DNA, 20 bp, synthetic construct
  misc_feature 1..20: note = CRISPR gRNA sequence
  source 1..20: mol_type = other DNA
gctgtcatttccaagaagag

SEQ ID NO: 51145 - DNA, 20 bp, synthetic construct
  misc_feature 1..20: note = CRISPR gRNA sequence
  source 1..20: mol_type = other DNA
gaagagaagcctccatgtct

SEQ ID NO: 51146 - DNA, 20 bp, synthetic construct
  misc_feature 1..20: note = CRISPR gRNA sequence
  source 1..20: mol_type = other DNA
atgtctaagcatctattctc

SEQ ID NO: 51147 - DNA, 20 bp, synthetic construct
  misc_feature 1..20: note = CRISPR gRNA sequence
  source 1..20: mol_type = other DNA
ctaagcatctattctccaga

SEQ ID NO: 51148 - DNA, 20 bp, synthetic construct
  misc_feature 1..20: note = CRISPR gRNA sequence
  source 1..20: mol_type = other DNA
attctccagatggacacact

SEQ ID NO: 51149 - DNA, 20 bp, synthetic construct
  misc_feature 1..20: note = CRISPR gRNA sequence
  source 1..20: mol_type = other DNA
ttctccagatggacacactg

SEQ ID NO: 51150 - DNA, 20 bp, synthetic construct
  misc_feature 1..20: note = CRISPR gRNA sequence
  source 1..20: mol_type = other DNA
cagatggacacactgaggcc

SEQ ID NO: 51151 - DNA, 20 bp, synthetic construct
  misc_feature 1..20: note = CRISPR gRNA sequence
  source 1..20: mol_type = other DNA
atggacacactgaggcccag

SEQ ID NO: 51152 - DNA, 20 bp, synthetic construct
  misc_feature 1..20: note = CRISPR gRNA sequence
  source 1..20: mol_type = other DNA
tggacacactgaggcccaga

SEQ ID NO: 51153 - DNA, 20 bp, synthetic construct
  misc_feature 1..20: note = CRISPR gRNA sequence
  source 1..20: mol_type = other DNA
agaaggataccatccccaca

SEQ ID NO: 51154 - DNA, 20 bp, synthetic construct
  misc_feature 1..20: note = CRISPR gRNA sequence
  source 1..20: mol_type = other DNA
gaaggataccatccccacac

SEQ ID NO: 51155 - DNA, 20 bp, synthetic construct
  misc_feature 1..20: note = CRISPR gRNA sequence
  source 1..20: mol_type = other DNA
ggataccatccccacacagg

SEQ ID NO: 51156 - DNA, 20 bp, synthetic construct
  misc_feature 1..20: note = CRISPR gRNA sequence
  source 1..20: mol_type = other DNA
catccccacacaggcagaac

SEQ ID NO: 51157 - DNA, 20 bp, synthetic construct
  misc_feature 1..20: note = CRISPR gRNA sequence
  source 1..20: mol_type = other DNA
cacacaggcagaactggcac

SEQ ID NO: 51158 - DNA, 20 bp, synthetic construct
  misc_feature 1..20: note = CRISPR gRNA sequence
  source 1..20: mol_type = other DNA
cagaactggcaccagaccct

SEQ ID NO: 51159 - DNA, 20 bp, synthetic construct
  misc_feature 1..20: note = CRISPR gRNA sequence
  source 1..20: mol_type = other DNA
gcaccagaccctgagtcctt

SEQ ID NO: 51160 - DNA, 20 bp, synthetic construct
  misc_feature 1..20: note = CRISPR gRNA sequence
  source 1..20: mol_type = other DNA
caccctgcccgctgcccctg

SEQ ID NO: 51161 - DNA, 20 bp, synthetic construct
  misc_feature 1..20: note = CRISPR gRNA sequence
  source 1..20: mol_type = other DNA
tgcccgctgcccctgtggtc

SEQ ID NO: 51162 - DNA, 20 bp, synthetic construct
  misc_feature 1..20: note = CRISPR gRNA sequence
  source 1..20: mol_type = other DNA
gcccgctgcccctgtggtct

SEQ ID NO: 51163 - DNA, 20 bp, synthetic construct
  misc_feature 1..20: note = CRISPR gRNA sequence
  source 1..20: mol_type = other DNA
cccgctgcccctgtggtctg

SEQ ID NO: 51164 - DNA, 20 bp, synthetic construct
  misc_feature 1..20: note = CRISPR gRNA sequence
  source 1..20: mol_type = other DNA
tgcccctgtggtctggggtc

SEQ ID NO: 51165 - DNA, 20 bp, synthetic construct
  misc_feature 1..20: note = CRISPR gRNA sequence
  source 1..20: mol_type = other DNA
gcccctgtggtctggggtct

SEQ ID NO: 51166 - DNA, 20 bp, synthetic construct
  misc_feature 1..20: note = CRISPR gRNA sequence
  source 1..20: mol_type = other DNA
gtggtctggggtctgggcac

SEQ ID NO: 51167 - DNA, 20 bp, synthetic construct
  misc_feature 1..20: note = CRISPR gRNA sequence
  source 1..20: mol_type = other DNA
tctggggtctgggcactggc

SEQ ID NO: 51168 - DNA, 20 bp, synthetic construct
  misc_feature 1..20: note = CRISPR gRNA sequence
  source 1..20: mol_type = other DNA
ctggggtctgggcactggca

SEQ ID NO: 51169 - DNA, 20 bp, synthetic construct
  misc_feature 1..20: note = CRISPR gRNA sequence
  source 1..20: mol_type = other DNA
ggtctgggcactggcaaggc

SEQ ID NO: 51170 - DNA, 20 bp, synthetic construct
  misc_feature 1..20: note = CRISPR gRNA sequence
  source 1..20: mol_type = other DNA
gtctgggcactggcaaggcc

SEQ ID NO: 51171 - DNA, 20 bp, synthetic construct
  misc_feature 1..20: note = CRISPR gRNA sequence
  source 1..20: mol_type = other DNA
gggcactggcaaggccaggc

SEQ ID NO: 51172 - DNA, 20 bp, synthetic construct
  misc_feature 1..20: note = CRISPR gRNA sequence
  source 1..20: mol_type = other DNA
cactggcaaggccaggctgg

SEQ ID NO: 51173 - DNA, 20 bp, synthetic construct
  misc_feature 1..20: note = CRISPR gRNA sequence
  source 1..20: mol_type = other DNA
caaggccaggctggcagctc

SEQ ID NO: 51174 - DNA, 20 bp, synthetic construct
  misc_feature 1..20: note = CRISPR gRNA sequence
  source 1..20: mol_type = other DNA
ctggcagctctagccccgca

SEQ ID NO: 51175 - DNA, 20 bp, synthetic construct
  misc_feature 1..20: note = CRISPR gRNA sequence
  source 1..20: mol_type = other DNA
tggcagctctagccccgcat

SEQ ID NO: 51176 - DNA, 20 bp, synthetic construct
  misc_feature 1..20: note = CRISPR gRNA sequence
  source 1..20: mol_type = other DNA
gctctagccccgcatgggtc

SEQ ID NO: 51177 - DNA, 20 bp, synthetic construct
  misc_feature 1..20: note = CRISPR gRNA sequence
  source 1..20: mol_type = other DNA
ctctagccccgcatgggtca

SEQ ID NO: 51178 - DNA, 20 bp, synthetic construct
  misc_feature 1..20: note = CRISPR gRNA sequence
  source 1..20: mol_type = other DNA
cgcatgggtcaaggactccc

SEQ ID NO: 51179 - DNA, 20 bp, synthetic construct
  misc_feature 1..20: note = CRISPR gRNA sequence
  source 1..20: mol_type = other DNA
gtcaaggactcccgagcacg

SEQ ID NO: 51180 - DNA, 20 bp, synthetic construct
  misc_feature 1..20: note = CRISPR gRNA sequence
  source 1..20: mol_type = other DNA
ggactcccgagcacgaagct

SEQ ID NO: 51181 - DNA, 20 bp, synthetic construct
  misc_feature 1..20: note = CRISPR gRNA sequence
  source 1..20: mol_type = other DNA
gagcacgaagctcagttgcc

SEQ ID NO: 51182 - DNA, 20 bp, synthetic construct
  misc_feature 1..20: note = CRISPR gRNA sequence
  source 1..20: mol_type = other DNA
aagctcagttgcctagcaac

SEQ ID NO: 51183 - DNA, 20 bp, synthetic construct
  misc_feature 1..20: note = CRISPR gRNA sequence
  source 1..20: mol_type = other DNA
ctcagttgcctagcaacaag

SEQ ID NO: 51184 - DNA, 20 bp, synthetic construct
  misc_feature 1..20: note = CRISPR gRNA sequence
  source 1..20: mol_type = other DNA
cctagcaacaagtggtgtcc

SEQ ID NO: 51185 - DNA, 20 bp, synthetic construct
  misc_feature 1..20: note = CRISPR gRNA sequence
  source 1..20: mol_type = other DNA
tagcaacaagtggtgtcctg

SEQ ID NO: 51186 - DNA, 20 bp, synthetic construct
  misc_feature 1..20: note = CRISPR gRNA sequence
  source 1..20: mol_type = other DNA
aacaagtggtgtcctggagc

SEQ ID NO: 51187 - DNA, 20 bp, synthetic construct
  misc_feature 1..20: note = CRISPR gRNA sequence
  source 1..20: mol_type = other DNA
cctggagctggctgtcactc

SEQ ID NO: 51188 - DNA, 20 bp, synthetic construct
  misc_feature 1..20: note = CRISPR gRNA sequence
  source 1..20: mol_type = other DNA
ggagctggctgtcactccag

SEQ ID NO: 51189 - DNA, 20 bp, synthetic construct
  misc_feature 1..20: note = CRISPR gRNA sequence
  source 1..20: mol_type = other DNA
gagctggctgtcactccagc

SEQ ID NO: 51190 - DNA, 20 bp, synthetic construct
  misc_feature 1..20: note = CRISPR gRNA sequence
  source 1..20: mol_type = other DNA
gctgtcactccagcaggtca

SEQ ID NO: 51191 - DNA, 20 bp, synthetic construct
  misc_feature 1..20: note = CRISPR gRNA sequence
  source 1..20: mol_type = other DNA
ctgtcactccagcaggtcac

SEQ ID NO: 51192 - DNA, 20 bp, synthetic construct
  misc_feature 1..20: note = CRISPR gRNA sequence
  source 1..20: mol_type = other DNA
gtcactccagcaggtcacgg

SEQ ID NO: 51193 - DNA, 20 bp, synthetic construct
  misc_feature 1..20: note = CRISPR gRNA sequence
  source 1..20: mol_type = other DNA
cactccagcaggtcacggga

SEQ ID NO: 51194 - DNA, 20 bp, synthetic construct
  misc_feature 1..20: note = CRISPR gRNA sequence
  source 1..20: mol_type = other DNA
ccagcaggtcacgggagaga

SEQ ID NO: 51195 - DNA, 20 bp, synthetic construct
  misc_feature 1..20: note = CRISPR gRNA sequence
  source 1..20: mol_type = other DNA
cagcaggtcacgggagagat

SEQ ID NO: 51196 - DNA, 20 bp, synthetic construct
  misc_feature 1..20: note = CRISPR gRNA sequence
  source 1..20: mol_type = other DNA
agcaggtcacgggagagatg

SEQ ID NO: 51197 - DNA, 20 bp, synthetic construct
  misc_feature 1..20: note = CRISPR gRNA sequence
  source 1..20: mol_type = other DNA
ggagagatggggcaaccatg

SEQ ID NO: 51198 - DNA, 20 bp, synthetic construct
  misc_feature 1..20: note = CRISPR gRNA sequence
  source 1..20: mol_type = other DNA
aaccatgtggatgacttcct

SEQ ID NO: 51199 - DNA, 20 bp, synthetic construct
  misc_feature 1..20: note = CRISPR gRNA sequence
  source 1..20: mol_type = other DNA
accatgtggatgacttccta

SEQ ID NO: 51200 - DNA, 20 bp, synthetic construct
  misc_feature 1..20: note = CRISPR gRNA sequence
  source 1..20: mol_type = other DNA
ctaaggccccttgcctgcca

SEQ ID NO: 51201 - DNA, 20 bp, synthetic construct
  misc_feature 1..20: note = CRISPR gRNA sequence
  source 1..20: mol_type = other DNA
taaggccccttgcctgccac

SEQ ID NO: 51202 - DNA, 20 bp, synthetic construct
  misc_feature 1..20: note = CRISPR gRNA sequence
  source 1..20: mol_type = other DNA
aaggccccttgcctgccaca

SEQ ID NO: 51203 - DNA, 20 bp, synthetic construct
  misc_feature 1..20: note = CRISPR gRNA sequence
  source 1..20: mol_type = other DNA
atctccacatttatgttcca

SEQ ID NO: 51204 - DNA, 20 bp, synthetic construct
  misc_feature 1..20: note = CRISPR gRNA sequence
  source 1..20: mol_type = other DNA
cacatttatgttccacagat

SEQ ID NO: 51205 - DNA, 20 bp, synthetic construct
  misc_feature 1..20: note = CRISPR gRNA sequence
  source 1..20: mol_type = other DNA
acatttatgttccacagatt

SEQ ID NO: 51206 - DNA, 20 bp, synthetic construct
  misc_feature 1..20: note = CRISPR gRNA sequence
  source 1..20: mol_type = other DNA
ttatgttccacagattgggt

SEQ ID NO: 51207 - DNA, 20 bp, synthetic construct
  misc_feature 1..20: note = CRISPR gRNA sequence
  source 1..20: mol_type = other DNA
tgttccacagattgggtcag

SEQ ID NO: 51208 - DNA, 20 bp, synthetic construct
  misc_feature 1..20: note = CRISPR gRNA sequence
  source 1..20: mol_type = other DNA
agattgggtcagaagaattt

SEQ ID NO: 51209 - DNA, 20 bp, synthetic construct
  misc_feature 1..20: note = CRISPR gRNA sequence
  source 1..20: mol_type = other DNA
gattgggtcagaagaatttc

SEQ ID NO: 51210 - DNA, 20 bp, synthetic construct
  misc_feature 1..20: note = CRISPR gRNA sequence
  source 1..20: mol_type = other DNA
attgggtcagaagaatttca

SEQ ID NO: 51211 - DNA, 20 bp, synthetic construct
  misc_feature 1..20: note = CRISPR gRNA sequence
  source 1..20: mol_type = other DNA
ggtcagaagaatttcaggga

SEQ ID NO: 51212 - DNA, 20 bp, synthetic construct
  misc_feature 1..20: note = CRISPR gRNA sequence
  source 1..20: mol_type = other DNA
gtcagaagaatttcagggac

SEQ ID NO: 51213 - DNA, 20 bp, synthetic construct
  misc_feature 1..20: note = CRISPR gRNA sequence
  source 1..20: mol_type = other DNA
gaagaatttcagggacggga

SEQ ID NO: 51214 - DNA, 20 bp, synthetic construct
  misc_feature 1..20: note = CRISPR gRNA sequence
  source 1..20: mol_type = other DNA
atttcagggacgggatggac

SEQ ID NO: 51215 - DNA, 20 bp, synthetic construct
  misc_feature 1..20: note = CRISPR gRNA sequence
  source 1..20: mol_type = other DNA
tttcagggacgggatggacc

SEQ ID NO: 51216 - DNA, 20 bp, synthetic construct
  misc_feature 1..20: note = CRISPR gRNA sequence
  source 1..20: mol_type = other DNA
tcagggacgggatggaccag

SEQ ID NO: 51217 - DNA, 20 bp, synthetic construct
  misc_feature 1..20: note = CRISPR gRNA sequence
  source 1..20: mol_type = other DNA
ggacgggatggaccaggagc

SEQ ID NO: 51218 - DNA, 20 bp, synthetic construct
  misc_feature 1..20: note = CRISPR gRNA sequence
  source 1..20: mol_type = other DNA
gacgggatggaccaggagcc

SEQ ID NO: 51219 - DNA, 20 bp, synthetic construct
  misc_feature 1..20: note = CRISPR gRNA sequence
  source 1..20: mol_type = other DNA
gggatggaccaggagccagg

SEQ ID NO: 51220 - DNA, 20 bp, synthetic construct
  misc_feature 1..20: note = CRISPR gRNA sequence
  source 1..20: mol_type = other DNA
aggcagctgcaatcccgcat

SEQ ID NO: 51221 - DNA, 20 bp, synthetic construct
  misc_feature 1..20: note = CRISPR gRNA sequence
  source 1..20: mol_type = other DNA
agctgcaatcccgcatcagc

SEQ ID NO: 51222 - DNA, 20 bp, synthetic construct
  misc_feature 1..20: note = CRISPR gRNA sequence
  source 1..20: mol_type = other DNA
gcaatcccgcatcagctggt

SEQ ID NO: 51223 - DNA, 20 bp, synthetic construct
  misc_feature 1..20: note = CRISPR gRNA sequence
  source 1..20: mol_type = other DNA
caatcccgcatcagctggtt

SEQ ID NO: 51224 - DNA, 20 bp, synthetic construct
  misc_feature 1..20: note = CRISPR gRNA sequence
  source 1..20: mol_type = other DNA
aatcccgcatcagctggttg

SEQ ID NO: 51225 - DNA, 20 bp, synthetic construct
  misc_feature 1..20: note = CRISPR gRNA sequence
  source 1..20: mol_type = other DNA
ccgcatcagctggttgggga

SEQ ID NO: 51226 - DNA, 20 bp, synthetic construct
  misc_feature 1..20: note = CRISPR gRNA sequence
  source 1..20: mol_type = other DNA
gaatgttgcttccctgtccc

SEQ ID NO: 51227 - DNA, 20 bp, synthetic construct
  misc_feature 1..20: note = CRISPR gRNA sequence
  source 1..20: mol_type = other DNA
aatgttgcttccctgtcccc

SEQ ID NO: 51228 - DNA, 20 bp, synthetic construct
  misc_feature 1..20: note = CRISPR gRNA sequence
  source 1..20: mol_type = other DNA
ttgcttccctgtccccaggt

SEQ ID NO: 51229 - DNA, 20 bp, synthetic construct
  misc_feature 1..20: note = CRISPR gRNA sequence
  source 1..20: mol_type = other DNA
tccctgtccccaggtcagtt

SEQ ID NO: 51230 - DNA, 20 bp, synthetic construct
  misc_feature 1..20: note = CRISPR gRNA sequence
  source 1..20: mol_type = other DNA
tccccaggtcagtttggctg

SEQ ID NO: 51231 - DNA, 20 bp, synthetic construct
  misc_feature 1..20: note = CRISPR gRNA sequence
  source 1..20: mol_type = other DNA
ccccaggtcagtttggctgt

SEQ ID NO: 51232 - DNA, 20 bp, synthetic construct
  misc_feature 1..20: note = CRISPR gRNA sequence
  source 1..20: mol_type = other DNA
cccaggtcagtttggctgta

SEQ ID NO: 51233 - DNA, 20 bp, synthetic construct
  misc_feature 1..20: note = CRISPR gRNA sequence
  source 1..20: mol_type = other DNA
ccaggtcagtttggctgtag

SEQ ID NO: 51234 - DNA, 20 bp, synthetic construct
  misc_feature 1..20: note = CRISPR gRNA sequence
  source 1..20: mol_type = other DNA
tgtcaccctgccacgaatca

SEQ ID NO: 51235 - DNA, 20 bp, synthetic construct
  misc_feature 1..20: note = CRISPR gRNA sequence
  source 1..20: mol_type = other DNA
ccacgaatcacagcctctct

SEQ ID NO: 51236 - DNA, 20 bp, synthetic construct
  misc_feature 1..20: note = CRISPR gRNA sequence
  source 1..20: mol_type = other DNA
cacgaatcacagcctctctt

SEQ ID NO: 51237 - DNA, 20 bp, synthetic construct
  misc_feature 1..20: note = CRISPR gRNA sequence
  source 1..20: mol_type = other DNA
cacagcctctcttgggtgtt

SEQ ID NO: 51238 - DNA, 20 bp, synthetic construct
  misc_feature 1..20: note = CRISPR gRNA sequence
  source 1..20: mol_type = other DNA
agcctctcttgggtgtttgg

SEQ ID NO: 51239 - DNA, 20 bp, synthetic construct
  misc_feature 1..20: note = CRISPR gRNA sequence
  source 1..20: mol_type = other DNA
cctctcttgggtgtttggtg

SEQ ID NO: 51240 - DNA, 20 bp, synthetic construct
  misc_feature 1..20: note = CRISPR gRNA sequence
  source 1..20: mol_type = other DNA
ctctcttgggtgtttggtgg

SEQ ID NO: 51241 - DNA, 20 bp, synthetic construct
  misc_feature 1..20: note = CRISPR gRNA sequence
  source 1..20: mol_type = other DNA
tttggtggaggatctgccca

SEQ ID NO: 51242 - DNA, 20 bp, synthetic construct
  misc_feature 1..20: note = CRISPR gRNA sequence
  source 1..20: mol_type = other DNA
ggtggaggatctgcccatgg

SEQ ID NO: 51243 - DNA, 20 bp, synthetic construct
  misc_feature 1..20: note = CRISPR gRNA sequence
  source 1..20: mol_type = other DNA
gtggaggatctgcccatggt

SEQ ID NO: 51244 - DNA, 20 bp, synthetic construct
  misc_feature 1..20: note = CRISPR gRNA sequence
  source 1..20: mol_type = other DNA
gatctgcccatggtgggtgt

SEQ ID NO: 51245 - DNA, 20 bp, synthetic construct
  misc_feature 1..20: note = CRISPR gRNA sequence
  source 1..20: mol_type = other DNA
atctgcccatggtgggtgtg

SEQ ID NO: 51246 - DNA, 20 bp, synthetic construct
  misc_feature 1..20: note = CRISPR gRNA sequence
  source 1..20: mol_type = other DNA
tctgcccatggtgggtgtga

SEQ ID NO: 51247 - DNA, 20 bp, synthetic construct
  misc_feature 1..20: note = CRISPR gRNA sequence
  source 1..20: mol_type = other DNA
cccatggtgggtgtgaggga

SEQ ID NO: 51248 - DNA, 20 bp, synthetic construct
  misc_feature 1..20: note = CRISPR gRNA sequence
  source 1..20: mol_type = other DNA
catggtgggtgtgagggaca

SEQ ID NO: 51249 - DNA, 20 bp, synthetic construct
  misc_feature 1..20: note = CRISPR gRNA sequence
  source 1..20: mol_type = other DNA
atggtgggtgtgagggacag

SEQ ID NO: 51250 - DNA, 20 bp, synthetic construct
  misc_feature 1..20: note = CRISPR gRNA sequence
  source 1..20: mol_type = other DNA
tgggtgtgagggacagagga

SEQ ID NO: 51251 - DNA, 20 bp, synthetic construct
  misc_feature 1..20: note = CRISPR gRNA sequence
  source 1..20: mol_type = other DNA
gggtgtgagggacagaggaa

SEQ ID NO: 51252 - DNA, 20 bp, synthetic construct
  misc_feature 1..20: note = CRISPR gRNA sequence
  source 1..20: mol_type = other DNA
agggacagaggaaaggaccc

SEQ ID NO: 51253 - DNA, 20 bp, synthetic construct
  misc_feature 1..20: note = CRISPR gRNA sequence
  source 1..20: mol_type = other DNA
gggacagaggaaaggaccca

SEQ ID NO: 51254 - DNA, 20 bp, synthetic construct
  misc_feature 1..20: note = CRISPR gRNA sequence
  source 1..20: mol_type = other DNA
cagaggaaaggacccaaggc

SEQ ID NO: 51255 - DNA, 20 bp, synthetic construct
  misc_feature 1..20: note = CRISPR gRNA sequence
  source 1..20: mol_type = other DNA
agaggaaaggacccaaggcc

SEQ ID NO: 51256 - DNA, 20 bp, synthetic construct
  misc_feature 1..20: note = CRISPR gRNA sequence
  source 1..20: mol_type = other DNA
gaggaaaggacccaaggcca

SEQ ID NO: 51257 - DNA, 20 bp, synthetic construct
  misc_feature 1..20: note = CRISPR gRNA sequence
  source 1..20: mol_type = other DNA
aggaaaggacccaaggccag

SEQ ID NO: 51258 - DNA, 20 bp, synthetic construct
  misc_feature 1..20: note = CRISPR gRNA sequence
  source 1..20: mol_type = other DNA
gaaaggacccaaggccaggg

SEQ ID NO: 51259 - DNA, 20 bp, synthetic construct
  misc_feature 1..20: note = CRISPR gRNA sequence
  source 1..20: mol_type = other DNA
gacccaaggccaggggagtg

SEQ ID NO: 51260 - DNA, 20 bp, synthetic construct
  misc_feature 1..20: note = CRISPR gRNA sequence
  source 1..20: mol_type = other DNA
acccaaggccaggggagtga

SEQ ID NO: 51261 - DNA, 20 bp, synthetic construct
  misc_feature 1..20: note = CRISPR gRNA sequence
  source 1..20: mol_type = other DNA
aaggccaggggagtgaaggc

SEQ ID NO: 51262 - DNA, 20 bp, synthetic construct
  misc_feature 1..20: note = CRISPR gRNA sequence
  source 1..20: mol_type = other DNA
aggccaggggagtgaaggca

SEQ ID NO: 51263 - DNA, 20 bp, synthetic construct
  misc_feature 1..20: note = CRISPR gRNA sequence
  source 1..20: mol_type = other DNA
ggccaggggagtgaaggcaa

SEQ ID NO: 51264 - DNA, 20 bp, synthetic construct
  misc_feature 1..20: note = CRISPR gRNA sequence
  source 1..20: mol_type = other DNA
caggggagtgaaggcaaggg

SEQ ID NO: 51265 - DNA, 20 bp, synthetic construct
  misc_feature 1..20: note = CRISPR gRNA sequence
  source 1..20: mol_type = other DNA
gaattgccccttgccctcca

SEQ ID NO: 51266 - DNA, 20 bp, synthetic construct
  misc_feature 1..20: note = CRISPR gRNA sequence
  source 1..20: mol_type = other DNA
cctccacagtccttgtcctc

SEQ ID NO: 51267 - DNA, 20 bp, synthetic construct
  misc_feature 1..20: note = CRISPR gRNA sequence
  source 1..20: mol_type = other DNA
gtccttgtcctctggtgctc

SEQ ID NO: 51268 - DNA, 20 bp, synthetic construct
  misc_feature 1..20: note = CRISPR gRNA sequence
  source 1..20: mol_type = other DNA
tccttgtcctctggtgctct

SEQ ID NO: 51269 - DNA, 20 bp, synthetic construct
  misc_feature 1..20: note = CRISPR gRNA sequence
  source 1..20: mol_type = other DNA
ccttgtcctctggtgctctg

SEQ ID NO: 51270 - DNA, 20 bp, synthetic construct
  misc_feature 1..20: note = CRISPR gRNA sequence
  source 1..20: mol_type = other DNA
cttgtcctctggtgctctgg

SEQ ID NO: 51271 - DNA, 20 bp, synthetic construct
  misc_feature 1..20: note = CRISPR gRNA sequence
  source 1..20: mol_type = other DNA
ggtgctctgggggatgccct

SEQ ID NO: 51272 - DNA, 20 bp, synthetic construct
  misc_feature 1..20: note = CRISPR gRNA sequence
  source 1..20: mol_type = other DNA
gctctgggggatgccctcag

SEQ ID NO: 51273 - DNA, 20 bp, synthetic construct
  misc_feature 1..20: note = CRISPR gRNA sequence
  source 1..20: mol_type = other DNA
ctctgggggatgccctcaga

SEQ ID NO: 51274 - DNA, 20 bp, synthetic construct
  misc_feature 1..20: note = CRISPR gRNA sequence
  source 1..20: mol_type = other DNA
ctgggggatgccctcagaag

SEQ ID NO: 51275 - DNA, 20 bp, synthetic construct
  misc_feature 1..20: note = CRISPR gRNA sequence
  source 1..20: mol_type = other DNA
aggagcccccatcatgcttt

SEQ ID NO: 51276 - DNA, 20 bp, synthetic construct
  misc_feature 1..20: note = CRISPR gRNA sequence
  source 1..20: mol_type = other DNA
cccccatcatgcttttggcc

SEQ ID NO: 51277 - DNA, 20 bp, synthetic construct
  misc_feature 1..20: note = CRISPR gRNA sequence
  source 1..20: mol_type = other DNA
ccccatcatgcttttggcct

SEQ ID NO: 51278 - DNA, 20 bp, synthetic construct
  misc_feature 1..20: note = CRISPR gRNA sequence
  source 1..20: mol_type = other DNA
cccatcatgcttttggccta

SEQ ID NO: 51279 - DNA, 20 bp, synthetic construct
  misc_feature 1..20: note = CRISPR gRNA sequence
  source 1..20: mol_type = other DNA
ccatcatgcttttggcctag

SEQ ID NO: 51280 - DNA, 20 bp, synthetic construct
  misc_feature 1..20: note = CRISPR gRNA sequence
  source 1..20: mol_type = other DNA
atcatgcttttggcctaggg

SEQ ID NO: 51281 - DNA, 20 bp, synthetic construct
  misc_feature 1..20: note = CRISPR gRNA sequence
  source 1..20: mol_type = other DNA
atgctgctttccacttactc

SEQ ID NO: 51282 - DNA, 20 bp, synthetic construct
  misc_feature 1..20: note = CRISPR gRNA sequence
  source 1..20: mol_type = other DNA
ttccacttactcaagcaaac

SEQ ID NO: 51283 - DNA, 20 bp, synthetic construct
  misc_feature 1..20: note = CRISPR gRNA sequence
  source 1..20: mol_type = other DNA
ccacttactcaagcaaaccg

SEQ ID NO: 51284 - DNA, 20 bp, synthetic construct
  misc_feature 1..20: note = CRISPR gRNA sequence
  source 1..20: mol_type = other DNA
ttactcaagcaaaccggaga

SEQ ID NO: 51285 - DNA, 20 bp, synthetic construct
  misc_feature 1..20: note = CRISPR gRNA sequence
  source 1..20: mol_type = other DNA
tactcaagcaaaccggagat

SEQ ID NO: 51286 - DNA, 20 bp, synthetic construct
  misc_feature 1..20: note = CRISPR gRNA sequence
  source 1..20: mol_type = other DNA
aaaccggagatgggcacctg

SEQ ID NO: 51287 - DNA, 20 bp, synthetic construct
  misc_feature 1..20: note = CRISPR gRNA sequence
  source 1..20: mol_type = other DNA
ccggagatgggcacctgcgg

SEQ ID NO: 51288 - DNA, 20 bp, synthetic construct
  misc_feature 1..20: note = CRISPR gRNA sequence
  source 1..20: mol_type = other DNA
ggcacctgcggcagacattc

SEQ ID NO: 51289 - DNA, 20 bp, synthetic construct
  misc_feature 1..20: note = CRISPR gRNA sequence
  source 1..20: mol_type = other DNA
acctgcggcagacattccag

SEQ ID NO: 51290 - DNA, 20 bp, synthetic construct
  misc_feature 1..20: note = CRISPR gRNA sequence
  source 1..20: mol_type = other DNA
cctgcggcagacattccaga

SEQ ID NO: 51291 - DNA, 20 bp, synthetic construct
  misc_feature 1..20: note = CRISPR gRNA sequence
  source 1..20: mol_type = other DNA
agacattccagaaggcatct

SEQ ID NO: 51292 - DNA, 20 bp, synthetic construct
  misc_feature 1..20: note = CRISPR gRNA sequence
  source 1..20: mol_type = other DNA
catctgagtccgctgtcgcc

SEQ ID NO: 51293 - DNA, 20 bp, synthetic construct
  misc_feature 1..20: note = CRISPR gRNA sequence
  source 1..20: mol_type = other DNA
ctgagtccgctgtcgcccag

SEQ ID NO: 51294 - DNA, 20 bp, synthetic construct
  misc_feature 1..20: note = CRISPR gRNA sequence
  source 1..20: mol_type = other DNA
tgagtccgctgtcgcccagc

SEQ ID NO: 51295 - DNA, 20 bp, synthetic construct
  misc_feature 1..20: note = CRISPR gRNA sequence
  source 1..20: mol_type = other DNA
tgtcgcccagcaggtttgct

SEQ ID NO: 51296 - DNA, 20 bp, synthetic construct
  misc_feature 1..20: note = CRISPR gRNA sequence
  source 1..20: mol_type = other DNA
tcgcccagcaggtttgctga

SEQ ID NO: 51297 - DNA, 20 bp, synthetic construct
  misc_feature 1..20: note = CRISPR gRNA sequence
  source 1..20: mol_type = other DNA
gcaggtttgctgagagactg

SEQ ID NO: 51298 - DNA, 20 bp, synthetic construct
  misc_feature 1..20: note = CRISPR gRNA sequence
  source 1..20: mol_type = other DNA
caggtttgctgagagactgt

SEQ ID NO: 51299 - DNA, 20 bp, synthetic construct
  misc_feature 1..20: note = CRISPR gRNA sequence
  source 1..20: mol_type = other DNA
aggtttgctgagagactgta

SEQ ID NO: 51300 - DNA, 20 bp, synthetic construct
  misc_feature 1..20: note = CRISPR gRNA sequence
  source 1..20: mol_type = other DNA
ggtttgctgagagactgtag

SEQ ID NO: 51301 - DNA, 20 bp, synthetic construct
  misc_feature 1..20: note = CRISPR gRNA sequence
  source 1..20: mol_type = other DNA
gtttgctgagagactgtagg

SEQ ID NO: 51302 - DNA, 20 bp, synthetic construct
  misc_feature 1..20: note = CRISPR gRNA sequence
  source 1..20: mol_type = other DNA
gctgagagactgtagggggt

SEQ ID NO: 51303 - DNA, 20 bp, synthetic construct
  misc_feature 1..20: note = CRISPR gRNA sequence
  source 1..20: mol_type = other DNA
ctgagagactgtagggggta

SEQ ID NO: 51304 - DNA, 20 bp, synthetic construct
  misc_feature 1..20: note = CRISPR gRNA sequence
  source 1..20: mol_type = other DNA
gagagactgtagggggtaag

SEQ ID NO: 51305 - DNA, 20 bp, synthetic construct
  misc_feature 1..20: note = CRISPR gRNA sequence
  source 1..20: mol_type = other DNA
agactgtagggggtaaggag

SEQ ID NO: 51306 - DNA, 20 bp, synthetic construct
  misc_feature 1..20: note = CRISPR gRNA sequence
  source 1..20: mol_type = other DNA
ctgtagggggtaaggagcag

SEQ ID NO: 51307 - DNA, 20 bp, synthetic construct
  misc_feature 1..20: note = CRISPR gRNA sequence
  source 1..20: mol_type = other DNA
tagggggtaaggagcagtgg

SEQ ID NO: 51308 - DNA, 20 bp, synthetic construct
  misc_feature 1..20: note = CRISPR gRNA sequence
  source 1..20: mol_type = other DNA
agggggtaaggagcagtggc

SEQ ID NO: 51309 - DNA, 20 bp, synthetic construct
  misc_feature 1..20: note = CRISPR gRNA sequence
  source 1..20: mol_type = other DNA
gggggtaaggagcagtggcg

SEQ ID NO: 51310 - DNA, 20 bp, synthetic construct
  misc_feature 1..20: note = CRISPR gRNA sequence
  source 1..20: mol_type = other DNA
taaggagcagtggcggggat

SEQ ID NO: 51311 - DNA, 20 bp, synthetic construct
  misc_feature 1..20: note = CRISPR gRNA sequence
  source 1..20: mol_type = other DNA
aggagcagtggcggggatca

SEQ ID NO: 51312 - DNA, 20 bp, synthetic construct
  misc_feature 1..20: note = CRISPR gRNA sequence
  source 1..20: mol_type = other DNA
ggagcagtggcggggatcag

SEQ ID NO: 51313 - DNA, 20 bp, synthetic construct
  misc_feature 1..20: note = CRISPR gRNA sequence
  source 1..20: mol_type = other DNA
ggggatcagaggtgcctcct

SEQ ID NO: 51314 - DNA, 20 bp, synthetic construct
  misc_feature 1..20: note = CRISPR gRNA sequence
  source 1..20: mol_type = other DNA
cagaggtgcctcctcagcct

SEQ ID NO: 51315 - DNA, 20 bp, synthetic construct
  misc_feature 1..20: note = CRISPR gRNA sequence
  source 1..20: mol_type = other DNA
cctcagcctgagatgctcct

SEQ ID NO: 51316 - DNA, 20 bp, synthetic construct
  misc_feature 1..20: note = CRISPR gRNA sequence
  source 1..20: mol_type = other DNA
ctgagatgctcctcagtcac

SEQ ID NO: 51317 - DNA, 20 bp, synthetic construct
  misc_feature 1..20: note = CRISPR gRNA sequence
  source 1..20: mol_type = other DNA
tgagatgctcctcagtcacc

SEQ ID NO: 51318 - DNA, 20 bp, synthetic construct
  misc_feature 1..20: note = CRISPR gRNA sequence
  source 1..20: mol_type = other DNA
agatgctcctcagtcaccag

SEQ ID NO: 51319 - DNA, 20 bp, synthetic construct
  misc_feature 1..20: note = CRISPR gRNA sequence
  source 1..20: mol_type = other DNA
gcatccactgtcactgctac

SEQ ID NO: 51320 - DNA, 20 bp, synthetic construct
  misc_feature 1..20: note = CRISPR gRNA sequence
  source 1..20: mol_type = other DNA
actgctactggaccccatgt

SEQ ID NO: 51321 - DNA, 20 bp, synthetic construct
  misc_feature 1..20: note = CRISPR gRNA sequence
  source 1..20: mol_type = other DNA
ctgctactggaccccatgtc

SEQ ID NO: 51322 - DNA, 20 bp, synthetic construct
  misc_feature 1..20: note = CRISPR gRNA sequence
  source 1..20: mol_type = other DNA
tgctactggaccccatgtca

SEQ ID NO: 51323 - DNA, 20 bp, synthetic construct
  misc_feature 1..20: note = CRISPR gRNA sequence
  source 1..20: mol_type = other DNA
ggaccccatgtcagggtcac

SEQ ID NO: 51324 - DNA, 20 bp, synthetic construct
  misc_feature 1..20: note = CRISPR gRNA sequence
  source 1..20: mol_type = other DNA
accaccatcaccaccatcac

SEQ ID NO: 51325 - DNA, 20 bp, synthetic construct
  misc_feature 1..20: note = CRISPR gRNA sequence
  source 1..20: mol_type = other DNA
accaccaatgtcaccaccac

SEQ ID NO: 51326 - DNA, 20 bp, synthetic construct
  misc_feature 1..20: note = CRISPR gRNA sequence
  source 1..20: mol_type = other DNA
caccacaattctacaccacc

SEQ ID NO: 51327 - DNA, 20 bp, synthetic construct
  misc_feature 1..20: note = CRISPR gRNA sequence
  source 1..20: mol_type = other DNA
caattctacaccaccaagcc

SEQ ID NO: 51328 - DNA, 20 bp, synthetic construct
  misc_feature 1..20: note = CRISPR gRNA sequence
  source 1..20: mol_type = other DNA
accatcccttccatcaccac

SEQ ID NO: 51329 - DNA, 20 bp, synthetic construct
  misc_feature 1..20: note = CRISPR gRNA sequence
  source 1..20: mol_type = other DNA
tccatcaccactagaatgac

SEQ ID NO: 51330 - DNA, 20 bp, synthetic construct
  misc_feature 1..20: note = CRISPR gRNA sequence
  source 1..20: mol_type = other DNA
ctctgctactatcccctccc

SEQ ID NO: 51331 - DNA, 20 bp, synthetic construct
  misc_feature 1..20: note = CRISPR gRNA sequence
  source 1..20: mol_type = other DNA
ctatcccctccccagcacca

SEQ ID NO: 51332 - DNA, 20 bp, synthetic construct
  misc_feature 1..20: note = CRISPR gRNA sequence
  source 1..20: mol_type = other DNA
ccacagtaaacccatcctct

SEQ ID NO: 51333 - DNA, 20 bp, synthetic construct
  misc_feature 1..20: note = CRISPR gRNA sequence
  source 1..20: mol_type = other DNA
ctcttggtcctcttccatat

SEQ ID NO: 51334 - DNA, 20 bp, synthetic construct
  misc_feature 1..20: note = CRISPR gRNA sequence
  source 1..20: mol_type = other DNA
tcttggtcctcttccatatc

SEQ ID NO: 51335 - DNA, 20 bp, synthetic construct
  misc_feature 1..20: note = CRISPR gRNA sequence
  source 1..20: mol_type = other DNA
ccatatcgggtgaccactca

SEQ ID NO: 51336 - DNA, 20 bp, synthetic construct
  misc_feature 1..20: note = CRISPR gRNA sequence
  source 1..20: mol_type = other DNA
tcgggtgaccactcatagct

SEQ ID NO: 51337 - DNA, 20 bp, synthetic construct
  misc_feature 1..20: note = CRISPR gRNA sequence
  source 1..20: mol_type = other DNA
cgggtgaccactcatagctc

SEQ ID NO: 51338 - DNA, 20 bp, synthetic construct
  misc_feature 1..20: note = CRISPR gRNA sequence
  source 1..20: mol_type = other DNA
actcatagctcaggtgcctc

SEQ ID NO: 51339 - DNA, 20 bp, synthetic construct
  misc_feature 1..20: note = CRISPR gRNA sequence
  source 1..20: mol_type = other DNA
catagctcaggtgcctccag

SEQ ID NO: 51340 - DNA, 20 bp, synthetic construct
  misc_feature 1..20: note = CRISPR gRNA sequence
  source 1..20: mol_type = other DNA
atagctcaggtgcctccagc

SEQ ID NO: 51341 - DNA, 20 bp, synthetic construct
  misc_feature 1..20: note = CRISPR gRNA sequence
  source 1..20: mol_type = other DNA
ggtgcctccagcaggctttc

SEQ ID NO: 51342 - DNA, 20 bp, synthetic construct
  misc_feature 1..20: note = CRISPR gRNA sequence
  source 1..20: mol_type = other DNA
gtgcctccagcaggctttca

SEQ ID NO: 51343 - DNA, 20 bp, synthetic construct
  misc_feature 1..20: note = CRISPR gRNA sequence
  source 1..20: mol_type = other DNA
tgcctccagcaggctttcaa

SEQ ID NO: 51344 - DNA, 20 bp, synthetic construct
  misc_feature 1..20: note = CRISPR gRNA sequence
  source 1..20: mol_type = other DNA
cagcaggctttcaagggtta

SEQ ID NO: 51345 - DNA, 20 bp, synthetic construct
  misc_feature 1..20: note = CRISPR gRNA sequence
  source 1..20: mol_type = other DNA
atttgccttcaccacgccct

SEQ ID NO: 51346 - DNA, 20 bp, synthetic construct
  misc_feature 1..20: note = CRISPR gRNA sequence
  source 1..20: mol_type = other DNA
gccttcaccacgcccttggc

SEQ ID NO: 51347 - DNA, 20 bp, synthetic construct
  misc_feature 1..20: note = CRISPR gRNA sequence
  source 1..20: mol_type = other DNA
cgcccttggccggcatcatt

SEQ ID NO: 51348 - DNA, 20 bp, synthetic construct
  misc_feature 1..20: note = CRISPR gRNA sequence
  source 1..20: mol_type = other DNA
gcccttggccggcatcattt

SEQ ID NO: 51349 - DNA, 20 bp, synthetic construct
  misc_feature 1..20: note = CRISPR gRNA sequence
  source 1..20: mol_type = other DNA
ccggcatcatttgggatcca

SEQ ID NO: 51350 - DNA, 20 bp, synthetic construct
  misc_feature 1..20: note = CRISPR gRNA sequence
  source 1..20: mol_type = other DNA
gggatccacagtttttgaat

SEQ ID NO: 51351 - DNA, 20 bp, synthetic construct
  misc_feature 1..20: note = CRISPR gRNA sequence
  source 1..20: mol_type = other DNA
gatccacagtttttgaatga

SEQ ID NO: 51352 - DNA, 20 bp, synthetic construct
  misc_feature 1..20: note = CRISPR gRNA sequence
  source 1..20: mol_type = other DNA
atccacagtttttgaatgag

SEQ ID NO: 51353 - DNA, 20 bp, synthetic construct
  misc_feature 1..20: note = CRISPR gRNA sequence
  source 1..20: mol_type = other DNA
tttttgaatgagaggaaatt

SEQ ID NO: 51354 - DNA, 20 bp, synthetic construct
  misc_feature 1..20: note = CRISPR gRNA sequence
  source 1..20: mol_type = other DNA
ttttgaatgagaggaaattc

SEQ ID NO: 51355 - DNA, 20 bp, synthetic construct
  misc_feature 1..20: note = CRISPR gRNA sequence
  source 1..20: mol_type = other DNA
tcaggaaaaaaaaatgtttg

SEQ ID NO: 51356 - DNA, 20 bp, synthetic construct
  misc_feature 1..20: note = CRISPR gRNA sequence
  source 1..20: mol_type = other DNA
caggaaaaaaaaatgtttgc

SEQ ID NO: 51357 - DNA, 20 bp, synthetic construct
  misc_feature 1..20: note = CRISPR gRNA sequence
  source 1..20: mol_type = other DNA
tgcaggatgcattaaaccca

SEQ ID NO: 51358 - DNA, 20 bp, synthetic construct
  misc_feature 1..20: note = CRISPR gRNA sequence
  source 1..20: mol_type = other DNA
atagatttcttcttttaatc

SEQ ID NO: 51359 - DNA, 20 bp, synthetic construct
  misc_feature 1..20: note = CRISPR gRNA sequence
  source 1..20: mol_type = other DNA
tagatttcttcttttaatct

SEQ ID NO: 51360 - DNA, 20 bp, synthetic construct
  misc_feature 1..20: note = CRISPR gRNA sequence
  source 1..20: mol_type = other DNA
tgggaatgcaatatcaatat

SEQ ID NO: 51361 - DNA, 20 bp, synthetic construct
  misc_feature 1..20: note = CRISPR gRNA sequence
  source 1..20: mol_type = other DNA
aatattggaaacctcacctg

SEQ ID NO: 51362 - DNA, 20 bp, synthetic construct
  misc_feature 1..20: note = CRISPR gRNA sequence
  source 1..20: mol_type = other DNA
tttcttacttcccttcattg

SEQ ID NO: 51363 - DNA, 20 bp, synthetic construct
  misc_feature 1..20: note = CRISPR gRNA sequence
  source 1..20: mol_type = other DNA
cccttcattgcagcattctg

SEQ ID NO: 51364 - DNA, 20 bp, synthetic construct
  misc_feature 1..20: note = CRISPR gRNA sequence
  source 1..20: mol_type = other DNA
tttatttatttatttatttt

SEQ ID NO: 51365 - DNA, 20 bp, synthetic construct
  misc_feature 1..20: note = CRISPR gRNA sequence
  source 1..20: mol_type = other DNA
tttatttatttattttgaga

SEQ ID NO: 51366 - DNA, 20 bp, synthetic construct
  misc_feature 1..20: note = CRISPR gRNA sequence
  source 1..20: mol_type = other DNA
tatttatttattttgagatg

SEQ ID NO: 51367 - DNA, 20 bp, synthetic construct
  misc_feature 1..20: note = CRISPR gRNA sequence
  source 1..20: mol_type = other DNA
tggagtcttgctctgttgcc

SEQ ID NO: 51368 - DNA, 20 bp, synthetic construct
  misc_feature 1..20: note = CRISPR gRNA sequence
  source 1..20: mol_type = other DNA
ggagtcttgctctgttgccc

SEQ ID NO: 51369 - DNA, 20 bp, synthetic construct
  misc_feature 1..20: note = CRISPR gRNA sequence
  source 1..20: mol_type = other DNA
tcttgctctgttgcccaggc

SEQ ID NO: 51370 - DNA, 20 bp, synthetic construct
  misc_feature 1..20: note = CRISPR gRNA sequence
  source 1..20: mol_type = other DNA
ttgctctgttgcccaggctg

SEQ ID NO: 51371 - DNA, 20 bp, synthetic construct
  misc_feature 1..20: note = CRISPR gRNA sequence
  source 1..20: mol_type = other DNA
ttgcccaggctggagtgcaa

SEQ ID NO: 51372 - DNA, 20 bp, synthetic construct
  misc_feature 1..20: note = CRISPR gRNA sequence
  source 1..20: mol_type = other DNA
ggagtgcaatggcacgatct

SEQ ID NO: 51373 - DNA, 20 bp, synthetic construct
  misc_feature 1..20: note = CRISPR gRNA sequence
  source 1..20: mol_type = other DNA
tcactgcgacctctgtctcc

SEQ ID NO: 51374 - DNA, 20 bp, synthetic construct
  misc_feature 1..20: note = CRISPR gRNA sequence
  source 1..20: mol_type = other DNA
cactgcgacctctgtctccc

SEQ ID NO: 51375 - DNA, 20 bp, synthetic construct
  misc_feature 1..20: note = CRISPR gRNA sequence
  source 1..20: mol_type = other DNA
gacctctgtctcccaggttc

SEQ ID NO: 51376 - DNA, 20 bp, synthetic construct
  misc_feature 1..20: note = CRISPR gRNA sequence
  source 1..20: mol_type = other DNA
cctctgtctcccaggttcaa

SEQ ID NO: 51377 - DNA, 20 bp, synthetic construct
  misc_feature 1..20: note = CRISPR gRNA sequence
  source 1..20: mol_type = other DNA
ttcaagagattctcctgcct

SEQ ID NO: 51378 - DNA, 20 bp, synthetic construct
  misc_feature 1..20: note = CRISPR gRNA sequence
  source 1..20: mol_type = other DNA
ttctcctgcctcagcctccc

SEQ ID NO: 51379 - DNA, 20 bp, synthetic construct
  misc_feature 1..20: note = CRISPR gRNA sequence
  source 1..20: mol_type = other DNA
tcctgcctcagcctcccaag

SEQ ID NO: 51380 - DNA, 20 bp, synthetic construct
  misc_feature 1..20: note = CRISPR gRNA sequence
  source 1..20: mol_type = other DNA
gcctcagcctcccaagtagc

SEQ ID NO: 51381 - DNA, 20 bp, synthetic construct
  misc_feature 1..20: note = CRISPR gRNA sequence
  source 1..20: mol_type = other DNA
cctcagcctcccaagtagct

SEQ ID NO: 51382 - DNA, 20 bp, synthetic construct
  misc_feature 1..20: note = CRISPR gRNA sequence
  source 1..20: mol_type = other DNA
ctcccaagtagctgggatta

SEQ ID NO: 51383 - DNA, 20 bp, synthetic construct
  misc_feature 1..20: note = CRISPR gRNA sequence
  source 1..20: mol_type = other DNA
tcccaagtagctgggattac

SEQ ID NO: 51384 - DNA, 20 bp, synthetic construct
  misc_feature 1..20: note = CRISPR gRNA sequence
  source 1..20: mol_type = other DNA
caggcatgtgccactatgcc

SEQ ID NO: 51385 - DNA, 20 bp, synthetic construct
  misc_feature 1..20: note = CRISPR gRNA sequence
  source 1..20: mol_type = other DNA
gctaattatttttgtatttt

SEQ ID NO: 51386 - DNA, 20 bp, synthetic construct
  misc_feature 1..20: note = CRISPR gRNA sequence
  source 1..20: mol_type = other DNA
aattatttttgtatttttag

SEQ ID NO: 51387 - DNA, 20 bp, synthetic construct
  misc_feature 1..20: note = CRISPR gRNA sequence
  source 1..20: mol_type = other DNA
ttatttttgtatttttagta

SEQ ID NO: 51388 - DNA, 20 bp, synthetic construct
  misc_feature 1..20: note = CRISPR gRNA sequence
  source 1..20: mol_type = other DNA
ttttgtatttttagtagaga

SEQ ID NO: 51389 - DNA, 20 bp, synthetic construct
  misc_feature 1..20: note = CRISPR gRNA sequence
  source 1..20: mol_type = other DNA
tttgtatttttagtagagac

SEQ ID NO: 51390 - DNA, 20 bp, synthetic construct
  misc_feature 1..20: note = CRISPR gRNA sequence
  source 1..20: mol_type = other DNA
cgggttttcaccatgttgat

SEQ ID NO: 51391 - DNA, 20 bp, synthetic construct
  misc_feature 1..20: note = CRISPR gRNA sequence
  source 1..20: mol_type = other DNA
gggttttcaccatgttgatc

SEQ ID NO: 51392 - DNA, 20 bp, synthetic construct
  misc_feature 1..20: note = CRISPR gRNA sequence
  source 1..20: mol_type = other DNA
tttcaccatgttgatcaggc

SEQ ID NO: 51393 - DNA, 20 bp, synthetic construct
  misc_feature 1..20: note = CRISPR gRNA sequence
  source 1..20: mol_type = other DNA
tggtctcaaactcctgacct

SEQ ID NO: 51394 - DNA, 20 bp, synthetic construct
  misc_feature 1..20: note = CRISPR gRNA sequence
  source 1..20: mol_type = other DNA
ggtctcaaactcctgacctc

SEQ ID NO: 51395 - DNA, 20 bp, synthetic construct
  misc_feature 1..20: note = CRISPR gRNA sequence
  source 1..20: mol_type = other DNA
ctcaggtgatccacccgctt

SEQ ID NO: 51396 - DNA, 20 bp, synthetic construct
  misc_feature 1..20: note = CRISPR gRNA sequence
  source 1..20: mol_type = other DNA
ccacccgctttggcctccca

SEQ ID NO: 51397 - DNA, 20 bp, synthetic construct
  misc_feature 1..20: note = CRISPR gRNA sequence
  source 1..20: mol_type = other DNA
gctttggcctcccaaagtgc

SEQ ID NO: 51398 - DNA, 20 bp, synthetic construct
  misc_feature 1..20: note = CRISPR gRNA sequence
  source 1..20: mol_type = other DNA
ctttggcctcccaaagtgct

SEQ ID NO: 51399 - DNA, 20 bp, synthetic construct
  misc_feature 1..20: note = CRISPR gRNA sequence
  source 1..20: mol_type = other DNA
ctcccaaagtgctgggatta

SEQ ID NO: 51400 - DNA, 20 bp, synthetic construct
  misc_feature 1..20: note = CRISPR gRNA sequence
  source 1..20: mol_type = other DNA
tcccaaagtgctgggattac

SEQ ID NO: 51401 - DNA, 20 bp, synthetic construct
  misc_feature 1..20: note = CRISPR gRNA sequence
  source 1..20: mol_type = other DNA
agtgctgggattacaggcgt

SEQ ID NO: 51402 - DNA, 20 bp, synthetic construct
  misc_feature 1..20: note = CRISPR gRNA sequence
  source 1..20: mol_type = other DNA
caggcgtgagccaccacgcc

SEQ ID NO: 51403 - DNA, 20 bp, synthetic construct
  misc_feature 1..20: note = CRISPR gRNA sequence
  source 1..20: mol_type = other DNA
cgtgagccaccacgcccagc

SEQ ID NO: 51404 - DNA, 20 bp, synthetic construct
  misc_feature 1..20: note = CRISPR gRNA sequence
  source 1..20: mol_type = other DNA
cgcccagctagttttaacta

SEQ ID NO: 51405 - DNA, 20 bp, synthetic construct
  misc_feature 1..20: note = CRISPR gRNA sequence
  source 1..20: mol_type = other DNA
gctagttttaactacagttt

SEQ ID NO: 51406 - DNA, 20 bp, synthetic construct
  misc_feature 1..20: note = CRISPR gRNA sequence
  source 1..20: mol_type = other DNA
agtttcagaaataatataac

SEQ ID NO: 51407 - DNA, 20 bp, synthetic construct
  misc_feature 1..20: note = CRISPR gRNA sequence
  source 1..20: mol_type = other DNA
ataatataaccagtgtgtcc

SEQ ID NO: 51408 - DNA, 20 bp, synthetic construct
  misc_feature 1..20: note = CRISPR gRNA sequence
  source 1..20: mol_type = other DNA
ggaacatctgattttcctcc

SEQ ID NO: 51409 - DNA, 20 bp, synthetic construct
  misc_feature 1..20: note = CRISPR gRNA sequence
  source 1..20: mol_type = other DNA
gaacatctgattttcctcct

SEQ ID NO: 51410 - DNA, 20 bp, synthetic construct
  misc_feature 1..20: note = CRISPR gRNA sequence
  source 1..20: mol_type = other DNA
tgttaatttcatcttttcct

SEQ ID NO: 51411 - DNA, 20 bp, synthetic construct
  misc_feature 1..20: note = CRISPR gRNA sequence
  source 1..20: mol_type = other DNA
gagaaacgtcatttaaaaat

SEQ ID NO: 51412 - DNA, 20 bp, synthetic construct
  misc_feature 1..20: note = CRISPR gRNA sequence
  source 1..20: mol_type = other DNA
aaaaattggtctgtcttatg

SEQ ID NO: 51413 - DNA, 20 bp, synthetic construct
  misc_feature 1..20: note = CRISPR gRNA sequence
  source 1..20: mol_type = other DNA
tatgaagccacttaataaaa

SEQ ID NO: 51414 - DNA, 20 bp, synthetic construct
  misc_feature 1..20: note = CRISPR gRNA sequence
  source 1..20: mol_type = other DNA
aataaaatagtctttaaaat

SEQ ID NO: 51415 - DNA, 20 bp, synthetic construct
  misc_feature 1..20: note = CRISPR gRNA sequence
  source 1..20: mol_type = other DNA
gtctttaaaataagaaaaat

SEQ ID NO: 51416 - DNA, 20 bp, synthetic construct
  misc_feature 1..20: note = CRISPR gRNA sequence
  source 1..20: mol_type = other DNA
ttaaaataagaaaaattggc

SEQ ID NO: 51417 - DNA, 20 bp, synthetic construct
  misc_feature 1..20: note = CRISPR gRNA sequence
  source 1..20: mol_type = other DNA
taaaataagaaaaattggct

SEQ ID NO: 51418 - DNA, 20 bp, synthetic construct
  misc_feature 1..20: note = CRISPR gRNA sequence
  source 1..20: mol_type = other DNA
taagaaaaattggctgggtg

SEQ ID NO: 51419 - DNA, 20 bp, synthetic construct
  misc_feature 1..20: note = CRISPR gRNA sequence
  source 1..20: mol_type = other DNA
gaaaaattggctgggtgcgg

SEQ ID NO: 51420 - DNA, 20 bp, synthetic construct
  misc_feature 1..20: note = CRISPR gRNA sequence
  source 1..20: mol_type = other DNA
ttggctgggtgcggtggctc

SEQ ID NO: 51421 - DNA, 20 bp, synthetic construct
  misc_feature 1..20: note = CRISPR gRNA sequence
  source 1..20: mol_type = other DNA
tggctgggtgcggtggctca

SEQ ID NO: 51422 - DNA, 20 bp, synthetic construct
  misc_feature 1..20: note = CRISPR gRNA sequence
  source 1..20: mol_type = other DNA
gtggctcaaggctgtaatcc

SEQ ID NO: 51423 - DNA, 20 bp, synthetic construct
  misc_feature 1..20: note = CRISPR gRNA sequence
  source 1..20: mol_type = other DNA
aggctgtaatcccagcactt

SEQ ID NO: 51424 - DNA, 20 bp, synthetic construct
  misc_feature 1..20: note = CRISPR gRNA sequence
  source 1..20: mol_type = other DNA
ggctgtaatcccagcacttt

SEQ ID NO: 51425 - DNA, 20 bp, synthetic construct
  misc_feature 1..20: note = CRISPR gRNA sequence
  source 1..20: mol_type = other DNA
ctgtaatcccagcactttgg

SEQ ID NO: 51426 - DNA, 20 bp, synthetic construct
  misc_feature 1..20: note = CRISPR gRNA sequence
  source 1..20: mol_type = other DNA
tgtaatcccagcactttggg

SEQ ID NO: 51427 - DNA, 20 bp, synthetic construct
  misc_feature 1..20: note = CRISPR gRNA sequence
  source 1..20: mol_type = other DNA
gtaatcccagcactttggga

SEQ ID NO: 51428 - DNA, 20 bp, synthetic construct
  misc_feature 1..20: note = CRISPR gRNA sequence
  source 1..20: mol_type = other DNA
tcccagcactttgggagggc

SEQ ID NO: 51429 - DNA, 20 bp, synthetic construct
  misc_feature 1..20: note = CRISPR gRNA sequence
  source 1..20: mol_type = other DNA
cccagcactttgggagggcg

SEQ ID NO: 51430 - DNA, 20 bp, synthetic construct
  misc_feature 1..20: note = CRISPR gRNA sequence
  source 1..20: mol_type = other DNA
agcactttgggagggcgagg

SEQ ID NO: 51431 - DNA, 20 bp, synthetic construct
  misc_feature 1..20: note = CRISPR gRNA sequence
  source 1..20: mol_type = other DNA
gcactttgggagggcgaggc

SEQ ID NO: 51432 - DNA, 20 bp, synthetic construct
  misc_feature 1..20: note = CRISPR gRNA sequence
  source 1..20: mol_type = other DNA
ctttgggagggcgaggcagg

SEQ ID NO: 51433 - DNA, 20 bp, synthetic construct
  misc_feature 1..20: note = CRISPR gRNA sequence
  source 1..20: mol_type = other DNA
gcgaggcaggcggatcgcct

SEQ ID NO: 51434 - DNA, 20 bp, synthetic construct
  misc_feature 1..20: note = CRISPR gRNA sequence
  source 1..20: mol_type = other DNA
cgaggcaggcggatcgcctg

SEQ ID NO: 51435 - DNA, 20 bp, synthetic construct
  misc_feature 1..20: note = CRISPR gRNA sequence
  source 1..20: mol_type = other DNA
gcaggcggatcgcctgaggt

SEQ ID NO: 51436 - DNA, 20 bp, synthetic construct
  misc_feature 1..20: note = CRISPR gRNA sequence
  source 1..20: mol_type = other DNA
caggcggatcgcctgaggtc

SEQ ID NO: 51437 - DNA, 20 bp, synthetic construct
  misc_feature 1..20: note = CRISPR gRNA sequence
  source 1..20: mol_type = other DNA
ggcggatcgcctgaggtcag

SEQ ID NO: 51438 - DNA, 20 bp, synthetic construct
  misc_feature 1..20: note = CRISPR gRNA sequence
  source 1..20: mol_type = other DNA
tcgcctgaggtcaggagttc

SEQ ID NO: 51439 - DNA, 20 bp, synthetic construct
  misc_feature 1..20: note = CRISPR gRNA sequence
  source 1..20: mol_type = other DNA
tgaggtcaggagttcaagac

SEQ ID NO: 51440 - DNA, 20 bp, synthetic construct
  misc_feature 1..20: note = CRISPR gRNA sequence
  source 1..20: mol_type = other DNA
tcaggagttcaagaccagcc

SEQ ID NO: 51441 - DNA, 20 bp, synthetic construct
  misc_feature 1..20: note = CRISPR gRNA sequence
  source 1..20: mol_type = other DNA
caagaccagcctggccaaca

SEQ ID NO: 51442 - DNA, 20 bp, synthetic construct
  misc_feature 1..20: note = CRISPR gRNA sequence
  source 1..20: mol_type = other DNA
tctactaaaaataccaaaat

SEQ ID NO: 51443 - DNA, 20 bp, synthetic construct
  misc_feature 1..20: note = CRISPR gRNA sequence
  source 1..20: mol_type = other DNA
ctaaaaataccaaaattagc

SEQ ID NO: 51444 - DNA, 20 bp, synthetic construct
  misc_feature 1..20: note = CRISPR gRNA sequence
  source 1..20: mol_type = other DNA
taaaaataccaaaattagcc

SEQ ID NO: 51445 - DNA, 20 bp, synthetic construct
  misc_feature 1..20: note = CRISPR gRNA sequence
  source 1..20: mol_type = other DNA
ataccaaaattagccaggca

SEQ ID NO: 51446 - DNA, 20 bp, synthetic construct
  misc_feature 1..20: note = CRISPR gRNA sequence
  source 1..20: mol_type = other DNA
ccaaaattagccaggcatgg

SEQ ID NO: 51447 - DNA, 20 bp, synthetic construct
  misc_feature 1..20: note = CRISPR gRNA sequence
  source 1..20: mol_type = other DNA
gtggctcatgcctgtaatct

SEQ ID NO: 51448 - DNA, 20 bp, synthetic construct
  misc_feature 1..20: note = CRISPR gRNA sequence
  source 1..20: mol_type = other DNA
tgcctgtaatctcagctcct

SEQ ID NO: 51449 - DNA, 20 bp, synthetic construct
  misc_feature 1..20: note = CRISPR gRNA sequence
  source 1..20: mol_type = other DNA
gcctgtaatctcagctcctt

SEQ ID NO: 51450 - DNA, 20 bp, synthetic construct
  misc_feature 1..20: note = CRISPR gRNA sequence
  source 1..20: mol_type = other DNA
ctgtaatctcagctccttgg

SEQ ID NO: 51451 - DNA, 20 bp, synthetic construct
  misc_feature 1..20: note = CRISPR gRNA sequence
  source 1..20: mol_type = other DNA
tgtaatctcagctccttggg

SEQ ID NO: 51452 - DNA, 20 bp, synthetic construct
  misc_feature 1..20: note = CRISPR gRNA sequence
  source 1..20: mol_type = other DNA
tctcagctccttgggaggct

SEQ ID NO: 51453 - DNA, 20 bp, synthetic construct
  misc_feature 1..20: note = CRISPR gRNA sequence
  source 1..20: mol_type = other DNA
ctcagctccttgggaggctg

SEQ ID NO: 51454 - DNA, 20 bp, synthetic construct
  misc_feature 1..20: note = CRISPR gRNA sequence
  source 1..20: mol_type = other DNA
agctccttgggaggctgagg

SEQ ID NO: 51455 - DNA, 20 bp, synthetic construct
  misc_feature 1..20: note = CRISPR gRNA sequence
  source 1..20: mol_type = other DNA
gctccttgggaggctgaggc

SEQ ID NO: 51456 - DNA, 20 bp, synthetic construct
  misc_feature 1..20: note = CRISPR gRNA sequence
  source 1..20: mol_type = other DNA
tccttgggaggctgaggcag

SEQ ID NO: 51457 - DNA, 20 bp, synthetic construct
  misc_feature 1..20: note = CRISPR gRNA sequence
  source 1..20: mol_type = other DNA
gcaggagaattgcttgaacc

SEQ ID NO: 51458 - DNA, 20 bp, synthetic construct
  misc_feature 1..20: note = CRISPR gRNA sequence
  source 1..20: mol_type = other DNA
caggagaattgcttgaacct

SEQ ID NO: 51459 - DNA, 20 bp, synthetic construct
  misc_feature 1..20: note = CRISPR gRNA sequence
  source 1..20: mol_type = other DNA
ggagaattgcttgaacctgg

SEQ ID NO: 51460 - DNA, 20 bp, synthetic construct
  misc_feature 1..20: note = CRISPR gRNA sequence
  source 1..20: mol_type = other DNA
gagaattgcttgaacctggg

SEQ ID NO: 51461 - DNA, 20 bp, synthetic construct
  misc_feature 1..20: note = CRISPR gRNA sequence
  source 1..20: mol_type = other DNA
aattgcttgaacctgggagg

SEQ ID NO: 51462 - DNA, 20 bp, synthetic construct
  misc_feature 1..20: note = CRISPR gRNA sequence
  source 1..20: mol_type = other DNA
tgcttgaacctgggaggcgg

SEQ ID NO: 51463 - DNA, 20 bp, synthetic construct
  misc_feature 1..20: note = CRISPR gRNA sequence
  source 1..20: mol_type = other DNA
aacctgggaggcggaagttg

SEQ ID NO: 51464 - DNA, 20 bp, synthetic construct
  misc_feature 1..20: note = CRISPR gRNA sequence
  source 1..20: mol_type = other DNA
tgggaggcggaagttgcagt

SEQ ID NO: 51465 - DNA, 20 bp, synthetic construct
  misc_feature 1..20: note = CRISPR gRNA sequence
  source 1..20: mol_type = other DNA
gaaattgcgccactgcattc

SEQ ID NO: 51466 - DNA, 20 bp, synthetic construct
  misc_feature 1..20: note = CRISPR gRNA sequence
  source 1..20: mol_type = other DNA
tgcgccactgcattccagcc

SEQ ID NO: 51467 - DNA, 20 bp, synthetic construct
  misc_feature 1..20: note = CRISPR gRNA sequence
  source 1..20: mol_type = other DNA
gcgccactgcattccagcct

SEQ ID NO: 51468 - DNA, 20 bp, synthetic construct
  misc_feature 1..20: note = CRISPR gRNA sequence
  source 1..20: mol_type = other DNA
ccactgcattccagcctggg

SEQ ID NO: 51469 - DNA, 20 bp, synthetic construct
  misc_feature 1..20: note = CRISPR gRNA sequence
  source 1..20: mol_type = other DNA
ctgcattccagcctgggcag

SEQ ID NO: 51470 - DNA, 20 bp, synthetic construct
  misc_feature 1..20: note = CRISPR gRNA sequence
  source 1..20: mol_type = other DNA
gcattccagcctgggcagca

SEQ ID NO: 51471 - DNA, 20 bp, synthetic construct
  misc_feature 1..20: note = CRISPR gRNA sequence
  source 1..20: mol_type = other DNA
tccagcctgggcagcagaga

SEQ ID NO: 51472 - DNA, 20 bp, synthetic construct
  misc_feature 1..20: note = CRISPR gRNA sequence
  source 1..20: mol_type = other DNA
aaagactccatctaaaaaaa

SEQ ID NO: 51473 - DNA, 20 bp, synthetic construct
  misc_feature 1..20: note = CRISPR gRNA sequence
  source 1..20: mol_type = other DNA
actccatctaaaaaaaaaga

SEQ ID NO: 51474 - DNA, 20 bp, synthetic construct
  misc_feature 1..20: note = CRISPR gRNA sequence
  source 1..20: mol_type = other DNA
catctaaaaaaaaagaaaga

SEQ ID NO: 51475 - DNA, 20 bp, synthetic construct
  misc_feature 1..20: note = CRISPR gRNA sequence
  source 1..20: mol_type = other DNA
aaaaaaaaagaaagaaagaa

SEQ ID NO: 51476 - DNA, 20 bp, synthetic construct
  misc_feature 1..20: note = CRISPR gRNA sequence
  source 1..20: mol_type = other DNA
aatgaaaaacaaaaaactca

SEQ ID NO: 51477 - DNA, 20 bp, synthetic construct
  misc_feature 1..20: note = CRISPR gRNA sequence
  source 1..20: mol_type = other DNA
atctgtttaaaatacattcc

SEQ ID NO: 51478 - DNA, 20 bp, synthetic construct
  misc_feature 1..20: note = CRISPR gRNA sequence
  source 1..20: mol_type = other DNA
tttaaaatacattccaagca

SEQ ID NO: 51479 - DNA, 20 bp, synthetic construct
  misc_feature 1..20: note = CRISPR gRNA sequence
  source 1..20: mol_type = other DNA
aaaatacattccaagcacag

SEQ ID NO: 51480 - DNA, 20 bp, synthetic construct
  misc_feature 1..20: note = CRISPR gRNA sequence
  source 1..20: mol_type = other DNA
gcggctcatgcctgtaatct

SEQ ID NO: 51481 - DNA, 20 bp, synthetic construct
  misc_feature 1..20: note = CRISPR gRNA sequence
  source 1..20: mol_type = other DNA
tgcctgtaatctcagcaacc

SEQ ID NO: 51482 - DNA, 20 bp, synthetic construct
  misc_feature 1..20: note = CRISPR gRNA sequence
  source 1..20: mol_type = other DNA
gcctgtaatctcagcaacct

SEQ ID NO: 51483 - DNA, 20 bp, synthetic construct
  misc_feature 1..20: note = CRISPR gRNA sequence
  source 1..20: mol_type = other DNA
ctgtaatctcagcaacctgg

SEQ ID NO: 51484 - DNA, 20 bp, synthetic construct
  misc_feature 1..20: note = CRISPR gRNA sequence
  source 1..20: mol_type = other DNA
tgtaatctcagcaacctggg

SEQ ID NO: 51485 - DNA, 20 bp, synthetic construct
  misc_feature 1..20: note = CRISPR gRNA sequence
  source 1..20: mol_type = other DNA
tctcagcaacctgggaggct

SEQ ID NO: 51486 - DNA, 20 bp, synthetic construct
  misc_feature 1..20: note = CRISPR gRNA sequence
  source 1..20: mol_type = other DNA
ctcagcaacctgggaggctg

SEQ ID NO: 51487 - DNA, 20 bp, synthetic construct
  misc_feature 1..20: note = CRISPR gRNA sequence
  source 1..20: mol_type = other DNA
tgggaggctgaggatcacct

SEQ ID NO: 51488 - DNA, 20 bp, synthetic construct
  misc_feature 1..20: note = CRISPR gRNA sequence
  source 1..20: mol_type = other DNA
ggctgaggatcacctgagct

SEQ ID NO: 51489 - DNA, 20 bp, synthetic construct
  misc_feature 1..20: note = CRISPR gRNA sequence
  source 1..20: mol_type = other DNA
tgaggatcacctgagctcag

SEQ ID NO: 51490 - DNA, 20 bp, synthetic construct
  misc_feature 1..20: note = CRISPR gRNA sequence
  source 1..20: mol_type = other DNA
tcacctgagctcagaagttt

SEQ ID NO: 51491 - DNA, 20 bp, synthetic construct
  misc_feature 1..20: note = CRISPR gRNA sequence
  source 1..20: mol_type = other DNA
tcagaagtttgagaccaacc

SEQ ID NO: 51492 - DNA, 20 bp, synthetic construct
  misc_feature 1..20: note = CRISPR gRNA sequence
  source 1..20: mol_type = other DNA
cagaagtttgagaccaacct

SEQ ID NO: 51493 - DNA, 20 bp, synthetic construct
  misc_feature 1..20: note = CRISPR gRNA sequence
  source 1..20: mol_type = other DNA
agaagtttgagaccaacctg

SEQ ID NO: 51494 - DNA, 20 bp, synthetic construct
  misc_feature 1..20: note = CRISPR gRNA sequence
  source 1..20: mol_type = other DNA
tgagaccaacctggggaaca

SEQ ID NO: 51495 - DNA, 20 bp, synthetic construct
  misc_feature 1..20: note = CRISPR gRNA sequence
  source 1..20: mol_type = other DNA
accaacctggggaacatggt

SEQ ID NO: 51496 - DNA, 20 bp, synthetic construct
  misc_feature 1..20: note = CRISPR gRNA sequence
  source 1..20: mol_type = other DNA
ctcttacaaaactaaactat

SEQ ID NO: 51497 - DNA, 20 bp, synthetic construct
  misc_feature 1..20: note = CRISPR gRNA sequence
  source 1..20: mol_type = other DNA
tacaaaactaaactattagc

SEQ ID NO: 51498 - DNA, 20 bp, synthetic construct
  misc_feature 1..20: note = CRISPR gRNA sequence
  source 1..20: mol_type = other DNA
acaaaactaaactattagcc

SEQ ID NO: 51499 - DNA, 20 bp, synthetic construct
  misc_feature 1..20: note = CRISPR gRNA sequence
  source 1..20: mol_type = other DNA
aaactattagccaggcatgt

SEQ ID NO: 51500 - DNA, 20 bp, synthetic construct
  misc_feature 1..20: note = CRISPR gRNA sequence
  source 1..20: mol_type = other DNA
ggcatgttggtgtgtgcctg

SEQ ID NO: 51501 - DNA, 20 bp, synthetic construct
  misc_feature 1..20: note = CRISPR gRNA sequence
  source 1..20: mol_type = other DNA
ttggtgtgtgcctgtagtcc

SEQ ID NO: 51502 - DNA, 20 bp, synthetic construct
  misc_feature 1..20: note = CRISPR gRNA sequence
  source 1..20: mol_type = other DNA
gcctgtagtcccagctactc

SEQ ID NO: 51503 - DNA, 20 bp, synthetic construct
  misc_feature 1..20: note = CRISPR gRNA sequence
  source 1..20: mol_type = other DNA
ctgtagtcccagctactcca

SEQ ID NO: 51504 - DNA, 20 bp, synthetic construct
  misc_feature 1..20: note = CRISPR gRNA sequence
  source 1..20: mol_type = other DNA
tgtagtcccagctactccag

SEQ ID NO: 51505 - DNA, 20 bp, synthetic construct
  misc_feature 1..20: note = CRISPR gRNA sequence
  source 1..20: mol_type = other DNA
tcccagctactccagaggct

SEQ ID NO: 51506 - DNA, 20 bp, synthetic construct
  misc_feature 1..20: note = CRISPR gRNA sequence
  source 1..20: mol_type = other DNA
cccagctactccagaggctg

SEQ ID NO: 51507 - DNA, 20 bp, synthetic construct
  misc_feature 1..20: note = CRISPR gRNA sequence
  source 1..20: mol_type = other DNA
agctactccagaggctgagg

SEQ ID NO: 51508 - DNA, 20 bp, synthetic construct
  misc_feature 1..20: note = CRISPR gRNA sequence
  source 1..20: mol_type = other DNA
gctactccagaggctgaggt

SEQ ID NO: 51509 - DNA, 20 bp, synthetic construct
  misc_feature 1..20: note = CRISPR gRNA sequence
  source 1..20: mol_type = other DNA
tactccagaggctgaggtgg

SEQ ID NO: 51510 - DNA, 20 bp, synthetic construct
  misc_feature 1..20: note = CRISPR gRNA sequence
  source 1..20: mol_type = other DNA
actccagaggctgaggtggg

SEQ ID NO: 51511 - DNA, 20 bp, synthetic construct
  misc_feature 1..20: note = CRISPR gRNA sequence
  source 1..20: mol_type = other DNA
ctgaggtgggaggatcgctt

SEQ ID NO: 51512 - DNA, 20 bp, synthetic construct
  misc_feature 1..20: note = CRISPR gRNA sequence
  source 1..20: mol_type = other DNA
gtgggaggatcgcttgagcc

SEQ ID NO: 51513 - DNA, 20 bp, synthetic construct
  misc_feature 1..20: note = CRISPR gRNA sequence
  source 1..20: mol_type = other DNA
tgggaggatcgcttgagccc

SEQ ID NO: 51514 - DNA, 20 bp, synthetic construct
  misc_feature 1..20: note = CRISPR gRNA sequence
  source 1..20: mol_type = other DNA
ggaggatcgcttgagcccag

SEQ ID NO: 51515 - DNA, 20 bp, synthetic construct
  misc_feature 1..20: note = CRISPR gRNA sequence
  source 1..20: mol_type = other DNA
gatcgcttgagcccaggagt

SEQ ID NO: 51516 - DNA, 20 bp, synthetic construct
  misc_feature 1..20: note = CRISPR gRNA sequence
  source 1..20: mol_type = other DNA
tcgcttgagcccaggagttg

SEQ ID NO: 51517 - DNA, 20 bp, synthetic construct
  misc_feature 1..20: note = CRISPR gRNA sequence
  source 1..20: mol_type = other DNA
cgcttgagcccaggagttgg

SEQ ID NO: 51518 - DNA, 20 bp, synthetic construct
  misc_feature 1..20: note = CRISPR gRNA sequence
  source 1..20: mol_type = other DNA
agcccaggagttggaggctg

SEQ ID NO: 51519 - DNA, 20 bp, synthetic construct
  misc_feature 1..20: note = CRISPR gRNA sequence
  source 1..20: mol_type = other DNA
atcattgcaccactgcactc

SEQ ID NO: 51520 - DNA, 20 bp, synthetic construct
  misc_feature 1..20: note = CRISPR gRNA sequence
  source 1..20: mol_type = other DNA
tgcaccactgcactccagcc

SEQ ID NO: 51521 - DNA, 20 bp, synthetic construct
  misc_feature 1..20: note = CRISPR gRNA sequence
  source 1..20: mol_type = other DNA
gcaccactgcactccagcct

SEQ ID NO: 51522 - DNA, 20 bp, synthetic construct
  misc_feature 1..20: note = CRISPR gRNA sequence
  source 1..20: mol_type = other DNA
ctgcactccagcctgggcaa

SEQ ID NO: 51523 - DNA, 20 bp, synthetic construct
  misc_feature 1..20: note = CRISPR gRNA sequence
  source 1..20: mol_type = other DNA
gcactccagcctgggcaaca

SEQ ID NO: 51524 - DNA, 20 bp, synthetic construct
  misc_feature 1..20: note = CRISPR gRNA sequence
  source 1..20: mol_type = other DNA
tccagcctgggcaacagagt

SEQ ID NO: 51525 - DNA, 20 bp, synthetic construct
  misc_feature 1..20: note = CRISPR gRNA sequence
  source 1..20: mol_type = other DNA
tgggcaacagagtgagaccc

SEQ ID NO: 51526 - DNA, 20 bp, synthetic construct
  misc_feature 1..20: note = CRISPR gRNA sequence
  source 1..20: mol_type = other DNA
gggcaacagagtgagacccc

SEQ ID NO: 51527 - DNA, 20 bp, synthetic construct
  misc_feature 1..20: note = CRISPR gRNA sequence
  source 1..20: mol_type = other DNA
accccaggtcttaaaaaaaa

SEQ ID NO: 51528 - DNA, 20 bp, synthetic construct
  misc_feature 1..20: note = CRISPR gRNA sequence
  source 1..20: mol_type = other DNA
aaagaaatccatgattttat

SEQ ID NO: 51529 - DNA, 20 bp, synthetic construct
  misc_feature 1..20: note = CRISPR gRNA sequence
  source 1..20: mol_type = other DNA
tcttctctgccacatcacaa

SEQ ID NO: 51530 - DNA, 20 bp, synthetic construct
  misc_feature 1..20: note = CRISPR gRNA sequence
  source 1..20: mol_type = other DNA
caacagaaatgaaaattgtg

SEQ ID NO: 51531 - DNA, 20 bp, synthetic construct
  misc_feature 1..20: note = CRISPR gRNA sequence
  source 1..20: mol_type = other DNA
tgaaaattgtgtggcatttt

SEQ ID NO: 51532 - DNA, 20 bp, synthetic construct
  misc_feature 1..20: note = CRISPR gRNA sequence
  source 1..20: mol_type = other DNA
aaattgtgtggcatttttgg

SEQ ID NO: 51533 - DNA, 20 bp, synthetic construct
  misc_feature 1..20: note = CRISPR gRNA sequence
  source 1..20: mol_type = other DNA
ctgctctctctatttcccac

SEQ ID NO: 51534 - DNA, 20 bp, synthetic construct
  misc_feature 1..20: note = CRISPR gRNA sequence
  source 1..20: mol_type = other DNA
tctctatttcccactggtcc

SEQ ID NO: 51535 - DNA, 20 bp, synthetic construct
  misc_feature 1..20: note = CRISPR gRNA sequence
  source 1..20: mol_type = other DNA
ctctatttcccactggtcct

SEQ ID NO: 51536 - DNA, 20 bp, synthetic construct
  misc_feature 1..20: note = CRISPR gRNA sequence
  source 1..20: mol_type = other DNA
atttcccactggtcctaggc

SEQ ID NO: 51537 - DNA, 20 bp, synthetic construct
  misc_feature 1..20: note = CRISPR gRNA sequence
  source 1..20: mol_type = other DNA
gctggattcccaatgcgtct

SEQ ID NO: 51538 - DNA, 20 bp, synthetic construct
  misc_feature 1..20: note = CRISPR gRNA sequence
  source 1..20: mol_type = other DNA
ggattcccaatgcgtctgag

SEQ ID NO: 51539 - DNA, 20 bp, synthetic construct
  misc_feature 1..20: note = CRISPR gRNA sequence
  source 1..20: mol_type = other DNA
gattcccaatgcgtctgagc

SEQ ID NO: 51540 - DNA, 20 bp, synthetic construct
  misc_feature 1..20: note = CRISPR gRNA sequence
  source 1..20: mol_type = other DNA
attcccaatgcgtctgagca

SEQ ID NO: 51541 - DNA, 20 bp, synthetic construct
  misc_feature 1..20: note = CRISPR gRNA sequence
  source 1..20: mol_type = other DNA
gcagggactctgcattttac

SEQ ID NO: 51542 - DNA, 20 bp, synthetic construct
  misc_feature 1..20: note = CRISPR gRNA sequence
  source 1..20: mol_type = other DNA
ttttactagctgtgtgacct

SEQ ID NO: 51543 - DNA, 20 bp, synthetic construct
  misc_feature 1..20: note = CRISPR gRNA sequence
  source 1..20: mol_type = other DNA
tttactagctgtgtgacctt

SEQ ID NO: 51544 - DNA, 20 bp, synthetic construct
  misc_feature 1..20: note = CRISPR gRNA sequence
  source 1..20: mol_type = other DNA
ctagctgtgtgaccttgggc

SEQ ID NO: 51545 - DNA, 20 bp, synthetic construct
  misc_feature 1..20: note = CRISPR gRNA sequence
  source 1..20: mol_type = other DNA
ttcttacaccctctgtgtct

SEQ ID NO: 51546 - DNA, 20 bp, synthetic construct
  misc_feature 1..20: note = CRISPR gRNA sequence
  source 1..20: mol_type = other DNA
agttccctcatctgtaaaat

SEQ ID NO: 51547 - DNA, 20 bp, synthetic construct
  misc_feature 1..20: note = CRISPR gRNA sequence
  source 1..20: mol_type = other DNA
ctgtaaaatgagaacaatac

SEQ ID NO: 51548 - DNA, 20 bp, synthetic construct
  misc_feature 1..20: note = CRISPR gRNA sequence
  source 1..20: mol_type = other DNA
atgagaacaatactagtatc

SEQ ID NO: 51549 - DNA, 20 bp, synthetic construct
  misc_feature 1..20: note = CRISPR gRNA sequence
  source 1..20: mol_type = other DNA
tgagaacaatactagtatcc

SEQ ID NO: 51550 - DNA, 20 bp, synthetic construct
  misc_feature 1..20: note = CRISPR gRNA sequence
  source 1..20: mol_type = other DNA
gagaacaatactagtatcca

SEQ ID NO: 51551 - DNA, 20 bp, synthetic construct
  misc_feature 1..20: note = CRISPR gRNA sequence
  source 1..20: mol_type = other DNA
aatactagtatccagggata

SEQ ID NO: 51552 - DNA, 20 bp, synthetic construct
  misc_feature 1..20: note = CRISPR gRNA sequence
  source 1..20: mol_type = other DNA
atactagtatccagggatat

SEQ ID NO: 51553 - DNA, 20 bp, synthetic construct
  misc_feature 1..20: note = CRISPR gRNA sequence
  source 1..20: mol_type = other DNA
agggatatgggaaacataaa

SEQ ID NO: 51554 - DNA, 20 bp, synthetic construct
  misc_feature 1..20: note = CRISPR gRNA sequence
  source 1..20: mol_type = other DNA
aaacataaaaagaacatgtc

SEQ ID NO: 51555 - DNA, 20 bp, synthetic construct
  misc_feature 1..20: note = CRISPR gRNA sequence
  source 1..20: mol_type = other DNA
aaaagaacatgtcaagcact

SEQ ID NO: 51556 - DNA, 20 bp, synthetic construct
  misc_feature 1..20: note = CRISPR gRNA sequence
  source 1..20: mol_type = other DNA
aacatgtcaagcacttagaa

SEQ ID NO: 51557 - DNA, 20 bp, synthetic construct
  misc_feature 1..20: note = CRISPR gRNA sequence
  source 1..20: mol_type = other DNA
atgtcaagcacttagaacag

SEQ ID NO: 51558 - DNA, 20 bp, synthetic construct
  misc_feature 1..20: note = CRISPR gRNA sequence
  source 1..20: mol_type = other DNA
gtcaagcacttagaacagtg

SEQ ID NO: 51559 - DNA, 20 bp, synthetic construct
  misc_feature 1..20: note = CRISPR gRNA sequence
  source 1..20: mol_type = other DNA
agcacttagaacagtggaga

SEQ ID NO: 51560 - DNA, 20 bp, synthetic construct
  misc_feature 1..20: note = CRISPR gRNA sequence
  source 1..20: mol_type = other DNA
agaacagtggagaaagtgct

SEQ ID NO: 51561 - DNA, 20 bp, synthetic construct
  misc_feature 1..20: note = CRISPR gRNA sequence
  source 1..20: mol_type = other DNA
acagtggagaaagtgctcag

SEQ ID NO: 51562 - DNA, 20 bp, synthetic construct
  misc_feature 1..20: note = CRISPR gRNA sequence
  source 1..20: mol_type = other DNA
agaaagtgctcagtagctgt

SEQ ID NO: 51563 - DNA, 20 bp, synthetic construct
  misc_feature 1..20: note = CRISPR gRNA sequence
  source 1..20: mol_type = other DNA
ctattattattccacccatg

SEQ ID NO: 51564 - DNA, 20 bp, synthetic construct
  misc_feature 1..20: note = CRISPR gRNA sequence
  source 1..20: mol_type = other DNA
tattattattccacccatgc

SEQ ID NO: 51565 - DNA, 20 bp, synthetic construct
  misc_feature 1..20: note = CRISPR gRNA sequence
  source 1..20: mol_type = other DNA
attattattccacccatgca

SEQ ID NO: 51566 - DNA, 20 bp, synthetic construct
  misc_feature 1..20: note = CRISPR gRNA sequence
  source 1..20: mol_type = other DNA
ttattattccacccatgcag

SEQ ID NO: 51567 - DNA, 20 bp, synthetic construct
  misc_feature 1..20: note = CRISPR gRNA sequence
  source 1..20: mol_type = other DNA
ggctgactatttgaatatcc

SEQ ID NO: 51568 - DNA, 20 bp, synthetic construct
  misc_feature 1..20: note = CRISPR gRNA sequence
  source 1..20: mol_type = other DNA
gactatttgaatatccaaga

SEQ ID NO: 51569 - DNA, 20 bp, synthetic construct
  misc_feature 1..20: note = CRISPR gRNA sequence
  source 1..20: mol_type = other DNA
actatttgaatatccaagac

SEQ ID NO: 51570 - DNA, 20 bp, synthetic construct
  misc_feature 1..20: note = CRISPR gRNA sequence
  source 1..20: mol_type = other DNA
aatatccaagacaggccacg

SEQ ID NO: 51571 - DNA, 20 bp, synthetic construct
  misc_feature 1..20: note = CRISPR gRNA sequence
  source 1..20: mol_type = other DNA
ataccacatctcaacaatac

SEQ ID NO: 51572 - DNA, 20 bp, synthetic construct
  misc_feature 1..20: note = CRISPR gRNA sequence
  source 1..20: mol_type = other DNA
accacatctcaacaatacaa

SEQ ID NO: 51573 - DNA, 20 bp, synthetic construct
  misc_feature 1..20: note = CRISPR gRNA sequence
  source 1..20: mol_type = other DNA
tcaacaatacaagagactgc

SEQ ID NO: 51574 - DNA, 20 bp, synthetic construct
  misc_feature 1..20: note = CRISPR gRNA sequence
  source 1..20: mol_type = other DNA
gagactgcaagaccccaccc

SEQ ID NO: 51575 - DNA, 20 bp, synthetic construct
  misc_feature 1..20: note = CRISPR gRNA sequence
  source 1..20: mol_type = other DNA
ctgcaagaccccaccctggc

SEQ ID NO: 51576 - DNA, 20 bp, synthetic construct
  misc_feature 1..20: note = CRISPR gRNA sequence
  source 1..20: mol_type = other DNA
gctggctctgcgtccctcct

SEQ ID NO: 51577 - DNA, 20 bp, synthetic construct
  misc_feature 1..20: note = CRISPR gRNA sequence
  source 1..20: mol_type = other DNA
ctggctctgcgtccctcctc

SEQ ID NO: 51578 - DNA, 20 bp, synthetic construct
  misc_feature 1..20: note = CRISPR gRNA sequence
  source 1..20: mol_type = other DNA
gctctgcgtccctcctcagg

SEQ ID NO: 51579 - DNA, 20 bp, synthetic construct
  misc_feature 1..20: note = CRISPR gRNA sequence
  source 1..20: mol_type = other DNA
tctgcgtccctcctcaggca

SEQ ID NO: 51580 - DNA, 20 bp, synthetic construct
  misc_feature 1..20: note = CRISPR gRNA sequence
  source 1..20: mol_type = other DNA
cctcctcaggcagagtcatc

SEQ ID NO: 51581 - DNA, 20 bp, synthetic construct
  misc_feature 1..20: note = CRISPR gRNA sequence
  source 1..20: mol_type = other DNA
cggtacttttaaccacctgc

SEQ ID NO: 51582 - DNA, 20 bp, synthetic construct
  misc_feature 1..20: note = CRISPR gRNA sequence
  source 1..20: mol_type = other DNA
ggtacttttaaccacctgct

SEQ ID NO: 51583 - DNA, 20 bp, synthetic construct
  misc_feature 1..20: note = CRISPR gRNA sequence
  source 1..20: mol_type = other DNA
caacaatgaatcctgcgttt

SEQ ID NO: 51584 - DNA, 20 bp, synthetic construct
  misc_feature 1..20: note = CRISPR gRNA sequence
  source 1..20: mol_type = other DNA
gcgttttagcccccatctgc

SEQ ID NO: 51585 - DNA, 20 bp, synthetic construct
  misc_feature 1..20: note = CRISPR gRNA sequence
  source 1..20: mol_type = other DNA
ttttagcccccatctgccag

SEQ ID NO: 51586 - DNA, 20 bp, synthetic construct
  misc_feature 1..20: note = CRISPR gRNA sequence
  source 1..20: mol_type = other DNA
ttagcccccatctgccagca

SEQ ID NO: 51587 - DNA, 20 bp, synthetic construct
  misc_feature 1..20: note = CRISPR gRNA sequence
  source 1..20: mol_type = other DNA
agcagagcttgcacatactt

SEQ ID NO: 51588 - DNA, 20 bp, synthetic construct
  misc_feature 1..20: note = CRISPR gRNA sequence
  source 1..20: mol_type = other DNA
gcagagcttgcacatacttg

SEQ ID NO: 51589 - DNA, 20 bp, synthetic construct
  misc_feature 1..20: note = CRISPR gRNA sequence
  source 1..20: mol_type = other DNA
gcttgcacatacttgaggct

SEQ ID NO: 51590 - DNA, 20 bp, synthetic construct
  misc_feature 1..20: note = CRISPR gRNA sequence
  source 1..20: mol_type = other DNA
cttgcacatacttgaggctg

SEQ ID NO: 51591 - DNA, 20 bp, synthetic construct
  misc_feature 1..20: note = CRISPR gRNA sequence
  source 1..20: mol_type = other DNA
ttgcacatacttgaggctga

SEQ ID NO: 51592 - DNA, 20 bp, synthetic construct
  misc_feature 1..20: note = CRISPR gRNA sequence
  source 1..20: mol_type = other DNA
cttgaggctgagggctgccc

SEQ ID NO: 51593 - DNA, 20 bp, synthetic construct
  misc_feature 1..20: note = CRISPR gRNA sequence
  source 1..20: mol_type = other DNA
aggctgagggctgcccaagt

SEQ ID NO: 51594 - DNA, 20 bp, synthetic construct
  misc_feature 1..20: note = CRISPR gRNA sequence
  source 1..20: mol_type = other DNA
gctgagggctgcccaagtca

SEQ ID NO: 51595 - DNA, 20 bp, synthetic construct
  misc_feature 1..20: note = CRISPR gRNA sequence
  source 1..20: mol_type = other DNA
ctgagggctgcccaagtcag

SEQ ID NO: 51596 - DNA, 20 bp, synthetic construct
  misc_feature 1..20: note = CRISPR gRNA sequence
  source 1..20: mol_type = other DNA
tgagggctgcccaagtcaga

SEQ ID NO: 51597 - DNA, 20 bp, synthetic construct
  misc_feature 1..20: note = CRISPR gRNA sequence
  source 1..20: mol_type = other DNA
ccaagtcagagggcacacca

SEQ ID NO: 51598 - DNA, 20 bp, synthetic construct
  misc_feature 1..20: note = CRISPR gRNA sequence
  source 1..20: mol_type = other DNA
cagagggcacaccatggaac

SEQ ID NO: 51599 - DNA, 20 bp, synthetic construct
  misc_feature 1..20: note = CRISPR gRNA sequence
  source 1..20: mol_type = other DNA
ccatggaactagctccacca

SEQ ID NO: 51600 - DNA, 20 bp, synthetic construct
  misc_feature 1..20: note = CRISPR gRNA sequence
  source 1..20: mol_type = other DNA
ggaactagctccaccatggc

SEQ ID NO: 51601 - DNA, 20 bp, synthetic construct
  misc_feature 1..20: note = CRISPR gRNA sequence
  source 1..20: mol_type = other DNA
aactagctccaccatggcga

SEQ ID NO: 51602 - DNA, 20 bp, synthetic construct
  misc_feature 1..20: note = CRISPR gRNA sequence
  source 1..20: mol_type = other DNA
tagctccaccatggcgagag

SEQ ID NO: 51603 - DNA, 20 bp, synthetic construct
  misc_feature 1..20: note = CRISPR gRNA sequence
  source 1..20: mol_type = other DNA
agctccaccatggcgagagt

SEQ ID NO: 51604 - DNA, 20 bp, synthetic construct
  misc_feature 1..20: note = CRISPR gRNA sequence
  source 1..20: mol_type = other DNA
gctccaccatggcgagagtg

SEQ ID NO: 51605 - DNA, 20 bp, synthetic construct
  misc_feature 1..20: note = CRISPR gRNA sequence
  source 1..20: mol_type = other DNA
ctccaccatggcgagagtgg

SEQ ID NO: 51606 - DNA, 20 bp, synthetic construct
  misc_feature 1..20: note = CRISPR gRNA sequence
  source 1..20: mol_type = other DNA
caccatggcgagagtggggg

SEQ ID NO: 51607 - DNA, 20 bp, synthetic construct
  misc_feature 1..20: note = CRISPR gRNA sequence
  source 1..20: mol_type = other DNA
accatggcgagagtgggggc

SEQ ID NO: 51608 - DNA, 20 bp, synthetic construct
  misc_feature 1..20: note = CRISPR gRNA sequence
  source 1..20: mol_type = other DNA
catggcgagagtgggggcgg

SEQ ID NO: 51609 - DNA, 20 bp, synthetic construct
  misc_feature 1..20: note = CRISPR gRNA sequence
  source 1..20: mol_type = other DNA
tggcgagagtgggggcggga

SEQ ID NO: 51610 - DNA, 20 bp, synthetic construct
  misc_feature 1..20: note = CRISPR gRNA sequence
  source 1..20: mol_type = other DNA
gcgagagtgggggcgggaga

SEQ ID NO: 51611 - DNA, 20 bp, synthetic construct
  misc_feature 1..20: note = CRISPR gRNA sequence
  source 1..20: mol_type = other DNA
cgggagagagaaaattgatt

SEQ ID NO: 51612 - DNA, 20 bp, synthetic construct
  misc_feature 1..20: note = CRISPR gRNA sequence
  source 1..20: mol_type = other DNA
gggagagagaaaattgattc

SEQ ID NO: 51613 - DNA, 20 bp, synthetic construct
  misc_feature 1..20: note = CRISPR gRNA sequence
  source 1..20: mol_type = other DNA
ggagagagaaaattgattca

SEQ ID NO: 51614 - DNA, 20 bp, synthetic construct
  misc_feature 1..20: note = CRISPR gRNA sequence
  source 1..20: mol_type = other DNA
gagagaaaattgattcaggg

SEQ ID NO: 51615 - DNA, 20 bp, synthetic construct
  misc_feature 1..20: note = CRISPR gRNA sequence
  source 1..20: mol_type = other DNA
aaattgattcagggaagctt

SEQ ID NO: 51616 - DNA, 20 bp, synthetic construct
  misc_feature 1..20: note = CRISPR gRNA sequence
  source 1..20: mol_type = other DNA
aattgattcagggaagcttt

SEQ ID NO: 51617 - DNA, 20 bp, synthetic construct
  misc_feature 1..20: note = CRISPR gRNA sequence
  source 1..20: mol_type = other DNA
gaagctttgggtatgtgacc

SEQ ID NO: 51618 - DNA, 20 bp, synthetic construct
  misc_feature 1..20: note = CRISPR gRNA sequence
  source 1..20: mol_type = other DNA
aagctttgggtatgtgaccc

SEQ ID NO: 51619 - DNA, 20 bp, synthetic construct
  misc_feature 1..20: note = CRISPR gRNA sequence
  source 1..20: mol_type = other DNA
tgtgacccaggcatccctga

SEQ ID NO: 51620 - DNA, 20 bp, synthetic construct
  misc_feature 1..20: note = CRISPR gRNA sequence
  source 1..20: mol_type = other DNA
acccaggcatccctgacagc

SEQ ID NO: 51621 - DNA, 20 bp, synthetic construct
  misc_feature 1..20: note = CRISPR gRNA sequence
  source 1..20: mol_type = other DNA
catccctgacagctggtcct

SEQ ID NO: 51622 - DNA, 20 bp, synthetic construct
  misc_feature 1..20: note = CRISPR gRNA sequence
  source 1..20: mol_type = other DNA
tccctgacagctggtcctga

SEQ ID NO: 51623 - DNA, 20 bp, synthetic construct
  misc_feature 1..20: note = CRISPR gRNA sequence
  source 1..20: mol_type = other DNA
ccctgacagctggtcctgag

SEQ ID NO: 51624 - DNA, 20 bp, synthetic construct
  misc_feature 1..20: note = CRISPR gRNA sequence
  source 1..20: mol_type = other DNA
acagctggtcctgagaggtg

SEQ ID NO: 51625 - DNA, 20 bp, synthetic construct
  misc_feature 1..20: note = CRISPR gRNA sequence
  source 1..20: mol_type = other DNA
cagctggtcctgagaggtgt

SEQ ID NO: 51626 - DNA, 20 bp, synthetic construct
  misc_feature 1..20: note = CRISPR gRNA sequence
  source 1..20: mol_type = other DNA
ctggtcctgagaggtgtagg

SEQ ID NO: 51627 - DNA, 20 bp, synthetic construct
  misc_feature 1..20: note = CRISPR gRNA sequence
  source 1..20: mol_type = other DNA
tggtcctgagaggtgtaggc

SEQ ID NO: 51628 - DNA, 20 bp, synthetic construct
  misc_feature 1..20: note = CRISPR gRNA sequence
  source 1..20: mol_type = other DNA
aggtgtaggcaggcacacat

SEQ ID NO: 51629 - DNA, 20 bp, synthetic construct
  misc_feature 1..20: note = CRISPR gRNA sequence
  source 1..20: mol_type = other DNA
catgagtgtatgtgcacaca

SEQ ID NO: 51630 - DNA, 20 bp, synthetic construct
  misc_feature 1..20: note = CRISPR gRNA sequence
  source 1..20: mol_type = other DNA
acggaccctcataccccctt

SEQ ID NO: 51631 - DNA, 20 bp, synthetic construct
  misc_feature 1..20: note = CRISPR gRNA sequence
  source 1..20: mol_type = other DNA
atacccccttcagtgcccct

SEQ ID NO: 51632 - DNA, 20 bp, synthetic construct
  misc_feature 1..20: note = CRISPR gRNA sequence
  source 1..20: mol_type = other DNA
tacccccttcagtgcccctc

SEQ ID NO: 51633 - DNA, 20 bp, synthetic construct
  misc_feature 1..20: note = CRISPR gRNA sequence
  source 1..20: mol_type = other DNA
ctccctcaacttactccacc

SEQ ID NO: 51634 - DNA, 20 bp, synthetic construct
  misc_feature 1..20: note = CRISPR gRNA sequence
  source 1..20: mol_type = other DNA
tcaacttactccacctggct

SEQ ID NO: 51635 - DNA, 20 bp, synthetic construct
  misc_feature 1..20: note = CRISPR gRNA sequence
  source 1..20: mol_type = other DNA
caacttactccacctggctg

SEQ ID NO: 51636 - DNA, 20 bp, synthetic construct
  misc_feature 1..20: note = CRISPR gRNA sequence
  source 1..20: mol_type = other DNA
ctgaggtctttacacttgct

SEQ ID NO: 51637 - DNA, 20 bp, synthetic construct
  misc_feature 1..20: note = CRISPR gRNA sequence
  source 1..20: mol_type = other DNA
ctttacacttgctcagcaac

SEQ ID NO: 51638 - DNA, 20 bp, synthetic construct
  misc_feature 1..20: note = CRISPR gRNA sequence
  source 1..20: mol_type = other DNA
tacacttgctcagcaaccag

SEQ ID NO: 51639 - DNA, 20 bp, synthetic construct
  misc_feature 1..20: note = CRISPR gRNA sequence
  source 1..20: mol_type = other DNA
cacttgctcagcaaccagca

SEQ ID NO: 51640 - DNA, 20 bp, synthetic construct
  misc_feature 1..20: note = CRISPR gRNA sequence
  source 1..20: mol_type = other DNA
agagtgactctacgtgctcc

SEQ ID NO: 51641 - DNA, 20 bp, synthetic construct
  misc_feature 1..20: note = CRISPR gRNA sequence
  source 1..20: mol_type = other DNA
gactctacgtgctcctggct

SEQ ID NO: 51642 - DNA, 20 bp, synthetic construct
  misc_feature 1..20: note = CRISPR gRNA sequence
  source 1..20: mol_type = other DNA
actctacgtgctcctggctg

SEQ ID NO: 51643 - DNA, 20 bp, synthetic construct
  misc_feature 1..20: note = CRISPR gRNA sequence
  source 1..20: mol_type = other DNA
cgtgctcctggctgaggctg

SEQ ID NO: 51644 - DNA, 20 bp, synthetic construct
  misc_feature 1..20: note = CRISPR gRNA sequence
  source 1..20: mol_type = other DNA
gctgcagcctgtgaacctgc

SEQ ID NO: 51645 - DNA, 20 bp, synthetic construct
  misc_feature 1..20: note = CRISPR gRNA sequence
  source 1..20: mol_type = other DNA
cagcctgtgaacctgctgga

SEQ ID NO: 51646 - DNA, 20 bp, synthetic construct
  misc_feature 1..20: note = CRISPR gRNA sequence
  source 1..20: mol_type = other DNA
gcctgtgaacctgctggacg

SEQ ID NO: 51647 - DNA, 20 bp, synthetic construct
  misc_feature 1..20: note = CRISPR gRNA sequence
  source 1..20: mol_type = other DNA
cctgtgaacctgctggacgg

SEQ ID NO: 51648 - DNA, 20 bp, synthetic construct
  misc_feature 1..20: note = CRISPR gRNA sequence
  source 1..20: mol_type = other DNA
gaacctgctggacggaggta

SEQ ID NO: 51649 - DNA, 20 bp, synthetic construct
  misc_feature 1..20: note = CRISPR gRNA sequence
  source 1..20: mol_type = other DNA
aacctgctggacggaggtaa

SEQ ID NO: 51650 - DNA, 20 bp, synthetic construct
  misc_feature 1..20: note = CRISPR gRNA sequence
  source 1..20: mol_type = other DNA
acctgctggacggaggtaaa

SEQ ID NO: 51651 - DNA, 20 bp, synthetic construct
  misc_feature 1..20: note = CRISPR gRNA sequence
  source 1..20: mol_type = other DNA
cctgctggacggaggtaaag

SEQ ID NO: 51652 - DNA, 20 bp, synthetic construct
  misc_feature 1..20: note = CRISPR gRNA sequence
  source 1..20: mol_type = other DNA
tggacggaggtaaaggggac

SEQ ID NO: 51653 - DNA, 20 bp, synthetic construct
  misc_feature 1..20: note = CRISPR gRNA sequence
  source 1..20: mol_type = other DNA
acggaggtaaaggggacaag

SEQ ID NO: 51654 - DNA, 20 bp, synthetic construct
  misc_feature 1..20: note = CRISPR gRNA sequence
  source 1..20: mol_type = other DNA
cggaggtaaaggggacaagc

SEQ ID NO: 51655 - DNA, 20 bp, synthetic construct
  misc_feature 1..20: note = CRISPR gRNA sequence
  source 1..20: mol_type = other DNA
ggaggtaaaggggacaagca

SEQ ID NO: 51656 - DNA, 20 bp, synthetic construct
  misc_feature 1..20: note = CRISPR gRNA sequence
  source 1..20: mol_type = other DNA
gaggtaaaggggacaagcag

SEQ ID NO: 51657 - DNA, 20 bp, synthetic construct
  misc_feature 1..20: note = CRISPR gRNA sequence
  source 1..20: mol_type = other DNA
taaaggggacaagcagggga

SEQ ID NO: 51658 - DNA, 20 bp, synthetic construct
  misc_feature 1..20: note = CRISPR gRNA sequence
  source 1..20: mol_type = other DNA
aaaggggacaagcaggggat

SEQ ID NO: 51659 - DNA, 20 bp, synthetic construct
  misc_feature 1..20: note = CRISPR gRNA sequence
  source 1..20: mol_type = other DNA
aaggggacaagcaggggatg

SEQ ID NO: 51660 - DNA, 20 bp, synthetic construct
  misc_feature 1..20: note = CRISPR gRNA sequence
  source 1..20: mol_type = other DNA
caagcaggggatggggcgtt

SEQ ID NO: 51661 - DNA, 20 bp, synthetic construct
  misc_feature 1..20: note = CRISPR gRNA sequence
  source 1..20: mol_type = other DNA
ggatggggcgtttggccact

SEQ ID NO: 51662 - DNA, 20 bp, synthetic construct
  misc_feature 1..20: note = CRISPR gRNA sequence
  source 1..20: mol_type = other DNA
ttggccactgagaccccctc

SEQ ID NO: 51663 - DNA, 20 bp, synthetic construct
  misc_feature 1..20: note = CRISPR gRNA sequence
  source 1..20: mol_type = other DNA
cactgagaccccctccggcc

SEQ ID NO: 51664 - DNA, 20 bp, synthetic construct
  misc_feature 1..20: note = CRISPR gRNA sequence
  source 1..20: mol_type = other DNA
gagaccccctccggcctggc

SEQ ID NO: 51665 - DNA, 20 bp, synthetic construct
  misc_feature 1..20: note = CRISPR gRNA sequence
  source 1..20: mol_type = other DNA
cccctccggcctggctagcc

SEQ ID NO: 51666 - DNA, 20 bp, synthetic construct
  misc_feature 1..20: note = CRISPR gRNA sequence
  source 1..20: mol_type = other DNA
ccctccggcctggctagccc

SEQ ID NO: 51667 - DNA, 20 bp, synthetic construct
  misc_feature 1..20: note = CRISPR gRNA sequence
  source 1..20: mol_type = other DNA
cctccggcctggctagccca

SEQ ID NO: 51668 - DNA, 20 bp, synthetic construct
  misc_feature 1..20: note = CRISPR gRNA sequence
  source 1..20: mol_type = other DNA
ggcctggctagcccagggca

SEQ ID NO: 51669 - DNA, 20 bp, synthetic construct
  misc_feature 1..20: note = CRISPR gRNA sequence
  source 1..20: mol_type = other DNA
ctagcccagggcacagcctc

SEQ ID NO: 51670 - DNA, 20 bp, synthetic construct
  misc_feature 1..20: note = CRISPR gRNA sequence
  source 1..20: mol_type = other DNA
tagcccagggcacagcctct

SEQ ID NO: 51671 - DNA, 20 bp, synthetic construct
  misc_feature 1..20: note = CRISPR gRNA sequence
  source 1..20: mol_type = other DNA
agggcacagcctctgggctc

SEQ ID NO: 51672 - DNA, 20 bp, synthetic construct
  misc_feature 1..20: note = CRISPR gRNA sequence
  source 1..20: mol_type = other DNA
gggcacagcctctgggctcc

SEQ ID NO: 51673 - DNA, 20 bp, synthetic construct
  misc_feature 1..20: note = CRISPR gRNA sequence
  source 1..20: mol_type = other DNA
cacagcctctgggctccagg

SEQ ID NO: 51674 - DNA, 20 bp, synthetic construct
  misc_feature 1..20: note = CRISPR gRNA sequence
  source 1..20: mol_type = other DNA
acagcctctgggctccaggt

SEQ ID NO: 51675 - DNA, 20 bp, synthetic construct
  misc_feature 1..20: note = CRISPR gRNA sequence
  source 1..20: mol_type = other DNA
ctccaggtgggtctccactc

SEQ ID NO: 51676 - DNA, 20 bp, synthetic construct
  misc_feature 1..20: note = CRISPR gRNA sequence
  source 1..20: mol_type = other DNA
ggtgggtctccactcaagct

SEQ ID NO: 51677 - DNA, 20 bp, synthetic construct
  misc_feature 1..20: note = CRISPR gRNA sequence
  source 1..20: mol_type = other DNA
ccactcaagcttggaccctc

SEQ ID NO: 51678 - DNA, 20 bp, synthetic construct
  misc_feature 1..20: note = CRISPR gRNA sequence
  source 1..20: mol_type = other DNA
ctcaagcttggaccctctgg

SEQ ID NO: 51679 - DNA, 20 bp, synthetic construct
  misc_feature 1..20: note = CRISPR gRNA sequence
  source 1..20: mol_type = other DNA
ttggaccctctggaagtgtc

SEQ ID NO: 51680 - DNA, 20 bp, synthetic construct
  misc_feature 1..20: note = CRISPR gRNA sequence
  source 1..20: mol_type = other DNA
atccactgctcccaccccca

SEQ ID NO: 51681 - DNA, 20 bp, synthetic construct
  misc_feature 1..20: note = CRISPR gRNA sequence
  source 1..20: mol_type = other DNA
cactgctcccacccccacag

SEQ ID NO: 51682 - DNA, 20 bp, synthetic construct
  misc_feature 1..20: note = CRISPR gRNA sequence
  source 1..20: mol_type = other DNA
cccccacagtagatcccacc

SEQ ID NO: 51683 - DNA, 20 bp, synthetic construct
  misc_feature 1..20: note = CRISPR gRNA sequence
  source 1..20: mol_type = other DNA
ggacctgtgtttcttcatgc

SEQ ID NO: 51684 - DNA, 20 bp, synthetic construct
  misc_feature 1..20: note = CRISPR gRNA sequence
  source 1..20: mol_type = other DNA
gacctgtgtttcttcatgct

SEQ ID NO: 51685 - DNA, 20 bp, synthetic construct
  misc_feature 1..20: note = CRISPR gRNA sequence
  source 1..20: mol_type = other DNA
ttcttcatgctgggtgaaac

SEQ ID NO: 51686 - DNA, 20 bp, synthetic construct
  misc_feature 1..20: note = CRISPR gRNA sequence
  source 1..20: mol_type = other DNA
gggtgaaacaagtccctctg

SEQ ID NO: 51687 - DNA, 20 bp, synthetic construct
  misc_feature 1..20: note = CRISPR gRNA sequence
  source 1..20: mol_type = other DNA
ggtgaaacaagtccctctgc

SEQ ID NO: 51688 - DNA, 20 bp, synthetic construct
  misc_feature 1..20: note = CRISPR gRNA sequence
  source 1..20: mol_type = other DNA
gtgaaacaagtccctctgca

SEQ ID NO: 51689 - DNA, 20 bp, synthetic construct
  misc_feature 1..20: note = CRISPR gRNA sequence
  source 1..20: mol_type = other DNA
gtccctctgcagggttgttc

SEQ ID NO: 51690 - DNA, 20 bp, synthetic construct
  misc_feature 1..20: note = CRISPR gRNA sequence
  source 1..20: mol_type = other DNA
tccctctgcagggttgttcc

SEQ ID NO: 51691 - DNA, 20 bp, synthetic construct
  misc_feature 1..20: note = CRISPR gRNA sequence
  source 1..20: mol_type = other DNA
ccctctgcagggttgttcca

SEQ ID NO: 51692 - DNA, 20 bp, synthetic construct
  misc_feature 1..20: note = CRISPR gRNA sequence
  source 1..20: mol_type = other DNA
cctctgcagggttgttccag

SEQ ID NO: 51693 - DNA, 20 bp, synthetic construct
  misc_feature 1..20: note = CRISPR gRNA sequence
  source 1..20: mol_type = other DNA
tgttccaggggaatgttttg

SEQ ID NO: 51694 - DNA, 20 bp, synthetic construct
  misc_feature 1..20: note = CRISPR gRNA sequence
  source 1..20: mol_type = other DNA
tccaggggaatgttttgtgg

SEQ ID NO: 51695 - DNA, 20 bp, synthetic construct
  misc_feature 1..20: note = CRISPR gRNA sequence
  source 1..20: mol_type = other DNA
ccaggggaatgttttgtggt

SEQ ID NO: 51696 - DNA, 20 bp, synthetic construct
  misc_feature 1..20: note = CRISPR gRNA sequence
  source 1..20: mol_type = other DNA
ggggaatgttttgtggtagg

SEQ ID NO: 51697 - DNA, 20 bp, synthetic construct
  misc_feature 1..20: note = CRISPR gRNA sequence
  source 1..20: mol_type = other DNA
aggcagtctgcatactgctc

SEQ ID NO: 51698 - DNA, 20 bp, synthetic construct
  misc_feature 1..20: note = CRISPR gRNA sequence
  source 1..20: mol_type = other DNA
tgcatactgctctggccacc

SEQ ID NO: 51699 - DNA, 20 bp, synthetic construct
  misc_feature 1..20: note = CRISPR gRNA sequence
  source 1..20: mol_type = other DNA
gcatactgctctggccaccc

SEQ ID NO: 51700 - DNA, 20 bp, synthetic construct
  misc_feature 1..20: note = CRISPR gRNA sequence
  source 1..20: mol_type = other DNA
atactgctctggccacccag

SEQ ID NO: 51701 - DNA, 20 bp, synthetic construct
  misc_feature 1..20: note = CRISPR gRNA sequence
  source 1..20: mol_type = other DNA
tactgctctggccacccagg

SEQ ID NO: 51702 - DNA, 20 bp, synthetic construct
  misc_feature 1..20: note = CRISPR gRNA sequence
  source 1..20: mol_type = other DNA
tgctctggccacccaggagg

SEQ ID NO: 51703 - DNA, 20 bp, synthetic construct
  misc_feature 1..20: note = CRISPR gRNA sequence
  source 1..20: mol_type = other DNA
cacccaggaggcagatctac

SEQ ID NO: 51704 - DNA, 20 bp, synthetic construct
  misc_feature 1..20: note = CRISPR gRNA sequence
  source 1..20: mol_type = other DNA
tactggtccccaacatcaac

SEQ ID NO: 51705 - DNA, 20 bp, synthetic construct
  misc_feature 1..20: note = CRISPR gRNA sequence
  source 1..20: mol_type = other DNA
cccaacatcaactagctgcc

SEQ ID NO: 51706 - DNA, 20 bp, synthetic construct
  misc_feature 1..20: note = CRISPR gRNA sequence
  source 1..20: mol_type = other DNA
ccaacatcaactagctgcct

SEQ ID NO: 51707 - DNA, 20 bp, synthetic construct
  misc_feature 1..20: note = CRISPR gRNA sequence
  source 1..20: mol_type = other DNA
atcaactagctgcctaggca

SEQ ID NO: 51708 - DNA, 20 bp, synthetic construct
  misc_feature 1..20: note = CRISPR gRNA sequence
  source 1..20: mol_type = other DNA
tagctgcctaggcatggttc

SEQ ID NO: 51709 - DNA, 20 bp, synthetic construct
  misc_feature 1..20: note = CRISPR gRNA sequence
  source 1..20: mol_type = other DNA
agctgcctaggcatggttca

SEQ ID NO: 51710 - DNA, 20 bp, synthetic construct
  misc_feature 1..20: note = CRISPR gRNA sequence
  source 1..20: mol_type = other DNA
gctgcctaggcatggttcaa

SEQ ID NO: 51711 - DNA, 20 bp, synthetic construct
  misc_feature 1..20: note = CRISPR gRNA sequence
  source 1..20: mol_type = other DNA
ctgcctaggcatggttcaag

SEQ ID NO: 51712 - DNA, 20 bp, synthetic construct
  misc_feature 1..20: note = CRISPR gRNA sequence
  source 1..20: mol_type = other DNA
tgcctaggcatggttcaagg

SEQ ID NO: 51713 - DNA, 20 bp, synthetic construct
  misc_feature 1..20: note = CRISPR gRNA sequence
  source 1..20: mol_type = other DNA
ggttcaagggggcttaccca

SEQ ID NO: 51714 - DNA, 20 bp, synthetic construct
  misc_feature 1..20: note = CRISPR gRNA sequence
  source 1..20: mol_type = other DNA
cacgccttcctcctcctcgt

SEQ ID NO: 51715 - DNA, 20 bp, synthetic construct
  misc_feature 1..20: note = CRISPR gRNA sequence
  source 1..20: mol_type = other DNA
cctcctcctcgttggatctg

SEQ ID NO: 51716 - DNA, 20 bp, synthetic construct
  misc_feature 1..20: note = CRISPR gRNA sequence
  source 1..20: mol_type = other DNA
ctcgttggatctgaagtgca

SEQ ID NO: 51717 - DNA, 20 bp, synthetic construct
  misc_feature 1..20: note = CRISPR gRNA sequence
  source 1..20: mol_type = other DNA
atctgaagtgcaaagttgca

SEQ ID NO: 51718 - DNA, 20 bp, synthetic construct
  misc_feature 1..20: note = CRISPR gRNA sequence
  source 1..20: mol_type = other DNA
aagtgcaaagttgcatggtg

SEQ ID NO: 51719 - DNA, 20 bp, synthetic construct
  misc_feature 1..20: note = CRISPR gRNA sequence
  source 1..20: mol_type = other DNA
agtgcaaagttgcatggtgc

SEQ ID NO: 51720 - DNA, 20 bp, synthetic construct
  misc_feature 1..20: note = CRISPR gRNA sequence
  source 1..20: mol_type = other DNA
gtgcaaagttgcatggtgca

SEQ ID NO: 51721 - DNA, 20 bp, synthetic construct
  misc_feature 1..20: note = CRISPR gRNA sequence
  source 1..20: mol_type = other DNA
agttgcatggtgcagggacc

SEQ ID NO: 51722 - DNA, 20 bp, synthetic construct
  misc_feature 1..20: note = CRISPR gRNA sequence
  source 1..20: mol_type = other DNA
catggtgcagggacctggat

SEQ ID NO: 51723 - DNA, 20 bp, synthetic construct
  misc_feature 1..20: note = CRISPR gRNA sequence
  source 1..20: mol_type = other DNA
gtgcagggacctggatcaga

SEQ ID NO: 51724 - DNA, 20 bp, synthetic construct
  misc_feature 1..20: note = CRISPR gRNA sequence
  source 1..20: mol_type = other DNA
tgcagggacctggatcagac

SEQ ID NO: 51725 - DNA, 20 bp, synthetic construct
  misc_feature 1..20: note = CRISPR gRNA sequence
  source 1..20: mol_type = other DNA
gacctggatcagacaggacc

SEQ ID NO: 51726 - DNA, 20 bp, synthetic construct
  misc_feature 1..20: note = CRISPR gRNA sequence
  source 1..20: mol_type = other DNA
acctggatcagacaggacct

SEQ ID NO: 51727 - DNA, 20 bp, synthetic construct
  misc_feature 1..20: note = CRISPR gRNA sequence
  source 1..20: mol_type = other DNA
ggatcagacaggacctgggt

SEQ ID NO: 51728 - DNA, 20 bp, synthetic construct
  misc_feature 1..20: note = CRISPR gRNA sequence
  source 1..20: mol_type = other DNA
cagacaggacctgggtcaga

SEQ ID NO: 51729 - DNA, 20 bp, synthetic construct
  misc_feature 1..20: note = CRISPR gRNA sequence
  source 1..20: mol_type = other DNA
ggacctgggtcagacagctg

SEQ ID NO: 51730 - DNA, 20 bp, synthetic construct
  misc_feature 1..20: note = CRISPR gRNA sequence
  source 1..20: mol_type = other DNA
gggtcagacagctgtggcca

SEQ ID NO: 51731 - DNA, 20 bp, synthetic construct
  misc_feature 1..20: note = CRISPR gRNA sequence
  source 1..20: mol_type = other DNA
gacagctgtggccacagcct

SEQ ID NO: 51732 - DNA, 20 bp, synthetic construct
  misc_feature 1..20: note = CRISPR gRNA sequence
  source 1..20: mol_type = other DNA
acagctgtggccacagcctc

SEQ ID NO: 51733 - DNA, 20 bp, synthetic construct
  misc_feature 1..20: note = CRISPR gRNA sequence
  source 1..20: mol_type = other DNA
acagcctcaggatgccccca

SEQ ID NO: 51734 - DNA, 20 bp, synthetic construct
  misc_feature 1..20: note = CRISPR gRNA sequence
  source 1..20: mol_type = other DNA
cagcctcaggatgcccccac

SEQ ID NO: 51735 - DNA, 20 bp, synthetic construct
  misc_feature 1..20: note = CRISPR gRNA sequence
  source 1..20: mol_type = other DNA
agcctcaggatgcccccacg

SEQ ID NO: 51736 - DNA, 20 bp, synthetic construct
  misc_feature 1..20: note = CRISPR gRNA sequence
  source 1..20: mol_type = other DNA
tcaggatgcccccacggggc

SEQ ID NO: 51737 - DNA, 20 bp, synthetic construct
  misc_feature 1..20: note = CRISPR gRNA sequence
  source 1..20: mol_type = other DNA
cggggccagcacccctcctc

SEQ ID NO: 51738 - DNA, 20 bp, synthetic construct
  misc_feature 1..20: note = CRISPR gRNA sequence
  source 1..20: mol_type = other DNA
ggccagcacccctcctccgg

SEQ ID NO: 51739 - DNA, 20 bp, synthetic construct
  misc_feature 1..20: note = CRISPR gRNA sequence
  source 1..20: mol_type = other DNA
gcacccctcctccggaagcc

SEQ ID NO: 51740 - DNA, 20 bp, synthetic construct
  misc_feature 1..20: note = CRISPR gRNA sequence
  source 1..20: mol_type = other DNA
tcctccggaagcccagcctc

SEQ ID NO: 51741 - DNA, 20 bp, synthetic construct
  misc_feature 1..20: note = CRISPR gRNA sequence
  source 1..20: mol_type = other DNA
ccggaagcccagcctctagt

SEQ ID NO: 51742 - DNA, 20 bp, synthetic construct
  misc_feature 1..20: note = CRISPR gRNA sequence
  source 1..20: mol_type = other DNA
cggaagcccagcctctagtt

SEQ ID NO: 51743 - DNA, 20 bp, synthetic construct
  misc_feature 1..20: note = CRISPR gRNA sequence
  source 1..20: mol_type = other DNA
tcctaccccctcatacccac

SEQ ID NO: 51744 - DNA, 20 bp, synthetic construct
  misc_feature 1..20: note = CRISPR gRNA sequence
  source 1..20: mol_type = other DNA
ccctcatacccaccagactc

SEQ ID NO: 51745 - DNA, 20 bp, synthetic construct
  misc_feature 1..20: note = CRISPR gRNA sequence
  source 1..20: mol_type = other DNA
cctcatacccaccagactcc

SEQ ID NO: 51746 - DNA, 20 bp, synthetic construct
  misc_feature 1..20: note = CRISPR gRNA sequence
  source 1..20: mol_type = other DNA
agactccaggcacaaccctt

SEQ ID NO: 51747 - DNA, 20 bp, synthetic construct
  misc_feature 1..20: note = CRISPR gRNA sequence
  source 1..20: mol_type = other DNA
gactccaggcacaacccttc

SEQ ID NO: 51748 - DNA, 20 bp, synthetic construct
  misc_feature 1..20: note = CRISPR gRNA sequence
  source 1..20: mol_type = other DNA
caggcacaacccttcaggac

SEQ ID NO: 51749 - DNA, 20 bp, synthetic construct
  misc_feature 1..20: note = CRISPR gRNA sequence
  source 1..20: mol_type = other DNA
caacccttcaggacgagtcc

SEQ ID NO: 51750 - DNA, 20 bp, synthetic construct
  misc_feature 1..20: note = CRISPR gRNA sequence
  source 1..20: mol_type = other DNA
aggacgagtcctggctgtcc

SEQ ID NO: 51751 - DNA, 20 bp, synthetic construct
  misc_feature 1..20: note = CRISPR gRNA sequence
  source 1..20: mol_type = other DNA
ggacgagtcctggctgtccc

SEQ ID NO: 51752 - DNA, 20 bp, synthetic construct
  misc_feature 1..20: note = CRISPR gRNA sequence
  source 1..20: mol_type = other DNA
gacgagtcctggctgtccca

SEQ ID NO: 51753 - DNA, 20 bp, synthetic construct
  misc_feature 1..20: note = CRISPR gRNA sequence
  source 1..20: mol_type = other DNA
acgagtcctggctgtcccag

SEQ ID NO: 51754 - DNA, 20 bp, synthetic construct
  misc_feature 1..20: note = CRISPR gRNA sequence
  source 1..20: mol_type = other DNA
tcccaggggaatgcccacct

SEQ ID NO: 51755 - DNA, 20 bp, synthetic construct
  misc_feature 1..20: note = CRISPR gRNA sequence
  source 1..20: mol_type = other DNA
agatccacctttttaacccg

SEQ ID NO: 51756 - DNA, 20 bp, synthetic construct
  misc_feature 1..20: note = CRISPR gRNA sequence
  source 1..20: mol_type = other DNA
acctttttaacccgtggaca

SEQ ID NO: 51757 - DNA, 20 bp, synthetic construct
  misc_feature 1..20: note = CRISPR gRNA sequence
  source 1..20: mol_type = other DNA
cctttttaacccgtggacac

SEQ ID NO: 51758 - DNA, 20 bp, synthetic construct
  misc_feature 1..20: note = CRISPR gRNA sequence
  source 1..20: mol_type = other DNA
taacccgtggacacaggctt

SEQ ID NO: 51759 - DNA, 20 bp, synthetic construct
  misc_feature 1..20: note = CRISPR gRNA sequence
  source 1..20: mol_type = other DNA
aacccgtggacacaggctta

SEQ ID NO: 51760 - DNA, 20 bp, synthetic construct
  misc_feature 1..20: note = CRISPR gRNA sequence
  source 1..20: mol_type = other DNA
tggacacaggcttaaggtgt

SEQ ID NO: 51761 - DNA, 20 bp, synthetic construct
  misc_feature 1..20: note = CRISPR gRNA sequence
  source 1..20: mol_type = other DNA
cacaggcttaaggtgttggc

SEQ ID NO: 51762 - DNA, 20 bp, synthetic construct
  misc_feature 1..20: note = CRISPR gRNA sequence
  source 1..20: mol_type = other DNA
aggcttaaggtgttggccag

SEQ ID NO: 51763 - DNA, 20 bp, synthetic construct
  misc_feature 1..20: note = CRISPR gRNA sequence
  source 1..20: mol_type = other DNA
ggcttaaggtgttggccagc

SEQ ID NO: 51764 - DNA, 20 bp, synthetic construct
  misc_feature 1..20: note = CRISPR gRNA sequence
  source 1..20: mol_type = other DNA
ttaaggtgttggccagcagg

SEQ ID NO: 51765 - DNA, 20 bp, synthetic construct
  misc_feature 1..20: note = CRISPR gRNA sequence
  source 1..20: mol_type = other DNA
taaggtgttggccagcagga

SEQ ID NO: 51766 - DNA, 20 bp, synthetic construct
  misc_feature 1..20: note = CRISPR gRNA sequence
  source 1..20: mol_type = other DNA
aaggtgttggccagcaggaa

SEQ ID NO: 51767 - DNA, 20 bp, synthetic construct
  misc_feature 1..20: note = CRISPR gRNA sequence
  source 1..20: mol_type = other DNA
aggtgttggccagcaggaag

SEQ ID NO: 51768 - DNA, 20 bp, synthetic construct
  misc_feature 1..20: note = CRISPR gRNA sequence
  source 1..20: mol_type = other DNA
gccagcaggaaggggctttt

SEQ ID NO: 51769 - DNA, 20 bp, synthetic construct
  misc_feature 1..20: note = CRISPR gRNA sequence
  source 1..20: mol_type = other DNA
ccagcaggaaggggcttttc

SEQ ID NO: 51770 - DNA, 20 bp, synthetic construct
  misc_feature 1..20: note = CRISPR gRNA sequence
  source 1..20: mol_type = other DNA
cagcaggaaggggcttttcg

SEQ ID NO: 51771 - DNA, 20 bp, synthetic construct
  misc_feature 1..20: note = CRISPR gRNA sequence
  source 1..20: mol_type = other DNA
aggaaggggcttttcgggga

SEQ ID NO: 51772 - DNA, 20 bp, synthetic construct
  misc_feature 1..20: note = CRISPR gRNA sequence
  source 1..20: mol_type = other DNA
ttttcggggacagtcccgtc

SEQ ID NO: 51773 - DNA, 20 bp, synthetic construct
  misc_feature 1..20: note = CRISPR gRNA sequence
  source 1..20: mol_type = other DNA
ggggacagtcccgtctggct

SEQ ID NO: 51774 - DNA, 20 bp, synthetic construct
  misc_feature 1..20: note = CRISPR gRNA sequence
  source 1..20: mol_type = other DNA
cccgtctggctcagcctgaa

SEQ ID NO: 51775 - DNA, 20 bp, synthetic construct
  misc_feature 1..20: note = CRISPR gRNA sequence
  source 1..20: mol_type = other DNA
ccgtctggctcagcctgaaa

SEQ ID NO: 51776 - DNA, 20 bp, synthetic construct
  misc_feature 1..20: note = CRISPR gRNA sequence
  source 1..20: mol_type = other DNA
ctggctcagcctgaaaagga

SEQ ID NO: 51777 - DNA, 20 bp, synthetic construct
  misc_feature 1..20: note = CRISPR gRNA sequence
  source 1..20: mol_type = other DNA
tggctcagcctgaaaaggaa

SEQ ID NO: 51778 - DNA, 20 bp, synthetic construct
  misc_feature 1..20: note = CRISPR gRNA sequence
  source 1..20: mol_type = other DNA
ggctcagcctgaaaaggaaa

SEQ ID NO: 51779 - DNA, 20 bp, synthetic construct
  misc_feature 1..20: note = CRISPR gRNA sequence
  source 1..20: mol_type = other DNA
gctcagcctgaaaaggaaag

SEQ ID NO: 51780 - DNA, 20 bp, synthetic construct
  misc_feature 1..20: note = CRISPR gRNA sequence
  source 1..20: mol_type = other DNA
ctcagcctgaaaaggaaagg

SEQ ID NO: 51781 - DNA, 20 bp, synthetic construct
  misc_feature 1..20: note = CRISPR gRNA sequence
  source 1..20: mol_type = other DNA
agcctgaaaaggaaaggggg

SEQ ID NO: 51782 - DNA, 20 bp, synthetic construct
  misc_feature 1..20: note = CRISPR gRNA sequence
  source 1..20: mol_type = other DNA
aaaaggaaagggggtagatc

SEQ ID NO: 51783 - DNA, 20 bp, synthetic construct
  misc_feature 1..20: note = CRISPR gRNA sequence
  source 1..20: mol_type = other DNA
ggaaagggggtagatccggc

SEQ ID NO: 51784 - DNA, 20 bp, synthetic construct
  misc_feature 1..20: note = CRISPR gRNA sequence
  source 1..20: mol_type = other DNA
gggggtagatccggcaagat

SEQ ID NO: 51785 - DNA, 20 bp, synthetic construct
  misc_feature 1..20: note = CRISPR gRNA sequence
  source 1..20: mol_type = other DNA
ggtagatccggcaagatgag

SEQ ID NO: 51786 - DNA, 20 bp, synthetic construct
  misc_feature 1..20: note = CRISPR gRNA sequence
  source 1..20: mol_type = other DNA
atccggcaagatgagtggac

SEQ ID NO: 51787 - DNA, 20 bp, synthetic construct
  misc_feature 1..20: note = CRISPR gRNA sequence
  source 1..20: mol_type = other DNA
tccggcaagatgagtggaca

SEQ ID NO: 51788 - DNA, 20 bp, synthetic construct
  misc_feature 1..20: note = CRISPR gRNA sequence
  source 1..20: mol_type = other DNA
agatgagtggacaaggaacc

SEQ ID NO: 51789 - DNA, 20 bp, synthetic construct
  misc_feature 1..20: note = CRISPR gRNA sequence
  source 1..20: mol_type = other DNA
gagtggacaaggaacctggc

SEQ ID NO: 51790 - DNA, 20 bp, synthetic construct
  misc_feature 1..20: note = CRISPR gRNA sequence
  source 1..20: mol_type = other DNA
gacaaggaacctggctagcc

SEQ ID NO: 51791 - DNA, 20 bp, synthetic construct
  misc_feature 1..20: note = CRISPR gRNA sequence
  source 1..20: mol_type = other DNA
caaggaacctggctagcctg

SEQ ID NO: 51792 - DNA, 20 bp, synthetic construct
  misc_feature 1..20: note = CRISPR gRNA sequence
  source 1..20: mol_type = other DNA
aaggaacctggctagcctgg

SEQ ID NO: 51793 - DNA, 20 bp, synthetic construct
  misc_feature 1..20: note = CRISPR gRNA sequence
  source 1..20: mol_type = other DNA
aggaacctggctagcctgga

SEQ ID NO: 51794 - DNA, 20 bp, synthetic construct
  misc_feature 1..20: note = CRISPR gRNA sequence
  source 1..20: mol_type = other DNA
acctggctagcctggagggt

SEQ ID NO: 51795 - DNA, 20 bp, synthetic construct
  misc_feature 1..20: note = CRISPR gRNA sequence
  source 1..20: mol_type = other DNA
cctggctagcctggagggta

SEQ ID NO: 51796 - DNA, 20 bp, synthetic construct
  misc_feature 1..20: note = CRISPR gRNA sequence
  source 1..20: mol_type = other DNA
gctagcctggagggtaagga

SEQ ID NO: 51797 - DNA, 20 bp, synthetic construct
  misc_feature 1..20: note = CRISPR gRNA sequence
  source 1..20: mol_type = other DNA
ctagcctggagggtaaggaa

SEQ ID NO: 51798 - DNA, 20 bp, synthetic construct
  misc_feature 1..20: note = CRISPR gRNA sequence
  source 1..20: mol_type = other DNA
tagcctggagggtaaggaaa

SEQ ID NO: 51799 - DNA, 20 bp, synthetic construct
  misc_feature 1..20: note = CRISPR gRNA sequence
  source 1..20: mol_type = other DNA
gcctggagggtaaggaaagg

SEQ ID NO: 51800 - DNA, 20 bp, synthetic construct
  misc_feature 1..20: note = CRISPR gRNA sequence
  source 1..20: mol_type = other DNA
cctggagggtaaggaaaggg

SEQ ID NO: 51801 - DNA, 20 bp, synthetic construct
  misc_feature 1..20: note = CRISPR gRNA sequence
  source 1..20: mol_type = other DNA
ctggagggtaaggaaaggga

SEQ ID NO: 51802 - DNA, 20 bp, synthetic construct
  misc_feature 1..20: note = CRISPR gRNA sequence
  source 1..20: mol_type = other DNA
gagggtaaggaaagggaggg

SEQ ID NO: 51803 - DNA, 20 bp, synthetic construct
  misc_feature 1..20: note = CRISPR gRNA sequence
  source 1..20: mol_type = other DNA
agggtaaggaaagggagggt

SEQ ID NO: 51804 - DNA, 20 bp, synthetic construct
  misc_feature 1..20: note = CRISPR gRNA sequence
  source 1..20: mol_type = other DNA
gggtaaggaaagggagggtg

SEQ ID NO: 51805 - DNA, 20 bp, synthetic construct
  misc_feature 1..20: note = CRISPR gRNA sequence
  source 1..20: mol_type = other DNA
gtaaggaaagggagggtggg

SEQ ID NO: 51806 - DNA, 20 bp, synthetic construct
  misc_feature 1..20: note = CRISPR gRNA sequence
  source 1..20: mol_type = other DNA
taaggaaagggagggtgggg

SEQ ID NO: 51807 - DNA, 20 bp, synthetic construct
  misc_feature 1..20: note = CRISPR gRNA sequence
  source 1..20: mol_type = other DNA
aaggaaagggagggtgggga

SEQ ID NO: 51808 - DNA, 20 bp, synthetic construct
  misc_feature 1..20: note = CRISPR gRNA sequence
  source 1..20: mol_type = other DNA
aaagggagggtggggagggc

SEQ ID NO: 51809 - DNA, 20 bp, synthetic construct
  misc_feature 1..20: note = CRISPR gRNA sequence
  source 1..20: mol_type = other DNA
gggagggtggggagggctag

SEQ ID NO: 51810 - DNA, 20 bp, synthetic construct
  misc_feature 1..20: note = CRISPR gRNA sequence
  source 1..20: mol_type = other DNA
ggtggggagggctagcagct

SEQ ID NO: 51811 - DNA, 20 bp, synthetic construct
  misc_feature 1..20: note = CRISPR gRNA sequence
  source 1..20: mol_type = other DNA
gggagggctagcagctcagc

SEQ ID NO: 51812 - DNA, 20 bp, synthetic construct
  misc_feature 1..20: note = CRISPR gRNA sequence
  source 1..20: mol_type = other DNA
ggagggctagcagctcagca

SEQ ID NO: 51813 - DNA, 20 bp, synthetic construct
  misc_feature 1..20: note = CRISPR gRNA sequence
  source 1..20: mol_type = other DNA
ctagcagctcagcaaggcaa

SEQ ID NO: 51814 - DNA, 20 bp, synthetic construct
  misc_feature 1..20: note = CRISPR gRNA sequence
  source 1..20: mol_type = other DNA
tagcagctcagcaaggcaat

SEQ ID NO: 51815 - DNA, 20 bp, synthetic construct
  misc_feature 1..20: note = CRISPR gRNA sequence
  source 1..20: mol_type = other DNA
agcagctcagcaaggcaata

SEQ ID NO: 51816 - DNA, 20 bp, synthetic construct
  misc_feature 1..20: note = CRISPR gRNA sequence
  source 1..20: mol_type = other DNA
agctcagcaaggcaataggg

SEQ ID NO: 51817 - DNA, 20 bp, synthetic construct
  misc_feature 1..20: note = CRISPR gRNA sequence
  source 1..20: mol_type = other DNA
tcagcaaggcaatagggaag

SEQ ID NO: 51818 - DNA, 20 bp, synthetic construct
  misc_feature 1..20: note = CRISPR gRNA sequence
  source 1..20: mol_type = other DNA
cagcaaggcaatagggaagc

SEQ ID NO: 51819 - DNA, 20 bp, synthetic construct
  misc_feature 1..20: note = CRISPR gRNA sequence
  source 1..20: mol_type = other DNA
caaggcaatagggaagcagg

SEQ ID NO: 51820 - DNA, 20 bp, synthetic construct
  misc_feature 1..20: note = CRISPR gRNA sequence
  source 1..20: mol_type = other DNA
aaggcaatagggaagcaggc

SEQ ID NO: 51821 - DNA, 20 bp, synthetic construct
  misc_feature 1..20: note = CRISPR gRNA sequence
  source 1..20: mol_type = other DNA
aggcaatagggaagcaggca

SEQ ID NO: 51822 - DNA, 20 bp, synthetic construct
  misc_feature 1..20: note = CRISPR gRNA sequence
  source 1..20: mol_type = other DNA
ggcaatagggaagcaggcag

SEQ ID NO: 51823 - DNA, 20 bp, synthetic construct
  misc_feature 1..20: note = CRISPR gRNA sequence
  source 1..20: mol_type = other DNA
agggaagcaggcaggggatc

SEQ ID NO: 51824 - DNA, 20 bp, synthetic construct
  misc_feature 1..20: note = CRISPR gRNA sequence
  source 1..20: mol_type = other DNA
ggaagcaggcaggggatcaa

SEQ ID NO: 51825 - DNA, 20 bp, synthetic construct
  misc_feature 1..20: note = CRISPR gRNA sequence
  source 1..20: mol_type = other DNA
gaagcaggcaggggatcaag

SEQ ID NO: 51826 - DNA, 20 bp, synthetic construct
  misc_feature 1..20: note = CRISPR gRNA sequence
  source 1..20: mol_type = other DNA
aggggatcaagaggcacaaa

SEQ ID NO: 51827 - DNA, 20 bp, synthetic construct
  misc_feature 1..20: note = CRISPR gRNA sequence
  source 1..20: mol_type = other DNA
ggggatcaagaggcacaaat

SEQ ID NO: 51828 - DNA, 20 bp, synthetic construct
  misc_feature 1..20: note = CRISPR gRNA sequence
  source 1..20: mol_type = other DNA
gggatcaagaggcacaaata

SEQ ID NO: 51829 - DNA, 20 bp, synthetic construct
  misc_feature 1..20: note = CRISPR gRNA sequence
  source 1..20: mol_type = other DNA
caagaggcacaaatagggct

SEQ ID NO: 51830 - DNA, 20 bp, synthetic construct
  misc_feature 1..20: note = CRISPR gRNA sequence
  source 1..20: mol_type = other DNA
aagaggcacaaatagggctg

SEQ ID NO: 51831 - DNA, 20 bp, synthetic construct
  misc_feature 1..20: note = CRISPR gRNA sequence
  source 1..20: mol_type = other DNA
agaggcacaaatagggctga

SEQ ID NO: 51832 - DNA, 20 bp, synthetic construct
  misc_feature 1..20: note = CRISPR gRNA sequence
  source 1..20: mol_type = other DNA
gcacaaatagggctgaggga

SEQ ID NO: 51833 - DNA, 20 bp, synthetic construct
  misc_feature 1..20: note = CRISPR gRNA sequence
  source 1..20: mol_type = other DNA
cacaaatagggctgagggac

SEQ ID NO: 51834 - DNA, 20 bp, synthetic construct
  misc_feature 1..20: note = CRISPR gRNA sequence
  source 1..20: mol_type = other DNA
aaatagggctgagggacagg

SEQ ID NO: 51835 - DNA, 20 bp, synthetic construct
  misc_feature 1..20: note = CRISPR gRNA sequence
  source 1..20: mol_type = other DNA
ggctgagggacaggcagatt

SEQ ID NO: 51836 - DNA, 20 bp, synthetic construct
  misc_feature 1..20: note = CRISPR gRNA sequence
  source 1..20: mol_type = other DNA
ggacaggcagatttggattt

SEQ ID NO: 51837 - DNA, 20 bp, synthetic construct
  misc_feature 1..20: note = CRISPR gRNA sequence
  source 1..20: mol_type = other DNA
gcagatttggatttgagtcc

SEQ ID NO: 51838 - DNA, 20 bp, synthetic construct
  misc_feature 1..20: note = CRISPR gRNA sequence
  source 1..20: mol_type = other DNA
tgagtcccagttctgcttat

SEQ ID NO: 51839 - DNA, 20 bp, synthetic construct
  misc_feature 1..20: note = CRISPR gRNA sequence
  source 1..20: mol_type = other DNA
gcttattggctgtgtgacct

SEQ ID NO: 51840 - DNA, 20 bp, synthetic construct
  misc_feature 1..20: note = CRISPR gRNA sequence
  source 1..20: mol_type = other DNA
ttattggctgtgtgaccttg

SEQ ID NO: 51841 - DNA, 20 bp, synthetic construct
  misc_feature 1..20: note = CRISPR gRNA sequence
  source 1..20: mol_type = other DNA
ttggctgtgtgaccttggag

SEQ ID NO: 51842 - DNA, 20 bp, synthetic construct
  misc_feature 1..20: note = CRISPR gRNA sequence
  source 1..20: mol_type = other DNA
agaagtgacttcacctctct

SEQ ID NO: 51843 - DNA, 20 bp, synthetic construct
  misc_feature 1..20: note = CRISPR gRNA sequence
  source 1..20: mol_type = other DNA
gacttcacctctctgagctt

SEQ ID NO: 51844 - DNA, 20 bp, synthetic construct
  misc_feature 1..20: note = CRISPR gRNA sequence
  source 1..20: mol_type = other DNA
tgagcttcagtttccttatc

SEQ ID NO: 51845 - DNA, 20 bp, synthetic construct
  misc_feature 1..20: note = CRISPR gRNA sequence
  source 1..20: mol_type = other DNA
agtttccttatctggaaatc

SEQ ID NO: 51846 - DNA, 20 bp, synthetic construct
  misc_feature 1..20: note = CRISPR gRNA sequence
  source 1..20: mol_type = other DNA
actcgtcatgtatgactctc

SEQ ID NO: 51847 - DNA, 20 bp, synthetic construct
  misc_feature 1..20: note = CRISPR gRNA sequence
  source 1..20: mol_type = other DNA
ctcgtcatgtatgactctcg

SEQ ID NO: 51848 - DNA, 20 bp, synthetic construct
  misc_feature 1..20: note = CRISPR gRNA sequence
  source 1..20: mol_type = other DNA
gtatgactctcgaggtatat

SEQ ID NO: 51849 - DNA, 20 bp, synthetic construct
  misc_feature 1..20: note = CRISPR gRNA sequence
  source 1..20: mol_type = other DNA
tatgactctcgaggtatatg

SEQ ID NO: 51850 - DNA, 20 bp, synthetic construct
  misc_feature 1..20: note = CRISPR gRNA sequence
  source 1..20: mol_type = other DNA
gaggatttaattacatcatg

SEQ ID NO: 51851 - DNA, 20 bp, synthetic construct
  misc_feature 1..20: note = CRISPR gRNA sequence
  source 1..20: mol_type = other DNA
aggatttaattacatcatgc

SEQ ID NO: 51852 - DNA, 20 bp, synthetic construct
  misc_feature 1..20: note = CRISPR gRNA sequence
  source 1..20: mol_type = other DNA
acatcatgcaggtgcactgc

SEQ ID NO: 51853 - DNA, 20 bp, synthetic construct
  misc_feature 1..20: note = CRISPR gRNA sequence
  source 1..20: mol_type = other DNA
catcatgcaggtgcactgcc

SEQ ID NO: 51854 - DNA, 20 bp, synthetic construct
  misc_feature 1..20: note = CRISPR gRNA sequence
  source 1..20: mol_type = other DNA
tgcaggtgcactgccgggca

SEQ ID NO: 51855 - DNA, 20 bp, synthetic construct
  misc_feature 1..20: note = CRISPR gRNA sequence
  source 1..20: mol_type = other DNA
gcaggtgcactgccgggcat

SEQ ID NO: 51856 - DNA, 20 bp, synthetic construct
  misc_feature 1..20: note = CRISPR gRNA sequence
  source 1..20: mol_type = other DNA
ttactattgtttttacctgc

SEQ ID NO: 51857 - DNA, 20 bp, synthetic construct
  misc_feature 1..20: note = CRISPR gRNA sequence
  source 1..20: mol_type = other DNA
attgtttttacctgcaagca

SEQ ID NO: 51858 - DNA, 20 bp, synthetic construct
  misc_feature 1..20: note = CRISPR gRNA sequence
  source 1..20: mol_type = other DNA
acctgcaagcacagatttca

SEQ ID NO: 51859 - DNA, 20 bp, synthetic construct
  misc_feature 1..20: note = CRISPR gRNA sequence
  source 1..20: mol_type = other DNA
cctgcaagcacagatttcac

SEQ ID NO: 51860 - DNA, 20 bp, synthetic construct
  misc_feature 1..20: note = CRISPR gRNA sequence
  source 1..20: mol_type = other DNA
caagcacagatttcacaggc

SEQ ID NO: 51861 - DNA, 20 bp, synthetic construct
  misc_feature 1..20: note = CRISPR gRNA sequence
  source 1..20: mol_type = other DNA
cacaggcgagtccttgctca

SEQ ID NO: 51862 - DNA, 20 bp, synthetic construct
  misc_feature 1..20: note = CRISPR gRNA sequence
  source 1..20: mol_type = other DNA
caggcgagtccttgctcaca

SEQ ID NO: 51863 - DNA, 20 bp, synthetic construct
  misc_feature 1..20: note = CRISPR gRNA sequence
  source 1..20: mol_type = other DNA
ggcgagtccttgctcacaga

SEQ ID NO: 51864 - DNA, 20 bp, synthetic construct
  misc_feature 1..20: note = CRISPR gRNA sequence
  source 1..20: mol_type = other DNA
gagtccttgctcacagagag

SEQ ID NO: 51865 - DNA, 20 bp, synthetic construct
  misc_feature 1..20: note = CRISPR gRNA sequence
  source 1..20: mol_type = other DNA
agtccttgctcacagagagt

SEQ ID NO: 51866 - DNA, 20 bp, synthetic construct
  misc_feature 1..20: note = CRISPR gRNA sequence
  source 1..20: mol_type = other DNA
ccttgctcacagagagtggg

SEQ ID NO: 51867 - DNA, 20 bp, synthetic construct
  misc_feature 1..20: note = CRISPR gRNA sequence
  source 1..20: mol_type = other DNA
tcacagagagtgggaagctt

SEQ ID NO: 51868 - DNA, 20 bp, synthetic construct
  misc_feature 1..20: note = CRISPR gRNA sequence
  source 1..20: mol_type = other DNA
cacagagagtgggaagcttc

SEQ ID NO: 51869 - DNA, 20 bp, synthetic construct
  misc_feature 1..20: note = CRISPR gRNA sequence
  source 1..20: mol_type = other DNA
gtgggaagcttcaggccctt

SEQ ID NO: 51870 - DNA, 20 bp, synthetic construct
  misc_feature 1..20: note = CRISPR gRNA sequence
  source 1..20: mol_type = other DNA
agcttcaggcccttcagaca

SEQ ID NO: 51871 - DNA, 20 bp, synthetic construct
  misc_feature 1..20: note = CRISPR gRNA sequence
  source 1..20: mol_type = other DNA
cagacacagtttttaaacct

SEQ ID NO: 51872 - DNA, 20 bp, synthetic construct
  misc_feature 1..20: note = CRISPR gRNA sequence
  source 1..20: mol_type = other DNA
ttttaaaccttagcactatt

SEQ ID NO: 51873 - DNA, 20 bp, synthetic construct
  misc_feature 1..20: note = CRISPR gRNA sequence
  source 1..20: mol_type = other DNA
ccttagcactattgagatgt

SEQ ID NO: 51874 - DNA, 20 bp, synthetic construct
  misc_feature 1..20: note = CRISPR gRNA sequence
  source 1..20: mol_type = other DNA
cttagcactattgagatgtg

SEQ ID NO: 51875 - DNA, 20 bp, synthetic construct
  misc_feature 1..20: note = CRISPR gRNA sequence
  source 1..20: mol_type = other DNA
ggtccaataattctttgttg

SEQ ID NO: 51876 - DNA, 20 bp, synthetic construct
  misc_feature 1..20: note = CRISPR gRNA sequence
  source 1..20: mol_type = other DNA
gtccaataattctttgttgt

SEQ ID NO: 51877 - DNA, 20 bp, synthetic construct
  misc_feature 1..20: note = CRISPR gRNA sequence
  source 1..20: mol_type = other DNA
gtgggctctcctgtgcccta

SEQ ID NO: 51878 - DNA, 20 bp, synthetic construct
  misc_feature 1..20: note = CRISPR gRNA sequence
  source 1..20: mol_type = other DNA
tgggctctcctgtgccctat

SEQ ID NO: 51879 - DNA, 20 bp, synthetic construct
  misc_feature 1..20: note = CRISPR gRNA sequence
  source 1..20: mol_type = other DNA
cctgtgccctataggatgtt

SEQ ID NO: 51880 - DNA, 20 bp, synthetic construct
  misc_feature 1..20: note = CRISPR gRNA sequence
  source 1..20: mol_type = other DNA
gtgccctataggatgttcag

SEQ ID NO: 51881 - DNA, 20 bp, synthetic construct
  misc_feature 1..20: note = CRISPR gRNA sequence
  source 1..20: mol_type = other DNA
taggatgttcagcagcatcc

SEQ ID NO: 51882 - DNA, 20 bp, synthetic construct
  misc_feature 1..20: note = CRISPR gRNA sequence
  source 1..20: mol_type = other DNA
gatctctattcattcgatgc

SEQ ID NO: 51883 - DNA, 20 bp, synthetic construct
  misc_feature 1..20: note = CRISPR gRNA sequence
  source 1..20: mol_type = other DNA
ctctattcattcgatgccag

SEQ ID NO: 51884 - DNA, 20 bp, synthetic construct
  misc_feature 1..20: note = CRISPR gRNA sequence
  source 1..20: mol_type = other DNA
tattcattcgatgccagtag

SEQ ID NO: 51885 - DNA, 20 bp, synthetic construct
  misc_feature 1..20: note = CRISPR gRNA sequence
  source 1..20: mol_type = other DNA
gtagcagcacccctcacccg

SEQ ID NO: 51886 - DNA, 20 bp, synthetic construct
  misc_feature 1..20: note = CRISPR gRNA sequence
  source 1..20: mol_type = other DNA
atgaccaccaaaaatatctc

SEQ ID NO: 51887 - DNA, 20 bp, synthetic construct
  misc_feature 1..20: note = CRISPR gRNA sequence
  source 1..20: mol_type = other DNA
gatatttccaaatgactccc

SEQ ID NO: 51888 - DNA, 20 bp, synthetic construct
  misc_feature 1..20: note = CRISPR gRNA sequence
  source 1..20: mol_type = other DNA
atatttccaaatgactccca

SEQ ID NO: 51889 - DNA, 20 bp, synthetic construct
  misc_feature 1..20: note = CRISPR gRNA sequence
  source 1..20: mol_type = other DNA
tatttccaaatgactcccaa

SEQ ID NO: 51890 - DNA, 20 bp, synthetic construct
  misc_feature 1..20: note = CRISPR gRNA sequence
  source 1..20: mol_type = other DNA
ccaagggtgaaaatcacccc

SEQ ID NO: 51891 - DNA, 20 bp, synthetic construct
  misc_feature 1..20: note = CRISPR gRNA sequence
  source 1..20: mol_type = other DNA
gggtgaaaatcacccccagt

SEQ ID NO: 51892 - DNA, 20 bp, synthetic construct
  misc_feature 1..20: note = CRISPR gRNA sequence
  source 1..20: mol_type = other DNA
ccagttggaaaccactgcct

SEQ ID NO: 51893 - DNA, 20 bp, synthetic construct
  misc_feature 1..20: note = CRISPR gRNA sequence
  source 1..20: mol_type = other DNA
agttggaaaccactgcctta

SEQ ID NO: 51894 - DNA, 20 bp, synthetic construct
  misc_feature 1..20: note = CRISPR gRNA sequence
  source 1..20: mol_type = other DNA
ggaaaccactgccttagaga

SEQ ID NO: 51895 - DNA, 20 bp, synthetic construct
  misc_feature 1..20: note = CRISPR gRNA sequence
  source 1..20: mol_type = other DNA
accactgccttagagaaagt

SEQ ID NO: 51896 - DNA, 20 bp, synthetic construct
  misc_feature 1..20: note = CRISPR gRNA sequence
  source 1..20: mol_type = other DNA
ctgccttagagaaagtgaga

SEQ ID NO: 51897 - DNA, 20 bp, synthetic construct
  misc_feature 1..20: note = CRISPR gRNA sequence
  source 1..20: mol_type = other DNA
tgccttagagaaagtgagat

SEQ ID NO: 51898 - DNA, 20 bp, synthetic construct
  misc_feature 1..20: note = CRISPR gRNA sequence
  source 1..20: mol_type = other DNA
agatgggtccactctgccct

SEQ ID NO: 51899 - DNA, 20 bp, synthetic construct
  misc_feature 1..20: note = CRISPR gRNA sequence
  source 1..20: mol_type = other DNA
atgggtccactctgccctca

SEQ ID NO: 51900 - DNA, 20 bp, synthetic construct
  misc_feature 1..20: note = CRISPR gRNA sequence
  source 1..20: mol_type = other DNA
tgggtccactctgccctcag

SEQ ID NO: 51901 - DNA, 20 bp, synthetic construct
  misc_feature 1..20: note = CRISPR gRNA sequence
  source 1..20: mol_type = other DNA
gtccactctgccctcagagg

SEQ ID NO: 51902 - DNA, 20 bp, synthetic construct
  misc_feature 1..20: note = CRISPR gRNA sequence
  source 1..20: mol_type = other DNA
tctgccctcagaggcagcct

SEQ ID NO: 51903 - DNA, 20 bp, synthetic construct
  misc_feature 1..20: note = CRISPR gRNA sequence
  source 1..20: mol_type = other DNA
gcacctccatttgcctcatc

SEQ ID NO: 51904 - DNA, 20 bp, synthetic construct
  misc_feature 1..20: note = CRISPR gRNA sequence
  source 1..20: mol_type = other DNA
tcatccagtaatccccctat

SEQ ID NO: 51905 - DNA, 20 bp, synthetic construct
  misc_feature 1..20: note = CRISPR gRNA sequence
  source 1..20: mol_type = other DNA
tgtctgtaaattccactctc

SEQ ID NO: 51906 - DNA, 20 bp, synthetic construct
  misc_feature 1..20: note = CRISPR gRNA sequence
  source 1..20: mol_type = other DNA
ccactctcaagatccaccct

SEQ ID NO: 51907 - DNA, 20 bp, synthetic construct
  misc_feature 1..20: note = CRISPR gRNA sequence
  source 1..20: mol_type = other DNA
taccaacttctatcccaccc

SEQ ID NO: 51908 - DNA, 20 bp, synthetic construct
  misc_feature 1..20: note = CRISPR gRNA sequence
  source 1..20: mol_type = other DNA
caacttctatcccaccccag

SEQ ID NO: 51909 - DNA, 20 bp, synthetic construct
  misc_feature 1..20: note = CRISPR gRNA sequence
  source 1..20: mol_type = other DNA
tatcccaccccagcagtgat

SEQ ID NO: 51910 - DNA, 20 bp, synthetic construct
  misc_feature 1..20: note = CRISPR gRNA sequence
  source 1..20: mol_type = other DNA
ccccagcagtgatcagcccc

SEQ ID NO: 51911 - DNA, 20 bp, synthetic construct
  misc_feature 1..20: note = CRISPR gRNA sequence
  source 1..20: mol_type = other DNA
ctcccaatccattctctacc

SEQ ID NO: 51912 - DNA, 20 bp, synthetic construct
  misc_feature 1..20: note = CRISPR gRNA sequence
  source 1..20: mol_type = other DNA
tccattctctacccagcact

SEQ ID NO: 51913 - DNA, 20 bp, synthetic construct
  misc_feature 1..20: note = CRISPR gRNA sequence
  source 1..20: mol_type = other DNA
gaacttttgaaaacccaaat

SEQ ID NO: 51914 - DNA, 20 bp, synthetic construct
  misc_feature 1..20: note = CRISPR gRNA sequence
  source 1..20: mol_type = other DNA
aacttttgaaaacccaaatg

SEQ ID NO: 51915 - DNA, 20 bp, synthetic construct
  misc_feature 1..20: note = CRISPR gRNA sequence
  source 1..20: mol_type = other DNA
ttgaaaacccaaatgaggaa

SEQ ID NO: 51916 - DNA, 20 bp, synthetic construct
  misc_feature 1..20: note = CRISPR gRNA sequence
  source 1..20: mol_type = other DNA
tgaaaacccaaatgaggaac

SEQ ID NO: 51917 - DNA, 20 bp, synthetic construct
  misc_feature 1..20: note = CRISPR gRNA sequence
  source 1..20: mol_type = other DNA
acccaaatgaggaacgggtg

SEQ ID NO: 51918 - DNA, 20 bp, synthetic construct
  misc_feature 1..20: note = CRISPR gRNA sequence
  source 1..20: mol_type = other DNA
caaatgaggaacgggtgcag

SEQ ID NO: 51919 - DNA, 20 bp, synthetic construct
  misc_feature 1..20: note = CRISPR gRNA sequence
  source 1..20: mol_type = other DNA
gtggctcctgcctgtaatct

SEQ ID NO: 51920 - DNA, 20 bp, synthetic construct
  misc_feature 1..20: note = CRISPR gRNA sequence
  source 1..20: mol_type = other DNA
tgcctgtaatctcagtactt

SEQ ID NO: 51921 - DNA, 20 bp, synthetic construct
  misc_feature 1..20: note = CRISPR gRNA sequence
  source 1..20: mol_type = other DNA
gcctgtaatctcagtacttt

SEQ ID NO: 51922 - DNA, 20 bp, synthetic construct
  misc_feature 1..20: note = CRISPR gRNA sequence
  source 1..20: mol_type = other DNA
tgtaatctcagtactttggg

SEQ ID NO: 51923 - DNA, 20 bp, synthetic construct
  misc_feature 1..20: note = CRISPR gRNA sequence
  source 1..20: mol_type = other DNA
tctcagtactttgggaagcc

SEQ ID NO: 51924 - DNA, 20 bp, synthetic construct
  misc_feature 1..20: note = CRISPR gRNA sequence
  source 1..20: mol_type = other DNA
ctcagtactttgggaagccg

SEQ ID NO: 51925 - DNA, 20 bp, synthetic construct
  misc_feature 1..20: note = CRISPR gRNA sequence
  source 1..20: mol_type = other DNA
agtactttgggaagccgagg

SEQ ID NO: 51926 - DNA, 20 bp, synthetic construct
  misc_feature 1..20: note = CRISPR gRNA sequence
  source 1..20: mol_type = other DNA
gtactttgggaagccgaggc

SEQ ID NO: 51927 - DNA, 20 bp, synthetic construct
  misc_feature 1..20: note = CRISPR gRNA sequence
  source 1..20: mol_type = other DNA
ctttgggaagccgaggcggg

SEQ ID NO: 51928 - DNA, 20 bp, synthetic construct
  misc_feature 1..20: note = CRISPR gRNA sequence
  source 1..20: mol_type = other DNA
ccgaggcgggcggatcactt

SEQ ID NO: 51929 - DNA, 20 bp, synthetic construct
  misc_feature 1..20: note = CRISPR gRNA sequence
  source 1..20: mol_type = other DNA
cgaggcgggcggatcacttg

SEQ ID NO: 51930 - DNA, 20 bp, synthetic construct
  misc_feature 1..20: note = CRISPR gRNA sequence
  source 1..20: mol_type = other DNA
gcgggcggatcacttgaggt

SEQ ID NO: 51931 - DNA, 20 bp, synthetic construct
  misc_feature 1..20: note = CRISPR gRNA sequence
  source 1..20: mol_type = other DNA
cgggcggatcacttgaggtc

SEQ ID NO: 51932 - DNA, 20 bp, synthetic construct
  misc_feature 1..20: note = CRISPR gRNA sequence
  source 1..20: mol_type = other DNA
ggcggatcacttgaggtcgg

SEQ ID NO: 51933 - DNA, 20 bp, synthetic construct
  misc_feature 1..20: note = CRISPR gRNA sequence
  source 1..20: mol_type = other DNA
tcacttgaggtcgggagttt

SEQ ID NO: 51934 - DNA, 20 bp, synthetic construct
  misc_feature 1..20: note = CRISPR gRNA sequence
  source 1..20: mol_type = other DNA
tgaggtcgggagtttgagac

SEQ ID NO: 51935 - DNA, 20 bp, synthetic construct
  misc_feature 1..20: note = CRISPR gRNA sequence
  source 1..20: mol_type = other DNA
tcgggagtttgagaccagca

SEQ ID NO: 51936 - DNA, 20 bp, synthetic construct
  misc_feature 1..20: note = CRISPR gRNA sequence
  source 1..20: mol_type = other DNA
tgagaccagcatggtcaaca

SEQ ID NO: 51937 - DNA, 20 bp, synthetic construct
  misc_feature 1..20: note = CRISPR gRNA sequence
  source 1..20: mol_type = other DNA
tctactaaaaatacaaaaat

SEQ ID NO: 51938 - DNA, 20 bp, synthetic construct
  misc_feature 1..20: note = CRISPR gRNA sequence
  source 1..20: mol_type = other DNA
ctaaaaatacaaaaattagc

SEQ ID NO: 51939 - DNA, 20 bp, synthetic construct
  misc_feature 1..20: note = CRISPR gRNA sequence
  source 1..20: mol_type = other DNA
taaaaatacaaaaattagct

SEQ ID NO: 51940 - DNA, 20 bp, synthetic construct
  misc_feature 1..20: note = CRISPR gRNA sequence
  source 1..20: mol_type = other DNA
caaaaattagctgggcatga

SEQ ID NO: 51941 - DNA, 20 bp, synthetic construct
  misc_feature 1..20: note = CRISPR gRNA sequence
  source 1..20: mol_type = other DNA
atggtgcacgcctgtaatcc

SEQ ID NO: 51942 - DNA, 20 bp, synthetic construct
  misc_feature 1..20: note = CRISPR gRNA sequence
  source 1..20: mol_type = other DNA
cgcctgtaatcccagctact

SEQ ID NO: 51943 - DNA, 20 bp, synthetic construct
  misc_feature 1..20: note = CRISPR gRNA sequence
  source 1..20: mol_type = other DNA
gcctgtaatcccagctactt

SEQ ID NO: 51944 - DNA, 20 bp, synthetic construct
  misc_feature 1..20: note = CRISPR gRNA sequence
  source 1..20: mol_type = other DNA
ctgtaatcccagctacttgg

SEQ ID NO: 51945 - DNA, 20 bp, synthetic construct
  misc_feature 1..20: note = CRISPR gRNA sequence
  source 1..20: mol_type = other DNA
tgtaatcccagctacttggg

SEQ ID NO: 51946 - DNA, 20 bp, synthetic construct
  misc_feature 1..20: note = CRISPR gRNA sequence
  source 1..20: mol_type = other DNA
tcccagctacttgggaggct

SEQ ID NO: 51947 - DNA, 20 bp, synthetic construct
  misc_feature 1..20: note = CRISPR gRNA sequence
  source 1..20: mol_type = other DNA
cccagctacttgggaggctg

SEQ ID NO: 51948 - DNA, 20 bp, synthetic construct
  misc_feature 1..20: note = CRISPR gRNA sequence
  source 1..20: mol_type = other DNA
tacttgggaggctgaggcac

SEQ ID NO: 51949 - DNA, 20 bp, synthetic construct
  misc_feature 1..20: note = CRISPR gRNA sequence
  source 1..20: mol_type = other DNA
gcacaagaattgcctgaacc

SEQ ID NO: 51950 - DNA, 20 bp, synthetic construct
  misc_feature 1..20: note = CRISPR gRNA sequence
  source 1..20: mol_type = other DNA
cacaagaattgcctgaacct

SEQ ID NO: 51951 - DNA, 20 bp, synthetic construct
  misc_feature 1..20: note = CRISPR gRNA sequence
  source 1..20: mol_type = other DNA
caagaattgcctgaacctgg

SEQ ID NO: 51952 - DNA, 20 bp, synthetic construct
  misc_feature 1..20: note = CRISPR gRNA sequence
  source 1..20: mol_type = other DNA
aagaattgcctgaacctggg

SEQ ID NO: 51953 - DNA, 20 bp, synthetic construct
  misc_feature 1..20: note = CRISPR gRNA sequence
  source 1..20: mol_type = other DNA
aattgcctgaacctgggagg

SEQ ID NO: 51954 - DNA, 20 bp, synthetic construct
  misc_feature 1..20: note = CRISPR gRNA sequence
  source 1..20: mol_type = other DNA
ttgcctgaacctgggaggcg

SEQ ID NO: 51955 - DNA, 20 bp, synthetic construct
  misc_feature 1..20: note = CRISPR gRNA sequence
  source 1..20: mol_type = other DNA
tgcctgaacctgggaggcgg

SEQ ID NO: 51956 - DNA, 20 bp, synthetic construct
  misc_feature 1..20: note = CRISPR gRNA sequence
  source 1..20: mol_type = other DNA
aacctgggaggcggaggttg

SEQ ID NO: 51957 - DNA, 20 bp, synthetic construct
  misc_feature 1..20: note = CRISPR gRNA sequence
  source 1..20: mol_type = other DNA
tgggaggcggaggttgcagt

SEQ ID NO: 51958 - DNA, 20 bp, synthetic construct
  misc_feature 1..20: note = CRISPR gRNA sequence
  source 1..20: mol_type = other DNA
ggcggaggttgcagtgagcc

SEQ ID NO: 51959 - DNA, 20 bp, synthetic construct
  misc_feature 1..20: note = CRISPR gRNA sequence
  source 1..20: mol_type = other DNA
gagattgcgccattgcactc

SEQ ID NO: 51960 - DNA, 20 bp, synthetic construct
  misc_feature 1..20: note = CRISPR gRNA sequence
  source 1..20: mol_type = other DNA
ttgcactccagcctgtgtga

SEQ ID NO: 51961 - DNA, 20 bp, synthetic construct
  misc_feature 1..20: note = CRISPR gRNA sequence
  source 1..20: mol_type = other DNA
gcactccagcctgtgtgaca

SEQ ID NO: 51962 - DNA, 20 bp, synthetic construct
  misc_feature 1..20: note = CRISPR gRNA sequence
  source 1..20: mol_type = other DNA
tccagcctgtgtgacagagc

SEQ ID NO: 51963 - DNA, 20 bp, synthetic construct
  misc_feature 1..20: note = CRISPR gRNA sequence
  source 1..20: mol_type = other DNA
cgagaccctcccccacaaaa

SEQ ID NO: 51964 - DNA, 20 bp, synthetic construct
  misc_feature 1..20: note = CRISPR gRNA sequence
  source 1..20: mol_type = other DNA
accctcccccacaaaaaaga

SEQ ID NO: 51965 - DNA, 20 bp, synthetic construct
  misc_feature 1..20: note = CRISPR gRNA sequence
  source 1..20: mol_type = other DNA
tcccccacaaaaaagaaaga

SEQ ID NO: 51966 - DNA, 20 bp, synthetic construct
  misc_feature 1..20: note = CRISPR gRNA sequence
  source 1..20: mol_type = other DNA
tcctctccctttcatgttcc

SEQ ID NO: 51967 - DNA, 20 bp, synthetic construct
  misc_feature 1..20: note = CRISPR gRNA sequence
  source 1..20: mol_type = other DNA
cctctccctttcatgttccc

SEQ ID NO: 51968 - DNA, 20 bp, synthetic construct
  misc_feature 1..20: note = CRISPR gRNA sequence
  source 1..20: mol_type = other DNA
tttcatgttcccaggaacaa

SEQ ID NO: 51969 - DNA, 20 bp, synthetic construct
  misc_feature 1..20: note = CRISPR gRNA sequence
  source 1..20: mol_type = other DNA
aaaagtctaaactctcccca

SEQ ID NO: 51970 - DNA, 20 bp, synthetic construct
  misc_feature 1..20: note = CRISPR gRNA sequence
  source 1..20: mol_type = other DNA
aaagtctaaactctccccat

SEQ ID NO: 51971 - DNA, 20 bp, synthetic construct
  misc_feature 1..20: note = CRISPR gRNA sequence
  source 1..20: mol_type = other DNA
taaactctccccatgggtgc

SEQ ID NO: 51972 - DNA, 20 bp, synthetic construct
  misc_feature 1..20: note = CRISPR gRNA sequence
  source 1..20: mol_type = other DNA
aaactctccccatgggtgcc

SEQ ID NO: 51973 - DNA, 20 bp, synthetic construct
  misc_feature 1..20: note = CRISPR gRNA sequence
  source 1..20: mol_type = other DNA
ggccccatgcaacccaaccc

SEQ ID NO: 51974 - DNA, 20 bp, synthetic construct
  misc_feature 1..20: note = CRISPR gRNA sequence
  source 1..20: mol_type = other DNA
tctctctcttcctcctctcc

SEQ ID NO: 51975 - DNA, 20 bp, synthetic construct
  misc_feature 1..20: note = CRISPR gRNA sequence
  source 1..20: mol_type = other DNA
ctctctcttcctcctctcct

SEQ ID NO: 51976 - DNA, 20 bp, synthetic construct
  misc_feature 1..20: note = CRISPR gRNA sequence
  source 1..20: mol_type = other DNA
tctcctaggactgtccctgc

SEQ ID NO: 51977 - DNA, 20 bp, synthetic construct
  misc_feature 1..20: note = CRISPR gRNA sequence
  source 1..20: mol_type = other DNA
ccctgccagtcactgtgctc

SEQ ID NO: 51978 - DNA, 20 bp, synthetic construct
  misc_feature 1..20: note = CRISPR gRNA sequence
  source 1..20: mol_type = other DNA
tcactgtgctctggctgtct

SEQ ID NO: 51979 - DNA, 20 bp, synthetic construct
  misc_feature 1..20: note = CRISPR gRNA sequence
  source 1..20: mol_type = other DNA
tctcggttccgcgctgttcc

SEQ ID NO: 51980 - DNA, 20 bp, synthetic construct
  misc_feature 1..20: note = CRISPR gRNA sequence
  source 1..20: mol_type = other DNA
tcggttccgcgctgttcctg

SEQ ID NO: 51981 - DNA, 20 bp, synthetic construct
  misc_feature 1..20: note = CRISPR gRNA sequence
  source 1..20: mol_type = other DNA
cgctgttcctggagcccacc

SEQ ID NO: 51982 - DNA, 20 bp, synthetic construct
  misc_feature 1..20: note = CRISPR gRNA sequence
  source 1..20: mol_type = other DNA
caccaagcttaatcatgcct

SEQ ID NO: 51983 - DNA, 20 bp, synthetic construct
  misc_feature 1..20: note = CRISPR gRNA sequence
  source 1..20: mol_type = other DNA
accaagcttaatcatgcctc

SEQ ID NO: 51984 - DNA, 20 bp, synthetic construct
  misc_feature 1..20: note = CRISPR gRNA sequence
  source 1..20: mol_type = other DNA
ccaagcttaatcatgcctca

SEQ ID NO: 51985 - DNA, 20 bp, synthetic construct
  misc_feature 1..20: note = CRISPR gRNA sequence
  source 1..20: mol_type = other DNA
cacatgccgttccctctgcc

SEQ ID NO: 51986 - DNA, 20 bp, synthetic construct
  misc_feature 1..20: note = CRISPR gRNA sequence
  source 1..20: mol_type = other DNA
cgttccctctgcctggaatg

SEQ ID NO: 51987 - DNA, 20 bp, synthetic construct
  misc_feature 1..20: note = CRISPR gRNA sequence
  source 1..20: mol_type = other DNA
tgcagttccctgctcttcac

SEQ ID NO: 51988 - DNA, 20 bp, synthetic construct
  misc_feature 1..20: note = CRISPR gRNA sequence
  source 1..20: mol_type = other DNA
gcagttccctgctcttcaca

SEQ ID NO: 51989 - DNA, 20 bp, synthetic construct
  misc_feature 1..20: note = CRISPR gRNA sequence
  source 1..20: mol_type = other DNA
ttccctgctcttcacaaggc

SEQ ID NO: 51990 - DNA, 20 bp, synthetic construct
  misc_feature 1..20: note = CRISPR gRNA sequence
  source 1..20: mol_type = other DNA
gcgagctctctctcttcctt

SEQ ID NO: 51991 - DNA, 20 bp, synthetic construct
  misc_feature 1..20: note = CRISPR gRNA sequence
  source 1..20: mol_type = other DNA
cgagctctctctcttccttt

SEQ ID NO: 51992 - DNA, 20 bp, synthetic construct
  misc_feature 1..20: note = CRISPR gRNA sequence
  source 1..20: mol_type = other DNA
ctctctcttcctttaggtcc

SEQ ID NO: 51993 - DNA, 20 bp, synthetic construct
  misc_feature 1..20: note = CRISPR gRNA sequence
  source 1..20: mol_type = other DNA
tcttcctttaggtcccagct

SEQ ID NO: 51994 - DNA, 20 bp, synthetic construct
  misc_feature 1..20: note = CRISPR gRNA sequence
  source 1..20: mol_type = other DNA
cccagctcagcatccctcct

SEQ ID NO: 51995 - DNA, 20 bp, synthetic construct
  misc_feature 1..20: note = CRISPR gRNA sequence
  source 1..20: mol_type = other DNA
cagctcagcatccctcctca

SEQ ID NO: 51996 - DNA, 20 bp, synthetic construct
  misc_feature 1..20: note = CRISPR gRNA sequence
  source 1..20: mol_type = other DNA
tcctcagagatgttccctga

SEQ ID NO: 51997 - DNA, 20 bp, synthetic construct
  misc_feature 1..20: note = CRISPR gRNA sequence
  source 1..20: mol_type = other DNA
ccacatctaaatcacctctc

SEQ ID NO: 51998 - DNA, 20 bp, synthetic construct
  misc_feature 1..20: note = CRISPR gRNA sequence
  source 1..20: mol_type = other DNA
gccactcttcaccacatccc

SEQ ID NO: 51999 - DNA, 20 bp, synthetic construct
  misc_feature 1..20: note = CRISPR gRNA sequence
  source 1..20: mol_type = other DNA
cgagaaaattctcttatcac

SEQ ID NO: 52000 - DNA, 20 bp, synthetic construct
  misc_feature 1..20: note = CRISPR gRNA sequence
  source 1..20: mol_type = other DNA
aaattctcttatcactggct

SEQ ID NO: 52001 - DNA, 20 bp, synthetic construct
  misc_feature 1..20: note = CRISPR gRNA sequence
  source 1..20: mol_type = other DNA
attttactttacttattttt

SEQ ID NO: 52002 - DNA, 20 bp, synthetic construct
  misc_feature 1..20: note = CRISPR gRNA sequence
  source 1..20: mol_type = other DNA
ttttcagctcccactattgt

SEQ ID NO: 52003 - DNA, 20 bp, synthetic construct
  misc_feature 1..20: note = CRISPR gRNA sequence
  source 1..20: mol_type = other DNA
ttcagctcccactattgtaa

SEQ ID NO: 52004 - DNA, 20 bp, synthetic construct
  misc_feature 1..20: note = CRISPR gRNA sequence
  source 1..20: mol_type = other DNA
tcagctcccactattgtaag

SEQ ID NO: 52005 - DNA, 20 bp, synthetic construct
  misc_feature 1..20: note = CRISPR gRNA sequence
  source 1..20: mol_type = other DNA
agctcccactattgtaagag

SEQ ID NO: 52006 - DNA, 20 bp, synthetic construct
  misc_feature 1..20: note = CRISPR gRNA sequence
  source 1..20: mol_type = other DNA
actattgtaagaggagctcc

SEQ ID NO: 52007 - DNA, 20 bp, synthetic construct
  misc_feature 1..20: note = CRISPR gRNA sequence
  source 1..20: mol_type = other DNA
attgtaagaggagctccaag

SEQ ID NO: 52008 - DNA, 20 bp, synthetic construct
  misc_feature 1..20: note = CRISPR gRNA sequence
  source 1..20: mol_type = other DNA
aagaggagctccaagaagat

SEQ ID NO: 52009 - DNA, 20 bp, synthetic construct
  misc_feature 1..20: note = CRISPR gRNA sequence
  source 1..20: mol_type = other DNA
agaggagctccaagaagata

SEQ ID NO: 52010 - DNA, 20 bp, synthetic construct
  misc_feature 1..20: note = CRISPR gRNA sequence
  source 1..20: mol_type = other DNA
gctccaagaagataaggaca

SEQ ID NO: 52011 - DNA, 20 bp, synthetic construct
  misc_feature 1..20: note = CRISPR gRNA sequence
  source 1..20: mol_type = other DNA
ctgtgtcgtcacacaatgcc

SEQ ID NO: 52012 - DNA, 20 bp, synthetic construct
  misc_feature 1..20: note = CRISPR gRNA sequence
  source 1..20: mol_type = other DNA
gtcacacaatgcctggccca

SEQ ID NO: 52013 - DNA, 20 bp, synthetic construct
  misc_feature 1..20: note = CRISPR gRNA sequence
  source 1..20: mol_type = other DNA
acacaatgcctggcccacag

SEQ ID NO: 52014 - DNA, 20 bp, synthetic construct
  misc_feature 1..20: note = CRISPR gRNA sequence
  source 1..20: mol_type = other DNA
cacaatgcctggcccacagt

SEQ ID NO: 52015 - DNA, 20 bp, synthetic construct
  misc_feature 1..20: note = CRISPR gRNA sequence
  source 1..20: mol_type = other DNA
acaatgcctggcccacagta

SEQ ID NO: 52016 - DNA, 20 bp, synthetic construct
  misc_feature 1..20: note = CRISPR gRNA sequence
  source 1..20: mol_type = other DNA
ctggcccacagtagggccac

SEQ ID NO: 52017 - DNA, 20 bp, synthetic construct
  misc_feature 1..20: note = CRISPR gRNA sequence
  source 1..20: mol_type = other DNA
ggccacaagcactacacgtt

SEQ ID NO: 52018 - DNA, 20 bp, synthetic construct
  misc_feature 1..20: note = CRISPR gRNA sequence
  source 1..20: mol_type = other DNA
actacacgttgagtactaca

SEQ ID NO: 52019 - DNA, 20 bp, synthetic construct
  misc_feature 1..20: note = CRISPR gRNA sequence
  source 1..20: mol_type = other DNA
gtactacaaagtttaaaccc

SEQ ID NO: 52020 - DNA, 20 bp, synthetic construct
  misc_feature 1..20: note = CRISPR gRNA sequence
  source 1..20: mol_type = other DNA
tacaaagtttaaaccctggc

SEQ ID NO: 52021 - DNA, 20 bp, synthetic construct
  misc_feature 1..20: note = CRISPR gRNA sequence
  source 1..20: mol_type = other DNA
acaaagtttaaaccctggca

SEQ ID NO: 52022 - DNA, 20 bp, synthetic construct
  misc_feature 1..20: note = CRISPR gRNA sequence
  source 1..20: mol_type = other DNA
caaagtttaaaccctggcaa

SEQ ID NO: 52023 - DNA, 20 bp, synthetic construct
  misc_feature 1..20: note = CRISPR gRNA sequence
  source 1..20: mol_type = other DNA
aaagtttaaaccctggcaag

SEQ ID NO: 52024 - DNA, 20 bp, synthetic construct
  misc_feature 1..20: note = CRISPR gRNA sequence
  source 1..20: mol_type = other DNA
tttaaaccctggcaaggggt

SEQ ID NO: 52025 - DNA, 20 bp, synthetic construct
  misc_feature 1..20: note = CRISPR gRNA sequence
  source 1..20: mol_type = other DNA
ttaaaccctggcaaggggtc

SEQ ID NO: 52026 - DNA, 20 bp, synthetic construct
  misc_feature 1..20: note = CRISPR gRNA sequence
  source 1..20: mol_type = other DNA
accctggcaaggggtcaggc

SEQ ID NO: 52027 - DNA, 20 bp, synthetic construct
  misc_feature 1..20: note = CRISPR gRNA sequence
  source 1..20: mol_type = other DNA
aggctggccacgccactcca

SEQ ID NO: 52028 - DNA, 20 bp, synthetic construct
  misc_feature 1..20: note = CRISPR gRNA sequence
  source 1..20: mol_type = other DNA
ggctggccacgccactccaa

SEQ ID NO: 52029 - DNA, 20 bp, synthetic construct
  misc_feature 1..20: note = CRISPR gRNA sequence
  source 1..20: mol_type = other DNA
tggccacgccactccaaagg

SEQ ID NO: 52030 - DNA, 20 bp, synthetic construct
  misc_feature 1..20: note = CRISPR gRNA sequence
  source 1..20: mol_type = other DNA
acgccactccaaaggcggac

SEQ ID NO: 52031 - DNA, 20 bp, synthetic construct
  misc_feature 1..20: note = CRISPR gRNA sequence
  source 1..20: mol_type = other DNA
cgccactccaaaggcggacg

SEQ ID NO: 52032 - DNA, 20 bp, synthetic construct
  misc_feature 1..20: note = CRISPR gRNA sequence
  source 1..20: mol_type = other DNA
ccactccaaaggcggacgag

SEQ ID NO: 52033 - DNA, 20 bp, synthetic construct
  misc_feature 1..20: note = CRISPR gRNA sequence
  source 1..20: mol_type = other DNA
tccaaaggcggacgaggagt

SEQ ID NO: 52034 - DNA, 20 bp, synthetic construct
  misc_feature 1..20: note = CRISPR gRNA sequence
  source 1..20: mol_type = other DNA
ccaaaggcggacgaggagtc

SEQ ID NO: 52035 - DNA, 20 bp, synthetic construct
  misc_feature 1..20: note = CRISPR gRNA sequence
  source 1..20: mol_type = other DNA
caaaggcggacgaggagtca

SEQ ID NO: 52036 - DNA, 20 bp, synthetic construct
  misc_feature 1..20: note = CRISPR gRNA sequence
  source 1..20: mol_type = other DNA
aaaggcggacgaggagtcag

SEQ ID NO: 52037 - DNA, 20 bp, synthetic construct
  misc_feature 1..20: note = CRISPR gRNA sequence
  source 1..20: mol_type = other DNA
cggacgaggagtcaggggtg

SEQ ID NO: 52038 - DNA, 20 bp, synthetic construct
  misc_feature 1..20: note = CRISPR gRNA sequence
  source 1..20: mol_type = other DNA
aggggtgaagctgtgtgatt

SEQ ID NO: 52039 - DNA, 20 bp, synthetic construct
  misc_feature 1..20: note = CRISPR gRNA sequence
  source 1..20: mol_type = other DNA
ggggtgaagctgtgtgattt

SEQ ID NO: 52040 - DNA, 20 bp, synthetic construct
  misc_feature 1..20: note = CRISPR gRNA sequence
  source 1..20: mol_type = other DNA
gaagctgtgtgatttaggca

SEQ ID NO: 52041 - DNA, 20 bp, synthetic construct
  misc_feature 1..20: note = CRISPR gRNA sequence
  source 1..20: mol_type = other DNA
agctgtgtgatttaggcaaa

SEQ ID NO: 52042 - DNA, 20 bp, synthetic construct
  misc_feature 1..20: note = CRISPR gRNA sequence
  source 1..20: mol_type = other DNA
tgtgtgatttaggcaaagag

SEQ ID NO: 52043 - DNA, 20 bp, synthetic construct
  misc_feature 1..20: note = CRISPR gRNA sequence
  source 1..20: mol_type = other DNA
ggcaaagagaagttcctctc

SEQ ID NO: 52044 - DNA, 20 bp, synthetic construct
  misc_feature 1..20: note = CRISPR gRNA sequence
  source 1..20: mol_type = other DNA
gagaagttcctctccggtct

SEQ ID NO: 52045 - DNA, 20 bp, synthetic construct
  misc_feature 1..20: note = CRISPR gRNA sequence
  source 1..20: mol_type = other DNA
agaagttcctctccggtctg

SEQ ID NO: 52046 - DNA, 20 bp, synthetic construct
  misc_feature 1..20: note = CRISPR gRNA sequence
  source 1..20: mol_type = other DNA
cctgccaccttttatgtcca

SEQ ID NO: 52047 - DNA, 20 bp, synthetic construct
  misc_feature 1..20: note = CRISPR gRNA sequence
  source 1..20: mol_type = other DNA
ctgccaccttttatgtccaa

SEQ ID NO: 52048 - DNA, 20 bp, synthetic construct
  misc_feature 1..20: note = CRISPR gRNA sequence
  source 1..20: mol_type = other DNA
gccaccttttatgtccaaag

SEQ ID NO: 52049 - DNA, 20 bp, synthetic construct
  misc_feature 1..20: note = CRISPR gRNA sequence
  source 1..20: mol_type = other DNA
cctttctgactcattatctc

SEQ ID NO: 52050 - DNA, 20 bp, synthetic construct
  misc_feature 1..20: note = CRISPR gRNA sequence
  source 1..20: mol_type = other DNA
ctttctgactcattatctcc

SEQ ID NO: 52051 - DNA, 20 bp, synthetic construct
  misc_feature 1..20: note = CRISPR gRNA sequence
  source 1..20: mol_type = other DNA
tctgactcattatctccggg

SEQ ID NO: 52052 - DNA, 20 bp, synthetic construct
  misc_feature 1..20: note = CRISPR gRNA sequence
  source 1..20: mol_type = other DNA
ctgactcattatctccgggc

SEQ ID NO: 52053 - DNA, 20 bp, synthetic construct
  misc_feature 1..20: note = CRISPR gRNA sequence
  source 1..20: mol_type = other DNA
tgactcattatctccgggca

SEQ ID NO: 52054 - DNA, 20 bp, synthetic construct
  misc_feature 1..20: note = CRISPR gRNA sequence
  source 1..20: mol_type = other DNA
ctcattatctccgggcaggg

SEQ ID NO: 52055 - DNA, 20 bp, synthetic construct
  misc_feature 1..20: note = CRISPR gRNA sequence
  source 1..20: mol_type = other DNA
tcattatctccgggcagggt

SEQ ID NO: 52056 - DNA, 20 bp, synthetic construct
  misc_feature 1..20: note = CRISPR gRNA sequence
  source 1..20: mol_type = other DNA
cgggcagggtgggactatta

SEQ ID NO: 52057 - DNA, 20 bp, synthetic construct
  misc_feature 1..20: note = CRISPR gRNA sequence
  source 1..20: mol_type = other DNA
gggcagggtgggactattac

SEQ ID NO: 52058 - DNA, 20 bp, synthetic construct
  misc_feature 1..20: note = CRISPR gRNA sequence
  source 1..20: mol_type = other DNA
ggcagggtgggactattaca

SEQ ID NO: 52059 - DNA, 20 bp, synthetic construct
  misc_feature 1..20: note = CRISPR gRNA sequence
  source 1..20: mol_type = other DNA
gggactattacagggtgcca

SEQ ID NO: 52060 - DNA, 20 bp, synthetic construct
  misc_feature 1..20: note = CRISPR gRNA sequence
  source 1..20: mol_type = other DNA
ggactattacagggtgccat

SEQ ID NO: 52061 - DNA, 20 bp, synthetic construct
  misc_feature 1..20: note = CRISPR gRNA sequence
  source 1..20: mol_type = other DNA
gactattacagggtgccatg

SEQ ID NO: 52062 - DNA, 20 bp, synthetic construct
  misc_feature 1..20: note = CRISPR gRNA sequence
  source 1..20: mol_type = other DNA
agggtgccatggggtgctgt

SEQ ID NO: 52063 - DNA, 20 bp, synthetic construct
  misc_feature 1..20: note = CRISPR gRNA sequence
  source 1..20: mol_type = other DNA
tgccatggggtgctgtgagc

SEQ ID NO: 52064 - DNA, 20 bp, synthetic construct
  misc_feature 1..20: note = CRISPR gRNA sequence
  source 1..20: mol_type = other DNA
gccatggggtgctgtgagct

SEQ ID NO: 52065 - DNA, 20 bp, synthetic construct
  misc_feature 1..20: note = CRISPR gRNA sequence
  source 1..20: mol_type = other DNA
agctgggctgtacttgcccc

SEQ ID NO: 52066 - DNA, 20 bp, synthetic construct
  misc_feature 1..20: note = CRISPR gRNA sequence
  source 1..20: mol_type = other DNA
cacgtctcctccctccctcc

SEQ ID NO: 52067 - DNA, 20 bp, synthetic construct
  misc_feature 1..20: note = CRISPR gRNA sequence
  source 1..20: mol_type = other DNA
ctccctcccagataaaaccc

SEQ ID NO: 52068 - DNA, 20 bp, synthetic construct
  misc_feature 1..20: note = CRISPR gRNA sequence
  source 1..20: mol_type = other DNA
cccagataaaacccaagcat

SEQ ID NO: 52069 - DNA, 20 bp, synthetic construct
  misc_feature 1..20: note = CRISPR gRNA sequence
  source 1..20: mol_type = other DNA
gataaaacccaagcataagc

SEQ ID NO: 52070 - DNA, 20 bp, synthetic construct
  misc_feature 1..20: note = CRISPR gRNA sequence
  source 1..20: mol_type = other DNA
cccaagcataagcgagatcc

SEQ ID NO: 52071 - DNA, 20 bp, synthetic construct
  misc_feature 1..20: note = CRISPR gRNA sequence
  source 1..20: mol_type = other DNA
caagcataagcgagatcctg

SEQ ID NO: 52072 - DNA, 20 bp, synthetic construct
  misc_feature 1..20: note = CRISPR gRNA sequence
  source 1..20: mol_type = other DNA
aagcataagcgagatcctgg

SEQ ID NO: 52073 - DNA, 20 bp, synthetic construct
  misc_feature 1..20: note = CRISPR gRNA sequence
  source 1..20: mol_type = other DNA
cgagatcctggaggtgatgc

SEQ ID NO: 52074 - DNA, 20 bp, synthetic construct
  misc_feature 1..20: note = CRISPR gRNA sequence
  source 1..20: mol_type = other DNA
ggaggtgatgcgagccatct

SEQ ID NO: 52075 - DNA, 20 bp, synthetic construct
  misc_feature 1..20: note = CRISPR gRNA sequence
  source 1..20: mol_type = other DNA
gcgagccatcttagacatcc

SEQ ID NO: 52076 - DNA, 20 bp, synthetic construct
  misc_feature 1..20: note = CRISPR gRNA sequence
  source 1..20: mol_type = other DNA
gagccatcttagacatccca

SEQ ID NO: 52077 - DNA, 20 bp, synthetic construct
  misc_feature 1..20: note = CRISPR gRNA sequence
  source 1..20: mol_type = other DNA
gccatcttagacatcccaga

SEQ ID NO: 52078 - DNA, 20 bp, synthetic construct
  misc_feature 1..20: note = CRISPR gRNA sequence
  source 1..20: mol_type = other DNA
ttagacatcccagagagccc

SEQ ID NO: 52079 - DNA, 20 bp, synthetic construct
  misc_feature 1..20: note = CRISPR gRNA sequence
  source 1..20: mol_type = other DNA
cctgctgtattttttcatct

SEQ ID NO: 52080 - DNA, 20 bp, synthetic construct
  misc_feature 1..20: note = CRISPR gRNA sequence
  source 1..20: mol_type = other DNA
gtattttttcatcttagctg

SEQ ID NO: 52081 - DNA, 20 bp, synthetic construct
  misc_feature 1..20: note = CRISPR gRNA sequence
  source 1..20: mol_type = other DNA
cccaccccgcctcccaccac

SEQ ID NO: 52082 - DNA, 20 bp, synthetic construct
  misc_feature 1..20: note = CRISPR gRNA sequence
  source 1..20: mol_type = other DNA
accccgcctcccaccactag

SEQ ID NO: 52083 - DNA, 20 bp, synthetic construct
  misc_feature 1..20: note = CRISPR gRNA sequence
  source 1..20: mol_type = other DNA
caccactagaagactgttta

SEQ ID NO: 52084 - DNA, 20 bp, synthetic construct
  misc_feature 1..20: note = CRISPR gRNA sequence
  source 1..20: mol_type = other DNA
ttttttctttttttttttct

SEQ ID NO: 52085 - DNA, 20 bp, synthetic construct
  misc_feature 1..20: note = CRISPR gRNA sequence
  source 1..20: mol_type = other DNA
ttctttttttttttctgaga

SEQ ID NO: 52086 - DNA, 20 bp, synthetic construct
  misc_feature 1..20: note = CRISPR gRNA sequence
  source 1..20: mol_type = other DNA
ctttttttttttctgagatg

SEQ ID NO: 52087 - DNA, 20 bp, synthetic construct
  misc_feature 1..20: note = CRISPR gRNA sequence
  source 1..20: mol_type = other DNA
gagtttcactcttgtcgccc

SEQ ID NO: 52088 - DNA, 20 bp, synthetic construct
  misc_feature 1..20: note = CRISPR gRNA sequence
  source 1..20: mol_type = other DNA
ttcactcttgtcgcccaagc

SEQ ID NO: 52089 - DNA, 20 bp, synthetic construct
  misc_feature 1..20: note = CRISPR gRNA sequence
  source 1..20: mol_type = other DNA
cactcttgtcgcccaagctg

SEQ ID NO: 52090 - DNA, 20 bp, synthetic construct
  misc_feature 1..20: note = CRISPR gRNA sequence
  source 1..20: mol_type = other DNA
tcgcccaagctggagtgcaa

SEQ ID NO: 52091 - DNA, 20 bp, synthetic construct
  misc_feature 1..20: note = CRISPR gRNA sequence
  source 1..20: mol_type = other DNA
ggagtgcaatggcgcgatct

SEQ ID NO: 52092 - DNA, 20 bp, synthetic construct
  misc_feature 1..20: note = CRISPR gRNA sequence
  source 1..20: mol_type = other DNA
cactgcaacctccgcctccc

SEQ ID NO: 52093 - DNA, 20 bp, synthetic construct
  misc_feature 1..20: note = CRISPR gRNA sequence
  source 1..20: mol_type = other DNA
aacctccgcctcccaagttc

SEQ ID NO: 52094 - DNA, 20 bp, synthetic construct
  misc_feature 1..20: note = CRISPR gRNA sequence
  source 1..20: mol_type = other DNA
ttcaagcaattctcctgcct

SEQ ID NO: 52095 - DNA, 20 bp, synthetic construct
  misc_feature 1..20: note = CRISPR gRNA sequence
  source 1..20: mol_type = other DNA
ttctcctgcctcagcctccc

SEQ ID NO: 52096 - DNA, 20 bp, synthetic construct
  misc_feature 1..20: note = CRISPR gRNA sequence
  source 1..20: mol_type = other DNA
tcctgcctcagcctcccaag

SEQ ID NO: 52097 - DNA, 20 bp, synthetic construct
  misc_feature 1..20: note = CRISPR gRNA sequence
  source 1..20: mol_type = other DNA
gcctcagcctcccaagtagc

SEQ ID NO: 52098 - DNA, 20 bp, synthetic construct
  misc_feature 1..20: note = CRISPR gRNA sequence
  source 1..20: mol_type = other DNA
ctcccaagtagctggaatta

SEQ ID NO: 52099 - DNA, 20 bp, synthetic construct
  misc_feature 1..20: note = CRISPR gRNA sequence
  source 1..20: mol_type = other DNA
tcccaagtagctggaattac

SEQ ID NO: 52100 - DNA, 20 bp, synthetic construct
  misc_feature 1..20: note = CRISPR gRNA sequence
  source 1..20: mol_type = other DNA
acaggcacccaccaccacac

SEQ ID NO: 52101 - DNA, 20 bp, synthetic construct
  misc_feature 1..20: note = CRISPR gRNA sequence
  source 1..20: mol_type = other DNA
caggcacccaccaccacacc

SEQ ID NO: 52102 - DNA, 20 bp, synthetic construct
  misc_feature 1..20: note = CRISPR gRNA sequence
  source 1..20: mol_type = other DNA
cgggctaatttttgtatttt

SEQ ID NO: 52103 - DNA, 20 bp, synthetic construct
  misc_feature 1..20: note = CRISPR gRNA sequence
  source 1..20: mol_type = other DNA
gctaatttttgtatttttag

SEQ ID NO: 52104 - DNA, 20 bp, synthetic construct
  misc_feature 1..20: note = CRISPR gRNA sequence
  source 1..20: mol_type = other DNA
taatttttgtatttttagta

SEQ ID NO: 52105 - DNA, 20 bp, synthetic construct
  misc_feature 1..20: note = CRISPR gRNA sequence
  source 1..20: mol_type = other DNA
ttttgtatttttagtagaga

SEQ ID NO: 52106 - DNA, 20 bp, synthetic construct
  misc_feature 1..20: note = CRISPR gRNA sequence
  source 1..20: mol_type = other DNA
tttgtatttttagtagagac

SEQ ID NO: 52107 - DNA, 20 bp, synthetic construct
  misc_feature 1..20: note = CRISPR gRNA sequence
  source 1..20: mol_type = other DNA
ttgtatttttagtagagacg

SEQ ID NO: 52108 - DNA, 20 bp, synthetic construct
  misc_feature 1..20: note = CRISPR gRNA sequence
  source 1..20: mol_type = other DNA
gagacggggtttcaccacat

SEQ ID NO: 52109 - DNA, 20 bp, synthetic construct
  misc_feature 1..20: note = CRISPR gRNA sequence
  source 1..20: mol_type = other DNA
cggggtttcaccacattggc

SEQ ID NO: 52110 - DNA, 20 bp, synthetic construct
  misc_feature 1..20: note = CRISPR gRNA sequence
  source 1..20: mol_type = other DNA
ggggtttcaccacattggcc

SEQ ID NO: 52111 - DNA, 20 bp, synthetic construct
  misc_feature 1..20: note = CRISPR gRNA sequence
  source 1..20: mol_type = other DNA
tttcaccacattggccaggc

SEQ ID NO: 52112 - DNA, 20 bp, synthetic construct
  misc_feature 1..20: note = CRISPR gRNA sequence
  source 1..20: mol_type = other DNA
tggtctcaaactcctgacct

SEQ ID NO: 52113 - DNA, 20 bp, synthetic construct
  misc_feature 1..20: note = CRISPR gRNA sequence
  source 1..20: mol_type = other DNA
ggtctcaaactcctgacctc

SEQ ID NO: 52114 - DNA, 20 bp, synthetic construct
  misc_feature 1..20: note = CRISPR gRNA sequence
  source 1..20: mol_type = other DNA
ctcaggtgatctgcccgcct

SEQ ID NO: 52115 - DNA, 20 bp, synthetic construct
  misc_feature 1..20: note = CRISPR gRNA sequence
  source 1..20: mol_type = other DNA
ctgcccgcctcggcctccca

SEQ ID NO: 52116 - DNA, 20 bp, synthetic construct
  misc_feature 1..20: note = CRISPR gRNA sequence
  source 1..20: mol_type = other DNA
gcctcggcctcccaaagtgc

SEQ ID NO: 52117 - DNA, 20 bp, synthetic construct
  misc_feature 1..20: note = CRISPR gRNA sequence
  source 1..20: mol_type = other DNA
cctcggcctcccaaagtgcc

SEQ ID NO: 52118 - DNA, 20 bp, synthetic construct
  misc_feature 1..20: note = CRISPR gRNA sequence
  source 1..20: mol_type = other DNA
ctcccaaagtgccgggatta

SEQ ID NO: 52119 - DNA, 20 bp, synthetic construct
  misc_feature 1..20: note = CRISPR gRNA sequence
  source 1..20: mol_type = other DNA
tcccaaagtgccgggattac

SEQ ID NO: 52120 - DNA, 20 bp, synthetic construct
  misc_feature 1..20: note = CRISPR gRNA sequence
  source 1..20: mol_type = other DNA
agtgccgggattacaggcat

SEQ ID NO: 52121 - DNA, 20 bp, synthetic construct
  misc_feature 1..20: note = CRISPR gRNA sequence
  source 1..20: mol_type = other DNA
caggcatgagccaccacaca

SEQ ID NO: 52122 - DNA, 20 bp, synthetic construct
  misc_feature 1..20: note = CRISPR gRNA sequence
  source 1..20: mol_type = other DNA
aatacttttaaaattctaac

SEQ ID NO: 52123 - DNA, 20 bp, synthetic construct
  misc_feature 1..20: note = CRISPR gRNA sequence
  source 1..20: mol_type = other DNA
tttaaaattctaaccagtct

SEQ ID NO: 52124 - DNA, 20 bp, synthetic construct
  misc_feature 1..20: note = CRISPR gRNA sequence
  source 1..20: mol_type = other DNA
taaccagtctgagctgaaat

SEQ ID NO: 52125 - DNA, 20 bp, synthetic construct
  misc_feature 1..20: note = CRISPR gRNA sequence
  source 1..20: mol_type = other DNA
tctgagctgaaattagaaaa

SEQ ID NO: 52126 - DNA, 20 bp, synthetic construct
  misc_feature 1..20: note = CRISPR gRNA sequence
  source 1..20: mol_type = other DNA
agaaaatagttttaatactt

SEQ ID NO: 52127 - DNA, 20 bp, synthetic construct
  misc_feature 1..20: note = CRISPR gRNA sequence
  source 1..20: mol_type = other DNA
gaaaatagttttaatacttt

SEQ ID NO: 52128 - DNA, 20 bp, synthetic construct
  misc_feature 1..20: note = CRISPR gRNA sequence
  source 1..20: mol_type = other DNA
aaaatagttttaatactttg

SEQ ID NO: 52129 - DNA, 20 bp, synthetic construct
  misc_feature 1..20: note = CRISPR gRNA sequence
  source 1..20: mol_type = other DNA
aaatagttttaatactttgg

SEQ ID NO: 52130 - DNA, 20 bp, synthetic construct
  misc_feature 1..20: note = CRISPR gRNA sequence
  source 1..20: mol_type = other DNA
tgcttaaattccctttttgc

SEQ ID NO: 52131 - DNA, 20 bp, synthetic construct
  misc_feature 1..20: note = CRISPR gRNA sequence
  source 1..20: mol_type = other DNA
ttccctttttgcgagtttga

SEQ ID NO: 52132 - DNA, 20 bp, synthetic construct
  misc_feature 1..20: note = CRISPR gRNA sequence
  source 1..20: mol_type = other DNA
gtttgacggtgacctttaaa

SEQ ID NO: 52133 - DNA, 20 bp, synthetic construct
  misc_feature 1..20: note = CRISPR gRNA sequence
  source 1..20: mol_type = other DNA
tgacggtgacctttaaaaag

SEQ ID NO: 52134 - DNA, 20 bp, synthetic construct
  misc_feature 1..20: note = CRISPR gRNA sequence
  source 1..20: mol_type = other DNA
tttaaaaagcagcatgtgat

SEQ ID NO: 52135 - DNA, 20 bp, synthetic construct
  misc_feature 1..20: note = CRISPR gRNA sequence
  source 1..20: mol_type = other DNA
aaagcagcatgtgataagta

SEQ ID NO: 52136 - DNA, 20 bp, synthetic construct
  misc_feature 1..20: note = CRISPR gRNA sequence
  source 1..20: mol_type = other DNA
aagcagcatgtgataagtac

SEQ ID NO: 52137 - DNA, 20 bp, synthetic construct
  misc_feature 1..20: note = CRISPR gRNA sequence
  source 1..20: mol_type = other DNA
gtacaggacctacatctgta

SEQ ID NO: 52138 - DNA, 20 bp, synthetic construct
  misc_feature 1..20: note = CRISPR gRNA sequence
  source 1..20: mol_type = other DNA
tctgtacagcccctttctac

SEQ ID NO: 52139 - DNA, 20 bp, synthetic construct
  misc_feature 1..20: note = CRISPR gRNA sequence
  source 1..20: mol_type = other DNA
gtacagcccctttctacgag

SEQ ID NO: 52140 - DNA, 20 bp, synthetic construct
  misc_feature 1..20: note = CRISPR gRNA sequence
  source 1..20: mol_type = other DNA
tacagcccctttctacgagt

SEQ ID NO: 52141 - DNA, 20 bp, synthetic construct
  misc_feature 1..20: note = CRISPR gRNA sequence
  source 1..20: mol_type = other DNA
tacgagtgggtgaccctccg

SEQ ID NO: 52142 - DNA, 20 bp, synthetic construct
  misc_feature 1..20: note = CRISPR gRNA sequence
  source 1..20: mol_type = other DNA
acgagtgggtgaccctccgt

SEQ ID NO: 52143 - DNA, 20 bp, synthetic construct
  misc_feature 1..20: note = CRISPR gRNA sequence
  source 1..20: mol_type = other DNA
agtgggtgaccctccgtggg

SEQ ID NO: 52144 - DNA, 20 bp, synthetic construct
  misc_feature 1..20: note = CRISPR gRNA sequence
  source 1..20: mol_type = other DNA
gtgggtgaccctccgtgggt

SEQ ID NO: 52145 - DNA, 20 bp, synthetic construct
  misc_feature 1..20: note = CRISPR gRNA sequence
  source 1..20: mol_type = other DNA
tgggtgaccctccgtgggtg

SEQ ID NO: 52146 - DNA, 20 bp, synthetic construct
  misc_feature 1..20: note = CRISPR gRNA sequence
  source 1..20: mol_type = other DNA
ggtgaccctccgtgggtggg

SEQ ID NO: 52147 - DNA, 20 bp, synthetic construct
  misc_feature 1..20: note = CRISPR gRNA sequence
  source 1..20: mol_type = other DNA
gaccctccgtgggtggggag

SEQ ID NO: 52148 - DNA, 20 bp, synthetic construct
  misc_feature 1..20: note = CRISPR gRNA sequence
  source 1..20: mol_type = other DNA
ctccgtgggtggggagaagt

SEQ ID NO: 52149 - DNA, 20 bp, synthetic construct
  misc_feature 1..20: note = CRISPR gRNA sequence
  source 1..20: mol_type = other DNA
gtgggtggggagaagttgga

SEQ ID NO: 52150 - DNA, 20 bp, synthetic construct
  misc_feature 1..20: note = CRISPR gRNA sequence
  source 1..20: mol_type = other DNA
gttggacagctcatttgtca

SEQ ID NO: 52151 - DNA, 20 bp, synthetic construct
  misc_feature 1..20: note = CRISPR gRNA sequence
  source 1..20: mol_type = other DNA
tcacagatcttccatttctt

SEQ ID NO: 52152 - DNA, 20 bp, synthetic construct
  misc_feature 1..20: note = CRISPR gRNA sequence
  source 1..20: mol_type = other DNA
cacagatcttccatttctta

SEQ ID NO: 52153 - DNA, 20 bp, synthetic construct
  misc_feature 1..20: note = CRISPR gRNA sequence
  source 1..20: mol_type = other DNA
tccatttcttaaggtgattt

SEQ ID NO: 52154 - DNA, 20 bp, synthetic construct
  misc_feature 1..20: note = CRISPR gRNA sequence
  source 1..20: mol_type = other DNA
gattttagaataacttattt

SEQ ID NO: 52155 - DNA, 20 bp, synthetic construct
  misc_feature 1..20: note = CRISPR gRNA sequence
  source 1..20: mol_type = other DNA
acttatttgagtcccaactc

SEQ ID NO: 52156 - DNA, 20 bp, synthetic construct
  misc_feature 1..20: note = CRISPR gRNA sequence
  source 1..20: mol_type = other DNA
cttatttgagtcccaactct

SEQ ID NO: 52157 - DNA, 20 bp, synthetic construct
  misc_feature 1..20: note = CRISPR gRNA sequence
  source 1..20: mol_type = other DNA
ttatttgagtcccaactctg

SEQ ID NO: 52158 - DNA, 20 bp, synthetic construct
  misc_feature 1..20: note = CRISPR gRNA sequence
  source 1..20: mol_type = other DNA
tatttgagtcccaactctgg

SEQ ID NO: 52159 - DNA, 20 bp, synthetic construct
  misc_feature 1..20: note = CRISPR gRNA sequence
  source 1..20: mol_type = other DNA
gagtcccaactctgggggaa

SEQ ID NO: 52160 - DNA, 20 bp, synthetic construct
  misc_feature 1..20: note = CRISPR gRNA sequence
  source 1..20: mol_type = other DNA
agtcccaactctgggggaat

SEQ ID NO: 52161 - DNA, 20 bp, synthetic construct
  misc_feature 1..20: note = CRISPR gRNA sequence
  source 1..20: mol_type = other DNA
cccaactctgggggaatggg

SEQ ID NO: 52162 - DNA, 20 bp, synthetic construct
  misc_feature 1..20: note = CRISPR gRNA sequence
  source 1..20: mol_type = other DNA
ccaactctgggggaatgggc

SEQ ID NO: 52163 - DNA, 20 bp, synthetic construct
  misc_feature 1..20: note = CRISPR gRNA sequence
  source 1..20: mol_type = other DNA
caactctgggggaatgggcg

SEQ ID NO: 52164 - DNA, 20 bp, synthetic construct
  misc_feature 1..20: note = CRISPR gRNA sequence
  source 1..20: mol_type = other DNA
ggaatattaatcccatttgt

SEQ ID NO: 52165 - DNA, 20 bp, synthetic construct
  misc_feature 1..20: note = CRISPR gRNA sequence
  source 1..20: mol_type = other DNA
attaatcccatttgtcagat

SEQ ID NO: 52166 - DNA, 20 bp, synthetic construct
  misc_feature 1..20: note = CRISPR gRNA sequence
  source 1..20: mol_type = other DNA
ttaatcccatttgtcagatg

SEQ ID NO: 52167 - DNA, 20 bp, synthetic construct
  misc_feature 1..20: note = CRISPR gRNA sequence
  source 1..20: mol_type = other DNA
atttgtcagatgaggaaact

SEQ ID NO: 52168 - DNA, 20 bp, synthetic construct
  misc_feature 1..20: note = CRISPR gRNA sequence
  source 1..20: mol_type = other DNA
cagatgaggaaactgagacg

SEQ ID NO: 52169 - DNA, 20 bp, synthetic construct
  misc_feature 1..20: note = CRISPR gRNA sequence
  source 1..20: mol_type = other DNA
gatgaggaaactgagacgca

SEQ ID NO: 52170 - DNA, 20 bp, synthetic construct
  misc_feature 1..20: note = CRISPR gRNA sequence
  source 1..20: mol_type = other DNA
atgaggaaactgagacgcag

SEQ ID NO: 52171 - DNA, 20 bp, synthetic construct
  misc_feature 1..20: note = CRISPR gRNA sequence
  source 1..20: mol_type = other DNA
gaggaaactgagacgcagag

SEQ ID NO: 52172 - DNA, 20 bp, synthetic construct
  misc_feature 1..20: note = CRISPR gRNA sequence
  source 1..20: mol_type = other DNA
aggaaactgagacgcagagg

SEQ ID NO: 52173 - DNA, 20 bp, synthetic construct
  misc_feature 1..20: note = CRISPR gRNA sequence
  source 1..20: mol_type = other DNA
ggaggcaaacgacgccccct

SEQ ID NO: 52174 - DNA, 20 bp, synthetic construct
  misc_feature 1..20: note = CRISPR gRNA sequence
  source 1..20: mol_type = other DNA
gaggcaaacgacgccccctg

SEQ ID NO: 52175 - DNA, 20 bp, synthetic construct
  misc_feature 1..20: note = CRISPR gRNA sequence
  source 1..20: mol_type = other DNA
gacgccccctgaggttgaca

SEQ ID NO: 52176 - DNA, 20 bp, synthetic construct
  misc_feature 1..20: note = CRISPR gRNA sequence
  source 1..20: mol_type = other DNA
ccctgaggttgacaaagtat

SEQ ID NO: 52177 - DNA, 20 bp, synthetic construct
  misc_feature 1..20: note = CRISPR gRNA sequence
  source 1..20: mol_type = other DNA
cctgaggttgacaaagtatt

SEQ ID NO: 52178 - DNA, 20 bp, synthetic construct
  misc_feature 1..20: note = CRISPR gRNA sequence
  source 1..20: mol_type = other DNA
ctgaggttgacaaagtatta

SEQ ID NO: 52179 - DNA, 20 bp, synthetic construct
  misc_feature 1..20: note = CRISPR gRNA sequence
  source 1..20: mol_type = other DNA
aggttgacaaagtattaggg

SEQ ID NO: 52180 - DNA, 20 bp, synthetic construct
  misc_feature 1..20: note = CRISPR gRNA sequence
  source 1..20: mol_type = other DNA
gttgacaaagtattagggtg

SEQ ID NO: 52181 - DNA, 20 bp, synthetic construct
  misc_feature 1..20: note = CRISPR gRNA sequence
  source 1..20: mol_type = other DNA
acaaagtattagggtggagc

SEQ ID NO: 52182 - DNA, 20 bp, synthetic construct
  misc_feature 1..20: note = CRISPR gRNA sequence
  source 1..20: mol_type = other DNA
aagtattagggtggagctgg

SEQ ID NO: 52183 - DNA, 20 bp, synthetic construct
  misc_feature 1..20: note = CRISPR gRNA sequence
  source 1..20: mol_type = other DNA
tattagggtggagctggaag

SEQ ID NO: 52184 - DNA, 20 bp, synthetic construct
  misc_feature 1..20: note = CRISPR gRNA sequence
  source 1..20: mol_type = other DNA
gggtggagctggaagcagat

SEQ ID NO: 52185 - DNA, 20 bp, synthetic construct
  misc_feature 1..20: note = CRISPR gRNA sequence
  source 1..20: mol_type = other DNA
gtggagctggaagcagattg

SEQ ID NO: 52186 - DNA, 20 bp, synthetic construct
  misc_feature 1..20: note = CRISPR gRNA sequence
  source 1..20: mol_type = other DNA
tggaagcagattggagtccc

SEQ ID NO: 52187 - DNA, 20 bp, synthetic construct
  misc_feature 1..20: note = CRISPR gRNA sequence
  source 1..20: mol_type = other DNA
attggagtccccagttgtgc

SEQ ID NO: 52188 - DNA, 20 bp, synthetic construct
  misc_feature 1..20: note = CRISPR gRNA sequence
  source 1..20: mol_type = other DNA
ttggagtccccagttgtgcc

SEQ ID NO: 52189 - DNA, 20 bp, synthetic construct
  misc_feature 1..20: note = CRISPR gRNA sequence
  source 1..20: mol_type = other DNA
gtaaaatgataaaacaacct

SEQ ID NO: 52190 - DNA, 20 bp, synthetic construct
  misc_feature 1..20: note = CRISPR gRNA sequence
  source 1..20: mol_type = other DNA
taaaatgataaaacaaccta

SEQ ID NO: 52191 - DNA, 20 bp, synthetic construct
  misc_feature 1..20: note = CRISPR gRNA sequence
  source 1..20: mol_type = other DNA
atgataaaacaacctaagga

SEQ ID NO: 52192 - DNA, 20 bp, synthetic construct
  misc_feature 1..20: note = CRISPR gRNA sequence
  source 1..20: mol_type = other DNA
aaaacaacctaaggaaagaa

SEQ ID NO: 52193 - DNA, 20 bp, synthetic construct
  misc_feature 1..20: note = CRISPR gRNA sequence
  source 1..20: mol_type = other DNA
aacaacctaaggaaagaatg

SEQ ID NO: 52194 - DNA, 20 bp, synthetic construct
  misc_feature 1..20: note = CRISPR gRNA sequence
  source 1..20: mol_type = other DNA
aacctaaggaaagaatggag

SEQ ID NO: 52195 - DNA, 20 bp, synthetic construct
  misc_feature 1..20: note = CRISPR gRNA sequence
  source 1..20: mol_type = other DNA
acctaaggaaagaatggagc

SEQ ID NO: 52196 - DNA, 20 bp, synthetic construct
  misc_feature 1..20: note = CRISPR gRNA sequence
  source 1..20: mol_type = other DNA
taaggaaagaatggagcggg

SEQ ID NO: 52197 - DNA, 20 bp, synthetic construct
  misc_feature 1..20: note = CRISPR gRNA sequence
  source 1..20: mol_type = other DNA
aggaaagaatggagcgggta

SEQ ID NO: 52198 - DNA, 20 bp, synthetic construct
  misc_feature 1..20: note = CRISPR gRNA sequence
  source 1..20: mol_type = other DNA
ggaaagaatggagcgggtag

SEQ ID NO: 52199 - DNA, 20 bp, synthetic construct
  misc_feature 1..20: note = CRISPR gRNA sequence
  source 1..20: mol_type = other DNA
gaaagaatggagcgggtaga

SEQ ID NO: 52200 - DNA, 20 bp, synthetic construct
  misc_feature 1..20: note = CRISPR gRNA sequence
  source 1..20: mol_type = other DNA
aaagaatggagcgggtagag

SEQ ID NO: 52201 - DNA, 20 bp, synthetic construct
  misc_feature 1..20: note = CRISPR gRNA sequence
  source 1..20: mol_type = other DNA
aagaatggagcgggtagagg

SEQ ID NO: 52202 - DNA, 20 bp, synthetic construct
  misc_feature 1..20: note = CRISPR gRNA sequence
  source 1..20: mol_type = other DNA
atggagcgggtagagggggt

SEQ ID NO: 52203 - DNA, 20 bp, synthetic construct
  misc_feature 1..20: note = CRISPR gRNA sequence
  source 1..20: mol_type = other DNA
ggagcgggtagagggggttg

SEQ ID NO: 52204 - DNA, 20 bp, synthetic construct
  misc_feature 1..20: note = CRISPR gRNA sequence
  source 1..20: mol_type = other DNA
gagcgggtagagggggttgg

SEQ ID NO: 52205 - DNA, 20 bp, synthetic construct
  misc_feature 1..20: note = CRISPR gRNA sequence
  source 1..20: mol_type = other DNA
agcgggtagagggggttgga

SEQ ID NO: 52206 - DNA, 20 bp, synthetic construct
  misc_feature 1..20: note = CRISPR gRNA sequence
  source 1..20: mol_type = other DNA
gcgggtagagggggttggag

SEQ ID NO: 52207 - DNA, 20 bp, synthetic construct
  misc_feature 1..20: note = CRISPR gRNA sequence
  source 1..20: mol_type = other DNA
cgggtagagggggttggagg

SEQ ID NO: 52208 - DNA, 20 bp, synthetic construct
  misc_feature 1..20: note = CRISPR gRNA sequence
  source 1..20: mol_type = other DNA
agagggggttggagggggta

SEQ ID NO: 52209 - DNA, 20 bp, synthetic construct
  misc_feature 1..20: note = CRISPR gRNA sequence
  source 1..20: mol_type = other DNA
gagggggttggagggggtaa

SEQ ID NO: 52210 - DNA, 20 bp, synthetic construct
  misc_feature 1..20: note = CRISPR gRNA sequence
  source 1..20: mol_type = other DNA
ggggttggagggggtaaagg

SEQ ID NO: 52211 - DNA, 20 bp, synthetic construct
  misc_feature 1..20: note = CRISPR gRNA sequence
  source 1..20: mol_type = other DNA
gggttggagggggtaaaggc

SEQ ID NO: 52212 - DNA, 20 bp, synthetic construct
  misc_feature 1..20: note = CRISPR gRNA sequence
  source 1..20: mol_type = other DNA
ggttggagggggtaaaggcg

SEQ ID NO: 52213 - DNA, 20 bp, synthetic construct
  misc_feature 1..20: note = CRISPR gRNA sequence
  source 1..20: mol_type = other DNA
gttggagggggtaaaggcgg

SEQ ID NO: 52214 - DNA, 20 bp, synthetic construct
  misc_feature 1..20: note = CRISPR gRNA sequence
  source 1..20: mol_type = other DNA
ttggagggggtaaaggcggg

SEQ ID NO: 52215 - DNA, 20 bp, synthetic construct
  misc_feature 1..20: note = CRISPR gRNA sequence
  source 1..20: mol_type = other DNA
gggggtaaaggcggggggtt

SEQ ID NO: 52216 - DNA, 20 bp, synthetic construct
  misc_feature 1..20: note = CRISPR gRNA sequence
  source 1..20: mol_type = other DNA
ggggtaaaggcggggggttg

SEQ ID NO: 52217 - DNA, 20 bp, synthetic construct
  misc_feature 1..20: note = CRISPR gRNA sequence
  source 1..20: mol_type = other DNA
gggtaaaggcggggggttga

SEQ ID NO: 52218 - DNA, 20 bp, synthetic construct
  misc_feature 1..20: note = CRISPR gRNA sequence
  source 1..20: mol_type = other DNA
ggtaaaggcggggggttgag

SEQ ID NO: 52219 - DNA, 20 bp, synthetic construct
  misc_feature 1..20: note = CRISPR gRNA sequence
  source 1..20: mol_type = other DNA
aaggcggggggttgaggggt

SEQ ID NO: 52220 - DNA, 20 bp, synthetic construct
  misc_feature 1..20: note = CRISPR gRNA sequence
  source 1..20: mol_type = other DNA
ggcggggggttgaggggtta

SEQ ID NO: 52221 - DNA, 20 bp, synthetic construct
  misc_feature 1..20: note = CRISPR gRNA sequence
  source 1..20: mol_type = other DNA
gcggggggttgaggggttag

SEQ ID NO: 52222 - DNA, 20 bp, synthetic construct
  misc_feature 1..20: note = CRISPR gRNA sequence
  source 1..20: mol_type = other DNA
cggggggttgaggggttaga

SEQ ID NO: 52223 - DNA, 20 bp, synthetic construct
  misc_feature 1..20: note = CRISPR gRNA sequence
  source 1..20: mol_type = other DNA
ggggttgaggggttagaggg

SEQ ID NO: 52224 - DNA, 20 bp, synthetic construct
  misc_feature 1..20: note = CRISPR gRNA sequence
  source 1..20: mol_type = other DNA
gggttgaggggttagagggc

SEQ ID NO: 52225 - DNA, 20 bp, synthetic construct
  misc_feature 1..20: note = CRISPR gRNA sequence
  source 1..20: mol_type = other DNA
gaggggttagagggcaggta

SEQ ID NO: 52226 - DNA, 20 bp, synthetic construct
  misc_feature 1..20: note = CRISPR gRNA sequence
  source 1..20: mol_type = other DNA
gggcaggtacagctttgcca

SEQ ID NO: 52227 - DNA, 20 bp, synthetic construct
  misc_feature 1..20: note = CRISPR gRNA sequence
  source 1..20: mol_type = other DNA
gcaggtacagctttgccatg

SEQ ID NO: 52228 - DNA, 20 bp, synthetic construct
  misc_feature 1..20: note = CRISPR gRNA sequence
  source 1..20: mol_type = other DNA
caggtacagctttgccatgg

SEQ ID NO: 52229 - DNA, 20 bp, synthetic construct
  misc_feature 1..20: note = CRISPR gRNA sequence
  source 1..20: mol_type = other DNA
ggtacagctttgccatggag

SEQ ID NO: 52230 - DNA, 20 bp, synthetic construct
  misc_feature 1..20: note = CRISPR gRNA sequence
  source 1..20: mol_type = other DNA
gctttgccatggaggagcct

SEQ ID NO: 52231 - DNA, 20 bp, synthetic construct
  misc_feature 1..20: note = CRISPR gRNA sequence
  source 1..20: mol_type = other DNA
tggaggagccttagaaacac

SEQ ID NO: 52232 - DNA, 20 bp, synthetic construct
  misc_feature 1..20: note = CRISPR gRNA sequence
  source 1..20: mol_type = other DNA
agccttagaaacacgagcac

SEQ ID NO: 52233 - DNA, 20 bp, synthetic construct
  misc_feature 1..20: note = CRISPR gRNA sequence
  source 1..20: mol_type = other DNA
gccttagaaacacgagcaca

SEQ ID NO: 52234 - DNA, 20 bp, synthetic construct
  misc_feature 1..20: note = CRISPR gRNA sequence
  source 1..20: mol_type = other DNA
gaaacacgagcacaaggaac

SEQ ID NO: 52235 - DNA, 20 bp, synthetic construct
  misc_feature 1..20: note = CRISPR gRNA sequence
  source 1..20: mol_type = other DNA
aaacacgagcacaaggaacc

SEQ ID NO: 52236 - DNA, 20 bp, synthetic construct
  misc_feature 1..20: note = CRISPR gRNA sequence
  source 1..20: mol_type = other DNA
gagcacaaggaaccgggaaa

SEQ ID NO: 52237 - DNA, 20 bp, synthetic construct
  misc_feature 1..20: note = CRISPR gRNA sequence
  source 1..20: mol_type = other DNA
agcacaaggaaccgggaaat

SEQ ID NO: 52238 - DNA, 20 bp, synthetic construct
  misc_feature 1..20: note = CRISPR gRNA sequence
  source 1..20: mol_type = other DNA
gaaaaactctcgtcttactg

SEQ ID NO: 52239 - DNA, 20 bp, synthetic construct
  misc_feature 1..20: note = CRISPR gRNA sequence
  source 1..20: mol_type = other DNA
aaactctcgtcttactgcag

SEQ ID NO: 52240 - DNA, 20 bp, synthetic construct
  misc_feature 1..20: note = CRISPR gRNA sequence
  source 1..20: mol_type = other DNA
aactctcgtcttactgcagc

SEQ ID NO: 52241 - DNA, 20 bp, synthetic construct
  misc_feature 1..20: note = CRISPR gRNA sequence
  source 1..20: mol_type = other DNA
tcgtcttactgcagcaggct

SEQ ID NO: 52242 - DNA, 20 bp, synthetic construct
  misc_feature 1..20: note = CRISPR gRNA sequence
  source 1..20: mol_type = other DNA
ttactgcagcaggctcagct

SEQ ID NO: 52243 - DNA, 20 bp, synthetic construct
  misc_feature 1..20: note = CRISPR gRNA sequence
  source 1..20: mol_type = other DNA
tactgcagcaggctcagctg

SEQ ID NO: 52244 - DNA, 20 bp, synthetic construct
  misc_feature 1..20: note = CRISPR gRNA sequence
  source 1..20: mol_type = other DNA
actgcagcaggctcagctga

SEQ ID NO: 52245 - DNA, 20 bp, synthetic construct
  misc_feature 1..20: note = CRISPR gRNA sequence
  source 1..20: mol_type = other DNA
tgcagcaggctcagctgagg

SEQ ID NO: 52246 - DNA, 20 bp, synthetic construct
  misc_feature 1..20: note = CRISPR gRNA sequence
  source 1..20: mol_type = other DNA
caggctcagctgagggagtt

SEQ ID NO: 52247 - DNA, 20 bp, synthetic construct
  misc_feature 1..20: note = CRISPR gRNA sequence
  source 1..20: mol_type = other DNA
aggctcagctgagggagttg

SEQ ID NO: 52248 - DNA, 20 bp, synthetic construct
  misc_feature 1..20: note = CRISPR gRNA sequence
  source 1..20: mol_type = other DNA
tcagctgagggagttgaggt

SEQ ID NO: 52249 - DNA, 20 bp, synthetic construct
  misc_feature 1..20: note = CRISPR gRNA sequence
  source 1..20: mol_type = other DNA
gctgagggagttgaggtaag

SEQ ID NO: 52250 - DNA, 20 bp, synthetic construct
  misc_feature 1..20: note = CRISPR gRNA sequence
  source 1..20: mol_type = other DNA
gggagttgaggtaagcagtc

SEQ ID NO: 52251 - DNA, 20 bp, synthetic construct
  misc_feature 1..20: note = CRISPR gRNA sequence
  source 1..20: mol_type = other DNA
agttgaggtaagcagtccag

SEQ ID NO: 52252 - DNA, 20 bp, synthetic construct
  misc_feature 1..20: note = CRISPR gRNA sequence
  source 1..20: mol_type = other DNA
ttgaggtaagcagtccagta

SEQ ID NO: 52253 - DNA, 20 bp, synthetic construct
  misc_feature 1..20: note = CRISPR gRNA sequence
  source 1..20: mol_type = other DNA
aagcagtccagtagagtctc

SEQ ID NO: 52254 - DNA, 20 bp, synthetic construct
  misc_feature 1..20: note = CRISPR gRNA sequence
  source 1..20: mol_type = other DNA
agcagtccagtagagtctcc

SEQ ID NO: 52255 - DNA, 20 bp, synthetic construct
  misc_feature 1..20: note = CRISPR gRNA sequence
  source 1..20: mol_type = other DNA
ccagtagagtctccaggctc

SEQ ID NO: 52256 - DNA, 20 bp, synthetic construct
  misc_feature 1..20: note = CRISPR gRNA sequence
  source 1..20: mol_type = other DNA
gtctccaggctctggtcact

SEQ ID NO: 52257 - DNA, 20 bp, synthetic construct
  misc_feature 1..20: note = CRISPR gRNA sequence
  source 1..20: mol_type = other DNA
tctccaggctctggtcactc

SEQ ID NO: 52258 - DNA, 20 bp, synthetic construct
  misc_feature 1..20: note = CRISPR gRNA sequence
  source 1..20: mol_type = other DNA
tctggtcactcaggaactca

SEQ ID NO: 52259 - DNA, 20 bp, synthetic construct
  misc_feature 1..20: note = CRISPR gRNA sequence
  source 1..20: mol_type = other DNA
ctggtcactcaggaactcac

SEQ ID NO: 52260 - DNA, 20 bp, synthetic construct
  misc_feature 1..20: note = CRISPR gRNA sequence
  source 1..20: mol_type = other DNA
acaggacaatctgtgaaaca

SEQ ID NO: 52261 - DNA, 20 bp, synthetic construct
  misc_feature 1..20: note = CRISPR gRNA sequence
  source 1..20: mol_type = other DNA
ggacaatctgtgaaacaaag

SEQ ID NO: 52262 - DNA, 20 bp, synthetic construct
  misc_feature 1..20: note = CRISPR gRNA sequence
  source 1..20: mol_type = other DNA
gacaatctgtgaaacaaagc

SEQ ID NO: 52263 - DNA, 20 bp, synthetic construct
  misc_feature 1..20: note = CRISPR gRNA sequence
  source 1..20: mol_type = other DNA
aatctgtgaaacaaagcagg

SEQ ID NO: 52264 - DNA, 20 bp, synthetic construct
  misc_feature 1..20: note = CRISPR gRNA sequence
  source 1..20: mol_type = other DNA
gtgaaacaaagcaggtggat

SEQ ID NO: 52265 - DNA, 20 bp, synthetic construct
  misc_feature 1..20: note = CRISPR gRNA sequence
  source 1..20: mol_type = other DNA
tgaaacaaagcaggtggatg

SEQ ID NO: 52266 - DNA, 20 bp, synthetic construct
  misc_feature 1..20: note = CRISPR gRNA sequence
  source 1..20: mol_type = other DNA
aacaaagcaggtggatgagg

SEQ ID NO: 52267 - DNA, 20 bp, synthetic construct
  misc_feature 1..20: note = CRISPR gRNA sequence
  source 1..20: mol_type = other DNA
acaaagcaggtggatgaggt

SEQ ID NO: 52268 - DNA, 20 bp, synthetic construct
  misc_feature 1..20: note = CRISPR gRNA sequence
  source 1..20: mol_type = other DNA
caaagcaggtggatgaggtg

SEQ ID NO: 52269 - DNA, 20 bp, synthetic construct
  misc_feature 1..20: note = CRISPR gRNA sequence
  source 1..20: mol_type = other DNA
aaagcaggtggatgaggtgg

SEQ ID NO: 52270 - DNA, 20 bp, synthetic construct
  misc_feature 1..20: note = CRISPR gRNA sequence
  source 1..20: mol_type = other DNA
atgaggtgggggaaaccttc

SEQ ID NO: 52271 - DNA, 20 bp, synthetic construct
  misc_feature 1..20: note = CRISPR gRNA sequence
  source 1..20: mol_type = other DNA
tgaggtgggggaaaccttcc

SEQ ID NO: 52272 - DNA, 20 bp, synthetic construct
  misc_feature 1..20: note = CRISPR gRNA sequence
  source 1..20: mol_type = other DNA
gtgggggaaaccttccagga

SEQ ID NO: 52273 - DNA, 20 bp, synthetic construct
  misc_feature 1..20: note = CRISPR gRNA sequence
  source 1..20: mol_type = other DNA
ggggaaaccttccaggaaag

SEQ ID NO: 52274 - DNA, 20 bp, synthetic construct
  misc_feature 1..20: note = CRISPR gRNA sequence
  source 1..20: mol_type = other DNA
gggaaaccttccaggaaagc

SEQ ID NO: 52275 - DNA, 20 bp, synthetic construct
  misc_feature 1..20: note = CRISPR gRNA sequence
  source 1..20: mol_type = other DNA
ggaaaccttccaggaaagca

SEQ ID NO: 52276 - DNA, 20 bp, synthetic construct
  misc_feature 1..20: note = CRISPR gRNA sequence
  source 1..20: mol_type = other DNA
aaaccttccaggaaagcagg

SEQ ID NO: 52277 - DNA, 20 bp, synthetic construct
  misc_feature 1..20: note = CRISPR gRNA sequence
  source 1..20: mol_type = other DNA
ttccaggaaagcagggagca

SEQ ID NO: 52278 - DNA, 20 bp, synthetic construct
  misc_feature 1..20: note = CRISPR gRNA sequence
  source 1..20: mol_type = other DNA
aagcagggagcacggcctca

SEQ ID NO: 52279 - DNA, 20 bp, synthetic construct
  misc_feature 1..20: note = CRISPR gRNA sequence
  source 1..20: mol_type = other DNA
agggagcacggcctcatagc

SEQ ID NO: 52280 - DNA, 20 bp, synthetic construct
  misc_feature 1..20: note = CRISPR gRNA sequence
  source 1..20: mol_type = other DNA
ggagcacggcctcatagcca

SEQ ID NO: 52281 - DNA, 20 bp, synthetic construct
  misc_feature 1..20: note = CRISPR gRNA sequence
  source 1..20: mol_type = other DNA
gcctcatagccagagccttc

SEQ ID NO: 52282 - DNA, 20 bp, synthetic construct
  misc_feature 1..20: note = CRISPR gRNA sequence
  source 1..20: mol_type = other DNA
ctcatagccagagccttctg

SEQ ID NO: 52283 - DNA, 20 bp, synthetic construct
  misc_feature 1..20: note = CRISPR gRNA sequence
  source 1..20: mol_type = other DNA
tagccagagccttctggaga

SEQ ID NO: 52284 - DNA, 20 bp, synthetic construct
  misc_feature 1..20: note = CRISPR gRNA sequence
  source 1..20: mol_type = other DNA
agccagagccttctggagat

SEQ ID NO: 52285 - DNA, 20 bp, synthetic construct
  misc_feature 1..20: note = CRISPR gRNA sequence
  source 1..20: mol_type = other DNA
ttctggagatgggacctaac

SEQ ID NO: 52286 - DNA, 20 bp, synthetic construct
  misc_feature 1..20: note = CRISPR gRNA sequence
  source 1..20: mol_type = other DNA
tctggagatgggacctaacc

SEQ ID NO: 52287 - DNA, 20 bp, synthetic construct
  misc_feature 1..20: note = CRISPR gRNA sequence
  source 1..20: mol_type = other DNA
ctggagatgggacctaacca

SEQ ID NO: 52288 - DNA, 20 bp, synthetic construct
  misc_feature 1..20: note = CRISPR gRNA sequence
  source 1..20: mol_type = other DNA
tcacctgaaacattccctcc

SEQ ID NO: 52289 - DNA, 20 bp, synthetic construct
  misc_feature 1..20: note = CRISPR gRNA sequence
  source 1..20: mol_type = other DNA
gaaacattccctcccagcac

SEQ ID NO: 52290 - DNA, 20 bp, synthetic construct
  misc_feature 1..20: note = CRISPR gRNA sequence
  source 1..20: mol_type = other DNA
aaacattccctcccagcact

SEQ ID NO: 52291 - DNA, 20 bp, synthetic construct
  misc_feature 1..20: note = CRISPR gRNA sequence
  source 1..20: mol_type = other DNA
ccctcccagcactgggtcca

SEQ ID NO: 52292 - DNA, 20 bp, synthetic construct
  misc_feature 1..20: note = CRISPR gRNA sequence
  source 1..20: mol_type = other DNA
cctcccagcactgggtccat

SEQ ID NO: 52293 - DNA, 20 bp, synthetic construct
  misc_feature 1..20: note = CRISPR gRNA sequence
  source 1..20: mol_type = other DNA
tgggtccatgggttatccgt

SEQ ID NO: 52294 - DNA, 20 bp, synthetic construct
  misc_feature 1..20: note = CRISPR gRNA sequence
  source 1..20: mol_type = other DNA
gggtccatgggttatccgtg

SEQ ID NO: 52295 - DNA, 20 bp, synthetic construct
  misc_feature 1..20: note = CRISPR gRNA sequence
  source 1..20: mol_type = other DNA
ccatgggttatccgtgaggc

SEQ ID NO: 52296 - DNA, 20 bp, synthetic construct
  misc_feature 1..20: note = CRISPR gRNA sequence
  source 1..20: mol_type = other DNA
tgggttatccgtgaggctgg

SEQ ID NO: 52297 - DNA, 20 bp, synthetic construct
  misc_feature 1..20: note = CRISPR gRNA sequence
  source 1..20: mol_type = other DNA
gttatccgtgaggctggaag

SEQ ID NO: 52298 - DNA, 20 bp, synthetic construct
  misc_feature 1..20: note = CRISPR gRNA sequence
  source 1..20: mol_type = other DNA
tatccgtgaggctggaagaa

SEQ ID NO: 52299 - DNA, 20 bp, synthetic construct
  misc_feature 1..20: note = CRISPR gRNA sequence
  source 1..20: mol_type = other DNA
atccgtgaggctggaagaag

SEQ ID NO: 52300 - DNA, 20 bp, synthetic construct
  misc_feature 1..20: note = CRISPR gRNA sequence
  source 1..20: mol_type = other DNA
cgtgaggctggaagaagagg

SEQ ID NO: 52301 - DNA, 20 bp, synthetic construct
  misc_feature 1..20: note = CRISPR gRNA sequence
  source 1..20: mol_type = other DNA
gtgaggctggaagaagagga

SEQ ID NO: 52302 - DNA, 20 bp, synthetic construct
  misc_feature 1..20: note = CRISPR gRNA sequence
  source 1..20: mol_type = other DNA
gaagaagaggaaggtctttt

SEQ ID NO: 52303 - DNA, 20 bp, synthetic construct
  misc_feature 1..20: note = CRISPR gRNA sequence
  source 1..20: mol_type = other DNA
agaggaaggtcttttaagtt

SEQ ID NO: 52304 - DNA, 20 bp, synthetic construct
  misc_feature 1..20: note = CRISPR gRNA sequence
  source 1..20: mol_type = other DNA
gaggaaggtcttttaagttt

SEQ ID NO: 52305 - DNA, 20 bp, synthetic construct
  misc_feature 1..20: note = CRISPR gRNA sequence
  source 1..20: mol_type = other DNA
tcttttaagtttgggaaata

SEQ ID NO: 52306 - DNA, 20 bp, synthetic construct
  misc_feature 1..20: note = CRISPR gRNA sequence
  source 1..20: mol_type = other DNA
cttttaagtttgggaaatac

SEQ ID NO: 52307 - DNA, 20 bp, synthetic construct
  misc_feature 1..20: note = CRISPR gRNA sequence
  source 1..20: mol_type = other DNA
ttttaagtttgggaaatacg

SEQ ID NO: 52308 - DNA, 20 bp, synthetic construct
  misc_feature 1..20: note = CRISPR gRNA sequence
  source 1..20: mol_type = other DNA
agtttgggaaatacggggtt

SEQ ID NO: 52309 - DNA, 20 bp, synthetic construct
  misc_feature 1..20: note = CRISPR gRNA sequence
  source 1..20: mol_type = other DNA
cggggttaagccaaattaaa

SEQ ID NO: 52310 - DNA, 20 bp, synthetic construct
  misc_feature 1..20: note = CRISPR gRNA sequence
  source 1..20: mol_type = other DNA
ttaaatggttttgtttgctg

SEQ ID NO: 52311 - DNA, 20 bp, synthetic construct
  misc_feature 1..20: note = CRISPR gRNA sequence
  source 1..20: mol_type = other DNA
taaatggttttgtttgctgc

SEQ ID NO: 52312 - DNA, 20 bp, synthetic construct
  misc_feature 1..20: note = CRISPR gRNA sequence
  source 1..20: mol_type = other DNA
aaatggttttgtttgctgca

SEQ ID NO: 52313 - DNA, 20 bp, synthetic construct
  misc_feature 1..20: note = CRISPR gRNA sequence
  source 1..20: mol_type = other DNA
gtttgctgcagggcttctct

SEQ ID NO: 52314 - DNA, 20 bp, synthetic construct
  misc_feature 1..20: note = CRISPR gRNA sequence
  source 1..20: mol_type = other DNA
tttgctgcagggcttctctg

SEQ ID NO: 52315 - DNA, 20 bp, synthetic construct
  misc_feature 1..20: note = CRISPR gRNA sequence
  source 1..20: mol_type = other DNA
gggcttctctgaggctgcga

SEQ ID NO: 52316 - DNA, 20 bp, synthetic construct
  misc_feature 1..20: note = CRISPR gRNA sequence
  source 1..20: mol_type = other DNA
ggcttctctgaggctgcgat

SEQ ID NO: 52317 - DNA, 20 bp, synthetic construct
  misc_feature 1..20: note = CRISPR gRNA sequence
  source 1..20: mol_type = other DNA
gctgtgcattatgaatttcc

SEQ ID NO: 52318 - DNA, 20 bp, synthetic construct
  misc_feature 1..20: note = CRISPR gRNA sequence
  source 1..20: mol_type = other DNA
ctgtgcattatgaatttcca

SEQ ID NO: 52319 - DNA, 20 bp, synthetic construct
  misc_feature 1..20: note = CRISPR gRNA sequence
  source 1..20: mol_type = other DNA
gtgcattatgaatttccaag

SEQ ID NO: 52320 - DNA, 20 bp, synthetic construct
  misc_feature 1..20: note = CRISPR gRNA sequence
  source 1..20: mol_type = other DNA
tatgaatttccaaggagcta

SEQ ID NO: 52321 - DNA, 20 bp, synthetic construct
  misc_feature 1..20: note = CRISPR gRNA sequence
  source 1..20: mol_type = other DNA
gaatttccaaggagctacag

SEQ ID NO: 52322 - DNA, 20 bp, synthetic construct
  misc_feature 1..20: note = CRISPR gRNA sequence
  source 1..20: mol_type = other DNA
agacttttccccaaactaaa

SEQ ID NO: 52323 - DNA, 20 bp, synthetic construct
  misc_feature 1..20: note = CRISPR gRNA sequence
  source 1..20: mol_type = other DNA
tttccccaaactaaatggac

SEQ ID NO: 52324 - DNA, 20 bp, synthetic construct
  misc_feature 1..20: note = CRISPR gRNA sequence
  source 1..20: mol_type = other DNA
ccccaaactaaatggactag

SEQ ID NO: 52325 - DNA, 20 bp, synthetic construct
  misc_feature 1..20: note = CRISPR gRNA sequence
  source 1..20: mol_type = other DNA
gactagcagaattaattttt

SEQ ID NO: 52326 - DNA, 20 bp, synthetic construct
  misc_feature 1..20: note = CRISPR gRNA sequence
  source 1..20: mol_type = other DNA
actagcagaattaattttta

SEQ ID NO: 52327 - DNA, 20 bp, synthetic construct
  misc_feature 1..20: note = CRISPR gRNA sequence
  source 1..20: mol_type = other DNA
ctagcagaattaatttttaa

SEQ ID NO: 52328 - DNA, 20 bp, synthetic construct
  misc_feature 1..20: note = CRISPR gRNA sequence
  source 1..20: mol_type = other DNA
attaatttttaagggccatg

SEQ ID NO: 52329 - DNA, 20 bp, synthetic construct
  misc_feature 1..20: note = CRISPR gRNA sequence
  source 1..20: mol_type = other DNA
ttaatttttaagggccatga

SEQ ID NO: 52330 - DNA, 20 bp, synthetic construct
  misc_feature 1..20: note = CRISPR gRNA sequence
  source 1..20: mol_type = other DNA
tttttaagggccatgaaggt

SEQ ID NO: 52331 - DNA, 20 bp, synthetic construct
  misc_feature 1..20: note = CRISPR gRNA sequence
  source 1..20: mol_type = other DNA
ttccgcaaaacatgtttgtt

SEQ ID NO: 52332 - DNA, 20 bp, synthetic construct
  misc_feature 1..20: note = CRISPR gRNA sequence
  source 1..20: mol_type = other DNA
caaaacatgtttgttaagaa

SEQ ID NO: 52333 - DNA, 20 bp, synthetic construct
  misc_feature 1..20: note = CRISPR gRNA sequence
  source 1..20: mol_type = other DNA
tgtttgttaagaaaagaatg

SEQ ID NO: 52334 - DNA, 20 bp, synthetic construct
  misc_feature 1..20: note = CRISPR gRNA sequence
  source 1..20: mol_type = other DNA
tgttaagaaaagaatgcagc

SEQ ID NO: 52335 - DNA, 20 bp, synthetic construct
  misc_feature 1..20: note = CRISPR gRNA sequence
  source 1..20: mol_type = other DNA
gttaagaaaagaatgcagct

SEQ ID NO: 52336 - DNA, 20 bp, synthetic construct
  misc_feature 1..20: note = CRISPR gRNA sequence
  source 1..20: mol_type = other DNA
gaaaagaatgcagctgggca

SEQ ID NO: 52337 - DNA, 20 bp, synthetic construct
  misc_feature 1..20: note = CRISPR gRNA sequence
  source 1..20: mol_type = other DNA
aagaatgcagctgggcatgg

SEQ ID NO: 52338 - DNA, 20 bp, synthetic construct
  misc_feature 1..20: note = CRISPR gRNA sequence
  source 1..20: mol_type = other DNA
gtggctcatgcctgtaatcg

SEQ ID NO: 52339 - DNA, 20 bp, synthetic construct
  misc_feature 1..20: note = CRISPR gRNA sequence
  source 1..20: mol_type = other DNA
tgcctgtaatcgcagcactt

SEQ ID NO: 52340 - DNA, 20 bp, synthetic construct
  misc_feature 1..20: note = CRISPR gRNA sequence
  source 1..20: mol_type = other DNA
gcctgtaatcgcagcacttt

SEQ ID NO: 52341 - DNA, 20 bp, synthetic construct
  misc_feature 1..20: note = CRISPR gRNA sequence
  source 1..20: mol_type = other DNA
ctgtaatcgcagcactttgg

SEQ ID NO: 52342 - DNA, 20 bp, synthetic construct
  misc_feature 1..20: note = CRISPR gRNA sequence
  source 1..20: mol_type = other DNA
tgtaatcgcagcactttggg

SEQ ID NO: 52343 - DNA, 20 bp, synthetic construct
  misc_feature 1..20: note = CRISPR gRNA sequence
  source 1..20: mol_type = other DNA
tcgcagcactttgggaggct

SEQ ID NO: 52344 - DNA, 20 bp, synthetic construct
  misc_feature 1..20: note = CRISPR gRNA sequence
  source 1..20: mol_type = other DNA
cgcagcactttgggaggctg

SEQ ID NO: 52345 - DNA, 20 bp, synthetic construct
  misc_feature 1..20: note = CRISPR gRNA sequence
  source 1..20: mol_type = other DNA
agcactttgggaggctgagg

SEQ ID NO: 52346 - DNA, 20 bp, synthetic construct
  misc_feature 1..20: note = CRISPR gRNA sequence
  source 1..20: mol_type = other DNA
gcactttgggaggctgaggt

SEQ ID NO: 52347 - DNA, 20 bp, synthetic construct
  misc_feature 1..20: note = CRISPR gRNA sequence
  source 1..20: mol_type = other DNA
ctttgggaggctgaggtggg

SEQ ID NO: 52348 - DNA, 20 bp, synthetic construct
  misc_feature 1..20: note = CRISPR gRNA sequence
  source 1..20: mol_type = other DNA
ctgaggtgggtggatcatct

SEQ ID NO: 52349 - DNA, 20 bp, synthetic construct
  misc_feature 1..20: note = CRISPR gRNA sequence
  source 1..20: mol_type = other DNA
tgaggtgggtggatcatctg

SEQ ID NO: 52350 - DNA, 20 bp, synthetic construct
  misc_feature 1..20: note = CRISPR gRNA sequence
  source 1..20: mol_type = other DNA
gtgggtggatcatctgaggt

SEQ ID NO: 52351 - DNA, 20 bp, synthetic construct
  misc_feature 1..20: note = CRISPR gRNA sequence
  source 1..20: mol_type = other DNA
tgggtggatcatctgaggtc

SEQ ID NO: 52352 - DNA, 20 bp, synthetic construct
  misc_feature 1..20: note = CRISPR gRNA sequence
  source 1..20: mol_type = other DNA
ggtggatcatctgaggtcag

SEQ ID NO: 52353 - DNA, 20 bp, synthetic construct
  misc_feature 1..20: note = CRISPR gRNA sequence
  source 1..20: mol_type = other DNA
atcatctgaggtcaggagtc

SEQ ID NO: 52354 - DNA, 20 bp, synthetic construct
  misc_feature 1..20: note = CRISPR gRNA sequence
  source 1..20: mol_type = other DNA
tcatctgaggtcaggagtct

SEQ ID NO: 52355 - DNA, 20 bp, synthetic construct
  misc_feature 1..20: note = CRISPR gRNA sequence
  source 1..20: mol_type = other DNA
tgaggtcaggagtctgggac

SEQ ID NO: 52356 - DNA, 20 bp, synthetic construct
  misc_feature 1..20: note = CRISPR gRNA sequence
  source 1..20: mol_type = other DNA
tcaggagtctgggaccagcc

SEQ ID NO: 52357 - DNA, 20 bp, synthetic construct
  misc_feature 1..20: note = CRISPR gRNA sequence
  source 1..20: mol_type = other DNA
caggagtctgggaccagcct

SEQ ID NO: 52358 - DNA, 20 bp, synthetic construct
  misc_feature 1..20: note = CRISPR gRNA sequence
  source 1..20: mol_type = other DNA
tgggaccagcctgggcaaca

SEQ ID NO: 52359 - DNA, 20 bp, synthetic construct
  misc_feature 1..20: note = CRISPR gRNA sequence
  source 1..20: mol_type = other DNA
acaaaaaacgaaaaaaaaat

SEQ ID NO: 52360 - DNA, 20 bp, synthetic construct
  misc_feature 1..20: note = CRISPR gRNA sequence
  source 1..20: mol_type = other DNA
aaaacgaaaaaaaaattagc

SEQ ID NO: 52361 - DNA, 20 bp, synthetic construct
  misc_feature 1..20: note = CRISPR gRNA sequence
  source 1..20: mol_type = other DNA
aaacgaaaaaaaaattagcc

SEQ ID NO: 52362 - DNA, 20 bp, synthetic construct
  misc_feature 1..20: note = CRISPR gRNA sequence
  source 1..20: mol_type = other DNA
aaaaaaaaattagccaggcg

SEQ ID NO: 52363 - DNA, 20 bp, synthetic construct
  misc_feature 1..20: note = CRISPR gRNA sequence
  source 1..20: mol_type = other DNA
aaaaaattagccaggcgtgg

SEQ ID NO: 52364 - DNA, 20 bp, synthetic construct
  misc_feature 1..20: note = CRISPR gRNA sequence
  source 1..20: mol_type = other DNA
ggcgtggtggtgcacacctg

SEQ ID NO: 52365 - DNA, 20 bp, synthetic construct
  misc_feature 1..20: note = CRISPR gRNA sequence
  source 1..20: mol_type = other DNA
gtggtgcacacctgtagtaa

SEQ ID NO: 52366 - DNA, 20 bp, synthetic construct
  misc_feature 1..20: note = CRISPR gRNA sequence
  source 1..20: mol_type = other DNA
cacctgtagtaatagctact

SEQ ID NO: 52367 - DNA, 20 bp, synthetic construct
  misc_feature 1..20: note = CRISPR gRNA sequence
  source 1..20: mol_type = other DNA
acctgtagtaatagctactc

SEQ ID NO: 52368 - DNA, 20 bp, synthetic construct
  misc_feature 1..20: note = CRISPR gRNA sequence
  source 1..20: mol_type = other DNA
ctgtagtaatagctactcag

SEQ ID NO: 52369 - DNA, 20 bp, synthetic construct
  misc_feature 1..20: note = CRISPR gRNA sequence
  source 1..20: mol_type = other DNA
tgtagtaatagctactcagg

SEQ ID NO: 52370 - DNA, 20 bp, synthetic construct
  misc_feature 1..20: note = CRISPR gRNA sequence
  source 1..20: mol_type = other DNA
taatagctactcaggaggct

SEQ ID NO: 52371 - DNA, 20 bp, synthetic construct
  misc_feature 1..20: note = CRISPR gRNA sequence
  source 1..20: mol_type = other DNA
aatagctactcaggaggctg

SEQ ID NO: 52372 - DNA, 20 bp, synthetic construct
  misc_feature 1..20: note = CRISPR gRNA sequence
  source 1..20: mol_type = other DNA
ctactcaggaggctgaggca

SEQ ID NO: 52373 - DNA, 20 bp, synthetic construct
  misc_feature 1..20: note = CRISPR gRNA sequence
  source 1..20: mol_type = other DNA
tactcaggaggctgaggcat

SEQ ID NO: 52374 - DNA, 20 bp, synthetic construct
  misc_feature 1..20: note = CRISPR gRNA sequence
  source 1..20: mol_type = other DNA
gcatgggaatcacttgaacc

SEQ ID NO: 52375 - DNA, 20 bp, synthetic construct
  misc_feature 1..20: note = CRISPR gRNA sequence
  source 1..20: mol_type = other DNA
catgggaatcacttgaacct

SEQ ID NO: 52376 - DNA, 20 bp, synthetic construct
  misc_feature 1..20: note = CRISPR gRNA sequence
  source 1..20: mol_type = other DNA
tgggaatcacttgaacctgg

SEQ ID NO: 52377 - DNA, 20 bp, synthetic construct
  misc_feature 1..20: note = CRISPR gRNA sequence
  source 1..20: mol_type = other DNA
gggaatcacttgaacctggg

SEQ ID NO: 52378 - DNA, 20 bp, synthetic construct
  misc_feature 1..20: note = CRISPR gRNA sequence
  source 1..20: mol_type = other DNA
aatcacttgaacctgggagg

SEQ ID NO: 52379 - DNA, 20 bp, synthetic construct
  misc_feature 1..20: note = CRISPR gRNA sequence
  source 1..20: mol_type = other DNA
tcacttgaacctgggaggca

SEQ ID NO: 52380 - DNA, 20 bp, synthetic construct
  misc_feature 1..20: note = CRISPR gRNA sequence
  source 1..20: mol_type = other DNA
cacttgaacctgggaggcag

SEQ ID NO: 52381 - DNA, 20 bp, synthetic construct
  misc_feature 1..20: note = CRISPR gRNA sequence
  source 1..20: mol_type = other DNA
aacctgggaggcagaggttg

SEQ ID NO: 52382 - DNA, 20 bp, synthetic construct
  misc_feature 1..20: note = CRISPR gRNA sequence
  source 1..20: mol_type = other DNA
tgggaggcagaggttgcagt

SEQ ID NO: 52383 - DNA, 20 bp, synthetic construct
  misc_feature 1..20: note = CRISPR gRNA sequence
  source 1..20: mol_type = other DNA
ggcagaggttgcagtgagcc

SEQ ID NO: 52384 - DNA, 20 bp, synthetic construct
  misc_feature 1..20: note = CRISPR gRNA sequence
  source 1..20: mol_type = other DNA
aagatcgtaccactgcactc

SEQ ID NO: 52385 - DNA, 20 bp, synthetic construct
  misc_feature 1..20: note = CRISPR gRNA sequence
  source 1..20: mol_type = other DNA
cgtaccactgcactccagcc

SEQ ID NO: 52386 - DNA, 20 bp, synthetic construct
  misc_feature 1..20: note = CRISPR gRNA sequence
  source 1..20: mol_type = other DNA
gtaccactgcactccagcct

SEQ ID NO: 52387 - DNA, 20 bp, synthetic construct
  misc_feature 1..20: note = CRISPR gRNA sequence
  source 1..20: mol_type = other DNA
ctgcactccagcctgggtga

SEQ ID NO: 52388 - DNA, 20 bp, synthetic construct
  misc_feature 1..20: note = CRISPR gRNA sequence
  source 1..20: mol_type = other DNA
gcactccagcctgggtgaca

SEQ ID NO: 52389 - DNA, 20 bp, synthetic construct
  misc_feature 1..20: note = CRISPR gRNA sequence
  source 1..20: mol_type = other DNA
tccagcctgggtgacagagc

SEQ ID NO: 52390 - DNA, 20 bp, synthetic construct
  misc_feature 1..20: note = CRISPR gRNA sequence
  source 1..20: mol_type = other DNA
tctatctcaaaaaaataaaa

SEQ ID NO: 52391 - DNA, 20 bp, synthetic construct
  misc_feature 1..20: note = CRISPR gRNA sequence
  source 1..20: mol_type = other DNA
ctcaaaaaaataaaaaagaa

SEQ ID NO: 52392 - DNA, 20 bp, synthetic construct
  misc_feature 1..20: note = CRISPR gRNA sequence
  source 1..20: mol_type = other DNA
aaaacaatgctgccttaacc

SEQ ID NO: 52393 - DNA, 20 bp, synthetic construct
  misc_feature 1..20: note = CRISPR gRNA sequence
  source 1..20: mol_type = other DNA
aacaatgctgccttaaccca

SEQ ID NO: 52394 - DNA, 20 bp, synthetic construct
  misc_feature 1..20: note = CRISPR gRNA sequence
  source 1..20: mol_type = other DNA
acaatgctgccttaacccag

SEQ ID NO: 52395 - DNA, 20 bp, synthetic construct
  misc_feature 1..20: note = CRISPR gRNA sequence
  source 1..20: mol_type = other DNA
aatgctgccttaacccagag

SEQ ID NO: 52396 - DNA, 20 bp, synthetic construct
  misc_feature 1..20: note = CRISPR gRNA sequence
  source 1..20: mol_type = other DNA
gctgccttaacccagaggag

SEQ ID NO: 52397 - DNA, 20 bp, synthetic construct
  misc_feature 1..20: note = CRISPR gRNA sequence
  source 1..20: mol_type = other DNA
acccagaggagtggatatga

SEQ ID NO: 52398 - DNA, 20 bp, synthetic construct
  misc_feature 1..20: note = CRISPR gRNA sequence
  source 1..20: mol_type = other DNA
cagaggagtggatatgacag

SEQ ID NO: 52399 - DNA, 20 bp, synthetic construct
  misc_feature 1..20: note = CRISPR gRNA sequence
  source 1..20: mol_type = other DNA
tggatatgacagtggaaatt

SEQ ID NO: 52400 - DNA, 20 bp, synthetic construct
  misc_feature 1..20: note = CRISPR gRNA sequence
  source 1..20: mol_type = other DNA
agtggaaattcagcatacaa

SEQ ID NO: 52401 - DNA, 20 bp, synthetic construct
  misc_feature 1..20: note = CRISPR gRNA sequence
  source 1..20: mol_type = other DNA
gtggaaattcagcatacaac

SEQ ID NO: 52402 - DNA, 20 bp, synthetic construct
  misc_feature 1..20: note = CRISPR gRNA sequence
  source 1..20: mol_type = other DNA
aaattcagcatacaacaggt

SEQ ID NO: 52403 - DNA, 20 bp, synthetic construct
  misc_feature 1..20: note = CRISPR gRNA sequence
  source 1..20: mol_type = other DNA
cagcatacaacaggtcagcg

SEQ ID NO: 52404 - DNA, 20 bp, synthetic construct
  misc_feature 1..20: note = CRISPR gRNA sequence
  source 1..20: mol_type = other DNA
agcatacaacaggtcagcga

SEQ ID NO: 52405 - DNA, 20 bp, synthetic construct
  misc_feature 1..20: note = CRISPR gRNA sequence
  source 1..20: mol_type = other DNA
catacaacaggtcagcgaag

SEQ ID NO: 52406 - DNA, 20 bp, synthetic construct
  misc_feature 1..20: note = CRISPR gRNA sequence
  source 1..20: mol_type = other DNA
caacaggtcagcgaaggaga

SEQ ID NO: 52407 - DNA, 20 bp, synthetic construct
  misc_feature 1..20: note = CRISPR gRNA sequence
  source 1..20: mol_type = other DNA
aacaggtcagcgaaggagac

SEQ ID NO: 52408 - DNA, 20 bp, synthetic construct
  misc_feature 1..20: note = CRISPR gRNA sequence
  source 1..20: mol_type = other DNA
acaggtcagcgaaggagaca

SEQ ID NO: 52409 - DNA, 20 bp, synthetic construct
  misc_feature 1..20: note = CRISPR gRNA sequence
  source 1..20: mol_type = other DNA
tcagcgaaggagacagggac

SEQ ID NO: 52410 - DNA, 20 bp, synthetic construct
  misc_feature 1..20: note = CRISPR gRNA sequence
  source 1..20: mol_type = other DNA
gaaggagacagggactggct

SEQ ID NO: 52411 - DNA, 20 bp, synthetic construct
  misc_feature 1..20: note = CRISPR gRNA sequence
  source 1..20: mol_type = other DNA
aaggagacagggactggctt

SEQ ID NO: 52412 - DNA, 20 bp, synthetic construct
  misc_feature 1..20: note = CRISPR gRNA sequence
  source 1..20: mol_type = other DNA
cagggactggcttgggtctc

SEQ ID NO: 52413 - DNA, 20 bp, synthetic construct
  misc_feature 1..20: note = CRISPR gRNA sequence
  source 1..20: mol_type = other DNA
ctctagttgcccattaacac

SEQ ID NO: 52414 - DNA, 20 bp, synthetic construct
  misc_feature 1..20: note = CRISPR gRNA sequence
  source 1..20: mol_type = other DNA
cccattaacaccagaccaac

SEQ ID NO: 52415 - DNA, 20 bp, synthetic construct
  misc_feature 1..20: note = CRISPR gRNA sequence
  source 1..20: mol_type = other DNA
ccaaccagctcatcattgtt

SEQ ID NO: 52416 - DNA, 20 bp, synthetic construct
  misc_feature 1..20: note = CRISPR gRNA sequence
  source 1..20: mol_type = other DNA
tcattgttcagataattcgt

SEQ ID NO: 52417 - DNA, 20 bp, synthetic construct
  misc_feature 1..20: note = CRISPR gRNA sequence
  source 1..20: mol_type = other DNA
tcagataattcgtcagaacc

SEQ ID NO: 52418 - DNA, 20 bp, synthetic construct
  misc_feature 1..20: note = CRISPR gRNA sequence
  source 1..20: mol_type = other DNA
tcgtcagaacccagtgcatt

SEQ ID NO: 52419 - DNA, 20 bp, synthetic construct
  misc_feature 1..20: note = CRISPR gRNA sequence
  source 1..20: mol_type = other DNA
cgtcagaacccagtgcattt

SEQ ID NO: 52420 - DNA, 20 bp, synthetic construct
  misc_feature 1..20: note = CRISPR gRNA sequence
  source 1..20: mol_type = other DNA
tcagaacccagtgcatttag

SEQ ID NO: 52421 - DNA, 20 bp, synthetic construct
  misc_feature 1..20: note = CRISPR gRNA sequence
  source 1..20: mol_type = other DNA
agtgcatttaggagaaactc

SEQ ID NO: 52422 - DNA, 20 bp, synthetic construct
  misc_feature 1..20: note = CRISPR gRNA sequence
  source 1..20: mol_type = other DNA
ctgccttgctgtctctgctc

SEQ ID NO: 52423 - DNA, 20 bp, synthetic construct
  misc_feature 1..20: note = CRISPR gRNA sequence
  source 1..20: mol_type = other DNA
cttgctgtctctgctctaga

SEQ ID NO: 52424 - DNA, 20 bp, synthetic construct
  misc_feature 1..20: note = CRISPR gRNA sequence
  source 1..20: mol_type = other DNA
tgctgtctctgctctagatg

SEQ ID NO: 52425 - DNA, 20 bp, synthetic construct
  misc_feature 1..20: note = CRISPR gRNA sequence
  source 1..20: mol_type = other DNA
gctgtctctgctctagatgg

SEQ ID NO: 52426 - DNA, 20 bp, synthetic construct
  misc_feature 1..20: note = CRISPR gRNA sequence
  source 1..20: mol_type = other DNA
ctctgctctagatggaggac

SEQ ID NO: 52427 - DNA, 20 bp, synthetic construct
  misc_feature 1..20: note = CRISPR gRNA sequence
  source 1..20: mol_type = other DNA
tctgctctagatggaggacc

SEQ ID NO: 52428 - DNA, 20 bp, synthetic construct
  misc_feature 1..20: note = CRISPR gRNA sequence
  source 1..20: mol_type = other DNA
atggaggaccaggacaactc

SEQ ID NO: 52429 - DNA, 20 bp, synthetic construct
  misc_feature 1..20: note = CRISPR gRNA sequence
  source 1..20: mol_type = other DNA
ccaggacaactcaagacact

SEQ ID NO: 52430 - DNA, 20 bp, synthetic construct
  misc_feature 1..20: note = CRISPR gRNA sequence
  source 1..20: mol_type = other DNA
actcaagacactgagttccc

SEQ ID NO: 52431 - DNA, 20 bp, synthetic construct
  misc_feature 1..20: note = CRISPR gRNA sequence
  source 1..20: mol_type = other DNA
ctcaagacactgagttccct

SEQ ID NO: 52432 - DNA, 20 bp, synthetic construct
  misc_feature 1..20: note = CRISPR gRNA sequence
  source 1..20: mol_type = other DNA
tcaagacactgagttccctg

SEQ ID NO: 52433 - DNA, 20 bp, synthetic construct
  misc_feature 1..20: note = CRISPR gRNA sequence
  source 1..20: mol_type = other DNA
agttccctggggtttaccta

SEQ ID NO: 52434 - DNA, 20 bp, synthetic construct
  misc_feature 1..20: note = CRISPR gRNA sequence
  source 1..20: mol_type = other DNA
gtttacctacagccccttcc

SEQ ID NO: 52435 - DNA, 20 bp, synthetic construct
  misc_feature 1..20: note = CRISPR gRNA sequence
  source 1..20: mol_type = other DNA
tttacctacagccccttcct

SEQ ID NO: 52436 - DNA, 20 bp, synthetic construct
  misc_feature 1..20: note = CRISPR gRNA sequence
  source 1..20: mol_type = other DNA
ttacctacagccccttcctg

SEQ ID NO: 52437 - DNA, 20 bp, synthetic construct
  misc_feature 1..20: note = CRISPR gRNA sequence
  source 1..20: mol_type = other DNA
tacctacagccccttcctgg

SEQ ID NO: 52438 - DNA, 20 bp, synthetic construct
  misc_feature 1..20: note = CRISPR gRNA sequence
  source 1..20: mol_type = other DNA
acctacagccccttcctggg

SEQ ID NO: 52439 - DNA, 20 bp, synthetic construct
  misc_feature 1..20: note = CRISPR gRNA sequence
  source 1..20: mol_type = other DNA
cagccccttcctggggggcc

SEQ ID NO: 52440 - DNA, 20 bp, synthetic construct
  misc_feature 1..20: note = CRISPR gRNA sequence
  source 1..20: mol_type = other DNA
gccccttcctggggggcctg

SEQ ID NO: 52441 - DNA, 20 bp, synthetic construct
  misc_feature 1..20: note = CRISPR gRNA sequence
  source 1..20: mol_type = other DNA
gagccacttcccaacccccg

SEQ ID NO: 52442 - DNA, 20 bp, synthetic construct
  misc_feature 1..20: note = CRISPR gRNA sequence
  source 1..20: mol_type = other DNA
ttctgttccttcatcctctg

SEQ ID NO: 52443 - DNA, 20 bp, synthetic construct
  misc_feature 1..20: note = CRISPR gRNA sequence
  source 1..20: mol_type = other DNA
tctgttccttcatcctctgc

SEQ ID NO: 52444 - DNA, 20 bp, synthetic construct
  misc_feature 1..20: note = CRISPR gRNA sequence
  source 1..20: mol_type = other DNA
aggctgccctctcccctctc

SEQ ID NO: 52445 - DNA, 20 bp, synthetic construct
  misc_feature 1..20: note = CRISPR gRNA sequence
  source 1..20: mol_type = other DNA
ggctgccctctcccctctcc

SEQ ID NO: 52446 - DNA, 20 bp, synthetic construct
  misc_feature 1..20: note = CRISPR gRNA sequence
  source 1..20: mol_type = other DNA
gctgccctctcccctctccg

SEQ ID NO: 52447 - DNA, 20 bp, synthetic construct
  misc_feature 1..20: note = CRISPR gRNA sequence
  source 1..20: mol_type = other DNA
ctcccctctccggggcctcc

SEQ ID NO: 52448 - DNA, 20 bp, synthetic construct
  misc_feature 1..20: note = CRISPR gRNA sequence
  source 1..20: mol_type = other DNA
tcccctctccggggcctcca

SEQ ID NO: 52449 - DNA, 20 bp, synthetic construct
  misc_feature 1..20: note = CRISPR gRNA sequence
  source 1..20: mol_type = other DNA
cccctctccggggcctccaa

SEQ ID NO: 52450 - DNA, 20 bp, synthetic construct
  misc_feature 1..20: note = CRISPR gRNA sequence
  source 1..20: mol_type = other DNA
ctccggggcctccaagggcc

SEQ ID NO: 52451 - DNA, 20 bp, synthetic construct
  misc_feature 1..20: note = CRISPR gRNA sequence
  source 1..20: mol_type = other DNA
atctctgctgctttctcctc

SEQ ID NO: 52452 - DNA, 20 bp, synthetic construct
  misc_feature 1..20: note = CRISPR gRNA sequence
  source 1..20: mol_type = other DNA
tgctttctcctctggctgtt

SEQ ID NO: 52453 - DNA, 20 bp, synthetic construct
  misc_feature 1..20: note = CRISPR gRNA sequence
  source 1..20: mol_type = other DNA
ctttctcctctggctgtttg

SEQ ID NO: 52454 - DNA, 20 bp, synthetic construct
  misc_feature 1..20: note = CRISPR gRNA sequence
  source 1..20: mol_type = other DNA
tttctcctctggctgtttgg

SEQ ID NO: 52455 - DNA, 20 bp, synthetic construct
  misc_feature 1..20: note = CRISPR gRNA sequence
  source 1..20: mol_type = other DNA
ttctcctctggctgtttgga

SEQ ID NO: 52456 - DNA, 20 bp, synthetic construct
  misc_feature 1..20: note = CRISPR gRNA sequence
  source 1..20: mol_type = other DNA
tctcctctggctgtttggag

SEQ ID NO: 52457 - DNA, 20 bp, synthetic construct
  misc_feature 1..20: note = CRISPR gRNA sequence
  source 1..20: mol_type = other DNA
tcctctggctgtttggaggg

SEQ ID NO: 52458 - DNA, 20 bp, synthetic construct
  misc_feature 1..20: note = CRISPR gRNA sequence
  source 1..20: mol_type = other DNA
cctctggctgtttggagggg

SEQ ID NO: 52459 - DNA, 20 bp, synthetic construct
  misc_feature 1..20: note = CRISPR gRNA sequence
  source 1..20: mol_type = other DNA
ggctgtttggaggggaggca

SEQ ID NO: 52460 - DNA, 20 bp, synthetic construct
  misc_feature 1..20: note = CRISPR gRNA sequence
  source 1..20: mol_type = other DNA
ctgtttggaggggaggcatg

SEQ ID NO: 52461 - DNA, 20 bp, synthetic construct
  misc_feature 1..20: note = CRISPR gRNA sequence
  source 1..20: mol_type = other DNA
tggaggggaggcatggagta

SEQ ID NO: 52462 - DNA, 20 bp, synthetic construct
  misc_feature 1..20: note = CRISPR gRNA sequence
  source 1..20: mol_type = other DNA
ggaggggaggcatggagtac

SEQ ID NO: 52463 - DNA, 20 bp, synthetic construct
  misc_feature 1..20: note = CRISPR gRNA sequence
  source 1..20: mol_type = other DNA
gaggggaggcatggagtaca

SEQ ID NO: 52464 - DNA, 20 bp, synthetic construct
  misc_feature 1..20: note = CRISPR gRNA sequence
  source 1..20: mol_type = other DNA
aggggaggcatggagtacag

SEQ ID NO: 52465 - DNA, 20 bp, synthetic construct
  misc_feature 1..20: note = CRISPR gRNA sequence
  source 1..20: mol_type = other DNA
tacaggggccctacatcaac

SEQ ID NO: 52466 - DNA, 20 bp, synthetic construct
  misc_feature 1..20: note = CRISPR gRNA sequence
  source 1..20: mol_type = other DNA
gggccctacatcaactggct

SEQ ID NO: 52467 - DNA, 20 bp, synthetic construct
  misc_feature 1..20: note = CRISPR gRNA sequence
  source 1..20: mol_type = other DNA
cctacatcaactggctcagt

SEQ ID NO: 52468 - DNA, 20 bp, synthetic construct
  misc_feature 1..20: note = CRISPR gRNA sequence
  source 1..20: mol_type = other DNA
catcaactggctcagtgagc

SEQ ID NO: 52469 - DNA, 20 bp, synthetic construct
  misc_feature 1..20: note = CRISPR gRNA sequence
  source 1..20: mol_type = other DNA
atcaactggctcagtgagct

SEQ ID NO: 52470 - DNA, 20 bp, synthetic construct
  misc_feature 1..20: note = CRISPR gRNA sequence
  source 1..20: mol_type = other DNA
tcaactggctcagtgagctg

SEQ ID NO: 52471 - DNA, 20 bp, synthetic construct
  misc_feature 1..20: note = CRISPR gRNA sequence
  source 1..20: mol_type = other DNA
caactggctcagtgagctgg

SEQ ID NO: 52472 - DNA, 20 bp, synthetic construct
  misc_feature 1..20: note = CRISPR gRNA sequence
  source 1..20: mol_type = other DNA
aactggctcagtgagctggg

SEQ ID NO: 52473 - DNA, 20 bp, synthetic construct
  misc_feature 1..20: note = CRISPR gRNA sequence
  source 1..20: mol_type = other DNA
tggctcagtgagctgggggg

SEQ ID NO: 52474 - DNA, 20 bp, synthetic construct
  misc_feature 1..20: note = CRISPR gRNA sequence
  source 1..20: mol_type = other DNA
ggctcagtgagctggggggc

SEQ ID NO: 52475 - DNA, 20 bp, synthetic construct
  misc_feature 1..20: note = CRISPR gRNA sequence
  source 1..20: mol_type = other DNA
gctcagtgagctggggggca

SEQ ID NO: 52476 - DNA, 20 bp, synthetic construct
  misc_feature 1..20: note = CRISPR gRNA sequence
  source 1..20: mol_type = other DNA
cagtgagctggggggcaggg

SEQ ID NO: 52477 - DNA, 20 bp, synthetic construct
  misc_feature 1..20: note = CRISPR gRNA sequence
  source 1..20: mol_type = other DNA
agtgagctggggggcagggt

SEQ ID NO: 52478 - DNA, 20 bp, synthetic construct
  misc_feature 1..20: note = CRISPR gRNA sequence
  source 1..20: mol_type = other DNA
gtgagctggggggcagggta

SEQ ID NO: 52479 - DNA, 20 bp, synthetic construct
  misc_feature 1..20: note = CRISPR gRNA sequence
  source 1..20: mol_type = other DNA
agctggggggcagggtaggg

SEQ ID NO: 52480 - DNA, 20 bp, synthetic construct
  misc_feature 1..20: note = CRISPR gRNA sequence
  source 1..20: mol_type = other DNA
gctggggggcagggtagggc

SEQ ID NO: 52481 - DNA, 20 bp, synthetic construct
  misc_feature 1..20: note = CRISPR gRNA sequence
  source 1..20: mol_type = other DNA
tggggggcagggtagggcgg

SEQ ID NO: 52482 - DNA, 20 bp, synthetic construct
  misc_feature 1..20: note = CRISPR gRNA sequence
  source 1..20: mol_type = other DNA
ggggggcagggtagggcggg

SEQ ID NO: 52483 - DNA, 20 bp, synthetic construct
  misc_feature 1..20: note = CRISPR gRNA sequence
  source 1..20: mol_type = other DNA
ggggcagggtagggcgggag

SEQ ID NO: 52484 - DNA, 20 bp, synthetic construct
  misc_feature 1..20: note = CRISPR gRNA sequence
  source 1..20: mol_type = other DNA
gcagggtagggcgggaggag

SEQ ID NO: 52485 - DNA, 20 bp, synthetic construct
  misc_feature 1..20: note = CRISPR gRNA sequence
  source 1..20: mol_type = other DNA
cgggaggagcagcctcatgt

SEQ ID NO: 52486 - DNA, 20 bp, synthetic construct
  misc_feature 1..20: note = CRISPR gRNA sequence
  source 1..20: mol_type = other DNA
ggaggagcagcctcatgttg

SEQ ID NO: 52487 - DNA, 20 bp, synthetic construct
  misc_feature 1..20: note = CRISPR gRNA sequence
  source 1..20: mol_type = other DNA
cctcatgttggagcctctgc

SEQ ID NO: 52488 - DNA, 20 bp, synthetic construct
  misc_feature 1..20: note = CRISPR gRNA sequence
  source 1..20: mol_type = other DNA
ctcatgttggagcctctgcc

SEQ ID NO: 52489 - DNA, 20 bp, synthetic construct
  misc_feature 1..20: note = CRISPR gRNA sequence
  source 1..20: mol_type = other DNA
tcatgttggagcctctgcca

SEQ ID NO: 52490 - DNA, 20 bp, synthetic construct
  misc_feature 1..20: note = CRISPR gRNA sequence
  source 1..20: mol_type = other DNA
ttggagcctctgccagggcc

SEQ ID NO: 52491 - DNA, 20 bp, synthetic construct
  misc_feature 1..20: note = CRISPR gRNA sequence
  source 1..20: mol_type = other DNA
tggagcctctgccagggccc

SEQ ID NO: 52492 - DNA, 20 bp, synthetic construct
  misc_feature 1..20: note = CRISPR gRNA sequence
  source 1..20: mol_type = other DNA
gcctctgccagggcccaggc

SEQ ID NO: 52493 - DNA, 20 bp, synthetic construct
  misc_feature 1..20: note = CRISPR gRNA sequence
  source 1..20: mol_type = other DNA
ctctgccagggcccaggctg

SEQ ID NO: 52494 - DNA, 20 bp, synthetic construct
  misc_feature 1..20: note = CRISPR gRNA sequence
  source 1..20: mol_type = other DNA
tctgccagggcccaggctgg

SEQ ID NO: 52495 - DNA, 20 bp, synthetic construct
  misc_feature 1..20: note = CRISPR gRNA sequence
  source 1..20: mol_type = other DNA
caactctaccctttctgccc

SEQ ID NO: 52496 - DNA, 20 bp, synthetic construct
  misc_feature 1..20: note = CRISPR gRNA sequence
  source 1..20: mol_type = other DNA
aactctaccctttctgcccc

SEQ ID NO: 52497 - DNA, 20 bp, synthetic construct
  misc_feature 1..20: note = CRISPR gRNA sequence
  source 1..20: mol_type = other DNA
actctaccctttctgcccca

SEQ ID NO: 52498 - DNA, 20 bp, synthetic construct
  misc_feature 1..20: note = CRISPR gRNA sequence
  source 1..20: mol_type = other DNA
accctttctgccccagggac

SEQ ID NO: 52499 - DNA, 20 bp, synthetic construct
  misc_feature 1..20: note = CRISPR gRNA sequence
  source 1..20: mol_type = other DNA
ccctttctgccccagggact

SEQ ID NO: 52500 - DNA, 20 bp, synthetic construct
  misc_feature 1..20: note = CRISPR gRNA sequence
  source 1..20: mol_type = other DNA
tctgccccagggactgggca

SEQ ID NO: 52501 - DNA, 20 bp, synthetic construct
  misc_feature 1..20: note = CRISPR gRNA sequence
  source 1..20: mol_type = other DNA
ctgccccagggactgggcat

SEQ ID NO: 52502 - DNA, 20 bp, synthetic construct
  misc_feature 1..20: note = CRISPR gRNA sequence
  source 1..20: mol_type = other DNA
gggactgggcatgggcccct

SEQ ID NO: 52503 - DNA, 20 bp, synthetic construct
  misc_feature 1..20: note = CRISPR gRNA sequence
  source 1..20: mol_type = other DNA
ggactgggcatgggcccctg

SEQ ID NO: 52504 - DNA, 20 bp, synthetic construct
  misc_feature 1..20: note = CRISPR gRNA sequence
  source 1..20: mol_type = other DNA
gggcatgggcccctgaggca

SEQ ID NO: 52505 - DNA, 20 bp, synthetic construct
  misc_feature 1..20: note = CRISPR gRNA sequence
  source 1..20: mol_type = other DNA
atgggcccctgaggcacagt

SEQ ID NO: 52506 - DNA, 20 bp, synthetic construct
  misc_feature 1..20: note = CRISPR gRNA sequence
  source 1..20: mol_type = other DNA
tgggcccctgaggcacagtc

SEQ ID NO: 52507 - DNA, 20 bp, synthetic construct
  misc_feature 1..20: note = CRISPR gRNA sequence
  source 1..20: mol_type = other DNA
ccctgaggcacagtcaggac

SEQ ID NO: 52508 - DNA, 20 bp, synthetic construct
  misc_feature 1..20: note = CRISPR gRNA sequence
  source 1..20: mol_type = other DNA
cctgaggcacagtcaggact

SEQ ID NO: 52509 - DNA, 20 bp, synthetic construct
  misc_feature 1..20: note = CRISPR gRNA sequence
  source 1..20: mol_type = other DNA
ctgaggcacagtcaggactg

SEQ ID NO: 52510 - DNA, 20 bp, synthetic construct
  misc_feature 1..20: note = CRISPR gRNA sequence
  source 1..20: mol_type = other DNA
tcaggactggggcctttatt

SEQ ID NO: 52511 - DNA, 20 bp, synthetic construct
  misc_feature 1..20: note = CRISPR gRNA sequence
  source 1..20: mol_type = other DNA
caggactggggcctttattg

SEQ ID NO: 52512 - DNA, 20 bp, synthetic construct
  misc_feature 1..20: note = CRISPR gRNA sequence
  source 1..20: mol_type = other DNA
aggactggggcctttattga

SEQ ID NO: 52513 - DNA, 20 bp, synthetic construct
  misc_feature 1..20: note = CRISPR gRNA sequence
  source 1..20: mol_type = other DNA
actggggcctttattgaggg

SEQ ID NO: 52514 - DNA, 20 bp, synthetic construct
  misc_feature 1..20: note = CRISPR gRNA sequence
  source 1..20: mol_type = other DNA
tttattgagggtggtctttc

SEQ ID NO: 52515 - DNA, 20 bp, synthetic construct
  misc_feature 1..20: note = CRISPR gRNA sequence
  source 1..20: mol_type = other DNA
ttccagaaacacatcccgta

SEQ ID NO: 52516 - DNA, 20 bp, synthetic construct
  misc_feature 1..20: note = CRISPR gRNA sequence
  source 1..20: mol_type = other DNA
catcccgtatggtgtcccac

SEQ ID NO: 52517 - DNA, 20 bp, synthetic construct
  misc_feature 1..20: note = CRISPR gRNA sequence
  source 1..20: mol_type = other DNA
ccagacccccaaatacacca

SEQ ID NO: 52518 - DNA, 20 bp, synthetic construct
  misc_feature 1..20: note = CRISPR gRNA sequence
  source 1..20: mol_type = other DNA
cagacccccaaatacaccat

SEQ ID NO: 52519 - DNA, 20 bp, synthetic construct
  misc_feature 1..20: note = CRISPR gRNA sequence
  source 1..20: mol_type = other DNA
cccaaatacaccatgggctc

SEQ ID NO: 52520 - DNA, 20 bp, synthetic construct
  misc_feature 1..20: note = CRISPR gRNA sequence
  source 1..20: mol_type = other DNA
aatacaccatgggctctggt

SEQ ID NO: 52521 - DNA, 20 bp, synthetic construct
  misc_feature 1..20: note = CRISPR gRNA sequence
  source 1..20: mol_type = other DNA
accatgggctctggttggca

SEQ ID NO: 52522 - DNA, 20 bp, synthetic construct
  misc_feature 1..20: note = CRISPR gRNA sequence
  source 1..20: mol_type = other DNA
ccatgggctctggttggcaa

SEQ ID NO: 52523 - DNA, 20 bp, synthetic construct
  misc_feature 1..20: note = CRISPR gRNA sequence
  source 1..20: mol_type = other DNA
atgggctctggttggcaaag

SEQ ID NO: 52524 - DNA, 20 bp, synthetic construct
  misc_feature 1..20: note = CRISPR gRNA sequence
  source 1..20: mol_type = other DNA
tgggctctggttggcaaagg

SEQ ID NO: 52525 - DNA, 20 bp, synthetic construct
  misc_feature 1..20: note = CRISPR gRNA sequence
  source 1..20: mol_type = other DNA
cctcctttttttttttttta

SEQ ID NO: 52526 - DNA, 20 bp, synthetic construct
  misc_feature 1..20: note = CRISPR gRNA sequence
  source 1..20: mol_type = other DNA
tttttttttttttaaagcaa

SEQ ID NO: 52527 - DNA, 20 bp, synthetic construct
  misc_feature 1..20: note = CRISPR gRNA sequence
  source 1..20: mol_type = other DNA
actctttaccacatcccaca

SEQ ID NO: 52528 - DNA, 20 bp, synthetic construct
  misc_feature 1..20: note = CRISPR gRNA sequence
  source 1..20: mol_type = other DNA
atggtatgcccatgtgtaca

SEQ ID NO: 52529 - DNA, 20 bp, synthetic construct
  misc_feature 1..20: note = CRISPR gRNA sequence
  source 1..20: mol_type = other DNA
tggtatgcccatgtgtacac

SEQ ID NO: 52530 - DNA, 20 bp, synthetic construct
  misc_feature 1..20: note = CRISPR gRNA sequence
  source 1..20: mol_type = other DNA
tgcccatgtgtacacaggca

SEQ ID NO: 52531 - DNA, 20 bp, synthetic construct
  misc_feature 1..20: note = CRISPR gRNA sequence
  source 1..20: mol_type = other DNA
ccatgtgtacacaggcaaag

SEQ ID NO: 52532 - DNA, 20 bp, synthetic construct
  misc_feature 1..20: note = CRISPR gRNA sequence
  source 1..20: mol_type = other DNA
acacaggcaaagtagacctg

SEQ ID NO: 52533 - DNA, 20 bp, synthetic construct
  misc_feature 1..20: note = CRISPR gRNA sequence
  source 1..20: mol_type = other DNA
agacctgcagtgcttgaatt

SEQ ID NO: 52534 - DNA, 20 bp, synthetic construct
  misc_feature 1..20: note = CRISPR gRNA sequence
  source 1..20: mol_type = other DNA
gacctgcagtgcttgaattc

SEQ ID NO: 52535 - DNA, 20 bp, synthetic construct
  misc_feature 1..20: note = CRISPR gRNA sequence
  source 1..20: mol_type = other DNA
acctgcagtgcttgaattca

SEQ ID NO: 52536 - DNA, 20 bp, synthetic construct
  misc_feature 1..20: note = CRISPR gRNA sequence
  source 1..20: mol_type = other DNA
ctgcagtgcttgaattcagg

SEQ ID NO: 52537 - DNA, 20 bp, synthetic construct
  misc_feature 1..20: note = CRISPR gRNA sequence
  source 1..20: mol_type = other DNA
tgcagtgcttgaattcaggg

SEQ ID NO: 52538 - DNA, 20 bp, synthetic construct
  misc_feature 1..20: note = CRISPR gRNA sequence
  source 1..20: mol_type = other DNA
gcagtgcttgaattcaggga

SEQ ID NO: 52539 - DNA, 20 bp, synthetic construct
  misc_feature 1..20: note = CRISPR gRNA sequence
  source 1..20: mol_type = other DNA
cagtgcttgaattcagggag

SEQ ID NO: 52540 - DNA, 20 bp, synthetic construct
  misc_feature 1..20: note = CRISPR gRNA sequence
  source 1..20: mol_type = other DNA
agtgcttgaattcagggagg

SEQ ID NO: 52541 - DNA, 20 bp, synthetic construct
  misc_feature 1..20: note = CRISPR gRNA sequence
  source 1..20: mol_type = other DNA
gtgcttgaattcagggaggg

SEQ ID NO: 52542 - DNA, 20 bp, synthetic construct
  misc_feature 1..20: note = CRISPR gRNA sequence
  source 1..20: mol_type = other DNA
ttgaattcagggagggggga

SEQ ID NO: 52543 - DNA, 20 bp, synthetic construct
  misc_feature 1..20: note = CRISPR gRNA sequence
  source 1..20: mol_type = other DNA
gaattcagggaggggggatg

SEQ ID NO: 52544 - DNA, 20 bp, synthetic construct
  misc_feature 1..20: note = CRISPR gRNA sequence
  source 1..20: mol_type = other DNA
gccccacaatctatcttccc

SEQ ID NO: 52545 - DNA, 20 bp, synthetic construct
  misc_feature 1..20: note = CRISPR gRNA sequence
  source 1..20: mol_type = other DNA
tctatcttccctggcttccc

SEQ ID NO: 52546 - DNA, 20 bp, synthetic construct
  misc_feature 1..20: note = CRISPR gRNA sequence
  source 1..20: mol_type = other DNA
atcttccctggcttccccgg

SEQ ID NO: 52547 - DNA, 20 bp, synthetic construct
  misc_feature 1..20: note = CRISPR gRNA sequence
  source 1..20: mol_type = other DNA
tggcttccccggtggaaccc

SEQ ID NO: 52548 - DNA, 20 bp, synthetic construct
  misc_feature 1..20: note = CRISPR gRNA sequence
  source 1..20: mol_type = other DNA
ggcttccccggtggaacccc

SEQ ID NO: 52549 - DNA, 20 bp, synthetic construct
  misc_feature 1..20: note = CRISPR gRNA sequence
  source 1..20: mol_type = other DNA
gcttccccggtggaaccccg

SEQ ID NO: 52550 - DNA, 20 bp, synthetic construct
  misc_feature 1..20: note = CRISPR gRNA sequence
  source 1..20: mol_type = other DNA
gtggaaccccggggaatcac

SEQ ID NO: 52551 - DNA, 20 bp, synthetic construct
  misc_feature 1..20: note = CRISPR gRNA sequence
  source 1..20: mol_type = other DNA
cccggggaatcactggactt

SEQ ID NO: 52552 - DNA, 20 bp, synthetic construct
  misc_feature 1..20: note = CRISPR gRNA sequence
  source 1..20: mol_type = other DNA
aatcactggacttcagcatt

SEQ ID NO: 52553 - DNA, 20 bp, synthetic construct
  misc_feature 1..20: note = CRISPR gRNA sequence
  source 1..20: mol_type = other DNA
agtaccttgatgactattta

SEQ ID NO: 52554 - DNA, 20 bp, synthetic construct
  misc_feature 1..20: note = CRISPR gRNA sequence
  source 1..20: mol_type = other DNA
atttatagcaataatcctgc

SEQ ID NO: 52555 - DNA, 20 bp, synthetic construct
  misc_feature 1..20: note = CRISPR gRNA sequence
  source 1..20: mol_type = other DNA
aataatcctgcaagtgatca

SEQ ID NO: 52556 - DNA, 20 bp, synthetic construct
  misc_feature 1..20: note = CRISPR gRNA sequence
  source 1..20: mol_type = other DNA
caagtgatcacagtactcta

SEQ ID NO: 52557 - DNA, 20 bp, synthetic construct
  misc_feature 1..20: note = CRISPR gRNA sequence
  source 1..20: mol_type = other DNA
acagtactctacagttgaca

SEQ ID NO: 52558 - DNA, 20 bp, synthetic construct
  misc_feature 1..20: note = CRISPR gRNA sequence
  source 1..20: mol_type = other DNA
tattgcactttccccaacca

SEQ ID NO: 52559 - DNA, 20 bp, synthetic construct
  misc_feature 1..20: note = CRISPR gRNA sequence
  source 1..20: mol_type = other DNA
attgcactttccccaaccac

SEQ ID NO: 52560 - DNA, 20 bp, synthetic construct
  misc_feature 1..20: note = CRISPR gRNA sequence
  source 1..20: mol_type = other DNA
ctttccccaaccacaggtaa

SEQ ID NO: 52561 - DNA, 20 bp, synthetic construct
  misc_feature 1..20: note = CRISPR gRNA sequence
  source 1..20: mol_type = other DNA
ttccccaaccacaggtaatg

SEQ ID NO: 52562 - DNA, 20 bp, synthetic construct
  misc_feature 1..20: note = CRISPR gRNA sequence
  source 1..20: mol_type = other DNA
tccccaaccacaggtaatgg

SEQ ID NO: 52563 - DNA, 20 bp, synthetic construct
  misc_feature 1..20: note = CRISPR gRNA sequence
  source 1..20: mol_type = other DNA
ccccaaccacaggtaatgga

SEQ ID NO: 52564 - DNA, 20 bp, synthetic construct
  misc_feature 1..20: note = CRISPR gRNA sequence
  source 1..20: mol_type = other DNA
cccaaccacaggtaatggag

SEQ ID NO: 52565 - DNA, 20 bp, synthetic construct
  misc_feature 1..20: note = CRISPR gRNA sequence
  source 1..20: mol_type = other DNA
ccaaccacaggtaatggagg

SEQ ID NO: 52566 - DNA, 20 bp, synthetic construct
  misc_feature 1..20: note = CRISPR gRNA sequence
  source 1..20: mol_type = other DNA
ctgaaactcccacctgtgct

SEQ ID NO: 52567 - DNA, 20 bp, synthetic construct
  misc_feature 1..20: note = CRISPR gRNA sequence
  source 1..20: mol_type = other DNA
ccacctgtgctcagaccgcc

SEQ ID NO: 52568 - DNA, 20 bp, synthetic construct
  misc_feature 1..20: note = CRISPR gRNA sequence
  source 1..20: mol_type = other DNA
ctcagaccgcccagtgctgc

SEQ ID NO: 52569 - DNA, 20 bp, synthetic construct
  misc_feature 1..20: note = CRISPR gRNA sequence
  source 1..20: mol_type = other DNA
agaccgcccagtgctgccag

SEQ ID NO: 52570 - DNA, 20 bp, synthetic construct
  misc_feature 1..20: note = CRISPR gRNA sequence
  source 1..20: mol_type = other DNA
gaccgcccagtgctgccagt

SEQ ID NO: 52571 - DNA, 20 bp, synthetic construct
  misc_feature 1..20: note = CRISPR gRNA sequence
  source 1..20: mol_type = other DNA
atttatttatttatttattt

SEQ ID NO: 52572 - DNA, 20 bp, synthetic construct
  misc_feature 1..20: note = CRISPR gRNA sequence
  source 1..20: mol_type = other DNA
atttatttatttatttgaga

SEQ ID NO: 52573 - DNA, 20 bp, synthetic construct
  misc_feature 1..20: note = CRISPR gRNA sequence
  source 1..20: mol_type = other DNA
ttatttatttatttgagaca

SEQ ID NO: 52574 - DNA, 20 bp, synthetic construct
  misc_feature 1..20: note = CRISPR gRNA sequence
  source 1..20: mol_type = other DNA
cagagtcttgctctgttgcc

SEQ ID NO: 52575 - DNA, 20 bp, synthetic construct
  misc_feature 1..20: note = CRISPR gRNA sequence
  source 1..20: mol_type = other DNA
agagtcttgctctgttgccc

SEQ ID NO: 52576 - DNA, 20 bp, synthetic construct
  misc_feature 1..20: note = CRISPR gRNA sequence
  source 1..20: mol_type = other DNA
tcttgctctgttgcccaggc

SEQ ID NO: 52577 - DNA, 20 bp, synthetic construct
  misc_feature 1..20: note = CRISPR gRNA sequence
  source 1..20: mol_type = other DNA
ttgctctgttgcccaggctg

SEQ ID NO: 52578 - DNA, 20 bp, synthetic construct
  misc_feature 1..20: note = CRISPR gRNA sequence
  source 1..20: mol_type = other DNA
tgctctgttgcccaggctgg

SEQ ID NO: 52579 - DNA, 20 bp, synthetic construct
  misc_feature 1..20: note = CRISPR gRNA sequence
  source 1..20: mol_type = other DNA
ctgttgcccaggctggagga

SEQ ID NO: 52580 - DNA, 20 bp, synthetic construct
  misc_feature 1..20: note = CRISPR gRNA sequence
  source 1..20: mol_type = other DNA
ttgcccaggctggaggacag

SEQ ID NO: 52581 - DNA, 20 bp, synthetic construct
  misc_feature 1..20: note = CRISPR gRNA sequence
  source 1..20: mol_type = other DNA
caggctggaggacagtggcg

SEQ ID NO: 52582 - DNA, 20 bp, synthetic construct
  misc_feature 1..20: note = CRISPR gRNA sequence
  source 1..20: mol_type = other DNA
ggaggacagtggcgcagtct

SEQ ID NO: 52583 - DNA, 20 bp, synthetic construct
  misc_feature 1..20: note = CRISPR gRNA sequence
  source 1..20: mol_type = other DNA
tcaccacaatctctgcctcc

SEQ ID NO: 52584 - DNA, 20 bp, synthetic construct
  misc_feature 1..20: note = CRISPR gRNA sequence
  source 1..20: mol_type = other DNA
caccacaatctctgcctccc

SEQ ID NO: 52585 - DNA, 20 bp, synthetic construct
  misc_feature 1..20: note = CRISPR gRNA sequence
  source 1..20: mol_type = other DNA
aatctctgcctcccgggttc

SEQ ID NO: 52586 - DNA, 20 bp, synthetic construct
  misc_feature 1..20: note = CRISPR gRNA sequence
  source 1..20: mol_type = other DNA
tctgcctcccgggttcaagc

SEQ ID NO: 52587 - DNA, 20 bp, synthetic construct
  misc_feature 1..20: note = CRISPR gRNA sequence
  source 1..20: mol_type = other DNA
gcaagtctcctgcctgcctc

SEQ ID NO: 52588 - DNA, 20 bp, synthetic construct
  misc_feature 1..20: note = CRISPR gRNA sequence
  source 1..20: mol_type = other DNA
aagtctcctgcctgcctcca

SEQ ID NO: 52589 - DNA, 20 bp, synthetic construct
  misc_feature 1..20: note = CRISPR gRNA sequence
  source 1..20: mol_type = other DNA
tctcctgcctgcctccagag

SEQ ID NO: 52590 - DNA, 20 bp, synthetic construct
  misc_feature 1..20: note = CRISPR gRNA sequence
  source 1..20: mol_type = other DNA
ctgcctgcctccagagtagc

SEQ ID NO: 52591 - DNA, 20 bp, synthetic construct
  misc_feature 1..20: note = CRISPR gRNA sequence
  source 1..20: mol_type = other DNA
tgcctgcctccagagtagct

SEQ ID NO: 52592 - DNA, 20 bp, synthetic construct
  misc_feature 1..20: note = CRISPR gRNA sequence
  source 1..20: mol_type = other DNA
ctccagagtagctgggatta

SEQ ID NO: 52593 - DNA, 20 bp, synthetic construct
  misc_feature 1..20: note = CRISPR gRNA sequence
  source 1..20: mol_type = other DNA
tccagagtagctgggattac

SEQ ID NO: 52594 - DNA, 20 bp, synthetic construct
  misc_feature 1..20: note = CRISPR gRNA sequence
  source 1..20: mol_type = other DNA
ccagagtagctgggattaca

SEQ ID NO: 52595 - DNA, 20 bp, synthetic construct
  misc_feature 1..20: note = CRISPR gRNA sequence
  source 1..20: mol_type = other DNA
cagagtagctgggattacag

SEQ ID NO: 52596 - DNA, 20 bp, synthetic construct
  misc_feature 1..20: note = CRISPR gRNA sequence
  source 1..20: mol_type = other DNA
caggggtgcaccaccatgcc

SEQ ID NO: 52597 - DNA, 20 bp, synthetic construct
  misc_feature 1..20: note = CRISPR gRNA sequence
  source 1..20: mol_type = other DNA
ctggctaatttttgtatttt

SEQ ID NO: 52598 - DNA, 20 bp, synthetic construct
  misc_feature 1..20: note = CRISPR gRNA sequence
  source 1..20: mol_type = other DNA
gctaatttttgtatttttag

SEQ ID NO: 52599 - DNA, 20 bp, synthetic construct
  misc_feature 1..20: note = CRISPR gRNA sequence
  source 1..20: mol_type = other DNA
taatttttgtatttttagta

SEQ ID NO: 52600 - DNA, 20 bp, synthetic construct
  misc_feature 1..20: note = CRISPR gRNA sequence
  source 1..20: mol_type = other DNA
ttttgtatttttagtagaga

SEQ ID NO: 52601 - DNA, 20 bp, synthetic construct
  misc_feature 1..20: note = CRISPR gRNA sequence
  source 1..20: mol_type = other DNA
tttgtatttttagtagagat

SEQ ID NO: 52602 - DNA, 20 bp, synthetic construct
  misc_feature 1..20: note = CRISPR gRNA sequence
  source 1..20: mol_type = other DNA
ttgtatttttagtagagatg

SEQ ID NO: 52603 - DNA, 20 bp, synthetic construct
  misc_feature 1..20: note = CRISPR gRNA sequence
  source 1..20: mol_type = other DNA
gagatggggtttcactatgt

SEQ ID NO: 52604 - DNA, 20 bp, synthetic construct
  misc_feature 1..20: note = CRISPR gRNA sequence
  source 1..20: mol_type = other DNA
tggggtttcactatgttggc

SEQ ID NO: 52605 - DNA, 20 bp, synthetic construct
  misc_feature 1..20: note = CRISPR gRNA sequence
  source 1..20: mol_type = other DNA
ggggtttcactatgttggcc

SEQ ID NO: 52606 - DNA, 20 bp, synthetic construct
  misc_feature 1..20: note = CRISPR gRNA sequence
  source 1..20: mol_type = other DNA
tttcactatgttggccaggc

SEQ ID NO: 52607 - DNA, 20 bp, synthetic construct
  misc_feature 1..20: note = CRISPR gRNA sequence
  source 1..20: mol_type = other DNA
gaactcctgacctcatgatc

SEQ ID NO: 52608 - DNA, 20 bp, synthetic construct
  misc_feature 1..20: note = CRISPR gRNA sequence
  source 1..20: mol_type = other DNA
acctcatgatccagccacct

SEQ ID NO: 52609 - DNA, 20 bp, synthetic construct
  misc_feature 1..20: note = CRISPR gRNA sequence
  source 1..20: mol_type = other DNA
ccagccacctcggcctccca

SEQ ID NO: 52610 - DNA, 20 bp, synthetic construct
  misc_feature 1..20: note = CRISPR gRNA sequence
  source 1..20: mol_type = other DNA
acctcggcctcccaaagtgc

SEQ ID NO: 52611 - DNA, 20 bp, synthetic construct
  misc_feature 1..20: note = CRISPR gRNA sequence
  source 1..20: mol_type = other DNA
cctcggcctcccaaagtgct

SEQ ID NO: 52612 - DNA, 20 bp, synthetic construct
  misc_feature 1..20: note = CRISPR gRNA sequence
  source 1..20: mol_type = other DNA
ctcccaaagtgctgggatta

SEQ ID NO: 52613 - DNA, 20 bp, synthetic construct
  misc_feature 1..20: note = CRISPR gRNA sequence
  source 1..20: mol_type = other DNA
tcccaaagtgctgggattat

SEQ ID NO: 52614 - DNA, 20 bp, synthetic construct
  misc_feature 1..20: note = CRISPR gRNA sequence
  source 1..20: mol_type = other DNA
agtgctgggattataggcgt

SEQ ID NO: 52615 - DNA, 20 bp, synthetic construct
  misc_feature 1..20: note = CRISPR gRNA sequence
  source 1..20: mol_type = other DNA
ataggcgtgagtcaccgtgc

SEQ ID NO: 52616 - DNA, 20 bp, synthetic construct
  misc_feature 1..20: note = CRISPR gRNA sequence
  source 1..20: mol_type = other DNA
taggcgtgagtcaccgtgcc

SEQ ID NO: 52617 - DNA, 20 bp, synthetic construct
  misc_feature 1..20: note = CRISPR gRNA sequence
  source 1..20: mol_type = other DNA
gagtcaccgtgccgggccgc

SEQ ID NO: 52618 - DNA, 20 bp, synthetic construct
  misc_feature 1..20: note = CRISPR gRNA sequence
  source 1..20: mol_type = other DNA
tcaccgtgccgggccgccag

SEQ ID NO: 52619 - DNA, 20 bp, synthetic construct
  misc_feature 1..20: note = CRISPR gRNA sequence
  source 1..20: mol_type = other DNA
caccgtgccgggccgccagt

SEQ ID NO: 52620 - DNA, 20 bp, synthetic construct
  misc_feature 1..20: note = CRISPR gRNA sequence
  source 1..20: mol_type = other DNA
gccagtgggctttttatatt

SEQ ID NO: 52621 - DNA, 20 bp, synthetic construct
  misc_feature 1..20: note = CRISPR gRNA sequence
  source 1..20: mol_type = other DNA
tttatattaagcttcctctg

SEQ ID NO: 52622 - DNA, 20 bp, synthetic construct
  misc_feature 1..20: note = CRISPR gRNA sequence
  source 1..20: mol_type = other DNA
cctctgcagatgatttgcct

SEQ ID NO: 52623 - DNA, 20 bp, synthetic construct
  misc_feature 1..20: note = CRISPR gRNA sequence
  source 1..20: mol_type = other DNA
tgcagatgatttgccttggc

SEQ ID NO: 52624 - DNA, 20 bp, synthetic construct
  misc_feature 1..20: note = CRISPR gRNA sequence
  source 1..20: mol_type = other DNA
agatgatttgccttggccag

SEQ ID NO: 52625 - DNA, 20 bp, synthetic construct
  misc_feature 1..20: note = CRISPR gRNA sequence
  source 1..20: mol_type = other DNA
atgatttgccttggccagca

SEQ ID NO: 52626 - DNA, 20 bp, synthetic construct
  misc_feature 1..20: note = CRISPR gRNA sequence
  source 1..20: mol_type = other DNA
ggccagcagagcccgcatcc

SEQ ID NO: 52627 - DNA, 20 bp, synthetic construct
  misc_feature 1..20: note = CRISPR gRNA sequence
  source 1..20: mol_type = other DNA
tcccagtctccttgtgttcc

SEQ ID NO: 52628 - DNA, 20 bp, synthetic construct
  misc_feature 1..20: note = CRISPR gRNA sequence
  source 1..20: mol_type = other DNA
cccagtctccttgtgttccc

SEQ ID NO: 52629 - DNA, 20 bp, synthetic construct
  misc_feature 1..20: note = CRISPR gRNA sequence
  source 1..20: mol_type = other DNA
ctccttgtgttcccaggatc

SEQ ID NO: 52630 - DNA, 20 bp, synthetic construct
  misc_feature 1..20: note = CRISPR gRNA sequence
  source 1..20: mol_type = other DNA
tgtgttcccaggatctggcc

SEQ ID NO: 52631 - DNA, 20 bp, synthetic construct
  misc_feature 1..20: note = CRISPR gRNA sequence
  source 1..20: mol_type = other DNA
ccaggatctggcccagtgca

SEQ ID NO: 52632 - DNA, 20 bp, synthetic construct
  misc_feature 1..20: note = CRISPR gRNA sequence
  source 1..20: mol_type = other DNA
gcccagtgcatggtatacaa

SEQ ID NO: 52633 - DNA, 20 bp, synthetic construct
  misc_feature 1..20: note = CRISPR gRNA sequence
  source 1..20: mol_type = other DNA
cccagtgcatggtatacaat

SEQ ID NO: 52634 - DNA, 20 bp, synthetic construct
  misc_feature 1..20: note = CRISPR gRNA sequence
  source 1..20: mol_type = other DNA
ggtatacaataggtacttaa

SEQ ID NO: 52635 - DNA, 20 bp, synthetic construct
  misc_feature 1..20: note = CRISPR gRNA sequence
  source 1..20: mol_type = other DNA
acttaacagtcaaatcacgt

SEQ ID NO: 52636 - DNA, 20 bp, synthetic construct
  misc_feature 1..20: note = CRISPR gRNA sequence
  source 1..20: mol_type = other DNA
ttaacagtcaaatcacgtaa

SEQ ID NO: 52637 - DNA, 20 bp, synthetic construct
  misc_feature 1..20: note = CRISPR gRNA sequence
  source 1..20: mol_type = other DNA
tcacgtaagagtgctttttg

SEQ ID NO: 52638 - DNA, 20 bp, synthetic construct
  misc_feature 1..20: note = CRISPR gRNA sequence
  source 1..20: mol_type = other DNA
gctttttgtagcactgactg

SEQ ID NO: 52639 - DNA, 20 bp, synthetic construct
  misc_feature 1..20: note = CRISPR gRNA sequence
  source 1..20: mol_type = other DNA
acaaaacaaaacacaacacc

SEQ ID NO: 52640 - DNA, 20 bp, synthetic construct
  misc_feature 1..20: note = CRISPR gRNA sequence
  source 1..20: mol_type = other DNA
aaacaaaacacaacacctag

SEQ ID NO: 52641 - DNA, 20 bp, synthetic construct
  misc_feature 1..20: note = CRISPR gRNA sequence
  source 1..20: mol_type = other DNA
caaaacacaacacctagaag

SEQ ID NO: 52642 - DNA, 20 bp, synthetic construct
  misc_feature 1..20: note = CRISPR gRNA sequence
  source 1..20: mol_type = other DNA
cacaacacctagaagcagtt

SEQ ID NO: 52643 - DNA, 20 bp, synthetic construct
  misc_feature 1..20: note = CRISPR gRNA sequence
  source 1..20: mol_type = other DNA
aagcagtttggatttcaatc

SEQ ID NO: 52644 - DNA, 20 bp, synthetic construct
  misc_feature 1..20: note = CRISPR gRNA sequence
  source 1..20: mol_type = other DNA
tttggatttcaatctagacc

SEQ ID NO: 52645 - DNA, 20 bp, synthetic construct
  misc_feature 1..20: note = CRISPR gRNA sequence
  source 1..20: mol_type = other DNA
caatctagaccaagttgtcc

SEQ ID NO: 52646 - DNA, 20 bp, synthetic construct
  misc_feature 1..20: note = CRISPR gRNA sequence
  source 1..20: mol_type = other DNA
accaagttgtccaagccaca

SEQ ID NO: 52647 - DNA, 20 bp, synthetic construct
  misc_feature 1..20: note = CRISPR gRNA sequence
  source 1..20: mol_type = other DNA
gccacatggcctgctgcatg

SEQ ID NO: 52648 - DNA, 20 bp, synthetic construct
  misc_feature 1..20: note = CRISPR gRNA sequence
  source 1..20: mol_type = other DNA
atggcctgctgcatgcagcc

SEQ ID NO: 52649 - DNA, 20 bp, synthetic construct
  misc_feature 1..20: note = CRISPR gRNA sequence
  source 1..20: mol_type = other DNA
tggcctgctgcatgcagcct

SEQ ID NO: 52650 - DNA, 20 bp, synthetic construct
  misc_feature 1..20: note = CRISPR gRNA sequence
  source 1..20: mol_type = other DNA
ctgctgcatgcagcctagga

SEQ ID NO: 52651 - DNA, 20 bp, synthetic construct
  misc_feature 1..20: note = CRISPR gRNA sequence
  source 1..20: mol_type = other DNA
gcctaggatggctttgaata

SEQ ID NO: 52652 - DNA, 20 bp, synthetic construct
  misc_feature 1..20: note = CRISPR gRNA sequence
  source 1..20: mol_type = other DNA
aaactttcttaaaacactat

SEQ ID NO: 52653 - DNA, 20 bp, synthetic construct
  misc_feature 1..20: note = CRISPR gRNA sequence
  source 1..20: mol_type = other DNA
aacactatgagatttttctt

SEQ ID NO: 52654 - DNA, 20 bp, synthetic construct
  misc_feature 1..20: note = CRISPR gRNA sequence
  source 1..20: mol_type = other DNA
cactatgagatttttctttg

SEQ ID NO: 52655 - DNA, 20 bp, synthetic construct
  misc_feature 1..20: note = CRISPR gRNA sequence
  source 1..20: mol_type = other DNA
ggagttttgttttttttttt

SEQ ID NO: 52656 - DNA, 20 bp, synthetic construct
  misc_feature 1..20: note = CRISPR gRNA sequence
  source 1..20: mol_type = other DNA
gttttttttttttagcacat

SEQ ID NO: 52657 - DNA, 20 bp, synthetic construct
  misc_feature 1..20: note = CRISPR gRNA sequence
  source 1..20: mol_type = other DNA
tttagcacatcagctatcgc

SEQ ID NO: 52658 - DNA, 20 bp, synthetic construct
  misc_feature 1..20: note = CRISPR gRNA sequence
  source 1..20: mol_type = other DNA
acatcagctatcgctagtgt

SEQ ID NO: 52659 - DNA, 20 bp, synthetic construct
  misc_feature 1..20: note = CRISPR gRNA sequence
  source 1..20: mol_type = other DNA
gtgttagtgtattttatgtg

SEQ ID NO: 52660 - DNA, 20 bp, synthetic construct
  misc_feature 1..20: note = CRISPR gRNA sequence
  source 1..20: mol_type = other DNA
gtgtattttatgtgtggccc

SEQ ID NO: 52661 - DNA, 20 bp, synthetic construct
  misc_feature 1..20: note = CRISPR gRNA sequence
  source 1..20: mol_type = other DNA
ttctttttcttcttccaatg

SEQ ID NO: 52662 - DNA, 20 bp, synthetic construct
  misc_feature 1..20: note = CRISPR gRNA sequence
  source 1..20: mol_type = other DNA
tttcttcttccaatgtggcc

SEQ ID NO: 52663 - DNA, 20 bp, synthetic construct
  misc_feature 1..20: note = CRISPR gRNA sequence
  source 1..20: mol_type = other DNA
ttcttcttccaatgtggccc

SEQ ID NO: 52664 - DNA, 20 bp, synthetic construct
  misc_feature 1..20: note = CRISPR gRNA sequence
  source 1..20: mol_type = other DNA
tcttcttccaatgtggccca

SEQ ID NO: 52665 - DNA, 20 bp, synthetic construct
  misc_feature 1..20: note = CRISPR gRNA sequence
  source 1..20: mol_type = other DNA
tcttccaatgtggcccaggg

SEQ ID NO: 52666 - DNA, 20 bp, synthetic construct
  misc_feature 1..20: note = CRISPR gRNA sequence
  source 1..20: mol_type = other DNA
atgtggcccagggaagccaa

SEQ ID NO: 52667 - DNA, 20 bp, synthetic construct
  misc_feature 1..20: note = CRISPR gRNA sequence
  source 1..20: mol_type = other DNA
gcccagggaagccaaaagat

SEQ ID NO: 52668 - DNA, 20 bp, synthetic construct
  misc_feature 1..20: note = CRISPR gRNA sequence
  source 1..20: mol_type = other DNA
aagattggacacccttgatc

SEQ ID NO: 52669 - DNA, 20 bp, synthetic construct
  misc_feature 1..20: note = CRISPR gRNA sequence
  source 1..20: mol_type = other DNA
gacacccttgatctagactc

SEQ ID NO: 52670 - DNA, 20 bp, synthetic construct
  misc_feature 1..20: note = CRISPR gRNA sequence
  source 1..20: mol_type = other DNA
acccttgatctagactctag

SEQ ID NO: 52671 - DNA, 20 bp, synthetic construct
  misc_feature 1..20: note = CRISPR gRNA sequence
  source 1..20: mol_type = other DNA
cccttgatctagactctaga

SEQ ID NO: 52672 - DNA, 20 bp, synthetic construct
  misc_feature 1..20: note = CRISPR gRNA sequence
  source 1..20: mol_type = other DNA
ccttgatctagactctagaa

SEQ ID NO: 52673 - DNA, 20 bp, synthetic construct
  misc_feature 1..20: note = CRISPR gRNA sequence
  source 1..20: mol_type = other DNA
atctagactctagaagggtg

SEQ ID NO: 52674 - DNA, 20 bp, synthetic construct
  misc_feature 1..20: note = CRISPR gRNA sequence
  source 1..20: mol_type = other DNA
tagactctagaagggtgtgg

SEQ ID NO: 52675 - DNA, 20 bp, synthetic construct
  misc_feature 1..20: note = CRISPR gRNA sequence
  source 1..20: mol_type = other DNA
gactctagaagggtgtggtg

SEQ ID NO: 52676 - DNA, 20 bp, synthetic construct
  misc_feature 1..20: note = CRISPR gRNA sequence
  source 1..20: mol_type = other DNA
gggtgtggtggagtaacttg

SEQ ID NO: 52677 - DNA, 20 bp, synthetic construct
  misc_feature 1..20: note = CRISPR gRNA sequence
  source 1..20: mol_type = other DNA
ttgcagctcgtcccgtactg

SEQ ID NO: 52678 - DNA, 20 bp, synthetic construct
  misc_feature 1..20: note = CRISPR gRNA sequence
  source 1..20: mol_type = other DNA
cgtcccgtactgtggcaatt

SEQ ID NO: 52679 - DNA, 20 bp, synthetic construct
  misc_feature 1..20: note = CRISPR gRNA sequence
  source 1..20: mol_type = other DNA
ctgtggcaatttagtattaa

SEQ ID NO: 52680 - DNA, 20 bp, synthetic construct
  misc_feature 1..20: note = CRISPR gRNA sequence
  source 1..20: mol_type = other DNA
tgtggcaatttagtattaaa

SEQ ID NO: 52681 - DNA, 20 bp, synthetic construct
  misc_feature 1..20: note = CRISPR gRNA sequence
  source 1..20: mol_type = other DNA
aatttagtattaaaaggcat

SEQ ID NO: 52682 - DNA, 20 bp, synthetic construct
  misc_feature 1..20: note = CRISPR gRNA sequence
  source 1..20: mol_type = other DNA
cagtatatactctgtgaaaa

SEQ ID NO: 52683 - DNA, 20 bp, synthetic construct
  misc_feature 1..20: note = CRISPR gRNA sequence
  source 1..20: mol_type = other DNA
agtatatactctgtgaaaac

SEQ ID NO: 52684 - DNA, 20 bp, synthetic construct
  misc_feature 1..20: note = CRISPR gRNA sequence
  source 1..20: mol_type = other DNA
tatactctgtgaaaacaggt

SEQ ID NO: 52685 - DNA, 20 bp, synthetic construct
  misc_feature 1..20: note = CRISPR gRNA sequence
  source 1..20: mol_type = other DNA
tactctgtgaaaacaggtaa

SEQ ID NO: 52686 - DNA, 20 bp, synthetic construct
  misc_feature 1..20: note = CRISPR gRNA sequence
  source 1..20: mol_type = other DNA
gaaaacaggtaagagacaat

SEQ ID NO: 52687 - DNA, 20 bp, synthetic construct
  misc_feature 1..20: note = CRISPR gRNA sequence
  source 1..20: mol_type = other DNA
aaaacaggtaagagacaatc

SEQ ID NO: 52688 - DNA, 20 bp, synthetic construct
  misc_feature 1..20: note = CRISPR gRNA sequence
  source 1..20: mol_type = other DNA
aaacaggtaagagacaatca

SEQ ID NO: 52689 - DNA, 20 bp, synthetic construct
  misc_feature 1..20: note = CRISPR gRNA sequence
  source 1..20: mol_type = other DNA
aatcagggaccactgaccat

SEQ ID NO: 52690 - DNA, 20 bp, synthetic construct
  misc_feature 1..20: note = CRISPR gRNA sequence
  source 1..20: mol_type = other DNA
actgaccattggttgacttt

SEQ ID NO: 52691 - DNA, 20 bp, synthetic construct
  misc_feature 1..20: note = CRISPR gRNA sequence
  source 1..20: mol_type = other DNA
ctgaccattggttgacttta

SEQ ID NO: 52692 - DNA, 20 bp, synthetic construct
  misc_feature 1..20: note = CRISPR gRNA sequence
  source 1..20: mol_type = other DNA
ctttaaggaattgccattaa

SEQ ID NO: 52693 - DNA, 20 bp, synthetic construct
  misc_feature 1..20: note = CRISPR gRNA sequence
  source 1..20: mol_type = other DNA
tttaaggaattgccattaat

SEQ ID NO: 52694 - DNA, 20 bp, synthetic construct
  misc_feature 1..20: note = CRISPR gRNA sequence
  source 1..20: mol_type = other DNA
ttaaggaattgccattaata

SEQ ID NO: 52695 - DNA, 20 bp, synthetic construct
  misc_feature 1..20: note = CRISPR gRNA sequence
  source 1..20: mol_type = other DNA
aggaattgccattaataggg

SEQ ID NO: 52696 - DNA, 20 bp, synthetic construct
  misc_feature 1..20: note = CRISPR gRNA sequence
  source 1..20: mol_type = other DNA
ggaattgccattaatagggt

SEQ ID NO: 52697 - DNA, 20 bp, synthetic construct
  misc_feature 1..20: note = CRISPR gRNA sequence
  source 1..20: mol_type = other DNA
tgccattaatagggtaggtc

SEQ ID NO: 52698 - DNA, 20 bp, synthetic construct
  misc_feature 1..20: note = CRISPR gRNA sequence
  source 1..20: mol_type = other DNA
gccattaatagggtaggtct

SEQ ID NO: 52699 - DNA, 20 bp, synthetic construct
  misc_feature 1..20: note = CRISPR gRNA sequence
  source 1..20: mol_type = other DNA
ttaatagggtaggtctgggc

SEQ ID NO: 52700 - DNA, 20 bp, synthetic construct
  misc_feature 1..20: note = CRISPR gRNA sequence
  source 1..20: mol_type = other DNA
taatagggtaggtctgggcc

SEQ ID NO: 52701 - DNA, 20 bp, synthetic construct
  misc_feature 1..20: note = CRISPR gRNA sequence
  source 1..20: mol_type = other DNA
gggtaggtctgggccaggtg

SEQ ID NO: 52702 - DNA, 20 bp, synthetic construct
  misc_feature 1..20: note = CRISPR gRNA sequence
  source 1..20: mol_type = other DNA
taggtctgggccaggtgcag

SEQ ID NO: 52703 - DNA, 20 bp, synthetic construct
  misc_feature 1..20: note = CRISPR gRNA sequence
  source 1..20: mol_type = other DNA
tgggccaggtgcagtggctc

SEQ ID NO: 52704 - DNA, 20 bp, synthetic construct
  misc_feature 1..20: note = CRISPR gRNA sequence
  source 1..20: mol_type = other DNA
agcctgtaatcccaacactt

SEQ ID NO: 52705 - DNA, 20 bp, synthetic construct
  misc_feature 1..20: note = CRISPR gRNA sequence
  source 1..20: mol_type = other DNA
gcctgtaatcccaacacttt

SEQ ID NO: 52706 - DNA, 20 bp, synthetic construct
  misc_feature 1..20: note = CRISPR gRNA sequence
  source 1..20: mol_type = other DNA
ctgtaatcccaacactttgg

SEQ ID NO: 52707 - DNA, 20 bp, synthetic construct
  misc_feature 1..20: note = CRISPR gRNA sequence
  source 1..20: mol_type = other DNA
tgtaatcccaacactttggg

SEQ ID NO: 52708 - DNA, 20 bp, synthetic construct
  misc_feature 1..20: note = CRISPR gRNA sequence
  source 1..20: mol_type = other DNA
tcccaacactttgggaggct

SEQ ID NO: 52709 - DNA, 20 bp, synthetic construct
  misc_feature 1..20: note = CRISPR gRNA sequence
  source 1..20: mol_type = other DNA
cccaacactttgggaggctg

SEQ ID NO: 52710 - DNA, 20 bp, synthetic construct
  misc_feature 1..20: note = CRISPR gRNA sequence
  source 1..20: mol_type = other DNA
aacactttgggaggctgagg

SEQ ID NO: 52711 - DNA, 20 bp, synthetic construct
  misc_feature 1..20: note = CRISPR gRNA sequence
  source 1..20: mol_type = other DNA
acactttgggaggctgagga

SEQ ID NO: 52712 - DNA, 20 bp, synthetic construct
  misc_feature 1..20: note = CRISPR gRNA sequence
  source 1..20: mol_type = other DNA
ctttgggaggctgaggaagg

SEQ ID NO: 52713 - DNA, 20 bp, synthetic construct
  misc_feature 1..20: note = CRISPR gRNA sequence
  source 1..20: mol_type = other DNA
ctgaggaaggtggatcactt

SEQ ID NO: 52714 - DNA, 20 bp, synthetic construct
  misc_feature 1..20: note = CRISPR gRNA sequence
  source 1..20: mol_type = other DNA
tgaggaaggtggatcacttg

SEQ ID NO: 52715 - DNA, 20 bp, synthetic construct
  misc_feature 1..20: note = CRISPR gRNA sequence
  source 1..20: mol_type = other DNA
gaaggtggatcacttgaggt

SEQ ID NO: 52716 - DNA, 20 bp, synthetic construct
  misc_feature 1..20: note = CRISPR gRNA sequence
  source 1..20: mol_type = other DNA
aaggtggatcacttgaggtc

SEQ ID NO: 52717 - DNA, 20 bp, synthetic construct
  misc_feature 1..20: note = CRISPR gRNA sequence
  source 1..20: mol_type = other DNA
ggtggatcacttgaggtcag

SEQ ID NO: 52718 - DNA, 20 bp, synthetic construct
  misc_feature 1..20: note = CRISPR gRNA sequence
  source 1..20: mol_type = other DNA
tcacttgaggtcaggagttc

SEQ ID NO: 52719 - DNA, 20 bp, synthetic construct
  misc_feature 1..20: note = CRISPR gRNA sequence
  source 1..20: mol_type = other DNA
tgaggtcaggagttcgagac

SEQ ID NO: 52720 - DNA, 20 bp, synthetic construct
  misc_feature 1..20: note = CRISPR gRNA sequence
  source 1..20: mol_type = other DNA
tcaggagttcgagaccagcc

SEQ ID NO: 52721 - DNA, 20 bp, synthetic construct
  misc_feature 1..20: note = CRISPR gRNA sequence
  source 1..20: mol_type = other DNA
cgagaccagcctggccaaca

SEQ ID NO: 52722 - DNA, 20 bp, synthetic construct
  misc_feature 1..20: note = CRISPR gRNA sequence
  source 1..20: mol_type = other DNA
tctactaaaaatacaaaaat

SEQ ID NO: 52723 - DNA, 20 bp, synthetic construct
  misc_feature 1..20: note = CRISPR gRNA sequence
  source 1..20: mol_type = other DNA
ctaaaaatacaaaaattagc

SEQ ID NO: 52724 - DNA, 20 bp, synthetic construct
  misc_feature 1..20: note = CRISPR gRNA sequence
  source 1..20: mol_type = other DNA
taaaaatacaaaaattagcc

SEQ ID NO: 52725 - DNA, 20 bp, synthetic construct
  misc_feature 1..20: note = CRISPR gRNA sequence
  source 1..20: mol_type = other DNA
caaaaattagccaggcatga

SEQ ID NO: 52726 - DNA, 20 bp, synthetic construct
  misc_feature 1..20: note = CRISPR gRNA sequence
  source 1..20: mol_type = other DNA
aaattagccaggcatgatgg

SEQ ID NO: 52727 - DNA, 20 bp, synthetic construct
  misc_feature 1..20: note = CRISPR gRNA sequence
  source 1..20: mol_type = other DNA
aattagccaggcatgatggc

SEQ ID NO: 52728 - DNA, 20 bp, synthetic construct
  misc_feature 1..20: note = CRISPR gRNA sequence
  source 1..20: mol_type = other DNA
atggcgggcgcctgtaatcc

SEQ ID NO: 52729 - DNA, 20 bp, synthetic construct
  misc_feature 1..20: note = CRISPR gRNA sequence
  source 1..20: mol_type = other DNA
cgcctgtaatcccagctact

SEQ ID NO: 52730 - DNA, 20 bp, synthetic construct
  misc_feature 1..20: note = CRISPR gRNA sequence
  source 1..20: mol_type = other DNA
gcctgtaatcccagctactc

SEQ ID NO: 52731 - DNA, 20 bp, synthetic construct
  misc_feature 1..20: note = CRISPR gRNA sequence
  source 1..20: mol_type = other DNA
ctgtaatcccagctactcag

SEQ ID NO: 52732 - DNA, 20 bp, synthetic construct
  misc_feature 1..20: note = CRISPR gRNA sequence
  source 1..20: mol_type = other DNA
tgtaatcccagctactcagg

SEQ ID NO: 52733 - DNA, 20 bp, synthetic construct
  misc_feature 1..20: note = CRISPR gRNA sequence
  source 1..20: mol_type = other DNA
tcccagctactcaggaggct

SEQ ID NO: 52734 - DNA, 20 bp, synthetic construct
  misc_feature 1..20: note = CRISPR gRNA sequence
  source 1..20: mol_type = other DNA
cccagctactcaggaggctg

SEQ ID NO: 52735 - DNA, 20 bp, synthetic construct
  misc_feature 1..20: note = CRISPR gRNA sequence
  source 1..20: mol_type = other DNA
agctactcaggaggctgagg

SEQ ID NO: 52736 - DNA, 20 bp, synthetic construct
  misc_feature 1..20: note = CRISPR gRNA sequence
  source 1..20: mol_type = other DNA
gctactcaggaggctgaggc

SEQ ID NO: 52737 - DNA, 20 bp, synthetic construct
  misc_feature 1..20: note = CRISPR gRNA sequence
  source 1..20: mol_type = other DNA
tactcaggaggctgaggcag

SEQ ID NO: 52738 - DNA, 20 bp, synthetic construct
  misc_feature 1..20: note = CRISPR gRNA sequence
  source 1..20: mol_type = other DNA
gcaggagaattgcttgaacc

SEQ ID NO: 52739 - DNA, 20 bp, synthetic construct
  misc_feature 1..20: note = CRISPR gRNA sequence
  source 1..20: mol_type = other DNA
caggagaattgcttgaaccc

SEQ ID NO: 52740 - DNA, 20 bp, synthetic construct
  misc_feature 1..20: note = CRISPR gRNA sequence
  source 1..20: mol_type = other DNA
ggagaattgcttgaacccag

SEQ ID NO: 52741 - DNA, 20 bp, synthetic construct
  misc_feature 1..20: note = CRISPR gRNA sequence
  source 1..20: mol_type = other DNA
gagaattgcttgaacccagg

SEQ ID NO: 52742 - DNA, 20 bp, synthetic construct
  misc_feature 1..20: note = CRISPR gRNA sequence
  source 1..20: mol_type = other DNA
aattgcttgaacccaggagg

SEQ ID NO: 52743 - DNA, 20 bp, synthetic construct
  misc_feature 1..20: note = CRISPR gRNA sequence
  source 1..20: mol_type = other DNA
ttgcttgaacccaggaggca

SEQ ID NO: 52744 - DNA, 20 bp, synthetic construct
  misc_feature 1..20: note = CRISPR gRNA sequence
  source 1..20: mol_type = other DNA
tgcttgaacccaggaggcag

SEQ ID NO: 52745 - DNA, 20 bp, synthetic construct
  misc_feature 1..20: note = CRISPR gRNA sequence
  source 1..20: mol_type = other DNA
ttgaacccaggaggcagagg

SEQ ID NO: 52746 - DNA, 20 bp, synthetic construct
  misc_feature 1..20: note = CRISPR gRNA sequence
  source 1..20: mol_type = other DNA
aacccaggaggcagaggtgg

SEQ ID NO: 52747 - DNA, 20 bp, synthetic construct
  misc_feature 1..20: note = CRISPR gRNA sequence
  source 1..20: mol_type = other DNA
caggaggcagaggtggcagc

SEQ ID NO: 52748 - DNA, 20 bp, synthetic construct
  misc_feature 1..20: note = CRISPR gRNA sequence
  source 1..20: mol_type = other DNA
ggcagaggtggcagcaagcc

SEQ ID NO: 52749 - DNA, 20 bp, synthetic construct
  misc_feature 1..20: note = CRISPR gRNA sequence
  source 1..20: mol_type = other DNA
gagatcacgccattgcactc

SEQ ID NO: 52750 - DNA, 20 bp, synthetic construct
  misc_feature 1..20: note = CRISPR gRNA sequence
  source 1..20: mol_type = other DNA
cacgccattgcactccagcc

SEQ ID NO: 52751 - DNA, 20 bp, synthetic construct
  misc_feature 1..20: note = CRISPR gRNA sequence
  source 1..20: mol_type = other DNA
acgccattgcactccagcct

SEQ ID NO: 52752 - DNA, 20 bp, synthetic construct
  misc_feature 1..20: note = CRISPR gRNA sequence
  source 1..20: mol_type = other DNA
tgcactccagcctgggcaac

SEQ ID NO: 52753 - DNA, 20 bp, synthetic construct
  misc_feature 1..20: note = CRISPR gRNA sequence
  source 1..20: mol_type = other DNA
cactccagcctgggcaacaa

SEQ ID NO: 52754 - DNA, 20 bp, synthetic construct
  misc_feature 1..20: note = CRISPR gRNA sequence
  source 1..20: mol_type = other DNA
acaagagcaaaactctgtct

SEQ ID NO: 52755 - DNA, 20 bp, synthetic construct
  misc_feature 1..20: note = CRISPR gRNA sequence
  source 1..20: mol_type = other DNA
tctgtctcagaaaaaaaaaa

SEQ ID NO: 52756 - DNA, 20 bp, synthetic construct
  misc_feature 1..20: note = CRISPR gRNA sequence
  source 1..20: mol_type = other DNA
ctcagaaaaaaaaaatagtg

SEQ ID NO: 52757 - DNA, 20 bp, synthetic construct
  misc_feature 1..20: note = CRISPR gRNA sequence
  source 1..20: mol_type = other DNA
tcagaaaaaaaaaatagtgt

SEQ ID NO: 52758 - DNA, 20 bp, synthetic construct
  misc_feature 1..20: note = CRISPR gRNA sequence
  source 1..20: mol_type = other DNA
aaatagtgtaggtctgataa

SEQ ID NO: 52759 - DNA, 20 bp, synthetic construct
  misc_feature 1..20: note = CRISPR gRNA sequence
  source 1..20: mol_type = other DNA
taggtctgataatggttttg

SEQ ID NO: 52760 - DNA, 20 bp, synthetic construct
  misc_feature 1..20: note = CRISPR gRNA sequence
  source 1..20: mol_type = other DNA
tgtggttatatgtttgaacc

SEQ ID NO: 52761 - DNA, 20 bp, synthetic construct
  misc_feature 1..20: note = CRISPR gRNA sequence
  source 1..20: mol_type = other DNA
tggttatatgtttgaacctg

SEQ ID NO: 52762 - DNA, 20 bp, synthetic construct
  misc_feature 1..20: note = CRISPR gRNA sequence
  source 1..20: mol_type = other DNA
ttatatgtttgaacctggag

SEQ ID NO: 52763 - DNA, 20 bp, synthetic construct
  misc_feature 1..20: note = CRISPR gRNA sequence
  source 1..20: mol_type = other DNA
tatatgtttgaacctggaga

SEQ ID NO: 52764 - DNA, 20 bp, synthetic construct
  misc_feature 1..20: note = CRISPR gRNA sequence
  source 1..20: mol_type = other DNA
tttgaacctggagaaggaca

SEQ ID NO: 52765 - DNA, 20 bp, synthetic construct
  misc_feature 1..20: note = CRISPR gRNA sequence
  source 1..20: mol_type = other DNA
ttgaacctggagaaggacat

SEQ ID NO: 52766 - DNA, 20 bp, synthetic construct
  misc_feature 1..20: note = CRISPR gRNA sequence
  source 1..20: mol_type = other DNA
aacctggagaaggacatggg

SEQ ID NO: 52767 - DNA, 20 bp, synthetic construct
  misc_feature 1..20: note = CRISPR gRNA sequence
  source 1..20: mol_type = other DNA
acctggagaaggacatggga

SEQ ID NO: 52768 - DNA, 20 bp, synthetic construct
  misc_feature 1..20: note = CRISPR gRNA sequence
  source 1..20: mol_type = other DNA
gacatgggaaggccacactc

SEQ ID NO: 52769 - DNA, 20 bp, synthetic construct
  misc_feature 1..20: note = CRISPR gRNA sequence
  source 1..20: mol_type = other DNA
acatgggaaggccacactcc

SEQ ID NO: 52770 - DNA, 20 bp, synthetic construct
  misc_feature 1..20: note = CRISPR gRNA sequence
  source 1..20: mol_type = other DNA
catgggaaggccacactcca

SEQ ID NO: 52771 - DNA, 20 bp, synthetic construct
  misc_feature 1..20: note = CRISPR gRNA sequence
  source 1..20: mol_type = other DNA
atgggaaggccacactccag

SEQ ID NO: 52772 - DNA, 20 bp, synthetic construct
  misc_feature 1..20: note = CRISPR gRNA sequence
  source 1..20: mol_type = other DNA
tgggaaggccacactccagg

SEQ ID NO: 52773 - DNA, 20 bp, synthetic construct
  misc_feature 1..20: note = CRISPR gRNA sequence
  source 1..20: mol_type = other DNA
cacactccagggggtcaaac

SEQ ID NO: 52774 - DNA, 20 bp, synthetic construct
  misc_feature 1..20: note = CRISPR gRNA sequence
  source 1..20: mol_type = other DNA
gggggtcaaaccggattatc

SEQ ID NO: 52775 - DNA, 20 bp, synthetic construct
  misc_feature 1..20: note = CRISPR gRNA sequence
  source 1..20: mol_type = other DNA
gtcaaaccggattatctggt

SEQ ID NO: 52776 - DNA, 20 bp, synthetic construct
  misc_feature 1..20: note = CRISPR gRNA sequence
  source 1..20: mol_type = other DNA
aaaccggattatctggttgg

SEQ ID NO: 52777 - DNA, 20 bp, synthetic construct
  misc_feature 1..20: note = CRISPR gRNA sequence
  source 1..20: mol_type = other DNA
aaccggattatctggttgga

SEQ ID NO: 52778 - DNA, 20 bp, synthetic construct
  misc_feature 1..20: note = CRISPR gRNA sequence
  source 1..20: mol_type = other DNA
accggattatctggttggaa

SEQ ID NO: 52779 - DNA, 20 bp, synthetic construct
  misc_feature 1..20: note = CRISPR gRNA sequence
  source 1..20: mol_type = other DNA
gattatctggttggaagggc

SEQ ID NO: 52780 - DNA, 20 bp, synthetic construct
  misc_feature 1..20: note = CRISPR gRNA sequence
  source 1..20: mol_type = other DNA
tatctggttggaagggctgg

SEQ ID NO: 52781 - DNA, 20 bp, synthetic construct
  misc_feature 1..20: note = CRISPR gRNA sequence
  source 1..20: mol_type = other DNA
atctggttggaagggctgga

SEQ ID NO: 52782 - DNA, 20 bp, synthetic construct
  misc_feature 1..20: note = CRISPR gRNA sequence
  source 1..20: mol_type = other DNA
tctggttggaagggctggaa

SEQ ID NO: 52783 - DNA, 20 bp, synthetic construct
  misc_feature 1..20: note = CRISPR gRNA sequence
  source 1..20: mol_type = other DNA
gaagggctggaagggcattt

SEQ ID NO: 52784 - DNA, 20 bp, synthetic construct
  misc_feature 1..20: note = CRISPR gRNA sequence
  source 1..20: mol_type = other DNA
ggctggaagggcatttgaga

SEQ ID NO: 52785 - DNA, 20 bp, synthetic construct
  misc_feature 1..20: note = CRISPR gRNA sequence
  source 1..20: mol_type = other DNA
gctggaagggcatttgagat

SEQ ID NO: 52786 - DNA, 20 bp, synthetic construct
  misc_feature 1..20: note = CRISPR gRNA sequence
  source 1..20: mol_type = other DNA
ctggaagggcatttgagatg

SEQ ID NO: 52787 - DNA, 20 bp, synthetic construct
  misc_feature 1..20: note = CRISPR gRNA sequence
  source 1..20: mol_type = other DNA
tggaagggcatttgagatgg

SEQ ID NO: 52788 - DNA, 20 bp, synthetic construct
  misc_feature 1..20: note = CRISPR gRNA sequence
  source 1..20: mol_type = other DNA
agggcatttgagatgggggc

SEQ ID NO: 52789 - DNA, 20 bp, synthetic construct
  misc_feature 1..20: note = CRISPR gRNA sequence
  source 1..20: mol_type = other DNA
catttgagatgggggctaga

SEQ ID NO: 52790 - DNA, 20 bp, synthetic construct
  misc_feature 1..20: note = CRISPR gRNA sequence
  source 1..20: mol_type = other DNA
tgagatgggggctagaaagc

SEQ ID NO: 52791 - DNA, 20 bp, synthetic construct
  misc_feature 1..20: note = CRISPR gRNA sequence
  source 1..20: mol_type = other DNA
ggggctagaaagcaagaaaa

SEQ ID NO: 52792 - DNA, 20 bp, synthetic construct
  misc_feature 1..20: note = CRISPR gRNA sequence
  source 1..20: mol_type = other DNA
gaaagcaagaaaaaagactg

SEQ ID NO: 52793 - DNA, 20 bp, synthetic construct
  misc_feature 1..20: note = CRISPR gRNA sequence
  source 1..20: mol_type = other DNA
gaaaaaagactgaagcaaaa

SEQ ID NO: 52794 - DNA, 20 bp, synthetic construct
  misc_feature 1..20: note = CRISPR gRNA sequence
  source 1..20: mol_type = other DNA
ctgaagcaaaatggaaaaca

SEQ ID NO: 52795 - DNA, 20 bp, synthetic construct
  misc_feature 1..20: note = CRISPR gRNA sequence
  source 1..20: mol_type = other DNA
acacagatgctatgaaaaca

SEQ ID NO: 52796 - DNA, 20 bp, synthetic construct
  misc_feature 1..20: note = CRISPR gRNA sequence
  source 1..20: mol_type = other DNA
gaaaacacagtgcatgaaac

SEQ ID NO: 52797 - DNA, 20 bp, synthetic construct
  misc_feature 1..20: note = CRISPR gRNA sequence
  source 1..20: mol_type = other DNA
aactagtttatgactgcaaa

SEQ ID NO: 52798 - DNA, 20 bp, synthetic construct
  misc_feature 1..20: note = CRISPR gRNA sequence
  source 1..20: mol_type = other DNA
actagtttatgactgcaaac

SEQ ID NO: 52799 - DNA, 20 bp, synthetic construct
  misc_feature 1..20: note = CRISPR gRNA sequence
  source 1..20: mol_type = other DNA
agtttatgactgcaaacagg

SEQ ID NO: 52800 - DNA, 20 bp, synthetic construct
  misc_feature 1..20: note = CRISPR gRNA sequence
  source 1..20: mol_type = other DNA
gtagaaactgaatatgcaaa

SEQ ID NO: 52801 - DNA, 20 bp, synthetic construct
  misc_feature 1..20: note = CRISPR gRNA sequence
  source 1..20: mol_type = other DNA
tagaaactgaatatgcaaat

SEQ ID NO: 52802 - DNA, 20 bp, synthetic construct
  misc_feature 1..20: note = CRISPR gRNA sequence
  source 1..20: mol_type = other DNA
aactgaatatgcaaataggc

SEQ ID NO: 52803 - DNA, 20 bp, synthetic construct
  misc_feature 1..20: note = CRISPR gRNA sequence
  source 1..20: mol_type = other DNA
actgaatatgcaaataggca

SEQ ID NO: 52804 - DNA, 20 bp, synthetic construct
  misc_feature 1..20: note = CRISPR gRNA sequence
  source 1..20: mol_type = other DNA
tgaatatgcaaataggcaag

SEQ ID NO: 52805 - DNA, 20 bp, synthetic construct
  misc_feature 1..20: note = CRISPR gRNA sequence
  source 1..20: mol_type = other DNA
atatgcaaataggcaaggag

SEQ ID NO: 52806 - DNA, 20 bp, synthetic construct
  misc_feature 1..20: note = CRISPR gRNA sequence
  source 1..20: mol_type = other DNA
gcaaataggcaaggagtaga

SEQ ID NO: 52807 - DNA, 20 bp, synthetic construct
  misc_feature 1..20: note = CRISPR gRNA sequence
  source 1..20: mol_type = other DNA
gcaaggagtagacagtcctg

SEQ ID NO: 52808 - DNA, 20 bp, synthetic construct
  misc_feature 1..20: note = CRISPR gRNA sequence
  source 1..20: mol_type = other DNA
cctgtggacacatgacaaca

SEQ ID NO: 52809 - DNA, 20 bp, synthetic construct
  misc_feature 1..20: note = CRISPR gRNA sequence
  source 1..20: mol_type = other DNA
catgacaacatggatttgat

SEQ ID NO: 52810 - DNA, 20 bp, synthetic construct
  misc_feature 1..20: note = CRISPR gRNA sequence
  source 1..20: mol_type = other DNA
tgacaacatggatttgatga

SEQ ID NO: 52811 - DNA, 20 bp, synthetic construct
  misc_feature 1..20: note = CRISPR gRNA sequence
  source 1..20: mol_type = other DNA
caacatggatttgatgagag

SEQ ID NO: 52812 - DNA, 20 bp, synthetic construct
  misc_feature 1..20: note = CRISPR gRNA sequence
  source 1..20: mol_type = other DNA
acatggatttgatgagagaa

SEQ ID NO: 52813 - DNA, 20 bp, synthetic construct
  misc_feature 1..20: note = CRISPR gRNA sequence
  source 1..20: mol_type = other DNA
catggatttgatgagagaag

SEQ ID NO: 52814 - DNA, 20 bp, synthetic construct
  misc_feature 1..20: note = CRISPR gRNA sequence
  source 1..20: mol_type = other DNA
tgatgagagaagaggttgtt

SEQ ID NO: 52815 - DNA, 20 bp, synthetic construct
  misc_feature 1..20: note = CRISPR gRNA sequence
  source 1..20: mol_type = other DNA
gatgagagaagaggttgttt

SEQ ID NO: 52816 - DNA, 20 bp, synthetic construct
  misc_feature 1..20: note = CRISPR gRNA sequence
  source 1..20: mol_type = other DNA
agagaagaggttgtttaggt

SEQ ID NO: 52817 - DNA, 20 bp, synthetic construct
  misc_feature 1..20: note = CRISPR gRNA sequence
  source 1..20: mol_type = other DNA
gagaagaggttgtttaggtg

SEQ ID NO: 52818 - DNA, 20 bp, synthetic construct
  misc_feature 1..20: note = CRISPR gRNA sequence
  source 1..20: mol_type = other DNA
aagaggttgtttaggtgagg

SEQ ID NO: 52819 - DNA, 20 bp, synthetic construct
  misc_feature 1..20: note = CRISPR gRNA sequence
  source 1..20: mol_type = other DNA
agaggttgtttaggtgaggc

SEQ ID NO: 52820 - DNA, 20 bp, synthetic construct
  misc_feature 1..20: note = CRISPR gRNA sequence
  source 1..20: mol_type = other DNA
aggtgaggcaggttttgtct

SEQ ID NO: 52821 - DNA, 20 bp, synthetic construct
  misc_feature 1..20: note = CRISPR gRNA sequence
  source 1..20: mol_type = other DNA
gtcttggatttctttatttt

SEQ ID NO: 52822 - DNA, 20 bp, synthetic construct
  misc_feature 1..20: note = CRISPR gRNA sequence
  source 1..20: mol_type = other DNA
tcttggatttctttatttta

SEQ ID NO: 52823 - DNA, 20 bp, synthetic construct
  misc_feature 1..20: note = CRISPR gRNA sequence
  source 1..20: mol_type = other DNA
ttttaaggtaattactataa

SEQ ID NO: 52824 - DNA, 20 bp, synthetic construct
  misc_feature 1..20: note = CRISPR gRNA sequence
  source 1..20: mol_type = other DNA
aatcaccacaatgacaataa

SEQ ID NO: 52825 - DNA, 20 bp, synthetic construct
  misc_feature 1..20: note = CRISPR gRNA sequence
  source 1..20: mol_type = other DNA
atcaccacaatgacaataaa

SEQ ID NO: 52826 - DNA, 20 bp, synthetic construct
  misc_feature 1..20: note = CRISPR gRNA sequence
  source 1..20: mol_type = other DNA
ccacaatgacaataaaagga

SEQ ID NO: 52827 - DNA, 20 bp, synthetic construct
  misc_feature 1..20: note = CRISPR gRNA sequence
  source 1..20: mol_type = other DNA
cacaatgacaataaaaggaa

SEQ ID NO: 52828 - DNA, 20 bp, synthetic construct
  misc_feature 1..20: note = CRISPR gRNA sequence
  source 1..20: mol_type = other DNA
aaggctgaccatccactgtg

SEQ ID NO: 52829 - DNA, 20 bp, synthetic construct
  misc_feature 1..20: note = CRISPR gRNA sequence
  source 1..20: mol_type = other DNA
gaccatccactgtgcagatg

SEQ ID NO: 52830 - DNA, 20 bp, synthetic construct
  misc_feature 1..20: note = CRISPR gRNA sequence
  source 1..20: mol_type = other DNA
catccactgtgcagatgaag

SEQ ID NO: 52831 - DNA, 20 bp, synthetic construct
  misc_feature 1..20: note = CRISPR gRNA sequence
  source 1..20: mol_type = other DNA
actgtgcagatgaagaagct

SEQ ID NO: 52832 - DNA, 20 bp, synthetic construct
  misc_feature 1..20: note = CRISPR gRNA sequence
  source 1..20: mol_type = other DNA
ctgtgcagatgaagaagctg

SEQ ID NO: 52833 - DNA, 20 bp, synthetic construct
  misc_feature 1..20: note = CRISPR gRNA sequence
  source 1..20: mol_type = other DNA
cagatgaagaagctgaggcc

SEQ ID NO: 52834 - DNA, 20 bp, synthetic construct
  misc_feature 1..20: note = CRISPR gRNA sequence
  source 1..20: mol_type = other DNA
agatgaagaagctgaggccc

SEQ ID NO: 52835 - DNA, 20 bp, synthetic construct
  misc_feature 1..20: note = CRISPR gRNA sequence
  source 1..20: mol_type = other DNA
gatgaagaagctgaggcccg

SEQ ID NO: 52836 - DNA, 20 bp, synthetic construct
  misc_feature 1..20: note = CRISPR gRNA sequence
  source 1..20: mol_type = other DNA
tgaagaagctgaggcccggg

SEQ ID NO: 52837 - DNA, 20 bp, synthetic construct
  misc_feature 1..20: note = CRISPR gRNA sequence
  source 1..20: mol_type = other DNA
cggggagttaaatccctttt

SEQ ID NO: 52838 - DNA, 20 bp, synthetic construct
  misc_feature 1..20: note = CRISPR gRNA sequence
  source 1..20: mol_type = other DNA
agttaaatcccttttgagcc

SEQ ID NO: 52839 - DNA, 20 bp, synthetic construct
  misc_feature 1..20: note = CRISPR gRNA sequence
  source 1..20: mol_type = other DNA
ttaaatcccttttgagccaa

SEQ ID NO: 52840 - DNA, 20 bp, synthetic construct
  misc_feature 1..20: note = CRISPR gRNA sequence
  source 1..20: mol_type = other DNA
tgagccaagagtcctgattc

SEQ ID NO: 52841 - DNA, 20 bp, synthetic construct
  misc_feature 1..20: note = CRISPR gRNA sequence
  source 1..20: mol_type = other DNA
gagccaagagtcctgattcc

SEQ ID NO: 52842 - DNA, 20 bp, synthetic construct
  misc_feature 1..20: note = CRISPR gRNA sequence
  source 1..20: mol_type = other DNA
aagagtcctgattccaggtc

SEQ ID NO: 52843 - DNA, 20 bp, synthetic construct
  misc_feature 1..20: note = CRISPR gRNA sequence
  source 1..20: mol_type = other DNA
ctgattccaggtccagtctc

SEQ ID NO: 52844 - DNA, 20 bp, synthetic construct
  misc_feature 1..20: note = CRISPR gRNA sequence
  source 1..20: mol_type = other DNA
ccaggtccagtctctggtta

SEQ ID NO: 52845 - DNA, 20 bp, synthetic construct
  misc_feature 1..20: note = CRISPR gRNA sequence
  source 1..20: mol_type = other DNA
ccagtctctggttacagacc

SEQ ID NO: 52846 - DNA, 20 bp, synthetic construct
  misc_feature 1..20: note = CRISPR gRNA sequence
  source 1..20: mol_type = other DNA
ggttacagacccagatgttc

SEQ ID NO: 52847 - DNA, 20 bp, synthetic construct
  misc_feature 1..20: note = CRISPR gRNA sequence
  source 1..20: mol_type = other DNA
gttacagacccagatgttct

SEQ ID NO: 52848 - DNA, 20 bp, synthetic construct
  misc_feature 1..20: note = CRISPR gRNA sequence
  source 1..20: mol_type = other DNA
ttacagacccagatgttctg

SEQ ID NO: 52849 - DNA, 20 bp, synthetic construct
  misc_feature 1..20: note = CRISPR gRNA sequence
  source 1..20: mol_type = other DNA
agacccagatgttctggggc

SEQ ID NO: 52850 - DNA, 20 bp, synthetic construct
  misc_feature 1..20: note = CRISPR gRNA sequence
  source 1..20: mol_type = other DNA
ccagatgttctggggcgagt

SEQ ID NO: 52851 - DNA, 20 bp, synthetic construct
  misc_feature 1..20: note = CRISPR gRNA sequence
  source 1..20: mol_type = other DNA
cagatgttctggggcgagtg

SEQ ID NO: 52852 - DNA, 20 bp, synthetic construct
  misc_feature 1..20: note = CRISPR gRNA sequence
  source 1..20: mol_type = other DNA
atgttctggggcgagtgagg

SEQ ID NO: 52853 - DNA, 20 bp, synthetic construct
  misc_feature 1..20: note = CRISPR gRNA sequence
  source 1..20: mol_type = other DNA
gcgagtgaggtggtaacccc

SEQ ID NO: 52854 - DNA, 20 bp, synthetic construct
  misc_feature 1..20: note = CRISPR gRNA sequence
  source 1..20: mol_type = other DNA
cgagtgaggtggtaacccca

SEQ ID NO: 52855 - DNA, 20 bp, synthetic construct
  misc_feature 1..20: note = CRISPR gRNA sequence
  source 1..20: mol_type = other DNA
agtgaggtggtaaccccaag

SEQ ID NO: 52856 - DNA, 20 bp, synthetic construct
  misc_feature 1..20: note = CRISPR gRNA sequence
  source 1..20: mol_type = other DNA
tgaggtggtaaccccaagga

SEQ ID NO: 52857 - DNA, 20 bp, synthetic construct
  misc_feature 1..20: note = CRISPR gRNA sequence
  source 1..20: mol_type = other DNA
ggtggtaaccccaaggagag

SEQ ID NO: 52858 - DNA, 20 bp, synthetic construct
  misc_feature 1..20: note = CRISPR gRNA sequence
  source 1..20: mol_type = other DNA
gtggtaaccccaaggagagt

SEQ ID NO: 52859 - DNA, 20 bp, synthetic construct
  misc_feature 1..20: note = CRISPR gRNA sequence
  source 1..20: mol_type = other DNA
tggtaaccccaaggagagtg

SEQ ID NO: 52860 - DNA, 20 bp, synthetic construct
  misc_feature 1..20: note = CRISPR gRNA sequence
  source 1..20: mol_type = other DNA
ggtaaccccaaggagagtgg

SEQ ID NO: 52861 - DNA, 20 bp, synthetic construct
  misc_feature 1..20: note = CRISPR gRNA sequence
  source 1..20: mol_type = other DNA
aaggagagtgggggtgcctt

SEQ ID NO: 52862 - DNA, 20 bp, synthetic construct
  misc_feature 1..20: note = CRISPR gRNA sequence
  source 1..20: mol_type = other DNA
aggagagtgggggtgccttg

SEQ ID NO: 52863 - DNA, 20 bp, synthetic construct
  misc_feature 1..20: note = CRISPR gRNA sequence
  source 1..20: mol_type = other DNA
agagtgggggtgccttgagg

SEQ ID NO: 52864 - DNA, 20 bp, synthetic construct
  misc_feature 1..20: note = CRISPR gRNA sequence
  source 1..20: mol_type = other DNA
gagtgggggtgccttgagga

SEQ ID NO: 52865 - DNA, 20 bp, synthetic construct
  misc_feature 1..20: note = CRISPR gRNA sequence
  source 1..20: mol_type = other DNA
agtgggggtgccttgaggaa

SEQ ID NO: 52866 - DNA, 20 bp, synthetic construct
  misc_feature 1..20: note = CRISPR gRNA sequence
  source 1..20: mol_type = other DNA
gtgccttgaggaagggcttt

SEQ ID NO: 52867 - DNA, 20 bp, synthetic construct
  misc_feature 1..20: note = CRISPR gRNA sequence
  source 1..20: mol_type = other DNA
ccttgaggaagggctttcag

SEQ ID NO: 52868 - DNA, 20 bp, synthetic construct
  misc_feature 1..20: note = CRISPR gRNA sequence
  source 1..20: mol_type = other DNA
ctttcagaagtgctacgctc

SEQ ID NO: 52869 - DNA, 20 bp, synthetic construct
  misc_feature 1..20: note = CRISPR gRNA sequence
  source 1..20: mol_type = other DNA
agtgctacgctccagccatg

SEQ ID NO: 52870 - DNA, 20 bp, synthetic construct
  misc_feature 1..20: note = CRISPR gRNA sequence
  source 1..20: mol_type = other DNA
gtgctacgctccagccatgc

SEQ ID NO: 52871 - DNA, 20 bp, synthetic construct
  misc_feature 1..20: note = CRISPR gRNA sequence
  source 1..20: mol_type = other DNA
ctacgctccagccatgcagg

SEQ ID NO: 52872 - DNA, 20 bp, synthetic construct
  misc_feature 1..20: note = CRISPR gRNA sequence
  source 1..20: mol_type = other DNA
tacgctccagccatgcaggc

SEQ ID NO: 52873 - DNA, 20 bp, synthetic construct
  misc_feature 1..20: note = CRISPR gRNA sequence
  source 1..20: mol_type = other DNA
ccagccatgcaggcaggttc

SEQ ID NO: 52874 - DNA, 20 bp, synthetic construct
  misc_feature 1..20: note = CRISPR gRNA sequence
  source 1..20: mol_type = other DNA
gccatgcaggcaggttcaag

SEQ ID NO: 52875 - DNA, 20 bp, synthetic construct
  misc_feature 1..20: note = CRISPR gRNA sequence
  source 1..20: mol_type = other DNA
ccatgcaggcaggttcaagt

SEQ ID NO: 52876 - DNA, 20 bp, synthetic construct
  misc_feature 1..20: note = CRISPR gRNA sequence
  source 1..20: mol_type = other DNA
gcaggttcaagtgggtgccc

SEQ ID NO: 52877 - DNA, 20 bp, synthetic construct
  misc_feature 1..20: note = CRISPR gRNA sequence
  source 1..20: mol_type = other DNA
gttcaagtgggtgccctggt

SEQ ID NO: 52878 - DNA, 20 bp, synthetic construct
  misc_feature 1..20: note = CRISPR gRNA sequence
  source 1..20: mol_type = other DNA
ttcaagtgggtgccctggtg

SEQ ID NO: 52879 - DNA, 20 bp, synthetic construct
  misc_feature 1..20: note = CRISPR gRNA sequence
  source 1..20: mol_type = other DNA
tgggtgccctggtgaggctc

SEQ ID NO: 52880 - DNA, 20 bp, synthetic construct
  misc_feature 1..20: note = CRISPR gRNA sequence
  source 1..20: mol_type = other DNA
gggtgccctggtgaggctcc

SEQ ID NO: 52881 - DNA, 20 bp, synthetic construct
  misc_feature 1..20: note = CRISPR gRNA sequence
  source 1..20: mol_type = other DNA
ggtgccctggtgaggctcca

SEQ ID NO: 52882 - DNA, 20 bp, synthetic construct
  misc_feature 1..20: note = CRISPR gRNA sequence
  source 1..20: mol_type = other DNA
gtgccctggtgaggctccag

SEQ ID NO: 52883 - DNA, 20 bp, synthetic construct
  misc_feature 1..20: note = CRISPR gRNA sequence
  source 1..20: mol_type = other DNA
ccctggtgaggctccagggg

SEQ ID NO: 52884 - DNA, 20 bp, synthetic construct
  misc_feature 1..20: note = CRISPR gRNA sequence
  source 1..20: mol_type = other DNA
cctggtgaggctccaggggt

SEQ ID NO: 52885 - DNA, 20 bp, synthetic construct
  misc_feature 1..20: note = CRISPR gRNA sequence
  source 1..20: mol_type = other DNA
ctggtgaggctccaggggtg

SEQ ID NO: 52886 - DNA, 20 bp, synthetic construct
  misc_feature 1..20: note = CRISPR gRNA sequence
  source 1..20: mol_type = other DNA
tgaggctccaggggtggggt

SEQ ID NO: 52887 - DNA, 20 bp, synthetic construct
  misc_feature 1..20: note = CRISPR gRNA sequence
  source 1..20: mol_type = other DNA
aggctccaggggtggggttg

SEQ ID NO: 52888 - DNA, 20 bp, synthetic construct
  misc_feature 1..20: note = CRISPR gRNA sequence
  source 1..20: mol_type = other DNA
ggctccaggggtggggttgg

SEQ ID NO: 52889 - DNA, 20 bp, synthetic construct
  misc_feature 1..20: note = CRISPR gRNA sequence
  source 1..20: mol_type = other DNA
tccaggggtggggttggagg

SEQ ID NO: 52890 - DNA, 20 bp, synthetic construct
  misc_feature 1..20: note = CRISPR gRNA sequence
  source 1..20: mol_type = other DNA
ggggtggggttggaggtgga

SEQ ID NO: 52891 - DNA, 20 bp, synthetic construct
  misc_feature 1..20: note = CRISPR gRNA sequence
  source 1..20: mol_type = other DNA
gggtggggttggaggtggac

SEQ ID NO: 52892 - DNA, 20 bp, synthetic construct
  misc_feature 1..20: note = CRISPR gRNA sequence
  source 1..20: mol_type = other DNA
ggtggggttggaggtggaca

SEQ ID NO: 52893 - DNA, 20 bp, synthetic construct
  misc_feature 1..20: note = CRISPR gRNA sequence
  source 1..20: mol_type = other DNA
ttggaggtggacagggctcc

SEQ ID NO: 52894 - DNA, 20 bp, synthetic construct
  misc_feature 1..20: note = CRISPR gRNA sequence
  source 1..20: mol_type = other DNA
tggaggtggacagggctccc

SEQ ID NO: 52895 - DNA, 20 bp, synthetic construct
  misc_feature 1..20: note = CRISPR gRNA sequence
  source 1..20: mol_type = other DNA
acagggctcccaggtgccct

SEQ ID NO: 52896 - DNA, 20 bp, synthetic construct
  misc_feature 1..20: note = CRISPR gRNA sequence
  source 1..20: mol_type = other DNA
gctcccaggtgccctgagtt

SEQ ID NO: 52897 - DNA, 20 bp, synthetic construct
  misc_feature 1..20: note = CRISPR gRNA sequence
  source 1..20: mol_type = other DNA
cccaggtgccctgagttgag

SEQ ID NO: 52898 - DNA, 20 bp, synthetic construct
  misc_feature 1..20: note = CRISPR gRNA sequence
  source 1..20: mol_type = other DNA
ggtgccctgagttgagtgga

SEQ ID NO: 52899 - DNA, 20 bp, synthetic construct
  misc_feature 1..20: note = CRISPR gRNA sequence
  source 1..20: mol_type = other DNA
cctgagttgagtggatggtg

SEQ ID NO: 52900 - DNA, 20 bp, synthetic construct
  misc_feature 1..20: note = CRISPR gRNA sequence
  source 1..20: mol_type = other DNA
ctgagttgagtggatggtgc

SEQ ID NO: 52901 - DNA, 20 bp, synthetic construct
  misc_feature 1..20: note = CRISPR gRNA sequence
  source 1..20: mol_type = other DNA
ttgagtggatggtgcaggtg

SEQ ID NO: 52902 - DNA, 20 bp, synthetic construct
  misc_feature 1..20: note = CRISPR gRNA sequence
  source 1..20: mol_type = other DNA
tgagtggatggtgcaggtga

SEQ ID NO: 52903 - DNA, 20 bp, synthetic construct
  misc_feature 1..20: note = CRISPR gRNA sequence
  source 1..20: mol_type = other DNA
ggtgcaggtgaaggcttccc

SEQ ID NO: 52904 - DNA, 20 bp, synthetic construct
  misc_feature 1..20: note = CRISPR gRNA sequence
  source 1..20: mol_type = other DNA
aggtgaaggcttccccagtc

SEQ ID NO: 52905 - DNA, 20 bp, synthetic construct
  misc_feature 1..20: note = CRISPR gRNA sequence
  source 1..20: mol_type = other DNA
aaggcttccccagtccagca

SEQ ID NO: 52906 - DNA, 20 bp, synthetic construct
  misc_feature 1..20: note = CRISPR gRNA sequence
  source 1..20: mol_type = other DNA
cagtccagcacagcatctcc

SEQ ID NO: 52907 - DNA, 20 bp, synthetic construct
  misc_feature 1..20: note = CRISPR gRNA sequence
  source 1..20: mol_type = other DNA
tccagcacagcatctcccag

SEQ ID NO: 52908 - DNA, 20 bp, synthetic construct
  misc_feature 1..20: note = CRISPR gRNA sequence
  source 1..20: mol_type = other DNA
ccagcacagcatctcccagt

SEQ ID NO: 52909 - DNA, 20 bp, synthetic construct
  misc_feature 1..20: note = CRISPR gRNA sequence
  source 1..20: mol_type = other DNA
agcacagcatctcccagtgg

SEQ ID NO: 52910 - DNA, 20 bp, synthetic construct
  misc_feature 1..20: note = CRISPR gRNA sequence
  source 1..20: mol_type = other DNA
gtgggagacatgcgctgcct

SEQ ID NO: 52911 - DNA, 20 bp, synthetic construct
  misc_feature 1..20: note = CRISPR gRNA sequence
  source 1..20: mol_type = other DNA
tgggagacatgcgctgccta

SEQ ID NO: 52912 - DNA, 20 bp, synthetic construct
  misc_feature 1..20: note = CRISPR gRNA sequence
  source 1..20: mol_type = other DNA
agacatgcgctgcctaaggc

SEQ ID NO: 52913 - DNA, 20 bp, synthetic construct
  misc_feature 1..20: note = CRISPR gRNA sequence
  source 1..20: mol_type = other DNA
gacatgcgctgcctaaggct

SEQ ID NO: 52914 - DNA, 20 bp, synthetic construct
  misc_feature 1..20: note = CRISPR gRNA sequence
  source 1..20: mol_type = other DNA
acatgcgctgcctaaggctg

SEQ ID NO: 52915 - DNA, 20 bp, synthetic construct
  misc_feature 1..20: note = CRISPR gRNA sequence
  source 1..20: mol_type = other DNA
catgcgctgcctaaggctgg

SEQ ID NO: 52916 - DNA, 20 bp, synthetic construct
  misc_feature 1..20: note = CRISPR gRNA sequence
  source 1..20: mol_type = other DNA
gcctaaggctgggggctgcc

SEQ ID NO: 52917 - DNA, 20 bp, synthetic construct
  misc_feature 1..20: note = CRISPR gRNA sequence
  source 1..20: mol_type = other DNA
ctaaggctgggggctgccga

SEQ ID NO: 52918 - DNA, 20 bp, synthetic construct
  misc_feature 1..20: note = CRISPR gRNA sequence
  source 1..20: mol_type = other DNA
ggctgggggctgccgagaga

SEQ ID NO: 52919 - DNA, 20 bp, synthetic construct
  misc_feature 1..20: note = CRISPR gRNA sequence
  source 1..20: mol_type = other DNA
ggggctgccgagagacagcc

SEQ ID NO: 52920 - DNA, 20 bp, synthetic construct
  misc_feature 1..20: note = CRISPR gRNA sequence
  source 1..20: mol_type = other DNA
agacagccaagtttctacca

SEQ ID NO: 52921 - DNA, 20 bp, synthetic construct
  misc_feature 1..20: note = CRISPR gRNA sequence
  source 1..20: mol_type = other DNA
gacagccaagtttctaccaa

SEQ ID NO: 52922 - DNA, 20 bp, synthetic construct
  misc_feature 1..20: note = CRISPR gRNA sequence
  source 1..20: mol_type = other DNA
gccaagtttctaccaaaggc

SEQ ID NO: 52923 - DNA, 20 bp, synthetic construct
  misc_feature 1..20: note = CRISPR gRNA sequence
  source 1..20: mol_type = other DNA
ccaagtttctaccaaaggcc

SEQ ID NO: 52924 - DNA, 20 bp, synthetic construct
  misc_feature 1..20: note = CRISPR gRNA sequence
  source 1..20: mol_type = other DNA
caagtttctaccaaaggcca

SEQ ID NO: 52925 - DNA, 20 bp, synthetic construct
  misc_feature 1..20: note = CRISPR gRNA sequence
  source 1..20: mol_type = other DNA
aagtttctaccaaaggccag

SEQ ID NO: 52926 - DNA, 20 bp, synthetic construct
  misc_feature 1..20: note = CRISPR gRNA sequence
  source 1..20: mol_type = other DNA
caaaggccaggggactctca

SEQ ID NO: 52927 - DNA, 20 bp, synthetic construct
  misc_feature 1..20: note = CRISPR gRNA sequence
  source 1..20: mol_type = other DNA
aaaggccaggggactctcat

SEQ ID NO: 52928 - DNA, 20 bp, synthetic construct
  misc_feature 1..20: note = CRISPR gRNA sequence
  source 1..20: mol_type = other DNA
aaggccaggggactctcatg

SEQ ID NO: 52929 - DNA, 20 bp, synthetic construct
  misc_feature 1..20: note = CRISPR gRNA sequence
  source 1..20: mol_type = other DNA
gccaggggactctcatgggg

SEQ ID NO: 52930 - DNA, 20 bp, synthetic construct
  misc_feature 1..20: note = CRISPR gRNA sequence
  source 1..20: mol_type = other DNA
ccaggggactctcatggggc

SEQ ID NO: 52931 - DNA, 20 bp, synthetic construct
  misc_feature 1..20: note = CRISPR gRNA sequence
  source 1..20: mol_type = other DNA
caggggactctcatggggca

SEQ ID NO: 52932 - DNA, 20 bp, synthetic construct
  misc_feature 1..20: note = CRISPR gRNA sequence
  source 1..20: mol_type = other DNA
ggactctcatggggcagggc

SEQ ID NO: 52933 - DNA, 20 bp, synthetic construct
  misc_feature 1..20: note = CRISPR gRNA sequence
  source 1..20: mol_type = other DNA
ctctcatggggcagggctgg

SEQ ID NO: 52934 - DNA, 20 bp, synthetic construct
  misc_feature 1..20: note = CRISPR gRNA sequence
  source 1..20: mol_type = other DNA
tctcatggggcagggctggt

SEQ ID NO: 52935 - DNA, 20 bp, synthetic construct
  misc_feature 1..20: note = CRISPR gRNA sequence
  source 1..20: mol_type = other DNA
catggggcagggctggtggg

SEQ ID NO: 52936 - DNA, 20 bp, synthetic construct
  misc_feature 1..20: note = CRISPR gRNA sequence
  source 1..20: mol_type = other DNA
agggctggtgggaagaaatc

SEQ ID NO: 52937 - DNA, 20 bp, synthetic construct
  misc_feature 1..20: note = CRISPR gRNA sequence
  source 1..20: mol_type = other DNA
ctggtgggaagaaatcgaga

SEQ ID NO: 52938 - DNA, 20 bp, synthetic construct
  misc_feature 1..20: note = CRISPR gRNA sequence
  source 1..20: mol_type = other DNA
gactcacctgtcttctaacc

SEQ ID NO: 52939 - DNA, 20 bp, synthetic construct
  misc_feature 1..20: note = CRISPR gRNA sequence
  source 1..20: mol_type = other DNA
tcacctgtcttctaaccaag

SEQ ID NO: 52940 - DNA, 20 bp, synthetic construct
  misc_feature 1..20: note = CRISPR gRNA sequence
  source 1..20: mol_type = other DNA
ctaaccaagaagccccctcc

SEQ ID NO: 52941 - DNA, 20 bp, synthetic construct
  misc_feature 1..20: note = CRISPR gRNA sequence
  source 1..20: mol_type = other DNA
taaccaagaagccccctccc

SEQ ID NO: 52942 - DNA, 20 bp, synthetic construct
  misc_feature 1..20: note = CRISPR gRNA sequence
  source 1..20: mol_type = other DNA
gaagccccctcccaggtcac

SEQ ID NO: 52943 - DNA, 20 bp, synthetic construct
  misc_feature 1..20: note = CRISPR gRNA sequence
  source 1..20: mol_type = other DNA
aagccccctcccaggtcact

SEQ ID NO: 52944 - DNA, 20 bp, synthetic construct
  misc_feature 1..20: note = CRISPR gRNA sequence
  source 1..20: mol_type = other DNA
ccccctcccaggtcactggg

SEQ ID NO: 52945 - DNA, 20 bp, synthetic construct
  misc_feature 1..20: note = CRISPR gRNA sequence
  source 1..20: mol_type = other DNA
tcactgggcagatccccaca

SEQ ID NO: 52946 - DNA, 20 bp, synthetic construct
  misc_feature 1..20: note = CRISPR gRNA sequence
  source 1..20: mol_type = other DNA
gatccccacatggtgccctc

SEQ ID NO: 52947 - DNA, 20 bp, synthetic construct
  misc_feature 1..20: note = CRISPR gRNA sequence
  source 1..20: mol_type = other DNA
atccccacatggtgccctct

SEQ ID NO: 52948 - DNA, 20 bp, synthetic construct
  misc_feature 1..20: note = CRISPR gRNA sequence
  source 1..20: mol_type = other DNA
tccccacatggtgccctctg

SEQ ID NO: 52949 - DNA, 20 bp, synthetic construct
  misc_feature 1..20: note = CRISPR gRNA sequence
  source 1..20: mol_type = other DNA
tgtgtcctcgttacttactg

SEQ ID NO: 52950 - DNA, 20 bp, synthetic construct
  misc_feature 1..20: note = CRISPR gRNA sequence
  source 1..20: mol_type = other DNA
ctcgttacttactgcagttc

SEQ ID NO: 52951 - DNA, 20 bp, synthetic construct
  misc_feature 1..20: note = CRISPR gRNA sequence
  source 1..20: mol_type = other DNA
tcgttacttactgcagttcc

SEQ ID NO: 52952 - DNA, 20 bp, synthetic construct
  misc_feature 1..20: note = CRISPR gRNA sequence
  source 1..20: mol_type = other DNA
cgttacttactgcagttcca

SEQ ID NO: 52953 - DNA, 20 bp, synthetic construct
  misc_feature 1..20: note = CRISPR gRNA sequence
  source 1..20: mol_type = other DNA
gttacttactgcagttccag

SEQ ID NO: 52954 - DNA, 20 bp, synthetic construct
  misc_feature 1..20: note = CRISPR gRNA sequence
  source 1..20: mol_type = other DNA
tactgcagttccaggggtcc

SEQ ID NO: 52955 - DNA, 20 bp, synthetic construct
  misc_feature 1..20: note = CRISPR gRNA sequence
  source 1..20: mol_type = other DNA
actgcagttccaggggtccc

SEQ ID NO: 52956 - DNA, 20 bp, synthetic construct
  misc_feature 1..20: note = CRISPR gRNA sequence
  source 1..20: mol_type = other DNA
gcagttccaggggtcccggg

SEQ ID NO: 52957 - DNA, 20 bp, synthetic construct
  misc_feature 1..20: note = CRISPR gRNA sequence
  source 1..20: mol_type = other DNA
aggggtcccgggcagtcctt

SEQ ID NO: 52958 - DNA, 20 bp, synthetic construct
  misc_feature 1..20: note = CRISPR gRNA sequence
  source 1..20: mol_type = other DNA
gggtcccgggcagtccttca

SEQ ID NO: 52959 - DNA, 20 bp, synthetic construct
  misc_feature 1..20: note = CRISPR gRNA sequence
  source 1..20: mol_type = other DNA
tcccgggcagtccttcagag

SEQ ID NO: 52960 - DNA, 20 bp, synthetic construct
  misc_feature 1..20: note = CRISPR gRNA sequence
  source 1..20: mol_type = other DNA
ggcagtccttcagagtggca

SEQ ID NO: 52961 - DNA, 20 bp, synthetic construct
  misc_feature 1..20: note = CRISPR gRNA sequence
  source 1..20: mol_type = other DNA
cagtccttcagagtggcaca

SEQ ID NO: 52962 - DNA, 20 bp, synthetic construct
  misc_feature 1..20: note = CRISPR gRNA sequence
  source 1..20: mol_type = other DNA
agtccttcagagtggcacag

SEQ ID NO: 52963 - DNA, 20 bp, synthetic construct
  misc_feature 1..20: note = CRISPR gRNA sequence
  source 1..20: mol_type = other DNA
ccttcagagtggcacagagg

SEQ ID NO: 52964 - DNA, 20 bp, synthetic construct
  misc_feature 1..20: note = CRISPR gRNA sequence
  source 1..20: mol_type = other DNA
cttcagagtggcacagaggc

SEQ ID NO: 52965 - DNA, 20 bp, synthetic construct
  misc_feature 1..20: note = CRISPR gRNA sequence
  source 1..20: mol_type = other DNA
agagtggcacagaggcgggt

SEQ ID NO: 52966 - DNA, 20 bp, synthetic construct
  misc_feature 1..20: note = CRISPR gRNA sequence
  source 1..20: mol_type = other DNA
gagtggcacagaggcgggtg

SEQ ID NO: 52967 - DNA, 20 bp, synthetic construct
  misc_feature 1..20: note = CRISPR gRNA sequence
  source 1..20: mol_type = other DNA
gcacagaggcgggtgaggct

SEQ ID NO: 52968 - DNA, 20 bp, synthetic construct
  misc_feature 1..20: note = CRISPR gRNA sequence
  source 1..20: mol_type = other DNA
cacagaggcgggtgaggctt

SEQ ID NO: 52969 - DNA, 20 bp, synthetic construct
  misc_feature 1..20: note = CRISPR gRNA sequence
  source 1..20: mol_type = other DNA
acagaggcgggtgaggcttg

SEQ ID NO: 52970 - DNA, 20 bp, synthetic construct
  misc_feature 1..20: note = CRISPR gRNA sequence
  source 1..20: mol_type = other DNA
cagaggcgggtgaggcttgg

SEQ ID NO: 52971 - DNA, 20 bp, synthetic construct
  misc_feature 1..20: note = CRISPR gRNA sequence
  source 1..20: mol_type = other DNA
cgggtgaggcttgggggctc

SEQ ID NO: 52972 - DNA, 20 bp, synthetic construct
  misc_feature 1..20: note = CRISPR gRNA sequence
  source 1..20: mol_type = other DNA
ggtgaggcttgggggctcca

SEQ ID NO: 52973 - DNA, 20 bp, synthetic construct
  misc_feature 1..20: note = CRISPR gRNA sequence
  source 1..20: mol_type = other DNA
gtgaggcttgggggctccag

SEQ ID NO: 52974 - DNA, 20 bp, synthetic construct
  misc_feature 1..20: note = CRISPR gRNA sequence
  source 1..20: mol_type = other DNA
ggctccagaggacactcact

SEQ ID NO: 52975 - DNA, 20 bp, synthetic construct
  misc_feature 1..20: note = CRISPR gRNA sequence
  source 1..20: mol_type = other DNA
gctccagaggacactcactg

SEQ ID NO: 52976 - DNA, 20 bp, synthetic construct
  misc_feature 1..20: note = CRISPR gRNA sequence
  source 1..20: mol_type = other DNA
ggacactcactgaggctgca

SEQ ID NO: 52977 - DNA, 20 bp, synthetic construct
  misc_feature 1..20: note = CRISPR gRNA sequence
  source 1..20: mol_type = other DNA
gacactcactgaggctgcaa

SEQ ID NO: 52978 - DNA, 20 bp, synthetic construct
  misc_feature 1..20: note = CRISPR gRNA sequence
  source 1..20: mol_type = other DNA
acactcactgaggctgcaaa

SEQ ID NO: 52979 - DNA, 20 bp, synthetic construct
  misc_feature 1..20: note = CRISPR gRNA sequence
  source 1..20: mol_type = other DNA
cactcactgaggctgcaaag

SEQ ID NO: 52980 - DNA, 20 bp, synthetic construct
  misc_feature 1..20: note = CRISPR gRNA sequence
  source 1..20: mol_type = other DNA
ctgaggctgcaaaggggcaa

SEQ ID NO: 52981 - DNA, 20 bp, synthetic construct
  misc_feature 1..20: note = CRISPR gRNA sequence
  source 1..20: mol_type = other DNA
tgaggctgcaaaggggcaat

SEQ ID NO: 52982 - DNA, 20 bp, synthetic construct
  misc_feature 1..20: note = CRISPR gRNA sequence
  source 1..20: mol_type = other DNA
ggctgcaaaggggcaatggg

SEQ ID NO: 52983 - DNA, 20 bp, synthetic construct
  misc_feature 1..20: note = CRISPR gRNA sequence
  source 1..20: mol_type = other DNA
gctgcaaaggggcaatgggc

SEQ ID NO: 52984 - DNA, 20 bp, synthetic construct
  misc_feature 1..20: note = CRISPR gRNA sequence
  source 1..20: mol_type = other DNA
ctgcaaaggggcaatgggca

SEQ ID NO: 52985 - DNA, 20 bp, synthetic construct
  misc_feature 1..20: note = CRISPR gRNA sequence
  source 1..20: mol_type = other DNA
caaaggggcaatgggcaggg

SEQ ID NO: 52986 - DNA, 20 bp, synthetic construct
  misc_feature 1..20: note = CRISPR gRNA sequence
  source 1..20: mol_type = other DNA
aaaggggcaatgggcagggc

SEQ ID NO: 52987 - DNA, 20 bp, synthetic construct
  misc_feature 1..20: note = CRISPR gRNA sequence
  source 1..20: mol_type = other DNA
aaggggcaatgggcagggca

SEQ ID NO: 52988 - DNA, 20 bp, synthetic construct
  misc_feature 1..20: note = CRISPR gRNA sequence
  source 1..20: mol_type = other DNA
caatgggcagggcagggaat

SEQ ID NO: 52989 - DNA, 20 bp, synthetic construct
  misc_feature 1..20: note = CRISPR gRNA sequence
  source 1..20: mol_type = other DNA
atgggcagggcagggaatca

SEQ ID NO: 52990 - DNA, 20 bp, synthetic construct
  misc_feature 1..20: note = CRISPR gRNA sequence
  source 1..20: mol_type = other DNA
gcagggcagggaatcagaga

SEQ ID NO: 52991 - DNA, 20 bp, synthetic construct
  misc_feature 1..20: note = CRISPR gRNA sequence
  source 1..20: mol_type = other DNA
gcagggaatcagagaaagcc

SEQ ID NO: 52992 - DNA, 20 bp, synthetic construct
  misc_feature 1..20: note = CRISPR gRNA sequence
  source 1..20: mol_type = other DNA
cagggaatcagagaaagccc

SEQ ID NO: 52993 - DNA, 20 bp, synthetic construct
  misc_feature 1..20: note = CRISPR gRNA sequence
  source 1..20: mol_type = other DNA
agggaatcagagaaagccca

SEQ ID NO: 52994 - DNA, 20 bp, synthetic construct
  misc_feature 1..20: note = CRISPR gRNA sequence
  source 1..20: mol_type = other DNA
cagagaaagcccagggtccc

SEQ ID NO: 52995 - DNA, 20 bp, synthetic construct
  misc_feature 1..20: note = CRISPR gRNA sequence
  source 1..20: mol_type = other DNA
gaaagcccagggtccctggc

SEQ ID NO: 52996 - DNA, 20 bp, synthetic construct
  misc_feature 1..20: note = CRISPR gRNA sequence
  source 1..20: mol_type = other DNA
ccagggtccctggctagccc

SEQ ID NO: 52997 - DNA, 20 bp, synthetic construct
  misc_feature 1..20: note = CRISPR gRNA sequence
  source 1..20: mol_type = other DNA
cagggtccctggctagcccc

SEQ ID NO: 52998 - DNA, 20 bp, synthetic construct
  misc_feature 1..20: note = CRISPR gRNA sequence
  source 1..20: mol_type = other DNA
agggtccctggctagcccca

SEQ ID NO: 52999 - DNA, 20 bp, synthetic construct
  misc_feature 1..20: note = CRISPR gRNA sequence
  source 1..20: mol_type = other DNA
gggtccctggctagccccag

SEQ ID NO: 53000 - DNA, 20 bp, synthetic construct
  misc_feature 1..20: note = CRISPR gRNA sequence
  source 1..20: mol_type = other DNA
caggggctctatccttctcc

SEQ ID NO: 53001 - DNA, 20 bp, synthetic construct
  misc_feature 1..20: note = CRISPR gRNA sequence
  source 1..20: mol_type = other DNA
ctcccagcatccctcactct

SEQ ID NO: 53002 - DNA, 20 bp, synthetic construct
  misc_feature 1..20: note = CRISPR gRNA sequence
  source 1..20: mol_type = other DNA
ccagcatccctcactctaag

SEQ ID NO: 53003 - DNA, 20 bp, synthetic construct
  misc_feature 1..20: note = CRISPR gRNA sequence
  source 1..20: mol_type = other DNA
cagcatccctcactctaagt

SEQ ID NO: 53004 - DNA, 20 bp, synthetic construct
  misc_feature 1..20: note = CRISPR gRNA sequence
  source 1..20: mol_type = other DNA
gcatccctcactctaagtgg

SEQ ID NO: 53005 - DNA, 20 bp, synthetic construct
  misc_feature 1..20: note = CRISPR gRNA sequence
  source 1..20: mol_type = other DNA
catccctcactctaagtggg

SEQ ID NO: 53006 - DNA, 20 bp, synthetic construct
  misc_feature 1..20: note = CRISPR gRNA sequence
  source 1..20: mol_type = other DNA
tcactctaagtgggaggcca

SEQ ID NO: 53007 - DNA, 20 bp, synthetic construct
  misc_feature 1..20: note = CRISPR gRNA sequence
  source 1..20: mol_type = other DNA
cactctaagtgggaggccac

SEQ ID NO: 53008 - DNA, 20 bp, synthetic construct
  misc_feature 1..20: note = CRISPR gRNA sequence
  source 1..20: mol_type = other DNA
gccacaggccccttcccctg

SEQ ID NO: 53009 - DNA, 20 bp, synthetic construct
  misc_feature 1..20: note = CRISPR gRNA sequence
  source 1..20: mol_type = other DNA
ccacaggccccttcccctgt

SEQ ID NO: 53010 - DNA, 20 bp, synthetic construct
  misc_feature 1..20: note = CRISPR gRNA sequence
  source 1..20: mol_type = other DNA
cacaggccccttcccctgtg

SEQ ID NO: 53011 - DNA, 20 bp, synthetic construct
  misc_feature 1..20: note = CRISPR gRNA sequence
  source 1..20: mol_type = other DNA
ggggcactcgcttccctctc

SEQ ID NO: 53012 - DNA, 20 bp, synthetic construct
  misc_feature 1..20: note = CRISPR gRNA sequence
  source 1..20: mol_type = other DNA
tccctctcgagtctcccctg

SEQ ID NO: 53013 - DNA, 20 bp, synthetic construct
  misc_feature 1..20: note = CRISPR gRNA sequence
  source 1..20: mol_type = other DNA
ccccaatcctcctgccctga

SEQ ID NO: 53014 - DNA, 20 bp, synthetic construct
  misc_feature 1..20: note = CRISPR gRNA sequence
  source 1..20: mol_type = other DNA
tcctcctgccctgacagtga

SEQ ID NO: 53015 - DNA, 20 bp, synthetic construct
  misc_feature 1..20: note = CRISPR gRNA sequence
  source 1..20: mol_type = other DNA
ctgccctgacagtgacagtg

SEQ ID NO: 53016 - DNA, 20 bp, synthetic construct
  misc_feature 1..20: note = CRISPR gRNA sequence
  source 1..20: mol_type = other DNA
tgccctgacagtgacagtgc

SEQ ID NO: 53017 - DNA, 20 bp, synthetic construct
  misc_feature 1..20: note = CRISPR gRNA sequence
  source 1..20: mol_type = other DNA
cagtgacagtgcaggaccct

SEQ ID NO: 53018 - DNA, 20 bp, synthetic construct
  misc_feature 1..20: note = CRISPR gRNA sequence
  source 1..20: mol_type = other DNA
agtgcaggaccctgagttcc

SEQ ID NO: 53019 - DNA, 20 bp, synthetic construct
  misc_feature 1..20: note = CRISPR gRNA sequence
  source 1..20: mol_type = other DNA
gagttcccagctgcccttgt

SEQ ID NO: 53020 - DNA, 20 bp, synthetic construct
  misc_feature 1..20: note = CRISPR gRNA sequence
  source 1..20: mol_type = other DNA
gcccttgtcagtgactctcc

SEQ ID NO: 53021 - DNA, 20 bp, synthetic construct
  misc_feature 1..20: note = CRISPR gRNA sequence
  source 1..20: mol_type = other DNA
gtcctccccaccgccccctc

SEQ ID NO: 53022 - DNA, 20 bp, synthetic construct
  misc_feature 1..20: note = CRISPR gRNA sequence
  source 1..20: mol_type = other DNA
cctccccaccgccccctcca

SEQ ID NO: 53023 - DNA, 20 bp, synthetic construct
  misc_feature 1..20: note = CRISPR gRNA sequence
  source 1..20: mol_type = other DNA
ccaccgccccctccagagcc

SEQ ID NO: 53024 - DNA, 20 bp, synthetic construct
  misc_feature 1..20: note = CRISPR gRNA sequence
  source 1..20: mol_type = other DNA
caccgccccctccagagccc

SEQ ID NO: 53025 - DNA, 20 bp, synthetic construct
  misc_feature 1..20: note = CRISPR gRNA sequence
  source 1..20: mol_type = other DNA
cttgaccatttaacaccctc

SEQ ID NO: 53026 - DNA, 20 bp, synthetic construct
  misc_feature 1..20: note = CRISPR gRNA sequence
  source 1..20: mol_type = other DNA
ttgaccatttaacaccctct

SEQ ID NO: 53027 - DNA, 20 bp, synthetic construct
  misc_feature 1..20: note = CRISPR gRNA sequence
  source 1..20: mol_type = other DNA
ttaatccctctctgccccac

SEQ ID NO: 53028 - DNA, 20 bp, synthetic construct
  misc_feature 1..20: note = CRISPR gRNA sequence
  source 1..20: mol_type = other DNA
tttaacactgcacatctgac

SEQ ID NO: 53029 - DNA, 20 bp, synthetic construct
  misc_feature 1..20: note = CRISPR gRNA sequence
  source 1..20: mol_type = other DNA
ttaacactgcacatctgacc

SEQ ID NO: 53030 - DNA, 20 bp, synthetic construct
  misc_feature 1..20: note = CRISPR gRNA sequence
  source 1..20: mol_type = other DNA
gcctctccctgttacccccg

SEQ ID NO: 53031 - DNA, 20 bp, synthetic construct
  misc_feature 1..20: note = CRISPR gRNA sequence
  source 1..20: mol_type = other DNA
cccgtggctccccattgccc

SEQ ID NO: 53032 - DNA, 20 bp, synthetic construct
  misc_feature 1..20: note = CRISPR gRNA sequence
  source 1..20: mol_type = other DNA
ccgtggctccccattgccct

SEQ ID NO: 53033 - DNA, 20 bp, synthetic construct
  misc_feature 1..20: note = CRISPR gRNA sequence
  source 1..20: mol_type = other DNA
cgtggctccccattgccctg

SEQ ID NO: 53034 - DNA, 20 bp, synthetic construct
  misc_feature 1..20: note = CRISPR gRNA sequence
  source 1..20: mol_type = other DNA
ccccattgccctggggctaa

SEQ ID NO: 53035 - DNA, 20 bp, synthetic construct
  misc_feature 1..20: note = CRISPR gRNA sequence
  source 1..20: mol_type = other DNA
tgaaattgaaatgtccttcc

SEQ ID NO: 53036 - DNA, 20 bp, synthetic construct
  misc_feature 1..20: note = CRISPR gRNA sequence
  source 1..20: mol_type = other DNA
gaaattgaaatgtccttccc

SEQ ID NO: 53037 - DNA, 20 bp, synthetic construct
  misc_feature 1..20: note = CRISPR gRNA sequence
  source 1..20: mol_type = other DNA
aaattgaaatgtccttccca

SEQ ID NO: 53038 - DNA, 20 bp, synthetic construct
  misc_feature 1..20: note = CRISPR gRNA sequence
  source 1..20: mol_type = other DNA
ctcacttgcctccacttccc

SEQ ID NO: 53039 - DNA, 20 bp, synthetic construct
  misc_feature 1..20: note = CRISPR gRNA sequence
  source 1..20: mol_type = other DNA
cacttgcctccacttccctg

SEQ ID NO: 53040 - DNA, 20 bp, synthetic construct
  misc_feature 1..20: note = CRISPR gRNA sequence
  source 1..20: mol_type = other DNA
acttgcctccacttccctgg

SEQ ID NO: 53041 - DNA, 20 bp, synthetic construct
  misc_feature 1..20: note = CRISPR gRNA sequence
  source 1..20: mol_type = other DNA
cctccacttccctggaggcc

SEQ ID NO: 53042 - DNA, 20 bp, synthetic construct
  misc_feature 1..20: note = CRISPR gRNA sequence
  source 1..20: mol_type = other DNA
tccacttccctggaggccta

SEQ ID NO: 53043 - DNA, 20 bp, synthetic construct
  misc_feature 1..20: note = CRISPR gRNA sequence
  source 1..20: mol_type = other DNA
cacttccctggaggcctaga

SEQ ID NO: 53044 - DNA, 20 bp, synthetic construct
  misc_feature 1..20: note = CRISPR gRNA sequence
  source 1..20: mol_type = other DNA
cttccctggaggcctagaga

SEQ ID NO: 53045 - DNA, 20 bp, synthetic construct
  misc_feature 1..20: note = CRISPR gRNA sequence
  source 1..20: mol_type = other DNA
ttccctggaggcctagagag

SEQ ID NO: 53046 - DNA, 20 bp, synthetic construct
  misc_feature 1..20: note = CRISPR gRNA sequence
  source 1..20: mol_type = other DNA
cctggaggcctagagagagg

SEQ ID NO: 53047 - DNA, 20 bp, synthetic construct
  misc_feature 1..20: note = CRISPR gRNA sequence
  source 1..20: mol_type = other DNA
ctggaggcctagagagaggt

SEQ ID NO: 53048 - DNA, 20 bp, synthetic construct
  misc_feature 1..20: note = CRISPR gRNA sequence
  source 1..20: mol_type = other DNA
tggaggcctagagagaggtg

SEQ ID NO: 53049 - DNA, 20 bp, synthetic construct
  misc_feature 1..20: note = CRISPR gRNA sequence
  source 1..20: mol_type = other DNA
gcctagagagaggtggggcc

SEQ ID NO: 53050 - DNA, 20 bp, synthetic construct
  misc_feature 1..20: note = CRISPR gRNA sequence
  source 1..20: mol_type = other DNA
agagagaggtggggccaagt

SEQ ID NO: 53051 - DNA, 20 bp, synthetic construct
  misc_feature 1..20: note = CRISPR gRNA sequence
  source 1..20: mol_type = other DNA
gagagaggtggggccaagtc

SEQ ID NO: 53052 - DNA, 20 bp, synthetic construct
  misc_feature 1..20: note = CRISPR gRNA sequence
  source 1..20: mol_type = other DNA
agagaggtggggccaagtca

SEQ ID NO: 53053 - DNA, 20 bp, synthetic construct
  misc_feature 1..20: note = CRISPR gRNA sequence
  source 1..20: mol_type = other DNA
ggggccaagtcagggtctca

SEQ ID NO: 53054 - DNA, 20 bp, synthetic construct
  misc_feature 1..20: note = CRISPR gRNA sequence
  source 1..20: mol_type = other DNA
cagggtctcacagcctctca

SEQ ID NO: 53055 - DNA, 20 bp, synthetic construct
  misc_feature 1..20: note = CRISPR gRNA sequence
  source 1..20: mol_type = other DNA
ggtctcacagcctctcatgg

SEQ ID NO: 53056 - DNA, 20 bp, synthetic construct
  misc_feature 1..20: note = CRISPR gRNA sequence
  source 1..20: mol_type = other DNA
tctcacagcctctcatggca

SEQ ID NO: 53057 - DNA, 20 bp, synthetic construct
  misc_feature 1..20: note = CRISPR gRNA sequence
  source 1..20: mol_type = other DNA
gcctctcatggcagagcttg

SEQ ID NO: 53058 - DNA, 20 bp, synthetic construct
  misc_feature 1..20: note = CRISPR gRNA sequence
  source 1..20: mol_type = other DNA
ctcatggcagagcttgcaga

SEQ ID NO: 53059 - DNA, 20 bp, synthetic construct
  misc_feature 1..20: note = CRISPR gRNA sequence
  source 1..20: mol_type = other DNA
tcatggcagagcttgcagat

SEQ ID NO: 53060 - DNA, 20 bp, synthetic construct
  misc_feature 1..20: note = CRISPR gRNA sequence
  source 1..20: mol_type = other DNA
catggcagagcttgcagatg

SEQ ID NO: 53061 - DNA, 20 bp, synthetic construct
  misc_feature 1..20: note = CRISPR gRNA sequence
  source 1..20: mol_type = other DNA
tggcagagcttgcagatggg

SEQ ID NO: 53062 - DNA, 20 bp, synthetic construct
  misc_feature 1..20: note = CRISPR gRNA sequence
  source 1..20: mol_type = other DNA
cttgcagatggggagtgtat

SEQ ID NO: 53063 - DNA, 20 bp, synthetic construct
  misc_feature 1..20: note = CRISPR gRNA sequence
  source 1..20: mol_type = other DNA
gcagatggggagtgtattag

SEQ ID NO: 53064 - DNA, 20 bp, synthetic construct
  misc_feature 1..20: note = CRISPR gRNA sequence
  source 1..20: mol_type = other DNA
cagatggggagtgtattagt

SEQ ID NO: 53065 - DNA, 20 bp, synthetic construct
  misc_feature 1..20: note = CRISPR gRNA sequence
  source 1..20: mol_type = other DNA
agatggggagtgtattagtg

SEQ ID NO: 53066 - DNA, 20 bp, synthetic construct
  misc_feature 1..20: note = CRISPR gRNA sequence
  source 1..20: mol_type = other DNA
atggggagtgtattagtggg

SEQ ID NO: 53067 - DNA, 20 bp, synthetic construct
  misc_feature 1..20: note = CRISPR gRNA sequence
  source 1..20: mol_type = other DNA
ggagtgtattagtggggaga

SEQ ID NO: 53068 - DNA, 20 bp, synthetic construct
  misc_feature 1..20: note = CRISPR gRNA sequence
  source 1..20: mol_type = other DNA
gagtgtattagtggggagac

SEQ ID NO: 53069 - DNA, 20 bp, synthetic construct
  misc_feature 1..20: note = CRISPR gRNA sequence
  source 1..20: mol_type = other DNA
caggccaacccctttctttc

SEQ ID NO: 53070 - DNA, 20 bp, synthetic construct
  misc_feature 1..20: note = CRISPR gRNA sequence
  source 1..20: mol_type = other DNA
ccaacccctttctttctgga

SEQ ID NO: 53071 - DNA, 20 bp, synthetic construct
  misc_feature 1..20: note = CRISPR gRNA sequence
  source 1..20: mol_type = other DNA
acccctttctttctggaaag

SEQ ID NO: 53072 - DNA, 20 bp, synthetic construct
  misc_feature 1..20: note = CRISPR gRNA sequence
  source 1..20: mol_type = other DNA
cccctttctttctggaaagt

SEQ ID NO: 53073 - DNA, 20 bp, synthetic construct
  misc_feature 1..20: note = CRISPR gRNA sequence
  source 1..20: mol_type = other DNA
tctggaaagtgggtgtcccc

SEQ ID NO: 53074 - DNA, 20 bp, synthetic construct
  misc_feature 1..20: note = CRISPR gRNA sequence
  source 1..20: mol_type = other DNA
tggaaagtgggtgtccccca

SEQ ID NO: 53075 - DNA, 20 bp, synthetic construct
  misc_feature 1..20: note = CRISPR gRNA sequence
  source 1..20: mol_type = other DNA
aaagtgggtgtcccccagag

SEQ ID NO: 53076 - DNA, 20 bp, synthetic construct
  misc_feature 1..20: note = CRISPR gRNA sequence
  source 1..20: mol_type = other DNA
tgggtgtcccccagagcaga

SEQ ID NO: 53077 - DNA, 20 bp, synthetic construct
  misc_feature 1..20: note = CRISPR gRNA sequence
  source 1..20: mol_type = other DNA
ggtgtcccccagagcagatg

SEQ ID NO: 53078 - DNA, 20 bp, synthetic construct
  misc_feature 1..20: note = CRISPR gRNA sequence
  source 1..20: mol_type = other DNA
cccagagcagatggagaccc

SEQ ID NO: 53079 - DNA, 20 bp, synthetic construct
  misc_feature 1..20: note = CRISPR gRNA sequence
  source 1..20: mol_type = other DNA
ccagagcagatggagacccc

SEQ ID NO: 53080 - DNA, 20 bp, synthetic construct
  misc_feature 1..20: note = CRISPR gRNA sequence
  source 1..20: mol_type = other DNA
gagcagatggagaccccagg

SEQ ID NO: 53081 - DNA, 20 bp, synthetic construct
  misc_feature 1..20: note = CRISPR gRNA sequence
  source 1..20: mol_type = other DNA
agcagatggagaccccaggc

SEQ ID NO: 53082 - DNA, 20 bp, synthetic construct
  misc_feature 1..20: note = CRISPR gRNA sequence
  source 1..20: mol_type = other DNA
gcagatggagaccccaggca

SEQ ID NO: 53083 - DNA, 20 bp, synthetic construct
  misc_feature 1..20: note = CRISPR gRNA sequence
  source 1..20: mol_type = other DNA
agatggagaccccaggcagg

SEQ ID NO: 53084 - DNA, 20 bp, synthetic construct
  misc_feature 1..20: note = CRISPR gRNA sequence
  source 1..20: mol_type = other DNA
tggagaccccaggcagggag

SEQ ID NO: 53085 - DNA, 20 bp, synthetic construct
  misc_feature 1..20: note = CRISPR gRNA sequence
  source 1..20: mol_type = other DNA
accccaggcagggagtggct

SEQ ID NO: 53086 - DNA, 20 bp, synthetic construct
  misc_feature 1..20: note = CRISPR gRNA sequence
  source 1..20: mol_type = other DNA
gagctgctctgtttgcttca

SEQ ID NO: 53087 - DNA, 20 bp, synthetic construct
  misc_feature 1..20: note = CRISPR gRNA sequence
  source 1..20: mol_type = other DNA
ctgtttgcttcacagaaatg

SEQ ID NO: 53088 - DNA, 20 bp, synthetic construct
  misc_feature 1..20: note = CRISPR gRNA sequence
  source 1..20: mol_type = other DNA
aaatgtggaatcttctctcc

SEQ ID NO: 53089 - DNA, 20 bp, synthetic construct
  misc_feature 1..20: note = CRISPR gRNA sequence
  source 1..20: mol_type = other DNA
aatgtggaatcttctctcca

SEQ ID NO: 53090 - DNA, 20 bp, synthetic construct
  misc_feature 1..20: note = CRISPR gRNA sequence
  source 1..20: mol_type = other DNA
tgtggaatcttctctccaag

SEQ ID NO: 53091 - DNA, 20 bp, synthetic construct
  misc_feature 1..20: note = CRISPR gRNA sequence
  source 1..20: mol_type = other DNA
tcttctctccaaggagaatg

SEQ ID NO: 53092 - DNA, 20 bp, synthetic construct
  misc_feature 1..20: note = CRISPR gRNA sequence
  source 1..20: mol_type = other DNA
cttctctccaaggagaatgc

SEQ ID NO: 53093 - DNA, 20 bp, synthetic construct
  misc_feature 1..20: note = CRISPR gRNA sequence
  source 1..20: mol_type = other DNA
ttctctccaaggagaatgcg

SEQ ID NO: 53094 - DNA, 20 bp, synthetic construct
  misc_feature 1..20: note = CRISPR gRNA sequence
  source 1..20: mol_type = other DNA
tccaaggagaatgcggggca

SEQ ID NO: 53095 - DNA, 20 bp, synthetic construct
  misc_feature 1..20: note = CRISPR gRNA sequence
  source 1..20: mol_type = other DNA
ccaaggagaatgcggggcat

SEQ ID NO: 53096 - DNA, 20 bp, synthetic construct
  misc_feature 1..20: note = CRISPR gRNA sequence
  source 1..20: mol_type = other DNA
ggagaatgcggggcatgggc

SEQ ID NO: 53097 - DNA, 20 bp, synthetic construct
  misc_feature 1..20: note = CRISPR gRNA sequence
  source 1..20: mol_type = other DNA
atgcggggcatgggccagct

SEQ ID NO: 53098 - DNA, 20 bp, synthetic construct
  misc_feature 1..20: note = CRISPR gRNA sequence
  source 1..20: mol_type = other DNA
gggccagctgagctgcccgt

SEQ ID NO: 53099 - DNA, 20 bp, synthetic construct
  misc_feature 1..20: note = CRISPR gRNA sequence
  source 1..20: mol_type = other DNA
ggccagctgagctgcccgtc

SEQ ID NO: 53100 - DNA, 20 bp, synthetic construct
  misc_feature 1..20: note = CRISPR gRNA sequence
  source 1..20: mol_type = other DNA
gccagctgagctgcccgtca

SEQ ID NO: 53101 - DNA, 20 bp, synthetic construct
  misc_feature 1..20: note = CRISPR gRNA sequence
  source 1..20: mol_type = other DNA
ccagctgagctgcccgtcag

SEQ ID NO: 53102 - DNA, 20 bp, synthetic construct
  misc_feature 1..20: note = CRISPR gRNA sequence
  source 1..20: mol_type = other DNA
ctgagctgcccgtcaggggc

SEQ ID NO: 53103 - DNA, 20 bp, synthetic construct
  misc_feature 1..20: note = CRISPR gRNA sequence
  source 1..20: mol_type = other DNA
gagctgcccgtcaggggcca

SEQ ID NO: 53104 - DNA, 20 bp, synthetic construct
  misc_feature 1..20: note = CRISPR gRNA sequence
  source 1..20: mol_type = other DNA
ggccagagctccccaactcc

SEQ ID NO: 53105 - DNA, 20 bp, synthetic construct
  misc_feature 1..20: note = CRISPR gRNA sequence
  source 1..20: mol_type = other DNA
cttccctctatcccaatccc

SEQ ID NO: 53106 - DNA, 20 bp, synthetic construct
  misc_feature 1..20: note = CRISPR gRNA sequence
  source 1..20: mol_type = other DNA
tctatcccaatccccagccc

SEQ ID NO: 53107 - DNA, 20 bp, synthetic construct
  misc_feature 1..20: note = CRISPR gRNA sequence
  source 1..20: mol_type = other DNA
ccccagccctagccccctgc

SEQ ID NO: 53108 - DNA, 20 bp, synthetic construct
  misc_feature 1..20: note = CRISPR gRNA sequence
  source 1..20: mol_type = other DNA
ctgacgcctcatccctatta

SEQ ID NO: 53109 - DNA, 20 bp, synthetic construct
  misc_feature 1..20: note = CRISPR gRNA sequence
  source 1..20: mol_type = other DNA
tattatggttacccccaaac

SEQ ID NO: 53110 - DNA, 20 bp, synthetic construct
  misc_feature 1..20: note = CRISPR gRNA sequence
  source 1..20: mol_type = other DNA
tatggttacccccaaacaag

SEQ ID NO: 53111 - DNA, 20 bp, synthetic construct
  misc_feature 1..20: note = CRISPR gRNA sequence
  source 1..20: mol_type = other DNA
atggttacccccaaacaaga

SEQ ID NO: 53112 - DNA, 20 bp, synthetic construct
  misc_feature 1..20: note = CRISPR gRNA sequence
  source 1..20: mol_type = other DNA
tggttacccccaaacaagaa

SEQ ID NO: 53113 - DNA, 20 bp, synthetic construct
  misc_feature 1..20: note = CRISPR gRNA sequence
  source 1..20: mol_type = other DNA
tacccccaaacaagaagggc

SEQ ID NO: 53114 - DNA, 20 bp, synthetic construct
  misc_feature 1..20: note = CRISPR gRNA sequence
  source 1..20: mol_type = other DNA
acccccaaacaagaagggct

SEQ ID NO: 53115 - DNA, 20 bp, synthetic construct
  misc_feature 1..20: note = CRISPR gRNA sequence
  source 1..20: mol_type = other DNA
ccaaacaagaagggctggga

SEQ ID NO: 53116 - DNA, 20 bp, synthetic construct
  misc_feature 1..20: note = CRISPR gRNA sequence
  source 1..20: mol_type = other DNA
aagaagggctgggacagtac

SEQ ID NO: 53117 - DNA, 20 bp, synthetic construct
  misc_feature 1..20: note = CRISPR gRNA sequence
  source 1..20: mol_type = other DNA
gaagggctgggacagtacca

SEQ ID NO: 53118 - DNA, 20 bp, synthetic construct
  misc_feature 1..20: note = CRISPR gRNA sequence
  source 1..20: mol_type = other DNA
aagggctgggacagtaccag

SEQ ID NO: 53119 - DNA, 20 bp, synthetic construct
  misc_feature 1..20: note = CRISPR gRNA sequence
  source 1..20: mol_type = other DNA
gggacagtaccagaggctcc

SEQ ID NO: 53120 - DNA, 20 bp, synthetic construct
  misc_feature 1..20: note = CRISPR gRNA sequence
  source 1..20: mol_type = other DNA
ggacagtaccagaggctcct

SEQ ID NO: 53121 - DNA, 20 bp, synthetic construct
  misc_feature 1..20: note = CRISPR gRNA sequence
  source 1..20: mol_type = other DNA
gacagtaccagaggctcctg

SEQ ID NO: 53122 - DNA, 20 bp, synthetic construct
  misc_feature 1..20: note = CRISPR gRNA sequence
  source 1..20: mol_type = other DNA
accagaggctcctggggatg

SEQ ID NO: 53123 - DNA, 20 bp, synthetic construct
  misc_feature 1..20: note = CRISPR gRNA sequence
  source 1..20: mol_type = other DNA
tcctggggatgcagcgctga

SEQ ID NO: 53124 - DNA, 20 bp, synthetic construct
  misc_feature 1..20: note = CRISPR gRNA sequence
  source 1..20: mol_type = other DNA
tgcagcgctgacggaaccct

SEQ ID NO: 53125 - DNA, 20 bp, synthetic construct
  misc_feature 1..20: note = CRISPR gRNA sequence
  source 1..20: mol_type = other DNA
ctgacggaaccctaagaact

SEQ ID NO: 53126 - DNA, 20 bp, synthetic construct
  misc_feature 1..20: note = CRISPR gRNA sequence
  source 1..20: mol_type = other DNA
gaaccctaagaacttggctg

SEQ ID NO: 53127 - DNA, 20 bp, synthetic construct
  misc_feature 1..20: note = CRISPR gRNA sequence
  source 1..20: mol_type = other DNA
cctaagaacttggctgcagc

SEQ ID NO: 53128 - DNA, 20 bp, synthetic construct
  misc_feature 1..20: note = CRISPR gRNA sequence
  source 1..20: mol_type = other DNA
ctaagaacttggctgcagct

SEQ ID NO: 53129 - DNA, 20 bp, synthetic construct
  misc_feature 1..20: note = CRISPR gRNA sequence
  source 1..20: mol_type = other DNA
agaacttggctgcagctggg

SEQ ID NO: 53130 - DNA, 20 bp, synthetic construct
  misc_feature 1..20: note = CRISPR gRNA sequence
  source 1..20: mol_type = other DNA
ttggctgcagctgggaagtc

SEQ ID NO: 53131 - DNA, 20 bp, synthetic construct
  misc_feature 1..20: note = CRISPR gRNA sequence
  source 1..20: mol_type = other DNA
tgcagctgggaagtctggca

SEQ ID NO: 53132 - DNA, 20 bp, synthetic construct
  misc_feature 1..20: note = CRISPR gRNA sequence
  source 1..20: mol_type = other DNA
tgggaagtctggcaaagatc

SEQ ID NO: 53133 - DNA, 20 bp, synthetic construct
  misc_feature 1..20: note = CRISPR gRNA sequence
  source 1..20: mol_type = other DNA
gaagtctggcaaagatccag

SEQ ID NO: 53134 - DNA, 20 bp, synthetic construct
  misc_feature 1..20: note = CRISPR gRNA sequence
  source 1..20: mol_type = other DNA
tccagtggcccacatatccc

SEQ ID NO: 53135 - DNA, 20 bp, synthetic construct
  misc_feature 1..20: note = CRISPR gRNA sequence
  source 1..20: mol_type = other DNA
ccagtggcccacatatccct

SEQ ID NO: 53136 - DNA, 20 bp, synthetic construct
  misc_feature 1..20: note = CRISPR gRNA sequence
  source 1..20: mol_type = other DNA
agtggcccacatatccctag

SEQ ID NO: 53137 - DNA, 20 bp, synthetic construct
  misc_feature 1..20: note = CRISPR gRNA sequence
  source 1..20: mol_type = other DNA
gtggcccacatatccctagg

SEQ ID NO: 53138 - DNA, 20 bp, synthetic construct
  misc_feature 1..20: note = CRISPR gRNA sequence
  source 1..20: mol_type = other DNA
tggcccacatatccctagga

SEQ ID NO: 53139 - DNA, 20 bp, synthetic construct
  misc_feature 1..20: note = CRISPR gRNA sequence
  source 1..20: mol_type = other DNA
ggcccacatatccctaggag

SEQ ID NO: 53140 - DNA, 20 bp, synthetic construct
  misc_feature 1..20: note = CRISPR gRNA sequence
  source 1..20: mol_type = other DNA
gcccacatatccctaggagg

SEQ ID NO: 53141 - DNA, 20 bp, synthetic construct
  misc_feature 1..20: note = CRISPR gRNA sequence
  source 1..20: mol_type = other DNA
tccctaggagggggatcatt

SEQ ID NO: 53142 - DNA, 20 bp, synthetic construct
  misc_feature 1..20: note = CRISPR gRNA sequence
  source 1..20: mol_type = other DNA
taggagggggatcatttaga

SEQ ID NO: 53143 - DNA, 20 bp, synthetic construct
  misc_feature 1..20: note = CRISPR gRNA sequence
  source 1..20: mol_type = other DNA
aggagggggatcatttagaa

SEQ ID NO: 53144 - DNA, 20 bp, synthetic construct
  misc_feature 1..20: note = CRISPR gRNA sequence
  source 1..20: mol_type = other DNA
gggggatcatttagaaagga

SEQ ID NO: 53145 - DNA, 20 bp, synthetic construct
  misc_feature 1..20: note = CRISPR gRNA sequence
  source 1..20: mol_type = other DNA
atcatttagaaaggaaagtt

SEQ ID NO: 53146 - DNA, 20 bp, synthetic construct
  misc_feature 1..20: note = CRISPR gRNA sequence
  source 1..20: mol_type = other DNA
gaaagttcagatcaccccct

SEQ ID NO: 53147 - DNA, 20 bp, synthetic construct
  misc_feature 1..20: note = CRISPR gRNA sequence
  source 1..20: mol_type = other DNA
agatcaccccctcggactcc

SEQ ID NO: 53148 - DNA, 20 bp, synthetic construct
  misc_feature 1..20: note = CRISPR gRNA sequence
  source 1..20: mol_type = other DNA
accccctcggactcccagcc

SEQ ID NO: 53149 - DNA, 20 bp, synthetic construct
  misc_feature 1..20: note = CRISPR gRNA sequence
  source 1..20: mol_type = other DNA
cagcccagcccatatacccc

SEQ ID NO: 53150 - DNA, 20 bp, synthetic construct
  misc_feature 1..20: note = CRISPR gRNA sequence
  source 1..20: mol_type = other DNA
agcccagcccatatacccct

SEQ ID NO: 53151 - DNA, 20 bp, synthetic construct
  misc_feature 1..20: note = CRISPR gRNA sequence
  source 1..20: mol_type = other DNA
cccagcccatatacccctag

SEQ ID NO: 53152 - DNA, 20 bp, synthetic construct
  misc_feature 1..20: note = CRISPR gRNA sequence
  source 1..20: mol_type = other DNA
ccagcccatatacccctagg

SEQ ID NO: 53153 - DNA, 20 bp, synthetic construct
  misc_feature 1..20: note = CRISPR gRNA sequence
  source 1..20: mol_type = other DNA
cagcccatatacccctagga

SEQ ID NO: 53154 - DNA, 20 bp, synthetic construct
  misc_feature 1..20: note = CRISPR gRNA sequence
  source 1..20: mol_type = other DNA
agcccatatacccctaggag

SEQ ID NO: 53155 - DNA, 20 bp, synthetic construct
  misc_feature 1..20: note = CRISPR gRNA sequence
  source 1..20: mol_type = other DNA
gcccatatacccctaggagg

SEQ ID NO: 53156 - DNA, 20 bp, synthetic construct
  misc_feature 1..20: note = CRISPR gRNA sequence
  source 1..20: mol_type = other DNA
cccctaggagggggatcgtt

SEQ ID NO: 53157 - DNA, 20 bp, synthetic construct
  misc_feature 1..20: note = CRISPR gRNA sequence
  source 1..20: mol_type = other DNA
taggagggggatcgtttaga

SEQ ID NO: 53158 - DNA, 20 bp, synthetic construct
  misc_feature 1..20: note = CRISPR gRNA sequence
  source 1..20: mol_type = other DNA
aggagggggatcgtttagaa

SEQ ID NO: 53159 - DNA, 20 bp, synthetic construct
  misc_feature 1..20: note = CRISPR gRNA sequence
  source 1..20: mol_type = other DNA
gggggatcgtttagaaagga

SEQ ID NO: 53160 - DNA, 20 bp, synthetic construct
  misc_feature 1..20: note = CRISPR gRNA sequence
  source 1..20: mol_type = other DNA
atcgtttagaaaggaaagtt

SEQ ID NO: 53161 - DNA, 20 bp, synthetic construct
  misc_feature 1..20: note = CRISPR gRNA sequence
  source 1..20: mol_type = other DNA
aaagttcagatcacccacat

SEQ ID NO: 53162 - DNA, 20 bp, synthetic construct
  misc_feature 1..20: note = CRISPR gRNA sequence
  source 1..20: mol_type = other DNA
gatcacccacattggactcc

SEQ ID NO: 53163 - DNA, 20 bp, synthetic construct
  misc_feature 1..20: note = CRISPR gRNA sequence
  source 1..20: mol_type = other DNA
ccacattggactcccagact

SEQ ID NO: 53164 - DNA, 20 bp, synthetic construct
  misc_feature 1..20: note = CRISPR gRNA sequence
  source 1..20: mol_type = other DNA
attggactcccagacttgga

SEQ ID NO: 53165 - DNA, 20 bp, synthetic construct
  misc_feature 1..20: note = CRISPR gRNA sequence
  source 1..20: mol_type = other DNA
gactcccagacttggaaagt

SEQ ID NO: 53166 - DNA, 20 bp, synthetic construct
  misc_feature 1..20: note = CRISPR gRNA sequence
  source 1..20: mol_type = other DNA
actcccagacttggaaagtc

SEQ ID NO: 53167 - DNA, 20 bp, synthetic construct
  misc_feature 1..20: note = CRISPR gRNA sequence
  source 1..20: mol_type = other DNA
ctcccagacttggaaagtca

SEQ ID NO: 53168 - DNA, 20 bp, synthetic construct
  misc_feature 1..20: note = CRISPR gRNA sequence
  source 1..20: mol_type = other DNA
cagacttggaaagtcagggc

SEQ ID NO: 53169 - DNA, 20 bp, synthetic construct
  misc_feature 1..20: note = CRISPR gRNA sequence
  source 1..20: mol_type = other DNA
acttggaaagtcagggctgg

SEQ ID NO: 53170 - DNA, 20 bp, synthetic construct
  misc_feature 1..20: note = CRISPR gRNA sequence
  source 1..20: mol_type = other DNA
cttggaaagtcagggctgga

SEQ ID NO: 53171 - DNA, 20 bp, synthetic construct
  misc_feature 1..20: note = CRISPR gRNA sequence
  source 1..20: mol_type = other DNA
gtcagggctggaaggcatct

SEQ ID NO: 53172 - DNA, 20 bp, synthetic construct
  misc_feature 1..20: note = CRISPR gRNA sequence
  source 1..20: mol_type = other DNA
cagggctggaaggcatctca

SEQ ID NO: 53173 - DNA, 20 bp, synthetic construct
  misc_feature 1..20: note = CRISPR gRNA sequence
  source 1..20: mol_type = other DNA
aaggcatctcagagacaatg

SEQ ID NO: 53174 - DNA, 20 bp, synthetic construct
  misc_feature 1..20: note = CRISPR gRNA sequence
  source 1..20: mol_type = other DNA
ctcagagacaatgcagtcac

SEQ ID NO: 53175 - DNA, 20 bp, synthetic construct
  misc_feature 1..20: note = CRISPR gRNA sequence
  source 1..20: mol_type = other DNA
acaatgcagtcactagatcc

SEQ ID NO: 53176 - DNA, 20 bp, synthetic construct
  misc_feature 1..20: note = CRISPR gRNA sequence
  source 1..20: mol_type = other DNA
gcagtcactagatcctagct

SEQ ID NO: 53177 - DNA, 20 bp, synthetic construct
  misc_feature 1..20: note = CRISPR gRNA sequence
  source 1..20: mol_type = other DNA
tagctcagtccctcattgtt

SEQ ID NO: 53178 - DNA, 20 bp, synthetic construct
  misc_feature 1..20: note = CRISPR gRNA sequence
  source 1..20: mol_type = other DNA
tcagtccctcattgttcaga

SEQ ID NO: 53179 - DNA, 20 bp, synthetic construct
  misc_feature 1..20: note = CRISPR gRNA sequence
  source 1..20: mol_type = other DNA
cagtccctcattgttcagat

SEQ ID NO: 53180 - DNA, 20 bp, synthetic construct
  misc_feature 1..20: note = CRISPR gRNA sequence
  source 1..20: mol_type = other DNA
agtccctcattgttcagatg

SEQ ID NO: 53181 - DNA, 20 bp, synthetic construct
  misc_feature 1..20: note = CRISPR gRNA sequence
  source 1..20: mol_type = other DNA
attgttcagatggggaaact

SEQ ID NO: 53182 - DNA, 20 bp, synthetic construct
  misc_feature 1..20: note = CRISPR gRNA sequence
  source 1..20: mol_type = other DNA
ttgttcagatggggaaactg

SEQ ID NO: 53183 - DNA, 20 bp, synthetic construct
  misc_feature 1..20: note = CRISPR gRNA sequence
  source 1..20: mol_type = other DNA
cagatggggaaactgaggct

SEQ ID NO: 53184 - DNA, 20 bp, synthetic construct
  misc_feature 1..20: note = CRISPR gRNA sequence
  source 1..20: mol_type = other DNA
agatggggaaactgaggctc

SEQ ID NO: 53185 - DNA, 20 bp, synthetic construct
  misc_feature 1..20: note = CRISPR gRNA sequence
  source 1..20: mol_type = other DNA
gatggggaaactgaggctca

SEQ ID NO: 53186 - DNA, 20 bp, synthetic construct
  misc_feature 1..20: note = CRISPR gRNA sequence
  source 1..20: mol_type = other DNA
ggggaaactgaggctcaggg

SEQ ID NO: 53187 - DNA, 20 bp, synthetic construct
  misc_feature 1..20: note = CRISPR gRNA sequence
  source 1..20: mol_type = other DNA
gggaaactgaggctcaggga

SEQ ID NO: 53188 - DNA, 20 bp, synthetic construct
  misc_feature 1..20: note = CRISPR gRNA sequence
  source 1..20: mol_type = other DNA
ggaaactgaggctcagggaa

SEQ ID NO: 53189 - DNA, 20 bp, synthetic construct
  misc_feature 1..20: note = CRISPR gRNA sequence
  source 1..20: mol_type = other DNA
aactgaggctcagggaaggg

SEQ ID NO: 53190 - DNA, 20 bp, synthetic construct
  misc_feature 1..20: note = CRISPR gRNA sequence
  source 1..20: mol_type = other DNA
ggctcagggaagggaagcct

SEQ ID NO: 53191 - DNA, 20 bp, synthetic construct
  misc_feature 1..20: note = CRISPR gRNA sequence
  source 1..20: mol_type = other DNA
cagggaagggaagcctgagt

SEQ ID NO: 53192 - DNA, 20 bp, synthetic construct
  misc_feature 1..20: note = CRISPR gRNA sequence
  source 1..20: mol_type = other DNA
aagggaagcctgagttagaa

SEQ ID NO: 53193 - DNA, 20 bp, synthetic construct
  misc_feature 1..20: note = CRISPR gRNA sequence
  source 1..20: mol_type = other DNA
gaagcctgagttagaaaagc

SEQ ID NO: 53194 - DNA, 20 bp, synthetic construct
  misc_feature 1..20: note = CRISPR gRNA sequence
  source 1..20: mol_type = other DNA
gcctgagttagaaaagccag

SEQ ID NO: 53195 - DNA, 20 bp, synthetic construct
  misc_feature 1..20: note = CRISPR gRNA sequence
  source 1..20: mol_type = other DNA
gccagcagcttgttcctgtc

SEQ ID NO: 53196 - DNA, 20 bp, synthetic construct
  misc_feature 1..20: note = CRISPR gRNA sequence
  source 1..20: mol_type = other DNA
ccagcagcttgttcctgtcc

SEQ ID NO: 53197 - DNA, 20 bp, synthetic construct
  misc_feature 1..20: note = CRISPR gRNA sequence
  source 1..20: mol_type = other DNA
cagcttgttcctgtccaggt

SEQ ID NO: 53198 - DNA, 20 bp, synthetic construct
  misc_feature 1..20: note = CRISPR gRNA sequence
  source 1..20: mol_type = other DNA
cttgttcctgtccaggtgag

SEQ ID NO: 53199 - DNA, 20 bp, synthetic construct
  misc_feature 1..20: note = CRISPR gRNA sequence
  source 1..20: mol_type = other DNA
ttgttcctgtccaggtgagc

SEQ ID NO: 53200 - DNA, 20 bp, synthetic construct
  misc_feature 1..20: note = CRISPR gRNA sequence
  source 1..20: mol_type = other DNA
ttcctgtccaggtgagcagg

SEQ ID NO: 53201 - DNA, 20 bp, synthetic construct
  misc_feature 1..20: note = CRISPR gRNA sequence
  source 1..20: mol_type = other DNA
tcctgtccaggtgagcaggc

SEQ ID NO: 53202 - DNA, 20 bp, synthetic construct
  misc_feature 1..20: note = CRISPR gRNA sequence
  source 1..20: mol_type = other DNA
ctgtccaggtgagcaggcag

SEQ ID NO: 53203 - DNA, 20 bp, synthetic construct
  misc_feature 1..20: note = CRISPR gRNA sequence
  source 1..20: mol_type = other DNA
tgtccaggtgagcaggcagg

SEQ ID NO: 53204 - DNA, 20 bp, synthetic construct
  misc_feature 1..20: note = CRISPR gRNA sequence
  source 1..20: mol_type = other DNA
gtgagcaggcaggaggaccc

SEQ ID NO: 53205 - DNA, 20 bp, synthetic construct
  misc_feature 1..20: note = CRISPR gRNA sequence
  source 1..20: mol_type = other DNA
gcaggcaggaggacccaaga

SEQ ID NO: 53206 - DNA, 20 bp, synthetic construct
  misc_feature 1..20: note = CRISPR gRNA sequence
  source 1..20: mol_type = other DNA
aggcaggaggacccaagaca

SEQ ID NO: 53207 - DNA, 20 bp, synthetic construct
  misc_feature 1..20: note = CRISPR gRNA sequence
  source 1..20: mol_type = other DNA
gagcctctctgaccactgct

SEQ ID NO: 53208 - DNA, 20 bp, synthetic construct
  misc_feature 1..20: note = CRISPR gRNA sequence
  source 1..20: mol_type = other DNA
acttctgcctccctgtacgt

SEQ ID NO: 53209 - DNA, 20 bp, synthetic construct
  misc_feature 1..20: note = CRISPR gRNA sequence
  source 1..20: mol_type = other DNA
ctccctgtacgtcagttctt

SEQ ID NO: 53210 - DNA, 20 bp, synthetic construct
  misc_feature 1..20: note = CRISPR gRNA sequence
  source 1..20: mol_type = other DNA
tccctgtacgtcagttcttt

SEQ ID NO: 53211 - DNA, 20 bp, synthetic construct
  misc_feature 1..20: note = CRISPR gRNA sequence
  source 1..20: mol_type = other DNA
acgtcagttctttgggcctc

SEQ ID NO: 53212 - DNA, 20 bp, synthetic construct
  misc_feature 1..20: note = CRISPR gRNA sequence
  source 1..20: mol_type = other DNA
ttctttgggcctcaagaacc

SEQ ID NO: 53213 - DNA, 20 bp, synthetic construct
  misc_feature 1..20: note = CRISPR gRNA sequence
  source 1..20: mol_type = other DNA
tctttgggcctcaagaaccc

SEQ ID NO: 53214 - DNA, 20 bp, synthetic construct
  misc_feature 1..20: note = CRISPR gRNA sequence
  source 1..20: mol_type = other DNA
ctttgggcctcaagaacccg

SEQ ID NO: 53215 - DNA, 20 bp, synthetic construct
  misc_feature 1..20: note = CRISPR gRNA sequence
  source 1..20: mol_type = other DNA
tttgggcctcaagaacccgg

SEQ ID NO: 53216 - DNA, 20 bp, synthetic construct
  misc_feature 1..20: note = CRISPR gRNA sequence
  source 1..20: mol_type = other DNA
tcaagaacccgggggttccc

SEQ ID NO: 53217 - DNA, 20 bp, synthetic construct
  misc_feature 1..20: note = CRISPR gRNA sequence
  source 1..20: mol_type = other DNA
acccgggggttccccagaaa

SEQ ID NO: 53218 - DNA, 20 bp, synthetic construct
  misc_feature 1..20: note = CRISPR gRNA sequence
  source 1..20: mol_type = other DNA
ccgggggttccccagaaaca

SEQ ID NO: 53219 - DNA, 20 bp, synthetic construct
  misc_feature 1..20: note = CRISPR gRNA sequence
  source 1..20: mol_type = other DNA
cagaaacagagatcctatcc

SEQ ID NO: 53220 - DNA, 20 bp, synthetic construct
  misc_feature 1..20: note = CRISPR gRNA sequence
  source 1..20: mol_type = other DNA
agaaacagagatcctatcct

SEQ ID NO: 53221 - DNA, 20 bp, synthetic construct
  misc_feature 1..20: note = CRISPR gRNA sequence
  source 1..20: mol_type = other DNA
aacagagatcctatcctggg

SEQ ID NO: 53222 - DNA, 20 bp, synthetic construct
  misc_feature 1..20: note = CRISPR gRNA sequence
  source 1..20: mol_type = other DNA
gagatcctatcctgggaagc

SEQ ID NO: 53223 - DNA, 20 bp, synthetic construct
  misc_feature 1..20: note = CRISPR gRNA sequence
  source 1..20: mol_type = other DNA
tcctgggaagcaagaccacc

SEQ ID NO: 53224 - DNA, 20 bp, synthetic construct
  misc_feature 1..20: note = CRISPR gRNA sequence
  source 1..20: mol_type = other DNA
cctgggaagcaagaccaccc

SEQ ID NO: 53225 - DNA, 20 bp, synthetic construct
  misc_feature 1..20: note = CRISPR gRNA sequence
  source 1..20: mol_type = other DNA
aagcaagaccacccaggctt

SEQ ID NO: 53226 - DNA, 20 bp, synthetic construct
  misc_feature 1..20: note = CRISPR gRNA sequence
  source 1..20: mol_type = other DNA
gagccacccctgactcctga

SEQ ID NO: 53227 - DNA, 20 bp, synthetic construct
  misc_feature 1..20: note = CRISPR gRNA sequence
  source 1..20: mol_type = other DNA
ctcctgacagcccatctgta

SEQ ID NO: 53228 - DNA, 20 bp, synthetic construct
  misc_feature 1..20: note = CRISPR gRNA sequence
  source 1..20: mol_type = other DNA
ctgacagcccatctgtacgg

SEQ ID NO: 53229 - DNA, 20 bp, synthetic construct
  misc_feature 1..20: note = CRISPR gRNA sequence
  source 1..20: mol_type = other DNA
agtgccttttcttgacacac

SEQ ID NO: 53230 - DNA, 20 bp, synthetic construct
  misc_feature 1..20: note = CRISPR gRNA sequence
  source 1..20: mol_type = other DNA
tagctgtgactctctccacc

SEQ ID NO: 53231 - DNA, 20 bp, synthetic construct
  misc_feature 1..20: note = CRISPR gRNA sequence
  source 1..20: mol_type = other DNA
tgtgactctctccacccagc

SEQ ID NO: 53232 - DNA, 20 bp, synthetic construct
  misc_feature 1..20: note = CRISPR gRNA sequence
  source 1..20: mol_type = other DNA
tccacccagccagctgcaca

SEQ ID NO: 53233 - DNA, 20 bp, synthetic construct
  misc_feature 1..20: note = CRISPR gRNA sequence
  source 1..20: mol_type = other DNA
ccacccagccagctgcacat

SEQ ID NO: 53234 - DNA, 20 bp, synthetic construct
  misc_feature 1..20: note = CRISPR gRNA sequence
  source 1..20: mol_type = other DNA
tgtccgctgccactgctccc

SEQ ID NO: 53235 - DNA, 20 bp, synthetic construct
  misc_feature 1..20: note = CRISPR gRNA sequence
  source 1..20: mol_type = other DNA
cgctgccactgctcccaagt

SEQ ID NO: 53236 - DNA, 20 bp, synthetic construct
  misc_feature 1..20: note = CRISPR gRNA sequence
  source 1..20: mol_type = other DNA
gctgccactgctcccaagtg

SEQ ID NO: 53237 - DNA, 20 bp, synthetic construct
  misc_feature 1..20: note = CRISPR gRNA sequence
  source 1..20: mol_type = other DNA
cactgctcccaagtgaggcc

SEQ ID NO: 53238 - DNA, 20 bp, synthetic construct
  misc_feature 1..20: note = CRISPR gRNA sequence
  source 1..20: mol_type = other DNA
ctgctcccaagtgaggccaa

SEQ ID NO: 53239 - DNA, 20 bp, synthetic construct
  misc_feature 1..20: note = CRISPR gRNA sequence
  source 1..20: mol_type = other DNA
tgctcccaagtgaggccaag

SEQ ID NO: 53240 - DNA, 20 bp, synthetic construct
  misc_feature 1..20: note = CRISPR gRNA sequence
  source 1..20: mol_type = other DNA
ccaagtgaggccaagaggcc

SEQ ID NO: 53241 - DNA, 20 bp, synthetic construct
  misc_feature 1..20: note = CRISPR gRNA sequence
  source 1..20: mol_type = other DNA
gccaagaggcctggtcccac

SEQ ID NO: 53242 - DNA, 20 bp, synthetic construct
  misc_feature 1..20: note = CRISPR gRNA sequence
  source 1..20: mol_type = other DNA
caagaggcctggtcccacta

SEQ ID NO: 53243 - DNA, 20 bp, synthetic construct
  misc_feature 1..20: note = CRISPR gRNA sequence
  source 1..20: mol_type = other DNA
aagaggcctggtcccactag

SEQ ID NO: 53244 - DNA, 20 bp, synthetic construct
  misc_feature 1..20: note = CRISPR gRNA sequence
  source 1..20: mol_type = other DNA
agaggcctggtcccactaga

SEQ ID NO: 53245 - DNA, 20 bp, synthetic construct
  misc_feature 1..20: note = CRISPR gRNA sequence
  source 1..20: mol_type = other DNA
ggcctggtcccactagaggg

SEQ ID NO: 53246 - DNA, 20 bp, synthetic construct
  misc_feature 1..20: note = CRISPR gRNA sequence
  source 1..20: mol_type = other DNA
tggtcccactagagggcagc

SEQ ID NO: 53247 - DNA, 20 bp, synthetic construct
  misc_feature 1..20: note = CRISPR gRNA sequence
  source 1..20: mol_type = other DNA
ggtcccactagagggcagcc

SEQ ID NO: 53248 - DNA, 20 bp, synthetic construct
  misc_feature 1..20: note = CRISPR gRNA sequence
  source 1..20: mol_type = other DNA
gggcagccgggaacatcatg

SEQ ID NO: 53249 - DNA, 20 bp, synthetic construct
  misc_feature 1..20: note = CRISPR gRNA sequence
  source 1..20: mol_type = other DNA
gcagccgggaacatcatgaa

SEQ ID NO: 53250 - DNA, 20 bp, synthetic construct
  misc_feature 1..20: note = CRISPR gRNA sequence
  source 1..20: mol_type = other DNA
aacatcatgaagagctaaac

SEQ ID NO: 53251 - DNA, 20 bp, synthetic construct
  misc_feature 1..20: note = CRISPR gRNA sequence
  source 1..20: mol_type = other DNA
atgaagagctaaactagtat

SEQ ID NO: 53252 - DNA, 20 bp, synthetic construct
  misc_feature 1..20: note = CRISPR gRNA sequence
  source 1..20: mol_type = other DNA
agtattggttgtttactgcg

SEQ ID NO: 53253 - DNA, 20 bp, synthetic construct
  misc_feature 1..20: note = CRISPR gRNA sequence
  source 1..20: mol_type = other DNA
ttggttgtttactgcgaaga

SEQ ID NO: 53254 - DNA, 20 bp, synthetic construct
  misc_feature 1..20: note = CRISPR gRNA sequence
  source 1..20: mol_type = other DNA
tggttgtttactgcgaagac

SEQ ID NO: 53255 - DNA, 20 bp, synthetic construct
  misc_feature 1..20: note = CRISPR gRNA sequence
  source 1..20: mol_type = other DNA
ggttgtttactgcgaagacg

SEQ ID NO: 53256 - DNA, 20 bp, synthetic construct
  misc_feature 1..20: note = CRISPR gRNA sequence
  source 1..20: mol_type = other DNA
agacggggaaaatgtttttt

SEQ ID NO: 53257 - DNA, 20 bp, synthetic construct
  misc_feature 1..20: note = CRISPR gRNA sequence
  source 1..20: mol_type = other DNA
acggggaaaatgttttttca

SEQ ID NO: 53258 - DNA, 20 bp, synthetic construct
  misc_feature 1..20: note = CRISPR gRNA sequence
  source 1..20: mol_type = other DNA
atgttttttcagagcaccca

SEQ ID NO: 53259 - DNA, 20 bp, synthetic construct
  misc_feature 1..20: note = CRISPR gRNA sequence
  source 1..20: mol_type = other DNA
gcacccacggcccctgcctt

SEQ ID NO: 53260 - DNA, 20 bp, synthetic construct
  misc_feature 1..20: note = CRISPR gRNA sequence
  source 1..20: mol_type = other DNA
acccacggcccctgccttca

SEQ ID NO: 53261 - DNA, 20 bp, synthetic construct
  misc_feature 1..20: note = CRISPR gRNA sequence
  source 1..20: mol_type = other DNA
cccctgccttcagagcgtga

SEQ ID NO: 53262 - DNA, 20 bp, synthetic construct
  misc_feature 1..20: note = CRISPR gRNA sequence
  source 1..20: mol_type = other DNA
ccctgccttcagagcgtgaa

SEQ ID NO: 53263 - DNA, 20 bp, synthetic construct
  misc_feature 1..20: note = CRISPR gRNA sequence
  source 1..20: mol_type = other DNA
cctgccttcagagcgtgaaa

SEQ ID NO: 53264 - DNA, 20 bp, synthetic construct
  misc_feature 1..20: note = CRISPR gRNA sequence
  source 1..20: mol_type = other DNA
gccttcagagcgtgaaaggg

SEQ ID NO: 53265 - DNA, 20 bp, synthetic construct
  misc_feature 1..20: note = CRISPR gRNA sequence
  source 1..20: mol_type = other DNA
tgaaagggcagtgacatgta

SEQ ID NO: 53266 - DNA, 20 bp, synthetic construct
  misc_feature 1..20: note = CRISPR gRNA sequence
  source 1..20: mol_type = other DNA
aaagggcagtgacatgtatg

SEQ ID NO: 53267 - DNA, 20 bp, synthetic construct
  misc_feature 1..20: note = CRISPR gRNA sequence
  source 1..20: mol_type = other DNA
gggcagtgacatgtatggag

SEQ ID NO: 53268 - DNA, 20 bp, synthetic construct
  misc_feature 1..20: note = CRISPR gRNA sequence
  source 1..20: mol_type = other DNA
cagtgacatgtatggagcgg

SEQ ID NO: 53269 - DNA, 20 bp, synthetic construct
  misc_feature 1..20: note = CRISPR gRNA sequence
  source 1..20: mol_type = other DNA
agtgacatgtatggagcggt

SEQ ID NO: 53270 - DNA, 20 bp, synthetic construct
  misc_feature 1..20: note = CRISPR gRNA sequence
  source 1..20: mol_type = other DNA
ctacaaaattccccgaaacg

SEQ ID NO: 53271 - DNA, 20 bp, synthetic construct
  misc_feature 1..20: note = CRISPR gRNA sequence
  source 1..20: mol_type = other DNA
caaaattccccgaaacgcag

SEQ ID NO: 53272 - DNA, 20 bp, synthetic construct
  misc_feature 1..20: note = CRISPR gRNA sequence
  source 1..20: mol_type = other DNA
ttctcctgtctcctcccaca

SEQ ID NO: 53273 - DNA, 20 bp, synthetic construct
  misc_feature 1..20: note = CRISPR gRNA sequence
  source 1..20: mol_type = other DNA
tcctgtctcctcccacacag

SEQ ID NO: 53274 - DNA, 20 bp, synthetic construct
  misc_feature 1..20: note = CRISPR gRNA sequence
  source 1..20: mol_type = other DNA
tcccacacagcagcaatctg

SEQ ID NO: 53275 - DNA, 20 bp, synthetic construct
  misc_feature 1..20: note = CRISPR gRNA sequence
  source 1..20: mol_type = other DNA
cccacacagcagcaatctgc

SEQ ID NO: 53276 - DNA, 20 bp, synthetic construct
  misc_feature 1..20: note = CRISPR gRNA sequence
  source 1..20: mol_type = other DNA
tgcgggcacctgccctgctc

SEQ ID NO: 53277 - DNA, 20 bp, synthetic construct
  misc_feature 1..20: note = CRISPR gRNA sequence
  source 1..20: mol_type = other DNA
gcgggcacctgccctgctct

SEQ ID NO: 53278 - DNA, 20 bp, synthetic construct
  misc_feature 1..20: note = CRISPR gRNA sequence
  source 1..20: mol_type = other DNA
catctgcattgcctccttcc

SEQ ID NO: 53279 - DNA, 20 bp, synthetic construct
  misc_feature 1..20: note = CRISPR gRNA sequence
  source 1..20: mol_type = other DNA
atctgcattgcctccttcca

SEQ ID NO: 53280 - DNA, 20 bp, synthetic construct
  misc_feature 1..20: note = CRISPR gRNA sequence
  source 1..20: mol_type = other DNA
tctgcattgcctccttccaa

SEQ ID NO: 53281 - DNA, 20 bp, synthetic construct
  misc_feature 1..20: note = CRISPR gRNA sequence
  source 1..20: mol_type = other DNA
ctgcattgcctccttccaag

SEQ ID NO: 53282 - DNA, 20 bp, synthetic construct
  misc_feature 1..20: note = CRISPR gRNA sequence
  source 1..20: mol_type = other DNA
gcctccttccaaggggaaaa

SEQ ID NO: 53283 - DNA, 20 bp, synthetic construct
  misc_feature 1..20: note = CRISPR gRNA sequence
  source 1..20: mol_type = other DNA
cctccttccaaggggaaaac

SEQ ID NO: 53284 - DNA, 20 bp, synthetic construct
  misc_feature 1..20: note = CRISPR gRNA sequence
  source 1..20: mol_type = other DNA
ctccttccaaggggaaaaca

SEQ ID NO: 53285 - DNA, 20 bp, synthetic construct
  misc_feature 1..20: note = CRISPR gRNA sequence
  source 1..20: mol_type = other DNA
cttccaaggggaaaacaggg

SEQ ID NO: 53286 - DNA, 20 bp, synthetic construct
  misc_feature 1..20: note = CRISPR gRNA sequence
  source 1..20: mol_type = other DNA
agttgattactgacaattta

SEQ ID NO: 53287 - DNA, 20 bp, synthetic construct
  misc_feature 1..20: note = CRISPR gRNA sequence
  source 1..20: mol_type = other DNA
gttgattactgacaatttat

SEQ ID NO: 53288 - DNA, 20 bp, synthetic construct
  misc_feature 1..20: note = CRISPR gRNA sequence
  source 1..20: mol_type = other DNA
ttgattactgacaatttatg

SEQ ID NO: 53289 - DNA, 20 bp, synthetic construct
  misc_feature 1..20: note = CRISPR gRNA sequence
  source 1..20: mol_type = other DNA
tgattactgacaatttatgg

SEQ ID NO: 53290 - DNA, 20 bp, synthetic construct
  misc_feature 1..20: note = CRISPR gRNA sequence
  source 1..20: mol_type = other DNA
gattactgacaatttatggg

SEQ ID NO: 53291 - DNA, 20 bp, synthetic construct
  misc_feature 1..20: note = CRISPR gRNA sequence
  source 1..20: mol_type = other DNA
attactgacaatttatgggg

SEQ ID NO: 53292 - DNA, 20 bp, synthetic construct
  misc_feature 1..20: note = CRISPR gRNA sequence
  source 1..20: mol_type = other DNA
ttactgacaatttatggggg

SEQ ID NO: 53293 - DNA, 20 bp, synthetic construct
  misc_feature 1..20: note = CRISPR gRNA sequence
  source 1..20: mol_type = other DNA
ctgacaatttatgggggggg

SEQ ID NO: 53294 - DNA, 20 bp, synthetic construct
  misc_feature 1..20: note = CRISPR gRNA sequence
  source 1..20: mol_type = other DNA
acaatttatggggggggcgg

SEQ ID NO: 53295 - DNA, 20 bp, synthetic construct
  misc_feature 1..20: note = CRISPR gRNA sequence
  source 1..20: mol_type = other DNA
ggggggggcggtggttactg

SEQ ID NO: 53296 - DNA, 20 bp, synthetic construct
  misc_feature 1..20: note = CRISPR gRNA sequence
  source 1..20: mol_type = other DNA
gggggcggtggttactgaag

SEQ ID NO: 53297 - DNA, 20 bp, synthetic construct
  misc_feature 1..20: note = CRISPR gRNA sequence
  source 1..20: mol_type = other DNA
actgaagtggtgattaaacc

SEQ ID NO: 53298 - DNA, 20 bp, synthetic construct
  misc_feature 1..20: note = CRISPR gRNA sequence
  source 1..20: mol_type = other DNA
ggtgattaaacctagtgtgc

SEQ ID NO: 53299 - DNA, 20 bp, synthetic construct
  misc_feature 1..20: note = CRISPR gRNA sequence
  source 1..20: mol_type = other DNA
taaacctagtgtgccggact

SEQ ID NO: 53300 - DNA, 20 bp, synthetic construct
  misc_feature 1..20: note = CRISPR gRNA sequence
  source 1..20: mol_type = other DNA
aaacctagtgtgccggactt

SEQ ID NO: 53301 - DNA, 20 bp, synthetic construct
  misc_feature 1..20: note = CRISPR gRNA sequence
  source 1..20: mol_type = other DNA
cctagtgtgccggacttggg

SEQ ID NO: 53302 - DNA, 20 bp, synthetic construct
  misc_feature 1..20: note = CRISPR gRNA sequence
  source 1..20: mol_type = other DNA
cggacttgggtggtttaact

SEQ ID NO: 53303 - DNA, 20 bp, synthetic construct
  misc_feature 1..20: note = CRISPR gRNA sequence
  source 1..20: mol_type = other DNA
gacttgggtggtttaactga

SEQ ID NO: 53304 - DNA, 20 bp, synthetic construct
  misc_feature 1..20: note = CRISPR gRNA sequence
  source 1..20: mol_type = other DNA
gggtggtttaactgagagct

SEQ ID NO: 53305 - DNA, 20 bp, synthetic construct
  misc_feature 1..20: note = CRISPR gRNA sequence
  source 1..20: mol_type = other DNA
tggtttaactgagagctgag

SEQ ID NO: 53306 - DNA, 20 bp, synthetic construct
  misc_feature 1..20: note = CRISPR gRNA sequence
  source 1..20: mol_type = other DNA
ttaactgagagctgagtggt

SEQ ID NO: 53307 - DNA, 20 bp, synthetic construct
  misc_feature 1..20: note = CRISPR gRNA sequence
  source 1..20: mol_type = other DNA
tgagagctgagtggtcagca

SEQ ID NO: 53308 - DNA, 20 bp, synthetic construct
  misc_feature 1..20: note = CRISPR gRNA sequence
  source 1..20: mol_type = other DNA
gagagctgagtggtcagcat

SEQ ID NO: 53309 - DNA, 20 bp, synthetic construct
  misc_feature 1..20: note = CRISPR gRNA sequence
  source 1..20: mol_type = other DNA
ctgagtggtcagcatgggtc

SEQ ID NO: 53310 - DNA, 20 bp, synthetic construct
  misc_feature 1..20: note = CRISPR gRNA sequence
  source 1..20: mol_type = other DNA
tgagtggtcagcatgggtct

SEQ ID NO: 53311 - DNA, 20 bp, synthetic construct
  misc_feature 1..20: note = CRISPR gRNA sequence
  source 1..20: mol_type = other DNA
gagtggtcagcatgggtctg

SEQ ID NO: 53312 - DNA, 20 bp, synthetic construct
  misc_feature 1..20: note = CRISPR gRNA sequence
  source 1..20: mol_type = other DNA
agtggtcagcatgggtctgg

SEQ ID NO: 53313 - DNA, 20 bp, synthetic construct
  misc_feature 1..20: note = CRISPR gRNA sequence
  source 1..20: mol_type = other DNA
ggtcagcatgggtctggggg

SEQ ID NO: 53314 - DNA, 20 bp, synthetic construct
  misc_feature 1..20: note = CRISPR gRNA sequence
  source 1..20: mol_type = other DNA
gtcagcatgggtctgggggt

SEQ ID NO: 53315 - DNA, 20 bp, synthetic construct
  misc_feature 1..20: note = CRISPR gRNA sequence
  source 1..20: mol_type = other DNA
tcagcatgggtctgggggtg

SEQ ID NO: 53316 - DNA, 20 bp, synthetic construct
  misc_feature 1..20: note = CRISPR gRNA sequence
  source 1..20: mol_type = other DNA
cagcatgggtctgggggtgg

SEQ ID NO: 53317 - DNA, 20 bp, synthetic construct
  misc_feature 1..20: note = CRISPR gRNA sequence
  source 1..20: mol_type = other DNA
agcatgggtctgggggtggg

SEQ ID NO: 53318 - DNA, 20 bp, synthetic construct
  misc_feature 1..20: note = CRISPR gRNA sequence
  source 1..20: mol_type = other DNA
gggggtggggggacctccaa

SEQ ID NO: 53319 - DNA, 20 bp, synthetic construct
  misc_feature 1..20: note = CRISPR gRNA sequence
  source 1..20: mol_type = other DNA
gtggggggacctccaacaga

SEQ ID NO: 53320 - DNA, 20 bp, synthetic construct
  misc_feature 1..20: note = CRISPR gRNA sequence
  source 1..20: mol_type = other DNA
tggggggacctccaacagac

SEQ ID NO: 53321 - DNA, 20 bp, synthetic construct
  misc_feature 1..20: note = CRISPR gRNA sequence
  source 1..20: mol_type = other DNA
ggggggacctccaacagacg

SEQ ID NO: 53322 - DNA, 20 bp, synthetic construct
  misc_feature 1..20: note = CRISPR gRNA sequence
  source 1..20: mol_type = other DNA
gacctccaacagacggggac

SEQ ID NO: 53323 - DNA, 20 bp, synthetic construct
  misc_feature 1..20: note = CRISPR gRNA sequence
  source 1..20: mol_type = other DNA
cctccaacagacggggacca

SEQ ID NO: 53324 - DNA, 20 bp, synthetic construct
  misc_feature 1..20: note = CRISPR gRNA sequence
  source 1..20: mol_type = other DNA
ccaacagacggggaccagag

SEQ ID NO: 53325 - DNA, 20 bp, synthetic construct
  misc_feature 1..20: note = CRISPR gRNA sequence
  source 1..20: mol_type = other DNA
caacagacggggaccagagc

SEQ ID NO: 53326 - DNA, 20 bp, synthetic construct
  misc_feature 1..20: note = CRISPR gRNA sequence
  source 1..20: mol_type = other DNA
acagacggggaccagagcgg

SEQ ID NO: 53327 - DNA, 20 bp, synthetic construct
  misc_feature 1..20: note = CRISPR gRNA sequence
  source 1..20: mol_type = other DNA
cagacggggaccagagcggg

SEQ ID NO: 53328 - DNA, 20 bp, synthetic construct
  misc_feature 1..20: note = CRISPR gRNA sequence
  source 1..20: mol_type = other DNA
agacggggaccagagcggga

SEQ ID NO: 53329 - DNA, 20 bp, synthetic construct
  misc_feature 1..20: note = CRISPR gRNA sequence
  source 1..20: mol_type = other DNA
gacggggaccagagcgggag

SEQ ID NO: 53330 - DNA, 20 bp, synthetic construct
  misc_feature 1..20: note = CRISPR gRNA sequence
  source 1..20: mol_type = other DNA
ggaggggactcccccacccc

SEQ ID NO: 53331 - DNA, 20 bp, synthetic construct
  misc_feature 1..20: note = CRISPR gRNA sequence
  source 1..20: mol_type = other DNA
ctgcttgtcttgtcccctct

SEQ ID NO: 53332 - DNA, 20 bp, synthetic construct
  misc_feature 1..20: note = CRISPR gRNA sequence
  source 1..20: mol_type = other DNA
tgcttgtcttgtcccctctc

SEQ ID NO: 53333 - DNA, 20 bp, synthetic construct
  misc_feature 1..20: note = CRISPR gRNA sequence
  source 1..20: mol_type = other DNA
cttgtcttgtcccctctcag

SEQ ID NO: 53334 - DNA, 20 bp, synthetic construct
  misc_feature 1..20: note = CRISPR gRNA sequence
  source 1..20: mol_type = other DNA
ttgtcttgtcccctctcagg

SEQ ID NO: 53335 - DNA, 20 bp, synthetic construct
  misc_feature 1..20: note = CRISPR gRNA sequence
  source 1..20: mol_type = other DNA
cccctctcaggaggatgtgt

SEQ ID NO: 53336 - DNA, 20 bp, synthetic construct
  misc_feature 1..20: note = CRISPR gRNA sequence
  source 1..20: mol_type = other DNA
ggaggatgtgttggctttca

SEQ ID NO: 53337 - DNA, 20 bp, synthetic construct
  misc_feature 1..20: note = CRISPR gRNA sequence
  source 1..20: mol_type = other DNA
gatgtgttggctttcaaagc

SEQ ID NO: 53338 - DNA, 20 bp, synthetic construct
  misc_feature 1..20: note = CRISPR gRNA sequence
  source 1..20: mol_type = other DNA
gtgttggctttcaaagctgg

SEQ ID NO: 53339 - DNA, 20 bp, synthetic construct
  misc_feature 1..20: note = CRISPR gRNA sequence
  source 1..20: mol_type = other DNA
ttggctttcaaagctggaag

SEQ ID NO: 53340 - DNA, 20 bp, synthetic construct
  misc_feature 1..20: note = CRISPR gRNA sequence
  source 1..20: mol_type = other DNA
ggctttcaaagctggaagca

SEQ ID NO: 53341 - DNA, 20 bp, synthetic construct
  misc_feature 1..20: note = CRISPR gRNA sequence
  source 1..20: mol_type = other DNA
ctttcaaagctggaagcaga

SEQ ID NO: 53342 - DNA, 20 bp, synthetic construct
  misc_feature 1..20: note = CRISPR gRNA sequence
  source 1..20: mol_type = other DNA
tttcaaagctggaagcagag

SEQ ID NO: 53343 - DNA, 20 bp, synthetic construct
  misc_feature 1..20: note = CRISPR gRNA sequence
  source 1..20: mol_type = other DNA
caaagctggaagcagagagg

SEQ ID NO: 53344 - DNA, 20 bp, synthetic construct
  misc_feature 1..20: note = CRISPR gRNA sequence
  source 1..20: mol_type = other DNA
agctggaagcagagaggaag

SEQ ID NO: 53345 - DNA, 20 bp, synthetic construct
  misc_feature 1..20: note = CRISPR gRNA sequence
  source 1..20: mol_type = other DNA
tggaagcagagaggaagcag

SEQ ID NO: 53346 - DNA, 20 bp, synthetic construct
  misc_feature 1..20: note = CRISPR gRNA sequence
  source 1..20: mol_type = other DNA
aggaagcagcagtttgaaaa

SEQ ID NO: 53347 - DNA, 20 bp, synthetic construct
  misc_feature 1..20: note = CRISPR gRNA sequence
  source 1..20: mol_type = other DNA
cagcagtttgaaaatggtca

SEQ ID NO: 53348 - DNA, 20 bp, synthetic construct
  misc_feature 1..20: note = CRISPR gRNA sequence
  source 1..20: mol_type = other DNA
tggtcaaagaccaacttccc

SEQ ID NO: 53349 - DNA, 20 bp, synthetic construct
  misc_feature 1..20: note = CRISPR gRNA sequence
  source 1..20: mol_type = other DNA
tcaaagaccaacttccctgg

SEQ ID NO: 53350 - DNA, 20 bp, synthetic construct
  misc_feature 1..20: note = CRISPR gRNA sequence
  source 1..20: mol_type = other DNA
aagaccaacttccctggcag

SEQ ID NO: 53351 - DNA, 20 bp, synthetic construct
  misc_feature 1..20: note = CRISPR gRNA sequence
  source 1..20: mol_type = other DNA
ccaacttccctggcagtggc

SEQ ID NO: 53352 - DNA, 20 bp, synthetic construct
  misc_feature 1..20: note = CRISPR gRNA sequence
  source 1..20: mol_type = other DNA
ccctggcagtggcaagaacc

SEQ ID NO: 53353 - DNA, 20 bp, synthetic construct
  misc_feature 1..20: note = CRISPR gRNA sequence
  source 1..20: mol_type = other DNA
gcagtggcaagaacccagac

SEQ ID NO: 53354 - DNA, 20 bp, synthetic construct
  misc_feature 1..20: note = CRISPR gRNA sequence
  source 1..20: mol_type = other DNA
tggcaagaacccagactggt

SEQ ID NO: 53355 - DNA, 20 bp, synthetic construct
  misc_feature 1..20: note = CRISPR gRNA sequence
  source 1..20: mol_type = other DNA
ggcaagaacccagactggtc

SEQ ID NO: 53356 - DNA, 20 bp, synthetic construct
  misc_feature 1..20: note = CRISPR gRNA sequence
  source 1..20: mol_type = other DNA
gcaagaacccagactggtca

SEQ ID NO: 53357 - DNA, 20 bp, synthetic construct
  misc_feature 1..20: note = CRISPR gRNA sequence
  source 1..20: mol_type = other DNA
gaacccagactggtcagggc

SEQ ID NO: 53358 - DNA, 20 bp, synthetic construct
  misc_feature 1..20: note = CRISPR gRNA sequence
  source 1..20: mol_type = other DNA
aacccagactggtcagggca

SEQ ID NO: 53359 - DNA, 20 bp, synthetic construct
  misc_feature 1..20: note = CRISPR gRNA sequence
  source 1..20: mol_type = other DNA
cccagactggtcagggcaag

SEQ ID NO: 53360 - DNA, 20 bp, synthetic construct
  misc_feature 1..20: note = CRISPR gRNA sequence
  source 1..20: mol_type = other DNA
ccagactggtcagggcaagg

SEQ ID NO: 53361 - DNA, 20 bp, synthetic construct
  misc_feature 1..20: note = CRISPR gRNA sequence
  source 1..20: mol_type = other DNA
cagactggtcagggcaagga

SEQ ID NO: 53362 - DNA, 20 bp, synthetic construct
  misc_feature 1..20: note = CRISPR gRNA sequence
  source 1..20: mol_type = other DNA
tggtcagggcaaggagggcc

SEQ ID NO: 53363 - DNA, 20 bp, synthetic construct
  misc_feature 1..20: note = CRISPR gRNA sequence
  source 1..20: mol_type = other DNA
ggtcagggcaaggagggcct

SEQ ID NO: 53364 - DNA, 20 bp, synthetic construct
  misc_feature 1..20: note = CRISPR gRNA sequence
  source 1..20: mol_type = other DNA
gtcagggcaaggagggcctg

SEQ ID NO: 53365 - DNA, 20 bp, synthetic construct
  misc_feature 1..20: note = CRISPR gRNA sequence
  source 1..20: mol_type = other DNA
agggcaaggagggcctgggg

SEQ ID NO: 53366 - DNA, 20 bp, synthetic construct
  misc_feature 1..20: note = CRISPR gRNA sequence
  source 1..20: mol_type = other DNA
cctggggtggcctgctttct

SEQ ID NO: 53367 - DNA, 20 bp, synthetic construct
  misc_feature 1..20: note = CRISPR gRNA sequence
  source 1..20: mol_type = other DNA
ggcctgctttcttagcaaac

SEQ ID NO: 53368 - DNA, 20 bp, synthetic construct
  misc_feature 1..20: note = CRISPR gRNA sequence
  source 1..20: mol_type = other DNA
gcctgctttcttagcaaaca

SEQ ID NO: 53369 - DNA, 20 bp, synthetic construct
  misc_feature 1..20: note = CRISPR gRNA sequence
  source 1..20: mol_type = other DNA
ctttcttagcaaacaaggaa

SEQ ID NO: 53370 - DNA, 20 bp, synthetic construct
  misc_feature 1..20: note = CRISPR gRNA sequence
  source 1..20: mol_type = other DNA
tagcaaacaaggaatagatt

SEQ ID NO: 53371 - DNA, 20 bp, synthetic construct
  misc_feature 1..20: note = CRISPR gRNA sequence
  source 1..20: mol_type = other DNA
aagcaacaattacatgtatc

SEQ ID NO: 53372 - DNA, 20 bp, synthetic construct
  misc_feature 1..20: note = CRISPR gRNA sequence
  source 1..20: mol_type = other DNA
catgtatcaagtcacatgca

SEQ ID NO: 53373 - DNA, 20 bp, synthetic construct
  misc_feature 1..20: note = CRISPR gRNA sequence
  source 1..20: mol_type = other DNA
tgattctcacaataaacaat

SEQ ID NO: 53374 - DNA, 20 bp, synthetic construct
  misc_feature 1..20: note = CRISPR gRNA sequence
  source 1..20: mol_type = other DNA
gattctcacaataaacaatg

SEQ ID NO: 53375 - DNA, 20 bp, synthetic construct
  misc_feature 1..20: note = CRISPR gRNA sequence
  source 1..20: mol_type = other DNA
ctcacaataaacaatgaggt

SEQ ID NO: 53376 - DNA, 20 bp, synthetic construct
  misc_feature 1..20: note = CRISPR gRNA sequence
  source 1..20: mol_type = other DNA
tcttctttgttgttgtttcg

SEQ ID NO: 53377 - DNA, 20 bp, synthetic construct
  misc_feature 1..20: note = CRISPR gRNA sequence
  source 1..20: mol_type = other DNA
ctttgttgttgtttcgaaga

SEQ ID NO: 53378 - DNA, 20 bp, synthetic construct
  misc_feature 1..20: note = CRISPR gRNA sequence
  source 1..20: mol_type = other DNA
tttgttgttgtttcgaagaa

SEQ ID NO: 53379 - DNA, 20 bp, synthetic construct
  misc_feature 1..20: note = CRISPR gRNA sequence
  source 1..20: mol_type = other DNA
ttgttgttgtttcgaagaaa

SEQ ID NO: 53380 - DNA, 20 bp, synthetic construct
  misc_feature 1..20: note = CRISPR gRNA sequence
  source 1..20: mol_type = other DNA
aagggtcttgctctgtcgcc

SEQ ID NO: 53381 - DNA, 20 bp, synthetic construct
  misc_feature 1..20: note = CRISPR gRNA sequence
  source 1..20: mol_type = other DNA
agggtcttgctctgtcgccc

SEQ ID NO: 53382 - DNA, 20 bp, synthetic construct
  misc_feature 1..20: note = CRISPR gRNA sequence
  source 1..20: mol_type = other DNA
tcttgctctgtcgcccaggc

SEQ ID NO: 53383 - DNA, 20 bp, synthetic construct
  misc_feature 1..20: note = CRISPR gRNA sequence
  source 1..20: mol_type = other DNA
ctgtcgcccaggctggtgtg

SEQ ID NO: 53384 - DNA, 20 bp, synthetic construct
  misc_feature 1..20: note = CRISPR gRNA sequence
  source 1..20: mol_type = other DNA
tcgcccaggctggtgtgcag

SEQ ID NO: 53385 - DNA, 20 bp, synthetic construct
  misc_feature 1..20: note = CRISPR gRNA sequence
  source 1..20: mol_type = other DNA
caggctggtgtgcagtggtg

SEQ ID NO: 53386 - DNA, 20 bp, synthetic construct
  misc_feature 1..20: note = CRISPR gRNA sequence
  source 1..20: mol_type = other DNA
ggtgtgcagtggtgcagtca

SEQ ID NO: 53387 - DNA, 20 bp, synthetic construct
  misc_feature 1..20: note = CRISPR gRNA sequence
  source 1..20: mol_type = other DNA
ggtgcagtcatggctcactg

SEQ ID NO: 53388 - DNA, 20 bp, synthetic construct
  misc_feature 1..20: note = CRISPR gRNA sequence
  source 1..20: mol_type = other DNA
actgcagcctcaaccttccc

SEQ ID NO: 53389 - DNA, 20 bp, synthetic construct
  misc_feature 1..20: note = CRISPR gRNA sequence
  source 1..20: mol_type = other DNA
ctgcagcctcaaccttcccc

SEQ ID NO: 53390 - DNA, 20 bp, synthetic construct
  misc_feature 1..20: note = CRISPR gRNA sequence
  source 1..20: mol_type = other DNA
ctcaactgatcctactgcct

SEQ ID NO: 53391 - DNA, 20 bp, synthetic construct
  misc_feature 1..20: note = CRISPR gRNA sequence
  source 1..20: mol_type = other DNA
tcctactgcctcagcctccc

SEQ ID NO: 53392 - DNA, 20 bp, synthetic construct
  misc_feature 1..20: note = CRISPR gRNA sequence
  source 1..20: mol_type = other DNA
tactgcctcagcctcccaag

SEQ ID NO: 53393 - DNA, 20 bp, synthetic construct
  misc_feature 1..20: note = CRISPR gRNA sequence
  source 1..20: mol_type = other DNA
gcctcagcctcccaagtagc

SEQ ID NO: 53394 - DNA, 20 bp, synthetic construct
  misc_feature 1..20: note = CRISPR gRNA sequence
  source 1..20: mol_type = other DNA
cctcagcctcccaagtagct

SEQ ID NO: 53395 - DNA, 20 bp, synthetic construct
  misc_feature 1..20: note = CRISPR gRNA sequence
  source 1..20: mol_type = other DNA
ctcccaagtagctgggacta

SEQ ID NO: 53396 - DNA, 20 bp, synthetic construct
  misc_feature 1..20: note = CRISPR gRNA sequence
  source 1..20: mol_type = other DNA
tcccaagtagctgggactac

SEQ ID NO: 53397 - DNA, 20 bp, synthetic construct
  misc_feature 1..20: note = CRISPR gRNA sequence
  source 1..20: mol_type = other DNA
tctaatttttgtattttttg

SEQ ID NO: 53398 - DNA, 20 bp, synthetic construct
  misc_feature 1..20: note = CRISPR gRNA sequence
  source 1..20: mol_type = other DNA
taatttttgtattttttgta

SEQ ID NO: 53399 - DNA, 20 bp, synthetic construct
  misc_feature 1..20: note = CRISPR gRNA sequence
  source 1..20: mol_type = other DNA
ttttgtattttttgtagaga

SEQ ID NO: 53400 - DNA, 20 bp, synthetic construct
  misc_feature 1..20: note = CRISPR gRNA sequence
  source 1..20: mol_type = other DNA
tttgtattttttgtagagat

SEQ ID NO: 53401 - DNA, 20 bp, synthetic construct
  misc_feature 1..20: note = CRISPR gRNA sequence
  source 1..20: mol_type = other DNA
ttgtattttttgtagagatg

SEQ ID NO: 53402 - DNA, 20 bp, synthetic construct
  misc_feature 1..20: note = CRISPR gRNA sequence
  source 1..20: mol_type = other DNA
agatggggttttgccatgtt

SEQ ID NO: 53403 - DNA, 20 bp, synthetic construct
  misc_feature 1..20: note = CRISPR gRNA sequence
  source 1..20: mol_type = other DNA
tggggttttgccatgttgag

SEQ ID NO: 53404 - DNA, 20 bp, synthetic construct
  misc_feature 1..20: note = CRISPR gRNA sequence
  source 1..20: mol_type = other DNA
ggggttttgccatgttgagc

SEQ ID NO: 53405 - DNA, 20 bp, synthetic construct
  misc_feature 1..20: note = CRISPR gRNA sequence
  source 1..20: mol_type = other DNA
ttttgccatgttgagcaggc

SEQ ID NO: 53406 - DNA, 20 bp, synthetic construct
  misc_feature 1..20: note = CRISPR gRNA sequence
  source 1..20: mol_type = other DNA
caggctggtctcaaactcca

SEQ ID NO: 53407 - DNA, 20 bp, synthetic construct
  misc_feature 1..20: note = CRISPR gRNA sequence
  source 1..20: mol_type = other DNA
ctcaaacgatcctcctgcct

SEQ ID NO: 53408 - DNA, 20 bp, synthetic construct
  misc_feature 1..20: note = CRISPR gRNA sequence
  source 1..20: mol_type = other DNA
cctcctgccttagcctccca

SEQ ID NO: 53409 - DNA, 20 bp, synthetic construct
  misc_feature 1..20: note = CRISPR gRNA sequence
  source 1..20: mol_type = other DNA
gccttagcctcccaaagtgc

SEQ ID NO: 53410 - DNA, 20 bp, synthetic construct
  misc_feature 1..20: note = CRISPR gRNA sequence
  source 1..20: mol_type = other DNA
ctcccaaagtgctggaatta

SEQ ID NO: 53411 - DNA, 20 bp, synthetic construct
  misc_feature 1..20: note = CRISPR gRNA sequence
  source 1..20: mol_type = other DNA
agtgctggaattacagatgt

SEQ ID NO: 53412 - DNA, 20 bp, synthetic construct
  misc_feature 1..20: note = CRISPR gRNA sequence
  source 1..20: mol_type = other DNA
cctgacatttttttttcttt

SEQ ID NO: 53413 - DNA, 20 bp, synthetic construct
  misc_feature 1..20: note = CRISPR gRNA sequence
  source 1..20: mol_type = other DNA
acatttttttttctttgaga

SEQ ID NO: 53414 - DNA, 20 bp, synthetic construct
  misc_feature 1..20: note = CRISPR gRNA sequence
  source 1..20: mol_type = other DNA
atttttttttctttgagaca

SEQ ID NO: 53415 - DNA, 20 bp, synthetic construct
  misc_feature 1..20: note = CRISPR gRNA sequence
  source 1..20: mol_type = other DNA
cagagtcttgctctgttgcc

SEQ ID NO: 53416 - DNA, 20 bp, synthetic construct
  misc_feature 1..20: note = CRISPR gRNA sequence
  source 1..20: mol_type = other DNA
agagtcttgctctgttgccc

SEQ ID NO: 53417 - DNA, 20 bp, synthetic construct
  misc_feature 1..20: note = CRISPR gRNA sequence
  source 1..20: mol_type = other DNA
tcttgctctgttgcccaggc

SEQ ID NO: 53418 - DNA, 20 bp, synthetic construct
  misc_feature 1..20: note = CRISPR gRNA sequence
  source 1..20: mol_type = other DNA
ttgctctgttgcccaggctg

SEQ ID NO: 53419 - DNA, 20 bp, synthetic construct
  misc_feature 1..20: note = CRISPR gRNA sequence
  source 1..20: mol_type = other DNA
ttgcccaggctggagtgcaa

SEQ ID NO: 53420 - DNA, 20 bp, synthetic construct
  misc_feature 1..20: note = CRISPR gRNA sequence
  source 1..20: mol_type = other DNA
ggtgtgatcacaactcactg

SEQ ID NO: 53421 - DNA, 20 bp, synthetic construct
  misc_feature 1..20: note = CRISPR gRNA sequence
  source 1..20: mol_type = other DNA
cactgtagcctcgatctcct

SEQ ID NO: 53422 - DNA, 20 bp, synthetic construct
  misc_feature 1..20: note = CRISPR gRNA sequence
  source 1..20: mol_type = other DNA
agcctcgatctcctgagtct

SEQ ID NO: 53423 - DNA, 20 bp, synthetic construct
  misc_feature 1..20: note = CRISPR gRNA sequence
  source 1..20: mol_type = other DNA
tctaagcaatcctcccacct

SEQ ID NO: 53424 - DNA, 20 bp, synthetic construct
  misc_feature 1..20: note = CRISPR gRNA sequence
  source 1..20: mol_type = other DNA
tcctcccacctcagcctccc

SEQ ID NO: 53425 - DNA, 20 bp, synthetic construct
  misc_feature 1..20: note = CRISPR gRNA sequence
  source 1..20: mol_type = other DNA
tcccacctcagcctcccaag

SEQ ID NO: 53426 - DNA, 20 bp, synthetic construct
  misc_feature 1..20: note = CRISPR gRNA sequence
  source 1..20: mol_type = other DNA
cccacctcagcctcccaagt

SEQ ID NO: 53427 - DNA, 20 bp, synthetic construct
  misc_feature 1..20: note = CRISPR gRNA sequence
  source 1..20: mol_type = other DNA
taggtgcatgccatcacgct

SEQ ID NO: 53428 - DNA, 20 bp, synthetic construct
  misc_feature 1..20: note = CRISPR gRNA sequence
  source 1..20: mol_type = other DNA
tcacgcttggctaattttta

SEQ ID NO: 53429 - DNA, 20 bp, synthetic construct
  misc_feature 1..20: note = CRISPR gRNA sequence
  source 1..20: mol_type = other DNA
gctaatttttaaagtttctg

SEQ ID NO: 53430 - DNA, 20 bp, synthetic construct
  misc_feature 1..20: note = CRISPR gRNA sequence
  source 1..20: mol_type = other DNA
taatttttaaagtttctgta

SEQ ID NO: 53431 - DNA, 20 bp, synthetic construct
  misc_feature 1..20: note = CRISPR gRNA sequence
  source 1..20: mol_type = other DNA
ttttaaagtttctgtagaga

SEQ ID NO: 53432 - DNA, 20 bp, synthetic construct
  misc_feature 1..20: note = CRISPR gRNA sequence
  source 1..20: mol_type = other DNA
tttaaagtttctgtagagat

SEQ ID NO: 53433 - DNA, 20 bp, synthetic construct
  misc_feature 1..20: note = CRISPR gRNA sequence
  source 1..20: mol_type = other DNA
ttaaagtttctgtagagatg

SEQ ID NO: 53434 - DNA, 20 bp, synthetic construct
  misc_feature 1..20: note = CRISPR gRNA sequence
  source 1..20: mol_type = other DNA
taaagtttctgtagagatgg

SEQ ID NO: 53435 - DNA, 20 bp, synthetic construct
  misc_feature 1..20: note = CRISPR gRNA sequence
  source 1..20: mol_type = other DNA
aaagtttctgtagagatggg

SEQ ID NO: 53436 - DNA, 20 bp, synthetic construct
  misc_feature 1..20: note = CRISPR gRNA sequence
  source 1..20: mol_type = other DNA
aagtttctgtagagatgggg

SEQ ID NO: 53437 - DNA, 20 bp, synthetic construct
  misc_feature 1..20: note = CRISPR gRNA sequence
  source 1..20: mol_type = other DNA
gggggtctcaccatgttgtc

SEQ ID NO: 53438 - DNA, 20 bp, synthetic construct
  misc_feature 1..20: note = CRISPR gRNA sequence
  source 1..20: mol_type = other DNA
ggggtctcaccatgttgtcc

SEQ ID NO: 53439 - DNA, 20 bp, synthetic construct
  misc_feature 1..20: note = CRISPR gRNA sequence
  source 1..20: mol_type = other DNA
tctcaccatgttgtccaggc

SEQ ID NO: 53440 - DNA, 20 bp, synthetic construct
  misc_feature 1..20: note = CRISPR gRNA sequence
  source 1..20: mol_type = other DNA
ccaggctggtctcaaactcc

SEQ ID NO: 53441 - DNA, 20 bp, synthetic construct
  misc_feature 1..20: note = CRISPR gRNA sequence
  source 1..20: mol_type = other DNA
caggctggtctcaaactcct

SEQ ID NO: 53442 - DNA, 20 bp, synthetic construct
  misc_feature 1..20: note = CRISPR gRNA sequence
  source 1..20: mol_type = other DNA
tggtctcaaactcctaggct

SEQ ID NO: 53443 - DNA, 20 bp, synthetic construct
  misc_feature 1..20: note = CRISPR gRNA sequence
  source 1..20: mol_type = other DNA
ggtctcaaactcctaggctc

SEQ ID NO: 53444 - DNA, 20 bp, synthetic construct
  misc_feature 1..20: note = CRISPR gRNA sequence
  source 1..20: mol_type = other DNA
tgatcctcctcctcctgtct

SEQ ID NO: 53445 - DNA, 20 bp, synthetic construct
  misc_feature 1..20: note = CRISPR gRNA sequence
  source 1..20: mol_type = other DNA
cctcctgtcttggcctccca

SEQ ID NO: 53446 - DNA, 20 bp, synthetic construct
  misc_feature 1..20: note = CRISPR gRNA sequence
  source 1..20: mol_type = other DNA
gtcttggcctcccaaagtgc

SEQ ID NO: 53447 - DNA, 20 bp, synthetic construct
  misc_feature 1..20: note = CRISPR gRNA sequence
  source 1..20: mol_type = other DNA
tcttggcctcccaaagtgct

SEQ ID NO: 53448 - DNA, 20 bp, synthetic construct
  misc_feature 1..20: note = CRISPR gRNA sequence
  source 1..20: mol_type = other DNA
ctcccaaagtgctgggatta

SEQ ID NO: 53449 - DNA, 20 bp, synthetic construct
  misc_feature 1..20: note = CRISPR gRNA sequence
  source 1..20: mol_type = other DNA
tcccaaagtgctgggattac

SEQ ID NO: 53450 - DNA, 20 bp, synthetic construct
  misc_feature 1..20: note = CRISPR gRNA sequence
  source 1..20: mol_type = other DNA
agtgctgggattacaggctt

SEQ ID NO: 53451 - DNA, 20 bp, synthetic construct
  misc_feature 1..20: note = CRISPR gRNA sequence
  source 1..20: mol_type = other DNA
acaggcttgagccactgtgc

SEQ ID NO: 53452 - DNA, 20 bp, synthetic construct
  misc_feature 1..20: note = CRISPR gRNA sequence
  source 1..20: mol_type = other DNA
caggcttgagccactgtgcc

SEQ ID NO: 53453 - DNA, 20 bp, synthetic construct
  misc_feature 1..20: note = CRISPR gRNA sequence
  source 1..20: mol_type = other DNA
cttgagccactgtgccaggc

SEQ ID NO: 53454 - DNA, 20 bp, synthetic construct
  misc_feature 1..20: note = CRISPR gRNA sequence
  source 1..20: mol_type = other DNA
ttattcttatctccatttta

SEQ ID NO: 53455 - DNA, 20 bp, synthetic construct
  misc_feature 1..20: note = CRISPR gRNA sequence
  source 1..20: mol_type = other DNA
cttatctccattttacagat

SEQ ID NO: 53456 - DNA, 20 bp, synthetic construct
  misc_feature 1..20: note = CRISPR gRNA sequence
  source 1..20: mol_type = other DNA
ttatctccattttacagatg

SEQ ID NO: 53457 - DNA, 20 bp, synthetic construct
  misc_feature 1..20: note = CRISPR gRNA sequence
  source 1..20: mol_type = other DNA
attttacagatgaggaaact

SEQ ID NO: 53458 - DNA, 20 bp, synthetic construct
  misc_feature 1..20: note = CRISPR gRNA sequence
  source 1..20: mol_type = other DNA
ttttacagatgaggaaactg

SEQ ID NO: 53459 - DNA, 20 bp, synthetic construct
  misc_feature 1..20: note = CRISPR gRNA sequence
  source 1..20: mol_type = other DNA
cagatgaggaaactgaggcc

SEQ ID NO: 53460 - DNA, 20 bp, synthetic construct
  misc_feature 1..20: note = CRISPR gRNA sequence
  source 1..20: mol_type = other DNA
gatgaggaaactgaggcctg

SEQ ID NO: 53461 - DNA, 20 bp, synthetic construct
  misc_feature 1..20: note = CRISPR gRNA sequence
  source 1..20: mol_type = other DNA
tgaggaaactgaggcctgga

SEQ ID NO: 53462 - DNA, 20 bp, synthetic construct
  misc_feature 1..20: note = CRISPR gRNA sequence
  source 1..20: mol_type = other DNA
gaggaaactgaggcctggag

SEQ ID NO: 53463 - DNA, 20 bp, synthetic construct
  misc_feature 1..20: note = CRISPR gRNA sequence
  source 1..20: mol_type = other DNA
actgaggcctggagaggctc

SEQ ID NO: 53464 - DNA, 20 bp, synthetic construct
  misc_feature 1..20: note = CRISPR gRNA sequence
  source 1..20: mol_type = other DNA
ctgaggcctggagaggctct

SEQ ID NO: 53465 - DNA, 20 bp, synthetic construct
  misc_feature 1..20: note = CRISPR gRNA sequence
  source 1..20: mol_type = other DNA
gaggctctgggacctgctct

SEQ ID NO: 53466 - DNA, 20 bp, synthetic construct
  misc_feature 1..20: note = CRISPR gRNA sequence
  source 1..20: mol_type = other DNA
tgggacctgctctgagctcg

SEQ ID NO: 53467 - DNA, 20 bp, synthetic construct
  misc_feature 1..20: note = CRISPR gRNA sequence
  source 1..20: mol_type = other DNA
gacctgctctgagctcgcag

SEQ ID NO: 53468 - DNA, 20 bp, synthetic construct
  misc_feature 1..20: note = CRISPR gRNA sequence
  source 1..20: mol_type = other DNA
gctctgagctcgcagcagtt

SEQ ID NO: 53469 - DNA, 20 bp, synthetic construct
  misc_feature 1..20: note = CRISPR gRNA sequence
  source 1..20: mol_type = other DNA
ctcgcagcagttaagtaact

SEQ ID NO: 53470 - DNA, 20 bp, synthetic construct
  misc_feature 1..20: note = CRISPR gRNA sequence
  source 1..20: mol_type = other DNA
agcagttaagtaactgagcc

SEQ ID NO: 53471 - DNA, 20 bp, synthetic construct
  misc_feature 1..20: note = CRISPR gRNA sequence
  source 1..20: mol_type = other DNA
tgagcctggtccatctgctg

SEQ ID NO: 53472 - DNA, 20 bp, synthetic construct
  misc_feature 1..20: note = CRISPR gRNA sequence
  source 1..20: mol_type = other DNA
gctgtggcacctcccattct

SEQ ID NO: 53473 - DNA, 20 bp, synthetic construct
  misc_feature 1..20: note = CRISPR gRNA sequence
  source 1..20: mol_type = other DNA
ctgtggcacctcccattctt

SEQ ID NO: 53474 - DNA, 20 bp, synthetic construct
  misc_feature 1..20: note = CRISPR gRNA sequence
  source 1..20: mol_type = other DNA
tgtggcacctcccattcttg

SEQ ID NO: 53475 - DNA, 20 bp, synthetic construct
  misc_feature 1..20: note = CRISPR gRNA sequence
  source 1..20: mol_type = other DNA
gtggcacctcccattcttgg

SEQ ID NO: 53476 - DNA, 20 bp, synthetic construct
  misc_feature 1..20: note = CRISPR gRNA sequence
  source 1..20: mol_type = other DNA
ctcccattcttgggggtcct

SEQ ID NO: 53477 - DNA, 20 bp, synthetic construct
  misc_feature 1..20: note = CRISPR gRNA sequence
  source 1..20: mol_type = other DNA
tcccattcttgggggtcctt

SEQ ID NO: 53478 - DNA, 20 bp, synthetic construct
  misc_feature 1..20: note = CRISPR gRNA sequence
  source 1..20: mol_type = other DNA
cccattcttgggggtcctta

SEQ ID NO: 53479 - DNA, 20 bp, synthetic construct
  misc_feature 1..20: note = CRISPR gRNA sequence
  source 1..20: mol_type = other DNA
attcttgggggtccttaggg

SEQ ID NO: 53480 - DNA, 20 bp, synthetic construct
  misc_feature 1..20: note = CRISPR gRNA sequence
  source 1..20: mol_type = other DNA
ttcttgggggtccttaggga

SEQ ID NO: 53481 - DNA, 20 bp, synthetic construct
  misc_feature 1..20: note = CRISPR gRNA sequence
  source 1..20: mol_type = other DNA
tcttgggggtccttagggaa

SEQ ID NO: 53482 - DNA, 20 bp, synthetic construct
  misc_feature 1..20: note = CRISPR gRNA sequence
  source 1..20: mol_type = other DNA
gggggtccttagggaaggga

SEQ ID NO: 53483 - DNA, 20 bp, synthetic construct
  misc_feature 1..20: note = CRISPR gRNA sequence
  source 1..20: mol_type = other DNA
ggggtccttagggaagggaa

SEQ ID NO: 53484 - DNA, 20 bp, synthetic construct
  misc_feature 1..20: note = CRISPR gRNA sequence
  source 1..20: mol_type = other DNA
gggtccttagggaagggaaa

SEQ ID NO: 53485 - DNA, 20 bp, synthetic construct
  misc_feature 1..20: note = CRISPR gRNA sequence
  source 1..20: mol_type = other DNA
tccttagggaagggaaaggg

SEQ ID NO: 53486 - DNA, 20 bp, synthetic construct
  misc_feature 1..20: note = CRISPR gRNA sequence
  source 1..20: mol_type = other DNA
ttagggaagggaaagggaag

SEQ ID NO: 53487 - DNA, 20 bp, synthetic construct
  misc_feature 1..20: note = CRISPR gRNA sequence
  source 1..20: mol_type = other DNA
cagacctcccctgaaaatca

SEQ ID NO: 53488 - DNA, 20 bp, synthetic construct
  misc_feature 1..20: note = CRISPR gRNA sequence
  source 1..20: mol_type = other DNA
tcccctgaaaatcatggatg

SEQ ID NO: 53489 - DNA, 20 bp, synthetic construct
  misc_feature 1..20: note = CRISPR gRNA sequence
  source 1..20: mol_type = other DNA
aatcatggatgcggtgccct

SEQ ID NO: 53490 - DNA, 20 bp, synthetic construct
  misc_feature 1..20: note = CRISPR gRNA sequence
  source 1..20: mol_type = other DNA
gatgcggtgccctgagtgcc

SEQ ID NO: 53491 - DNA, 20 bp, synthetic construct
  misc_feature 1..20: note = CRISPR gRNA sequence
  source 1..20: mol_type = other DNA
atgcggtgccctgagtgcct

SEQ ID NO: 53492 - DNA, 20 bp, synthetic construct
  misc_feature 1..20: note = CRISPR gRNA sequence
  source 1..20: mol_type = other DNA
tgcggtgccctgagtgcctg

SEQ ID NO: 53493 - DNA, 20 bp, synthetic construct
  misc_feature 1..20: note = CRISPR gRNA sequence
  source 1..20: mol_type = other DNA
ggtgccctgagtgcctgggg

SEQ ID NO: 53494 - DNA, 20 bp, synthetic construct
  misc_feature 1..20: note = CRISPR gRNA sequence
  source 1..20: mol_type = other DNA
cctgagtgcctggggtggct

SEQ ID NO: 53495 - DNA, 20 bp, synthetic construct
  misc_feature 1..20: note = CRISPR gRNA sequence
  source 1..20: mol_type = other DNA
agtgcctggggtggcttggc

SEQ ID NO: 53496 - DNA, 20 bp, synthetic construct
  misc_feature 1..20: note = CRISPR gRNA sequence
  source 1..20: mol_type = other DNA
cctggggtggcttggctggc

SEQ ID NO: 53497 - DNA, 20 bp, synthetic construct
  misc_feature 1..20: note = CRISPR gRNA sequence
  source 1..20: mol_type = other DNA
ctccccttttatattctcat

SEQ ID NO: 53498 - DNA, 20 bp, synthetic construct
  misc_feature 1..20: note = CRISPR gRNA sequence
  source 1..20: mol_type = other DNA
tctcatcagctcccacaatt

SEQ ID NO: 53499 - DNA, 20 bp, synthetic construct
  misc_feature 1..20: note = CRISPR gRNA sequence
  source 1..20: mol_type = other DNA
atcagctcccacaattaaga

SEQ ID NO: 53500 - DNA, 20 bp, synthetic construct
  misc_feature 1..20: note = CRISPR gRNA sequence
  source 1..20: mol_type = other DNA
tcagctcccacaattaagac

SEQ ID NO: 53501 - DNA, 20 bp, synthetic construct
  misc_feature 1..20: note = CRISPR gRNA sequence
  source 1..20: mol_type = other DNA
cacaattaagacaggtccct

SEQ ID NO: 53502 - DNA, 20 bp, synthetic construct
  misc_feature 1..20: note = CRISPR gRNA sequence
  source 1..20: mol_type = other DNA
aagacaggtccctgagtccc

SEQ ID NO: 53503 - DNA, 20 bp, synthetic construct
  misc_feature 1..20: note = CRISPR gRNA sequence
  source 1..20: mol_type = other DNA
acaggtccctgagtccccag

SEQ ID NO: 53504 - DNA, 20 bp, synthetic construct
  misc_feature 1..20: note = CRISPR gRNA sequence
  source 1..20: mol_type = other DNA
cctgagtccccagtggcaac

SEQ ID NO: 53505 - DNA, 20 bp, synthetic construct
  misc_feature 1..20: note = CRISPR gRNA sequence
  source 1..20: mol_type = other DNA
ctgagtccccagtggcaact

SEQ ID NO: 53506 - DNA, 20 bp, synthetic construct
  misc_feature 1..20: note = CRISPR gRNA sequence
  source 1..20: mol_type = other DNA
agtccccagtggcaactagg

SEQ ID NO: 53507 - DNA, 20 bp, synthetic construct
  misc_feature 1..20: note = CRISPR gRNA sequence
  source 1..20: mol_type = other DNA
agtggcaactaggaagctcc

SEQ ID NO: 53508 - DNA, 20 bp, synthetic construct
  misc_feature 1..20: note = CRISPR gRNA sequence
  source 1..20: mol_type = other DNA
tttcttttcttttttttttt

SEQ ID NO: 53509 - DNA, 20 bp, synthetic construct
  misc_feature 1..20: note = CRISPR gRNA sequence
  source 1..20: mol_type = other DNA
ttttctttttttttttgaga

SEQ ID NO: 53510 - DNA, 20 bp, synthetic construct
  misc_feature 1..20: note = CRISPR gRNA sequence
  source 1..20: mol_type = other DNA
ttctttttttttttgagatg

SEQ ID NO: 53511 - DNA, 20 bp, synthetic construct
  misc_feature 1..20: note = CRISPR gRNA sequence
  source 1..20: mol_type = other DNA
tggagtctcactctgtcgcc

SEQ ID NO: 53512 - DNA, 20 bp, synthetic construct
  misc_feature 1..20: note = CRISPR gRNA sequence
  source 1..20: mol_type = other DNA
ggagtctcactctgtcgccc

SEQ ID NO: 53513 - DNA, 20 bp, synthetic construct
  misc_feature 1..20: note = CRISPR gRNA sequence
  source 1..20: mol_type = other DNA
tctcactctgtcgcccaggc

SEQ ID NO: 53514 - DNA, 20 bp, synthetic construct
  misc_feature 1..20: note = CRISPR gRNA sequence
  source 1..20: mol_type = other DNA
tcactctgtcgcccaggctg

SEQ ID NO: 53515 - DNA, 20 bp, synthetic construct
  misc_feature 1..20: note = CRISPR gRNA sequence
  source 1..20: mol_type = other DNA
ctgtcgcccaggctggagtg

SEQ ID NO: 53516 - DNA, 20 bp, synthetic construct
  misc_feature 1..20: note = CRISPR gRNA sequence
  source 1..20: mol_type = other DNA
tcgcccaggctggagtgcag

SEQ ID NO: 53517 - DNA, 20 bp, synthetic construct
  misc_feature 1..20: note = CRISPR gRNA sequence
  source 1..20: mol_type = other DNA
ggagtgcagtggcacgatct

SEQ ID NO: 53518 - DNA, 20 bp, synthetic construct
  misc_feature 1..20: note = CRISPR gRNA sequence
  source 1..20: mol_type = other DNA
tcactgcaaccttcgcctcc

SEQ ID NO: 53519 - DNA, 20 bp, synthetic construct
  misc_feature 1..20: note = CRISPR gRNA sequence
  source 1..20: mol_type = other DNA
cactgcaaccttcgcctcct

SEQ ID NO: 53520 - DNA, 20 bp, synthetic construct
  misc_feature 1..20: note = CRISPR gRNA sequence
  source 1..20: mol_type = other DNA
aaccttcgcctcctgggttc

SEQ ID NO: 53521 - DNA, 20 bp, synthetic construct
  misc_feature 1..20: note = CRISPR gRNA sequence
  source 1..20: mol_type = other DNA
aagtgattctcctgactcct

SEQ ID NO: 53522 - DNA, 20 bp, synthetic construct
  misc_feature 1..20: note = CRISPR gRNA sequence
  source 1..20: mol_type = other DNA
tgattctcctgactcctgag

SEQ ID NO: 53523 - DNA, 20 bp, synthetic construct
  misc_feature 1..20: note = CRISPR gRNA sequence
  source 1..20: mol_type = other DNA
tctcctgactcctgagcggc

SEQ ID NO: 53524 - DNA, 20 bp, synthetic construct
  misc_feature 1..20: note = CRISPR gRNA sequence
  source 1..20: mol_type = other DNA
tcctgagcggctggcactac

SEQ ID NO: 53525 - DNA, 20 bp, synthetic construct
  misc_feature 1..20: note = CRISPR gRNA sequence
  source 1..20: mol_type = other DNA
cctgagcggctggcactaca

SEQ ID NO: 53526 - DNA, 20 bp, synthetic construct
  misc_feature 1..20: note = CRISPR gRNA sequence
  source 1..20: mol_type = other DNA
ctgagcggctggcactacaa

SEQ ID NO: 53527 - DNA, 20 bp, synthetic construct
  misc_feature 1..20: note = CRISPR gRNA sequence
  source 1..20: mol_type = other DNA
caagggctcacaaccacgcc

SEQ ID NO: 53528 - DNA, 20 bp, synthetic construct
  misc_feature 1..20: note = CRISPR gRNA sequence
  source 1..20: mol_type = other DNA
gatacttttttttttttttt

SEQ ID NO: 53529 - DNA, 20 bp, synthetic construct
  misc_feature 1..20: note = CRISPR gRNA sequence
  source 1..20: mol_type = other DNA
ttttttttttttggtatttt

SEQ ID NO: 53530 - DNA, 20 bp, synthetic construct
  misc_feature 1..20: note = CRISPR gRNA sequence
  source 1..20: mol_type = other DNA
tttttttttggtatttttag

SEQ ID NO: 53531 - DNA, 20 bp, synthetic construct
  misc_feature 1..20: note = CRISPR gRNA sequence
  source 1..20: mol_type = other DNA
tttttttggtatttttagca

SEQ ID NO: 53532 - DNA, 20 bp, synthetic construct
  misc_feature 1..20: note = CRISPR gRNA sequence
  source 1..20: mol_type = other DNA
tttggtatttttagcagaga

SEQ ID NO: 53533 - DNA, 20 bp, synthetic construct
  misc_feature 1..20: note = CRISPR gRNA sequence
  source 1..20: mol_type = other DNA
ttggtatttttagcagagac

SEQ ID NO: 53534 - DNA, 20 bp, synthetic construct
  misc_feature 1..20: note = CRISPR gRNA sequence
  source 1..20: mol_type = other DNA
tggtatttttagcagagaca

SEQ ID NO: 53535 - DNA, 20 bp, synthetic construct
  misc_feature 1..20: note = CRISPR gRNA sequence
  source 1..20: mol_type = other DNA
gagacagggtttcaccctgt

SEQ ID NO: 53536 - DNA, 20 bp, synthetic construct
  misc_feature 1..20: note = CRISPR gRNA sequence
  source 1..20: mol_type = other DNA
cagggtttcaccctgttggc

SEQ ID NO: 53537 - DNA, 20 bp, synthetic construct
  misc_feature 1..20: note = CRISPR gRNA sequence
  source 1..20: mol_type = other DNA
agggtttcaccctgttggcc

SEQ ID NO: 53538 - DNA, 20 bp, synthetic construct
  misc_feature 1..20: note = CRISPR gRNA sequence
  source 1..20: mol_type = other DNA
ctcacgtgatccgcccacct

SEQ ID NO: 53539 - DNA, 20 bp, synthetic construct
  misc_feature 1..20: note = CRISPR gRNA sequence
  source 1..20: mol_type = other DNA
accttggcctcccaaaatgc

SEQ ID NO: 53540 - DNA, 20 bp, synthetic construct
  misc_feature 1..20: note = CRISPR gRNA sequence
  source 1..20: mol_type = other DNA
ccttggcctcccaaaatgct

SEQ ID NO: 53541 - DNA, 20 bp, synthetic construct
  misc_feature 1..20: note = CRISPR gRNA sequence
  source 1..20: mol_type = other DNA
ctcccaaaatgctgggatta

SEQ ID NO: 53542 - DNA, 20 bp, synthetic construct
  misc_feature 1..20: note = CRISPR gRNA sequence
  source 1..20: mol_type = other DNA
tcccaaaatgctgggattac

SEQ ID NO: 53543 - DNA, 20 bp, synthetic construct
  misc_feature 1..20: note = CRISPR gRNA sequence
  source 1..20: mol_type = other DNA
aatgctgggattacaggcgt

SEQ ID NO: 53544 - DNA, 20 bp, synthetic construct
  misc_feature 1..20: note = CRISPR gRNA sequence
  source 1..20: mol_type = other DNA
caggcgtgagccaccgcgcc

SEQ ID NO: 53545 - DNA, 20 bp, synthetic construct
  misc_feature 1..20: note = CRISPR gRNA sequence
  source 1..20: mol_type = other DNA
gagccaccgcgcctggcccc

SEQ ID NO: 53546 - DNA, 20 bp, synthetic construct
  misc_feature 1..20: note = CRISPR gRNA sequence
  source 1..20: mol_type = other DNA
ctggcccccagttttcttaa

SEQ ID NO: 53547 - DNA, 20 bp, synthetic construct
  misc_feature 1..20: note = CRISPR gRNA sequence
  source 1..20: mol_type = other DNA
agttttcttaaaagtctctg

SEQ ID NO: 53548 - DNA, 20 bp, synthetic construct
  misc_feature 1..20: note = CRISPR gRNA sequence
  source 1..20: mol_type = other DNA
gtctctgcagcataccaaca

SEQ ID NO: 53549 - DNA, 20 bp, synthetic construct
  misc_feature 1..20: note = CRISPR gRNA sequence
  source 1..20: mol_type = other DNA
tatgttgtgcacatgtaccc

SEQ ID NO: 53550 - DNA, 20 bp, synthetic construct
  misc_feature 1..20: note = CRISPR gRNA sequence
  source 1..20: mol_type = other DNA
cacatgtaccctagaactta

SEQ ID NO: 53551 - DNA, 20 bp, synthetic construct
  misc_feature 1..20: note = CRISPR gRNA sequence
  source 1..20: mol_type = other DNA
tcctaaaaaaaaaaatctct

SEQ ID NO: 53552 - DNA, 20 bp, synthetic construct
  misc_feature 1..20: note = CRISPR gRNA sequence
  source 1..20: mol_type = other DNA
cctaaaaaaaaaaatctcta

SEQ ID NO: 53553 - DNA, 20 bp, synthetic construct
  misc_feature 1..20: note = CRISPR gRNA sequence
  source 1..20: mol_type = other DNA
aaatctctaaggactatcca

SEQ ID NO: 53554 - DNA, 20 bp, synthetic construct
  misc_feature 1..20: note = CRISPR gRNA sequence
  source 1..20: mol_type = other DNA
ctaaggactatccaaagaac

SEQ ID NO: 53555 - DNA, 20 bp, synthetic construct
  misc_feature 1..20: note = CRISPR gRNA sequence
  source 1..20: mol_type = other DNA
ggactatccaaagaacgagt

SEQ ID NO: 53556 - DNA, 20 bp, synthetic construct
  misc_feature 1..20: note = CRISPR gRNA sequence
  source 1..20: mol_type = other DNA
gactatccaaagaacgagtg

SEQ ID NO: 53557 - DNA, 20 bp, synthetic construct
  misc_feature 1..20: note = CRISPR gRNA sequence
  source 1..20: mol_type = other DNA
tatccaaagaacgagtgagg

SEQ ID NO: 53558 - DNA, 20 bp, synthetic construct
  misc_feature 1..20: note = CRISPR gRNA sequence
  source 1..20: mol_type = other DNA
tccaaagaacgagtgaggca

SEQ ID NO: 53559 - DNA, 20 bp, synthetic construct
  misc_feature 1..20: note = CRISPR gRNA sequence
  source 1..20: mol_type = other DNA
agagtcaatgaactctctaa

SEQ ID NO: 53560 - DNA, 20 bp, synthetic construct
  misc_feature 1..20: note = CRISPR gRNA sequence
  source 1..20: mol_type = other DNA
gaactctctaatggtgaatt

SEQ ID NO: 53561 - DNA, 20 bp, synthetic construct
  misc_feature 1..20: note = CRISPR gRNA sequence
  source 1..20: mol_type = other DNA
actctctaatggtgaatttg

SEQ ID NO: 53562 - DNA, 20 bp, synthetic construct
  misc_feature 1..20: note = CRISPR gRNA sequence
  source 1..20: mol_type = other DNA
tggtgaatttggagaaattt

SEQ ID NO: 53563 - DNA, 20 bp, synthetic construct
  misc_feature 1..20: note = CRISPR gRNA sequence
  source 1..20: mol_type = other DNA
ggagaaatttgagcatccgt

SEQ ID NO: 53564 - DNA, 20 bp, synthetic construct
  misc_feature 1..20: note = CRISPR gRNA sequence
  source 1..20: mol_type = other DNA
gagaaatttgagcatccgtg

SEQ ID NO: 53565 - DNA, 20 bp, synthetic construct
  misc_feature 1..20: note = CRISPR gRNA sequence
  source 1..20: mol_type = other DNA
catttgatcattcattcatt

SEQ ID NO: 53566 - DNA, 20 bp, synthetic construct
  misc_feature 1..20: note = CRISPR gRNA sequence
  source 1..20: mol_type = other DNA
ttgatcattcattcattcag

SEQ ID NO: 53567 - DNA, 20 bp, synthetic construct
  misc_feature 1..20: note = CRISPR gRNA sequence
  source 1..20: mol_type = other DNA
gacgcccatcacatgctctg

SEQ ID NO: 53568 - DNA, 20 bp, synthetic construct
  misc_feature 1..20: note = CRISPR gRNA sequence
  source 1..20: mol_type = other DNA
catcacatgctctgcagatc

SEQ ID NO: 53569 - DNA, 20 bp, synthetic construct
  misc_feature 1..20: note = CRISPR gRNA sequence
  source 1..20: mol_type = other DNA
ctgcagatctggtactgccc

SEQ ID NO: 53570 - DNA, 20 bp, synthetic construct
  misc_feature 1..20: note = CRISPR gRNA sequence
  source 1..20: mol_type = other DNA
tgcagatctggtactgccca

SEQ ID NO: 53571 - DNA, 20 bp, synthetic construct
  misc_feature 1..20: note = CRISPR gRNA sequence
  source 1..20: mol_type = other DNA
ctggtactgcccaaggtgct

SEQ ID NO: 53572 - DNA, 20 bp, synthetic construct
  misc_feature 1..20: note = CRISPR gRNA sequence
  source 1..20: mol_type = other DNA
tggtactgcccaaggtgctg

SEQ ID NO: 53573 - DNA, 20 bp, synthetic construct
  misc_feature 1..20: note = CRISPR gRNA sequence
  source 1..20: mol_type = other DNA
gcccaaggtgctgaggatga

SEQ ID NO: 53574 - DNA, 20 bp, synthetic construct
  misc_feature 1..20: note = CRISPR gRNA sequence
  source 1..20: mol_type = other DNA
cccaaggtgctgaggatgac

SEQ ID NO: 53575 - DNA, 20 bp, synthetic construct
  misc_feature 1..20: note = CRISPR gRNA sequence
  source 1..20: mol_type = other DNA
aggtgctgaggatgacaggt

SEQ ID NO: 53576 - DNA, 20 bp, synthetic construct
  misc_feature 1..20: note = CRISPR gRNA sequence
  source 1..20: mol_type = other DNA
atgacaggttggcatgaaac

SEQ ID NO: 53577 - DNA, 20 bp, synthetic construct
  misc_feature 1..20: note = CRISPR gRNA sequence
  source 1..20: mol_type = other DNA
acaggttggcatgaaactgg

SEQ ID NO: 53578 - DNA, 20 bp, synthetic construct
  misc_feature 1..20: note = CRISPR gRNA sequence
  source 1..20: mol_type = other DNA
ttggcatgaaactggtggac

SEQ ID NO: 53579 - DNA, 20 bp, synthetic construct
  misc_feature 1..20: note = CRISPR gRNA sequence
  source 1..20: mol_type = other DNA
tggcatgaaactggtggaca

SEQ ID NO: 53580 - DNA, 20 bp, synthetic construct
  misc_feature 1..20: note = CRISPR gRNA sequence
  source 1..20: mol_type = other DNA
ggcatgaaactggtggacaa

SEQ ID NO: 53581 - DNA, 20 bp, synthetic construct
  misc_feature 1..20: note = CRISPR gRNA sequence
  source 1..20: mol_type = other DNA
gcatgaaactggtggacaag

SEQ ID NO: 53582 - DNA, 20 bp, synthetic construct
  misc_feature 1..20: note = CRISPR gRNA sequence
  source 1..20: mol_type = other DNA
tggtggacaaggggcccacg

SEQ ID NO: 53583 - DNA, 20 bp, synthetic construct
  misc_feature 1..20: note = CRISPR gRNA sequence
  source 1..20: mol_type = other DNA
ggtggacaaggggcccacgt

SEQ ID NO: 53584 - DNA, 20 bp, synthetic construct
  misc_feature 1..20: note = CRISPR gRNA sequence
  source 1..20: mol_type = other DNA
tggacaaggggcccacgtgg

SEQ ID NO: 53585 - DNA, 20 bp, synthetic construct
  misc_feature 1..20: note = CRISPR gRNA sequence
  source 1..20: mol_type = other DNA
acaaggggcccacgtgggag

SEQ ID NO: 53586 - DNA, 20 bp, synthetic construct
  misc_feature 1..20: note = CRISPR gRNA sequence
  source 1..20: mol_type = other DNA
acgtgggagcagatgacctg

SEQ ID NO: 53587 - DNA, 20 bp, synthetic construct
  misc_feature 1..20: note = CRISPR gRNA sequence
  source 1..20: mol_type = other DNA
cgtgggagcagatgacctgt

SEQ ID NO: 53588 - DNA, 20 bp, synthetic construct
  misc_feature 1..20: note = CRISPR gRNA sequence
  source 1..20: mol_type = other DNA
ggagcagatgacctgtggga

SEQ ID NO: 53589 - DNA, 20 bp, synthetic construct
  misc_feature 1..20: note = CRISPR gRNA sequence
  source 1..20: mol_type = other DNA
gagcagatgacctgtgggat

SEQ ID NO: 53590 - DNA, 20 bp, synthetic construct
  misc_feature 1..20: note = CRISPR gRNA sequence
  source 1..20: mol_type = other DNA
agcagatgacctgtgggatg

SEQ ID NO: 53591 - DNA, 20 bp, synthetic construct
  misc_feature 1..20: note = CRISPR gRNA sequence
  source 1..20: mol_type = other DNA
gcagatgacctgtgggatgg

SEQ ID NO: 53592 - DNA, 20 bp, synthetic construct
  misc_feature 1..20: note = CRISPR gRNA sequence
  source 1..20: mol_type = other DNA
atgacctgtgggatggggga

SEQ ID NO: 53593 - DNA, 20 bp, synthetic construct
  misc_feature 1..20: note = CRISPR gRNA sequence
  source 1..20: mol_type = other DNA
tgacctgtgggatgggggac

SEQ ID NO: 53594 - DNA, 20 bp, synthetic construct
  misc_feature 1..20: note = CRISPR gRNA sequence
  source 1..20: mol_type = other DNA
gacctgtgggatgggggaca

SEQ ID NO: 53595 - DNA, 20 bp, synthetic construct
  misc_feature 1..20: note = CRISPR gRNA sequence
  source 1..20: mol_type = other DNA
acctgtgggatgggggacag

SEQ ID NO: 53596 - DNA, 20 bp, synthetic construct
  misc_feature 1..20: note = CRISPR gRNA sequence
  source 1..20: mol_type = other DNA
tgtgggatgggggacagggg

SEQ ID NO: 53597 - DNA, 20 bp, synthetic construct
  misc_feature 1..20: note = CRISPR gRNA sequence
  source 1..20: mol_type = other DNA
gtgggatgggggacaggggc

SEQ ID NO: 53598 - DNA, 20 bp, synthetic construct
  misc_feature 1..20: note = CRISPR gRNA sequence
  source 1..20: mol_type = other DNA
tgggatgggggacaggggca

SEQ ID NO: 53599 - DNA, 20 bp, synthetic construct
  misc_feature 1..20: note = CRISPR gRNA sequence
  source 1..20: mol_type = other DNA
atgggggacaggggcagggc

SEQ ID NO: 53600 - DNA, 20 bp, synthetic construct
  misc_feature 1..20: note = CRISPR gRNA sequence
  source 1..20: mol_type = other DNA
tgggggacaggggcagggct

SEQ ID NO: 53601 - DNA, 20 bp, synthetic construct
  misc_feature 1..20: note = CRISPR gRNA sequence
  source 1..20: mol_type = other DNA
gggggacaggggcagggctg

SEQ ID NO: 53602 - DNA, 20 bp, synthetic construct
  misc_feature 1..20: note = CRISPR gRNA sequence
  source 1..20: mol_type = other DNA
ggggacaggggcagggctgg

SEQ ID NO: 53603 - DNA, 20 bp, synthetic construct
  misc_feature 1..20: note = CRISPR gRNA sequence
  source 1..20: mol_type = other DNA
gacaggggcagggctggggg

SEQ ID NO: 53604 - DNA, 20 bp, synthetic construct
  misc_feature 1..20: note = CRISPR gRNA sequence
  source 1..20: mol_type = other DNA
caggggcagggctgggggcg

SEQ ID NO: 53605 - DNA, 20 bp, synthetic construct
  misc_feature 1..20: note = CRISPR gRNA sequence
  source 1..20: mol_type = other DNA
ggggcagggctgggggcgga

SEQ ID NO: 53606 - DNA, 20 bp, synthetic construct
  misc_feature 1..20: note = CRISPR gRNA sequence
  source 1..20: mol_type = other DNA
gggcagggctgggggcggag

SEQ ID NO: 53607 - DNA, 20 bp, synthetic construct
  misc_feature 1..20: note = CRISPR gRNA sequence
  source 1..20: mol_type = other DNA
ggcacgctcacctgatgtcc

SEQ ID NO: 53608 - DNA, 20 bp, synthetic construct
  misc_feature 1..20: note = CRISPR gRNA sequence
  source 1..20: mol_type = other DNA
acgctcacctgatgtccaag

SEQ ID NO: 53609 - DNA, 20 bp, synthetic construct
  misc_feature 1..20: note = CRISPR gRNA sequence
  source 1..20: mol_type = other DNA
ctcacctgatgtccaagcgg

SEQ ID NO: 53610 - DNA, 20 bp, synthetic construct
  misc_feature 1..20: note = CRISPR gRNA sequence
  source 1..20: mol_type = other DNA
cacctgatgtccaagcggaa

SEQ ID NO: 53611 - DNA, 20 bp, synthetic construct
  misc_feature 1..20: note = CRISPR gRNA sequence
  source 1..20: mol_type = other DNA
tccaagcggaagagccactg

SEQ ID NO: 53612 - DNA, 20 bp, synthetic construct
  misc_feature 1..20: note = CRISPR gRNA sequence
  source 1..20: mol_type = other DNA
caagcggaagagccactgca

SEQ ID NO: 53613 - DNA, 20 bp, synthetic construct
  misc_feature 1..20: note = CRISPR gRNA sequence
  source 1..20: mol_type = other DNA
gcggaagagccactgcagag

SEQ ID NO: 53614 - DNA, 20 bp, synthetic construct
  misc_feature 1..20: note = CRISPR gRNA sequence
  source 1..20: mol_type = other DNA
ggaagagccactgcagagtg

SEQ ID NO: 53615 - DNA, 20 bp, synthetic construct
  misc_feature 1..20: note = CRISPR gRNA sequence
  source 1..20: mol_type = other DNA
agagccactgcagagtggag

SEQ ID NO: 53616 - DNA, 20 bp, synthetic construct
  misc_feature 1..20: note = CRISPR gRNA sequence
  source 1..20: mol_type = other DNA
gcaccgaaccaaacccaaca

SEQ ID NO: 53617 - DNA, 20 bp, synthetic construct
  misc_feature 1..20: note = CRISPR gRNA sequence
  source 1..20: mol_type = other DNA
accaaacccaacacggcatc

SEQ ID NO: 53618 - DNA, 20 bp, synthetic construct
  misc_feature 1..20: note = CRISPR gRNA sequence
  source 1..20: mol_type = other DNA
ccaaacccaacacggcatcc

SEQ ID NO: 53619 - DNA, 20 bp, synthetic construct
  misc_feature 1..20: note = CRISPR gRNA sequence
  source 1..20: mol_type = other DNA
caaacccaacacggcatcca

SEQ ID NO: 53620 - DNA, 20 bp, synthetic construct
  misc_feature 1..20: note = CRISPR gRNA sequence
  source 1..20: mol_type = other DNA
agggacaaaccgttctcact

SEQ ID NO: 53621 - DNA, 20 bp, synthetic construct
  misc_feature 1..20: note = CRISPR gRNA sequence
  source 1..20: mol_type = other DNA
gggacaaaccgttctcactg

SEQ ID NO: 53622 - DNA, 20 bp, synthetic construct
  misc_feature 1..20: note = CRISPR gRNA sequence
  source 1..20: mol_type = other DNA
caaaccgttctcactgaggc

SEQ ID NO: 53623 - DNA, 20 bp, synthetic construct
  misc_feature 1..20: note = CRISPR gRNA sequence
  source 1..20: mol_type = other DNA
aaccgttctcactgaggctg

SEQ ID NO: 53624 - DNA, 20 bp, synthetic construct
  misc_feature 1..20: note = CRISPR gRNA sequence
  source 1..20: mol_type = other DNA
ctcactgaggctggagatca

SEQ ID NO: 53625 - DNA, 20 bp, synthetic construct
  misc_feature 1..20: note = CRISPR gRNA sequence
  source 1..20: mol_type = other DNA
tcactgaggctggagatcac

SEQ ID NO: 53626 - DNA, 20 bp, synthetic construct
  misc_feature 1..20: note = CRISPR gRNA sequence
  source 1..20: mol_type = other DNA
cactgaggctggagatcaca

SEQ ID NO: 53627 - DNA, 20 bp, synthetic construct
  misc_feature 1..20: note = CRISPR gRNA sequence
  source 1..20: mol_type = other DNA
actgaggctggagatcacag

SEQ ID NO: 53628 - DNA, 20 bp, synthetic construct
  misc_feature 1..20: note = CRISPR gRNA sequence
  source 1..20: mol_type = other DNA
gaggctggagatcacagggg

SEQ ID NO: 53629 - DNA, 20 bp, synthetic construct
  misc_feature 1..20: note = CRISPR gRNA sequence
  source 1..20: mol_type = other DNA
agatcacaggggtggcacaa

SEQ ID NO: 53630 - DNA, 20 bp, synthetic construct
  misc_feature 1..20: note = CRISPR gRNA sequence
  source 1..20: mol_type = other DNA
atcacaggggtggcacaatg

SEQ ID NO: 53631 - DNA, 20 bp, synthetic construct
  misc_feature 1..20: note = CRISPR gRNA sequence
  source 1..20: mol_type = other DNA
tcacaggggtggcacaatgg

SEQ ID NO: 53632 - DNA, 20 bp, synthetic construct
  misc_feature 1..20: note = CRISPR gRNA sequence
  source 1..20: mol_type = other DNA
gtggcacaatggaggtcact

SEQ ID NO: 53633 - DNA, 20 bp, synthetic construct
  misc_feature 1..20: note = CRISPR gRNA sequence
  source 1..20: mol_type = other DNA
tggcacaatggaggtcactc

SEQ ID NO: 53634 - DNA, 20 bp, synthetic construct
  misc_feature 1..20: note = CRISPR gRNA sequence
  source 1..20: mol_type = other DNA
acccaaacacatcctctttg

SEQ ID NO: 53635 - DNA, 20 bp, synthetic construct
  misc_feature 1..20: note = CRISPR gRNA sequence
  source 1..20: mol_type = other DNA
aaacacatcctctttgtggt

SEQ ID NO: 53636 - DNA, 20 bp, synthetic construct
  misc_feature 1..20: note = CRISPR gRNA sequence
  source 1..20: mol_type = other DNA
aacacatcctctttgtggtc

SEQ ID NO: 53637 - DNA, 20 bp, synthetic construct
  misc_feature 1..20: note = CRISPR gRNA sequence
  source 1..20: mol_type = other DNA
acacatcctctttgtggtca

SEQ ID NO: 53638 - DNA, 20 bp, synthetic construct
  misc_feature 1..20: note = CRISPR gRNA sequence
  source 1..20: mol_type = other DNA
tcctctttgtggtcagggca

SEQ ID NO: 53639 - DNA, 20 bp, synthetic construct
  misc_feature 1..20: note = CRISPR gRNA sequence
  source 1..20: mol_type = other DNA
cctctttgtggtcagggcac

SEQ ID NO: 53640 - DNA, 20 bp, synthetic construct
  misc_feature 1..20: note = CRISPR gRNA sequence
  source 1..20: mol_type = other DNA
ctctttgtggtcagggcaca

SEQ ID NO: 53641 - DNA, 20 bp, synthetic construct
  misc_feature 1..20: note = CRISPR gRNA sequence
  source 1..20: mol_type = other DNA
tttgtggtcagggcacaggg

SEQ ID NO: 53642 - DNA, 20 bp, synthetic construct
  misc_feature 1..20: note = CRISPR gRNA sequence
  source 1..20: mol_type = other DNA
ttgtggtcagggcacagggc

SEQ ID NO: 53643 - DNA, 20 bp, synthetic construct
  misc_feature 1..20: note = CRISPR gRNA sequence
  source 1..20: mol_type = other DNA
tgtggtcagggcacagggcg

SEQ ID NO: 53644 - DNA, 20 bp, synthetic construct
  misc_feature 1..20: note = CRISPR gRNA sequence
  source 1..20: mol_type = other DNA
gtggtcagggcacagggcgg

SEQ ID NO: 53645 - DNA, 20 bp, synthetic construct
  misc_feature 1..20: note = CRISPR gRNA sequence
  source 1..20: mol_type = other DNA
ggtcagggcacagggcgggg

SEQ ID NO: 53646 - DNA, 20 bp, synthetic construct
  misc_feature 1..20: note = CRISPR gRNA sequence
  source 1..20: mol_type = other DNA
gtcagggcacagggcggggg

SEQ ID NO: 53647 - DNA, 20 bp, synthetic construct
  misc_feature 1..20: note = CRISPR gRNA sequence
  source 1..20: mol_type = other DNA
tcagggcacagggcggggga

SEQ ID NO: 53648 - DNA, 20 bp, synthetic construct
  misc_feature 1..20: note = CRISPR gRNA sequence
  source 1..20: mol_type = other DNA
cagggcgggggagggatccc

SEQ ID NO: 53649 - DNA, 20 bp, synthetic construct
  misc_feature 1..20: note = CRISPR gRNA sequence
  source 1..20: mol_type = other DNA
gggggagggatccctggttc

SEQ ID NO: 53650 - DNA, 20 bp, synthetic construct
  misc_feature 1..20: note = CRISPR gRNA sequence
  source 1..20: mol_type = other DNA
ggatccctggttccagatga

SEQ ID NO: 53651 - DNA, 20 bp, synthetic construct
  misc_feature 1..20: note = CRISPR gRNA sequence
  source 1..20: mol_type = other DNA
tgacggaacccactgaaccc

SEQ ID NO: 53652 - DNA, 20 bp, synthetic construct
  misc_feature 1..20: note = CRISPR gRNA sequence
  source 1..20: mol_type = other DNA
ggaacccactgaacccaaga

SEQ ID NO: 53653 - DNA, 20 bp, synthetic construct
  misc_feature 1..20: note = CRISPR gRNA sequence
  source 1..20: mol_type = other DNA
cccactgaacccaagatggt

SEQ ID NO: 53654 - DNA, 20 bp, synthetic construct
  misc_feature 1..20: note = CRISPR gRNA sequence
  source 1..20: mol_type = other DNA
cactgaacccaagatggtca

SEQ ID NO: 53655 - DNA, 20 bp, synthetic construct
  misc_feature 1..20: note = CRISPR gRNA sequence
  source 1..20: mol_type = other DNA
ctgaacccaagatggtcaga

SEQ ID NO: 53656 - DNA, 20 bp, synthetic construct
  misc_feature 1..20: note = CRISPR gRNA sequence
  source 1..20: mol_type = other DNA
ggtcagagagcaccccttgc

SEQ ID NO: 53657 - DNA, 20 bp, synthetic construct
  misc_feature 1..20: note = CRISPR gRNA sequence
  source 1..20: mol_type = other DNA
gcaccccttgcaagtcctca

SEQ ID NO: 53658 - DNA, 20 bp, synthetic construct
  misc_feature 1..20: note = CRISPR gRNA sequence
  source 1..20: mol_type = other DNA
ccccttgcaagtcctcatgg

SEQ ID NO: 53659 - DNA, 20 bp, synthetic construct
  misc_feature 1..20: note = CRISPR gRNA sequence
  source 1..20: mol_type = other DNA
ccttgcaagtcctcatggtg

SEQ ID NO: 53660 - DNA, 20 bp, synthetic construct
  misc_feature 1..20: note = CRISPR gRNA sequence
  source 1..20: mol_type = other DNA
gcaagtcctcatggtggaga

SEQ ID NO: 53661 - DNA, 20 bp, synthetic construct
  misc_feature 1..20: note = CRISPR gRNA sequence
  source 1..20: mol_type = other DNA
caagtcctcatggtggagat

SEQ ID NO: 53662 - DNA, 20 bp, synthetic construct
  misc_feature 1..20: note = CRISPR gRNA sequence
  source 1..20: mol_type = other DNA
aagtcctcatggtggagatg

SEQ ID NO: 53663 - DNA, 20 bp, synthetic construct
  misc_feature 1..20: note = CRISPR gRNA sequence
  source 1..20: mol_type = other DNA
tcatggtggagatggggaaa

SEQ ID NO: 53664 - DNA, 20 bp, synthetic construct
  misc_feature 1..20: note = CRISPR gRNA sequence
  source 1..20: mol_type = other DNA
atggtggagatggggaaaca

SEQ ID NO: 53665 - DNA, 20 bp, synthetic construct
  misc_feature 1..20: note = CRISPR gRNA sequence
  source 1..20: mol_type = other DNA
gagatggggaaacagagtcc

SEQ ID NO: 53666 - DNA, 20 bp, synthetic construct
  misc_feature 1..20: note = CRISPR gRNA sequence
  source 1..20: mol_type = other DNA
gatggggaaacagagtccta

SEQ ID NO: 53667 - DNA, 20 bp, synthetic construct
  misc_feature 1..20: note = CRISPR gRNA sequence
  source 1..20: mol_type = other DNA
tggggaaacagagtcctaga

SEQ ID NO: 53668 - DNA, 20 bp, synthetic construct
  misc_feature 1..20: note = CRISPR gRNA sequence
  source 1..20: mol_type = other DNA
acagagtcctagagagaatc

SEQ ID NO: 53669 - DNA, 20 bp, synthetic construct
  misc_feature 1..20: note = CRISPR gRNA sequence
  source 1..20: mol_type = other DNA
cagagtcctagagagaatca

SEQ ID NO: 53670 - DNA, 20 bp, synthetic construct
  misc_feature 1..20: note = CRISPR gRNA sequence
  source 1..20: mol_type = other DNA
tcctagagagaatcaaggtc

SEQ ID NO: 53671 - DNA, 20 bp, synthetic construct
  misc_feature 1..20: note = CRISPR gRNA sequence
  source 1..20: mol_type = other DNA
agagaatcaaggtctagccc

SEQ ID NO: 53672 - DNA, 20 bp, synthetic construct
  misc_feature 1..20: note = CRISPR gRNA sequence
  source 1..20: mol_type = other DNA
gagaatcaaggtctagccca

SEQ ID NO: 53673 - DNA, 20 bp, synthetic construct
  misc_feature 1..20: note = CRISPR gRNA sequence
  source 1..20: mol_type = other DNA
aaggtctagcccaaggttat

SEQ ID NO: 53674 - DNA, 20 bp, synthetic construct
  misc_feature 1..20: note = CRISPR gRNA sequence
  source 1..20: mol_type = other DNA
cccaaggttatgagacatgt

SEQ ID NO: 53675 - DNA, 20 bp, synthetic construct
  misc_feature 1..20: note = CRISPR gRNA sequence
  source 1..20: mol_type = other DNA
gttatgagacatgttggtga

SEQ ID NO: 53676 - DNA, 20 bp, synthetic construct
  misc_feature 1..20: note = CRISPR gRNA sequence
  source 1..20: mol_type = other DNA
tatgagacatgttggtgaca

SEQ ID NO: 53677 - DNA, 20 bp, synthetic construct
  misc_feature 1..20: note = CRISPR gRNA sequence
  source 1..20: mol_type = other DNA
gacatgttggtgacagagct

SEQ ID NO: 53678 - DNA, 20 bp, synthetic construct
  misc_feature 1..20: note = CRISPR gRNA sequence
  source 1..20: mol_type = other DNA
tgttggtgacagagctgaga

SEQ ID NO: 53679 - DNA, 20 bp, synthetic construct
  misc_feature 1..20: note = CRISPR gRNA sequence
  source 1..20: mol_type = other DNA
gttggtgacagagctgagat

SEQ ID NO: 53680 - DNA, 20 bp, synthetic construct
  misc_feature 1..20: note = CRISPR gRNA sequence
  source 1..20: mol_type = other DNA
acagagctgagatgggcacc

SEQ ID NO: 53681 - DNA, 20 bp, synthetic construct
  misc_feature 1..20: note = CRISPR gRNA sequence
  source 1..20: mol_type = other DNA
gagctgagatgggcacccag

SEQ ID NO: 53682 - DNA, 20 bp, synthetic construct
  misc_feature 1..20: note = CRISPR gRNA sequence
  source 1..20: mol_type = other DNA
agctgagatgggcacccagt

SEQ ID NO: 53683 - DNA, 20 bp, synthetic construct
  misc_feature 1..20: note = CRISPR gRNA sequence
  source 1..20: mol_type = other DNA
tgggcacccagtgggtccct

SEQ ID NO: 53684 - DNA, 20 bp, synthetic construct
  misc_feature 1..20: note = CRISPR gRNA sequence
  source 1..20: mol_type = other DNA
gtgggtccctcggtctgtga

SEQ ID NO: 53685 - DNA, 20 bp, synthetic construct
  misc_feature 1..20: note = CRISPR gRNA sequence
  source 1..20: mol_type = other DNA
cctcggtctgtgatggatct

SEQ ID NO: 53686 - DNA, 20 bp, synthetic construct
  misc_feature 1..20: note = CRISPR gRNA sequence
  source 1..20: mol_type = other DNA
ctcggtctgtgatggatctg

SEQ ID NO: 53687 - DNA, 20 bp, synthetic construct
  misc_feature 1..20: note = CRISPR gRNA sequence
  source 1..20: mol_type = other DNA
cggtctgtgatggatctgag

SEQ ID NO: 53688 - DNA, 20 bp, synthetic construct
  misc_feature 1..20: note = CRISPR gRNA sequence
  source 1..20: mol_type = other DNA
tggatctgaggagtgctttc

SEQ ID NO: 53689 - DNA, 20 bp, synthetic construct
  misc_feature 1..20: note = CRISPR gRNA sequence
  source 1..20: mol_type = other DNA
tctgaggagtgctttctggc

SEQ ID NO: 53690 - DNA, 20 bp, synthetic construct
  misc_feature 1..20: note = CRISPR gRNA sequence
  source 1..20: mol_type = other DNA
tgaggagtgctttctggctg

SEQ ID NO: 53691 - DNA, 20 bp, synthetic construct
  misc_feature 1..20: note = CRISPR gRNA sequence
  source 1..20: mol_type = other DNA
gagtgctttctggctggagc

SEQ ID NO: 53692 - DNA, 20 bp, synthetic construct
  misc_feature 1..20: note = CRISPR gRNA sequence
  source 1..20: mol_type = other DNA
agtgctttctggctggagct

SEQ ID NO: 53693 - DNA, 20 bp, synthetic construct
  misc_feature 1..20: note = CRISPR gRNA sequence
  source 1..20: mol_type = other DNA
cctccttttctccacctgat

SEQ ID NO: 53694 - DNA, 20 bp, synthetic construct
  misc_feature 1..20: note = CRISPR gRNA sequence
  source 1..20: mol_type = other DNA
ctccttttctccacctgata

SEQ ID NO: 53695 - DNA, 20 bp, synthetic construct
  misc_feature 1..20: note = CRISPR gRNA sequence
  source 1..20: mol_type = other DNA
tccttttctccacctgataa

SEQ ID NO: 53696 - DNA, 20 bp, synthetic construct
  misc_feature 1..20: note = CRISPR gRNA sequence
  source 1..20: mol_type = other DNA
cttttctccacctgataagg

SEQ ID NO: 53697 - DNA, 20 bp, synthetic construct
  misc_feature 1..20: note = CRISPR gRNA sequence
  source 1..20: mol_type = other DNA
ttttctccacctgataaggg

SEQ ID NO: 53698 - DNA, 20 bp, synthetic construct
  misc_feature 1..20: note = CRISPR gRNA sequence
  source 1..20: mol_type = other DNA
tttctccacctgataaggga

SEQ ID NO: 53699 - DNA, 20 bp, synthetic construct
  misc_feature 1..20: note = CRISPR gRNA sequence
  source 1..20: mol_type = other DNA
ttctccacctgataagggag

SEQ ID NO: 53700 - DNA, 20 bp, synthetic construct
  misc_feature 1..20: note = CRISPR gRNA sequence
  source 1..20: mol_type = other DNA
tccacctgataagggagggg

SEQ ID NO: 53701 - DNA, 20 bp, synthetic construct
  misc_feature 1..20: note = CRISPR gRNA sequence
  source 1..20: mol_type = other DNA
gataagggaggggtggtacc

SEQ ID NO: 53702 - DNA, 20 bp, synthetic construct
  misc_feature 1..20: note = CRISPR gRNA sequence
  source 1..20: mol_type = other DNA
ataagggaggggtggtaccc

SEQ ID NO: 53703 - DNA, 20 bp, synthetic construct
  misc_feature 1..20: note = CRISPR gRNA sequence
  source 1..20: mol_type = other DNA
cccaggacaaaatgaaaatg

SEQ ID NO: 53704 - DNA, 20 bp, synthetic construct
  misc_feature 1..20: note = CRISPR gRNA sequence
  source 1..20: mol_type = other DNA
ccaggacaaaatgaaaatgc

SEQ ID NO: 53705 - DNA, 20 bp, synthetic construct
  misc_feature 1..20: note = CRISPR gRNA sequence
  source 1..20: mol_type = other DNA
caggacaaaatgaaaatgca

SEQ ID NO: 53706 - DNA, 20 bp, synthetic construct
  misc_feature 1..20: note = CRISPR gRNA sequence
  source 1..20: mol_type = other DNA
aaaatgcagggtctcttgtg

SEQ ID NO: 53707 - DNA, 20 bp, synthetic construct
  misc_feature 1..20: note = CRISPR gRNA sequence
  source 1..20: mol_type = other DNA
tgcagggtctcttgtgcaga

SEQ ID NO: 53708 - DNA, 20 bp, synthetic construct
  misc_feature 1..20: note = CRISPR gRNA sequence
  source 1..20: mol_type = other DNA
agggtctcttgtgcagaaag

SEQ ID NO: 53709 - DNA, 20 bp, synthetic construct
  misc_feature 1..20: note = CRISPR gRNA sequence
  source 1..20: mol_type = other DNA
gggtctcttgtgcagaaagc

SEQ ID NO: 53710 - DNA, 20 bp, synthetic construct
  misc_feature 1..20: note = CRISPR gRNA sequence
  source 1..20: mol_type = other DNA
ttgtgcagaaagcaggaaca

SEQ ID NO: 53711 - DNA, 20 bp, synthetic construct
  misc_feature 1..20: note = CRISPR gRNA sequence
  source 1..20: mol_type = other DNA
acaaagtgtctcctttcttt

SEQ ID NO: 53712 - DNA, 20 bp, synthetic construct
  misc_feature 1..20: note = CRISPR gRNA sequence
  source 1..20: mol_type = other DNA
caaagtgtctcctttctttc

SEQ ID NO: 53713 - DNA, 20 bp, synthetic construct
  misc_feature 1..20: note = CRISPR gRNA sequence
  source 1..20: mol_type = other DNA
aaagtgtctcctttctttca

SEQ ID NO: 53714 - DNA, 20 bp, synthetic construct
  misc_feature 1..20: note = CRISPR gRNA sequence
  source 1..20: mol_type = other DNA
aatgctacactcccctccca

SEQ ID NO: 53715 - DNA, 20 bp, synthetic construct
  misc_feature 1..20: note = CRISPR gRNA sequence
  source 1..20: mol_type = other DNA
atgctacactcccctcccac

SEQ ID NO: 53716 - DNA, 20 bp, synthetic construct
  misc_feature 1..20: note = CRISPR gRNA sequence
  source 1..20: mol_type = other DNA
tgctacactcccctcccacg

SEQ ID NO: 53717 - DNA, 20 bp, synthetic construct
  misc_feature 1..20: note = CRISPR gRNA sequence
  source 1..20: mol_type = other DNA
ctcccctcccacggggacac

SEQ ID NO: 53718 - DNA, 20 bp, synthetic construct
  misc_feature 1..20: note = CRISPR gRNA sequence
  source 1..20: mol_type = other DNA
ccctcccacggggacactgg

SEQ ID NO: 53719 - DNA, 20 bp, synthetic construct
  misc_feature 1..20: note = CRISPR gRNA sequence
  source 1..20: mol_type = other DNA
cctcccacggggacactggt

SEQ ID NO: 53720 - DNA, 20 bp, synthetic construct
  misc_feature 1..20: note = CRISPR gRNA sequence
  source 1..20: mol_type = other DNA
ctcccacggggacactggta

SEQ ID NO: 53721 - DNA, 20 bp, synthetic construct
  misc_feature 1..20: note = CRISPR gRNA sequence
  source 1..20: mol_type = other DNA
cacggggacactggtagggc

SEQ ID NO: 53722 - DNA, 20 bp, synthetic construct
  misc_feature 1..20: note = CRISPR gRNA sequence
  source 1..20: mol_type = other DNA
ggacactggtagggcgagtg

SEQ ID NO: 53723 - DNA, 20 bp, synthetic construct
  misc_feature 1..20: note = CRISPR gRNA sequence
  source 1..20: mol_type = other DNA
agggcgagtgtggaccctca

SEQ ID NO: 53724 - DNA, 20 bp, synthetic construct
  misc_feature 1..20: note = CRISPR gRNA sequence
  source 1..20: mol_type = other DNA
agtgtggaccctcacagcac

SEQ ID NO: 53725 - DNA, 20 bp, synthetic construct
  misc_feature 1..20: note = CRISPR gRNA sequence
  source 1..20: mol_type = other DNA
gtgtggaccctcacagcacc

SEQ ID NO: 53726 - DNA, 20 bp, synthetic construct
  misc_feature 1..20: note = CRISPR gRNA sequence
  source 1..20: mol_type = other DNA
ccctcacagcaccaggtcac

SEQ ID NO: 53727 - DNA, 20 bp, synthetic construct
  misc_feature 1..20: note = CRISPR gRNA sequence
  source 1..20: mol_type = other DNA
ggtcacgagtccacactaat

SEQ ID NO: 53728 - DNA, 20 bp, synthetic construct
  misc_feature 1..20: note = CRISPR gRNA sequence
  source 1..20: mol_type = other DNA
cacgagtccacactaataag

SEQ ID NO: 53729 - DNA, 20 bp, synthetic construct
  misc_feature 1..20: note = CRISPR gRNA sequence
  source 1..20: mol_type = other DNA
acgagtccacactaataaga

SEQ ID NO: 53730 - DNA, 20 bp, synthetic construct
  misc_feature 1..20: note = CRISPR gRNA sequence
  source 1..20: mol_type = other DNA
cactaataagaaggtcacat

SEQ ID NO: 53731 - DNA, 20 bp, synthetic construct
  misc_feature 1..20: note = CRISPR gRNA sequence
  source 1..20: mol_type = other DNA
actaataagaaggtcacatg

SEQ ID NO: 53732 - DNA, 20 bp, synthetic construct
  misc_feature 1..20: note = CRISPR gRNA sequence
  source 1..20: mol_type = other DNA
tgaggacatactaaaacctc

SEQ ID NO: 53733 - DNA, 20 bp, synthetic construct
  misc_feature 1..20: note = CRISPR gRNA sequence
  source 1..20: mol_type = other DNA
ttcatgtaatttgcctgcaa

SEQ ID NO: 53734 - DNA, 20 bp, synthetic construct
  misc_feature 1..20: note = CRISPR gRNA sequence
  source 1..20: mol_type = other DNA
tgtaatttgcctgcaatggt

SEQ ID NO: 53735 - DNA, 20 bp, synthetic construct
  misc_feature 1..20: note = CRISPR gRNA sequence
  source 1..20: mol_type = other DNA
gttagaccttccttccttcc

SEQ ID NO: 53736 - DNA, 20 bp, synthetic construct
  misc_feature 1..20: note = CRISPR gRNA sequence
  source 1..20: mol_type = other DNA
ttagaccttccttccttccc

SEQ ID NO: 53737 - DNA, 20 bp, synthetic construct
  misc_feature 1..20: note = CRISPR gRNA sequence
  source 1..20: mol_type = other DNA
ccttccttccttcccaggtg

SEQ ID NO: 53738 - DNA, 20 bp, synthetic construct
  misc_feature 1..20: note = CRISPR gRNA sequence
  source 1..20: mol_type = other DNA
cttccttccttcccaggtgc

SEQ ID NO: 53739 - DNA, 20 bp, synthetic construct
  misc_feature 1..20: note = CRISPR gRNA sequence
  source 1..20: mol_type = other DNA
tcccaggtgcaggccctgaa

SEQ ID NO: 53740 - DNA, 20 bp, synthetic construct
  misc_feature 1..20: note = CRISPR gRNA sequence
  source 1..20: mol_type = other DNA
cccaggtgcaggccctgaac

SEQ ID NO: 53741 - DNA, 20 bp, synthetic construct
  misc_feature 1..20: note = CRISPR gRNA sequence
  source 1..20: mol_type = other DNA
gcaggccctgaacaggaacc

SEQ ID NO: 53742 - DNA, 20 bp, synthetic construct
  misc_feature 1..20: note = CRISPR gRNA sequence
  source 1..20: mol_type = other DNA
caggccctgaacaggaacca

SEQ ID NO: 53743 - DNA, 20 bp, synthetic construct
  misc_feature 1..20: note = CRISPR gRNA sequence
  source 1..20: mol_type = other DNA
aaggcaactcccttccttcc

SEQ ID NO: 53744 - DNA, 20 bp, synthetic construct
  misc_feature 1..20: note = CRISPR gRNA sequence
  source 1..20: mol_type = other DNA
ttcccagcattgcacaaaaa

SEQ ID NO: 53745 - DNA, 20 bp, synthetic construct
  misc_feature 1..20: note = CRISPR gRNA sequence
  source 1..20: mol_type = other DNA
tcccagcattgcacaaaaac

SEQ ID NO: 53746 - DNA, 20 bp, synthetic construct
  misc_feature 1..20: note = CRISPR gRNA sequence
  source 1..20: mol_type = other DNA
cccagcattgcacaaaaaca

SEQ ID NO: 53747 - DNA, 20 bp, synthetic construct
  misc_feature 1..20: note = CRISPR gRNA sequence
  source 1..20: mol_type = other DNA
attgcacaaaaacagggtgt

SEQ ID NO: 53748 - DNA, 20 bp, synthetic construct
  misc_feature 1..20: note = CRISPR gRNA sequence
  source 1..20: mol_type = other DNA
gcacaaaaacagggtgtgag

SEQ ID NO: 53749 - DNA, 20 bp, synthetic construct
  misc_feature 1..20: note = CRISPR gRNA sequence
  source 1..20: mol_type = other DNA
cacaaaaacagggtgtgagc

SEQ ID NO: 53750 - DNA, 20 bp, synthetic construct
  misc_feature 1..20: note = CRISPR gRNA sequence
  source 1..20: mol_type = other DNA
acaaaaacagggtgtgagca

SEQ ID NO: 53751 - DNA, 20 bp, synthetic construct
  misc_feature 1..20: note = CRISPR gRNA sequence
  source 1..20: mol_type = other DNA
caaaaacagggtgtgagcag

SEQ ID NO: 53752 - DNA, 20 bp, synthetic construct
  misc_feature 1..20: note = CRISPR gRNA sequence
  source 1..20: mol_type = other DNA
aaaaacagggtgtgagcagg

SEQ ID NO: 53753 - DNA, 20 bp, synthetic construct
  misc_feature 1..20: note = CRISPR gRNA sequence
  source 1..20: mol_type = other DNA
gggtgtgagcagggggtcct

SEQ ID NO: 53754 - DNA, 20 bp, synthetic construct
  misc_feature 1..20: note = CRISPR gRNA sequence
  source 1..20: mol_type = other DNA
ggtgtgagcagggggtcctt

SEQ ID NO: 53755 - DNA, 20 bp, synthetic construct
  misc_feature 1..20: note = CRISPR gRNA sequence
  source 1..20: mol_type = other DNA
agcagggggtccttaggccc

SEQ ID NO: 53756 - DNA, 20 bp, synthetic construct
  misc_feature 1..20: note = CRISPR gRNA sequence
  source 1..20: mol_type = other DNA
ttaggccccagcactcattt

SEQ ID NO: 53757 - DNA, 20 bp, synthetic construct
  misc_feature 1..20: note = CRISPR gRNA sequence
  source 1..20: mol_type = other DNA
aggccccagcactcatttca

SEQ ID NO: 53758 - DNA, 20 bp, synthetic construct
  misc_feature 1..20: note = CRISPR gRNA sequence
  source 1..20: mol_type = other DNA
agcactcatttcagagatcg

SEQ ID NO: 53759 - DNA, 20 bp, synthetic construct
  misc_feature 1..20: note = CRISPR gRNA sequence
  source 1..20: mol_type = other DNA
tcagagatcgtagccaccaa

SEQ ID NO: 53760 - DNA, 20 bp, synthetic construct
  misc_feature 1..20: note = CRISPR gRNA sequence
  source 1..20: mol_type = other DNA
agagatcgtagccaccaaca

SEQ ID NO: 53761 - DNA, 20 bp, synthetic construct
  misc_feature 1..20: note = CRISPR gRNA sequence
  source 1..20: mol_type = other DNA
gagatcgtagccaccaacag

SEQ ID NO: 53762 - DNA, 20 bp, synthetic construct
  misc_feature 1..20: note = CRISPR gRNA sequence
  source 1..20: mol_type = other DNA
caatttatgtatttaccgac

SEQ ID NO: 53763 - DNA, 20 bp, synthetic construct
  misc_feature 1..20: note = CRISPR gRNA sequence
  source 1..20: mol_type = other DNA
aatttatgtatttaccgact

SEQ ID NO: 53764 - DNA, 20 bp, synthetic construct
  misc_feature 1..20: note = CRISPR gRNA sequence
  source 1..20: mol_type = other DNA
tgtatttaccgactgggaac

SEQ ID NO: 53765 - DNA, 20 bp, synthetic construct
  misc_feature 1..20: note = CRISPR gRNA sequence
  source 1..20: mol_type = other DNA
gtatttaccgactgggaacc

SEQ ID NO: 53766 - DNA, 20 bp, synthetic construct
  misc_feature 1..20: note = CRISPR gRNA sequence
  source 1..20: mol_type = other DNA
tatttaccgactgggaacca

SEQ ID NO: 53767 - DNA, 20 bp, synthetic construct
  misc_feature 1..20: note = CRISPR gRNA sequence
  source 1..20: mol_type = other DNA
ccgactgggaaccagggact

SEQ ID NO: 53768 - DNA, 20 bp, synthetic construct
  misc_feature 1..20: note = CRISPR gRNA sequence
  source 1..20: mol_type = other DNA
gactgggaaccagggactcg

SEQ ID NO: 53769 - DNA, 20 bp, synthetic construct
  misc_feature 1..20: note = CRISPR gRNA sequence
  source 1..20: mol_type = other DNA
ctgggaaccagggactcgga

SEQ ID NO: 53770 - DNA, 20 bp, synthetic construct
  misc_feature 1..20: note = CRISPR gRNA sequence
  source 1..20: mol_type = other DNA
tgggaaccagggactcggag

SEQ ID NO: 53771 - DNA, 20 bp, synthetic construct
  misc_feature 1..20: note = CRISPR gRNA sequence
  source 1..20: mol_type = other DNA
gggaaccagggactcggaga

SEQ ID NO: 53772 - DNA, 20 bp, synthetic construct
  misc_feature 1..20: note = CRISPR gRNA sequence
  source 1..20: mol_type = other DNA
ggaaccagggactcggagag

SEQ ID NO: 53773 - DNA, 20 bp, synthetic construct
  misc_feature 1..20: note = CRISPR gRNA sequence
  source 1..20: mol_type = other DNA
gagaggggatgtaacttgcc

SEQ ID NO: 53774 - DNA, 20 bp, synthetic construct
  misc_feature 1..20: note = CRISPR gRNA sequence
  source 1..20: mol_type = other DNA
gtaacttgcccagaatcaca

SEQ ID NO: 53775 - DNA, 20 bp, synthetic construct
  misc_feature 1..20: note = CRISPR gRNA sequence
  source 1..20: mol_type = other DNA
ttgcccagaatcacacagca

SEQ ID NO: 53776 - DNA, 20 bp, synthetic construct
  misc_feature 1..20: note = CRISPR gRNA sequence
  source 1..20: mol_type = other DNA
cacacagcaaagcgtgttca

SEQ ID NO: 53777 - DNA, 20 bp, synthetic construct
  misc_feature 1..20: note = CRISPR gRNA sequence
  source 1..20: mol_type = other DNA
cacagcaaagcgtgttcaca

SEQ ID NO: 53778 - DNA, 20 bp, synthetic construct
  misc_feature 1..20: note = CRISPR gRNA sequence
  source 1..20: mol_type = other DNA
gcaaagcgtgttcacagaga

SEQ ID NO: 53779 - DNA, 20 bp, synthetic construct
  misc_feature 1..20: note = CRISPR gRNA sequence
  source 1..20: mol_type = other DNA
gcgtgttcacagagacagcc

SEQ ID NO: 53780 - DNA, 20 bp, synthetic construct
  misc_feature 1..20: note = CRISPR gRNA sequence
  source 1..20: mol_type = other DNA
cacagagacagcctggaata

SEQ ID NO: 53781 - DNA, 20 bp, synthetic construct
  misc_feature 1..20: note = CRISPR gRNA sequence
  source 1..20: mol_type = other DNA
acagagacagcctggaatat

SEQ ID NO: 53782 - DNA, 20 bp, synthetic construct
  misc_feature 1..20: note = CRISPR gRNA sequence
  source 1..20: mol_type = other DNA
aggacctgtgacctctcccc

SEQ ID NO: 53783 - DNA, 20 bp, synthetic construct
  misc_feature 1..20: note = CRISPR gRNA sequence
  source 1..20: mol_type = other DNA
ggacctgtgacctctcccct

SEQ ID NO: 53784 - DNA, 20 bp, synthetic construct
  misc_feature 1..20: note = CRISPR gRNA sequence
  source 1..20: mol_type = other DNA
acctctcccctgggctcctc

SEQ ID NO: 53785 - DNA, 20 bp, synthetic construct
  misc_feature 1..20: note = CRISPR gRNA sequence
  source 1..20: mol_type = other DNA
cccctgggctcctctggctt

SEQ ID NO: 53786 - DNA, 20 bp, synthetic construct
  misc_feature 1..20: note = CRISPR gRNA sequence
  source 1..20: mol_type = other DNA
gggctcctctggctttggcc

SEQ ID NO: 53787 - DNA, 20 bp, synthetic construct
  misc_feature 1..20: note = CRISPR gRNA sequence
  source 1..20: mol_type = other DNA
ctcctctggctttggcccag

SEQ ID NO: 53788 - DNA, 20 bp, synthetic construct
  misc_feature 1..20: note = CRISPR gRNA sequence
  source 1..20: mol_type = other DNA
ggctttggcccagaagtgcc

SEQ ID NO: 53789 - DNA, 20 bp, synthetic construct
  misc_feature 1..20: note = CRISPR gRNA sequence
  source 1..20: mol_type = other DNA
gctttggcccagaagtgcct

SEQ ID NO: 53790 - DNA, 20 bp, synthetic construct
  misc_feature 1..20: note = CRISPR gRNA sequence
  source 1..20: mol_type = other DNA
tttggcccagaagtgcctgg

SEQ ID NO: 53791 - DNA, 20 bp, synthetic construct
  misc_feature 1..20: note = CRISPR gRNA sequence
  source 1..20: mol_type = other DNA
ttggcccagaagtgcctggg

SEQ ID NO: 53792 - DNA, 20 bp, synthetic construct
  misc_feature 1..20: note = CRISPR gRNA sequence
  source 1..20: mol_type = other DNA
ggcccagaagtgcctgggag

SEQ ID NO: 53793 - DNA, 20 bp, synthetic construct
  misc_feature 1..20: note = CRISPR gRNA sequence
  source 1..20: mol_type = other DNA
gcccagaagtgcctgggagg

SEQ ID NO: 53794 - DNA, 20 bp, synthetic construct
  misc_feature 1..20: note = CRISPR gRNA sequence
  source 1..20: mol_type = other DNA
cccagaagtgcctgggagga

SEQ ID NO: 53795 - DNA, 20 bp, synthetic construct
  misc_feature 1..20: note = CRISPR gRNA sequence
  source 1..20: mol_type = other DNA
ccagaagtgcctgggaggag

SEQ ID NO: 53796 - DNA, 20 bp, synthetic construct
  misc_feature 1..20: note = CRISPR gRNA sequence
  source 1..20: mol_type = other DNA
cagaagtgcctgggaggagg

SEQ ID NO: 53797 - DNA, 20 bp, synthetic construct
  misc_feature 1..20: note = CRISPR gRNA sequence
  source 1..20: mol_type = other DNA
gggaggagggggtgctttgt

SEQ ID NO: 53798 - DNA, 20 bp, synthetic construct
  misc_feature 1..20: note = CRISPR gRNA sequence
  source 1..20: mol_type = other DNA
gggggtgctttgtgagccaa

SEQ ID NO: 53799 - DNA, 20 bp, synthetic construct
  misc_feature 1..20: note = CRISPR gRNA sequence
  source 1..20: mol_type = other DNA
ctttgtgagccaaaagcacc

SEQ ID NO: 53800 - DNA, 20 bp, synthetic construct
  misc_feature 1..20: note = CRISPR gRNA sequence
  source 1..20: mol_type = other DNA
tttgtgagccaaaagcacca

SEQ ID NO: 53801 - DNA, 20 bp, synthetic construct
  misc_feature 1..20: note = CRISPR gRNA sequence
  source 1..20: mol_type = other DNA
ttgtgagccaaaagcaccaa

SEQ ID NO: 53802 - DNA, 20 bp, synthetic construct
  misc_feature 1..20: note = CRISPR gRNA sequence
  source 1..20: mol_type = other DNA
ccaaaagcaccaagggcatt

SEQ ID NO: 53803 - DNA, 20 bp, synthetic construct
  misc_feature 1..20: note = CRISPR gRNA sequence
  source 1..20: mol_type = other DNA
caaaagcaccaagggcattt

SEQ ID NO: 53804 - DNA, 20 bp, synthetic construct
  misc_feature 1..20: note = CRISPR gRNA sequence
  source 1..20: mol_type = other DNA
aaaagcaccaagggcattta

SEQ ID NO: 53805 - DNA, 20 bp, synthetic construct
  misc_feature 1..20: note = CRISPR gRNA sequence
  source 1..20: mol_type = other DNA
accaagggcatttagggatc

SEQ ID NO: 53806 - DNA, 20 bp, synthetic construct
  misc_feature 1..20: note = CRISPR gRNA sequence
  source 1..20: mol_type = other DNA
catttagggatcaagaactc

SEQ ID NO: 53807 - DNA, 20 bp, synthetic construct
  misc_feature 1..20: note = CRISPR gRNA sequence
  source 1..20: mol_type = other DNA
tcaagaactctggtccattg

SEQ ID NO: 53808 - DNA, 20 bp, synthetic construct
  misc_feature 1..20: note = CRISPR gRNA sequence
  source 1..20: mol_type = other DNA
caagaactctggtccattgc

SEQ ID NO: 53809 - DNA, 20 bp, synthetic construct
  misc_feature 1..20: note = CRISPR gRNA sequence
  source 1..20: mol_type = other DNA
ggtccattgcaggcaaactt

SEQ ID NO: 53810 - DNA, 20 bp, synthetic construct
  misc_feature 1..20: note = CRISPR gRNA sequence
  source 1..20: mol_type = other DNA
gtccattgcaggcaaacttt

SEQ ID NO: 53811 - DNA, 20 bp, synthetic construct
  misc_feature 1..20: note = CRISPR gRNA sequence
  source 1..20: mol_type = other DNA
tccattgcaggcaaactttg

SEQ ID NO: 53812 - DNA, 20 bp, synthetic construct
  misc_feature 1..20: note = CRISPR gRNA sequence
  source 1..20: mol_type = other DNA
tcctcctacacactctctgc

SEQ ID NO: 53813 - DNA, 20 bp, synthetic construct
  misc_feature 1..20: note = CRISPR gRNA sequence
  source 1..20: mol_type = other DNA
cctcctacacactctctgcc

SEQ ID NO: 53814 - DNA, 20 bp, synthetic construct
  misc_feature 1..20: note = CRISPR gRNA sequence
  source 1..20: mol_type = other DNA
cacactctctgccaggtact

SEQ ID NO: 53815 - DNA, 20 bp, synthetic construct
  misc_feature 1..20: note = CRISPR gRNA sequence
  source 1..20: mol_type = other DNA
acactctctgccaggtactc

SEQ ID NO: 53816 - DNA, 20 bp, synthetic construct
  misc_feature 1..20: note = CRISPR gRNA sequence
  source 1..20: mol_type = other DNA
cactctctgccaggtactca

SEQ ID NO: 53817 - DNA, 20 bp, synthetic construct
  misc_feature 1..20: note = CRISPR gRNA sequence
  source 1..20: mol_type = other DNA
gccaggtactcagggatcct

SEQ ID NO: 53818 - DNA, 20 bp, synthetic construct
  misc_feature 1..20: note = CRISPR gRNA sequence
  source 1..20: mol_type = other DNA
aggtactcagggatccttgg

SEQ ID NO: 53819 - DNA, 20 bp, synthetic construct
  misc_feature 1..20: note = CRISPR gRNA sequence
  source 1..20: mol_type = other DNA
tcagggatccttggcagccc

SEQ ID NO: 53820 - DNA, 20 bp, synthetic construct
  misc_feature 1..20: note = CRISPR gRNA sequence
  source 1..20: mol_type = other DNA
cagggatccttggcagccct

SEQ ID NO: 53821 - DNA, 20 bp, synthetic construct
  misc_feature 1..20: note = CRISPR gRNA sequence
  source 1..20: mol_type = other DNA
cagccctgggcaccctgctt

SEQ ID NO: 53822 - DNA, 20 bp, synthetic construct
  misc_feature 1..20: note = CRISPR gRNA sequence
  source 1..20: mol_type = other DNA
ccctgcttgagtgtcctctc

SEQ ID NO: 53823 - DNA, 20 bp, synthetic construct
  misc_feature 1..20: note = CRISPR gRNA sequence
  source 1..20: mol_type = other DNA
tgtctaccctgaccataccc

SEQ ID NO: 53824 - DNA, 20 bp, synthetic construct
  misc_feature 1..20: note = CRISPR gRNA sequence
  source 1..20: mol_type = other DNA
cctgaccataccccagctaa

SEQ ID NO: 53825 - DNA, 20 bp, synthetic construct
  misc_feature 1..20: note = CRISPR gRNA sequence
  source 1..20: mol_type = other DNA
cataccccagctaacagccc

SEQ ID NO: 53826 - DNA, 20 bp, synthetic construct
  misc_feature 1..20: note = CRISPR gRNA sequence
  source 1..20: mol_type = other DNA
ctaacagccccagcccctcc

SEQ ID NO: 53827 - DNA, 20 bp, synthetic construct
  misc_feature 1..20: note = CRISPR gRNA sequence
  source 1..20: mol_type = other DNA
cccagcccctcccggcaccc

SEQ ID NO: 53828 - DNA, 20 bp, synthetic construct
  misc_feature 1..20: note = CRISPR gRNA sequence
  source 1..20: mol_type = other DNA
ccagcccctcccggcacccc

SEQ ID NO: 53829 - DNA, 20 bp, synthetic construct
  misc_feature 1..20: note = CRISPR gRNA sequence
  source 1..20: mol_type = other DNA
cagcccctcccggcacccca

SEQ ID NO: 53830 - DNA, 20 bp, synthetic construct
  misc_feature 1..20: note = CRISPR gRNA sequence
  source 1..20: mol_type = other DNA
ccctcccggcaccccagggc

SEQ ID NO: 53831 - DNA, 20 bp, synthetic construct
  misc_feature 1..20: note = CRISPR gRNA sequence
  source 1..20: mol_type = other DNA
agggccagaataacaactgc

SEQ ID NO: 53832 - DNA, 20 bp, synthetic construct
  misc_feature 1..20: note = CRISPR gRNA sequence
  source 1..20: mol_type = other DNA
gaataacaactgccagccgt

SEQ ID NO: 53833 - DNA, 20 bp, synthetic construct
  misc_feature 1..20: note = CRISPR gRNA sequence
  source 1..20: mol_type = other DNA
gcacccacacctgccctccc

SEQ ID NO: 53834 - DNA, 20 bp, synthetic construct
  misc_feature 1..20: note = CRISPR gRNA sequence
  source 1..20: mol_type = other DNA
cacccacacctgccctcccc

SEQ ID NO: 53835 - DNA, 20 bp, synthetic construct
  misc_feature 1..20: note = CRISPR gRNA sequence
  source 1..20: mol_type = other DNA
acccacacctgccctcccca

SEQ ID NO: 53836 - DNA, 20 bp, synthetic construct
  misc_feature 1..20: note = CRISPR gRNA sequence
  source 1..20: mol_type = other DNA
cacacctgccctccccaggg

SEQ ID NO: 53837 - DNA, 20 bp, synthetic construct
  misc_feature 1..20: note = CRISPR gRNA sequence
  source 1..20: mol_type = other DNA
tgccctccccagggtggcct

SEQ ID NO: 53838 - DNA, 20 bp, synthetic construct
  misc_feature 1..20: note = CRISPR gRNA sequence
  source 1..20: mol_type = other DNA
cctccccagggtggcctcag

SEQ ID NO: 53839 - DNA, 20 bp, synthetic construct
  misc_feature 1..20: note = CRISPR gRNA sequence
  source 1..20: mol_type = other DNA
ggtggcctcagaagcctgtt

SEQ ID NO: 53840 - DNA, 20 bp, synthetic construct
  misc_feature 1..20: note = CRISPR gRNA sequence
  source 1..20: mol_type = other DNA
tggcctcagaagcctgttca

SEQ ID NO: 53841 - DNA, 20 bp, synthetic construct
  misc_feature 1..20: note = CRISPR gRNA sequence
  source 1..20: mol_type = other DNA
cagaagcctgttcagagatg

SEQ ID NO: 53842 - DNA, 20 bp, synthetic construct
  misc_feature 1..20: note = CRISPR gRNA sequence
  source 1..20: mol_type = other DNA
gaagcctgttcagagatgcg

SEQ ID NO: 53843 - DNA, 20 bp, synthetic construct
  misc_feature 1..20: note = CRISPR gRNA sequence
  source 1..20: mol_type = other DNA
cctgttcagagatgcggaga

SEQ ID NO: 53844 - DNA, 20 bp, synthetic construct
  misc_feature 1..20: note = CRISPR gRNA sequence
  source 1..20: mol_type = other DNA
ctgttcagagatgcggagac

SEQ ID NO: 53845 - DNA, 20 bp, synthetic construct
  misc_feature 1..20: note = CRISPR gRNA sequence
  source 1..20: mol_type = other DNA
agagatgcggagacaggttc

SEQ ID NO: 53846 - DNA, 20 bp, synthetic construct
  misc_feature 1..20: note = CRISPR gRNA sequence
  source 1..20: mol_type = other DNA
gatgcggagacaggttccag

SEQ ID NO: 53847 - DNA, 20 bp, synthetic construct
  misc_feature 1..20: note = CRISPR gRNA sequence
  source 1..20: mol_type = other DNA
ccagaagtgaaaccttgaat

SEQ ID NO: 53848 - DNA, 20 bp, synthetic construct
  misc_feature 1..20: note = CRISPR gRNA sequence
  source 1..20: mol_type = other DNA
gaagtgaaaccttgaatcag

SEQ ID NO: 53849 - DNA, 20 bp, synthetic construct
  misc_feature 1..20: note = CRISPR gRNA sequence
  source 1..20: mol_type = other DNA
gtgaaaccttgaatcagaag

SEQ ID NO: 53850 - DNA, 20 bp, synthetic construct
  misc_feature 1..20: note = CRISPR gRNA sequence
  source 1..20: mol_type = other DNA
tgaaaccttgaatcagaagt

SEQ ID NO: 53851 - DNA, 20 bp, synthetic construct
  misc_feature 1..20: note = CRISPR gRNA sequence
  source 1..20: mol_type = other DNA
gaatcagaagtgggattatt

SEQ ID NO: 53852 - DNA, 20 bp, synthetic construct
  misc_feature 1..20: note = CRISPR gRNA sequence
  source 1..20: mol_type = other DNA
gaagtgggattattgagtca

SEQ ID NO: 53853 - DNA, 20 bp, synthetic construct
  misc_feature 1..20: note = CRISPR gRNA sequence
  source 1..20: mol_type = other DNA
tattgagtcacagactctct

SEQ ID NO: 53854 - DNA, 20 bp, synthetic construct
  misc_feature 1..20: note = CRISPR gRNA sequence
  source 1..20: mol_type = other DNA
gagtcacagactctctgagt

SEQ ID NO: 53855 - DNA, 20 bp, synthetic construct
  misc_feature 1..20: note = CRISPR gRNA sequence
  source 1..20: mol_type = other DNA
tctgagtaagaatcatctat

SEQ ID NO: 53856 - DNA, 20 bp, synthetic construct
  misc_feature 1..20: note = CRISPR gRNA sequence
  source 1..20: mol_type = other DNA
agtaagaatcatctattagc

SEQ ID NO: 53857 - DNA, 20 bp, synthetic construct
  misc_feature 1..20: note = CRISPR gRNA sequence
  source 1..20: mol_type = other DNA
tctattagctagccttcacc

SEQ ID NO: 53858 - DNA, 20 bp, synthetic construct
  misc_feature 1..20: note = CRISPR gRNA sequence
  source 1..20: mol_type = other DNA
accgagaacttacattgtat

SEQ ID NO: 53859 - DNA, 20 bp, synthetic construct
  misc_feature 1..20: note = CRISPR gRNA sequence
  source 1..20: mol_type = other DNA
ccgagaacttacattgtatt

SEQ ID NO: 53860 - DNA, 20 bp, synthetic construct
  misc_feature 1..20: note = CRISPR gRNA sequence
  source 1..20: mol_type = other DNA
cgagaacttacattgtatta

SEQ ID NO: 53861 - DNA, 20 bp, synthetic construct
  misc_feature 1..20: note = CRISPR gRNA sequence
  source 1..20: mol_type = other DNA
gagaacttacattgtattag

SEQ ID NO: 53862 - DNA, 20 bp, synthetic construct
  misc_feature 1..20: note = CRISPR gRNA sequence
  source 1..20: mol_type = other DNA
tttaatctttacaataaccc

SEQ ID NO: 53863 - DNA, 20 bp, synthetic construct
  misc_feature 1..20: note = CRISPR gRNA sequence
  source 1..20: mol_type = other DNA
ttaatctttacaataacccc

SEQ ID NO: 53864 - DNA, 20 bp, synthetic construct
  misc_feature 1..20: note = CRISPR gRNA sequence
  source 1..20: mol_type = other DNA
tctttacaataaccccagga

SEQ ID NO: 53865 - DNA, 20 bp, synthetic construct
  misc_feature 1..20: note = CRISPR gRNA sequence
  source 1..20: mol_type = other DNA
tttacaataaccccaggaaa

SEQ ID NO: 53866 - DNA, 20 bp, synthetic construct
  misc_feature 1..20: note = CRISPR gRNA sequence
  source 1..20: mol_type = other DNA
ttacaataaccccaggaaag

SEQ ID NO: 53867 - DNA, 20 bp, synthetic construct
  misc_feature 1..20: note = CRISPR gRNA sequence
  source 1..20: mol_type = other DNA
tacaataaccccaggaaaga

SEQ ID NO: 53868 - DNA, 20 bp, synthetic construct
  misc_feature 1..20: note = CRISPR gRNA sequence
  source 1..20: mol_type = other DNA
acaataaccccaggaaagag

SEQ ID NO: 53869 - DNA, 20 bp, synthetic construct
  misc_feature 1..20: note = CRISPR gRNA sequence
  source 1..20: mol_type = other DNA
caataaccccaggaaagagg

SEQ ID NO: 53870 - DNA, 20 bp, synthetic construct
  misc_feature 1..20: note = CRISPR gRNA sequence
  source 1..20: mol_type = other DNA
aaccccaggaaagaggggga

SEQ ID NO: 53871 - DNA, 20 bp, synthetic construct
  misc_feature 1..20: note = CRISPR gRNA sequence
  source 1..20: mol_type = other DNA
accccaggaaagagggggat

SEQ ID NO: 53872 - DNA, 20 bp, synthetic construct
  misc_feature 1..20: note = CRISPR gRNA sequence
  source 1..20: mol_type = other DNA
caggaaagagggggatggga

SEQ ID NO: 53873 - DNA, 20 bp, synthetic construct
  misc_feature 1..20: note = CRISPR gRNA sequence
  source 1..20: mol_type = other DNA
ggaaagagggggatgggaca

SEQ ID NO: 53874 - DNA, 20 bp, synthetic construct
  misc_feature 1..20: note = CRISPR gRNA sequence
  source 1..20: mol_type = other DNA
agaatgctccccccctgccc

SEQ ID NO: 53875 - DNA, 20 bp, synthetic construct
  misc_feature 1..20: note = CRISPR gRNA sequence
  source 1..20: mol_type = other DNA
ctccccccctgccccagcct

SEQ ID NO: 53876 - DNA, 20 bp, synthetic construct
  misc_feature 1..20: note = CRISPR gRNA sequence
  source 1..20: mol_type = other DNA
ccccccctgccccagcctca

SEQ ID NO: 53877 - DNA, 20 bp, synthetic construct
  misc_feature 1..20: note = CRISPR gRNA sequence
  source 1..20: mol_type = other DNA
cccccctgccccagcctcag

SEQ ID NO: 53878 - DNA, 20 bp, synthetic construct
  misc_feature 1..20: note = CRISPR gRNA sequence
  source 1..20: mol_type = other DNA
ccagcctcagaggctctgcc

SEQ ID NO: 53879 - DNA, 20 bp, synthetic construct
  misc_feature 1..20: note = CRISPR gRNA sequence
  source 1..20: mol_type = other DNA
gcctcagaggctctgcctag

SEQ ID NO: 53880 - DNA, 20 bp, synthetic construct
  misc_feature 1..20: note = CRISPR gRNA sequence
  source 1..20: mol_type = other DNA
cctcagaggctctgcctagc

SEQ ID NO: 53881 - DNA, 20 bp, synthetic construct
  misc_feature 1..20: note = CRISPR gRNA sequence
  source 1..20: mol_type = other DNA
cctagcgggctactcacttc

SEQ ID NO: 53882 - DNA, 20 bp, synthetic construct
  misc_feature 1..20: note = CRISPR gRNA sequence
  source 1..20: mol_type = other DNA
ctagcgggctactcacttca

SEQ ID NO: 53883 - DNA, 20 bp, synthetic construct
  misc_feature 1..20: note = CRISPR gRNA sequence
  source 1..20: mol_type = other DNA
gctactcacttcaaggactg

SEQ ID NO: 53884 - DNA, 20 bp, synthetic construct
  misc_feature 1..20: note = CRISPR gRNA sequence
  source 1..20: mol_type = other DNA
tactcacttcaaggactgca

SEQ ID NO: 53885 - DNA, 20 bp, synthetic construct
  misc_feature 1..20: note = CRISPR gRNA sequence
  source 1..20: mol_type = other DNA
ttcaaggactgcagagctcc

SEQ ID NO: 53886 - DNA, 20 bp, synthetic construct
  misc_feature 1..20: note = CRISPR gRNA sequence
  source 1..20: mol_type = other DNA
gactgcagagctcccagccc

SEQ ID NO: 53887 - DNA, 20 bp, synthetic construct
  misc_feature 1..20: note = CRISPR gRNA sequence
  source 1..20: mol_type = other DNA
actgcagagctcccagccct

SEQ ID NO: 53888 - DNA, 20 bp, synthetic construct
  misc_feature 1..20: note = CRISPR gRNA sequence
  source 1..20: mol_type = other DNA
tgcagagctcccagccctgg

SEQ ID NO: 53889 - DNA, 20 bp, synthetic construct
  misc_feature 1..20: note = CRISPR gRNA sequence
  source 1..20: mol_type = other DNA
agagctcccagccctgggag

SEQ ID NO: 53890 - DNA, 20 bp, synthetic construct
  misc_feature 1..20: note = CRISPR gRNA sequence
  source 1..20: mol_type = other DNA
tcccagccctgggagcagct

SEQ ID NO: 53891 - DNA, 20 bp, synthetic construct
  misc_feature 1..20: note = CRISPR gRNA sequence
  source 1..20: mol_type = other DNA
agccctgggagcagctgagc

SEQ ID NO: 53892 - DNA, 20 bp, synthetic construct
  misc_feature 1..20: note = CRISPR gRNA sequence
  source 1..20: mol_type = other DNA
ctgggagcagctgagccagc

SEQ ID NO: 53893 - DNA, 20 bp, synthetic construct
  misc_feature 1..20: note = CRISPR gRNA sequence
  source 1..20: mol_type = other DNA
tgggagcagctgagccagcc

SEQ ID NO: 53894 - DNA, 20 bp, synthetic construct
  misc_feature 1..20: note = CRISPR gRNA sequence
  source 1..20: mol_type = other DNA
cgggctgcaccttcatcccc

SEQ ID NO: 53895 - DNA, 20 bp, synthetic construct
  misc_feature 1..20: note = CRISPR gRNA sequence
  source 1..20: mol_type = other DNA
ggctgcaccttcatccccca

SEQ ID NO: 53896 - DNA, 20 bp, synthetic construct
  misc_feature 1..20: note = CRISPR gRNA sequence
  source 1..20: mol_type = other DNA
catcccccagagcattgcct

SEQ ID NO: 53897 - DNA, 20 bp, synthetic construct
  misc_feature 1..20: note = CRISPR gRNA sequence
  source 1..20: mol_type = other DNA
cccccagagcattgcctgag

SEQ ID NO: 53898 - DNA, 20 bp, synthetic construct
  misc_feature 1..20: note = CRISPR gRNA sequence
  source 1..20: mol_type = other DNA
cagagcattgcctgagaagc

SEQ ID NO: 53899 - DNA, 20 bp, synthetic construct
  misc_feature 1..20: note = CRISPR gRNA sequence
  source 1..20: mol_type = other DNA
agagcattgcctgagaagct

SEQ ID NO: 53900 - DNA, 20 bp, synthetic construct
  misc_feature 1..20: note = CRISPR gRNA sequence
  source 1..20: mol_type = other DNA
gagcattgcctgagaagctg

SEQ ID NO: 53901 - DNA, 20 bp, synthetic construct
  misc_feature 1..20: note = CRISPR gRNA sequence
  source 1..20: mol_type = other DNA
agcattgcctgagaagctgg

SEQ ID NO: 53902 - DNA, 20 bp, synthetic construct
  misc_feature 1..20: note = CRISPR gRNA sequence
  source 1..20: mol_type = other DNA
attgcctgagaagctggggg

SEQ ID NO: 53903 - DNA, 20 bp, synthetic construct
  misc_feature 1..20: note = CRISPR gRNA sequence
  source 1..20: mol_type = other DNA
ttgcctgagaagctgggggt

SEQ ID NO: 53904 - DNA, 20 bp, synthetic construct
  misc_feature 1..20: note = CRISPR gRNA sequence
  source 1..20: mol_type = other DNA
tgcctgagaagctgggggtg

SEQ ID NO: 53905 - DNA, 20 bp, synthetic construct
  misc_feature 1..20: note = CRISPR gRNA sequence
  source 1..20: mol_type = other DNA
cctgagaagctgggggtggg

SEQ ID NO: 53906 - DNA, 20 bp, synthetic construct
  misc_feature 1..20: note = CRISPR gRNA sequence
  source 1..20: mol_type = other DNA
gagaagctgggggtggggag

SEQ ID NO: 53907 - DNA, 20 bp, synthetic construct
  misc_feature 1..20: note = CRISPR gRNA sequence
  source 1..20: mol_type = other DNA
agaagctgggggtggggaga

SEQ ID NO: 53908 - DNA, 20 bp, synthetic construct
  misc_feature 1..20: note = CRISPR gRNA sequence
  source 1..20: mol_type = other DNA
gaagctgggggtggggagaa

SEQ ID NO: 53909 - DNA, 20 bp, synthetic construct
  misc_feature 1..20: note = CRISPR gRNA sequence
  source 1..20: mol_type = other DNA
agctgggggtggggagaagg

SEQ ID NO: 53910 - DNA, 20 bp, synthetic construct
  misc_feature 1..20: note = CRISPR gRNA sequence
  source 1..20: mol_type = other DNA
gctgggggtggggagaaggg

SEQ ID NO: 53911 - DNA, 20 bp, synthetic construct
  misc_feature 1..20: note = CRISPR gRNA sequence
  source 1..20: mol_type = other DNA
ctgggggtggggagaaggga

SEQ ID NO: 53912 - DNA, 20 bp, synthetic construct
  misc_feature 1..20: note = CRISPR gRNA sequence
  source 1..20: mol_type = other DNA
tgggggtggggagaagggag

SEQ ID NO: 53913 - DNA, 20 bp, synthetic construct
  misc_feature 1..20: note = CRISPR gRNA sequence
  source 1..20: mol_type = other DNA
ggggtggggagaagggaggg

SEQ ID NO: 53914 - DNA, 20 bp, synthetic construct
  misc_feature 1..20: note = CRISPR gRNA sequence
  source 1..20: mol_type = other DNA
gagaagggaggggagaacat

SEQ ID NO: 53915 - DNA, 20 bp, synthetic construct
  misc_feature 1..20: note = CRISPR gRNA sequence
  source 1..20: mol_type = other DNA
aagggaggggagaacattag

SEQ ID NO: 53916 - DNA, 20 bp, synthetic construct
  misc_feature 1..20: note = CRISPR gRNA sequence
  source 1..20: mol_type = other DNA
agggaggggagaacattagc

SEQ ID NO: 53917 - DNA, 20 bp, synthetic construct
  misc_feature 1..20: note = CRISPR gRNA sequence
  source 1..20: mol_type = other DNA
gaggggagaacattagcagg

SEQ ID NO: 53918 - DNA, 20 bp, synthetic construct
  misc_feature 1..20: note = CRISPR gRNA sequence
  source 1..20: mol_type = other DNA
aggggagaacattagcaggt

SEQ ID NO: 53919 - DNA, 20 bp, synthetic construct
  misc_feature 1..20: note = CRISPR gRNA sequence
  source 1..20: mol_type = other DNA
ggggagaacattagcaggtg

SEQ ID NO: 53920 - DNA, 20 bp, synthetic construct
  misc_feature 1..20: note = CRISPR gRNA sequence
  source 1..20: mol_type = other DNA
ggagaacattagcaggtggg

SEQ ID NO: 53921 - DNA, 20 bp, synthetic construct
  misc_feature 1..20: note = CRISPR gRNA sequence
  source 1..20: mol_type = other DNA
gaacattagcaggtggggag

SEQ ID NO: 53922 - DNA, 20 bp, synthetic construct
  misc_feature 1..20: note = CRISPR gRNA sequence
  source 1..20: mol_type = other DNA
aacattagcaggtggggagt

SEQ ID NO: 53923 - DNA, 20 bp, synthetic construct
  misc_feature 1..20: note = CRISPR gRNA sequence
  source 1..20: mol_type = other DNA
gcaggtggggagtgggttgc

SEQ ID NO: 53924 - DNA, 20 bp, synthetic construct
  misc_feature 1..20: note = CRISPR gRNA sequence
  source 1..20: mol_type = other DNA
ggtggggagtgggttgctgg

SEQ ID NO: 53925 - DNA, 20 bp, synthetic construct
  misc_feature 1..20: note = CRISPR gRNA sequence
  source 1..20: mol_type = other DNA
ggagtgggttgctggcagca

SEQ ID NO: 53926 - DNA, 20 bp, synthetic construct
  misc_feature 1..20: note = CRISPR gRNA sequence
  source 1..20: mol_type = other DNA
gcagcatggtccctgcattc

SEQ ID NO: 53927 - DNA, 20 bp, synthetic construct
  misc_feature 1..20: note = CRISPR gRNA sequence
  source 1..20: mol_type = other DNA
gttactcaacttcctgaaac

SEQ ID NO: 53928 - DNA, 20 bp, synthetic construct
  misc_feature 1..20: note = CRISPR gRNA sequence
  source 1..20: mol_type = other DNA
caacttcctgaaactggaca

SEQ ID NO: 53929 - DNA, 20 bp, synthetic construct
  misc_feature 1..20: note = CRISPR gRNA sequence
  source 1..20: mol_type = other DNA
cctgaaactggacacagccc

SEQ ID NO: 53930 - DNA, 20 bp, synthetic construct
  misc_feature 1..20: note = CRISPR gRNA sequence
  source 1..20: mol_type = other DNA
ctgaaactggacacagccct

SEQ ID NO: 53931 - DNA, 20 bp, synthetic construct
  misc_feature 1..20: note = CRISPR gRNA sequence
  source 1..20: mol_type = other DNA
tggacacagccctgggctgc

SEQ ID NO: 53932 - DNA, 20 bp, synthetic construct
  misc_feature 1..20: note = CRISPR gRNA sequence
  source 1..20: mol_type = other DNA
ggacacagccctgggctgcc

SEQ ID NO: 53933 - DNA, 20 bp, synthetic construct
  misc_feature 1..20: note = CRISPR gRNA sequence
  source 1..20: mol_type = other DNA
acagccctgggctgccaggc

SEQ ID NO: 53934 - DNA, 20 bp, synthetic construct
  misc_feature 1..20: note = CRISPR gRNA sequence
  source 1..20: mol_type = other DNA
tgggctgccaggccagatct

SEQ ID NO: 53935 - DNA, 20 bp, synthetic construct
  misc_feature 1..20: note = CRISPR gRNA sequence
  source 1..20: mol_type = other DNA
gctgccaggccagatctcag

SEQ ID NO: 53936 - DNA, 20 bp, synthetic construct
  misc_feature 1..20: note = CRISPR gRNA sequence
  source 1..20: mol_type = other DNA
aggccagatctcagcagatc

SEQ ID NO: 53937 - DNA, 20 bp, synthetic construct
  misc_feature 1..20: note = CRISPR gRNA sequence
  source 1..20: mol_type = other DNA
agatctcagcagatctggca

SEQ ID NO: 53938 - DNA, 20 bp, synthetic construct
  misc_feature 1..20: note = CRISPR gRNA sequence
  source 1..20: mol_type = other DNA
gatctcagcagatctggcac

SEQ ID NO: 53939 - DNA, 20 bp, synthetic construct
  misc_feature 1..20: note = CRISPR gRNA sequence
  source 1..20: mol_type = other DNA
ctcagcagatctggcacggg

SEQ ID NO: 53940 - DNA, 20 bp, synthetic construct
  misc_feature 1..20: note = CRISPR gRNA sequence
  source 1..20: mol_type = other DNA
gcagatctggcacgggcagc

SEQ ID NO: 53941 - DNA, 20 bp, synthetic construct
  misc_feature 1..20: note = CRISPR gRNA sequence
  source 1..20: mol_type = other DNA
cagatctggcacgggcagct

SEQ ID NO: 53942 - DNA, 20 bp, synthetic construct
  misc_feature 1..20: note = CRISPR gRNA sequence
  source 1..20: mol_type = other DNA
agatctggcacgggcagctg

SEQ ID NO: 53943 - DNA, 20 bp, synthetic construct
  misc_feature 1..20: note = CRISPR gRNA sequence
  source 1..20: mol_type = other DNA
cgggcagctggggtctcccc

SEQ ID NO: 53944 - DNA, 20 bp, synthetic construct
  misc_feature 1..20: note = CRISPR gRNA sequence
  source 1..20: mol_type = other DNA
gggcagctggggtctccccc

SEQ ID NO: 53945 - DNA, 20 bp, synthetic construct
  misc_feature 1..20: note = CRISPR gRNA sequence
  source 1..20: mol_type = other DNA
ctcccccaggttcttattct

SEQ ID NO: 53946 - DNA, 20 bp, synthetic construct
  misc_feature 1..20: note = CRISPR gRNA sequence
  source 1..20: mol_type = other DNA
tcccccaggttcttattctg

SEQ ID NO: 53947 - DNA, 20 bp, synthetic construct
  misc_feature 1..20: note = CRISPR gRNA sequence
  source 1..20: mol_type = other DNA
ggttcttattctgaggttcg

SEQ ID NO: 53948 - DNA, 20 bp, synthetic construct
  misc_feature 1..20: note = CRISPR gRNA sequence
  source 1..20: mol_type = other DNA
tctgaggttcgtggacctct

SEQ ID NO: 53949 - DNA, 20 bp, synthetic construct
  misc_feature 1..20: note = CRISPR gRNA sequence
  source 1..20: mol_type = other DNA
ctgaggttcgtggacctctg

SEQ ID NO: 53950 - DNA, 20 bp, synthetic construct
  misc_feature 1..20: note = CRISPR gRNA sequence
  source 1..20: mol_type = other DNA
tgaggttcgtggacctctga

SEQ ID NO: 53951 - DNA, 20 bp, synthetic construct
  misc_feature 1..20: note = CRISPR gRNA sequence
  source 1..20: mol_type = other DNA
ttcgtggacctctgagggac

SEQ ID NO: 53952 - DNA, 20 bp, synthetic construct
  misc_feature 1..20: note = CRISPR gRNA sequence
  source 1..20: mol_type = other DNA
tcgtggacctctgagggacc

SEQ ID NO: 53953 - DNA, 20 bp, synthetic construct
  misc_feature 1..20: note = CRISPR gRNA sequence
  source 1..20: mol_type = other DNA
cgtggacctctgagggacca

SEQ ID NO: 53954 - DNA, 20 bp, synthetic construct
  misc_feature 1..20: note = CRISPR gRNA sequence
  source 1..20: mol_type = other DNA
gtggacctctgagggaccag

SEQ ID NO: 53955 - DNA, 20 bp, synthetic construct
  misc_feature 1..20: note = CRISPR gRNA sequence
  source 1..20: mol_type = other DNA
acctctgagggaccaggggt

SEQ ID NO: 53956 - DNA, 20 bp, synthetic construct
  misc_feature 1..20: note = CRISPR gRNA sequence
  source 1..20: mol_type = other DNA
gggaccaggggtgagcctcc

SEQ ID NO: 53957 - DNA, 20 bp, synthetic construct
  misc_feature 1..20: note = CRISPR gRNA sequence
  source 1..20: mol_type = other DNA
gggtgagcctccgagcgtgt

SEQ ID NO: 53958 - DNA, 20 bp, synthetic construct
  misc_feature 1..20: note = CRISPR gRNA sequence
  source 1..20: mol_type = other DNA
gcctccgagcgtgtcagaca

SEQ ID NO: 53959 - DNA, 20 bp, synthetic construct
  misc_feature 1..20: note = CRISPR gRNA sequence
  source 1..20: mol_type = other DNA
cctccgagcgtgtcagacat

SEQ ID NO: 53960 - DNA, 20 bp, synthetic construct
  misc_feature 1..20: note = CRISPR gRNA sequence
  source 1..20: mol_type = other DNA
ctccgagcgtgtcagacatg

SEQ ID NO: 53961 - DNA, 20 bp, synthetic construct
  misc_feature 1..20: note = CRISPR gRNA sequence
  source 1..20: mol_type = other DNA
tccgagcgtgtcagacatgg

SEQ ID NO: 53962 - DNA, 20 bp, synthetic construct
  misc_feature 1..20: note = CRISPR gRNA sequence
  source 1..20: mol_type = other DNA
gacatgggggatctgtatct

SEQ ID NO: 53963 - DNA, 20 bp, synthetic construct
  misc_feature 1..20: note = CRISPR gRNA sequence
  source 1..20: mol_type = other DNA
acatgggggatctgtatctt

SEQ ID NO: 53964 - DNA, 20 bp, synthetic construct
  misc_feature 1..20: note = CRISPR gRNA sequence
  source 1..20: mol_type = other DNA
atgggggatctgtatcttgg

SEQ ID NO: 53965 - DNA, 20 bp, synthetic construct
  misc_feature 1..20: note = CRISPR gRNA sequence
  source 1..20: mol_type = other DNA
tgggggatctgtatcttggg

SEQ ID NO: 53966 - DNA, 20 bp, synthetic construct
  misc_feature 1..20: note = CRISPR gRNA sequence
  source 1..20: mol_type = other DNA
gggatctgtatcttgggagg

SEQ ID NO: 53967 - DNA, 20 bp, synthetic construct
  misc_feature 1..20: note = CRISPR gRNA sequence
  source 1..20: mol_type = other DNA
gatctgtatcttgggaggaa

SEQ ID NO: 53968 - DNA, 20 bp, synthetic construct
  misc_feature 1..20: note = CRISPR gRNA sequence
  source 1..20: mol_type = other DNA
ggaagagtcacaactttcac

SEQ ID NO: 53969 - DNA, 20 bp, synthetic construct
  misc_feature 1..20: note = CRISPR gRNA sequence
  source 1..20: mol_type = other DNA
caactttcaccagattctcc

SEQ ID NO: 53970 - DNA, 20 bp, synthetic construct
  misc_feature 1..20: note = CRISPR gRNA sequence
  source 1..20: mol_type = other DNA
aactttcaccagattctcca

SEQ ID NO: 53971 - DNA, 20 bp, synthetic construct
  misc_feature 1..20: note = CRISPR gRNA sequence
  source 1..20: mol_type = other DNA
actttcaccagattctccaa

SEQ ID NO: 53972 - DNA, 20 bp, synthetic construct
  misc_feature 1..20: note = CRISPR gRNA sequence
  source 1..20: mol_type = other DNA
ctttcaccagattctccaag

SEQ ID NO: 53973 - DNA, 20 bp, synthetic construct
  misc_feature 1..20: note = CRISPR gRNA sequence
  source 1..20: mol_type = other DNA
ctccaaggggtttctgactt

SEQ ID NO: 53974 - DNA, 20 bp, synthetic construct
  misc_feature 1..20: note = CRISPR gRNA sequence
  source 1..20: mol_type = other DNA
caaggggtttctgacttcag

SEQ ID NO: 53975 - DNA, 20 bp, synthetic construct
  misc_feature 1..20: note = CRISPR gRNA sequence
  source 1..20: mol_type = other DNA
aaggggtttctgacttcagc

SEQ ID NO: 53976 - DNA, 20 bp, synthetic construct
  misc_feature 1..20: note = CRISPR gRNA sequence
  source 1..20: mol_type = other DNA
aggggtttctgacttcagca

SEQ ID NO: 53977 - DNA, 20 bp, synthetic construct
  misc_feature 1..20: note = CRISPR gRNA sequence
  source 1..20: mol_type = other DNA
gtttctgacttcagcaggga

SEQ ID NO: 53978 - DNA, 20 bp, synthetic construct
  misc_feature 1..20: note = CRISPR gRNA sequence
  source 1..20: mol_type = other DNA
tgacttcagcagggaaagaa

SEQ ID NO: 53979 - DNA, 20 bp, synthetic construct
  misc_feature 1..20: note = CRISPR gRNA sequence
  source 1..20: mol_type = other DNA
caacactaactcactgtaat

SEQ ID NO: 53980 - DNA, 20 bp, synthetic construct
  misc_feature 1..20: note = CRISPR gRNA sequence
  source 1..20: mol_type = other DNA
aacacacaaaccactcactc

SEQ ID NO: 53981 - DNA, 20 bp, synthetic construct
  misc_feature 1..20: note = CRISPR gRNA sequence
  source 1..20: mol_type = other DNA
acacacaaaccactcactcg

SEQ ID NO: 53982 - DNA, 20 bp, synthetic construct
  misc_feature 1..20: note = CRISPR gRNA sequence
  source 1..20: mol_type = other DNA
cacaaaccactcactcgagg

SEQ ID NO: 53983 - DNA, 20 bp, synthetic construct
  misc_feature 1..20: note = CRISPR gRNA sequence
  source 1..20: mol_type = other DNA
caaaccactcactcgaggtg

SEQ ID NO: 53984 - DNA, 20 bp, synthetic construct
  misc_feature 1..20: note = CRISPR gRNA sequence
  source 1..20: mol_type = other DNA
aaaccactcactcgaggtgg

SEQ ID NO: 53985 - DNA, 20 bp, synthetic construct
  misc_feature 1..20: note = CRISPR gRNA sequence
  source 1..20: mol_type = other DNA
cactcgaggtggaggtgacc

SEQ ID NO: 53986 - DNA, 20 bp, synthetic construct
  misc_feature 1..20: note = CRISPR gRNA sequence
  source 1..20: mol_type = other DNA
actcgaggtggaggtgaccg

SEQ ID NO: 53987 - DNA, 20 bp, synthetic construct
  misc_feature 1..20: note = CRISPR gRNA sequence
  source 1..20: mol_type = other DNA
cgaggtggaggtgaccgagg

SEQ ID NO: 53988 - DNA, 20 bp, synthetic construct
  misc_feature 1..20: note = CRISPR gRNA sequence
  source 1..20: mol_type = other DNA
ggtggaggtgaccgaggtgg

SEQ ID NO: 53989 - DNA, 20 bp, synthetic construct
  misc_feature 1..20: note = CRISPR gRNA sequence
  source 1..20: mol_type = other DNA
ccgaggtggcagcttcctcc

SEQ ID NO: 53990 - DNA, 20 bp, synthetic construct
  misc_feature 1..20: note = CRISPR gRNA sequence
  source 1..20: mol_type = other DNA
gaggtggcagcttcctccca

SEQ ID NO: 53991 - DNA, 20 bp, synthetic construct
  misc_feature 1..20: note = CRISPR gRNA sequence
  source 1..20: mol_type = other DNA
agcttcctcccagagccttg

SEQ ID NO: 53992 - DNA, 20 bp, synthetic construct
  misc_feature 1..20: note = CRISPR gRNA sequence
  source 1..20: mol_type = other DNA
cttcctcccagagccttgca

SEQ ID NO: 53993 - DNA, 20 bp, synthetic construct
  misc_feature 1..20: note = CRISPR gRNA sequence
  source 1..20: mol_type = other DNA
agagccttgcagagctgctc

SEQ ID NO: 53994 - DNA, 20 bp, synthetic construct
  misc_feature 1..20: note = CRISPR gRNA sequence
  source 1..20: mol_type = other DNA
gagccttgcagagctgctct

SEQ ID NO: 53995 - DNA, 20 bp, synthetic construct
  misc_feature 1..20: note = CRISPR gRNA sequence
  source 1..20: mol_type = other DNA
gctgctctaggtgcttttct

SEQ ID NO: 53996 - DNA, 20 bp, synthetic construct
  misc_feature 1..20: note = CRISPR gRNA sequence
  source 1..20: mol_type = other DNA
tgctctaggtgcttttcttg

SEQ ID NO: 53997 - DNA, 20 bp, synthetic construct
  misc_feature 1..20: note = CRISPR gRNA sequence
  source 1..20: mol_type = other DNA
gctctaggtgcttttcttgg

SEQ ID NO: 53998 - DNA, 20 bp, synthetic construct
  misc_feature 1..20: note = CRISPR gRNA sequence
  source 1..20: mol_type = other DNA
tcttggaggccacaatgtgt

SEQ ID NO: 53999 - DNA, 20 bp, synthetic construct
  misc_feature 1..20: note = CRISPR gRNA sequence
  source 1..20: mol_type = other DNA
ccacaatgtgtcagcctgcc

SEQ ID NO: 54000 - DNA, 20 bp, synthetic construct
  misc_feature 1..20: note = CRISPR gRNA sequence
  source 1..20: mol_type = other DNA
cacaatgtgtcagcctgccc

SEQ ID NO: 54001 - DNA, 20 bp, synthetic construct
  misc_feature 1..20: note = CRISPR gRNA sequence
  source 1..20: mol_type = other DNA
acaatgtgtcagcctgccca

SEQ ID NO: 54002 - DNA, 20 bp, synthetic construct
  misc_feature 1..20: note = CRISPR gRNA sequence
  source 1..20: mol_type = other DNA
cctgcccagggacaaaaaca

SEQ ID NO: 54003 - DNA, 20 bp, synthetic construct
  misc_feature 1..20: note = CRISPR gRNA sequence
  source 1..20: mol_type = other DNA
gtgctgcatgccccactgaa

SEQ ID NO: 54004 - DNA, 20 bp, synthetic construct
  misc_feature 1..20: note = CRISPR gRNA sequence
  source 1..20: mol_type = other DNA
gctgcatgccccactgaaca

SEQ ID NO: 54005 - DNA, 20 bp, synthetic construct
  misc_feature 1..20: note = CRISPR gRNA sequence
  source 1..20: mol_type = other DNA
ctgcatgccccactgaacag

SEQ ID NO: 54006 - DNA, 20 bp, synthetic construct
  misc_feature 1..20: note = CRISPR gRNA sequence
  source 1..20: mol_type = other DNA
catgccccactgaacagagg

SEQ ID NO: 54007 - DNA, 20 bp, synthetic construct
  misc_feature 1..20: note = CRISPR gRNA sequence
  source 1..20: mol_type = other DNA
atgccccactgaacagaggc

SEQ ID NO: 54008 - DNA, 20 bp, synthetic construct
  misc_feature 1..20: note = CRISPR gRNA sequence
  source 1..20: mol_type = other DNA
ccccactgaacagaggcggg

SEQ ID NO: 54009 - DNA, 20 bp, synthetic construct
  misc_feature 1..20: note = CRISPR gRNA sequence
  source 1..20: mol_type = other DNA
cccactgaacagaggcggga

SEQ ID NO: 54010 - DNA, 20 bp, synthetic construct
  misc_feature 1..20: note = CRISPR gRNA sequence
  source 1..20: mol_type = other DNA
cactgaacagaggcgggaag

SEQ ID NO: 54011 - DNA, 20 bp, synthetic construct
  misc_feature 1..20: note = CRISPR gRNA sequence
  source 1..20: mol_type = other DNA
ggagccgctttcccaccccc

SEQ ID NO: 54012 - DNA, 20 bp, synthetic construct
  misc_feature 1..20: note = CRISPR gRNA sequence
  source 1..20: mol_type = other DNA
gctttcccaccccccagaca

SEQ ID NO: 54013 - DNA, 20 bp, synthetic construct
  misc_feature 1..20: note = CRISPR gRNA sequence
  source 1..20: mol_type = other DNA
tttcccaccccccagacaca

SEQ ID NO: 54014 - DNA, 20 bp, synthetic construct
  misc_feature 1..20: note = CRISPR gRNA sequence
  source 1..20: mol_type = other DNA
ttcccaccccccagacacag

SEQ ID NO: 54015 - DNA, 20 bp, synthetic construct
  misc_feature 1..20: note = CRISPR gRNA sequence
  source 1..20: mol_type = other DNA
ccaccccccagacacagagg

SEQ ID NO: 54016 - DNA, 20 bp, synthetic construct
  misc_feature 1..20: note = CRISPR gRNA sequence
  source 1..20: mol_type = other DNA
accccccagacacagaggca

SEQ ID NO: 54017 - DNA, 20 bp, synthetic construct
  misc_feature 1..20: note = CRISPR gRNA sequence
  source 1..20: mol_type = other DNA
cagacacagaggcagagaat

SEQ ID NO: 54018 - DNA, 20 bp, synthetic construct
  misc_feature 1..20: note = CRISPR gRNA sequence
  source 1..20: mol_type = other DNA
agacacagaggcagagaatg

SEQ ID NO: 54019 - DNA, 20 bp, synthetic construct
  misc_feature 1..20: note = CRISPR gRNA sequence
  source 1..20: mol_type = other DNA
gaggcagagaatgaggcttg

SEQ ID NO: 54020 - DNA, 20 bp, synthetic construct
  misc_feature 1..20: note = CRISPR gRNA sequence
  source 1..20: mol_type = other DNA
aggcagagaatgaggcttgc

SEQ ID NO: 54021 - DNA, 20 bp, synthetic construct
  misc_feature 1..20: note = CRISPR gRNA sequence
  source 1..20: mol_type = other DNA
gcagagaatgaggcttgcag

SEQ ID NO: 54022 - DNA, 20 bp, synthetic construct
  misc_feature 1..20: note = CRISPR gRNA sequence
  source 1..20: mol_type = other DNA
agagaatgaggcttgcagga

SEQ ID NO: 54023 - DNA, 20 bp, synthetic construct
  misc_feature 1..20: note = CRISPR gRNA sequence
  source 1..20: mol_type = other DNA
gagaatgaggcttgcaggag

SEQ ID NO: 54024 - DNA, 20 bp, synthetic construct
  misc_feature 1..20: note = CRISPR gRNA sequence
  source 1..20: mol_type = other DNA
gaatgaggcttgcaggagag

SEQ ID NO: 54025 - DNA, 20 bp, synthetic construct
  misc_feature 1..20: note = CRISPR gRNA sequence
  source 1..20: mol_type = other DNA
aatgaggcttgcaggagagg

SEQ ID NO: 54026 - DNA, 20 bp, synthetic construct
  misc_feature 1..20: note = CRISPR gRNA sequence
  source 1..20: mol_type = other DNA
atgaggcttgcaggagagga

SEQ ID NO: 54027 - DNA, 20 bp, synthetic construct
  misc_feature 1..20: note = CRISPR gRNA sequence
  source 1..20: mol_type = other DNA
gcttgcaggagaggagggac

SEQ ID NO: 54028 - DNA, 20 bp, synthetic construct
  misc_feature 1..20: note = CRISPR gRNA sequence
  source 1..20: mol_type = other DNA
cttgcaggagaggagggact

SEQ ID NO: 54029 - DNA, 20 bp, synthetic construct
  misc_feature 1..20: note = CRISPR gRNA sequence
  source 1..20: mol_type = other DNA
aggagggactgggatgtatc

SEQ ID NO: 54030 - DNA, 20 bp, synthetic construct
  misc_feature 1..20: note = CRISPR gRNA sequence
  source 1..20: mol_type = other DNA
actgggatgtatctggcacc

SEQ ID NO: 54031 - DNA, 20 bp, synthetic construct
  misc_feature 1..20: note = CRISPR gRNA sequence
  source 1..20: mol_type = other DNA
ggatgtatctggcacctaga

SEQ ID NO: 54032 - DNA, 20 bp, synthetic construct
  misc_feature 1..20: note = CRISPR gRNA sequence
  source 1..20: mol_type = other DNA
gtatctggcacctagacaga

SEQ ID NO: 54033 - DNA, 20 bp, synthetic construct
  misc_feature 1..20: note = CRISPR gRNA sequence
  source 1..20: mol_type = other DNA
ggcacctagacagacggaca

SEQ ID NO: 54034 - DNA, 20 bp, synthetic construct
  misc_feature 1..20: note = CRISPR gRNA sequence
  source 1..20: mol_type = other DNA
cacctagacagacggacaaa

SEQ ID NO: 54035 - DNA, 20 bp, synthetic construct
  misc_feature 1..20: note = CRISPR gRNA sequence
  source 1..20: mol_type = other DNA
acctagacagacggacaaag

SEQ ID NO: 54036 - DNA, 20 bp, synthetic construct
  misc_feature 1..20: note = CRISPR gRNA sequence
  source 1..20: mol_type = other DNA
cctagacagacggacaaaga

SEQ ID NO: 54037 - DNA, 20 bp, synthetic construct
  misc_feature 1..20: note = CRISPR gRNA sequence
  source 1..20: mol_type = other DNA
accaacacacacgacaccca

SEQ ID NO: 54038 - DNA, 20 bp, synthetic construct
  misc_feature 1..20: note = CRISPR gRNA sequence
  source 1..20: mol_type = other DNA
ccaacacacacgacacccac

SEQ ID NO: 54039 - DNA, 20 bp, synthetic construct
  misc_feature 1..20: note = CRISPR gRNA sequence
  source 1..20: mol_type = other DNA
cacccacaggatgtcacata

SEQ ID NO: 54040 - DNA, 20 bp, synthetic construct
  misc_feature 1..20: note = CRISPR gRNA sequence
  source 1..20: mol_type = other DNA
acccacaggatgtcacatat

SEQ ID NO: 54041 - DNA, 20 bp, synthetic construct
  misc_feature 1..20: note = CRISPR gRNA sequence
  source 1..20: mol_type = other DNA
cacaggatgtcacatatagg

SEQ ID NO: 54042 - DNA, 20 bp, synthetic construct
  misc_feature 1..20: note = CRISPR gRNA sequence
  source 1..20: mol_type = other DNA
caggatgtcacatataggca

SEQ ID NO: 54043 - DNA, 20 bp, synthetic construct
  misc_feature 1..20: note = CRISPR gRNA sequence
  source 1..20: mol_type = other DNA
aggatgtcacatataggcag

SEQ ID NO: 54044 - DNA, 20 bp, synthetic construct
  misc_feature 1..20: note = CRISPR gRNA sequence
  source 1..20: mol_type = other DNA
ggatgtcacatataggcaga

SEQ ID NO: 54045 - DNA, 20 bp, synthetic construct
  misc_feature 1..20: note = CRISPR gRNA sequence
  source 1..20: mol_type = other DNA
tgtcacatataggcagaggg

SEQ ID NO: 54046 - DNA, 20 bp, synthetic construct
  misc_feature 1..20: note = CRISPR gRNA sequence
  source 1..20: mol_type = other DNA
gtcacatataggcagagggt

SEQ ID NO: 54047 - DNA, 20 bp, synthetic construct
  misc_feature 1..20: note = CRISPR gRNA sequence
  source 1..20: mol_type = other DNA
acatataggcagagggtggg

SEQ ID NO: 54048 - DNA, 20 bp, synthetic construct
  misc_feature 1..20: note = CRISPR gRNA sequence
  source 1..20: mol_type = other DNA
atataggcagagggtgggca

SEQ ID NO: 54049 - DNA, 20 bp, synthetic construct
  misc_feature 1..20: note = CRISPR gRNA sequence
  source 1..20: mol_type = other DNA
gcagagggtgggcagagaca

SEQ ID NO: 54050 - DNA, 20 bp, synthetic construct
  misc_feature 1..20: note = CRISPR gRNA sequence
  source 1..20: mol_type = other DNA
agggtgggcagagacacaga

SEQ ID NO: 54051 - DNA, 20 bp, synthetic construct
  misc_feature 1..20: note = CRISPR gRNA sequence
  source 1..20: mol_type = other DNA
gtgggcagagacacagatgg

SEQ ID NO: 54052 - DNA, 20 bp, synthetic construct
  misc_feature 1..20: note = CRISPR gRNA sequence
  source 1..20: mol_type = other DNA
tgggcagagacacagatgga

SEQ ID NO: 54053 - DNA, 20 bp, synthetic construct
  misc_feature 1..20: note = CRISPR gRNA sequence
  source 1..20: mol_type = other DNA
gacacagatggaaggaaacc

SEQ ID NO: 54054 - DNA, 20 bp, synthetic construct
  misc_feature 1..20: note = CRISPR gRNA sequence
  source 1..20: mol_type = other DNA
acacagatggaaggaaacca

SEQ ID NO: 54055 - DNA, 20 bp, synthetic construct
  misc_feature 1..20: note = CRISPR gRNA sequence
  source 1..20: mol_type = other DNA
gatggaaggaaaccaaggca

SEQ ID NO: 54056 - DNA, 20 bp, synthetic construct
  misc_feature 1..20: note = CRISPR gRNA sequence
  source 1..20: mol_type = other DNA
tggaaggaaaccaaggcaca

SEQ ID NO: 54057 - DNA, 20 bp, synthetic construct
  misc_feature 1..20: note = CRISPR gRNA sequence
  source 1..20: mol_type = other DNA
aaaccaaggcacagagacct

SEQ ID NO: 54058 - DNA, 20 bp, synthetic construct
  misc_feature 1..20: note = CRISPR gRNA sequence
  source 1..20: mol_type = other DNA
accaaggcacagagacctca

SEQ ID NO: 54059 - DNA, 20 bp, synthetic construct
  misc_feature 1..20: note = CRISPR gRNA sequence
  source 1..20: mol_type = other DNA
caaggcacagagacctcaga

SEQ ID NO: 54060 - DNA, 20 bp, synthetic construct
  misc_feature 1..20: note = CRISPR gRNA sequence
  source 1..20: mol_type = other DNA
aggcacagagacctcagaga

SEQ ID NO: 54061 - DNA, 20 bp, synthetic construct
  misc_feature 1..20: note = CRISPR gRNA sequence
  source 1..20: mol_type = other DNA
gcacagagacctcagagaga

SEQ ID NO: 54062 - DNA, 20 bp, synthetic construct
  misc_feature 1..20: note = CRISPR gRNA sequence
  source 1..20: mol_type = other DNA
acagagacctcagagagaga

SEQ ID NO: 54063 - DNA, 20 bp, synthetic construct
  misc_feature 1..20: note = CRISPR gRNA sequence
  source 1..20: mol_type = other DNA
gagacctcagagagagagag

SEQ ID NO: 54064 - DNA, 20 bp, synthetic construct
  misc_feature 1..20: note = CRISPR gRNA sequence
  source 1..20: mol_type = other DNA
ctcagagagagagagcagat

SEQ ID NO: 54065 - DNA, 20 bp, synthetic construct
  misc_feature 1..20: note = CRISPR gRNA sequence
  source 1..20: mol_type = other DNA
cagagagagagagcagatca

SEQ ID NO: 54066 - DNA, 20 bp, synthetic construct
  misc_feature 1..20: note = CRISPR gRNA sequence
  source 1..20: mol_type = other DNA
agagagagagagcagatcag

SEQ ID NO: 54067 - DNA, 20 bp, synthetic construct
  misc_feature 1..20: note = CRISPR gRNA sequence
  source 1..20: mol_type = other DNA
gagagagagcagatcagagg

SEQ ID NO: 54068 - DNA, 20 bp, synthetic construct
  misc_feature 1..20: note = CRISPR gRNA sequence
  source 1..20: mol_type = other DNA
gagagcagatcagaggaaga

SEQ ID NO: 54069 - DNA, 20 bp, synthetic construct
  misc_feature 1..20: note = CRISPR gRNA sequence
  source 1..20: mol_type = other DNA
cagatcagaggaagacagat

SEQ ID NO: 54070 - DNA, 20 bp, synthetic construct
  misc_feature 1..20: note = CRISPR gRNA sequence
  source 1..20: mol_type = other DNA
gacagataagactgaaataa

SEQ ID NO: 54071 - DNA, 20 bp, synthetic construct
  misc_feature 1..20: note = CRISPR gRNA sequence
  source 1..20: mol_type = other DNA
agttaaataaactgataaaa

SEQ ID NO: 54072 - DNA, 20 bp, synthetic construct
  misc_feature 1..20: note = CRISPR gRNA sequence
  source 1..20: mol_type = other DNA
ataaaacagaaatacacgat

SEQ ID NO: 54073 - DNA, 20 bp, synthetic construct
  misc_feature 1..20: note = CRISPR gRNA sequence
  source 1..20: mol_type = other DNA
aaaacagaaatacacgatga

SEQ ID NO: 54074 - DNA, 20 bp, synthetic construct
  misc_feature 1..20: note = CRISPR gRNA sequence
  source 1..20: mol_type = other DNA
aacagaaatacacgatgaga

SEQ ID NO: 54075 - DNA, 20 bp, synthetic construct
  misc_feature 1..20: note = CRISPR gRNA sequence
  source 1..20: mol_type = other DNA
acagaaatacacgatgagag

SEQ ID NO: 54076 - DNA, 20 bp, synthetic construct
  misc_feature 1..20: note = CRISPR gRNA sequence
  source 1..20: mol_type = other DNA
cagaaatacacgatgagaga

SEQ ID NO: 54077 - DNA, 20 bp, synthetic construct
  misc_feature 1..20: note = CRISPR gRNA sequence
  source 1..20: mol_type = other DNA
aaatacacgatgagagaggg

SEQ ID NO: 54078 - DNA, 20 bp, synthetic construct
  misc_feature 1..20: note = CRISPR gRNA sequence
  source 1..20: mol_type = other DNA
cgatgagagagggaagaaat

SEQ ID NO: 54079 - DNA, 20 bp, synthetic construct
  misc_feature 1..20: note = CRISPR gRNA sequence
  source 1..20: mol_type = other DNA
atgagagagggaagaaatga

SEQ ID NO: 54080 - DNA, 20 bp, synthetic construct
  misc_feature 1..20: note = CRISPR gRNA sequence
  source 1..20: mol_type = other DNA
gagggaagaaatgagagaaa

SEQ ID NO: 54081 - DNA, 20 bp, synthetic construct
  misc_feature 1..20: note = CRISPR gRNA sequence
  source 1..20: mol_type = other DNA
agggaagaaatgagagaaac

SEQ ID NO: 54082 - DNA, 20 bp, synthetic construct
  misc_feature 1..20: note = CRISPR gRNA sequence
  source 1..20: mol_type = other DNA
gaagaaatgagagaaacagg

SEQ ID NO: 54083 - DNA, 20 bp, synthetic construct
  misc_feature 1..20: note = CRISPR gRNA sequence
  source 1..20: mol_type = other DNA
agaaatgagagaaacaggca

SEQ ID NO: 54084 - DNA, 20 bp, synthetic construct
  misc_feature 1..20: note = CRISPR gRNA sequence
  source 1..20: mol_type = other DNA
gaaatgagagaaacaggcag

SEQ ID NO: 54085 - DNA, 20 bp, synthetic construct
  misc_feature 1..20: note = CRISPR gRNA sequence
  source 1..20: mol_type = other DNA
aaatgagagaaacaggcaga

SEQ ID NO: 54086 - DNA, 20 bp, synthetic construct
  misc_feature 1..20: note = CRISPR gRNA sequence
  source 1..20: mol_type = other DNA
gagagaaacaggcagaggga

SEQ ID NO: 54087 - DNA, 20 bp, synthetic construct
  misc_feature 1..20: note = CRISPR gRNA sequence
  source 1..20: mol_type = other DNA
gagaaacaggcagagggaca

SEQ ID NO: 54088 - DNA, 20 bp, synthetic construct
  misc_feature 1..20: note = CRISPR gRNA sequence
  source 1..20: mol_type = other DNA
agaaacaggcagagggacag

SEQ ID NO: 54089 - DNA, 20 bp, synthetic construct
  misc_feature 1..20: note = CRISPR gRNA sequence
  source 1..20: mol_type = other DNA
gaaacaggcagagggacaga

SEQ ID NO: 54090 - DNA, 20 bp, synthetic construct
  misc_feature 1..20: note = CRISPR gRNA sequence
  source 1..20: mol_type = other DNA
aacaggcagagggacagagg

SEQ ID NO: 54091 - DNA, 20 bp, synthetic construct
  misc_feature 1..20: note = CRISPR gRNA sequence
  source 1..20: mol_type = other DNA
gcagagggacagagggagat

SEQ ID NO: 54092 - DNA, 20 bp, synthetic construct
  misc_feature 1..20: note = CRISPR gRNA sequence
  source 1..20: mol_type = other DNA
cagagggacagagggagatt

SEQ ID NO: 54093 - DNA, 20 bp, synthetic construct
  misc_feature 1..20: note = CRISPR gRNA sequence
  source 1..20: mol_type = other DNA
gggacagagggagattagga

SEQ ID NO: 54094 - DNA, 20 bp, synthetic construct
  misc_feature 1..20: note = CRISPR gRNA sequence
  source 1..20: mol_type = other DNA
gagggagattaggacagaca

SEQ ID NO: 54095 - DNA, 20 bp, synthetic construct
  misc_feature 1..20: note = CRISPR gRNA sequence
  source 1..20: mol_type = other DNA
gattaggacagacaaagacc

SEQ ID NO: 54096 - DNA, 20 bp, synthetic construct
  misc_feature 1..20: note = CRISPR gRNA sequence
  source 1..20: mol_type = other DNA
ttaggacagacaaagaccaa

SEQ ID NO: 54097 - DNA, 20 bp, synthetic construct
  misc_feature 1..20: note = CRISPR gRNA sequence
  source 1..20: mol_type = other DNA
aggacagacaaagaccaaga

SEQ ID NO: 54098 - DNA, 20 bp, synthetic construct
  misc_feature 1..20: note = CRISPR gRNA sequence
  source 1..20: mol_type = other DNA
acagacaaagaccaagagag

SEQ ID NO: 54099 - DNA, 20 bp, synthetic construct
  misc_feature 1..20: note = CRISPR gRNA sequence
  source 1..20: mol_type = other DNA
cagacaaagaccaagagaga

SEQ ID NO: 54100 - DNA, 20 bp, synthetic construct
  misc_feature 1..20: note = CRISPR gRNA sequence
  source 1..20: mol_type = other DNA
agacaaagaccaagagagaa

SEQ ID NO: 54101 - DNA, 20 bp, synthetic construct
  misc_feature 1..20: note = CRISPR gRNA sequence
  source 1..20: mol_type = other DNA
gacaaagaccaagagagaag

SEQ ID NO: 54102 - DNA, 20 bp, synthetic construct
  misc_feature 1..20: note = CRISPR gRNA sequence
  source 1..20: mol_type = other DNA
acaaagaccaagagagaagg

SEQ ID NO: 54103 - DNA, 20 bp, synthetic construct
  misc_feature 1..20: note = CRISPR gRNA sequence
  source 1..20: mol_type = other DNA
caaagaccaagagagaaggg

SEQ ID NO: 54104 - DNA, 20 bp, synthetic construct
  misc_feature 1..20: note = CRISPR gRNA sequence
  source 1..20: mol_type = other DNA
agaccaagagagaagggggg

SEQ ID NO: 54105 - DNA, 20 bp, synthetic construct
  misc_feature 1..20: note = CRISPR gRNA sequence
  source 1..20: mol_type = other DNA
accaagagagaaggggggaa

SEQ ID NO: 54106 - DNA, 20 bp, synthetic construct
  misc_feature 1..20: note = CRISPR gRNA sequence
  source 1..20: mol_type = other DNA
gaaggggggaagagtgctga

SEQ ID NO: 54107 - DNA, 20 bp, synthetic construct
  misc_feature 1..20: note = CRISPR gRNA sequence
  source 1..20: mol_type = other DNA
aaggggggaagagtgctgat

SEQ ID NO: 54108 - DNA, 20 bp, synthetic construct
  misc_feature 1..20: note = CRISPR gRNA sequence
  source 1..20: mol_type = other DNA
ggggggaagagtgctgatgg

SEQ ID NO: 54109 - DNA, 20 bp, synthetic construct
  misc_feature 1..20: note = CRISPR gRNA sequence
  source 1..20: mol_type = other DNA
agagtgctgatgggagcccc

SEQ ID NO: 54110 - DNA, 20 bp, synthetic construct
  misc_feature 1..20: note = CRISPR gRNA sequence
  source 1..20: mol_type = other DNA
gagtgctgatgggagccccc

SEQ ID NO: 54111 - DNA, 20 bp, synthetic construct
  misc_feature 1..20: note = CRISPR gRNA sequence
  source 1..20: mol_type = other DNA
ctgatgggagcccccaggcc

SEQ ID NO: 54112 - DNA, 20 bp, synthetic construct
  misc_feature 1..20: note = CRISPR gRNA sequence
  source 1..20: mol_type = other DNA
tgatgggagcccccaggccc

SEQ ID NO: 54113 - DNA, 20 bp, synthetic construct
  misc_feature 1..20: note = CRISPR gRNA sequence
  source 1..20: mol_type = other DNA
gagcccccaggcccaggcac

SEQ ID NO: 54114 - DNA, 20 bp, synthetic construct
  misc_feature 1..20: note = CRISPR gRNA sequence
  source 1..20: mol_type = other DNA
agcccccaggcccaggcacc

SEQ ID NO: 54115 - DNA, 20 bp, synthetic construct
  misc_feature 1..20: note = CRISPR gRNA sequence
  source 1..20: mol_type = other DNA
cccaggcaccaggatcatga

SEQ ID NO: 54116 - DNA, 20 bp, synthetic construct
  misc_feature 1..20: note = CRISPR gRNA sequence
  source 1..20: mol_type = other DNA
aggcaccaggatcatgacag

SEQ ID NO: 54117 - DNA, 20 bp, synthetic construct
  misc_feature 1..20: note = CRISPR gRNA sequence
  source 1..20: mol_type = other DNA
ggcaccaggatcatgacaga

SEQ ID NO: 54118 - DNA, 20 bp, synthetic construct
  misc_feature 1..20: note = CRISPR gRNA sequence
  source 1..20: mol_type = other DNA
caccaggatcatgacagaag

SEQ ID NO: 54119 - DNA, 20 bp, synthetic construct
  misc_feature 1..20: note = CRISPR gRNA sequence
  source 1..20: mol_type = other DNA
ggatcatgacagaaggagcc

SEQ ID NO: 54120 - DNA, 20 bp, synthetic construct
  misc_feature 1..20: note = CRISPR gRNA sequence
  source 1..20: mol_type = other DNA
tgctccccttcacctctttt

SEQ ID NO: 54121 - DNA, 20 bp, synthetic construct
  misc_feature 1..20: note = CRISPR gRNA sequence
  source 1..20: mol_type = other DNA
ctccccttcacctcttttca

SEQ ID NO: 54122 - DNA, 20 bp, synthetic construct
  misc_feature 1..20: note = CRISPR gRNA sequence
  source 1..20: mol_type = other DNA
tcagagtctccacaacccct

SEQ ID NO: 54123 - DNA, 20 bp, synthetic construct
  misc_feature 1..20: note = CRISPR gRNA sequence
  source 1..20: mol_type = other DNA
ctccacaacccctcagctgc

SEQ ID NO: 54124 - DNA, 20 bp, synthetic construct
  misc_feature 1..20: note = CRISPR gRNA sequence
  source 1..20: mol_type = other DNA
tccacaacccctcagctgct

SEQ ID NO: 54125 - DNA, 20 bp, synthetic construct
  misc_feature 1..20: note = CRISPR gRNA sequence
  source 1..20: mol_type = other DNA
ccacaacccctcagctgctg

SEQ ID NO: 54126 - DNA, 20 bp, synthetic construct
  misc_feature 1..20: note = CRISPR gRNA sequence
  source 1..20: mol_type = other DNA
cacaacccctcagctgctgg

SEQ ID NO: 54127 - DNA, 20 bp, synthetic construct
  misc_feature 1..20: note = CRISPR gRNA sequence
  source 1..20: mol_type = other DNA
acccctcagctgctgggggt

SEQ ID NO: 54128 - DNA, 20 bp, synthetic construct
  misc_feature 1..20: note = CRISPR gRNA sequence
  source 1..20: mol_type = other DNA
cccctcagctgctgggggtc

SEQ ID NO: 54129 - DNA, 20 bp, synthetic construct
  misc_feature 1..20: note = CRISPR gRNA sequence
  source 1..20: mol_type = other DNA
ccctcagctgctgggggtca

SEQ ID NO: 54130 - DNA, 20 bp, synthetic construct
  misc_feature 1..20: note = CRISPR gRNA sequence
  source 1..20: mol_type = other DNA
ctcagctgctgggggtcagg

SEQ ID NO: 54131 - DNA, 20 bp, synthetic construct
  misc_feature 1..20: note = CRISPR gRNA sequence
  source 1..20: mol_type = other DNA
ctgctgggggtcagggagct

SEQ ID NO: 54132 - DNA, 20 bp, synthetic construct
  misc_feature 1..20: note = CRISPR gRNA sequence
  source 1..20: mol_type = other DNA
tgctgggggtcagggagcta

SEQ ID NO: 54133 - DNA, 20 bp, synthetic construct
  misc_feature 1..20: note = CRISPR gRNA sequence
  source 1..20: mol_type = other DNA
gctgggggtcagggagctaa

SEQ ID NO: 54134 - DNA, 20 bp, synthetic construct
  misc_feature 1..20: note = CRISPR gRNA sequence
  source 1..20: mol_type = other DNA
ctgggggtcagggagctaag

SEQ ID NO: 54135 - DNA, 20 bp, synthetic construct
  misc_feature 1..20: note = CRISPR gRNA sequence
  source 1..20: mol_type = other DNA
gggggtcagggagctaaggg

SEQ ID NO: 54136 - DNA, 20 bp, synthetic construct
  misc_feature 1..20: note = CRISPR gRNA sequence
  source 1..20: mol_type = other DNA
ggtcagggagctaaggggag

SEQ ID NO: 54137 - DNA, 20 bp, synthetic construct
  misc_feature 1..20: note = CRISPR gRNA sequence
  source 1..20: mol_type = other DNA
gtcagggagctaaggggagt

SEQ ID NO: 54138 - DNA, 20 bp, synthetic construct
  misc_feature 1..20: note = CRISPR gRNA sequence
  source 1..20: mol_type = other DNA
tcagggagctaaggggagtg

SEQ ID NO: 54139 - DNA, 20 bp, synthetic construct
  misc_feature 1..20: note = CRISPR gRNA sequence
  source 1..20: mol_type = other DNA
ctaaggggagtggggtctcc

SEQ ID NO: 54140 - DNA, 20 bp, synthetic construct
  misc_feature 1..20: note = CRISPR gRNA sequence
  source 1..20: mol_type = other DNA
taaggggagtggggtctcct

SEQ ID NO: 54141 - DNA, 20 bp, synthetic construct
  misc_feature 1..20: note = CRISPR gRNA sequence
  source 1..20: mol_type = other DNA
ggagtggggtctcctgggct

SEQ ID NO: 54142 - DNA, 20 bp, synthetic construct
  misc_feature 1..20: note = CRISPR gRNA sequence
  source 1..20: mol_type = other DNA
gagtggggtctcctgggctt

SEQ ID NO: 54143 - DNA, 20 bp, synthetic construct
  misc_feature 1..20: note = CRISPR gRNA sequence
  source 1..20: mol_type = other DNA
tggggtctcctgggcttggg

SEQ ID NO: 54144 - DNA, 20 bp, synthetic construct
  misc_feature 1..20: note = CRISPR gRNA sequence
  source 1..20: mol_type = other DNA
ggggtctcctgggcttggga

SEQ ID NO: 54145 - DNA, 20 bp, synthetic construct
  misc_feature 1..20: note = CRISPR gRNA sequence
  source 1..20: mol_type = other DNA
gtctcctgggcttgggaagg

SEQ ID NO: 54146 - DNA, 20 bp, synthetic construct
  misc_feature 1..20: note = CRISPR gRNA sequence
  source 1..20: mol_type = other DNA
gggcttgggaaggtggttga

SEQ ID NO: 54147 - DNA, 20 bp, synthetic construct
  misc_feature 1..20: note = CRISPR gRNA sequence
  source 1..20: mol_type = other DNA
ggcttgggaaggtggttgac

SEQ ID NO: 54148 - DNA, 20 bp, synthetic construct
  misc_feature 1..20: note = CRISPR gRNA sequence
  source 1..20: mol_type = other DNA
gcttgggaaggtggttgacg

SEQ ID NO: 54149 - DNA, 20 bp, synthetic construct
  misc_feature 1..20: note = CRISPR gRNA sequence
  source 1..20: mol_type = other DNA
ggttgacggggctgccttgt

SEQ ID NO: 54150 - DNA, 20 bp, synthetic construct
  misc_feature 1..20: note = CRISPR gRNA sequence
  source 1..20: mol_type = other DNA
gctgccttgtgagccctgtc

SEQ ID NO: 54151 - DNA, 20 bp, synthetic construct
  misc_feature 1..20: note = CRISPR gRNA sequence
  source 1..20: mol_type = other DNA
ctgccttgtgagccctgtct

SEQ ID NO: 54152 - DNA, 20 bp, synthetic construct
  misc_feature 1..20: note = CRISPR gRNA sequence
  source 1..20: mol_type = other DNA
tgccttgtgagccctgtctg

SEQ ID NO: 54153 - DNA, 20 bp, synthetic construct
  misc_feature 1..20: note = CRISPR gRNA sequence
  source 1..20: mol_type = other DNA
cttgtgagccctgtctgggg

SEQ ID NO: 54154 - DNA, 20 bp, synthetic construct
  misc_feature 1..20: note = CRISPR gRNA sequence
  source 1..20: mol_type = other DNA
ttgtgagccctgtctggggt

SEQ ID NO: 54155 - DNA, 20 bp, synthetic construct
  misc_feature 1..20: note = CRISPR gRNA sequence
  source 1..20: mol_type = other DNA
gagccctgtctggggtgggc

SEQ ID NO: 54156 - DNA, 20 bp, synthetic construct
  misc_feature 1..20: note = CRISPR gRNA sequence
  source 1..20: mol_type = other DNA
agccctgtctggggtgggct

SEQ ID NO: 54157 - DNA, 20 bp, synthetic construct
  misc_feature 1..20: note = CRISPR gRNA sequence
  source 1..20: mol_type = other DNA
cctgtctggggtgggctggg

SEQ ID NO: 54158 - DNA, 20 bp, synthetic construct
  misc_feature 1..20: note = CRISPR gRNA sequence
  source 1..20: mol_type = other DNA
ctgtctggggtgggctgggc

SEQ ID NO: 54159 - DNA, 20 bp, synthetic construct
  misc_feature 1..20: note = CRISPR gRNA sequence
  source 1..20: mol_type = other DNA
tgtctggggtgggctgggca

SEQ ID NO: 54160 - DNA, 20 bp, synthetic construct
  misc_feature 1..20: note = CRISPR gRNA sequence
  source 1..20: mol_type = other DNA
gtctggggtgggctgggcag

SEQ ID NO: 54161 - DNA, 20 bp, synthetic construct
  misc_feature 1..20: note = CRISPR gRNA sequence
  source 1..20: mol_type = other DNA
ctggggtgggctgggcaggg

SEQ ID NO: 54162 - DNA, 20 bp, synthetic construct
  misc_feature 1..20: note = CRISPR gRNA sequence
  source 1..20: mol_type = other DNA
tggggtgggctgggcagggg

SEQ ID NO: 54163 - DNA, 20 bp, synthetic construct
  misc_feature 1..20: note = CRISPR gRNA sequence
  source 1..20: mol_type = other DNA
ggtgggctgggcaggggagg

SEQ ID NO: 54164 - DNA, 20 bp, synthetic construct
  misc_feature 1..20: note = CRISPR gRNA sequence
  source 1..20: mol_type = other DNA
gtgggctgggcaggggaggt

SEQ ID NO: 54165 - DNA, 20 bp, synthetic construct
  misc_feature 1..20: note = CRISPR gRNA sequence
  source 1..20: mol_type = other DNA
gggctgggcaggggaggtag

SEQ ID NO: 54166 - DNA, 20 bp, synthetic construct
  misc_feature 1..20: note = CRISPR gRNA sequence
  source 1..20: mol_type = other DNA
ggctgggcaggggaggtagg

SEQ ID NO: 54167 - DNA, 20 bp, synthetic construct
  misc_feature 1..20: note = CRISPR gRNA sequence
  source 1..20: mol_type = other DNA
tgggcaggggaggtaggagg

SEQ ID NO: 54168 - DNA, 20 bp, synthetic construct
  misc_feature 1..20: note = CRISPR gRNA sequence
  source 1..20: mol_type = other DNA
gggcaggggaggtaggaggt

SEQ ID NO: 54169 - DNA, 20 bp, synthetic construct
  misc_feature 1..20: note = CRISPR gRNA sequence
  source 1..20: mol_type = other DNA
ggcaggggaggtaggaggta

SEQ ID NO: 54170 - DNA, 20 bp, synthetic construct
  misc_feature 1..20: note = CRISPR gRNA sequence
  source 1..20: mol_type = other DNA
aggggaggtaggaggtaggg

SEQ ID NO: 54171 - DNA, 20 bp, synthetic construct
  misc_feature 1..20: note = CRISPR gRNA sequence
  source 1..20: mol_type = other DNA
gaggtaggaggtagggaagc

SEQ ID NO: 54172 - DNA, 20 bp, synthetic construct
  misc_feature 1..20: note = CRISPR gRNA sequence
  source 1..20: mol_type = other DNA
aggtaggaggtagggaagcc

SEQ ID NO: 54173 - DNA, 20 bp, synthetic construct
  misc_feature 1..20: note = CRISPR gRNA sequence
  source 1..20: mol_type = other DNA
ggaagccaggccatgacccc

SEQ ID NO: 54174 - DNA, 20 bp, synthetic construct
  misc_feature 1..20: note = CRISPR gRNA sequence
  source 1..20: mol_type = other DNA
caggccatgacccctggaca

SEQ ID NO: 54175 - DNA, 20 bp, synthetic construct
  misc_feature 1..20: note = CRISPR gRNA sequence
  source 1..20: mol_type = other DNA
gccatgacccctggacacag

SEQ ID NO: 54176 - DNA, 20 bp, synthetic construct
  misc_feature 1..20: note = CRISPR gRNA sequence
  source 1..20: mol_type = other DNA
ccatgacccctggacacagc

SEQ ID NO: 54177 - DNA, 20 bp, synthetic construct
  misc_feature 1..20: note = CRISPR gRNA sequence
  source 1..20: mol_type = other DNA
gacccctggacacagcaggt

SEQ ID NO: 54178 - DNA, 20 bp, synthetic construct
  misc_feature 1..20: note = CRISPR gRNA sequence
  source 1..20: mol_type = other DNA
acccctggacacagcaggtc

SEQ ID NO: 54179 - DNA, 20 bp, synthetic construct
  misc_feature 1..20: note = CRISPR gRNA sequence
  source 1..20: mol_type = other DNA
acagcaggtcaggtgtcctt

SEQ ID NO: 54180 - DNA, 20 bp, synthetic construct
  misc_feature 1..20: note = CRISPR gRNA sequence
  source 1..20: mol_type = other DNA
cagcaggtcaggtgtccttc

SEQ ID NO: 54181 - DNA, 20 bp, synthetic construct
  misc_feature 1..20: note = CRISPR gRNA sequence
  source 1..20: mol_type = other DNA
agcaggtcaggtgtccttca

SEQ ID NO: 54182 - DNA, 20 bp, synthetic construct
  misc_feature 1..20: note = CRISPR gRNA sequence
  source 1..20: mol_type = other DNA
caggtcaggtgtccttcagg

SEQ ID NO: 54183 - DNA, 20 bp, synthetic construct
  misc_feature 1..20: note = CRISPR gRNA sequence
  source 1..20: mol_type = other DNA
ggtgtccttcagggagcatg

SEQ ID NO: 54184 - DNA, 20 bp, synthetic construct
  misc_feature 1..20: note = CRISPR gRNA sequence
  source 1..20: mol_type = other DNA
gtgtccttcagggagcatgt

SEQ ID NO: 54185 - DNA, 20 bp, synthetic construct
  misc_feature 1..20: note = CRISPR gRNA sequence
  source 1..20: mol_type = other DNA
tgtccttcagggagcatgtg

SEQ ID NO: 54186 - DNA, 20 bp, synthetic construct
  misc_feature 1..20: note = CRISPR gRNA sequence
  source 1..20: mol_type = other DNA
ttcagggagcatgtggggcc

SEQ ID NO: 54187 - DNA, 20 bp, synthetic construct
  misc_feature 1..20: note = CRISPR gRNA sequence
  source 1..20: mol_type = other DNA
tcagggagcatgtggggcct

SEQ ID NO: 54188 - DNA, 20 bp, synthetic construct
  misc_feature 1..20: note = CRISPR gRNA sequence
  source 1..20: mol_type = other DNA
gagcatgtggggcctgggca

SEQ ID NO: 54189 - DNA, 20 bp, synthetic construct
  misc_feature 1..20: note = CRISPR gRNA sequence
  source 1..20: mol_type = other DNA
agcatgtggggcctgggcac

SEQ ID NO: 54190 - DNA, 20 bp, synthetic construct
  misc_feature 1..20: note = CRISPR gRNA sequence
  source 1..20: mol_type = other DNA
gtggggcctgggcacaggtt

SEQ ID NO: 54191 - DNA, 20 bp, synthetic construct
  misc_feature 1..20: note = CRISPR gRNA sequence
  source 1..20: mol_type = other DNA
tggggcctgggcacaggttt

SEQ ID NO: 54192 - DNA, 20 bp, synthetic construct
  misc_feature 1..20: note = CRISPR gRNA sequence
  source 1..20: mol_type = other DNA
gggcctgggcacaggtttgg

SEQ ID NO: 54193 - DNA, 20 bp, synthetic construct
  misc_feature 1..20: note = CRISPR gRNA sequence
  source 1..20: mol_type = other DNA
cctgggcacaggtttgggag

SEQ ID NO: 54194 - DNA, 20 bp, synthetic construct
  misc_feature 1..20: note = CRISPR gRNA sequence
  source 1..20: mol_type = other DNA
ctgggcacaggtttgggagc

SEQ ID NO: 54195 - DNA, 20 bp, synthetic construct
  misc_feature 1..20: note = CRISPR gRNA sequence
  source 1..20: mol_type = other DNA
caggtttgggagcaggctct

SEQ ID NO: 54196 - DNA, 20 bp, synthetic construct
  misc_feature 1..20: note = CRISPR gRNA sequence
  source 1..20: mol_type = other DNA
gtttgggagcaggctctgag

SEQ ID NO: 54197 - DNA, 20 bp, synthetic construct
  misc_feature 1..20: note = CRISPR gRNA sequence
  source 1..20: mol_type = other DNA
tttgggagcaggctctgagc

SEQ ID NO: 54198 - DNA, 20 bp, synthetic construct
  misc_feature 1..20: note = CRISPR gRNA sequence
  source 1..20: mol_type = other DNA
ttgggagcaggctctgagca

SEQ ID NO: 54199 - DNA, 20 bp, synthetic construct
  misc_feature 1..20: note = CRISPR gRNA sequence
  source 1..20: mol_type = other DNA
tgggagcaggctctgagcag

SEQ ID NO: 54200 - DNA, 20 bp, synthetic construct
  misc_feature 1..20: note = CRISPR gRNA sequence
  source 1..20: mol_type = other DNA
gagcaggctctgagcagggg

SEQ ID NO: 54201 - DNA, 20 bp, synthetic construct
  misc_feature 1..20: note = CRISPR gRNA sequence
  source 1..20: mol_type = other DNA
agcaggctctgagcagggga

SEQ ID NO: 54202 - DNA, 20 bp, synthetic construct
  misc_feature 1..20: note = CRISPR gRNA sequence
  source 1..20: mol_type = other DNA
gcaggctctgagcaggggaa

SEQ ID NO: 54203 - DNA, 20 bp, synthetic construct
  misc_feature 1..20: note = CRISPR gRNA sequence
  source 1..20: mol_type = other DNA
aggctctgagcaggggaagg

SEQ ID NO: 54204 - DNA, 20 bp, synthetic construct
  misc_feature 1..20: note = CRISPR gRNA sequence
  source 1..20: mol_type = other DNA
ggctctgagcaggggaaggg

SEQ ID NO: 54205 - DNA, 20 bp, synthetic construct
  misc_feature 1..20: note = CRISPR gRNA sequence
  source 1..20: mol_type = other DNA
gctctgagcaggggaaggga

SEQ ID NO: 54206 - DNA, 20 bp, synthetic construct
  misc_feature 1..20: note = CRISPR gRNA sequence
  source 1..20: mol_type = other DNA
ctctgagcaggggaagggag

SEQ ID NO: 54207 - DNA, 20 bp, synthetic construct
  misc_feature 1..20: note = CRISPR gRNA sequence
  source 1..20: mol_type = other DNA
tctgagcaggggaagggagg

SEQ ID NO: 54208 - DNA, 20 bp, synthetic construct
  misc_feature 1..20: note = CRISPR gRNA sequence
  source 1..20: mol_type = other DNA
agcaggggaagggagggggc

SEQ ID NO: 54209 - DNA, 20 bp, synthetic construct
  misc_feature 1..20: note = CRISPR gRNA sequence
  source 1..20: mol_type = other DNA
gagggggctggaatcacaca

SEQ ID NO: 54210 - DNA, 20 bp, synthetic construct
  misc_feature 1..20: note = CRISPR gRNA sequence
  source 1..20: mol_type = other DNA
agggggctggaatcacacac

SEQ ID NO: 54211 - DNA, 20 bp, synthetic construct
  misc_feature 1..20: note = CRISPR gRNA sequence
  source 1..20: mol_type = other DNA
gggggctggaatcacacaca

SEQ ID NO: 54212 - DNA, 20 bp, synthetic construct
  misc_feature 1..20: note = CRISPR gRNA sequence
  source 1..20: mol_type = other DNA
gctggaatcacacacagggc

SEQ ID NO: 54213 - DNA, 20 bp, synthetic construct
  misc_feature 1..20: note = CRISPR gRNA sequence
  source 1..20: mol_type = other DNA
tggaatcacacacagggctg

SEQ ID NO: 54214 - DNA, 20 bp, synthetic construct
  misc_feature 1..20: note = CRISPR gRNA sequence
  source 1..20: mol_type = other DNA
ggaatcacacacagggctgg

SEQ ID NO: 54215 - DNA, 20 bp, synthetic construct
  misc_feature 1..20: note = CRISPR gRNA sequence
  source 1..20: mol_type = other DNA
catcactgtacctcatcctt

SEQ ID NO: 54216 - DNA, 20 bp, synthetic construct
  misc_feature 1..20: note = CRISPR gRNA sequence
  source 1..20: mol_type = other DNA
atcactgtacctcatccttc

SEQ ID NO: 54217 - DNA, 20 bp, synthetic construct
  misc_feature 1..20: note = CRISPR gRNA sequence
  source 1..20: mol_type = other DNA
cactgtacctcatccttcgg

SEQ ID NO: 54218 - DNA, 20 bp, synthetic construct
  misc_feature 1..20: note = CRISPR gRNA sequence
  source 1..20: mol_type = other DNA
tacctcatccttcgggagct

SEQ ID NO: 54219 - DNA, 20 bp, synthetic construct
  misc_feature 1..20: note = CRISPR gRNA sequence
  source 1..20: mol_type = other DNA
cctcatccttcgggagctca

SEQ ID NO: 54220 - DNA, 20 bp, synthetic construct
  misc_feature 1..20: note = CRISPR gRNA sequence
  source 1..20: mol_type = other DNA
ctcatccttcgggagctcag

SEQ ID NO: 54221 - DNA, 20 bp, synthetic construct
  misc_feature 1..20: note = CRISPR gRNA sequence
  source 1..20: mol_type = other DNA
atccttcgggagctcagagg

SEQ ID NO: 54222 - DNA, 20 bp, synthetic construct
  misc_feature 1..20: note = CRISPR gRNA sequence
  source 1..20: mol_type = other DNA
tcgggagctcagaggcagct

SEQ ID NO: 54223 - DNA, 20 bp, synthetic construct
  misc_feature 1..20: note = CRISPR gRNA sequence
  source 1..20: mol_type = other DNA
gggagctcagaggcagctca

SEQ ID NO: 54224 - DNA, 20 bp, synthetic construct
  misc_feature 1..20: note = CRISPR gRNA sequence
  source 1..20: mol_type = other DNA
ggagctcagaggcagctcag

SEQ ID NO: 54225 - DNA, 20 bp, synthetic construct
  misc_feature 1..20: note = CRISPR gRNA sequence
  source 1..20: mol_type = other DNA
gagctcagaggcagctcaga

SEQ ID NO: 54226 - DNA, 20 bp, synthetic construct
  misc_feature 1..20: note = CRISPR gRNA sequence
  source 1..20: mol_type = other DNA
gaggcagctcagagggcatc

SEQ ID NO: 54227 - DNA, 20 bp, synthetic construct
  misc_feature 1..20: note = CRISPR gRNA sequence
  source 1..20: mol_type = other DNA
ggcagctcagagggcatctg

SEQ ID NO: 54228 - DNA, 20 bp, synthetic construct
  misc_feature 1..20: note = CRISPR gRNA sequence
  source 1..20: mol_type = other DNA
tcagagggcatctggagcat

SEQ ID NO: 54229 - DNA, 20 bp, synthetic construct
  misc_feature 1..20: note = CRISPR gRNA sequence
  source 1..20: mol_type = other DNA
cagagggcatctggagcatg

SEQ ID NO: 54230 - DNA, 20 bp, synthetic construct
  misc_feature 1..20: note = CRISPR gRNA sequence
  source 1..20: mol_type = other DNA
atctggagcatgaggctgtc

SEQ ID NO: 54231 - DNA, 20 bp, synthetic construct
  misc_feature 1..20: note = CRISPR gRNA sequence
  source 1..20: mol_type = other DNA
catgaggctgtcaagaaatg

SEQ ID NO: 54232 - DNA, 20 bp, synthetic construct
  misc_feature 1..20: note = CRISPR gRNA sequence
  source 1..20: mol_type = other DNA
gctgtcaagaaatgcagccc

SEQ ID NO: 54233 - DNA, 20 bp, synthetic construct
  misc_feature 1..20: note = CRISPR gRNA sequence
  source 1..20: mol_type = other DNA
tgtcaagaaatgcagccctg

SEQ ID NO: 54234 - DNA, 20 bp, synthetic construct
  misc_feature 1..20: note = CRISPR gRNA sequence
  source 1..20: mol_type = other DNA
gtcaagaaatgcagccctgg

SEQ ID NO: 54235 - DNA, 20 bp, synthetic construct
  misc_feature 1..20: note = CRISPR gRNA sequence
  source 1..20: mol_type = other DNA
tcaagaaatgcagccctgga

SEQ ID NO: 54236 - DNA, 20 bp, synthetic construct
  misc_feature 1..20: note = CRISPR gRNA sequence
  source 1..20: mol_type = other DNA
agccctggagggacatcacc

SEQ ID NO: 54237 - DNA, 20 bp, synthetic construct
  misc_feature 1..20: note = CRISPR gRNA sequence
  source 1..20: mol_type = other DNA
gccctggagggacatcacca

SEQ ID NO: 54238 - DNA, 20 bp, synthetic construct
  misc_feature 1..20: note = CRISPR gRNA sequence
  source 1..20: mol_type = other DNA
tggagggacatcaccaaggc

SEQ ID NO: 54239 - DNA, 20 bp, synthetic construct
  misc_feature 1..20: note = CRISPR gRNA sequence
  source 1..20: mol_type = other DNA
ggagggacatcaccaaggcc

SEQ ID NO: 54240 - DNA, 20 bp, synthetic construct
  misc_feature 1..20: note = CRISPR gRNA sequence
  source 1..20: mol_type = other DNA
gacatcaccaaggccaggct

SEQ ID NO: 54241 - DNA, 20 bp, synthetic construct
  misc_feature 1..20: note = CRISPR gRNA sequence
  source 1..20: mol_type = other DNA
caccaaggccaggctgagca

SEQ ID NO: 54242 - DNA, 20 bp, synthetic construct
  misc_feature 1..20: note = CRISPR gRNA sequence
  source 1..20: mol_type = other DNA
accaaggccaggctgagcaa

SEQ ID NO: 54243 - DNA, 20 bp, synthetic construct
  misc_feature 1..20: note = CRISPR gRNA sequence
  source 1..20: mol_type = other DNA
aaggccatgtccgccatctc

SEQ ID NO: 54244 - DNA, 20 bp, synthetic construct
  misc_feature 1..20: note = CRISPR gRNA sequence
  source 1..20: mol_type = other DNA
ccatctccagaatccatcct

SEQ ID NO: 54245 - DNA, 20 bp, synthetic construct
  misc_feature 1..20: note = CRISPR gRNA sequence
  source 1..20: mol_type = other DNA
tccagaatccatcctcagcc

SEQ ID NO: 54246 - DNA, 20 bp, synthetic construct
  misc_feature 1..20: note = CRISPR gRNA sequence
  source 1..20: mol_type = other DNA
cagcctggccttccaccatc

SEQ ID NO: 54247 - DNA, 20 bp, synthetic construct
  misc_feature 1..20: note = CRISPR gRNA sequence
  source 1..20: mol_type = other DNA
atcgagccctatcctccacc

SEQ ID NO: 54248 - DNA, 20 bp, synthetic construct
  misc_feature 1..20: note = CRISPR gRNA sequence
  source 1..20: mol_type = other DNA
cgagccctatcctccaccta

SEQ ID NO: 54249 - DNA, 20 bp, synthetic construct
  misc_feature 1..20: note = CRISPR gRNA sequence
  source 1..20: mol_type = other DNA
atcctccacctagagtcaat

SEQ ID NO: 54250 - DNA, 20 bp, synthetic construct
  misc_feature 1..20: note = CRISPR gRNA sequence
  source 1..20: mol_type = other DNA
acctagagtcaatcagacct

SEQ ID NO: 54251 - DNA, 20 bp, synthetic construct
  misc_feature 1..20: note = CRISPR gRNA sequence
  source 1..20: mol_type = other DNA
atcagaccttggtgccaatt

SEQ ID NO: 54252 - DNA, 20 bp, synthetic construct
  misc_feature 1..20: note = CRISPR gRNA sequence
  source 1..20: mol_type = other DNA
aatttggcttctccacttcc

SEQ ID NO: 54253 - DNA, 20 bp, synthetic construct
  misc_feature 1..20: note = CRISPR gRNA sequence
  source 1..20: mol_type = other DNA
acttcctggttgtgtgaccc

SEQ ID NO: 54254 - DNA, 20 bp, synthetic construct
  misc_feature 1..20: note = CRISPR gRNA sequence
  source 1..20: mol_type = other DNA
gtgtgaccctggacaaatca

SEQ ID NO: 54255 - DNA, 20 bp, synthetic construct
  misc_feature 1..20: note = CRISPR gRNA sequence
  source 1..20: mol_type = other DNA
gacaaatcacagcctctcaa

SEQ ID NO: 54256 - DNA, 20 bp, synthetic construct
  misc_feature 1..20: note = CRISPR gRNA sequence
  source 1..20: mol_type = other DNA
acaaatcacagcctctcaat

SEQ ID NO: 54257 - DNA, 20 bp, synthetic construct
  misc_feature 1..20: note = CRISPR gRNA sequence
  source 1..20: mol_type = other DNA
aaatcacagcctctcaatgg

SEQ ID NO: 54258 - DNA, 20 bp, synthetic construct
  misc_feature 1..20: note = CRISPR gRNA sequence
  source 1..20: mol_type = other DNA
agactgtatgtgaactgcct

SEQ ID NO: 54259 - DNA, 20 bp, synthetic construct
  misc_feature 1..20: note = CRISPR gRNA sequence
  source 1..20: mol_type = other DNA
gtatgtgaactgccttagtt

SEQ ID NO: 54260 - DNA, 20 bp, synthetic construct
  misc_feature 1..20: note = CRISPR gRNA sequence
  source 1..20: mol_type = other DNA
aactgccttagtttggtgct

SEQ ID NO: 54261 - DNA, 20 bp, synthetic construct
  misc_feature 1..20: note = CRISPR gRNA sequence
  source 1..20: mol_type = other DNA
tttggtgcttggtgcataca

SEQ ID NO: 54262 - DNA, 20 bp, synthetic construct
  misc_feature 1..20: note = CRISPR gRNA sequence
  source 1..20: mol_type = other DNA
gtgcttggtgcatacatggc

SEQ ID NO: 54263 - DNA, 20 bp, synthetic construct
  misc_feature 1..20: note = CRISPR gRNA sequence
  source 1..20: mol_type = other DNA
cctcctcctcatctgtgctt

SEQ ID NO: 54264 - DNA, 20 bp, synthetic construct
  misc_feature 1..20: note = CRISPR gRNA sequence
  source 1..20: mol_type = other DNA
tcctcctcatctgtgcttca

SEQ ID NO: 54265 - DNA, 20 bp, synthetic construct
  misc_feature 1..20: note = CRISPR gRNA sequence
  source 1..20: mol_type = other DNA
catctgtgcttcagagatgt

SEQ ID NO: 54266 - DNA, 20 bp, synthetic construct
  misc_feature 1..20: note = CRISPR gRNA sequence
  source 1..20: mol_type = other DNA
tgcttcagagatgtcagccc

SEQ ID NO: 54267 - DNA, 20 bp, synthetic construct
  misc_feature 1..20: note = CRISPR gRNA sequence
  source 1..20: mol_type = other DNA
tcagagatgtcagccccagc

SEQ ID NO: 54268 - DNA, 20 bp, synthetic construct
  misc_feature 1..20: note = CRISPR gRNA sequence
  source 1..20: mol_type = other DNA
tgtcagccccagctggaatc

SEQ ID NO: 54269 - DNA, 20 bp, synthetic construct
  misc_feature 1..20: note = CRISPR gRNA sequence
  source 1..20: mol_type = other DNA
cccagctggaatcgagcctt

SEQ ID NO: 54270 - DNA, 20 bp, synthetic construct
  misc_feature 1..20: note = CRISPR gRNA sequence
  source 1..20: mol_type = other DNA
agctggaatcgagccttcag

SEQ ID NO: 54271 - DNA, 20 bp, synthetic construct
  misc_feature 1..20: note = CRISPR gRNA sequence
  source 1..20: mol_type = other DNA
gaatcgagccttcagtagtc

SEQ ID NO: 54272 - DNA, 20 bp, synthetic construct
  misc_feature 1..20: note = CRISPR gRNA sequence
  source 1..20: mol_type = other DNA
cttcagtagtccagactcta

SEQ ID NO: 54273 - DNA, 20 bp, synthetic construct
  misc_feature 1..20: note = CRISPR gRNA sequence
  source 1..20: mol_type = other DNA
cagtagtccagactctacag

SEQ ID NO: 54274 - DNA, 20 bp, synthetic construct
  misc_feature 1..20: note = CRISPR gRNA sequence
  source 1..20: mol_type = other DNA
gtagtccagactctacagaa

SEQ ID NO: 54275 - DNA, 20 bp, synthetic construct
  misc_feature 1..20: note = CRISPR gRNA sequence
  source 1..20: mol_type = other DNA
agactctacagaagagattg

SEQ ID NO: 54276 - DNA, 20 bp, synthetic construct
  misc_feature 1..20: note = CRISPR gRNA sequence
  source 1..20: mol_type = other DNA
gactctacagaagagattgt

SEQ ID NO: 54277 - DNA, 20 bp, synthetic construct
  misc_feature 1..20: note = CRISPR gRNA sequence
  source 1..20: mol_type = other DNA
tctacagaagagattgtggg

SEQ ID NO: 54278 - DNA, 20 bp, synthetic construct
  misc_feature 1..20: note = CRISPR gRNA sequence
  source 1..20: mol_type = other DNA
ctacagaagagattgtgggt

SEQ ID NO: 54279 - DNA, 20 bp, synthetic construct
  misc_feature 1..20: note = CRISPR gRNA sequence
  source 1..20: mol_type = other DNA
aagagattgtgggtgggctc

SEQ ID NO: 54280 - DNA, 20 bp, synthetic construct
  misc_feature 1..20: note = CRISPR gRNA sequence
  source 1..20: mol_type = other DNA
agagattgtgggtgggctcc

SEQ ID NO: 54281 - DNA, 20 bp, synthetic construct
  misc_feature 1..20: note = CRISPR gRNA sequence
  source 1..20: mol_type = other DNA
agattgtgggtgggctccgg

SEQ ID NO: 54282 - DNA, 20 bp, synthetic construct
  misc_feature 1..20: note = CRISPR gRNA sequence
  source 1..20: mol_type = other DNA
gtgggtgggctccgggagca

SEQ ID NO: 54283 - DNA, 20 bp, synthetic construct
  misc_feature 1..20: note = CRISPR gRNA sequence
  source 1..20: mol_type = other DNA
gggtgggctccgggagcaaa

SEQ ID NO: 54284 - DNA, 20 bp, synthetic construct
  misc_feature 1..20: note = CRISPR gRNA sequence
  source 1..20: mol_type = other DNA
ggctccgggagcaaagagct

SEQ ID NO: 54285 - DNA, 20 bp, synthetic construct
  misc_feature 1..20: note = CRISPR gRNA sequence
  source 1..20: mol_type = other DNA
ctgagtctctacccatgcgc

SEQ ID NO: 54286 - DNA, 20 bp, synthetic construct
  misc_feature 1..20: note = CRISPR gRNA sequence
  source 1..20: mol_type = other DNA
tgagtctctacccatgcgct

SEQ ID NO: 54287 - DNA, 20 bp, synthetic construct
  misc_feature 1..20: note = CRISPR gRNA sequence
  source 1..20: mol_type = other DNA
tctctacccatgcgctaggc

SEQ ID NO: 54288 - DNA, 20 bp, synthetic construct
  misc_feature 1..20: note = CRISPR gRNA sequence
  source 1..20: mol_type = other DNA
ctctacccatgcgctaggct

SEQ ID NO: 54289 - DNA, 20 bp, synthetic construct
  misc_feature 1..20: note = CRISPR gRNA sequence
  source 1..20: mol_type = other DNA
tctacccatgcgctaggctg

SEQ ID NO: 54290 - DNA, 20 bp, synthetic construct
  misc_feature 1..20: note = CRISPR gRNA sequence
  source 1..20: mol_type = other DNA
tgcgctaggctggggcaatc

SEQ ID NO: 54291 - DNA, 20 bp, synthetic construct
  misc_feature 1..20: note = CRISPR gRNA sequence
  source 1..20: mol_type = other DNA
gcgctaggctggggcaatcc

SEQ ID NO: 54292 - DNA, 20 bp, synthetic construct
  misc_feature 1..20: note = CRISPR gRNA sequence
  source 1..20: mol_type = other DNA
ggggcaatccaggaccctaa

SEQ ID NO: 54293 - DNA, 20 bp, synthetic construct
  misc_feature 1..20: note = CRISPR gRNA sequence
  source 1..20: mol_type = other DNA
gggcaatccaggaccctaat

SEQ ID NO: 54294 - DNA, 20 bp, synthetic construct
  misc_feature 1..20: note = CRISPR gRNA sequence
  source 1..20: mol_type = other DNA
cctaatgggtccttgtgtga

SEQ ID NO: 54295 - DNA, 20 bp, synthetic construct
  misc_feature 1..20: note = CRISPR gRNA sequence
  source 1..20: mol_type = other DNA
ctaatgggtccttgtgtgaa

SEQ ID NO: 54296 - DNA, 20 bp, synthetic construct
  misc_feature 1..20: note = CRISPR gRNA sequence
  source 1..20: mol_type = other DNA
taatgggtccttgtgtgaaa

SEQ ID NO: 54297 - DNA, 20 bp, synthetic construct
  misc_feature 1..20: note = CRISPR gRNA sequence
  source 1..20: mol_type = other DNA
gtccttgtgtgaaagggata

SEQ ID NO: 54298 - DNA, 20 bp, synthetic construct
  misc_feature 1..20: note = CRISPR gRNA sequence
  source 1..20: mol_type = other DNA
cttgtgtgaaagggatacag

SEQ ID NO: 54299 - DNA, 20 bp, synthetic construct
  misc_feature 1..20: note = CRISPR gRNA sequence
  source 1..20: mol_type = other DNA
agggatacagaagttccgac

SEQ ID NO: 54300 - DNA, 20 bp, synthetic construct
  misc_feature 1..20: note = CRISPR gRNA sequence
  source 1..20: mol_type = other DNA
gggatacagaagttccgacc

SEQ ID NO: 54301 - DNA, 20 bp, synthetic construct
  misc_feature 1..20: note = CRISPR gRNA sequence
  source 1..20: mol_type = other DNA
acagaagttccgaccaggac

SEQ ID NO: 54302 - DNA, 20 bp, synthetic construct
  misc_feature 1..20: note = CRISPR gRNA sequence
  source 1..20: mol_type = other DNA
agaagttccgaccaggacca

SEQ ID NO: 54303 - DNA, 20 bp, synthetic construct
  misc_feature 1..20: note = CRISPR gRNA sequence
  source 1..20: mol_type = other DNA
tccgaccaggaccagagcta

SEQ ID NO: 54304 - DNA, 20 bp, synthetic construct
  misc_feature 1..20: note = CRISPR gRNA sequence
  source 1..20: mol_type = other DNA
ccgaccaggaccagagctac

SEQ ID NO: 54305 - DNA, 20 bp, synthetic construct
  misc_feature 1..20: note = CRISPR gRNA sequence
  source 1..20: mol_type = other DNA
ccaggaccagagctacaggc

SEQ ID NO: 54306 - DNA, 20 bp, synthetic construct
  misc_feature 1..20: note = CRISPR gRNA sequence
  source 1..20: mol_type = other DNA
caggaccagagctacaggcc

SEQ ID NO: 54307 - DNA, 20 bp, synthetic construct
  misc_feature 1..20: note = CRISPR gRNA sequence
  source 1..20: mol_type = other DNA
ctacaggccaggcaatcccc

SEQ ID NO: 54308 - DNA, 20 bp, synthetic construct
  misc_feature 1..20: note = CRISPR gRNA sequence
  source 1..20: mol_type = other DNA
tacaggccaggcaatcccct

SEQ ID NO: 54309 - DNA, 20 bp, synthetic construct
  misc_feature 1..20: note = CRISPR gRNA sequence
  source 1..20: mol_type = other DNA
ccaggcaatcccctgggttt

SEQ ID NO: 54310 - DNA, 20 bp, synthetic construct
  misc_feature 1..20: note = CRISPR gRNA sequence
  source 1..20: mol_type = other DNA
gcaatcccctgggtttaagc

SEQ ID NO: 54311 - DNA, 20 bp, synthetic construct
  misc_feature 1..20: note = CRISPR gRNA sequence
  source 1..20: mol_type = other DNA
aatcccctgggtttaagctg

SEQ ID NO: 54312 - DNA, 20 bp, synthetic construct
  misc_feature 1..20: note = CRISPR gRNA sequence
  source 1..20: mol_type = other DNA
atcccctgggtttaagctgg

SEQ ID NO: 54313 - DNA, 20 bp, synthetic construct
  misc_feature 1..20: note = CRISPR gRNA sequence
  source 1..20: mol_type = other DNA
tcccctgggtttaagctgga

SEQ ID NO: 54314 - DNA, 20 bp, synthetic construct
  misc_feature 1..20: note = CRISPR gRNA sequence
  source 1..20: mol_type = other DNA
gggtttaagctggagggctc

SEQ ID NO: 54315 - DNA, 20 bp, synthetic construct
  misc_feature 1..20: note = CRISPR gRNA sequence
  source 1..20: mol_type = other DNA
gctggagggctctagtctcc

SEQ ID NO: 54316 - DNA, 20 bp, synthetic construct
  misc_feature 1..20: note = CRISPR gRNA sequence
  source 1..20: mol_type = other DNA
agtctcccggaatccccctc

SEQ ID NO: 54317 - DNA, 20 bp, synthetic construct
  misc_feature 1..20: note = CRISPR gRNA sequence
  source 1..20: mol_type = other DNA
tggctacccaactcctgccc

SEQ ID NO: 54318 - DNA, 20 bp, synthetic construct
  misc_feature 1..20: note = CRISPR gRNA sequence
  source 1..20: mol_type = other DNA
gctgtctatatcctacacac

SEQ ID NO: 54319 - DNA, 20 bp, synthetic construct
  misc_feature 1..20: note = CRISPR gRNA sequence
  source 1..20: mol_type = other DNA
ctgtctatatcctacacact

SEQ ID NO: 54320 - DNA, 20 bp, synthetic construct
  misc_feature 1..20: note = CRISPR gRNA sequence
  source 1..20: mol_type = other DNA
tgtctatatcctacacactg

SEQ ID NO: 54321 - DNA, 20 bp, synthetic construct
  misc_feature 1..20: note = CRISPR gRNA sequence
  source 1..20: mol_type = other DNA
ctacacactggggctccttt

SEQ ID NO: 54322 - DNA, 20 bp, synthetic construct
  misc_feature 1..20: note = CRISPR gRNA sequence
  source 1..20: mol_type = other DNA
tacacactggggctcctttc

SEQ ID NO: 54323 - DNA, 20 bp, synthetic construct
  misc_feature 1..20: note = CRISPR gRNA sequence
  source 1..20: mol_type = other DNA
gggctcctttcaggcaccat

SEQ ID NO: 54324 - DNA, 20 bp, synthetic construct
  misc_feature 1..20: note = CRISPR gRNA sequence
  source 1..20: mol_type = other DNA
gctcctttcaggcaccatga

SEQ ID NO: 54325 - DNA, 20 bp, synthetic construct
  misc_feature 1..20: note = CRISPR gRNA sequence
  source 1..20: mol_type = other DNA
ctcctttcaggcaccatgag

SEQ ID NO: 54326 - DNA, 20 bp, synthetic construct
  misc_feature 1..20: note = CRISPR gRNA sequence
  source 1..20: mol_type = other DNA
ctttcaggcaccatgagagg

SEQ ID NO: 54327 - DNA, 20 bp, synthetic construct
  misc_feature 1..20: note = CRISPR gRNA sequence
  source 1..20: mol_type = other DNA
ttcaggcaccatgagaggcg

SEQ ID NO: 54328 - DNA, 20 bp, synthetic construct
  misc_feature 1..20: note = CRISPR gRNA sequence
  source 1..20: mol_type = other DNA
tcaggcaccatgagaggcgg

SEQ ID NO: 54329 - DNA, 20 bp, synthetic construct
  misc_feature 1..20: note = CRISPR gRNA sequence
  source 1..20: mol_type = other DNA
ggcaccatgagaggcggagg

SEQ ID NO: 54330 - DNA, 20 bp, synthetic construct
  misc_feature 1..20: note = CRISPR gRNA sequence
  source 1..20: mol_type = other DNA
catgagaggcggaggtggtc

SEQ ID NO: 54331 - DNA, 20 bp, synthetic construct
  misc_feature 1..20: note = CRISPR gRNA sequence
  source 1..20: mol_type = other DNA
aggcggaggtggtctggatt

SEQ ID NO: 54332 - DNA, 20 bp, synthetic construct
  misc_feature 1..20: note = CRISPR gRNA sequence
  source 1..20: mol_type = other DNA
ggatttggaccctccccctt

SEQ ID NO: 54333 - DNA, 20 bp, synthetic construct
  misc_feature 1..20: note = CRISPR gRNA sequence
  source 1..20: mol_type = other DNA
gatttggaccctcccccttt

SEQ ID NO: 54334 - DNA, 20 bp, synthetic construct
  misc_feature 1..20: note = CRISPR gRNA sequence
  source 1..20: mol_type = other DNA
atttggaccctccccctttg

SEQ ID NO: 54335 - DNA, 20 bp, synthetic construct
  misc_feature 1..20: note = CRISPR gRNA sequence
  source 1..20: mol_type = other DNA
ttggggctgcatcctttgcc

SEQ ID NO: 54336 - DNA, 20 bp, synthetic construct
  misc_feature 1..20: note = CRISPR gRNA sequence
  source 1..20: mol_type = other DNA
cgctcttccgtgaatttgtc

SEQ ID NO: 54337 - DNA, 20 bp, synthetic construct
  misc_feature 1..20: note = CRISPR gRNA sequence
  source 1..20: mol_type = other DNA
gctcttccgtgaatttgtcc

SEQ ID NO: 54338 - DNA, 20 bp, synthetic construct
  misc_feature 1..20: note = CRISPR gRNA sequence
  source 1..20: mol_type = other DNA
tgaatttgtccaggtcaccc

SEQ ID NO: 54339 - DNA, 20 bp, synthetic construct
  misc_feature 1..20: note = CRISPR gRNA sequence
  source 1..20: mol_type = other DNA
atttgtccaggtcaccctgg

SEQ ID NO: 54340 - DNA, 20 bp, synthetic construct
  misc_feature 1..20: note = CRISPR gRNA sequence
  source 1..20: mol_type = other DNA
caccctggcagttgactgac

SEQ ID NO: 54341 - DNA, 20 bp, synthetic construct
  misc_feature 1..20: note = CRISPR gRNA sequence
  source 1..20: mol_type = other DNA
gttgactgactggcactgcc

SEQ ID NO: 54342 - DNA, 20 bp, synthetic construct
  misc_feature 1..20: note = CRISPR gRNA sequence
  source 1..20: mol_type = other DNA
tgactggcactgcccagctg

SEQ ID NO: 54343 - DNA, 20 bp, synthetic construct
  misc_feature 1..20: note = CRISPR gRNA sequence
  source 1..20: mol_type = other DNA
actggcactgcccagctgtg

SEQ ID NO: 54344 - DNA, 20 bp, synthetic construct
  misc_feature 1..20: note = CRISPR gRNA sequence
  source 1..20: mol_type = other DNA
ctggcactgcccagctgtgg

SEQ ID NO: 54345 - DNA, 20 bp, synthetic construct
  misc_feature 1..20: note = CRISPR gRNA sequence
  source 1..20: mol_type = other DNA
tggcactgcccagctgtgga

SEQ ID NO: 54346 - DNA, 20 bp, synthetic construct
  misc_feature 1..20: note = CRISPR gRNA sequence
  source 1..20: mol_type = other DNA
cactgcccagctgtggaggg

SEQ ID NO: 54347 - DNA, 20 bp, synthetic construct
  misc_feature 1..20: note = CRISPR gRNA sequence
  source 1..20: mol_type = other DNA
ctgcccagctgtggagggta

SEQ ID NO: 54348 - DNA, 20 bp, synthetic construct
  misc_feature 1..20: note = CRISPR gRNA sequence
  source 1..20: mol_type = other DNA
gcccagctgtggagggtaga

SEQ ID NO: 54349 - DNA, 20 bp, synthetic construct
  misc_feature 1..20: note = CRISPR gRNA sequence
  source 1..20: mol_type = other DNA
cccagctgtggagggtagag

SEQ ID NO: 54350 - DNA, 20 bp, synthetic construct
  misc_feature 1..20: note = CRISPR gRNA sequence
  source 1..20: mol_type = other DNA
ccagctgtggagggtagaga

SEQ ID NO: 54351 - DNA, 20 bp, synthetic construct
  misc_feature 1..20: note = CRISPR gRNA sequence
  source 1..20: mol_type = other DNA
cagctgtggagggtagagag

SEQ ID NO: 54352 - DNA, 20 bp, synthetic construct
  misc_feature 1..20: note = CRISPR gRNA sequence
  source 1..20: mol_type = other DNA
agaggggaatgtccctgact

SEQ ID NO: 54353 - DNA, 20 bp, synthetic construct
  misc_feature 1..20: note = CRISPR gRNA sequence
  source 1..20: mol_type = other DNA
ggaatgtccctgactgagca

SEQ ID NO: 54354 - DNA, 20 bp, synthetic construct
  misc_feature 1..20: note = CRISPR gRNA sequence
  source 1..20: mol_type = other DNA
aatgtccctgactgagcatg

SEQ ID NO: 54355 - DNA, 20 bp, synthetic construct
  misc_feature 1..20: note = CRISPR gRNA sequence
  source 1..20: mol_type = other DNA
tccctgactgagcatggagt

SEQ ID NO: 54356 - DNA, 20 bp, synthetic construct
  misc_feature 1..20: note = CRISPR gRNA sequence
  source 1..20: mol_type = other DNA
ccctgactgagcatggagtt

SEQ ID NO: 54357 - DNA, 20 bp, synthetic construct
  misc_feature 1..20: note = CRISPR gRNA sequence
  source 1..20: mol_type = other DNA
cctgactgagcatggagttg

SEQ ID NO: 54358 - DNA, 20 bp, synthetic construct
  misc_feature 1..20: note = CRISPR gRNA sequence
  source 1..20: mol_type = other DNA
gcatggagttggggtgaaat

SEQ ID NO: 54359 - DNA, 20 bp, synthetic construct
  misc_feature 1..20: note = CRISPR gRNA sequence
  source 1..20: mol_type = other DNA
catggagttggggtgaaatc

SEQ ID NO: 54360 - DNA, 20 bp, synthetic construct
  misc_feature 1..20: note = CRISPR gRNA sequence
  source 1..20: mol_type = other DNA
aaatcgggccctacctctcc

SEQ ID NO: 54361 - DNA, 20 bp, synthetic construct
  misc_feature 1..20: note = CRISPR gRNA sequence
  source 1..20: mol_type = other DNA
aatcgggccctacctctcct

SEQ ID NO: 54362 - DNA, 20 bp, synthetic construct
  misc_feature 1..20: note = CRISPR gRNA sequence
  source 1..20: mol_type = other DNA
atcgggccctacctctcctg

SEQ ID NO: 54363 - DNA, 20 bp, synthetic construct
  misc_feature 1..20: note = CRISPR gRNA sequence
  source 1..20: mol_type = other DNA
tggggccccttctgctcctc

SEQ ID NO: 54364 - DNA, 20 bp, synthetic construct
  misc_feature 1..20: note = CRISPR gRNA sequence
  source 1..20: mol_type = other DNA
ccttctgctcctctggctcc

SEQ ID NO: 54365 - DNA, 20 bp, synthetic construct
  misc_feature 1..20: note = CRISPR gRNA sequence
  source 1..20: mol_type = other DNA
cttctgctcctctggctcct

SEQ ID NO: 54366 - DNA, 20 bp, synthetic construct
  misc_feature 1..20: note = CRISPR gRNA sequence
  source 1..20: mol_type = other DNA
ctggctcctgggcaaacatg

SEQ ID NO: 54367 - DNA, 20 bp, synthetic construct
  misc_feature 1..20: note = CRISPR gRNA sequence
  source 1..20: mol_type = other DNA
ctgggcaaacatgaagatca

SEQ ID NO: 54368 - DNA, 20 bp, synthetic construct
  misc_feature 1..20: note = CRISPR gRNA sequence
  source 1..20: mol_type = other DNA
aagatcacagttttgtgctg

SEQ ID NO: 54369 - DNA, 20 bp, synthetic construct
  misc_feature 1..20: note = CRISPR gRNA sequence
  source 1..20: mol_type = other DNA
agatcacagttttgtgctgc

SEQ ID NO: 54370 - DNA, 20 bp, synthetic construct
  misc_feature 1..20: note = CRISPR gRNA sequence
  source 1..20: mol_type = other DNA
gttttgtgctgcaggctgtg

SEQ ID NO: 54371 - DNA, 20 bp, synthetic construct
  misc_feature 1..20: note = CRISPR gRNA sequence
  source 1..20: mol_type = other DNA
gctgcaggctgtgaagacaa

SEQ ID NO: 54372 - DNA, 20 bp, synthetic construct
  misc_feature 1..20: note = CRISPR gRNA sequence
  source 1..20: mol_type = other DNA
tgcaggctgtgaagacaaaa

SEQ ID NO: 54373 - DNA, 20 bp, synthetic construct
  misc_feature 1..20: note = CRISPR gRNA sequence
  source 1..20: mol_type = other DNA
gcaggctgtgaagacaaaag

SEQ ID NO: 54374 - DNA, 20 bp, synthetic construct
  misc_feature 1..20: note = CRISPR gRNA sequence
  source 1..20: mol_type = other DNA
caggctgtgaagacaaaaga

SEQ ID NO: 54375 - DNA, 20 bp, synthetic construct
  misc_feature 1..20: note = CRISPR gRNA sequence
  source 1..20: mol_type = other DNA
aggctgtgaagacaaaagag

SEQ ID NO: 54376 - DNA, 20 bp, synthetic construct
  misc_feature 1..20: note = CRISPR gRNA sequence
  source 1..20: mol_type = other DNA
tgtgaagacaaaagaggggt

SEQ ID NO: 54377 - DNA, 20 bp, synthetic construct
  misc_feature 1..20: note = CRISPR gRNA sequence
  source 1..20: mol_type = other DNA
gtgaagacaaaagaggggtg

SEQ ID NO: 54378 - DNA, 20 bp, synthetic construct
  misc_feature 1..20: note = CRISPR gRNA sequence
  source 1..20: mol_type = other DNA
aagacaaaagaggggtgagg

SEQ ID NO: 54379 - DNA, 20 bp, synthetic construct
  misc_feature 1..20: note = CRISPR gRNA sequence
  source 1..20: mol_type = other DNA
caaaagaggggtgaggaagc

SEQ ID NO: 54380 - DNA, 20 bp, synthetic construct
  misc_feature 1..20: note = CRISPR gRNA sequence
  source 1..20: mol_type = other DNA
aaagaggggtgaggaagcga

SEQ ID NO: 54381 - DNA, 20 bp, synthetic construct
  misc_feature 1..20: note = CRISPR gRNA sequence
  source 1..20: mol_type = other DNA
aagaggggtgaggaagcgag

SEQ ID NO: 54382 - DNA, 20 bp, synthetic construct
  misc_feature 1..20: note = CRISPR gRNA sequence
  source 1..20: mol_type = other DNA
gtgaggaagcgagaggttat

SEQ ID NO: 54383 - DNA, 20 bp, synthetic construct
  misc_feature 1..20: note = CRISPR gRNA sequence
  source 1..20: mol_type = other DNA
ccctgttactatttcttttt

SEQ ID NO: 54384 - DNA, 20 bp, synthetic construct
  misc_feature 1..20: note = CRISPR gRNA sequence
  source 1..20: mol_type = other DNA
ctgttactatttctttttga

SEQ ID NO: 54385 - DNA, 20 bp, synthetic construct
  misc_feature 1..20: note = CRISPR gRNA sequence
  source 1..20: mol_type = other DNA
ttactatttctttttgagag

SEQ ID NO: 54386 - DNA, 20 bp, synthetic construct
  misc_feature 1..20: note = CRISPR gRNA sequence
  source 1..20: mol_type = other DNA
tactatttctttttgagaga

SEQ ID NO: 54387 - DNA, 20 bp, synthetic construct
  misc_feature 1..20: note = CRISPR gRNA sequence
  source 1..20: mol_type = other DNA
ttctttttgagagaaggtct

SEQ ID NO: 54388 - DNA, 20 bp, synthetic construct
  misc_feature 1..20: note = CRISPR gRNA sequence
  source 1..20: mol_type = other DNA
aaggtctcagtctgttgccc

SEQ ID NO: 54389 - DNA, 20 bp, synthetic construct
  misc_feature 1..20: note = CRISPR gRNA sequence
  source 1..20: mol_type = other DNA
tctcagtctgttgcccaagc

SEQ ID NO: 54390 - DNA, 20 bp, synthetic construct
  misc_feature 1..20: note = CRISPR gRNA sequence
  source 1..20: mol_type = other DNA
ctgttgcccaagctggtgtg

SEQ ID NO: 54391 - DNA, 20 bp, synthetic construct
  misc_feature 1..20: note = CRISPR gRNA sequence
  source 1..20: mol_type = other DNA
ttgcccaagctggtgtgcag

SEQ ID NO: 54392 - DNA, 20 bp, synthetic construct
  misc_feature 1..20: note = CRISPR gRNA sequence
  source 1..20: mol_type = other DNA
ggtgtgcagtggtgcaatca

SEQ ID NO: 54393 - DNA, 20 bp, synthetic construct
  misc_feature 1..20: note = CRISPR gRNA sequence
  source 1..20: mol_type = other DNA
ggtgcaatcatggctcactg

SEQ ID NO: 54394 - DNA, 20 bp, synthetic construct
  misc_feature 1..20: note = CRISPR gRNA sequence
  source 1..20: mol_type = other DNA
tcactgaagcctccacctcc

SEQ ID NO: 54395 - DNA, 20 bp, synthetic construct
  misc_feature 1..20: note = CRISPR gRNA sequence
  source 1..20: mol_type = other DNA
cactgaagcctccacctcct

SEQ ID NO: 54396 - DNA, 20 bp, synthetic construct
  misc_feature 1..20: note = CRISPR gRNA sequence
  source 1..20: mol_type = other DNA
agcctccacctcctgggctc

SEQ ID NO: 54397 - DNA, 20 bp, synthetic construct
  misc_feature 1..20: note = CRISPR gRNA sequence
  source 1..20: mol_type = other DNA
ctcaagcaatcctcccactt

SEQ ID NO: 54398 - DNA, 20 bp, synthetic construct
  misc_feature 1..20: note = CRISPR gRNA sequence
  source 1..20: mol_type = other DNA
tcctcccacttcagcctcct

SEQ ID NO: 54399 - DNA, 20 bp, synthetic construct
  misc_feature 1..20: note = CRISPR gRNA sequence
  source 1..20: mol_type = other DNA
tcccacttcagcctcctgag

SEQ ID NO: 54400 - DNA, 20 bp, synthetic construct
  misc_feature 1..20: note = CRISPR gRNA sequence
  source 1..20: mol_type = other DNA
acttcagcctcctgagtagc

SEQ ID NO: 54401 - DNA, 20 bp, synthetic construct
  misc_feature 1..20: note = CRISPR gRNA sequence
  source 1..20: mol_type = other DNA
cttcagcctcctgagtagct

SEQ ID NO: 54402 - DNA, 20 bp, synthetic construct
  misc_feature 1..20: note = CRISPR gRNA sequence
  source 1..20: mol_type = other DNA
ctcctgagtagctgggatta

SEQ ID NO: 54403 - DNA, 20 bp, synthetic construct
  misc_feature 1..20: note = CRISPR gRNA sequence
  source 1..20: mol_type = other DNA
tcctgagtagctgggattac

SEQ ID NO: 54404 - DNA, 20 bp, synthetic construct
  misc_feature 1..20: note = CRISPR gRNA sequence
  source 1..20: mol_type = other DNA
ggattacaggcttgtgccat

SEQ ID NO: 54405 - DNA, 20 bp, synthetic construct
  misc_feature 1..20: note = CRISPR gRNA sequence
  source 1..20: mol_type = other DNA
gattacaggcttgtgccatc

SEQ ID NO: 54406 - DNA, 20 bp, synthetic construct
  misc_feature 1..20: note = CRISPR gRNA sequence
  source 1..20: mol_type = other DNA
caggcttgtgccatcaggcc

SEQ ID NO: 54407 - DNA, 20 bp, synthetic construct
  misc_feature 1..20: note = CRISPR gRNA sequence
  source 1..20: mol_type = other DNA
gcccagctaattaaaaaaaa

SEQ ID NO: 54408 - DNA, 20 bp, synthetic construct
  misc_feature 1..20: note = CRISPR gRNA sequence
  source 1..20: mol_type = other DNA
taattaaaaaaaaaagtatg

SEQ ID NO: 54409 - DNA, 20 bp, synthetic construct
  misc_feature 1..20: note = CRISPR gRNA sequence
  source 1..20: mol_type = other DNA
attaaaaaaaaaagtatgta

SEQ ID NO: 54410 - DNA, 20 bp, synthetic construct
  misc_feature 1..20: note = CRISPR gRNA sequence
  source 1..20: mol_type = other DNA
aaaaaaaaagtatgtagaga

SEQ ID NO: 54411 - DNA, 20 bp, synthetic construct
  misc_feature 1..20: note = CRISPR gRNA sequence
  source 1..20: mol_type = other DNA
acagtctatgttgtctactc

SEQ ID NO: 54412 - DNA, 20 bp, synthetic construct
  misc_feature 1..20: note = CRISPR gRNA sequence
  source 1..20: mol_type = other DNA
ctactctggtctcgaacttc

SEQ ID NO: 54413 - DNA, 20 bp, synthetic construct
  misc_feature 1..20: note = CRISPR gRNA sequence
  source 1..20: mol_type = other DNA
tactctggtctcgaacttct

SEQ ID NO: 54414 - DNA, 20 bp, synthetic construct
  misc_feature 1..20: note = CRISPR gRNA sequence
  source 1..20: mol_type = other DNA
tggtctcgaacttctgggct

SEQ ID NO: 54415 - DNA, 20 bp, synthetic construct
  misc_feature 1..20: note = CRISPR gRNA sequence
  source 1..20: mol_type = other DNA
ggtctcgaacttctgggctc

SEQ ID NO: 54416 - DNA, 20 bp, synthetic construct
  misc_feature 1..20: note = CRISPR gRNA sequence
  source 1..20: mol_type = other DNA
cctcccacctttgcttccca

SEQ ID NO: 54417 - DNA, 20 bp, synthetic construct
  misc_feature 1..20: note = CRISPR gRNA sequence
  source 1..20: mol_type = other DNA
acctttgcttcccaaagtgc

SEQ ID NO: 54418 - DNA, 20 bp, synthetic construct
  misc_feature 1..20: note = CRISPR gRNA sequence
  source 1..20: mol_type = other DNA
cctttgcttcccaaagtgct

SEQ ID NO: 54419 - DNA, 20 bp, synthetic construct
  misc_feature 1..20: note = CRISPR gRNA sequence
  source 1..20: mol_type = other DNA
ttcccaaagtgctgggatga

SEQ ID NO: 54420 - DNA, 20 bp, synthetic construct
  misc_feature 1..20: note = CRISPR gRNA sequence
  source 1..20: mol_type = other DNA
tcccaaagtgctgggatgat

SEQ ID NO: 54421 - DNA, 20 bp, synthetic construct
  misc_feature 1..20: note = CRISPR gRNA sequence
  source 1..20: mol_type = other DNA
agtgctgggatgataggtgt

SEQ ID NO: 54422 - DNA, 20 bp, synthetic construct
  misc_feature 1..20: note = CRISPR gRNA sequence
  source 1..20: mol_type = other DNA
taggtgtgagccaccgtgcc

SEQ ID NO: 54423 - DNA, 20 bp, synthetic construct
  misc_feature 1..20: note = CRISPR gRNA sequence
  source 1..20: mol_type = other DNA
ggcctgtcactttttacccc

SEQ ID NO: 54424 - DNA, 20 bp, synthetic construct
  misc_feature 1..20: note = CRISPR gRNA sequence
  source 1..20: mol_type = other DNA
gtcactttttacccctggcc

SEQ ID NO: 54425 - DNA, 20 bp, synthetic construct
  misc_feature 1..20: note = CRISPR gRNA sequence
  source 1..20: mol_type = other DNA
tcactttttacccctggccc

SEQ ID NO: 54426 - DNA, 20 bp, synthetic construct
  misc_feature 1..20: note = CRISPR gRNA sequence
  source 1..20: mol_type = other DNA
actttttacccctggcccgg

SEQ ID NO: 54427 - DNA, 20 bp, synthetic construct
  misc_feature 1..20: note = CRISPR gRNA sequence
  source 1..20: mol_type = other DNA
ctttttacccctggcccggg

SEQ ID NO: 54428 - DNA, 20 bp, synthetic construct
  misc_feature 1..20: note = CRISPR gRNA sequence
  source 1..20: mol_type = other DNA
ctggcccgggaggacctctc

SEQ ID NO: 54429 - DNA, 20 bp, synthetic construct
  misc_feature 1..20: note = CRISPR gRNA sequence
  source 1..20: mol_type = other DNA
aagttccatccccctgcctc

SEQ ID NO: 54430 - DNA, 20 bp, synthetic construct
  misc_feature 1..20: note = CRISPR gRNA sequence
  source 1..20: mol_type = other DNA
catccccctgcctccagctg

SEQ ID NO: 54431 - DNA, 20 bp, synthetic construct
  misc_feature 1..20: note = CRISPR gRNA sequence
  source 1..20: mol_type = other DNA
actcccctctgacttcctct

SEQ ID NO: 54432 - DNA, 20 bp, synthetic construct
  misc_feature 1..20: note = CRISPR gRNA sequence
  source 1..20: mol_type = other DNA
tctgacttcctctgagcttt

SEQ ID NO: 54433 - DNA, 20 bp, synthetic construct
  misc_feature 1..20: note = CRISPR gRNA sequence
  source 1..20: mol_type = other DNA
tgacttcctctgagcttttg

SEQ ID NO: 54434 - DNA, 20 bp, synthetic construct
  misc_feature 1..20: note = CRISPR gRNA sequence
  source 1..20: mol_type = other DNA
gacttcctctgagcttttgg

SEQ ID NO: 54435 - DNA, 20 bp, synthetic construct
  misc_feature 1..20: note = CRISPR gRNA sequence
  source 1..20: mol_type = other DNA
acttcctctgagcttttgga

SEQ ID NO: 54436 - DNA, 20 bp, synthetic construct
  misc_feature 1..20: note = CRISPR gRNA sequence
  source 1..20: mol_type = other DNA
gggctgaaatctttctacca

SEQ ID NO: 54437 - DNA, 20 bp, synthetic construct
  misc_feature 1..20: note = CRISPR gRNA sequence
  source 1..20: mol_type = other DNA
cacaaatgtatctattgcct

SEQ ID NO: 54438 - DNA, 20 bp, synthetic construct
  misc_feature 1..20: note = CRISPR gRNA sequence
  source 1..20: mol_type = other DNA
aatgtatctattgcctaagt

SEQ ID NO: 54439 - DNA, 20 bp, synthetic construct
  misc_feature 1..20: note = CRISPR gRNA sequence
  source 1..20: mol_type = other DNA
cctaagtaagccccatttcc

SEQ ID NO: 54440 - DNA, 20 bp, synthetic construct
  misc_feature 1..20: note = CRISPR gRNA sequence
  source 1..20: mol_type = other DNA
agtaagccccatttcctggc

SEQ ID NO: 54441 - DNA, 20 bp, synthetic construct
  misc_feature 1..20: note = CRISPR gRNA sequence
  source 1..20: mol_type = other DNA
catttcctggcaagtcttaa

SEQ ID NO: 54442 - DNA, 20 bp, synthetic construct
  misc_feature 1..20: note = CRISPR gRNA sequence
  source 1..20: mol_type = other DNA
aaattctgtgttctctcttt

SEQ ID NO: 54443 - DNA, 20 bp, synthetic construct
  misc_feature 1..20: note = CRISPR gRNA sequence
  source 1..20: mol_type = other DNA
tgtgttctctcttttagccc

SEQ ID NO: 54444 - DNA, 20 bp, synthetic construct
  misc_feature 1..20: note = CRISPR gRNA sequence
  source 1..20: mol_type = other DNA
actgaaacccctctctctgc

SEQ ID NO: 54445 - DNA, 20 bp, synthetic construct
  misc_feature 1..20: note = CRISPR gRNA sequence
  source 1..20: mol_type = other DNA
aaacccctctctctgctagt

SEQ ID NO: 54446 - DNA, 20 bp, synthetic construct
  misc_feature 1..20: note = CRISPR gRNA sequence
  source 1..20: mol_type = other DNA
cagtgttctgtctgtgctca

SEQ ID NO: 54447 - DNA, 20 bp, synthetic construct
  misc_feature 1..20: note = CRISPR gRNA sequence
  source 1..20: mol_type = other DNA
gtctgtgctcaaagtatgtg

SEQ ID NO: 54448 - DNA, 20 bp, synthetic construct
  misc_feature 1..20: note = CRISPR gRNA sequence
  source 1..20: mol_type = other DNA
aagtatgtgtggattacccc

SEQ ID NO: 54449 - DNA, 20 bp, synthetic construct
  misc_feature 1..20: note = CRISPR gRNA sequence
  source 1..20: mol_type = other DNA
ggattacccctggtaacctt

SEQ ID NO: 54450 - DNA, 20 bp, synthetic construct
  misc_feature 1..20: note = CRISPR gRNA sequence
  source 1..20: mol_type = other DNA
attacccctggtaacctttg

SEQ ID NO: 54451 - DNA, 20 bp, synthetic construct
  misc_feature 1..20: note = CRISPR gRNA sequence
  source 1..20: mol_type = other DNA
cccctggtaacctttggagt

SEQ ID NO: 54452 - DNA, 20 bp, synthetic construct
  misc_feature 1..20: note = CRISPR gRNA sequence
  source 1..20: mol_type = other DNA
ccttcaaaccttccattttc

SEQ ID NO: 54453 - DNA, 20 bp, synthetic construct
  misc_feature 1..20: note = CRISPR gRNA sequence
  source 1..20: mol_type = other DNA
taatttttgttttacaaaca

SEQ ID NO: 54454 - DNA, 20 bp, synthetic construct
  misc_feature 1..20: note = CRISPR gRNA sequence
  source 1..20: mol_type = other DNA
aatttttgttttacaaacat

SEQ ID NO: 54455 - DNA, 20 bp, synthetic construct
  misc_feature 1..20: note = CRISPR gRNA sequence
  source 1..20: mol_type = other DNA
acaaacatgggattaaacta

SEQ ID NO: 54456 - DNA, 20 bp, synthetic construct
  misc_feature 1..20: note = CRISPR gRNA sequence
  source 1..20: mol_type = other DNA
tagattctctttttaaacat

SEQ ID NO: 54457 - DNA, 20 bp, synthetic construct
  misc_feature 1..20: note = CRISPR gRNA sequence
  source 1..20: mol_type = other DNA
tttttaaacattagtttttt

SEQ ID NO: 54458 - DNA, 20 bp, synthetic construct
  misc_feature 1..20: note = CRISPR gRNA sequence
  source 1..20: mol_type = other DNA
ttttaaacattagtttttta

SEQ ID NO: 54459 - DNA, 20 bp, synthetic construct
  misc_feature 1..20: note = CRISPR gRNA sequence
  source 1..20: mol_type = other DNA
tttaaacattagttttttaa

SEQ ID NO: 54460 - DNA, 20 bp, synthetic construct
  misc_feature 1..20: note = CRISPR gRNA sequence
  source 1..20: mol_type = other DNA
aacattagttttttaagggc

SEQ ID NO: 54461 - DNA, 20 bp, synthetic construct
  misc_feature 1..20: note = CRISPR gRNA sequence
  source 1..20: mol_type = other DNA
attagttttttaagggctag

SEQ ID NO: 54462 - DNA, 20 bp, synthetic construct
  misc_feature 1..20: note = CRISPR gRNA sequence
  source 1..20: mol_type = other DNA
agttttttaagggctagaag

SEQ ID NO: 54463 - DNA, 20 bp, synthetic construct
  misc_feature 1..20: note = CRISPR gRNA sequence
  source 1..20: mol_type = other DNA
gttttttaagggctagaagc

SEQ ID NO: 54464 - DNA, 20 bp, synthetic construct
  misc_feature 1..20: note = CRISPR gRNA sequence
  source 1..20: mol_type = other DNA
ttttttaagggctagaagca

SEQ ID NO: 54465 - DNA, 20 bp, synthetic construct
  misc_feature 1..20: note = CRISPR gRNA sequence
  source 1..20: mol_type = other DNA
taatacttgatcattattga

SEQ ID NO: 54466 - DNA, 20 bp, synthetic construct
  misc_feature 1..20: note = CRISPR gRNA sequence
  source 1..20: mol_type = other DNA
aatacttgatcattattgat

SEQ ID NO: 54467 - DNA, 20 bp, synthetic construct
  misc_feature 1..20: note = CRISPR gRNA sequence
  source 1..20: mol_type = other DNA
ttgatcattattgatgggaa

SEQ ID NO: 54468 - DNA, 20 bp, synthetic construct
  misc_feature 1..20: note = CRISPR gRNA sequence
  source 1..20: mol_type = other DNA
tttttttttttttttaattt

SEQ ID NO: 54469 - DNA, 20 bp, synthetic construct
  misc_feature 1..20: note = CRISPR gRNA sequence
  source 1..20: mol_type = other DNA
tttttttttttaatttgaga

SEQ ID NO: 54470 - DNA, 20 bp, synthetic construct
  misc_feature 1..20: note = CRISPR gRNA sequence
  source 1..20: mol_type = other DNA
tttttttttaatttgagaca

SEQ ID NO: 54471 - DNA, 20 bp, synthetic construct
  misc_feature 1..20: note = CRISPR gRNA sequence
  source 1..20: mol_type = other DNA
cagagtcttgctctgtctcc

SEQ ID NO: 54472 - DNA, 20 bp, synthetic construct
  misc_feature 1..20: note = CRISPR gRNA sequence
  source 1..20: mol_type = other DNA
agagtcttgctctgtctccc

SEQ ID NO: 54473 - DNA, 20 bp, synthetic construct
  misc_feature 1..20: note = CRISPR gRNA sequence
  source 1..20: mol_type = other DNA
tcttgctctgtctcccaggc

SEQ ID NO: 54474 - DNA, 20 bp, synthetic construct
  misc_feature 1..20: note = CRISPR gRNA sequence
  source 1..20: mol_type = other DNA
ttgctctgtctcccaggctg

SEQ ID NO: 54475 - DNA, 20 bp, synthetic construct
  misc_feature 1..20: note = CRISPR gRNA sequence
  source 1..20: mol_type = other DNA
ctgtctcccaggctggagtg

SEQ ID NO: 54476 - DNA, 20 bp, synthetic construct
  misc_feature 1..20: note = CRISPR gRNA sequence
  source 1..20: mol_type = other DNA
tctcccaggctggagtgcag

SEQ ID NO: 54477 - DNA, 20 bp, synthetic construct
  misc_feature 1..20: note = CRISPR gRNA sequence
  source 1..20: mol_type = other DNA
ggagtgcagtggcatgatct

SEQ ID NO: 54478 - DNA, 20 bp, synthetic construct
  misc_feature 1..20: note = CRISPR gRNA sequence
  source 1..20: mol_type = other DNA
tcactgcaacctccgcctcc

SEQ ID NO: 54479 - DNA, 20 bp, synthetic construct
  misc_feature 1..20: note = CRISPR gRNA sequence
  source 1..20: mol_type = other DNA
cactgcaacctccgcctccc

SEQ ID NO: 54480 - DNA, 20 bp, synthetic construct
  misc_feature 1..20: note = CRISPR gRNA sequence
  source 1..20: mol_type = other DNA
aacctccgcctcccaggttc

SEQ ID NO: 54481 - DNA, 20 bp, synthetic construct
  misc_feature 1..20: note = CRISPR gRNA sequence
  source 1..20: mol_type = other DNA
ttccagcgattctcctgcct

SEQ ID NO: 54482 - DNA, 20 bp, synthetic construct
  misc_feature 1..20: note = CRISPR gRNA sequence
  source 1..20: mol_type = other DNA
ttctcctgcctcagcctcct

SEQ ID NO: 54483 - DNA, 20 bp, synthetic construct
  misc_feature 1..20: note = CRISPR gRNA sequence
  source 1..20: mol_type = other DNA
tcctgcctcagcctcctgag

SEQ ID NO: 54484 - DNA, 20 bp, synthetic construct
  misc_feature 1..20: note = CRISPR gRNA sequence
  source 1..20: mol_type = other DNA
gcctcagcctcctgagtagc

SEQ ID NO: 54485 - DNA, 20 bp, synthetic construct
  misc_feature 1..20: note = CRISPR gRNA sequence
  source 1..20: mol_type = other DNA
ctcctgagtagctggaatta

SEQ ID NO: 54486 - DNA, 20 bp, synthetic construct
  misc_feature 1..20: note = CRISPR gRNA sequence
  source 1..20: mol_type = other DNA
tcctgagtagctggaattac

SEQ ID NO: 54487 - DNA, 20 bp, synthetic construct
  misc_feature 1..20: note = CRISPR gRNA sequence
  source 1..20: mol_type = other DNA
caggtgcacgccaccatgcc

SEQ ID NO: 54488 - DNA, 20 bp, synthetic construct
  misc_feature 1..20: note = CRISPR gRNA sequence
  source 1..20: mol_type = other DNA
tgcacgccaccatgcccagc

SEQ ID NO: 54489 - DNA, 20 bp, synthetic construct
  misc_feature 1..20: note = CRISPR gRNA sequence
  source 1..20: mol_type = other DNA
ccagctagtttttgtatttt

SEQ ID NO: 54490 - DNA, 20 bp, synthetic construct
  misc_feature 1..20: note = CRISPR gRNA sequence
  source 1..20: mol_type = other DNA
gctagtttttgtatttttag

SEQ ID NO: 54491 - DNA, 20 bp, synthetic construct
  misc_feature 1..20: note = CRISPR gRNA sequence
  source 1..20: mol_type = other DNA
tagtttttgtatttttagta

SEQ ID NO: 54492 - DNA, 20 bp, synthetic construct
  misc_feature 1..20: note = CRISPR gRNA sequence
  source 1..20: mol_type = other DNA
ttttgtatttttagtagaga

SEQ ID NO: 54493 - DNA, 20 bp, synthetic construct
  misc_feature 1..20: note = CRISPR gRNA sequence
  source 1..20: mol_type = other DNA
tttgtatttttagtagagac

SEQ ID NO: 54494 - DNA, 20 bp, synthetic construct
  misc_feature 1..20: note = CRISPR gRNA sequence
  source 1..20: mol_type = other DNA
ttgtatttttagtagagacg

SEQ ID NO: 54495 - DNA, 20 bp, synthetic construct
  misc_feature 1..20: note = CRISPR gRNA sequence
  source 1..20: mol_type = other DNA
gagacggggtttcatcctat

SEQ ID NO: 54496 - DNA, 20 bp, synthetic construct
  misc_feature 1..20: note = CRISPR gRNA sequence
  source 1..20: mol_type = other DNA
cggggtttcatcctattggc

SEQ ID NO: 54497 - DNA, 20 bp, synthetic construct
  misc_feature 1..20: note = CRISPR gRNA sequence
  source 1..20: mol_type = other DNA
ggggtttcatcctattggcc

SEQ ID NO: 54498 - DNA, 20 bp, synthetic construct
  misc_feature 1..20: note = CRISPR gRNA sequence
  source 1..20: mol_type = other DNA
tttcatcctattggccaggc

SEQ ID NO: 54499 - DNA, 20 bp, synthetic construct
  misc_feature 1..20: note = CRISPR gRNA sequence
  source 1..20: mol_type = other DNA
tggtcttgaactcctgacct

SEQ ID NO: 54500 - DNA, 20 bp, synthetic construct
  misc_feature 1..20: note = CRISPR gRNA sequence
  source 1..20: mol_type = other DNA
ggtcttgaactcctgacctc

SEQ ID NO: 54501 - DNA, 20 bp, synthetic construct
  misc_feature 1..20: note = CRISPR gRNA sequence
  source 1..20: mol_type = other DNA
ctcaggtgatccccctgcct

SEQ ID NO: 54502 - DNA, 20 bp, synthetic construct
  misc_feature 1..20: note = CRISPR gRNA sequence
  source 1..20: mol_type = other DNA
ccccctgcctcagcctccca

SEQ ID NO: 54503 - DNA, 20 bp, synthetic construct
  misc_feature 1..20: note = CRISPR gRNA sequence
  source 1..20: mol_type = other DNA
gcctcagcctcccaaagtgc

SEQ ID NO: 54504 - DNA, 20 bp, synthetic construct
  misc_feature 1..20: note = CRISPR gRNA sequence
  source 1..20: mol_type = other DNA
cctcagcctcccaaagtgct

SEQ ID NO: 54505 - DNA, 20 bp, synthetic construct
  misc_feature 1..20: note = CRISPR gRNA sequence
  source 1..20: mol_type = other DNA
ctcccaaagtgctgggttta

SEQ ID NO: 54506 - DNA, 20 bp, synthetic construct
  misc_feature 1..20: note = CRISPR gRNA sequence
  source 1..20: mol_type = other DNA
aagtgctgggtttacagcat

SEQ ID NO: 54507 - DNA, 20 bp, synthetic construct
  misc_feature 1..20: note = CRISPR gRNA sequence
  source 1..20: mol_type = other DNA
tgggtttacagcatgagcca

SEQ ID NO: 54508 - DNA, 20 bp, synthetic construct
  misc_feature 1..20: note = CRISPR gRNA sequence
  source 1..20: mol_type = other DNA
acagcatgagccacagcacc

SEQ ID NO: 54509 - DNA, 20 bp, synthetic construct
  misc_feature 1..20: note = CRISPR gRNA sequence
  source 1..20: mol_type = other DNA
atgagccacagcacctggcc

SEQ ID NO: 54510 - DNA, 20 bp, synthetic construct
  misc_feature 1..20: note = CRISPR gRNA sequence
  source 1..20: mol_type = other DNA
ctgccattgcatatcttgaa

SEQ ID NO: 54511 - DNA, 20 bp, synthetic construct
  misc_feature 1..20: note = CRISPR gRNA sequence
  source 1..20: mol_type = other DNA
ataatcttttataatctttt

SEQ ID NO: 54512 - DNA, 20 bp, synthetic construct
  misc_feature 1..20: note = CRISPR gRNA sequence
  source 1..20: mol_type = other DNA
ttataatcttttaagataat

SEQ ID NO: 54513 - DNA, 20 bp, synthetic construct
  misc_feature 1..20: note = CRISPR gRNA sequence
  source 1..20: mol_type = other DNA
tgagttaaaatttttatgtt

SEQ ID NO: 54514 - DNA, 20 bp, synthetic construct
  misc_feature 1..20: note = CRISPR gRNA sequence
  source 1..20: mol_type = other DNA
taaaatttttatgtttggcc

SEQ ID NO: 54515 - DNA, 20 bp, synthetic construct
  misc_feature 1..20: note = CRISPR gRNA sequence
  source 1..20: mol_type = other DNA
tttttatgtttggcctggtg

SEQ ID NO: 54516 - DNA, 20 bp, synthetic construct
  misc_feature 1..20: note = CRISPR gRNA sequence
  source 1..20: mol_type = other DNA
ttatgtttggcctggtgcag

SEQ ID NO: 54517 - DNA, 20 bp, synthetic construct
  misc_feature 1..20: note = CRISPR gRNA sequence
  source 1..20: mol_type = other DNA
tacctataatccttgctctt

SEQ ID NO: 54518 - DNA, 20 bp, synthetic construct
  misc_feature 1..20: note = CRISPR gRNA sequence
  source 1..20: mol_type = other DNA
acctataatccttgctcttt

SEQ ID NO: 54519 - DNA, 20 bp, synthetic construct
  misc_feature 1..20: note = CRISPR gRNA sequence
  source 1..20: mol_type = other DNA
ctataatccttgctctttgg

SEQ ID NO: 54520 - DNA, 20 bp, synthetic construct
  misc_feature 1..20: note = CRISPR gRNA sequence
  source 1..20: mol_type = other DNA
tataatccttgctctttggg

SEQ ID NO: 54521 - DNA, 20 bp, synthetic construct
  misc_feature 1..20: note = CRISPR gRNA sequence
  source 1..20: mol_type = other DNA
atccttgctctttgggaggc

SEQ ID NO: 54522 - DNA, 20 bp, synthetic construct
  misc_feature 1..20: note = CRISPR gRNA sequence
  source 1..20: mol_type = other DNA
tccttgctctttgggaggcc

SEQ ID NO: 54523 - DNA, 20 bp, synthetic construct
  misc_feature 1..20: note = CRISPR gRNA sequence
  source 1..20: mol_type = other DNA
ccttgctctttgggaggcca

SEQ ID NO: 54524 - DNA, 20 bp, synthetic construct
  misc_feature 1..20: note = CRISPR gRNA sequence
  source 1..20: mol_type = other DNA
tgctctttgggaggccaggg

SEQ ID NO: 54525 - DNA, 20 bp, synthetic construct
  misc_feature 1..20: note = CRISPR gRNA sequence
  source 1..20: mol_type = other DNA
gctctttgggaggccagggc

SEQ ID NO: 54526 - DNA, 20 bp, synthetic construct
  misc_feature 1..20: note = CRISPR gRNA sequence
  source 1..20: mol_type = other DNA
tctttgggaggccagggcag

SEQ ID NO: 54527 - DNA, 20 bp, synthetic construct
  misc_feature 1..20: note = CRISPR gRNA sequence
  source 1..20: mol_type = other DNA
ctttgggaggccagggcagg

SEQ ID NO: 54528 - DNA, 20 bp, synthetic construct
  misc_feature 1..20: note = CRISPR gRNA sequence
  source 1..20: mol_type = other DNA
ccagggcaggaggatcacat

SEQ ID NO: 54529 - DNA, 20 bp, synthetic construct
  misc_feature 1..20: note = CRISPR gRNA sequence
  source 1..20: mol_type = other DNA
gcaggaggatcacatgagct

SEQ ID NO: 54530 - DNA, 20 bp, synthetic construct
  misc_feature 1..20: note = CRISPR gRNA sequence
  source 1..20: mol_type = other DNA
caggaggatcacatgagctc

SEQ ID NO: 54531 - DNA, 20 bp, synthetic construct
  misc_feature 1..20: note = CRISPR gRNA sequence
  source 1..20: mol_type = other DNA
ggaggatcacatgagctcgg

SEQ ID NO: 54532 - DNA, 20 bp, synthetic construct
  misc_feature 1..20: note = CRISPR gRNA sequence
  source 1..20: mol_type = other DNA
tcacatgagctcgggagttt

SEQ ID NO: 54533 - DNA, 20 bp, synthetic construct
  misc_feature 1..20: note = CRISPR gRNA sequence
  source 1..20: mol_type = other DNA
tgagctcgggagtttgagaa

SEQ ID NO: 54534 - DNA, 20 bp, synthetic construct
  misc_feature 1..20: note = CRISPR gRNA sequence
  source 1..20: mol_type = other DNA
tcgggagtttgagaacagcc

SEQ ID NO: 54535 - DNA, 20 bp, synthetic construct
  misc_feature 1..20: note = CRISPR gRNA sequence
  source 1..20: mol_type = other DNA
tgagaacagcctggtcaata

SEQ ID NO: 54536 - DNA, 20 bp, synthetic construct
  misc_feature 1..20: note = CRISPR gRNA sequence
  source 1..20: mol_type = other DNA
aacagcctggtcaatatagc

SEQ ID NO: 54537 - DNA, 20 bp, synthetic construct
  misc_feature 1..20: note = CRISPR gRNA sequence
  source 1..20: mol_type = other DNA
ctaaaaataaaaaaaattgc

SEQ ID NO: 54538 - DNA, 20 bp, synthetic construct
  misc_feature 1..20: note = CRISPR gRNA sequence
  source 1..20: mol_type = other DNA
taaaaataaaaaaaattgcc

SEQ ID NO: 54539 - DNA, 20 bp, synthetic construct
  misc_feature 1..20: note = CRISPR gRNA sequence
  source 1..20: mol_type = other DNA
ataaaaaaaattgccaggca

SEQ ID NO: 54540 - DNA, 20 bp, synthetic construct
  misc_feature 1..20: note = CRISPR gRNA sequence
  source 1..20: mol_type = other DNA
gtgactcatgactgtaatcc

SEQ ID NO: 54541 - DNA, 20 bp, synthetic construct
  misc_feature 1..20: note = CRISPR gRNA sequence
  source 1..20: mol_type = other DNA
tgactgtaatcccagcactt

SEQ ID NO: 54542 - DNA, 20 bp, synthetic construct
  misc_feature 1..20: note = CRISPR gRNA sequence
  source 1..20: mol_type = other DNA
gactgtaatcccagcacttt

SEQ ID NO: 54543 - DNA, 20 bp, synthetic construct
  misc_feature 1..20: note = CRISPR gRNA sequence
  source 1..20: mol_type = other DNA
ctgtaatcccagcactttgg

SEQ ID NO: 54544 - DNA, 20 bp, synthetic construct
  misc_feature 1..20: note = CRISPR gRNA sequence
  source 1..20: mol_type = other DNA
tcccagcactttgggagact

SEQ ID NO: 54545 - DNA, 20 bp, synthetic construct
  misc_feature 1..20: note = CRISPR gRNA sequence
  source 1..20: mol_type = other DNA
ccagcactttgggagactaa

SEQ ID NO: 54546 - DNA, 20 bp, synthetic construct
  misc_feature 1..20: note = CRISPR gRNA sequence
  source 1..20: mol_type = other DNA
agcactttgggagactaaga

SEQ ID NO: 54547 - DNA, 20 bp, synthetic construct
  misc_feature 1..20: note = CRISPR gRNA sequence
  source 1..20: mol_type = other DNA
ctttgggagactaagagaga

SEQ ID NO: 54548 - DNA, 20 bp, synthetic construct
  misc_feature 1..20: note = CRISPR gRNA sequence
  source 1..20: mol_type = other DNA
actaagagagatggattgct

SEQ ID NO: 54549 - DNA, 20 bp, synthetic construct
  misc_feature 1..20: note = CRISPR gRNA sequence
  source 1..20: mol_type = other DNA
gagagatggattgctgagcc

SEQ ID NO: 54550 - DNA, 20 bp, synthetic construct
  misc_feature 1..20: note = CRISPR gRNA sequence
  source 1..20: mol_type = other DNA
agagatggattgctgagccc

SEQ ID NO: 54551 - DNA, 20 bp, synthetic construct
  misc_feature 1..20: note = CRISPR gRNA sequence
  source 1..20: mol_type = other DNA
ggattgctgagcccaggatt

SEQ ID NO: 54552 - DNA, 20 bp, synthetic construct
  misc_feature 1..20: note = CRISPR gRNA sequence
  source 1..20: mol_type = other DNA
attgctgagcccaggatttg

SEQ ID NO: 54553 - DNA, 20 bp, synthetic construct
  misc_feature 1..20: note = CRISPR gRNA sequence
  source 1..20: mol_type = other DNA
ttgctgagcccaggatttgg

SEQ ID NO: 54554 - DNA, 20 bp, synthetic construct
  misc_feature 1..20: note = CRISPR gRNA sequence
  source 1..20: mol_type = other DNA
agcccaggatttggaggtta

SEQ ID NO: 54555 - DNA, 20 bp, synthetic construct
  misc_feature 1..20: note = CRISPR gRNA sequence
  source 1..20: mol_type = other DNA
caggatttggaggttacagt

SEQ ID NO: 54556 - DNA, 20 bp, synthetic construct
  misc_feature 1..20: note = CRISPR gRNA sequence
  source 1..20: mol_type = other DNA
gtgattgtgtcactgtactc

SEQ ID NO: 54557 - DNA, 20 bp, synthetic construct
  misc_feature 1..20: note = CRISPR gRNA sequence
  source 1..20: mol_type = other DNA
gtgtcactgtactccagcct

SEQ ID NO: 54558 - DNA, 20 bp, synthetic construct
  misc_feature 1..20: note = CRISPR gRNA sequence
  source 1..20: mol_type = other DNA
ctgtactccagccttggtaa

SEQ ID NO: 54559 - DNA, 20 bp, synthetic construct
  misc_feature 1..20: note = CRISPR gRNA sequence
  source 1..20: mol_type = other DNA
gtactccagccttggtaaca

SEQ ID NO: 54560 - DNA, 20 bp, synthetic construct
  misc_feature 1..20: note = CRISPR gRNA sequence
  source 1..20: mol_type = other DNA
tccagccttggtaacagagc

SEQ ID NO: 54561 - DNA, 20 bp, synthetic construct
  misc_feature 1..20: note = CRISPR gRNA sequence
  source 1..20: mol_type = other DNA
agagcaagatcctgtctcta

SEQ ID NO: 54562 - DNA, 20 bp, synthetic construct
  misc_feature 1..20: note = CRISPR gRNA sequence
  source 1..20: mol_type = other DNA
tattatcatttttttttcta

SEQ ID NO: 54563 - DNA, 20 bp, synthetic construct
  misc_feature 1..20: note = CRISPR gRNA sequence
  source 1..20: mol_type = other DNA
tttttttctatggttccact

SEQ ID NO: 54564 - DNA, 20 bp, synthetic construct
  misc_feature 1..20: note = CRISPR gRNA sequence
  source 1..20: mol_type = other DNA
tggttccactgagttctctc

SEQ ID NO: 54565 - DNA, 20 bp, synthetic construct
  misc_feature 1..20: note = CRISPR gRNA sequence
  source 1..20: mol_type = other DNA
ttccactgagttctctctgg

SEQ ID NO: 54566 - DNA, 20 bp, synthetic construct
  misc_feature 1..20: note = CRISPR gRNA sequence
  source 1..20: mol_type = other DNA
agttctctctggaagtaact

SEQ ID NO: 54567 - DNA, 20 bp, synthetic construct
  misc_feature 1..20: note = CRISPR gRNA sequence
  source 1..20: mol_type = other DNA
ttagtctaactaatatccct

SEQ ID NO: 54568 - DNA, 20 bp, synthetic construct
  misc_feature 1..20: note = CRISPR gRNA sequence
  source 1..20: mol_type = other DNA
tatccctcggttaaacattc

SEQ ID NO: 54569 - DNA, 20 bp, synthetic construct
  misc_feature 1..20: note = CRISPR gRNA sequence
  source 1..20: mol_type = other DNA
ttcctattataaccaatact

SEQ ID NO: 54570 - DNA, 20 bp, synthetic construct
  misc_feature 1..20: note = CRISPR gRNA sequence
  source 1..20: mol_type = other DNA
tcctattataaccaatactg

SEQ ID NO: 54571 - DNA, 20 bp, synthetic construct
  misc_feature 1..20: note = CRISPR gRNA sequence
  source 1..20: mol_type = other DNA
tactgaggtgaacatcccta

SEQ ID NO: 54572 - DNA, 20 bp, synthetic construct
  misc_feature 1..20: note = CRISPR gRNA sequence
  source 1..20: mol_type = other DNA
cacaatcgtgataatttatt

SEQ ID NO: 54573 - DNA, 20 bp, synthetic construct
  misc_feature 1..20: note = CRISPR gRNA sequence
  source 1..20: mol_type = other DNA
cgtgataatttatttagtat

SEQ ID NO: 54574 - DNA, 20 bp, synthetic construct
  misc_feature 1..20: note = CRISPR gRNA sequence
  source 1..20: mol_type = other DNA
atttatttagtataagttcc

SEQ ID NO: 54575 - DNA, 20 bp, synthetic construct
  misc_feature 1..20: note = CRISPR gRNA sequence
  source 1..20: mol_type = other DNA
tatttagtataagttcctgg

SEQ ID NO: 54576 - DNA, 20 bp, synthetic construct
  misc_feature 1..20: note = CRISPR gRNA sequence
  source 1..20: mol_type = other DNA
tataagttcctggaagtgaa

SEQ ID NO: 54577 - DNA, 20 bp, synthetic construct
  misc_feature 1..20: note = CRISPR gRNA sequence
  source 1..20: mol_type = other DNA
ataagttcctggaagtgaac

SEQ ID NO: 54578 - DNA, 20 bp, synthetic construct
  misc_feature 1..20: note = CRISPR gRNA sequence
  source 1..20: mol_type = other DNA
taagttcctggaagtgaaca

SEQ ID NO: 54579 - DNA, 20 bp, synthetic construct
  misc_feature 1..20: note = CRISPR gRNA sequence
  source 1..20: mol_type = other DNA
gaagtgaacagggcatcgct

SEQ ID NO: 54580 - DNA, 20 bp, synthetic construct
  misc_feature 1..20: note = CRISPR gRNA sequence
  source 1..20: mol_type = other DNA
gggcatcgcttggaatgcac

SEQ ID NO: 54581 - DNA, 20 bp, synthetic construct
  misc_feature 1..20: note = CRISPR gRNA sequence
  source 1..20: mol_type = other DNA
ggcatcgcttggaatgcact

SEQ ID NO: 54582 - DNA, 20 bp, synthetic construct
  misc_feature 1..20: note = CRISPR gRNA sequence
  source 1..20: mol_type = other DNA
gcatcgcttggaatgcacta

SEQ ID NO: 54583 - DNA, 20 bp, synthetic construct
  misc_feature 1..20: note = CRISPR gRNA sequence
  source 1..20: mol_type = other DNA
ctttattgaatcatcatata

SEQ ID NO: 54584 - DNA, 20 bp, synthetic construct
  misc_feature 1..20: note = CRISPR gRNA sequence
  source 1..20: mol_type = other DNA
atcatcatatacagtgaacc

SEQ ID NO: 54585 - DNA, 20 bp, synthetic construct
  misc_feature 1..20: note = CRISPR gRNA sequence
  source 1..20: mol_type = other DNA
tcatcatatacagtgaacca

SEQ ID NO: 54586 - DNA, 20 bp, synthetic construct
  misc_feature 1..20: note = CRISPR gRNA sequence
  source 1..20: mol_type = other DNA
aggtcccctaatctaccttt

SEQ ID NO: 54587 - DNA, 20 bp, synthetic construct
  misc_feature 1..20: note = CRISPR gRNA sequence
  source 1..20: mol_type = other DNA
ggtcccctaatctacctttt

SEQ ID NO: 54588 - DNA, 20 bp, synthetic construct
  misc_feature 1..20: note = CRISPR gRNA sequence
  source 1..20: mol_type = other DNA
aatctaccttttgggtgaat

SEQ ID NO: 54589 - DNA, 20 bp, synthetic construct
  misc_feature 1..20: note = CRISPR gRNA sequence
  source 1..20: mol_type = other DNA
cggtttccctctcctccctt

SEQ ID NO: 54590 - DNA, 20 bp, synthetic construct
  misc_feature 1..20: note = CRISPR gRNA sequence
  source 1..20: mol_type = other DNA
ggtttccctctcctcccttg

SEQ ID NO: 54591 - DNA, 20 bp, synthetic construct
  misc_feature 1..20: note = CRISPR gRNA sequence
  source 1..20: mol_type = other DNA
gtttccctctcctcccttga

SEQ ID NO: 54592 - DNA, 20 bp, synthetic construct
  misc_feature 1..20: note = CRISPR gRNA sequence
  source 1..20: mol_type = other DNA
tttccctctcctcccttgag

SEQ ID NO: 54593 - DNA, 20 bp, synthetic construct
  misc_feature 1..20: note = CRISPR gRNA sequence
  source 1..20: mol_type = other DNA
cctcccttgaggggtgttta

SEQ ID NO: 54594 - DNA, 20 bp, synthetic construct
  misc_feature 1..20: note = CRISPR gRNA sequence
  source 1..20: mol_type = other DNA
cccttgaggggtgtttaaag

SEQ ID NO: 54595 - DNA, 20 bp, synthetic construct
  misc_feature 1..20: note = CRISPR gRNA sequence
  source 1..20: mol_type = other DNA
ccttgaggggtgtttaaagc

SEQ ID NO: 54596 - DNA, 20 bp, synthetic construct
  misc_feature 1..20: note = CRISPR gRNA sequence
  source 1..20: mol_type = other DNA
cttgaggggtgtttaaagca

SEQ ID NO: 54597 - DNA, 20 bp, synthetic construct
  misc_feature 1..20: note = CRISPR gRNA sequence
  source 1..20: mol_type = other DNA
taaagcagggaccaccctac

SEQ ID NO: 54598 - DNA, 20 bp, synthetic construct
  misc_feature 1..20: note = CRISPR gRNA sequence
  source 1..20: mol_type = other DNA
aaagcagggaccaccctact

SEQ ID NO: 54599 - DNA, 20 bp, synthetic construct
  misc_feature 1..20: note = CRISPR gRNA sequence
  source 1..20: mol_type = other DNA
agggaccaccctactgggtt

SEQ ID NO: 54600 - DNA, 20 bp, synthetic construct
  misc_feature 1..20: note = CRISPR gRNA sequence
  source 1..20: mol_type = other DNA
caccctactgggttgagaat

SEQ ID NO: 54601 - DNA, 20 bp, synthetic construct
  misc_feature 1..20: note = CRISPR gRNA sequence
  source 1..20: mol_type = other DNA
accctactgggttgagaatg

SEQ ID NO: 54602 - DNA, 20 bp, synthetic construct
  misc_feature 1..20: note = CRISPR gRNA sequence
  source 1..20: mol_type = other DNA
tgagaatgaggctttcctcc

SEQ ID NO: 54603 - DNA, 20 bp, synthetic construct
  misc_feature 1..20: note = CRISPR gRNA sequence
  source 1..20: mol_type = other DNA
gaatgaggctttcctccgag

SEQ ID NO: 54604 - DNA, 20 bp, synthetic construct
  misc_feature 1..20: note = CRISPR gRNA sequence
  source 1..20: mol_type = other DNA
aatgaggctttcctccgagt

SEQ ID NO: 54605 - DNA, 20 bp, synthetic construct
  misc_feature 1..20: note = CRISPR gRNA sequence
  source 1..20: mol_type = other DNA
ctttcctccgagtgggaact

SEQ ID NO: 54606 - DNA, 20 bp, synthetic construct
  misc_feature 1..20: note = CRISPR gRNA sequence
  source 1..20: mol_type = other DNA
cctcacctccccatactcaa

SEQ ID NO: 54607 - DNA, 20 bp, synthetic construct
  misc_feature 1..20: note = CRISPR gRNA sequence
  source 1..20: mol_type = other DNA
acctccccatactcaacggc

SEQ ID NO: 54608 - DNA, 20 bp, synthetic construct
  misc_feature 1..20: note = CRISPR gRNA sequence
  source 1..20: mol_type = other DNA
atactcaacggcgagactta

SEQ ID NO: 54609 - DNA, 20 bp, synthetic construct
  misc_feature 1..20: note = CRISPR gRNA sequence
  source 1..20: mol_type = other DNA
aacggcgagacttacagaaa

SEQ ID NO: 54610 - DNA, 20 bp, synthetic construct
  misc_feature 1..20: note = CRISPR gRNA sequence
  source 1..20: mol_type = other DNA
acggcgagacttacagaaat

SEQ ID NO: 54611 - DNA, 20 bp, synthetic construct
  misc_feature 1..20: note = CRISPR gRNA sequence
  source 1..20: mol_type = other DNA
gagacttacagaaataggat

SEQ ID NO: 54612 - DNA, 20 bp, synthetic construct
  misc_feature 1..20: note = CRISPR gRNA sequence
  source 1..20: mol_type = other DNA
agacttacagaaataggatt

SEQ ID NO: 54613 - DNA, 20 bp, synthetic construct
  misc_feature 1..20: note = CRISPR gRNA sequence
  source 1..20: mol_type = other DNA
agaaataggattgggttccc

SEQ ID NO: 54614 - DNA, 20 bp, synthetic construct
  misc_feature 1..20: note = CRISPR gRNA sequence
  source 1..20: mol_type = other DNA
aataggattgggttccctag

SEQ ID NO: 54615 - DNA, 20 bp, synthetic construct
  misc_feature 1..20: note = CRISPR gRNA sequence
  source 1..20: mol_type = other DNA
aggattgggttccctagtgg

SEQ ID NO: 54616 - DNA, 20 bp, synthetic construct
  misc_feature 1..20: note = CRISPR gRNA sequence
  source 1..20: mol_type = other DNA
gattgggttccctagtggca

SEQ ID NO: 54617 - DNA, 20 bp, synthetic construct
  misc_feature 1..20: note = CRISPR gRNA sequence
  source 1..20: mol_type = other DNA
ggttccctagtggcagagcc

SEQ ID NO: 54618 - DNA, 20 bp, synthetic construct
  misc_feature 1..20: note = CRISPR gRNA sequence
  source 1..20: mol_type = other DNA
gttccctagtggcagagcct

SEQ ID NO: 54619 - DNA, 20 bp, synthetic construct
  misc_feature 1..20: note = CRISPR gRNA sequence
  source 1..20: mol_type = other DNA
gtggcagagcctgggtctgt

SEQ ID NO: 54620 - DNA, 20 bp, synthetic construct
  misc_feature 1..20: note = CRISPR gRNA sequence
  source 1..20: mol_type = other DNA
gcagagcctgggtctgtgag

SEQ ID NO: 54621 - DNA, 20 bp, synthetic construct
  misc_feature 1..20: note = CRISPR gRNA sequence
  source 1..20: mol_type = other DNA
cagagcctgggtctgtgagt

SEQ ID NO: 54622 - DNA, 20 bp, synthetic construct
  misc_feature 1..20: note = CRISPR gRNA sequence
  source 1..20: mol_type = other DNA
agagcctgggtctgtgagtg

SEQ ID NO: 54623 - DNA, 20 bp, synthetic construct
  misc_feature 1..20: note = CRISPR gRNA sequence
  source 1..20: mol_type = other DNA
gcctgggtctgtgagtgggg

SEQ ID NO: 54624 - DNA, 20 bp, synthetic construct
  misc_feature 1..20: note = CRISPR gRNA sequence
  source 1..20: mol_type = other DNA
cctgggtctgtgagtggggt

SEQ ID NO: 54625 - DNA, 20 bp, synthetic construct
  misc_feature 1..20: note = CRISPR gRNA sequence
  source 1..20: mol_type = other DNA
ctgggtctgtgagtggggta

SEQ ID NO: 54626 - DNA, 20 bp, synthetic construct
  misc_feature 1..20: note = CRISPR gRNA sequence
  source 1..20: mol_type = other DNA
tgggtctgtgagtggggtag

SEQ ID NO: 54627 - DNA, 20 bp, synthetic construct
  misc_feature 1..20: note = CRISPR gRNA sequence
  source 1..20: mol_type = other DNA
gggtctgtgagtggggtagg

SEQ ID NO: 54628 - DNA, 20 bp, synthetic construct
  misc_feature 1..20: note = CRISPR gRNA sequence
  source 1..20: mol_type = other DNA
gggggtcgcatgtcacttgt

SEQ ID NO: 54629 - DNA, 20 bp, synthetic construct
  misc_feature 1..20: note = CRISPR gRNA sequence
  source 1..20: mol_type = other DNA
ttgcgcacatcatgaactga

SEQ ID NO: 54630 - DNA, 20 bp, synthetic construct
  misc_feature 1..20: note = CRISPR gRNA sequence
  source 1..20: mol_type = other DNA
atgaactgacggtctgctct

SEQ ID NO: 54631 - DNA, 20 bp, synthetic construct
  misc_feature 1..20: note = CRISPR gRNA sequence
  source 1..20: mol_type = other DNA
tgaactgacggtctgctctc

SEQ ID NO: 54632 - DNA, 20 bp, synthetic construct
  misc_feature 1..20: note = CRISPR gRNA sequence
  source 1..20: mol_type = other DNA
aactgacggtctgctctcag

SEQ ID NO: 54633 - DNA, 20 bp, synthetic construct
  misc_feature 1..20: note = CRISPR gRNA sequence
  source 1..20: mol_type = other DNA
cggtctgctctcaggagaaa

SEQ ID NO: 54634 - DNA, 20 bp, synthetic construct
  misc_feature 1..20: note = CRISPR gRNA sequence
  source 1..20: mol_type = other DNA
ctgctctcaggagaaacagt

SEQ ID NO: 54635 - DNA, 20 bp, synthetic construct
  misc_feature 1..20: note = CRISPR gRNA sequence
  source 1..20: mol_type = other DNA
tgctctcaggagaaacagta

SEQ ID NO: 54636 - DNA, 20 bp, synthetic construct
  misc_feature 1..20: note = CRISPR gRNA sequence
  source 1..20: mol_type = other DNA
gctctcaggagaaacagtaa

SEQ ID NO: 54637 - DNA, 20 bp, synthetic construct
  misc_feature 1..20: note = CRISPR gRNA sequence
  source 1..20: mol_type = other DNA
aggagaaacagtaagggact

SEQ ID NO: 54638 - DNA, 20 bp, synthetic construct
  misc_feature 1..20: note = CRISPR gRNA sequence
  source 1..20: mol_type = other DNA
ggagaaacagtaagggactg

SEQ ID NO: 54639 - DNA, 20 bp, synthetic construct
  misc_feature 1..20: note = CRISPR gRNA sequence
  source 1..20: mol_type = other DNA
gagaaacagtaagggactga

SEQ ID NO: 54640 - DNA, 20 bp, synthetic construct
  misc_feature 1..20: note = CRISPR gRNA sequence
  source 1..20: mol_type = other DNA
aaacagtaagggactgaggg

SEQ ID NO: 54641 - DNA, 20 bp, synthetic construct
  misc_feature 1..20: note = CRISPR gRNA sequence
  source 1..20: mol_type = other DNA
agggactgagggaagccaaa

SEQ ID NO: 54642 - DNA, 20 bp, synthetic construct
  misc_feature 1..20: note = CRISPR gRNA sequence
  source 1..20: mol_type = other DNA
ggactgagggaagccaaacg

SEQ ID NO: 54643 - DNA, 20 bp, synthetic construct
  misc_feature 1..20: note = CRISPR gRNA sequence
  source 1..20: mol_type = other DNA
tgagggaagccaaacggagc

SEQ ID NO: 54644 - DNA, 20 bp, synthetic construct
  misc_feature 1..20: note = CRISPR gRNA sequence
  source 1..20: mol_type = other DNA
agccaaacggagcaagtcct

SEQ ID NO: 54645 - DNA, 20 bp, synthetic construct
  misc_feature 1..20: note = CRISPR gRNA sequence
  source 1..20: mol_type = other DNA
aacggagcaagtccttggcc

SEQ ID NO: 54646 - DNA, 20 bp, synthetic construct
  misc_feature 1..20: note = CRISPR gRNA sequence
  source 1..20: mol_type = other DNA
aagtccttggcctagtctcc

SEQ ID NO: 54647 - DNA, 20 bp, synthetic construct
  misc_feature 1..20: note = CRISPR gRNA sequence
  source 1..20: mol_type = other DNA
agtccttggcctagtctccc

SEQ ID NO: 54648 - DNA, 20 bp, synthetic construct
  misc_feature 1..20: note = CRISPR gRNA sequence
  source 1..20: mol_type = other DNA
gtccttggcctagtctccca

SEQ ID NO: 54649 - DNA, 20 bp, synthetic construct
  misc_feature 1..20: note = CRISPR gRNA sequence
  source 1..20: mol_type = other DNA
ccttggcctagtctcccagg

SEQ ID NO: 54650 - DNA, 20 bp, synthetic construct
  misc_feature 1..20: note = CRISPR gRNA sequence
  source 1..20: mol_type = other DNA
cccagggagctttgtcccac

SEQ ID NO: 54651 - DNA, 20 bp, synthetic construct
  misc_feature 1..20: note = CRISPR gRNA sequence
  source 1..20: mol_type = other DNA
cagggagctttgtcccactg

SEQ ID NO: 54652 - DNA, 20 bp, synthetic construct
  misc_feature 1..20: note = CRISPR gRNA sequence
  source 1..20: mol_type = other DNA
gggagctttgtcccactgga

SEQ ID NO: 54653 - DNA, 20 bp, synthetic construct
  misc_feature 1..20: note = CRISPR gRNA sequence
  source 1..20: mol_type = other DNA
ctttgtcccactggagagtt

SEQ ID NO: 54654 - DNA, 20 bp, synthetic construct
  misc_feature 1..20: note = CRISPR gRNA sequence
  source 1..20: mol_type = other DNA
tttgtcccactggagagttt

SEQ ID NO: 54655 - DNA, 20 bp, synthetic construct
  misc_feature 1..20: note = CRISPR gRNA sequence
  source 1..20: mol_type = other DNA
tcccactggagagtttgggc

SEQ ID NO: 54656 - DNA, 20 bp, synthetic construct
  misc_feature 1..20: note = CRISPR gRNA sequence
  source 1..20: mol_type = other DNA
ccactggagagtttgggctg

SEQ ID NO: 54657 - DNA, 20 bp, synthetic construct
  misc_feature 1..20: note = CRISPR gRNA sequence
  source 1..20: mol_type = other DNA
actggagagtttgggctgga

SEQ ID NO: 54658 - DNA, 20 bp, synthetic construct
  misc_feature 1..20: note = CRISPR gRNA sequence
  source 1..20: mol_type = other DNA
gtgccctctgcctctgtcat

SEQ ID NO: 54659 - DNA, 20 bp, synthetic construct
  misc_feature 1..20: note = CRISPR gRNA sequence
  source 1..20: mol_type = other DNA
gcctctgtcattggccactc

SEQ ID NO: 54660 - DNA, 20 bp, synthetic construct
  misc_feature 1..20: note = CRISPR gRNA sequence
  source 1..20: mol_type = other DNA
cctctgtcattggccactct

SEQ ID NO: 54661 - DNA, 20 bp, synthetic construct
  misc_feature 1..20: note = CRISPR gRNA sequence
  source 1..20: mol_type = other DNA
tgtcattggccactctaggt

SEQ ID NO: 54662 - DNA, 20 bp, synthetic construct
  misc_feature 1..20: note = CRISPR gRNA sequence
  source 1..20: mol_type = other DNA
gtcattggccactctaggtt

SEQ ID NO: 54663 - DNA, 20 bp, synthetic construct
  misc_feature 1..20: note = CRISPR gRNA sequence
  source 1..20: mol_type = other DNA
tcattggccactctaggtta

SEQ ID NO: 54664 - DNA, 20 bp, synthetic construct
  misc_feature 1..20: note = CRISPR gRNA sequence
  source 1..20: mol_type = other DNA
cattggccactctaggttag

SEQ ID NO: 54665 - DNA, 20 bp, synthetic construct
  misc_feature 1..20: note = CRISPR gRNA sequence
  source 1..20: mol_type = other DNA
ggccactctaggttagggga

SEQ ID NO: 54666 - DNA, 20 bp, synthetic construct
  misc_feature 1..20: note = CRISPR gRNA sequence
  source 1..20: mol_type = other DNA
cactctaggttaggggaaag

SEQ ID NO: 54667 - DNA, 20 bp, synthetic construct
  misc_feature 1..20: note = CRISPR gRNA sequence
  source 1..20: mol_type = other DNA
actctaggttaggggaaagt

SEQ ID NO: 54668 - DNA, 20 bp, synthetic construct
  misc_feature 1..20: note = CRISPR gRNA sequence
  source 1..20: mol_type = other DNA
ctctaggttaggggaaagtg

SEQ ID NO: 54669 - DNA, 20 bp, synthetic construct
  misc_feature 1..20: note = CRISPR gRNA sequence
  source 1..20: mol_type = other DNA
tctaggttaggggaaagtgg

SEQ ID NO: 54670 - DNA, 20 bp, synthetic construct
  misc_feature 1..20: note = CRISPR gRNA sequence
  source 1..20: mol_type = other DNA
aagtgggggttgtaccctgc

SEQ ID NO: 54671 - DNA, 20 bp, synthetic construct
  misc_feature 1..20: note = CRISPR gRNA sequence
  source 1..20: mol_type = other DNA
agtgggggttgtaccctgcc

SEQ ID NO: 54672 - DNA, 20 bp, synthetic construct
  misc_feature 1..20: note = CRISPR gRNA sequence
  source 1..20: mol_type = other DNA
tgtaccctgccaggcgtctc

SEQ ID NO: 54673 - DNA, 20 bp, synthetic construct
  misc_feature 1..20: note = CRISPR gRNA sequence
  source 1..20: mol_type = other DNA
caggcgtctctggttcttat

SEQ ID NO: 54674 - DNA, 20 bp, synthetic construct
  misc_feature 1..20: note = CRISPR gRNA sequence
  source 1..20: mol_type = other DNA
gtctctggttcttatcagcc

SEQ ID NO: 54675 - DNA, 20 bp, synthetic construct
  misc_feature 1..20: note = CRISPR gRNA sequence
  source 1..20: mol_type = other DNA
tctctggttcttatcagcca

SEQ ID NO: 54676 - DNA, 20 bp, synthetic construct
  misc_feature 1..20: note = CRISPR gRNA sequence
  source 1..20: mol_type = other DNA
ctctggttcttatcagccaa

SEQ ID NO: 54677 - DNA, 20 bp, synthetic construct
  misc_feature 1..20: note = CRISPR gRNA sequence
  source 1..20: mol_type = other DNA
tggttcttatcagccaaggg

SEQ ID NO: 54678 - DNA, 20 bp, synthetic construct
  misc_feature 1..20: note = CRISPR gRNA sequence
  source 1..20: mol_type = other DNA
atcagccaagggtagttctc

SEQ ID NO: 54679 - DNA, 20 bp, synthetic construct
  misc_feature 1..20: note = CRISPR gRNA sequence
  source 1..20: mol_type = other DNA
cagccaagggtagttctcca

SEQ ID NO: 54680 - DNA, 20 bp, synthetic construct
  misc_feature 1..20: note = CRISPR gRNA sequence
  source 1..20: mol_type = other DNA
agccaagggtagttctccag

SEQ ID NO: 54681 - DNA, 20 bp, synthetic construct
  misc_feature 1..20: note = CRISPR gRNA sequence
  source 1..20: mol_type = other DNA
tctccagaggtataaaccat

SEQ ID NO: 54682 - DNA, 20 bp, synthetic construct
  misc_feature 1..20: note = CRISPR gRNA sequence
  source 1..20: mol_type = other DNA
ccagaggtataaaccatgag

SEQ ID NO: 54683 - DNA, 20 bp, synthetic construct
  misc_feature 1..20: note = CRISPR gRNA sequence
  source 1..20: mol_type = other DNA
ccatgagcagcctatatcca

SEQ ID NO: 54684 - DNA, 20 bp, synthetic construct
  misc_feature 1..20: note = CRISPR gRNA sequence
  source 1..20: mol_type = other DNA
tgagcagcctatatccacag

SEQ ID NO: 54685 - DNA, 20 bp, synthetic construct
  misc_feature 1..20: note = CRISPR gRNA sequence
  source 1..20: mol_type = other DNA
cagcctatatccacagcagc

SEQ ID NO: 54686 - DNA, 20 bp, synthetic construct
  misc_feature 1..20: note = CRISPR gRNA sequence
  source 1..20: mol_type = other DNA
agcctatatccacagcagct

SEQ ID NO: 54687 - DNA, 20 bp, synthetic construct
  misc_feature 1..20: note = CRISPR gRNA sequence
  source 1..20: mol_type = other DNA
ctatatccacagcagctagg

SEQ ID NO: 54688 - DNA, 20 bp, synthetic construct
  misc_feature 1..20: note = CRISPR gRNA sequence
  source 1..20: mol_type = other DNA
atatccacagcagctaggaa

SEQ ID NO: 54689 - DNA, 20 bp, synthetic construct
  misc_feature 1..20: note = CRISPR gRNA sequence
  source 1..20: mol_type = other DNA
tatccacagcagctaggaag

SEQ ID NO: 54690 - DNA, 20 bp, synthetic construct
  misc_feature 1..20: note = CRISPR gRNA sequence
  source 1..20: mol_type = other DNA
atccacagcagctaggaaga

SEQ ID NO: 54691 - DNA, 20 bp, synthetic construct
  misc_feature 1..20: note = CRISPR gRNA sequence
  source 1..20: mol_type = other DNA
tccacagcagctaggaagag

SEQ ID NO: 54692 - DNA, 20 bp, synthetic construct
  misc_feature 1..20: note = CRISPR gRNA sequence
  source 1..20: mol_type = other DNA
gcagctaggaagaggggtgc

SEQ ID NO: 54693 - DNA, 20 bp, synthetic construct
  misc_feature 1..20: note = CRISPR gRNA sequence
  source 1..20: mol_type = other DNA
aagaggggtgccggctgtaa

SEQ ID NO: 54694 - DNA, 20 bp, synthetic construct
  misc_feature 1..20: note = CRISPR gRNA sequence
  source 1..20: mol_type = other DNA
agaggggtgccggctgtaac

SEQ ID NO: 54695 - DNA, 20 bp, synthetic construct
  misc_feature 1..20: note = CRISPR gRNA sequence
  source 1..20: mol_type = other DNA
gaggggtgccggctgtaacg

SEQ ID NO: 54696 - DNA, 20 bp, synthetic construct
  misc_feature 1..20: note = CRISPR gRNA sequence
  source 1..20: mol_type = other DNA
gtgccggctgtaacggggtc

SEQ ID NO: 54697 - DNA, 20 bp, synthetic construct
  misc_feature 1..20: note = CRISPR gRNA sequence
  source 1..20: mol_type = other DNA
tgccggctgtaacggggtct

SEQ ID NO: 54698 - DNA, 20 bp, synthetic construct
  misc_feature 1..20: note = CRISPR gRNA sequence
  source 1..20: mol_type = other DNA
cggctgtaacggggtctggg

SEQ ID NO: 54699 - DNA, 20 bp, synthetic construct
  misc_feature 1..20: note = CRISPR gRNA sequence
  source 1..20: mol_type = other DNA
ggctgtaacggggtctgggt

SEQ ID NO: 54700 - DNA, 20 bp, synthetic construct
  misc_feature 1..20: note = CRISPR gRNA sequence
  source 1..20: mol_type = other DNA
gtaacggggtctgggtggga

SEQ ID NO: 54701 - DNA, 20 bp, synthetic construct
  misc_feature 1..20: note = CRISPR gRNA sequence
  source 1..20: mol_type = other DNA
acggggtctgggtgggacag

SEQ ID NO: 54702 - DNA, 20 bp, synthetic construct
  misc_feature 1..20: note = CRISPR gRNA sequence
  source 1..20: mol_type = other DNA
gggtctgggtgggacagcag

SEQ ID NO: 54703 - DNA, 20 bp, synthetic construct
  misc_feature 1..20: note = CRISPR gRNA sequence
  source 1..20: mol_type = other DNA
cagcatcttctgcccgtccc

SEQ ID NO: 54704 - DNA, 20 bp, synthetic construct
  misc_feature 1..20: note = CRISPR gRNA sequence
  source 1..20: mol_type = other DNA
agcatcttctgcccgtccca

SEQ ID NO: 54705 - DNA, 20 bp, synthetic construct
  misc_feature 1..20: note = CRISPR gRNA sequence
  source 1..20: mol_type = other DNA
cttctgcccgtcccaaggcc

SEQ ID NO: 54706 - DNA, 20 bp, synthetic construct
  misc_feature 1..20: note = CRISPR gRNA sequence
  source 1..20: mol_type = other DNA
ttctgcccgtcccaaggcct

SEQ ID NO: 54707 - DNA, 20 bp, synthetic construct
  misc_feature 1..20: note = CRISPR gRNA sequence
  source 1..20: mol_type = other DNA
cccgtcccaaggcctgggcc

SEQ ID NO: 54708 - DNA, 20 bp, synthetic construct
  misc_feature 1..20: note = CRISPR gRNA sequence
  source 1..20: mol_type = other DNA
gtcccaaggcctgggcccag

SEQ ID NO: 54709 - DNA, 20 bp, synthetic construct
  misc_feature 1..20: note = CRISPR gRNA sequence
  source 1..20: mol_type = other DNA
tcccaaggcctgggcccaga

SEQ ID NO: 54710 - DNA, 20 bp, synthetic construct
  misc_feature 1..20: note = CRISPR gRNA sequence
  source 1..20: mol_type = other DNA
ctgggcccagaaggaattcc

SEQ ID NO: 54711 - DNA, 20 bp, synthetic construct
  misc_feature 1..20: note = CRISPR gRNA sequence
  source 1..20: mol_type = other DNA
tgggcccagaaggaattcca

SEQ ID NO: 54712 - DNA, 20 bp, synthetic construct
  misc_feature 1..20: note = CRISPR gRNA sequence
  source 1..20: mol_type = other DNA
gggcccagaaggaattccaa

SEQ ID NO: 54713 - DNA, 20 bp, synthetic construct
  misc_feature 1..20: note = CRISPR gRNA sequence
  source 1..20: mol_type = other DNA
agaaggaattccaagggctt

SEQ ID NO: 54714 - DNA, 20 bp, synthetic construct
  misc_feature 1..20: note = CRISPR gRNA sequence
  source 1..20: mol_type = other DNA
aaggaattccaagggcttca

SEQ ID NO: 54715 - DNA, 20 bp, synthetic construct
  misc_feature 1..20: note = CRISPR gRNA sequence
  source 1..20: mol_type = other DNA
ggaattccaagggcttcaga

SEQ ID NO: 54716 - DNA, 20 bp, synthetic construct
  misc_feature 1..20: note = CRISPR gRNA sequence
  source 1..20: mol_type = other DNA
aattccaagggcttcagaga

SEQ ID NO: 54717 - DNA, 20 bp, synthetic construct
  misc_feature 1..20: note = CRISPR gRNA sequence
  source 1..20: mol_type = other DNA
gggcttcagagagagcatga

SEQ ID NO: 54718 - DNA, 20 bp, synthetic construct
  misc_feature 1..20: note = CRISPR gRNA sequence
  source 1..20: mol_type = other DNA
ggcttcagagagagcatgat

SEQ ID NO: 54719 - DNA, 20 bp, synthetic construct
  misc_feature 1..20: note = CRISPR gRNA sequence
  source 1..20: mol_type = other DNA
gcttcagagagagcatgatg

SEQ ID NO: 54720 - DNA, 20 bp, synthetic construct
  misc_feature 1..20: note = CRISPR gRNA sequence
  source 1..20: mol_type = other DNA
cttcagagagagcatgatgg

SEQ ID NO: 54721 - DNA, 20 bp, synthetic construct
  misc_feature 1..20: note = CRISPR gRNA sequence
  source 1..20: mol_type = other DNA
ttcagagagagcatgatggg

SEQ ID NO: 54722 - DNA, 20 bp, synthetic construct
  misc_feature 1..20: note = CRISPR gRNA sequence
  source 1..20: mol_type = other DNA
tcagagagagcatgatgggg

SEQ ID NO: 54723 - DNA, 20 bp, synthetic construct
  misc_feature 1..20: note = CRISPR gRNA sequence
  source 1..20: mol_type = other DNA
cagagagagcatgatggggg

SEQ ID NO: 54724 - DNA, 20 bp, synthetic construct
  misc_feature 1..20: note = CRISPR gRNA sequence
  source 1..20: mol_type = other DNA
agagagagcatgatgggggg

SEQ ID NO: 54725 - DNA, 20 bp, synthetic construct
  misc_feature 1..20: note = CRISPR gRNA sequence
  source 1..20: mol_type = other DNA
gagagagcatgatggggggg

SEQ ID NO: 54726 - DNA, 20 bp, synthetic construct
  misc_feature 1..20: note = CRISPR gRNA sequence
  source 1..20: mol_type = other DNA
gagcatgatgggggggggga

SEQ ID NO: 54727 - DNA, 20 bp, synthetic construct
  misc_feature 1..20: note = CRISPR gRNA sequence
  source 1..20: mol_type = other DNA
agcatgatggggggggggat

SEQ ID NO: 54728 - DNA, 20 bp, synthetic construct
  misc_feature 1..20: note = CRISPR gRNA sequence
  source 1..20: mol_type = other DNA
ggggggggggatgggtaccg

SEQ ID NO: 54729 - DNA, 20 bp, synthetic construct
  misc_feature 1..20: note = CRISPR gRNA sequence
  source 1..20: mol_type = other DNA
ggggatgggtaccgtggtct

SEQ ID NO: 54730 - DNA, 20 bp, synthetic construct
  misc_feature 1..20: note = CRISPR gRNA sequence
  source 1..20: mol_type = other DNA
gggatgggtaccgtggtctg

SEQ ID NO: 54731 - DNA, 20 bp, synthetic construct
  misc_feature 1..20: note = CRISPR gRNA sequence
  source 1..20: mol_type = other DNA
ggatgggtaccgtggtctga

SEQ ID NO: 54732 - DNA, 20 bp, synthetic construct
  misc_feature 1..20: note = CRISPR gRNA sequence
  source 1..20: mol_type = other DNA
atgggtaccgtggtctgagg

SEQ ID NO: 54733 - DNA, 20 bp, synthetic construct
  misc_feature 1..20: note = CRISPR gRNA sequence
  source 1..20: mol_type = other DNA
gggagctcccacctgatgtg

SEQ ID NO: 54734 - DNA, 20 bp, synthetic construct
  misc_feature 1..20: note = CRISPR gRNA sequence
  source 1..20: mol_type = other DNA
cacctgatgtgcagctctgc

SEQ ID NO: 54735 - DNA, 20 bp, synthetic construct
  misc_feature 1..20: note = CRISPR gRNA sequence
  source 1..20: mol_type = other DNA
acctgatgtgcagctctgcc

SEQ ID NO: 54736 - DNA, 20 bp, synthetic construct
  misc_feature 1..20: note = CRISPR gRNA sequence
  source 1..20: mol_type = other DNA
cctgatgtgcagctctgcca

SEQ ID NO: 54737 - DNA, 20 bp, synthetic construct
  misc_feature 1..20: note = CRISPR gRNA sequence
  source 1..20: mol_type = other DNA
tgtgcagctctgccagggtc

SEQ ID NO: 54738 - DNA, 20 bp, synthetic construct
  misc_feature 1..20: note = CRISPR gRNA sequence
  source 1..20: mol_type = other DNA
cagggtccagcacgcactca

SEQ ID NO: 54739 - DNA, 20 bp, synthetic construct
  misc_feature 1..20: note = CRISPR gRNA sequence
  source 1..20: mol_type = other DNA
cagcacgcactcacggccct

SEQ ID NO: 54740 - DNA, 20 bp, synthetic construct
  misc_feature 1..20: note = CRISPR gRNA sequence
  source 1..20: mol_type = other DNA
cctcagcacacaatgcaccc

SEQ ID NO: 54741 - DNA, 20 bp, synthetic construct
  misc_feature 1..20: note = CRISPR gRNA sequence
  source 1..20: mol_type = other DNA
cacacaatgcaccccggcca

SEQ ID NO: 54742 - DNA, 20 bp, synthetic construct
  misc_feature 1..20: note = CRISPR gRNA sequence
  source 1..20: mol_type = other DNA
caatgcaccccggccacaga

SEQ ID NO: 54743 - DNA, 20 bp, synthetic construct
  misc_feature 1..20: note = CRISPR gRNA sequence
  source 1..20: mol_type = other DNA
acagaaagcccgttgttact

SEQ ID NO: 54744 - DNA, 20 bp, synthetic construct
  misc_feature 1..20: note = CRISPR gRNA sequence
  source 1..20: mol_type = other DNA
cagaaagcccgttgttactg

SEQ ID NO: 54745 - DNA, 20 bp, synthetic construct
  misc_feature 1..20: note = CRISPR gRNA sequence
  source 1..20: mol_type = other DNA
gcccgttgttactgaggctg

SEQ ID NO: 54746 - DNA, 20 bp, synthetic construct
  misc_feature 1..20: note = CRISPR gRNA sequence
  source 1..20: mol_type = other DNA
ccgttgttactgaggctgtg

SEQ ID NO: 54747 - DNA, 20 bp, synthetic construct
  misc_feature 1..20: note = CRISPR gRNA sequence
  source 1..20: mol_type = other DNA
gttgttactgaggctgtgga

SEQ ID NO: 54748 - DNA, 20 bp, synthetic construct
  misc_feature 1..20: note = CRISPR gRNA sequence
  source 1..20: mol_type = other DNA
gttactgaggctgtggagag

SEQ ID NO: 54749 - DNA, 20 bp, synthetic construct
  misc_feature 1..20: note = CRISPR gRNA sequence
  source 1..20: mol_type = other DNA
ttactgaggctgtggagagc

SEQ ID NO: 54750 - DNA, 20 bp, synthetic construct
  misc_feature 1..20: note = CRISPR gRNA sequence
  source 1..20: mol_type = other DNA
actgaggctgtggagagcag

SEQ ID NO: 54751 - DNA, 20 bp, synthetic construct
  misc_feature 1..20: note = CRISPR gRNA sequence
  source 1..20: mol_type = other DNA
gaggctgtggagagcaggag

SEQ ID NO: 54752 - DNA, 20 bp, synthetic construct
  misc_feature 1..20: note = CRISPR gRNA sequence
  source 1..20: mol_type = other DNA
aggctgtggagagcaggaga

SEQ ID NO: 54753 - DNA, 20 bp, synthetic construct
  misc_feature 1..20: note = CRISPR gRNA sequence
  source 1..20: mol_type = other DNA
ctgtggagagcaggagaagg

SEQ ID NO: 54754 - DNA, 20 bp, synthetic construct
  misc_feature 1..20: note = CRISPR gRNA sequence
  source 1..20: mol_type = other DNA
gagcaggagaaggcagccgt

SEQ ID NO: 54755 - DNA, 20 bp, synthetic construct
  misc_feature 1..20: note = CRISPR gRNA sequence
  source 1..20: mol_type = other DNA
agaaggcagccgttggcatg

SEQ ID NO: 54756 - DNA, 20 bp, synthetic construct
  misc_feature 1..20: note = CRISPR gRNA sequence
  source 1..20: mol_type = other DNA
gcagccgttggcatgtggct

SEQ ID NO: 54757 - DNA, 20 bp, synthetic construct
  misc_feature 1..20: note = CRISPR gRNA sequence
  source 1..20: mol_type = other DNA
cagccgttggcatgtggctg

SEQ ID NO: 54758 - DNA, 20 bp, synthetic construct
  misc_feature 1..20: note = CRISPR gRNA sequence
  source 1..20: mol_type = other DNA
tggcatgtggctgaggtacc

SEQ ID NO: 54759 - DNA, 20 bp, synthetic construct
  misc_feature 1..20: note = CRISPR gRNA sequence
  source 1..20: mol_type = other DNA
gtggctgaggtacccagccc

SEQ ID NO: 54760 - DNA, 20 bp, synthetic construct
  misc_feature 1..20: note = CRISPR gRNA sequence
  source 1..20: mol_type = other DNA
ctgaggtacccagccccagc

SEQ ID NO: 54761 - DNA, 20 bp, synthetic construct
  misc_feature 1..20: note = CRISPR gRNA sequence
  source 1..20: mol_type = other DNA
tacccagccccagccagctc

SEQ ID NO: 54762 - DNA, 20 bp, synthetic construct
  misc_feature 1..20: note = CRISPR gRNA sequence
  source 1..20: mol_type = other DNA
ccagctctagcccctccctg

SEQ ID NO: 54763 - DNA, 20 bp, synthetic construct
  misc_feature 1..20: note = CRISPR gRNA sequence
  source 1..20: mol_type = other DNA
tctagcccctccctgtggct

SEQ ID NO: 54764 - DNA, 20 bp, synthetic construct
  misc_feature 1..20: note = CRISPR gRNA sequence
  source 1..20: mol_type = other DNA
agcccctccctgtggctcag

SEQ ID NO: 54765 - DNA, 20 bp, synthetic construct
  misc_feature 1..20: note = CRISPR gRNA sequence
  source 1..20: mol_type = other DNA
cctgtggctcagcagcttgc

SEQ ID NO: 54766 - DNA, 20 bp, synthetic construct
  misc_feature 1..20: note = CRISPR gRNA sequence
  source 1..20: mol_type = other DNA
agcttgctggctgtcactcc

SEQ ID NO: 54767 - DNA, 20 bp, synthetic construct
  misc_feature 1..20: note = CRISPR gRNA sequence
  source 1..20: mol_type = other DNA
gctgtcactcctggatgtcc

SEQ ID NO: 54768 - DNA, 20 bp, synthetic construct
  misc_feature 1..20: note = CRISPR gRNA sequence
  source 1..20: mol_type = other DNA
ctgtcactcctggatgtcct

SEQ ID NO: 54769 - DNA, 20 bp, synthetic construct
  misc_feature 1..20: note = CRISPR gRNA sequence
  source 1..20: mol_type = other DNA
ggatgtcctaggtcccttgc

SEQ ID NO: 54770 - DNA, 20 bp, synthetic construct
  misc_feature 1..20: note = CRISPR gRNA sequence
  source 1..20: mol_type = other DNA
gatgtcctaggtcccttgcc

SEQ ID NO: 54771 - DNA, 20 bp, synthetic construct
  misc_feature 1..20: note = CRISPR gRNA sequence
  source 1..20: mol_type = other DNA
atgtcctaggtcccttgcca

SEQ ID NO: 54772 - DNA, 20 bp, synthetic construct
  misc_feature 1..20: note = CRISPR gRNA sequence
  source 1..20: mol_type = other DNA
tgtcctaggtcccttgccag

SEQ ID NO: 54773 - DNA, 20 bp, synthetic construct
  misc_feature 1..20: note = CRISPR gRNA sequence
  source 1..20: mol_type = other DNA
tcccttgccaggggatctca

SEQ ID NO: 54774 - DNA, 20 bp, synthetic construct
  misc_feature 1..20: note = CRISPR gRNA sequence
  source 1..20: mol_type = other DNA
cccttgccaggggatctcaa

SEQ ID NO: 54775 - DNA, 20 bp, synthetic construct
  misc_feature 1..20: note = CRISPR gRNA sequence
  source 1..20: mol_type = other DNA
caggggatctcaaaggattc

SEQ ID NO: 54776 - DNA, 20 bp, synthetic construct
  misc_feature 1..20: note = CRISPR gRNA sequence
  source 1..20: mol_type = other DNA
caaaggattctggtgcgtgt

SEQ ID NO: 54777 - DNA, 20 bp, synthetic construct
  misc_feature 1..20: note = CRISPR gRNA sequence
  source 1..20: mol_type = other DNA
ggattctggtgcgtgtgagt

SEQ ID NO: 54778 - DNA, 20 bp, synthetic construct
  misc_feature 1..20: note = CRISPR gRNA sequence
  source 1..20: mol_type = other DNA
catgacacccccatcccatt

SEQ ID NO: 54779 - DNA, 20 bp, synthetic construct
  misc_feature 1..20: note = CRISPR gRNA sequence
  source 1..20: mol_type = other DNA
cccatcccatttggaaaata

SEQ ID NO: 54780 - DNA, 20 bp, synthetic construct
  misc_feature 1..20: note = CRISPR gRNA sequence
  source 1..20: mol_type = other DNA
atttggaaaataaagttgtc

SEQ ID NO: 54781 - DNA, 20 bp, synthetic construct
  misc_feature 1..20: note = CRISPR gRNA sequence
  source 1..20: mol_type = other DNA
aataaagttgtccagcttga

SEQ ID NO: 54782 - DNA, 20 bp, synthetic construct
  misc_feature 1..20: note = CRISPR gRNA sequence
  source 1..20: mol_type = other DNA
aagttgtccagcttgacagc

SEQ ID NO: 54783 - DNA, 20 bp, synthetic construct
  misc_feature 1..20: note = CRISPR gRNA sequence
  source 1..20: mol_type = other DNA
ccagcttgacagcaagaact

SEQ ID NO: 54784 - DNA, 20 bp, synthetic construct
  misc_feature 1..20: note = CRISPR gRNA sequence
  source 1..20: mol_type = other DNA
gttttcacctctctgacccc

SEQ ID NO: 54785 - DNA, 20 bp, synthetic construct
  misc_feature 1..20: note = CRISPR gRNA sequence
  source 1..20: mol_type = other DNA
taaaataaccaccattttct

SEQ ID NO: 54786 - DNA, 20 bp, synthetic construct
  misc_feature 1..20: note = CRISPR gRNA sequence
  source 1..20: mol_type = other DNA
tttctgagccctgactatac

SEQ ID NO: 54787 - DNA, 20 bp, synthetic construct
  misc_feature 1..20: note = CRISPR gRNA sequence
  source 1..20: mol_type = other DNA
ctataccagactctgtacaa

SEQ ID NO: 54788 - DNA, 20 bp, synthetic construct
  misc_feature 1..20: note = CRISPR gRNA sequence
  source 1..20: mol_type = other DNA
tataccagactctgtacaaa

SEQ ID NO: 54789 - DNA, 20 bp, synthetic construct
  misc_feature 1..20: note = CRISPR gRNA sequence
  source 1..20: mol_type = other DNA
caaaaggctttgtacatata

SEQ ID NO: 54790 - DNA, 20 bp, synthetic construct
  misc_feature 1..20: note = CRISPR gRNA sequence
  source 1..20: mol_type = other DNA
tttcatgtgatcccatttta

SEQ ID NO: 54791 - DNA, 20 bp, synthetic construct
  misc_feature 1..20: note = CRISPR gRNA sequence
  source 1..20: mol_type = other DNA
tcatgtgatcccattttaca

SEQ ID NO: 54792 - DNA, 20 bp, synthetic construct
  misc_feature 1..20: note = CRISPR gRNA sequence
  source 1..20: mol_type = other DNA
catgtgatcccattttacag

SEQ ID NO: 54793 - DNA, 20 bp, synthetic construct
  misc_feature 1..20: note = CRISPR gRNA sequence
  source 1..20: mol_type = other DNA
atgtgatcccattttacaga

SEQ ID NO: 54794 - DNA, 20 bp, synthetic construct
  misc_feature 1..20: note = CRISPR gRNA sequence
  source 1..20: mol_type = other DNA
tgtgatcccattttacagag

SEQ ID NO: 54795 - DNA, 20 bp, synthetic construct
  misc_feature 1..20: note = CRISPR gRNA sequence
  source 1..20: mol_type = other DNA
cattttacagaggggaaacc

SEQ ID NO: 54796 - DNA, 20 bp, synthetic construct
  misc_feature 1..20: note = CRISPR gRNA sequence
  source 1..20: mol_type = other DNA
attttacagaggggaaaccg

SEQ ID NO: 54797 - DNA, 20 bp, synthetic construct
  misc_feature 1..20: note = CRISPR gRNA sequence
  source 1..20: mol_type = other DNA
acagaggggaaaccgaggcc

SEQ ID NO: 54798 - DNA, 20 bp, synthetic construct
  misc_feature 1..20: note = CRISPR gRNA sequence
  source 1..20: mol_type = other DNA
agaggggaaaccgaggccca

SEQ ID NO: 54799 - DNA, 20 bp, synthetic construct
  misc_feature 1..20: note = CRISPR gRNA sequence
  source 1..20: mol_type = other DNA
gagacattcaattactttcc

SEQ ID NO: 54800 - DNA, 20 bp, synthetic construct
  misc_feature 1..20: note = CRISPR gRNA sequence
  source 1..20: mol_type = other DNA
agacattcaattactttccc

SEQ ID NO: 54801 - DNA, 20 bp, synthetic construct
  misc_feature 1..20: note = CRISPR gRNA sequence
  source 1..20: mol_type = other DNA
cccaggttcacaatgctact

SEQ ID NO: 54802 - DNA, 20 bp, synthetic construct
  misc_feature 1..20: note = CRISPR gRNA sequence
  source 1..20: mol_type = other DNA
ttcacaatgctactaagtga

SEQ ID NO: 54803 - DNA, 20 bp, synthetic construct
  misc_feature 1..20: note = CRISPR gRNA sequence
  source 1..20: mol_type = other DNA
cacaatgctactaagtgaca

SEQ ID NO: 54804 - DNA, 20 bp, synthetic construct
  misc_feature 1..20: note = CRISPR gRNA sequence
  source 1..20: mol_type = other DNA
tgctactaagtgacagagcg

SEQ ID NO: 54805 - DNA, 20 bp, synthetic construct
  misc_feature 1..20: note = CRISPR gRNA sequence
  source 1..20: mol_type = other DNA
agagcgaagattgaaatcca

SEQ ID NO: 54806 - DNA, 20 bp, synthetic construct
  misc_feature 1..20: note = CRISPR gRNA sequence
  source 1..20: mol_type = other DNA
gaagattgaaatccaaagct

SEQ ID NO: 54807 - DNA, 20 bp, synthetic construct
  misc_feature 1..20: note = CRISPR gRNA sequence
  source 1..20: mol_type = other DNA
aagattgaaatccaaagctg

SEQ ID NO: 54808 - DNA, 20 bp, synthetic construct
  misc_feature 1..20: note = CRISPR gRNA sequence
  source 1..20: mol_type = other DNA
cccgacccacacttgatcct

SEQ ID NO: 54809 - DNA, 20 bp, synthetic construct
  misc_feature 1..20: note = CRISPR gRNA sequence
  source 1..20: mol_type = other DNA
cacttgatcctaagaccccc

SEQ ID NO: 54810 - DNA, 20 bp, synthetic construct
  misc_feature 1..20: note = CRISPR gRNA sequence
  source 1..20: mol_type = other DNA
cctcaccccatgcaacacca

SEQ ID NO: 54811 - DNA, 20 bp, synthetic construct
  misc_feature 1..20: note = CRISPR gRNA sequence
  source 1..20: mol_type = other DNA
atgcaacaccacagcacacc

SEQ ID NO: 54812 - DNA, 20 bp, synthetic construct
  misc_feature 1..20: note = CRISPR gRNA sequence
  source 1..20: mol_type = other DNA
caacaccacagcacacccag

SEQ ID NO: 54813 - DNA, 20 bp, synthetic construct
  misc_feature 1..20: note = CRISPR gRNA sequence
  source 1..20: mol_type = other DNA
cagcacacccagcagcctaa

SEQ ID NO: 54814 - DNA, 20 bp, synthetic construct
  misc_feature 1..20: note = CRISPR gRNA sequence
  source 1..20: mol_type = other DNA
ctcaccacccctcaccccaa

SEQ ID NO: 54815 - DNA, 20 bp, synthetic construct
  misc_feature 1..20: note = CRISPR gRNA sequence
  source 1..20: mol_type = other DNA
accccaacagtgtatcccca

SEQ ID NO: 54816 - DNA, 20 bp, synthetic construct
  misc_feature 1..20: note = CRISPR gRNA sequence
  source 1..20: mol_type = other DNA
ccccaacagtgtatccccac

SEQ ID NO: 54817 - DNA, 20 bp, synthetic construct
  misc_feature 1..20: note = CRISPR gRNA sequence
  source 1..20: mol_type = other DNA
gaacacaccactccctaccc

SEQ ID NO: 54818 - DNA, 20 bp, synthetic construct
  misc_feature 1..20: note = CRISPR gRNA sequence
  source 1..20: mol_type = other DNA
cactccctaccctagcaccc

SEQ ID NO: 54819 - DNA, 20 bp, synthetic construct
  misc_feature 1..20: note = CRISPR gRNA sequence
  source 1..20: mol_type = other DNA
accccagcatgacacctcca

SEQ ID NO: 54820 - DNA, 20 bp, synthetic construct
  misc_feature 1..20: note = CRISPR gRNA sequence
  source 1..20: mol_type = other DNA
cacccaccctgacacctccc

SEQ ID NO: 54821 - DNA, 20 bp, synthetic construct
  misc_feature 1..20: note = CRISPR gRNA sequence
  source 1..20: mol_type = other DNA
caccccaccccaccgtgctc

SEQ ID NO: 54822 - DNA, 20 bp, synthetic construct
  misc_feature 1..20: note = CRISPR gRNA sequence
  source 1..20: mol_type = other DNA
accccaccccaccgtgctcc

SEQ ID NO: 54823 - DNA, 20 bp, synthetic construct
  misc_feature 1..20: note = CRISPR gRNA sequence
  source 1..20: mol_type = other DNA
ccccaccccaccgtgctcca

SEQ ID NO: 54824 - DNA, 20 bp, synthetic construct
  misc_feature 1..20: note = CRISPR gRNA sequence
  source 1..20: mol_type = other DNA
caccccaccgtgctccaggg

SEQ ID NO: 54825 - DNA, 20 bp, synthetic construct
  misc_feature 1..20: note = CRISPR gRNA sequence
  source 1..20: mol_type = other DNA
cgtgctccagggcagctaca

SEQ ID NO: 54826 - DNA, 20 bp, synthetic construct
  misc_feature 1..20: note = CRISPR gRNA sequence
  source 1..20: mol_type = other DNA
gggcagctacaaagatgaat

SEQ ID NO: 54827 - DNA, 20 bp, synthetic construct
  misc_feature 1..20: note = CRISPR gRNA sequence
  source 1..20: mol_type = other DNA
acaaagatgaattggaatgc

SEQ ID NO: 54828 - DNA, 20 bp, synthetic construct
  misc_feature 1..20: note = CRISPR gRNA sequence
  source 1..20: mol_type = other DNA
tgaacgcattttacacatgt

SEQ ID NO: 54829 - DNA, 20 bp, synthetic construct
  misc_feature 1..20: note = CRISPR gRNA sequence
  source 1..20: mol_type = other DNA
gaacgcattttacacatgta

SEQ ID NO: 54830 - DNA, 20 bp, synthetic construct
  misc_feature 1..20: note = CRISPR gRNA sequence
  source 1..20: mol_type = other DNA
aacgcattttacacatgtaa

SEQ ID NO: 54831 - DNA, 20 bp, synthetic construct
  misc_feature 1..20: note = CRISPR gRNA sequence
  source 1..20: mol_type = other DNA
ttttacacatgtaagggtgc

SEQ ID NO: 54832 - DNA, 20 bp, synthetic construct
  misc_feature 1..20: note = CRISPR gRNA sequence
  source 1..20: mol_type = other DNA
atgtaagggtgctagatgat

SEQ ID NO: 54833 - DNA, 20 bp, synthetic construct
  misc_feature 1..20: note = CRISPR gRNA sequence
  source 1..20: mol_type = other DNA
gggtgctagatgattggact

SEQ ID NO: 54834 - DNA, 20 bp, synthetic construct
  misc_feature 1..20: note = CRISPR gRNA sequence
  source 1..20: mol_type = other DNA
gctagatgattggactaaga

SEQ ID NO: 54835 - DNA, 20 bp, synthetic construct
  misc_feature 1..20: note = CRISPR gRNA sequence
  source 1..20: mol_type = other DNA
agatgattggactaagacag

SEQ ID NO: 54836 - DNA, 20 bp, synthetic construct
  misc_feature 1..20: note = CRISPR gRNA sequence
  source 1..20: mol_type = other DNA
actaagacagtggctcatgc

SEQ ID NO: 54837 - DNA, 20 bp, synthetic construct
  misc_feature 1..20: note = CRISPR gRNA sequence
  source 1..20: mol_type = other DNA
taagacagtggctcatgccg

SEQ ID NO: 54838 - DNA, 20 bp, synthetic construct
  misc_feature 1..20: note = CRISPR gRNA sequence
  source 1..20: mol_type = other DNA
aagacagtggctcatgccgg

SEQ ID NO: 54839 - DNA, 20 bp, synthetic construct
  misc_feature 1..20: note = CRISPR gRNA sequence
  source 1..20: mol_type = other DNA
agtggctcatgccggaggtg

SEQ ID NO: 54840 - DNA, 20 bp, synthetic construct
  misc_feature 1..20: note = CRISPR gRNA sequence
  source 1..20: mol_type = other DNA
gtggctcatgccggaggtga

SEQ ID NO: 54841 - DNA, 20 bp, synthetic construct
  misc_feature 1..20: note = CRISPR gRNA sequence
  source 1..20: mol_type = other DNA
ctcatgccggaggtgaaggc

SEQ ID NO: 54842 - DNA, 20 bp, synthetic construct
  misc_feature 1..20: note = CRISPR gRNA sequence
  source 1..20: mol_type = other DNA
tcatgccggaggtgaaggca

SEQ ID NO: 54843 - DNA, 20 bp, synthetic construct
  misc_feature 1..20: note = CRISPR gRNA sequence
  source 1..20: mol_type = other DNA
ccggaggtgaaggcaaggca

SEQ ID NO: 54844 - DNA, 20 bp, synthetic construct
  misc_feature 1..20: note = CRISPR gRNA sequence
  source 1..20: mol_type = other DNA
tcaaaccatcttgactttgc

SEQ ID NO: 54845 - DNA, 20 bp, synthetic construct
  misc_feature 1..20: note = CRISPR gRNA sequence
  source 1..20: mol_type = other DNA
aaaccatcttgactttgctg

SEQ ID NO: 54846 - DNA, 20 bp, synthetic construct
  misc_feature 1..20: note = CRISPR gRNA sequence
  source 1..20: mol_type = other DNA
catcttgactttgctggagt

SEQ ID NO: 54847 - DNA, 20 bp, synthetic construct
  misc_feature 1..20: note = CRISPR gRNA sequence
  source 1..20: mol_type = other DNA
atcttgactttgctggagtt

SEQ ID NO: 54848 - DNA, 20 bp, synthetic construct
  misc_feature 1..20: note = CRISPR gRNA sequence
  source 1..20: mol_type = other DNA
cttgactttgctggagttgg

SEQ ID NO: 54849 - DNA, 20 bp, synthetic construct
  misc_feature 1..20: note = CRISPR gRNA sequence
  source 1..20: mol_type = other DNA
ttgactttgctggagttggg

SEQ ID NO: 54850 - DNA, 20 bp, synthetic construct
  misc_feature 1..20: note = CRISPR gRNA sequence
  source 1..20: mol_type = other DNA
actttgctggagttgggagg

SEQ ID NO: 54851 - DNA, 20 bp, synthetic construct
  misc_feature 1..20: note = CRISPR gRNA sequence
  source 1..20: mol_type = other DNA
ttgctggagttgggaggaag

SEQ ID NO: 54852 - DNA, 20 bp, synthetic construct
  misc_feature 1..20: note = CRISPR gRNA sequence
  source 1..20: mol_type = other DNA
tgctggagttgggaggaagc

SEQ ID NO: 54853 - DNA, 20 bp, synthetic construct
  misc_feature 1..20: note = CRISPR gRNA sequence
  source 1..20: mol_type = other DNA
gctggagttgggaggaagca

SEQ ID NO: 54854 - DNA, 20 bp, synthetic construct
  misc_feature 1..20: note = CRISPR gRNA sequence
  source 1..20: mol_type = other DNA
ctggagttgggaggaagcag

SEQ ID NO: 54855 - DNA, 20 bp, synthetic construct
  misc_feature 1..20: note = CRISPR gRNA sequence
  source 1..20: mol_type = other DNA
gagttgggaggaagcagggg

SEQ ID NO: 54856 - DNA, 20 bp, synthetic construct
  misc_feature 1..20: note = CRISPR gRNA sequence
  source 1..20: mol_type = other DNA
ttgggaggaagcaggggtgg

SEQ ID NO: 54857 - DNA, 20 bp, synthetic construct
  misc_feature 1..20: note = CRISPR gRNA sequence
  source 1..20: mol_type = other DNA
ggaggaagcaggggtggcag

SEQ ID NO: 54858 - DNA, 20 bp, synthetic construct
  misc_feature 1..20: note = CRISPR gRNA sequence
  source 1..20: mol_type = other DNA
aagcaggggtggcagtggat

SEQ ID NO: 54859 - DNA, 20 bp, synthetic construct
  misc_feature 1..20: note = CRISPR gRNA sequence
  source 1..20: mol_type = other DNA
cttactgctgattacgaaca

SEQ ID NO: 54860 - DNA, 20 bp, synthetic construct
  misc_feature 1..20: note = CRISPR gRNA sequence
  source 1..20: mol_type = other DNA
ttactgctgattacgaacac

SEQ ID NO: 54861 - DNA, 20 bp, synthetic construct
  misc_feature 1..20: note = CRISPR gRNA sequence
  source 1..20: mol_type = other DNA
tactgctgattacgaacacg

SEQ ID NO: 54862 - DNA, 20 bp, synthetic construct
  misc_feature 1..20: note = CRISPR gRNA sequence
  source 1..20: mol_type = other DNA
ttacgaacacggggacctcc

SEQ ID NO: 54863 - DNA, 20 bp, synthetic construct
  misc_feature 1..20: note = CRISPR gRNA sequence
  source 1..20: mol_type = other DNA
tacgaacacggggacctcct

SEQ ID NO: 54864 - DNA, 20 bp, synthetic construct
  misc_feature 1..20: note = CRISPR gRNA sequence
  source 1..20: mol_type = other DNA
acgaacacggggacctcctg

SEQ ID NO: 54865 - DNA, 20 bp, synthetic construct
  misc_feature 1..20: note = CRISPR gRNA sequence
  source 1..20: mol_type = other DNA
ggggacctcctggggctcta

SEQ ID NO: 54866 - DNA, 20 bp, synthetic construct
  misc_feature 1..20: note = CRISPR gRNA sequence
  source 1..20: mol_type = other DNA
gggacctcctggggctctac

SEQ ID NO: 54867 - DNA, 20 bp, synthetic construct
  misc_feature 1..20: note = CRISPR gRNA sequence
  source 1..20: mol_type = other DNA
ggacctcctggggctctaca

SEQ ID NO: 54868 - DNA, 20 bp, synthetic construct
  misc_feature 1..20: note = CRISPR gRNA sequence
  source 1..20: mol_type = other DNA
gggctctacagggccttccc

SEQ ID NO: 54869 - DNA, 20 bp, synthetic construct
  misc_feature 1..20: note = CRISPR gRNA sequence
  source 1..20: mol_type = other DNA
acagggccttccctggtacc

SEQ ID NO: 54870 - DNA, 20 bp, synthetic construct
  misc_feature 1..20: note = CRISPR gRNA sequence
  source 1..20: mol_type = other DNA
gggccttccctggtacccag

SEQ ID NO: 54871 - DNA, 20 bp, synthetic construct
  misc_feature 1..20: note = CRISPR gRNA sequence
  source 1..20: mol_type = other DNA
ccttccctggtacccagcgg

SEQ ID NO: 54872 - DNA, 20 bp, synthetic construct
  misc_feature 1..20: note = CRISPR gRNA sequence
  source 1..20: mol_type = other DNA
cttccctggtacccagcggt

SEQ ID NO: 54873 - DNA, 20 bp, synthetic construct
  misc_feature 1..20: note = CRISPR gRNA sequence
  source 1..20: mol_type = other DNA
ttccctggtacccagcggtg

SEQ ID NO: 54874 - DNA, 20 bp, synthetic construct
  misc_feature 1..20: note = CRISPR gRNA sequence
  source 1..20: mol_type = other DNA
cctggtacccagcggtgggg

SEQ ID NO: 54875 - DNA, 20 bp, synthetic construct
  misc_feature 1..20: note = CRISPR gRNA sequence
  source 1..20: mol_type = other DNA
gtggggtggacaactcactc

SEQ ID NO: 54876 - DNA, 20 bp, synthetic construct
  misc_feature 1..20: note = CRISPR gRNA sequence
  source 1..20: mol_type = other DNA
gacaactcactccagcttcc

SEQ ID NO: 54877 - DNA, 20 bp, synthetic construct
  misc_feature 1..20: note = CRISPR gRNA sequence
  source 1..20: mol_type = other DNA
tccagcttcctggcgatgtg

SEQ ID NO: 54878 - DNA, 20 bp, synthetic construct
  misc_feature 1..20: note = CRISPR gRNA sequence
  source 1..20: mol_type = other DNA
gcttcctggcgatgtgcagc

SEQ ID NO: 54879 - DNA, 20 bp, synthetic construct
  misc_feature 1..20: note = CRISPR gRNA sequence
  source 1..20: mol_type = other DNA
cttcctggcgatgtgcagct

SEQ ID NO: 54880 - DNA, 20 bp, synthetic construct
  misc_feature 1..20: note = CRISPR gRNA sequence
  source 1..20: mol_type = other DNA
ggcgatgtgcagctgggatg

SEQ ID NO: 54881 - DNA, 20 bp, synthetic construct
  misc_feature 1..20: note = CRISPR gRNA sequence
  source 1..20: mol_type = other DNA
tgggatgcagcctctgccat

SEQ ID NO: 54882 - DNA, 20 bp, synthetic construct
  misc_feature 1..20: note = CRISPR gRNA sequence
  source 1..20: mol_type = other DNA
cagcctctgccatcagccga

SEQ ID NO: 54883 - DNA, 20 bp, synthetic construct
  misc_feature 1..20: note = CRISPR gRNA sequence
  source 1..20: mol_type = other DNA
agccgacagccttcatcttc

SEQ ID NO: 54884 - DNA, 20 bp, synthetic construct
  misc_feature 1..20: note = CRISPR gRNA sequence
  source 1..20: mol_type = other DNA
gacagccttcatcttccagc

SEQ ID NO: 54885 - DNA, 20 bp, synthetic construct
  misc_feature 1..20: note = CRISPR gRNA sequence
  source 1..20: mol_type = other DNA
catcttccagctggttccct

SEQ ID NO: 54886 - DNA, 20 bp, synthetic construct
  misc_feature 1..20: note = CRISPR gRNA sequence
  source 1..20: mol_type = other DNA
tcttccagctggttccctga

SEQ ID NO: 54887 - DNA, 20 bp, synthetic construct
  misc_feature 1..20: note = CRISPR gRNA sequence
  source 1..20: mol_type = other DNA
cttccagctggttccctgag

SEQ ID NO: 54888 - DNA, 20 bp, synthetic construct
  misc_feature 1..20: note = CRISPR gRNA sequence
  source 1..20: mol_type = other DNA
agctggttccctgagaggct

SEQ ID NO: 54889 - DNA, 20 bp, synthetic construct
  misc_feature 1..20: note = CRISPR gRNA sequence
  source 1..20: mol_type = other DNA
ggttccctgagaggctgaga

SEQ ID NO: 54890 - DNA, 20 bp, synthetic construct
  misc_feature 1..20: note = CRISPR gRNA sequence
  source 1..20: mol_type = other DNA
gttccctgagaggctgagac

SEQ ID NO: 54891 - DNA, 20 bp, synthetic construct
  misc_feature 1..20: note = CRISPR gRNA sequence
  source 1..20: mol_type = other DNA
ttccctgagaggctgagacg

SEQ ID NO: 54892 - DNA, 20 bp, synthetic construct
  misc_feature 1..20: note = CRISPR gRNA sequence
  source 1..20: mol_type = other DNA
tccctgagaggctgagacgg

SEQ ID NO: 54893 - DNA, 20 bp, synthetic construct
  misc_feature 1..20: note = CRISPR gRNA sequence
  source 1..20: mol_type = other DNA
ccctgagaggctgagacggg

SEQ ID NO: 54894 - DNA, 20 bp, synthetic construct
  misc_feature 1..20: note = CRISPR gRNA sequence
  source 1..20: mol_type = other DNA
gggcccaatgcactgtattg

SEQ ID NO: 54895 - DNA, 20 bp, synthetic construct
  misc_feature 1..20: note = CRISPR gRNA sequence
  source 1..20: mol_type = other DNA
ggcccaatgcactgtattgt

SEQ ID NO: 54896 - DNA, 20 bp, synthetic construct
  misc_feature 1..20: note = CRISPR gRNA sequence
  source 1..20: mol_type = other DNA
gcccaatgcactgtattgtg

SEQ ID NO: 54897 - DNA, 20 bp, synthetic construct
  misc_feature 1..20: note = CRISPR gRNA sequence
  source 1..20: mol_type = other DNA
aatgcactgtattgtggggc

SEQ ID NO: 54898 - DNA, 20 bp, synthetic construct
  misc_feature 1..20: note = CRISPR gRNA sequence
  source 1..20: mol_type = other DNA
tgcactgtattgtggggctg

SEQ ID NO: 54899 - DNA, 20 bp, synthetic construct
  misc_feature 1..20: note = CRISPR gRNA sequence
  source 1..20: mol_type = other DNA
tactcctcctttgctaactt

SEQ ID NO: 54900 - DNA, 20 bp, synthetic construct
  misc_feature 1..20: note = CRISPR gRNA sequence
  source 1..20: mol_type = other DNA
tcctttgctaactttagtca

SEQ ID NO: 54901 - DNA, 20 bp, synthetic construct
  misc_feature 1..20: note = CRISPR gRNA sequence
  source 1..20: mol_type = other DNA
tttagtcaaagtgtcactct

SEQ ID NO: 54902 - DNA, 20 bp, synthetic construct
  misc_feature 1..20: note = CRISPR gRNA sequence
  source 1..20: mol_type = other DNA
ttagtcaaagtgtcactctc

SEQ ID NO: 54903 - DNA, 20 bp, synthetic construct
  misc_feature 1..20: note = CRISPR gRNA sequence
  source 1..20: mol_type = other DNA
ttgataataactgaaatcga

SEQ ID NO: 54904 - DNA, 20 bp, synthetic construct
  misc_feature 1..20: note = CRISPR gRNA sequence
  source 1..20: mol_type = other DNA
cagactccataccacatgcc

SEQ ID NO: 54905 - DNA, 20 bp, synthetic construct
  misc_feature 1..20: note = CRISPR gRNA sequence
  source 1..20: mol_type = other DNA
ccacatgcctggcaacatcc

SEQ ID NO: 54906 - DNA, 20 bp, synthetic construct
  misc_feature 1..20: note = CRISPR gRNA sequence
  source 1..20: mol_type = other DNA
cacatgcctggcaacatcct

SEQ ID NO: 54907 - DNA, 20 bp, synthetic construct
  misc_feature 1..20: note = CRISPR gRNA sequence
  source 1..20: mol_type = other DNA
ctaggttcttctatgactat

SEQ ID NO: 54908 - DNA, 20 bp, synthetic construct
  misc_feature 1..20: note = CRISPR gRNA sequence
  source 1..20: mol_type = other DNA
attggcctatttcatcctca

SEQ ID NO: 54909 - DNA, 20 bp, synthetic construct
  misc_feature 1..20: note = CRISPR gRNA sequence
  source 1..20: mol_type = other DNA
tcctcatagtgccgatgacg

SEQ ID NO: 54910 - DNA, 20 bp, synthetic construct
  misc_feature 1..20: note = CRISPR gRNA sequence
  source 1..20: mol_type = other DNA
cctcatagtgccgatgacgt

SEQ ID NO: 54911 - DNA, 20 bp, synthetic construct
  misc_feature 1..20: note = CRISPR gRNA sequence
  source 1..20: mol_type = other DNA
attatcctcaccttactgat

SEQ ID NO: 54912 - DNA, 20 bp, synthetic construct
  misc_feature 1..20: note = CRISPR gRNA sequence
  source 1..20: mol_type = other DNA
ccttactgatgagtaaactc

SEQ ID NO: 54913 - DNA, 20 bp, synthetic construct
  misc_feature 1..20: note = CRISPR gRNA sequence
  source 1..20: mol_type = other DNA
ctgatgagtaaactcaagtg

SEQ ID NO: 54914 - DNA, 20 bp, synthetic construct
  misc_feature 1..20: note = CRISPR gRNA sequence
  source 1..20: mol_type = other DNA
gatgagtaaactcaagtgca

SEQ ID NO: 54915 - DNA, 20 bp, synthetic construct
  misc_feature 1..20: note = CRISPR gRNA sequence
  source 1..20: mol_type = other DNA
gagtaaactcaagtgcagag

SEQ ID NO: 54916 - DNA, 20 bp, synthetic construct
  misc_feature 1..20: note = CRISPR gRNA sequence
  source 1..20: mol_type = other DNA
aactcaagtgcagagtggtt

SEQ ID NO: 54917 - DNA, 20 bp, synthetic construct
  misc_feature 1..20: note = CRISPR gRNA sequence
  source 1..20: mol_type = other DNA
aagtgcagagtggttaagtg

SEQ ID NO: 54918 - DNA, 20 bp, synthetic construct
  misc_feature 1..20: note = CRISPR gRNA sequence
  source 1..20: mol_type = other DNA
gtgcagagtggttaagtgca

SEQ ID NO: 54919 - DNA, 20 bp, synthetic construct
  misc_feature 1..20: note = CRISPR gRNA sequence
  source 1..20: mol_type = other DNA
gagtggttaagtgcagagta

SEQ ID NO: 54920 - DNA, 20 bp, synthetic construct
  misc_feature 1..20: note = CRISPR gRNA sequence
  source 1..20: mol_type = other DNA
gttaagtgcagagtaaagtt

SEQ ID NO: 54921 - DNA, 20 bp, synthetic construct
  misc_feature 1..20: note = CRISPR gRNA sequence
  source 1..20: mol_type = other DNA
ttaagtgcagagtaaagtta

SEQ ID NO: 54922 - DNA, 20 bp, synthetic construct
  misc_feature 1..20: note = CRISPR gRNA sequence
  source 1..20: mol_type = other DNA
taaagttaaggcacttgctc

SEQ ID NO: 54923 - DNA, 20 bp, synthetic construct
  misc_feature 1..20: note = CRISPR gRNA sequence
  source 1..20: mol_type = other DNA
aaagttaaggcacttgctcg

SEQ ID NO: 54924 - DNA, 20 bp, synthetic construct
  misc_feature 1..20: note = CRISPR gRNA sequence
  source 1..20: mol_type = other DNA
aagttaaggcacttgctcga

SEQ ID NO: 54925 - DNA, 20 bp, synthetic construct
  misc_feature 1..20: note = CRISPR gRNA sequence
  source 1..20: mol_type = other DNA
gttaaggcacttgctcgagg

SEQ ID NO: 54926 - DNA, 20 bp, synthetic construct
  misc_feature 1..20: note = CRISPR gRNA sequence
  source 1..20: mol_type = other DNA
cacttgctcgagggagaacc

SEQ ID NO: 54927 - DNA, 20 bp, synthetic construct
  misc_feature 1..20: note = CRISPR gRNA sequence
  source 1..20: mol_type = other DNA
ggagaacctggatttgaacc

SEQ ID NO: 54928 - DNA, 20 bp, synthetic construct
  misc_feature 1..20: note = CRISPR gRNA sequence
  source 1..20: mol_type = other DNA
gagaacctggatttgaaccc

SEQ ID NO: 54929 - DNA, 20 bp, synthetic construct
  misc_feature 1..20: note = CRISPR gRNA sequence
  source 1..20: mol_type = other DNA
aacctggatttgaacccagg

SEQ ID NO: 54930 - DNA, 20 bp, synthetic construct
  misc_feature 1..20: note = CRISPR gRNA sequence
  source 1..20: mol_type = other DNA
aacccaggcagcctgccttc

SEQ ID NO: 54931 - DNA, 20 bp, synthetic construct
  misc_feature 1..20: note = CRISPR gRNA sequence
  source 1..20: mol_type = other DNA
acccaggcagcctgccttca

SEQ ID NO: 54932 - DNA, 20 bp, synthetic construct
  misc_feature 1..20: note = CRISPR gRNA sequence
  source 1..20: mol_type = other DNA
caactcttcctttatgctgc

SEQ ID NO: 54933 - DNA, 20 bp, synthetic construct
  misc_feature 1..20: note = CRISPR gRNA sequence
  source 1..20: mol_type = other DNA
tgtgataaacttcatgatta

SEQ ID NO: 54934 - DNA, 20 bp, synthetic construct
  misc_feature 1..20: note = CRISPR gRNA sequence
  source 1..20: mol_type = other DNA
gtgataaacttcatgattat

SEQ ID NO: 54935 - DNA, 20 bp, synthetic construct
  misc_feature 1..20: note = CRISPR gRNA sequence
  source 1..20: mol_type = other DNA
tgataaacttcatgattatg

SEQ ID NO: 54936 - DNA, 20 bp, synthetic construct
  misc_feature 1..20: note = CRISPR gRNA sequence
  source 1..20: mol_type = other DNA
gataaacttcatgattatgg

SEQ ID NO: 54937 - DNA, 20 bp, synthetic construct
  misc_feature 1..20: note = CRISPR gRNA sequence
  source 1..20: mol_type = other DNA
gattatgggggcatctgacc

SEQ ID NO: 54938 - DNA, 20 bp, synthetic construct
  misc_feature 1..20: note = CRISPR gRNA sequence
  source 1..20: mol_type = other DNA
tgggggcatctgacctagtc

SEQ ID NO: 54939 - DNA, 20 bp, synthetic construct
  misc_feature 1..20: note = CRISPR gRNA sequence
  source 1..20: mol_type = other DNA
gggggcatctgacctagtct

SEQ ID NO: 54940 - DNA, 20 bp, synthetic construct
  misc_feature 1..20: note = CRISPR gRNA sequence
  source 1..20: mol_type = other DNA
gggcatctgacctagtctgg

SEQ ID NO: 54941 - DNA, 20 bp, synthetic construct
  misc_feature 1..20: note = CRISPR gRNA sequence
  source 1..20: mol_type = other DNA
atctgacctagtctgggagt

SEQ ID NO: 54942 - DNA, 20 bp, synthetic construct
  misc_feature 1..20: note = CRISPR gRNA sequence
  source 1..20: mol_type = other DNA
tctgacctagtctgggagtc

SEQ ID NO: 54943 - DNA, 20 bp, synthetic construct
  misc_feature 1..20: note = CRISPR gRNA sequence
  source 1..20: mol_type = other DNA
ctgacctagtctgggagtcg

SEQ ID NO: 54944 - DNA, 20 bp, synthetic construct
  misc_feature 1..20: note = CRISPR gRNA sequence
  source 1..20: mol_type = other DNA
cctagtctgggagtcgggga

SEQ ID NO: 54945 - DNA, 20 bp, synthetic construct
  misc_feature 1..20: note = CRISPR gRNA sequence
  source 1..20: mol_type = other DNA
ggatggcttatttgttgctt

SEQ ID NO: 54946 - DNA, 20 bp, synthetic construct
  misc_feature 1..20: note = CRISPR gRNA sequence
  source 1..20: mol_type = other DNA
aagctacttgctgaaataac

SEQ ID NO: 54947 - DNA, 20 bp, synthetic construct
  misc_feature 1..20: note = CRISPR gRNA sequence
  source 1..20: mol_type = other DNA
agctacttgctgaaataact

SEQ ID NO: 54948 - DNA, 20 bp, synthetic construct
  misc_feature 1..20: note = CRISPR gRNA sequence
  source 1..20: mol_type = other DNA
ctacttgctgaaataactgg

SEQ ID NO: 54949 - DNA, 20 bp, synthetic construct
  misc_feature 1..20: note = CRISPR gRNA sequence
  source 1..20: mol_type = other DNA
tgctgaaataactgggagtt

SEQ ID NO: 54950 - DNA, 20 bp, synthetic construct
  misc_feature 1..20: note = CRISPR gRNA sequence
  source 1..20: mol_type = other DNA
tgaaataactgggagttcag

SEQ ID NO: 54951 - DNA, 20 bp, synthetic construct
  misc_feature 1..20: note = CRISPR gRNA sequence
  source 1..20: mol_type = other DNA
gaaataactgggagttcagt

SEQ ID NO: 54952 - DNA, 20 bp, synthetic construct
  misc_feature 1..20: note = CRISPR gRNA sequence
  source 1..20: mol_type = other DNA
actgggagttcagtaggtaa

SEQ ID NO: 54953 - DNA, 20 bp, synthetic construct
  misc_feature 1..20: note = CRISPR gRNA sequence
  source 1..20: mol_type = other DNA
ctgggagttcagtaggtaaa

SEQ ID NO: 54954 - DNA, 20 bp, synthetic construct
  misc_feature 1..20: note = CRISPR gRNA sequence
  source 1..20: mol_type = other DNA
gagttcagtaggtaaaaggt

SEQ ID NO: 54955 - DNA, 20 bp, synthetic construct
  misc_feature 1..20: note = CRISPR gRNA sequence
  source 1..20: mol_type = other DNA
agttcagtaggtaaaaggtt

SEQ ID NO: 54956 - DNA, 20 bp, synthetic construct
  misc_feature 1..20: note = CRISPR gRNA sequence
  source 1..20: mol_type = other DNA
gttcagtaggtaaaaggttg

SEQ ID NO: 54957 - DNA, 20 bp, synthetic construct
  misc_feature 1..20: note = CRISPR gRNA sequence
  source 1..20: mol_type = other DNA
ttcagtaggtaaaaggttgg

SEQ ID NO: 54958 - DNA, 20 bp, synthetic construct
  misc_feature 1..20: note = CRISPR gRNA sequence
  source 1..20: mol_type = other DNA
cagtaggtaaaaggttgggg

SEQ ID NO: 54959 - DNA, 20 bp, synthetic construct
  misc_feature 1..20: note = CRISPR gRNA sequence
  source 1..20: mol_type = other DNA
gtaggtaaaaggttggggga

SEQ ID NO: 54960 - DNA, 20 bp, synthetic construct
  misc_feature 1..20: note = CRISPR gRNA sequence
  source 1..20: mol_type = other DNA
gtaaaaggttgggggagaga

SEQ ID NO: 54961 - DNA, 20 bp, synthetic construct
  misc_feature 1..20: note = CRISPR gRNA sequence
  source 1..20: mol_type = other DNA
aaaaggttgggggagagatg

SEQ ID NO: 54962 - DNA, 20 bp, synthetic construct
  misc_feature 1..20: note = CRISPR gRNA sequence
  source 1..20: mol_type = other DNA
aaaggttgggggagagatgg

SEQ ID NO: 54963 - DNA, 20 bp, synthetic construct
  misc_feature 1..20: note = CRISPR gRNA sequence
  source 1..20: mol_type = other DNA
ggttgggggagagatggagg

SEQ ID NO: 54964 - DNA, 20 bp, synthetic construct
  misc_feature 1..20: note = CRISPR gRNA sequence
  source 1..20: mol_type = other DNA
gttgggggagagatggagga

SEQ ID NO: 54965 - DNA, 20 bp, synthetic construct
  misc_feature 1..20: note = CRISPR gRNA sequence
  source 1..20: mol_type = other DNA
ttgggggagagatggaggaa

SEQ ID NO: 54966 - DNA, 20 bp, synthetic construct
  misc_feature 1..20: note = CRISPR gRNA sequence
  source 1..20: mol_type = other DNA
agatggaggaagggtgttcc

SEQ ID NO: 54967 - DNA, 20 bp, synthetic construct
  misc_feature 1..20: note = CRISPR gRNA sequence
  source 1..20: mol_type = other DNA
tggaggaagggtgttcctgg

SEQ ID NO: 54968 - DNA, 20 bp, synthetic construct
  misc_feature 1..20: note = CRISPR gRNA sequence
  source 1..20: mol_type = other DNA
aggaagggtgttcctggtgg

SEQ ID NO: 54969 - DNA, 20 bp, synthetic construct
  misc_feature 1..20: note = CRISPR gRNA sequence
  source 1..20: mol_type = other DNA
aagggtgttcctggtggtag

SEQ ID NO: 54970 - DNA, 20 bp, synthetic construct
  misc_feature 1..20: note = CRISPR gRNA sequence
  source 1..20: mol_type = other DNA
ggtgttcctggtggtagaag

SEQ ID NO: 54971 - DNA, 20 bp, synthetic construct
  misc_feature 1..20: note = CRISPR gRNA sequence
  source 1..20: mol_type = other DNA
tggtagaagcagtacattca

SEQ ID NO: 54972 - DNA, 20 bp, synthetic construct
  misc_feature 1..20: note = CRISPR gRNA sequence
  source 1..20: mol_type = other DNA
ggtagaagcagtacattcaa

SEQ ID NO: 54973 - DNA, 20 bp, synthetic construct
  misc_feature 1..20: note = CRISPR gRNA sequence
  source 1..20: mol_type = other DNA
cagtacattcaaaggccctg

SEQ ID NO: 54974 - DNA, 20 bp, synthetic construct
  misc_feature 1..20: note = CRISPR gRNA sequence
  source 1..20: mol_type = other DNA
ccctgtggcataacacatat

SEQ ID NO: 54975 - DNA, 20 bp, synthetic construct
  misc_feature 1..20: note = CRISPR gRNA sequence
  source 1..20: mol_type = other DNA
cctgtggcataacacatatg

SEQ ID NO: 54976 - DNA, 20 bp, synthetic construct
  misc_feature 1..20: note = CRISPR gRNA sequence
  source 1..20: mol_type = other DNA
taacacatatgaggacctga

SEQ ID NO: 54977 - DNA, 20 bp, synthetic construct
  misc_feature 1..20: note = CRISPR gRNA sequence
  source 1..20: mol_type = other DNA
acacatatgaggacctgaaa

SEQ ID NO: 54978 - DNA, 20 bp, synthetic construct
  misc_feature 1..20: note = CRISPR gRNA sequence
  source 1..20: mol_type = other DNA
acatatgaggacctgaaaga

SEQ ID NO: 54979 - DNA, 20 bp, synthetic construct
  misc_feature 1..20: note = CRISPR gRNA sequence
  source 1..20: mol_type = other DNA
atgaggacctgaaagagagc

SEQ ID NO: 54980 - DNA, 20 bp, synthetic construct
  misc_feature 1..20: note = CRISPR gRNA sequence
  source 1..20: mol_type = other DNA
tgaaagagagccagtgtgtc

SEQ ID NO: 54981 - DNA, 20 bp, synthetic construct
  misc_feature 1..20: note = CRISPR gRNA sequence
  source 1..20: mol_type = other DNA
gagagccagtgtgtctggat

SEQ ID NO: 54982 - DNA, 20 bp, synthetic construct
  misc_feature 1..20: note = CRISPR gRNA sequence
  source 1..20: mol_type = other DNA
gagccagtgtgtctggattg

SEQ ID NO: 54983 - DNA, 20 bp, synthetic construct
  misc_feature 1..20: note = CRISPR gRNA sequence
  source 1..20: mol_type = other DNA
gtgtgtctggattggagatt

SEQ ID NO: 54984 - DNA, 20 bp, synthetic construct
  misc_feature 1..20: note = CRISPR gRNA sequence
  source 1..20: mol_type = other DNA
tgtctggattggagattgag

SEQ ID NO: 54985 - DNA, 20 bp, synthetic construct
  misc_feature 1..20: note = CRISPR gRNA sequence
  source 1..20: mol_type = other DNA
ctggattggagattgagtgg

SEQ ID NO: 54986 - DNA, 20 bp, synthetic construct
  misc_feature 1..20: note = CRISPR gRNA sequence
  source 1..20: mol_type = other DNA
tggattggagattgagtgga

SEQ ID NO: 54987 - DNA, 20 bp, synthetic construct
  misc_feature 1..20: note = CRISPR gRNA sequence
  source 1..20: mol_type = other DNA
ttggagattgagtggaagga

SEQ ID NO: 54988 - DNA, 20 bp, synthetic construct
  misc_feature 1..20: note = CRISPR gRNA sequence
  source 1..20: mol_type = other DNA
tggagattgagtggaaggat

SEQ ID NO: 54989 - DNA, 20 bp, synthetic construct
  misc_feature 1..20: note = CRISPR gRNA sequence
  source 1..20: mol_type = other DNA
ggagattgagtggaaggatg

SEQ ID NO: 54990 - DNA, 20 bp, synthetic construct
  misc_feature 1..20: note = CRISPR gRNA sequence
  source 1..20: mol_type = other DNA
attgagtggaaggatggggt

SEQ ID NO: 54991 - DNA, 20 bp, synthetic construct
  misc_feature 1..20: note = CRISPR gRNA sequence
  source 1..20: mol_type = other DNA
agtggaaggatggggtcaga

SEQ ID NO: 54992 - DNA, 20 bp, synthetic construct
  misc_feature 1..20: note = CRISPR gRNA sequence
  source 1..20: mol_type = other DNA
gtggaaggatggggtcagat

SEQ ID NO: 54993 - DNA, 20 bp, synthetic construct
  misc_feature 1..20: note = CRISPR gRNA sequence
  source 1..20: mol_type = other DNA
tggaaggatggggtcagatg

SEQ ID NO: 54994 - DNA, 20 bp, synthetic construct
  misc_feature 1..20: note = CRISPR gRNA sequence
  source 1..20: mol_type = other DNA
ggatggggtcagatggggtt

SEQ ID NO: 54995 - DNA, 20 bp, synthetic construct
  misc_feature 1..20: note = CRISPR gRNA sequence
  source 1..20: mol_type = other DNA
gatggggtcagatggggttt

SEQ ID NO: 54996 - DNA, 20 bp, synthetic construct
  misc_feature 1..20: note = CRISPR gRNA sequence
  source 1..20: mol_type = other DNA
tggggtcagatggggtttag

SEQ ID NO: 54997 - DNA, 20 bp, synthetic construct
  misc_feature 1..20: note = CRISPR gRNA sequence
  source 1..20: mol_type = other DNA
ggggtcagatggggtttagg

SEQ ID NO: 54998 - DNA, 20 bp, synthetic construct
  misc_feature 1..20: note = CRISPR gRNA sequence
  source 1..20: mol_type = other DNA
tcagatggggtttaggaggc

SEQ ID NO: 54999 - DNA, 20 bp, synthetic construct
  misc_feature 1..20: note = CRISPR gRNA sequence
  source 1..20: mol_type = other DNA
cagatggggtttaggaggct

SEQ ID NO: 55000 - DNA, 20 bp, synthetic construct
  misc_feature 1..20: note = CRISPR gRNA sequence
  source 1..20: mol_type = other DNA
agatggggtttaggaggctg

SEQ ID NO: 55001 - DNA, 20 bp, synthetic construct
  misc_feature 1..20: note = CRISPR gRNA sequence
  source 1..20: mol_type = other DNA
gatggggtttaggaggctgg

SEQ ID NO: 55002 - DNA, 20 bp, synthetic construct
  misc_feature 1..20: note = CRISPR gRNA sequence
  source 1..20: mol_type = other DNA
ggggtttaggaggctggggg

SEQ ID NO: 55003 - DNA, 20 bp, synthetic construct
  misc_feature 1..20: note = CRISPR gRNA sequence
  source 1..20: mol_type = other DNA
gggtttaggaggctgggggc

SEQ ID NO: 55004 - DNA, 20 bp, synthetic construct
  misc_feature 1..20: note = CRISPR gRNA sequence
  source 1..20: mol_type = other DNA
ggtttaggaggctgggggca

SEQ ID NO: 55005 - DNA, 20 bp, synthetic construct
  misc_feature 1..20: note = CRISPR gRNA sequence
  source 1..20: mol_type = other DNA
ggaggctgggggcagggttc

SEQ ID NO: 55006 - DNA, 20 bp, synthetic construct
  misc_feature 1..20: note = CRISPR gRNA sequence
  source 1..20: mol_type = other DNA
gggcagggttctggaccacc

SEQ ID NO: 55007 - DNA, 20 bp, synthetic construct
  misc_feature 1..20: note = CRISPR gRNA sequence
  source 1..20: mol_type = other DNA
ggcagggttctggaccacct

SEQ ID NO: 55008 - DNA, 20 bp, synthetic construct
  misc_feature 1..20: note = CRISPR gRNA sequence
  source 1..20: mol_type = other DNA
cagggttctggaccacctgg

SEQ ID NO: 55009 - DNA, 20 bp, synthetic construct
  misc_feature 1..20: note = CRISPR gRNA sequence
  source 1..20: mol_type = other DNA
ttctggaccacctgggagtt

SEQ ID NO: 55010 - DNA, 20 bp, synthetic construct
  misc_feature 1..20: note = CRISPR gRNA sequence
  source 1..20: mol_type = other DNA
ccacctgggagtttagaatg

SEQ ID NO: 55011 - DNA, 20 bp, synthetic construct
  misc_feature 1..20: note = CRISPR gRNA sequence
  source 1..20: mol_type = other DNA
cacctgggagtttagaatgt

SEQ ID NO: 55012 - DNA, 20 bp, synthetic construct
  misc_feature 1..20: note = CRISPR gRNA sequence
  source 1..20: mol_type = other DNA
tagaatgtgggttttatcct

SEQ ID NO: 55013 - DNA, 20 bp, synthetic construct
  misc_feature 1..20: note = CRISPR gRNA sequence
  source 1..20: mol_type = other DNA
aatgtgggttttatcctgag

SEQ ID NO: 55014 - DNA, 20 bp, synthetic construct
  misc_feature 1..20: note = CRISPR gRNA sequence
  source 1..20: mol_type = other DNA
gtgggttttatcctgagcag

SEQ ID NO: 55015 - DNA, 20 bp, synthetic construct
  misc_feature 1..20: note = CRISPR gRNA sequence
  source 1..20: mol_type = other DNA
tgggttttatcctgagcagt

SEQ ID NO: 55016 - DNA, 20 bp, synthetic construct
  misc_feature 1..20: note = CRISPR gRNA sequence
  source 1..20: mol_type = other DNA
gttttatcctgagcagtggg

SEQ ID NO: 55017 - DNA, 20 bp, synthetic construct
  misc_feature 1..20: note = CRISPR gRNA sequence
  source 1..20: mol_type = other DNA
ttttatcctgagcagtggga

SEQ ID NO: 55018 - DNA, 20 bp, synthetic construct
  misc_feature 1..20: note = CRISPR gRNA sequence
  source 1..20: mol_type = other DNA
ttatcctgagcagtgggaag

SEQ ID NO: 55019 - DNA, 20 bp, synthetic construct
  misc_feature 1..20: note = CRISPR gRNA sequence
  source 1..20: mol_type = other DNA
ctgagcagtgggaaggagtg

SEQ ID NO: 55020 - DNA, 20 bp, synthetic construct
  misc_feature 1..20: note = CRISPR gRNA sequence
  source 1..20: mol_type = other DNA
tgagcagtgggaaggagtga

SEQ ID NO: 55021 - DNA, 20 bp, synthetic construct
  misc_feature 1..20: note = CRISPR gRNA sequence
  source 1..20: mol_type = other DNA
gagcagtgggaaggagtgaa

SEQ ID NO: 55022 - DNA, 20 bp, synthetic construct
  misc_feature 1..20: note = CRISPR gRNA sequence
  source 1..20: mol_type = other DNA
agcagtgggaaggagtgaag

SEQ ID NO: 55023 - DNA, 20 bp, synthetic construct
  misc_feature 1..20: note = CRISPR gRNA sequence
  source 1..20: mol_type = other DNA
gcagtgggaaggagtgaagg

SEQ ID NO: 55024 - DNA, 20 bp, synthetic construct
  misc_feature 1..20: note = CRISPR gRNA sequence
  source 1..20: mol_type = other DNA
gtgggaaggagtgaaggggg

SEQ ID NO: 55025 - DNA, 20 bp, synthetic construct
  misc_feature 1..20: note = CRISPR gRNA sequence
  source 1..20: mol_type = other DNA
tgggaaggagtgaagggggc

SEQ ID NO: 55026 - DNA, 20 bp, synthetic construct
  misc_feature 1..20: note = CRISPR gRNA sequence
  source 1..20: mol_type = other DNA
ggagtgaagggggcaggcat

SEQ ID NO: 55027 - DNA, 20 bp, synthetic construct
  misc_feature 1..20: note = CRISPR gRNA sequence
  source 1..20: mol_type = other DNA
agggggcaggcatcagtgaa

SEQ ID NO: 55028 - DNA, 20 bp, synthetic construct
  misc_feature 1..20: note = CRISPR gRNA sequence
  source 1..20: mol_type = other DNA
aaaagtgatctactctctgc

SEQ ID NO: 55029 - DNA, 20 bp, synthetic construct
  misc_feature 1..20: note = CRISPR gRNA sequence
  source 1..20: mol_type = other DNA
aaagtgatctactctctgcc

SEQ ID NO: 55030 - DNA, 20 bp, synthetic construct
  misc_feature 1..20: note = CRISPR gRNA sequence
  source 1..20: mol_type = other DNA
gtgatctactctctgccagg

SEQ ID NO: 55031 - DNA, 20 bp, synthetic construct
  misc_feature 1..20: note = CRISPR gRNA sequence
  source 1..20: mol_type = other DNA
atctactctctgccaggtgg

SEQ ID NO: 55032 - DNA, 20 bp, synthetic construct
  misc_feature 1..20: note = CRISPR gRNA sequence
  source 1..20: mol_type = other DNA
tactctctgccaggtggaag

SEQ ID NO: 55033 - DNA, 20 bp, synthetic construct
  misc_feature 1..20: note = CRISPR gRNA sequence
  source 1..20: mol_type = other DNA
ctctgccaggtggaagtggc

SEQ ID NO: 55034 - DNA, 20 bp, synthetic construct
  misc_feature 1..20: note = CRISPR gRNA sequence
  source 1..20: mol_type = other DNA
tctgccaggtggaagtggcc

SEQ ID NO: 55035 - DNA, 20 bp, synthetic construct
  misc_feature 1..20: note = CRISPR gRNA sequence
  source 1..20: mol_type = other DNA
ctgccaggtggaagtggcca

SEQ ID NO: 55036 - DNA, 20 bp, synthetic construct
  misc_feature 1..20: note = CRISPR gRNA sequence
  source 1..20: mol_type = other DNA
ggtggaagtggccagggtga

SEQ ID NO: 55037 - DNA, 20 bp, synthetic construct
  misc_feature 1..20: note = CRISPR gRNA sequence
  source 1..20: mol_type = other DNA
ggaagtggccagggtgaaag

SEQ ID NO: 55038 - DNA, 20 bp, synthetic construct
  misc_feature 1..20: note = CRISPR gRNA sequence
  source 1..20: mol_type = other DNA
gaagtggccagggtgaaagc

SEQ ID NO: 55039 - DNA, 20 bp, synthetic construct
  misc_feature 1..20: note = CRISPR gRNA sequence
  source 1..20: mol_type = other DNA
aagtggccagggtgaaagca

SEQ ID NO: 55040 - DNA, 20 bp, synthetic construct
  misc_feature 1..20: note = CRISPR gRNA sequence
  source 1..20: mol_type = other DNA
tggccagggtgaaagcaggg

SEQ ID NO: 55041 - DNA, 20 bp, synthetic construct
  misc_feature 1..20: note = CRISPR gRNA sequence
  source 1..20: mol_type = other DNA
cagggtgaaagcagggaagc

SEQ ID NO: 55042 - DNA, 20 bp, synthetic construct
  misc_feature 1..20: note = CRISPR gRNA sequence
  source 1..20: mol_type = other DNA
gtgaaagcagggaagccagc

SEQ ID NO: 55043 - DNA, 20 bp, synthetic construct
  misc_feature 1..20: note = CRISPR gRNA sequence
  source 1..20: mol_type = other DNA
tgaaagcagggaagccagca

SEQ ID NO: 55044 - DNA, 20 bp, synthetic construct
  misc_feature 1..20: note = CRISPR gRNA sequence
  source 1..20: mol_type = other DNA
aagcagggaagccagcaagg

SEQ ID NO: 55045 - DNA, 20 bp, synthetic construct
  misc_feature 1..20: note = CRISPR gRNA sequence
  source 1..20: mol_type = other DNA
agcagggaagccagcaagga

SEQ ID NO: 55046 - DNA, 20 bp, synthetic construct
  misc_feature 1..20: note = CRISPR gRNA sequence
  source 1..20: mol_type = other DNA
gggaagccagcaaggaaggc

SEQ ID NO: 55047 - DNA, 20 bp, synthetic construct
  misc_feature 1..20: note = CRISPR gRNA sequence
  source 1..20: mol_type = other DNA
ggaagccagcaaggaaggca

SEQ ID NO: 55048 - DNA, 20 bp, synthetic construct
  misc_feature 1..20: note = CRISPR gRNA sequence
  source 1..20: mol_type = other DNA
gccagcaaggaaggcaaggc

SEQ ID NO: 55049 - DNA, 20 bp, synthetic construct
  misc_feature 1..20: note = CRISPR gRNA sequence
  source 1..20: mol_type = other DNA
ccagcaaggaaggcaaggcg

SEQ ID NO: 55050 - DNA, 20 bp, synthetic construct
  misc_feature 1..20: note = CRISPR gRNA sequence
  source 1..20: mol_type = other DNA
cagcaaggaaggcaaggcga

SEQ ID NO: 55051 - DNA, 20 bp, synthetic construct
  misc_feature 1..20: note = CRISPR gRNA sequence
  source 1..20: mol_type = other DNA
agcaaggaaggcaaggcgag

SEQ ID NO: 55052 - DNA, 20 bp, synthetic construct
  misc_feature 1..20: note = CRISPR gRNA sequence
  source 1..20: mol_type = other DNA
gcaaggaaggcaaggcgagg

SEQ ID NO: 55053 - DNA, 20 bp, synthetic construct
  misc_feature 1..20: note = CRISPR gRNA sequence
  source 1..20: mol_type = other DNA
ggcaaggcgagggggtcatc

SEQ ID NO: 55054 - DNA, 20 bp, synthetic construct
  misc_feature 1..20: note = CRISPR gRNA sequence
  source 1..20: mol_type = other DNA
gcaaggcgagggggtcatcc

SEQ ID NO: 55055 - DNA, 20 bp, synthetic construct
  misc_feature 1..20: note = CRISPR gRNA sequence
  source 1..20: mol_type = other DNA
ggcgagggggtcatccaggt

SEQ ID NO: 55056 - DNA, 20 bp, synthetic construct
  misc_feature 1..20: note = CRISPR gRNA sequence
  source 1..20: mol_type = other DNA
cgagggggtcatccaggtaa

SEQ ID NO: 55057 - DNA, 20 bp, synthetic construct
  misc_feature 1..20: note = CRISPR gRNA sequence
  source 1..20: mol_type = other DNA
gggtcatccaggtaagagat

SEQ ID NO: 55058 - DNA, 20 bp, synthetic construct
  misc_feature 1..20: note = CRISPR gRNA sequence
  source 1..20: mol_type = other DNA
ggtcatccaggtaagagatg

SEQ ID NO: 55059 - DNA, 20 bp, synthetic construct
  misc_feature 1..20: note = CRISPR gRNA sequence
  source 1..20: mol_type = other DNA
gtcatccaggtaagagatga

SEQ ID NO: 55060 - DNA, 20 bp, synthetic construct
  misc_feature 1..20: note = CRISPR gRNA sequence
  source 1..20: mol_type = other DNA
atccaggtaagagatgaggg

SEQ ID NO: 55061 - DNA, 20 bp, synthetic construct
  misc_feature 1..20: note = CRISPR gRNA sequence
  source 1..20: mol_type = other DNA
tccaggtaagagatgagggt

SEQ ID NO: 55062 - DNA, 20 bp, synthetic construct
  misc_feature 1..20: note = CRISPR gRNA sequence
  source 1..20: mol_type = other DNA
ggtaagagatgagggtgggt

SEQ ID NO: 55063 - DNA, 20 bp, synthetic construct
  misc_feature 1..20: note = CRISPR gRNA sequence
  source 1..20: mol_type = other DNA
gagatgagggtgggttggac

SEQ ID NO: 55064 - DNA, 20 bp, synthetic construct
  misc_feature 1..20: note = CRISPR gRNA sequence
  source 1..20: mol_type = other DNA
tgagggtgggttggactaga

SEQ ID NO: 55065 - DNA, 20 bp, synthetic construct
  misc_feature 1..20: note = CRISPR gRNA sequence
  source 1..20: mol_type = other DNA
gagggtgggttggactagaa

SEQ ID NO: 55066 - DNA, 20 bp, synthetic construct
  misc_feature 1..20: note = CRISPR gRNA sequence
  source 1..20: mol_type = other DNA
ggtgggttggactagaaagg

SEQ ID NO: 55067 - DNA, 20 bp, synthetic construct
  misc_feature 1..20: note = CRISPR gRNA sequence
  source 1..20: mol_type = other DNA
tgggttggactagaaaggtg

SEQ ID NO: 55068 - DNA, 20 bp, synthetic construct
  misc_feature 1..20: note = CRISPR gRNA sequence
  source 1..20: mol_type = other DNA
gggttggactagaaaggtgg

SEQ ID NO: 55069 - DNA, 20 bp, synthetic construct
  misc_feature 1..20: note = CRISPR gRNA sequence
  source 1..20: mol_type = other DNA
ggactagaaaggtggaggaa

SEQ ID NO: 55070 - DNA, 20 bp, synthetic construct
  misc_feature 1..20: note = CRISPR gRNA sequence
  source 1..20: mol_type = other DNA
actagaaaggtggaggaaaa

SEQ ID NO: 55071 - DNA, 20 bp, synthetic construct
  misc_feature 1..20: note = CRISPR gRNA sequence
  source 1..20: mol_type = other DNA
ctagaaaggtggaggaaaag

SEQ ID NO: 55072 - DNA, 20 bp, synthetic construct
  misc_feature 1..20: note = CRISPR gRNA sequence
  source 1..20: mol_type = other DNA
aaaggtggaggaaaagagga

SEQ ID NO: 55073 - DNA, 20 bp, synthetic construct
  misc_feature 1..20: note = CRISPR gRNA sequence
  source 1..20: mol_type = other DNA
gaggaaaagaggatagtttt

SEQ ID NO: 55074 - DNA, 20 bp, synthetic construct
  misc_feature 1..20: note = CRISPR gRNA sequence
  source 1..20: mol_type = other DNA
aggatagttttgagcgctac

SEQ ID NO: 55075 - DNA, 20 bp, synthetic construct
  misc_feature 1..20: note = CRISPR gRNA sequence
  source 1..20: mol_type = other DNA
atagttttgagcgctaccag

SEQ ID NO: 55076 - DNA, 20 bp, synthetic construct
  misc_feature 1..20: note = CRISPR gRNA sequence
  source 1..20: mol_type = other DNA
tagttttgagcgctaccagt

SEQ ID NO: 55077 - DNA, 20 bp, synthetic construct
  misc_feature 1..20: note = CRISPR gRNA sequence
  source 1..20: mol_type = other DNA
gcgctaccagtaggtccatc

SEQ ID NO: 55078 - DNA, 20 bp, synthetic construct
  misc_feature 1..20: note = CRISPR gRNA sequence
  source 1..20: mol_type = other DNA
gctaccagtaggtccatctg

SEQ ID NO: 55079 - DNA, 20 bp, synthetic construct
  misc_feature 1..20: note = CRISPR gRNA sequence
  source 1..20: mol_type = other DNA
ctaccagtaggtccatctgg

SEQ ID NO: 55080 - DNA, 20 bp, synthetic construct
  misc_feature 1..20: note = CRISPR gRNA sequence
  source 1..20: mol_type = other DNA
taccagtaggtccatctgga

SEQ ID NO: 55081 - DNA, 20 bp, synthetic construct
  misc_feature 1..20: note = CRISPR gRNA sequence
  source 1..20: mol_type = other DNA
ccatctggagggactaaatg

SEQ ID NO: 55082 - DNA, 20 bp, synthetic construct
  misc_feature 1..20: note = CRISPR gRNA sequence
  source 1..20: mol_type = other DNA
catctggagggactaaatgt

SEQ ID NO: 55083 - DNA, 20 bp, synthetic construct
  misc_feature 1..20: note = CRISPR gRNA sequence
  source 1..20: mol_type = other DNA
tctggagggactaaatgtgg

SEQ ID NO: 55084 - DNA, 20 bp, synthetic construct
  misc_feature 1..20: note = CRISPR gRNA sequence
  source 1..20: mol_type = other DNA
ggagggactaaatgtgggag

SEQ ID NO: 55085 - DNA, 20 bp, synthetic construct
  misc_feature 1..20: note = CRISPR gRNA sequence
  source 1..20: mol_type = other DNA
gagggactaaatgtgggaga

SEQ ID NO: 55086 - DNA, 20 bp, synthetic construct
  misc_feature 1..20: note = CRISPR gRNA sequence
  source 1..20: mol_type = other DNA
agggactaaatgtgggagaa

SEQ ID NO: 55087 - DNA, 20 bp, synthetic construct
  misc_feature 1..20: note = CRISPR gRNA sequence
  source 1..20: mol_type = other DNA
actaaatgtgggagaagggc

SEQ ID NO: 55088 - DNA, 20 bp, synthetic construct
  misc_feature 1..20: note = CRISPR gRNA sequence
  source 1..20: mol_type = other DNA
ctaaatgtgggagaagggca

SEQ ID NO: 55089 - DNA, 20 bp, synthetic construct
  misc_feature 1..20: note = CRISPR gRNA sequence
  source 1..20: mol_type = other DNA
taaatgtgggagaagggcaa

SEQ ID NO: 55090 - DNA, 20 bp, synthetic construct
  misc_feature 1..20: note = CRISPR gRNA sequence
  source 1..20: mol_type = other DNA
aaatgtgggagaagggcaag

SEQ ID NO: 55091 - DNA, 20 bp, synthetic construct
  misc_feature 1..20: note = CRISPR gRNA sequence
  source 1..20: mol_type = other DNA
aatgtgggagaagggcaagg

SEQ ID NO: 55092 - DNA, 20 bp, synthetic construct
  misc_feature 1..20: note = CRISPR gRNA sequence
  source 1..20: mol_type = other DNA
tgggagaagggcaagggggc

SEQ ID NO: 55093 - DNA, 20 bp, synthetic construct
  misc_feature 1..20: note = CRISPR gRNA sequence
  source 1..20: mol_type = other DNA
gggagaagggcaagggggct

SEQ ID NO: 55094 - DNA, 20 bp, synthetic construct
  misc_feature 1..20: note = CRISPR gRNA sequence
  source 1..20: mol_type = other DNA
gagaagggcaagggggctag

SEQ ID NO: 55095 - DNA, 20 bp, synthetic construct
  misc_feature 1..20: note = CRISPR gRNA sequence
  source 1..20: mol_type = other DNA
agaagggcaagggggctagg

SEQ ID NO: 55096 - DNA, 20 bp, synthetic construct
  misc_feature 1..20: note = CRISPR gRNA sequence
  source 1..20: mol_type = other DNA
agggcaagggggctaggagg

SEQ ID NO: 55097 - DNA, 20 bp, synthetic construct
  misc_feature 1..20: note = CRISPR gRNA sequence
  source 1..20: mol_type = other DNA
ctaggaggtggctgcgtaac

SEQ ID NO: 55098 - DNA, 20 bp, synthetic construct
  misc_feature 1..20: note = CRISPR gRNA sequence
  source 1..20: mol_type = other DNA
taggaggtggctgcgtaacc

SEQ ID NO: 55099 - DNA, 20 bp, synthetic construct
  misc_feature 1..20: note = CRISPR gRNA sequence
  source 1..20: mol_type = other DNA
gaggtggctgcgtaaccagg

SEQ ID NO: 55100 - DNA, 20 bp, synthetic construct
  misc_feature 1..20: note = CRISPR gRNA sequence
  source 1..20: mol_type = other DNA
aggtggctgcgtaaccaggc

SEQ ID NO: 55101 - DNA, 20 bp, synthetic construct
  misc_feature 1..20: note = CRISPR gRNA sequence
  source 1..20: mol_type = other DNA
ctgcgtaaccaggcgggtga

SEQ ID NO: 55102 - DNA, 20 bp, synthetic construct
  misc_feature 1..20: note = CRISPR gRNA sequence
  source 1..20: mol_type = other DNA
tgcgtaaccaggcgggtgat

SEQ ID NO: 55103 - DNA, 20 bp, synthetic construct
  misc_feature 1..20: note = CRISPR gRNA sequence
  source 1..20: mol_type = other DNA
gcgtaaccaggcgggtgatg

SEQ ID NO: 55104 - DNA, 20 bp, synthetic construct
  misc_feature 1..20: note = CRISPR gRNA sequence
  source 1..20: mol_type = other DNA
gggtgatggggctgcttctg

SEQ ID NO: 55105 - DNA, 20 bp, synthetic construct
  misc_feature 1..20: note = CRISPR gRNA sequence
  source 1..20: mol_type = other DNA
ggtgatggggctgcttctgc

SEQ ID NO: 55106 - DNA, 20 bp, synthetic construct
  misc_feature 1..20: note = CRISPR gRNA sequence
  source 1..20: mol_type = other DNA
ggggctgcttctgcaggtga

SEQ ID NO: 55107 - DNA, 20 bp, synthetic construct
  misc_feature 1..20: note = CRISPR gRNA sequence
  source 1..20: mol_type = other DNA
cttctgcaggtgatggcact

SEQ ID NO: 55108 - DNA, 20 bp, synthetic construct
  misc_feature 1..20: note = CRISPR gRNA sequence
  source 1..20: mol_type = other DNA
ttctgcaggtgatggcactc

SEQ ID NO: 55109 - DNA, 20 bp, synthetic construct
  misc_feature 1..20: note = CRISPR gRNA sequence
  source 1..20: mol_type = other DNA
tctgcaggtgatggcactcg

SEQ ID NO: 55110 - DNA, 20 bp, synthetic construct
  misc_feature 1..20: note = CRISPR gRNA sequence
  source 1..20: mol_type = other DNA
tgcaggtgatggcactcggg

SEQ ID NO: 55111 - DNA, 20 bp, synthetic construct
  misc_feature 1..20: note = CRISPR gRNA sequence
  source 1..20: mol_type = other DNA
gcaggtgatggcactcgggg

SEQ ID NO: 55112 - DNA, 20 bp, synthetic construct
  misc_feature 1..20: note = CRISPR gRNA sequence
  source 1..20: mol_type = other DNA
caggtgatggcactcgggga

SEQ ID NO: 55113 - DNA, 20 bp, synthetic construct
  misc_feature 1..20: note = CRISPR gRNA sequence
  source 1..20: mol_type = other DNA
aggtgatggcactcggggag

SEQ ID NO: 55114 - DNA, 20 bp, synthetic construct
  misc_feature 1..20: note = CRISPR gRNA sequence
  source 1..20: mol_type = other DNA
cactcggggaggggcatgct

SEQ ID NO: 55115 - DNA, 20 bp, synthetic construct
  misc_feature 1..20: note = CRISPR gRNA sequence
  source 1..20: mol_type = other DNA
gggaggggcatgctcagtgc

SEQ ID NO: 55116 - DNA, 20 bp, synthetic construct
  misc_feature 1..20: note = CRISPR gRNA sequence
  source 1..20: mol_type = other DNA
ggggcatgctcagtgctggt

SEQ ID NO: 55117 - DNA, 20 bp, synthetic construct
  misc_feature 1..20: note = CRISPR gRNA sequence
  source 1..20: mol_type = other DNA
gggcatgctcagtgctggtg

SEQ ID NO: 55118 - DNA, 20 bp, synthetic construct
  misc_feature 1..20: note = CRISPR gRNA sequence
  source 1..20: mol_type = other DNA
catgctcagtgctggtgagg

SEQ ID NO: 55119 - DNA, 20 bp, synthetic construct
  misc_feature 1..20: note = CRISPR gRNA sequence
  source 1..20: mol_type = other DNA
atgctcagtgctggtgaggc

SEQ ID NO: 55120 - DNA, 20 bp, synthetic construct
  misc_feature 1..20: note = CRISPR gRNA sequence
  source 1..20: mol_type = other DNA
ctcagtgctggtgaggcagg

SEQ ID NO: 55121 - DNA, 20 bp, synthetic construct
  misc_feature 1..20: note = CRISPR gRNA sequence
  source 1..20: mol_type = other DNA
agtgctggtgaggcaggtag

SEQ ID NO: 55122 - DNA, 20 bp, synthetic construct
  misc_feature 1..20: note = CRISPR gRNA sequence
  source 1..20: mol_type = other DNA
tgaggcaggtagaagtgtgt

SEQ ID NO: 55123 - DNA, 20 bp, synthetic construct
  misc_feature 1..20: note = CRISPR gRNA sequence
  source 1..20: mol_type = other DNA
accaccttctaattctgtcc

SEQ ID NO: 55124 - DNA, 20 bp, synthetic construct
  misc_feature 1..20: note = CRISPR gRNA sequence
  source 1..20: mol_type = other DNA
ttctgtcctggttctcccaa

SEQ ID NO: 55125 - DNA, 20 bp, synthetic construct
  misc_feature 1..20: note = CRISPR gRNA sequence
  source 1..20: mol_type = other DNA
tctgtcctggttctcccaat

SEQ ID NO: 55126 - DNA, 20 bp, synthetic construct
  misc_feature 1..20: note = CRISPR gRNA sequence
  source 1..20: mol_type = other DNA
cctggttctcccaatgggac

SEQ ID NO: 55127 - DNA, 20 bp, synthetic construct
  misc_feature 1..20: note = CRISPR gRNA sequence
  source 1..20: mol_type = other DNA
ctggttctcccaatgggacg

SEQ ID NO: 55128 - DNA, 20 bp, synthetic construct
  misc_feature 1..20: note = CRISPR gRNA sequence
  source 1..20: mol_type = other DNA
tctcccaatgggacgaggtc

SEQ ID NO: 55129 - DNA, 20 bp, synthetic construct
  misc_feature 1..20: note = CRISPR gRNA sequence
  source 1..20: mol_type = other DNA
ctcccaatgggacgaggtcc

SEQ ID NO: 55130 - DNA, 20 bp, synthetic construct
  misc_feature 1..20: note = CRISPR gRNA sequence
  source 1..20: mol_type = other DNA
atgggacgaggtccaggatc

SEQ ID NO: 55131 - DNA, 20 bp, synthetic construct
  misc_feature 1..20: note = CRISPR gRNA sequence
  source 1..20: mol_type = other DNA
gggacgaggtccaggatcaa

SEQ ID NO: 55132 - DNA, 20 bp, synthetic construct
  misc_feature 1..20: note = CRISPR gRNA sequence
  source 1..20: mol_type = other DNA
ggacgaggtccaggatcaag

SEQ ID NO: 55133 - DNA, 20 bp, synthetic construct
  misc_feature 1..20: note = CRISPR gRNA sequence
  source 1..20: mol_type = other DNA
acccctatccgtcttaccct

SEQ ID NO: 55134 - DNA, 20 bp, synthetic construct
  misc_feature 1..20: note = CRISPR gRNA sequence
  source 1..20: mol_type = other DNA
cccctatccgtcttaccctg

SEQ ID NO: 55135 - DNA, 20 bp, synthetic construct
  misc_feature 1..20: note = CRISPR gRNA sequence
  source 1..20: mol_type = other DNA
ctatccgtcttaccctgagg

SEQ ID NO: 55136 - DNA, 20 bp, synthetic construct
  misc_feature 1..20: note = CRISPR gRNA sequence
  source 1..20: mol_type = other DNA
tatccgtcttaccctgaggt

SEQ ID NO: 55137 - DNA, 20 bp, synthetic construct
  misc_feature 1..20: note = CRISPR gRNA sequence
  source 1..20: mol_type = other DNA
atccgtcttaccctgaggtg

SEQ ID NO: 55138 - DNA, 20 bp, synthetic construct
  misc_feature 1..20: note = CRISPR gRNA sequence
  source 1..20: mol_type = other DNA
tgaggtggggccactcgacc

SEQ ID NO: 55139 - DNA, 20 bp, synthetic construct
  misc_feature 1..20: note = CRISPR gRNA sequence
  source 1..20: mol_type = other DNA
actcgacccagaacacatcc

SEQ ID NO: 55140 - DNA, 20 bp, synthetic construct
  misc_feature 1..20: note = CRISPR gRNA sequence
  source 1..20: mol_type = other DNA
catctgccttcatgttcact

SEQ ID NO: 55141 - DNA, 20 bp, synthetic construct
  misc_feature 1..20: note = CRISPR gRNA sequence
  source 1..20: mol_type = other DNA
tctgccttcatgttcacttg

SEQ ID NO: 55142 - DNA, 20 bp, synthetic construct
  misc_feature 1..20: note = CRISPR gRNA sequence
  source 1..20: mol_type = other DNA
ctgccttcatgttcacttgg

SEQ ID NO: 55143 - DNA, 20 bp, synthetic construct
  misc_feature 1..20: note = CRISPR gRNA sequence
  source 1..20: mol_type = other DNA
atgttcacttggaggtttcc

SEQ ID NO: 55144 - DNA, 20 bp, synthetic construct
  misc_feature 1..20: note = CRISPR gRNA sequence
  source 1..20: mol_type = other DNA
gttcacttggaggtttcctg

SEQ ID NO: 55145 - DNA, 20 bp, synthetic construct
  misc_feature 1..20: note = CRISPR gRNA sequence
  source 1..20: mol_type = other DNA
ttcacttggaggtttcctgg

SEQ ID NO: 55146 - DNA, 20 bp, synthetic construct
  misc_feature 1..20: note = CRISPR gRNA sequence
  source 1..20: mol_type = other DNA
tcacttggaggtttcctgga

SEQ ID NO: 55147 - DNA, 20 bp, synthetic construct
  misc_feature 1..20: note = CRISPR gRNA sequence
  source 1..20: mol_type = other DNA
cacttggaggtttcctggag

SEQ ID NO: 55148 - DNA, 20 bp, synthetic construct
  misc_feature 1..20: note = CRISPR gRNA sequence
  source 1..20: mol_type = other DNA
tcctggaggggcgcccctcc

SEQ ID NO: 55149 - DNA, 20 bp, synthetic construct
  misc_feature 1..20: note = CRISPR gRNA sequence
  source 1..20: mol_type = other DNA
cctggaggggcgcccctcct

SEQ ID NO: 55150 - DNA, 20 bp, synthetic construct
  misc_feature 1..20: note = CRISPR gRNA sequence
  source 1..20: mol_type = other DNA
ctggaggggcgcccctccta

SEQ ID NO: 55151 - DNA, 20 bp, synthetic construct
  misc_feature 1..20: note = CRISPR gRNA sequence
  source 1..20: mol_type = other DNA
cgcccctcctagggtcgtga

SEQ ID NO: 55152 - DNA, 20 bp, synthetic construct
  misc_feature 1..20: note = CRISPR gRNA sequence
  source 1..20: mol_type = other DNA
cccctcctagggtcgtgaca

SEQ ID NO: 55153 - DNA, 20 bp, synthetic construct
  misc_feature 1..20: note = CRISPR gRNA sequence
  source 1..20: mol_type = other DNA
cagagcctccgtccatcccc

SEQ ID NO: 55154 - DNA, 20 bp, synthetic construct
  misc_feature 1..20: note = CRISPR gRNA sequence
  source 1..20: mol_type = other DNA
tccccaagcactactcttat

SEQ ID NO: 55155 - DNA, 20 bp, synthetic construct
  misc_feature 1..20: note = CRISPR gRNA sequence
  source 1..20: mol_type = other DNA
agcactactcttattggctt

SEQ ID NO: 55156 - DNA, 20 bp, synthetic construct
  misc_feature 1..20: note = CRISPR gRNA sequence
  source 1..20: mol_type = other DNA
ctactcttattggcttcagc

SEQ ID NO: 55157 - DNA, 20 bp, synthetic construct
  misc_feature 1..20: note = CRISPR gRNA sequence
  source 1..20: mol_type = other DNA
tactcttattggcttcagcc

SEQ ID NO: 55158 - DNA, 20 bp, synthetic construct
  misc_feature 1..20: note = CRISPR gRNA sequence
  source 1..20: mol_type = other DNA
actcttattggcttcagcca

SEQ ID NO: 55159 - DNA, 20 bp, synthetic construct
  misc_feature 1..20: note = CRISPR gRNA sequence
  source 1..20: mol_type = other DNA
ctcttattggcttcagccag

SEQ ID NO: 55160 - DNA, 20 bp, synthetic construct
  misc_feature 1..20: note = CRISPR gRNA sequence
  source 1..20: mol_type = other DNA
tattggcttcagccaggggc

SEQ ID NO: 55161 - DNA, 20 bp, synthetic construct
  misc_feature 1..20: note = CRISPR gRNA sequence
  source 1..20: mol_type = other DNA
cagccaggggctggacgcca

SEQ ID NO: 55162 - DNA, 20 bp, synthetic construct
  misc_feature 1..20: note = CRISPR gRNA sequence
  source 1..20: mol_type = other DNA
agccaggggctggacgccat

SEQ ID NO: 55163 - DNA, 20 bp, synthetic construct
  misc_feature 1..20: note = CRISPR gRNA sequence
  source 1..20: mol_type = other DNA
gggaatttctccatcccgaa

SEQ ID NO: 55164 - DNA, 20 bp, synthetic construct
  misc_feature 1..20: note = CRISPR gRNA sequence
  source 1..20: mol_type = other DNA
gaatttctccatcccgaaaa

SEQ ID NO: 55165 - DNA, 20 bp, synthetic construct
  misc_feature 1..20: note = CRISPR gRNA sequence
  source 1..20: mol_type = other DNA
tttctccatcccgaaaagag

SEQ ID NO: 55166 - DNA, 20 bp, synthetic construct
  misc_feature 1..20: note = CRISPR gRNA sequence
  source 1..20: mol_type = other DNA
ttctccatcccgaaaagaga

SEQ ID NO: 55167 - DNA, 20 bp, synthetic construct
  misc_feature 1..20: note = CRISPR gRNA sequence
  source 1..20: mol_type = other DNA
aaggttatcccactctactc

SEQ ID NO: 55168 - DNA, 20 bp, synthetic construct
  misc_feature 1..20: note = CRISPR gRNA sequence
  source 1..20: mol_type = other DNA
aggttatcccactctactct

SEQ ID NO: 55169 - DNA, 20 bp, synthetic construct
  misc_feature 1..20: note = CRISPR gRNA sequence
  source 1..20: mol_type = other DNA
gttatcccactctactctgg

SEQ ID NO: 55170 - DNA, 20 bp, synthetic construct
  misc_feature 1..20: note = CRISPR gRNA sequence
  source 1..20: mol_type = other DNA
atcccactctactctgggag

SEQ ID NO: 55171 - DNA, 20 bp, synthetic construct
  misc_feature 1..20: note = CRISPR gRNA sequence
  source 1..20: mol_type = other DNA
tcccactctactctgggaga

SEQ ID NO: 55172 - DNA, 20 bp, synthetic construct
  misc_feature 1..20: note = CRISPR gRNA sequence
  source 1..20: mol_type = other DNA
tctactctgggagaaggatg

SEQ ID NO: 55173 - DNA, 20 bp, synthetic construct
  misc_feature 1..20: note = CRISPR gRNA sequence
  source 1..20: mol_type = other DNA
ctactctgggagaaggatga

SEQ ID NO: 55174 - DNA, 20 bp, synthetic construct
  misc_feature 1..20: note = CRISPR gRNA sequence
  source 1..20: mol_type = other DNA
tactctgggagaaggatgaa

SEQ ID NO: 55175 - DNA, 20 bp, synthetic construct
  misc_feature 1..20: note = CRISPR gRNA sequence
  source 1..20: mol_type = other DNA
actctgggagaaggatgaag

SEQ ID NO: 55176 - DNA, 20 bp, synthetic construct
  misc_feature 1..20: note = CRISPR gRNA sequence
  source 1..20: mol_type = other DNA
ctctgggagaaggatgaagg

SEQ ID NO: 55177 - DNA, 20 bp, synthetic construct
  misc_feature 1..20: note = CRISPR gRNA sequence
  source 1..20: mol_type = other DNA
tgggagaaggatgaaggggg

SEQ ID NO: 55178 - DNA, 20 bp, synthetic construct
  misc_feature 1..20: note = CRISPR gRNA sequence
  source 1..20: mol_type = other DNA
gggagaaggatgaagggggt

SEQ ID NO: 55179 - DNA, 20 bp, synthetic construct
  misc_feature 1..20: note = CRISPR gRNA sequence
  source 1..20: mol_type = other DNA
ggagaaggatgaagggggtg

SEQ ID NO: 55180 - DNA, 20 bp, synthetic construct
  misc_feature 1..20: note = CRISPR gRNA sequence
  source 1..20: mol_type = other DNA
gagaaggatgaagggggtgg

SEQ ID NO: 55181 - DNA, 20 bp, synthetic construct
  misc_feature 1..20: note = CRISPR gRNA sequence
  source 1..20: mol_type = other DNA
agaaggatgaagggggtggg

SEQ ID NO: 55182 - DNA, 20 bp, synthetic construct
  misc_feature 1..20: note = CRISPR gRNA sequence
  source 1..20: mol_type = other DNA
aaggatgaagggggtggggg

SEQ ID NO: 55183 - DNA, 20 bp, synthetic construct
  misc_feature 1..20: note = CRISPR gRNA sequence
  source 1..20: mol_type = other DNA
aagggggtggggggagccct

SEQ ID NO: 55184 - DNA, 20 bp, synthetic construct
  misc_feature 1..20: note = CRISPR gRNA sequence
  source 1..20: mol_type = other DNA
agggggtggggggagccctg

SEQ ID NO: 55185 - DNA, 20 bp, synthetic construct
  misc_feature 1..20: note = CRISPR gRNA sequence
  source 1..20: mol_type = other DNA
gggggtggggggagccctga

SEQ ID NO: 55186 - DNA, 20 bp, synthetic construct
  misc_feature 1..20: note = CRISPR gRNA sequence
  source 1..20: mol_type = other DNA
gggggagccctgagggactg

SEQ ID NO: 55187 - DNA, 20 bp, synthetic construct
  misc_feature 1..20: note = CRISPR gRNA sequence
  source 1..20: mol_type = other DNA
agccctgagggactgtggtt

SEQ ID NO: 55188 - DNA, 20 bp, synthetic construct
  misc_feature 1..20: note = CRISPR gRNA sequence
  source 1..20: mol_type = other DNA
cctgagggactgtggtttgg

SEQ ID NO: 55189 - DNA, 20 bp, synthetic construct
  misc_feature 1..20: note = CRISPR gRNA sequence
  source 1..20: mol_type = other DNA
ctgagggactgtggtttgga

SEQ ID NO: 55190 - DNA, 20 bp, synthetic construct
  misc_feature 1..20: note = CRISPR gRNA sequence
  source 1..20: mol_type = other DNA
agggactgtggtttggaagg

SEQ ID NO: 55191 - DNA, 20 bp, synthetic construct
  misc_feature 1..20: note = CRISPR gRNA sequence
  source 1..20: mol_type = other DNA
tgtggtttggaaggcagacc

SEQ ID NO: 55192 - DNA, 20 bp, synthetic construct
  misc_feature 1..20: note = CRISPR gRNA sequence
  source 1..20: mol_type = other DNA
gtggtttggaaggcagaccc

SEQ ID NO: 55193 - DNA, 20 bp, synthetic construct
  misc_feature 1..20: note = CRISPR gRNA sequence
  source 1..20: mol_type = other DNA
ttggaaggcagacccaggtg

SEQ ID NO: 55194 - DNA, 20 bp, synthetic construct
  misc_feature 1..20: note = CRISPR gRNA sequence
  source 1..20: mol_type = other DNA
gaaggcagacccaggtgtgg

SEQ ID NO: 55195 - DNA, 20 bp, synthetic construct
  misc_feature 1..20: note = CRISPR gRNA sequence
  source 1..20: mol_type = other DNA
aaggcagacccaggtgtggt

SEQ ID NO: 55196 - DNA, 20 bp, synthetic construct
  misc_feature 1..20: note = CRISPR gRNA sequence
  source 1..20: mol_type = other DNA
aggcagacccaggtgtggtg

SEQ ID NO: 55197 - DNA, 20 bp, synthetic construct
  misc_feature 1..20: note = CRISPR gRNA sequence
  source 1..20: mol_type = other DNA
ggtgtggtggggtttctact

SEQ ID NO: 55198 - DNA, 20 bp, synthetic construct
  misc_feature 1..20: note = CRISPR gRNA sequence
  source 1..20: mol_type = other DNA
gtggtggggtttctacttgg

SEQ ID NO: 55199 - DNA, 20 bp, synthetic construct
  misc_feature 1..20: note = CRISPR gRNA sequence
  source 1..20: mol_type = other DNA
ggtttctacttggcagatct

SEQ ID NO: 55200 - DNA, 20 bp, synthetic construct
  misc_feature 1..20: note = CRISPR gRNA sequence
  source 1..20: mol_type = other DNA
tctacttggcagatctcagc

SEQ ID NO: 55201 - DNA, 20 bp, synthetic construct
  misc_feature 1..20: note = CRISPR gRNA sequence
  source 1..20: mol_type = other DNA
tacttggcagatctcagcaa

SEQ ID NO: 55202 - DNA, 20 bp, synthetic construct
  misc_feature 1..20: note = CRISPR gRNA sequence
  source 1..20: mol_type = other DNA
cttggcagatctcagcaaga

SEQ ID NO: 55203 - DNA, 20 bp, synthetic construct
  misc_feature 1..20: note = CRISPR gRNA sequence
  source 1..20: mol_type = other DNA
ttggcagatctcagcaagag

SEQ ID NO: 55204 - DNA, 20 bp, synthetic construct
  misc_feature 1..20: note = CRISPR gRNA sequence
  source 1..20: mol_type = other DNA
gcagatctcagcaagagagg

SEQ ID NO: 55205 - DNA, 20 bp, synthetic construct
  misc_feature 1..20: note = CRISPR gRNA sequence
  source 1..20: mol_type = other DNA
gatctcagcaagagaggtag

SEQ ID NO: 55206 - DNA, 20 bp, synthetic construct
  misc_feature 1..20: note = CRISPR gRNA sequence
  source 1..20: mol_type = other DNA
ctcagcaagagaggtagcag

SEQ ID NO: 55207 - DNA, 20 bp, synthetic construct
  misc_feature 1..20: note = CRISPR gRNA sequence
  source 1..20: mol_type = other DNA
agagaggtagcagtggttat

SEQ ID NO: 55208 - DNA, 20 bp, synthetic construct
  misc_feature 1..20: note = CRISPR gRNA sequence
  source 1..20: mol_type = other DNA
gagaggtagcagtggttatg

SEQ ID NO: 55209 - DNA, 20 bp, synthetic construct
  misc_feature 1..20: note = CRISPR gRNA sequence
  source 1..20: mol_type = other DNA
gtagcagtggttatgaggat

SEQ ID NO: 55210 - DNA, 20 bp, synthetic construct
  misc_feature 1..20: note = CRISPR gRNA sequence
  source 1..20: mol_type = other DNA
tagcagtggttatgaggatg

SEQ ID NO: 55211 - DNA, 20 bp, synthetic construct
  misc_feature 1..20: note = CRISPR gRNA sequence
  source 1..20: mol_type = other DNA
ggttatgaggatgaggctgc

SEQ ID NO: 55212 - DNA, 20 bp, synthetic construct
  misc_feature 1..20: note = CRISPR gRNA sequence
  source 1..20: mol_type = other DNA
atgaggatgaggctgcgagc

SEQ ID NO: 55213 - DNA, 20 bp, synthetic construct
  misc_feature 1..20: note = CRISPR gRNA sequence
  source 1..20: mol_type = other DNA
aggctgcgagccagactgtc

SEQ ID NO: 55214 - DNA, 20 bp, synthetic construct
  misc_feature 1..20: note = CRISPR gRNA sequence
  source 1..20: mol_type = other DNA
ggctgcgagccagactgtct

SEQ ID NO: 55215 - DNA, 20 bp, synthetic construct
  misc_feature 1..20: note = CRISPR gRNA sequence
  source 1..20: mol_type = other DNA
gactgtctgggcttgaaccc

SEQ ID NO: 55216 - DNA, 20 bp, synthetic construct
  misc_feature 1..20: note = CRISPR gRNA sequence
  source 1..20: mol_type = other DNA
tctgggcttgaaccctagcc

SEQ ID NO: 55217 - DNA, 20 bp, synthetic construct
  misc_feature 1..20: note = CRISPR gRNA sequence
  source 1..20: mol_type = other DNA
ctagactcttcctacctgtg

SEQ ID NO: 55218 - DNA, 20 bp, synthetic construct
  misc_feature 1..20: note = CRISPR gRNA sequence
  source 1..20: mol_type = other DNA
cttcctacctgtgtggcctt

SEQ ID NO: 55219 - DNA, 20 bp, synthetic construct
  misc_feature 1..20: note = CRISPR gRNA sequence
  source 1..20: mol_type = other DNA
ctacctgtgtggccttgagc

SEQ ID NO: 55220 - DNA, 20 bp, synthetic construct
  misc_feature 1..20: note = CRISPR gRNA sequence
  source 1..20: mol_type = other DNA
tgagcaagtttatctttctg

SEQ ID NO: 55221 - DNA, 20 bp, synthetic construct
  misc_feature 1..20: note = CRISPR gRNA sequence
  source 1..20: mol_type = other DNA
aacttcctcctctataaaat

SEQ ID NO: 55222 - DNA, 20 bp, synthetic construct
  misc_feature 1..20: note = CRISPR gRNA sequence
  source 1..20: mol_type = other DNA
acttcctcctctataaaatg

SEQ ID NO: 55223 - DNA, 20 bp, synthetic construct
  misc_feature 1..20: note = CRISPR gRNA sequence
  source 1..20: mol_type = other DNA
cctcctctataaaatgagga

SEQ ID NO: 55224 - DNA, 20 bp, synthetic construct
  misc_feature 1..20: note = CRISPR gRNA sequence
  source 1..20: mol_type = other DNA
ctataaaatgaggacagtaa

SEQ ID NO: 55225 - DNA, 20 bp, synthetic construct
  misc_feature 1..20: note = CRISPR gRNA sequence
  source 1..20: mol_type = other DNA
cagtaacagtgcttacatca

SEQ ID NO: 55226 - DNA, 20 bp, synthetic construct
  misc_feature 1..20: note = CRISPR gRNA sequence
  source 1..20: mol_type = other DNA
gtaacagtgcttacatcaca

SEQ ID NO: 55227 - DNA, 20 bp, synthetic construct
  misc_feature 1..20: note = CRISPR gRNA sequence
  source 1..20: mol_type = other DNA
tgcttacatcacagagatgt

SEQ ID NO: 55228 - DNA, 20 bp, synthetic construct
  misc_feature 1..20: note = CRISPR gRNA sequence
  source 1..20: mol_type = other DNA
gcttacatcacagagatgtg

SEQ ID NO: 55229 - DNA, 20 bp, synthetic construct
  misc_feature 1..20: note = CRISPR gRNA sequence
  source 1..20: mol_type = other DNA
ttacatcacagagatgtgag

SEQ ID NO: 55230 - DNA, 20 bp, synthetic construct
  misc_feature 1..20: note = CRISPR gRNA sequence
  source 1..20: mol_type = other DNA
gagatgtgaggagtgaatgc

SEQ ID NO: 55231 - DNA, 20 bp, synthetic construct
  misc_feature 1..20: note = CRISPR gRNA sequence
  source 1..20: mol_type = other DNA
agatgtgaggagtgaatgcg

SEQ ID NO: 55232 - DNA, 20 bp, synthetic construct
  misc_feature 1..20: note = CRISPR gRNA sequence
  source 1..20: mol_type = other DNA
atgtgaggagtgaatgcgag

SEQ ID NO: 55233 - DNA, 20 bp, synthetic construct
  misc_feature 1..20: note = CRISPR gRNA sequence
  source 1..20: mol_type = other DNA
tgtgaggagtgaatgcgagg

SEQ ID NO: 55234 - DNA, 20 bp, synthetic construct
  misc_feature 1..20: note = CRISPR gRNA sequence
  source 1..20: mol_type = other DNA
tgaatgcgaggaggcatgta

SEQ ID NO: 55235 - DNA, 20 bp, synthetic construct
  misc_feature 1..20: note = CRISPR gRNA sequence
  source 1..20: mol_type = other DNA
gaggaggcatgtacagtccc

SEQ ID NO: 55236 - DNA, 20 bp, synthetic construct
  misc_feature 1..20: note = CRISPR gRNA sequence
  source 1..20: mol_type = other DNA
ggcatgtacagtccctagca

SEQ ID NO: 55237 - DNA, 20 bp, synthetic construct
  misc_feature 1..20: note = CRISPR gRNA sequence
  source 1..20: mol_type = other DNA
ccctagcacagcacctgacc

SEQ ID NO: 55238 - DNA, 20 bp, synthetic construct
  misc_feature 1..20: note = CRISPR gRNA sequence
  source 1..20: mol_type = other DNA
cctagcacagcacctgaccc

SEQ ID NO: 55239 - DNA, 20 bp, synthetic construct
  misc_feature 1..20: note = CRISPR gRNA sequence
  source 1..20: mol_type = other DNA
cacagcacctgacccgggac

SEQ ID NO: 55240 - DNA, 20 bp, synthetic construct
  misc_feature 1..20: note = CRISPR gRNA sequence
  source 1..20: mol_type = other DNA
gacccgggacaagtgctgaa

SEQ ID NO: 55241 - DNA, 20 bp, synthetic construct
  misc_feature 1..20: note = CRISPR gRNA sequence
  source 1..20: mol_type = other DNA
ccgggacaagtgctgaatag

SEQ ID NO: 55242 - DNA, 20 bp, synthetic construct
  misc_feature 1..20: note = CRISPR gRNA sequence
  source 1..20: mol_type = other DNA
ggacaagtgctgaatagtag

SEQ ID NO: 55243 - DNA, 20 bp, synthetic construct
  misc_feature 1..20: note = CRISPR gRNA sequence
  source 1..20: mol_type = other DNA
gattcccccaaattcttcat

SEQ ID NO: 55244 - DNA, 20 bp, synthetic construct
  misc_feature 1..20: note = CRISPR gRNA sequence
  source 1..20: mol_type = other DNA
attcccccaaattcttcatg

SEQ ID NO: 55245 - DNA, 20 bp, synthetic construct
  misc_feature 1..20: note = CRISPR gRNA sequence
  source 1..20: mol_type = other DNA
cccccaaattcttcatgagg

SEQ ID NO: 55246 - DNA, 20 bp, synthetic construct
  misc_feature 1..20: note = CRISPR gRNA sequence
  source 1..20: mol_type = other DNA
tcccccacaccacccaccca

SEQ ID NO: 55247 - DNA, 20 bp, synthetic construct
  misc_feature 1..20: note = CRISPR gRNA sequence
  source 1..20: mol_type = other DNA
cccccacaccacccacccaa

SEQ ID NO: 55248 - DNA, 20 bp, synthetic construct
  misc_feature 1..20: note = CRISPR gRNA sequence
  source 1..20: mol_type = other DNA
cacaccacccacccaaaggc

SEQ ID NO: 55249 - DNA, 20 bp, synthetic construct
  misc_feature 1..20: note = CRISPR gRNA sequence
  source 1..20: mol_type = other DNA
acaccacccacccaaaggcg

SEQ ID NO: 55250 - DNA, 20 bp, synthetic construct
  misc_feature 1..20: note = CRISPR gRNA sequence
  source 1..20: mol_type = other DNA
ccctctccaacctcctttcc

SEQ ID NO: 55251 - DNA, 20 bp, synthetic construct
  misc_feature 1..20: note = CRISPR gRNA sequence
  source 1..20: mol_type = other DNA
tcctttcctggctcctacgc

SEQ ID NO: 55252 - DNA, 20 bp, synthetic construct
  misc_feature 1..20: note = CRISPR gRNA sequence
  source 1..20: mol_type = other DNA
cctttcctggctcctacgcc

SEQ ID NO: 55253 - DNA, 20 bp, synthetic construct
  misc_feature 1..20: note = CRISPR gRNA sequence
  source 1..20: mol_type = other DNA
ctttcctggctcctacgcca

SEQ ID NO: 55254 - DNA, 20 bp, synthetic construct
  misc_feature 1..20: note = CRISPR gRNA sequence
  source 1..20: mol_type = other DNA
gatactcactccacttcctc

SEQ ID NO: 55255 - DNA, 20 bp, synthetic construct
  misc_feature 1..20: note = CRISPR gRNA sequence
  source 1..20: mol_type = other DNA
atactcactccacttcctcc

SEQ ID NO: 55256 - DNA, 20 bp, synthetic construct
  misc_feature 1..20: note = CRISPR gRNA sequence
  source 1..20: mol_type = other DNA
tcactccacttcctccaggt

SEQ ID NO: 55257 - DNA, 20 bp, synthetic construct
  misc_feature 1..20: note = CRISPR gRNA sequence
  source 1..20: mol_type = other DNA
cactccacttcctccaggtg

SEQ ID NO: 55258 - DNA, 20 bp, synthetic construct
  misc_feature 1..20: note = CRISPR gRNA sequence
  source 1..20: mol_type = other DNA
actccacttcctccaggtga

SEQ ID NO: 55259 - DNA, 20 bp, synthetic construct
  misc_feature 1..20: note = CRISPR gRNA sequence
  source 1..20: mol_type = other DNA
cctccaggtgagggccttcc

SEQ ID NO: 55260 - DNA, 20 bp, synthetic construct
  misc_feature 1..20: note = CRISPR gRNA sequence
  source 1..20: mol_type = other DNA
tccaggtgagggccttcctg

SEQ ID NO: 55261 - DNA, 20 bp, synthetic construct
  misc_feature 1..20: note = CRISPR gRNA sequence
  source 1..20: mol_type = other DNA
aggtgagggccttcctggag

SEQ ID NO: 55262 - DNA, 20 bp, synthetic construct
  misc_feature 1..20: note = CRISPR gRNA sequence
  source 1..20: mol_type = other DNA
ggtgagggccttcctggagc

SEQ ID NO: 55263 - DNA, 20 bp, synthetic construct
  misc_feature 1..20: note = CRISPR gRNA sequence
  source 1..20: mol_type = other DNA
gtgagggccttcctggagca

SEQ ID NO: 55264 - DNA, 20 bp, synthetic construct
  misc_feature 1..20: note = CRISPR gRNA sequence
  source 1..20: mol_type = other DNA
ccttcctggagcagggctat

SEQ ID NO: 55265 - DNA, 20 bp, synthetic construct
  misc_feature 1..20: note = CRISPR gRNA sequence
  source 1..20: mol_type = other DNA
cttcctggagcagggctatg

SEQ ID NO: 55266 - DNA, 20 bp, synthetic construct
  misc_feature 1..20: note = CRISPR gRNA sequence
  source 1..20: mol_type = other DNA
ttcctggagcagggctatga

SEQ ID NO: 55267 - DNA, 20 bp, synthetic construct
  misc_feature 1..20: note = CRISPR gRNA sequence
  source 1..20: mol_type = other DNA
ctatgagggcctccgcatcg

SEQ ID NO: 55268 - DNA, 20 bp, synthetic construct
  misc_feature 1..20: note = CRISPR gRNA sequence
  source 1..20: mol_type = other DNA
gggcctccgcatcgtggacc

SEQ ID NO: 55269 - DNA, 20 bp, synthetic construct
  misc_feature 1..20: note = CRISPR gRNA sequence
  source 1..20: mol_type = other DNA
gcctccgcatcgtggacctg

SEQ ID NO: 55270 - DNA, 20 bp, synthetic construct
  misc_feature 1..20: note = CRISPR gRNA sequence
  source 1..20: mol_type = other DNA
acctggagctgacacttctg

SEQ ID NO: 55271 - DNA, 20 bp, synthetic construct
  misc_feature 1..20: note = CRISPR gRNA sequence
  source 1..20: mol_type = other DNA
agctgacacttctgcagcct

SEQ ID NO: 55272 - DNA, 20 bp, synthetic construct
  misc_feature 1..20: note = CRISPR gRNA sequence
  source 1..20: mol_type = other DNA
gctgacacttctgcagcctt

SEQ ID NO: 55273 - DNA, 20 bp, synthetic construct
  misc_feature 1..20: note = CRISPR gRNA sequence
  source 1..20: mol_type = other DNA
gacacttctgcagccttggg

SEQ ID NO: 55274 - DNA, 20 bp, synthetic construct
  misc_feature 1..20: note = CRISPR gRNA sequence
  source 1..20: mol_type = other DNA
acacttctgcagccttgggt

SEQ ID NO: 55275 - DNA, 20 bp, synthetic construct
  misc_feature 1..20: note = CRISPR gRNA sequence
  source 1..20: mol_type = other DNA
acttctgcagccttgggtag

SEQ ID NO: 55276 - DNA, 20 bp, synthetic construct
  misc_feature 1..20: note = CRISPR gRNA sequence
  source 1..20: mol_type = other DNA
tctgcagccttgggtaggag

SEQ ID NO: 55277 - DNA, 20 bp, synthetic construct
  misc_feature 1..20: note = CRISPR gRNA sequence
  source 1..20: mol_type = other DNA
ctgcagccttgggtaggagt

SEQ ID NO: 55278 - DNA, 20 bp, synthetic construct
  misc_feature 1..20: note = CRISPR gRNA sequence
  source 1..20: mol_type = other DNA
tgcagccttgggtaggagtg

SEQ ID NO: 55279 - DNA, 20 bp, synthetic construct
  misc_feature 1..20: note = CRISPR gRNA sequence
  source 1..20: mol_type = other DNA
gcagccttgggtaggagtgg

SEQ ID NO: 55280 - DNA, 20 bp, synthetic construct
  misc_feature 1..20: note = CRISPR gRNA sequence
  source 1..20: mol_type = other DNA
ccttgggtaggagtggggga

SEQ ID NO: 55281 - DNA, 20 bp, synthetic construct
  misc_feature 1..20: note = CRISPR gRNA sequence
  source 1..20: mol_type = other DNA
tgggtaggagtgggggacag

SEQ ID NO: 55282 - DNA, 20 bp, synthetic construct
  misc_feature 1..20: note = CRISPR gRNA sequence
  source 1..20: mol_type = other DNA
gggtaggagtgggggacaga

SEQ ID NO: 55283 - DNA, 20 bp, synthetic construct
  misc_feature 1..20: note = CRISPR gRNA sequence
  source 1..20: mol_type = other DNA
ggtaggagtgggggacagaa

SEQ ID NO: 55284 - DNA, 20 bp, synthetic construct
  misc_feature 1..20: note = CRISPR gRNA sequence
  source 1..20: mol_type = other DNA
gagtgggggacagaagggct

SEQ ID NO: 55285 - DNA, 20 bp, synthetic construct
  misc_feature 1..20: note = CRISPR gRNA sequence
  source 1..20: mol_type = other DNA
agtgggggacagaagggctc

SEQ ID NO: 55286 - DNA, 20 bp, synthetic construct
  misc_feature 1..20: note = CRISPR gRNA sequence
  source 1..20: mol_type = other DNA
gtgggggacagaagggctca

SEQ ID NO: 55287 - DNA, 20 bp, synthetic construct
  misc_feature 1..20: note = CRISPR gRNA sequence
  source 1..20: mol_type = other DNA
acagaagggctcagggcaaa

SEQ ID NO: 55288 - DNA, 20 bp, synthetic construct
  misc_feature 1..20: note = CRISPR gRNA sequence
  source 1..20: mol_type = other DNA
ggcaaacagcccctactcca

SEQ ID NO: 55289 - DNA, 20 bp, synthetic construct
  misc_feature 1..20: note = CRISPR gRNA sequence
  source 1..20: mol_type = other DNA
cccctactccatggcccctc

SEQ ID NO: 55290 - DNA, 20 bp, synthetic construct
  misc_feature 1..20: note = CRISPR gRNA sequence
  source 1..20: mol_type = other DNA
gcccctccagcttccaatgc

SEQ ID NO: 55291 - DNA, 20 bp, synthetic construct
  misc_feature 1..20: note = CRISPR gRNA sequence
  source 1..20: mol_type = other DNA
cccctccagcttccaatgct

SEQ ID NO: 55292 - DNA, 20 bp, synthetic construct
  misc_feature 1..20: note = CRISPR gRNA sequence
  source 1..20: mol_type = other DNA
ccctccagcttccaatgctg

SEQ ID NO: 55293 - DNA, 20 bp, synthetic construct
  misc_feature 1..20: note = CRISPR gRNA sequence
  source 1..20: mol_type = other DNA
cctccagcttccaatgctgg

SEQ ID NO: 55294 - DNA, 20 bp, synthetic construct
  misc_feature 1..20: note = CRISPR gRNA sequence
  source 1..20: mol_type = other DNA
tccagcttccaatgctgggg

SEQ ID NO: 55295 - DNA, 20 bp, synthetic construct
  misc_feature 1..20: note = CRISPR gRNA sequence
  source 1..20: mol_type = other DNA
gcttccaatgctgggggagt

SEQ ID NO: 55296 - DNA, 20 bp, synthetic construct
  misc_feature 1..20: note = CRISPR gRNA sequence
  source 1..20: mol_type = other DNA
cttccaatgctgggggagtc

SEQ ID NO: 55297 - DNA, 20 bp, synthetic construct
  misc_feature 1..20: note = CRISPR gRNA sequence
  source 1..20: mol_type = other DNA
ttccaatgctgggggagtca

SEQ ID NO: 55298 - DNA, 20 bp, synthetic construct
  misc_feature 1..20: note = CRISPR gRNA sequence
  source 1..20: mol_type = other DNA
tccaatgctgggggagtcag

SEQ ID NO: 55299 - DNA, 20 bp, synthetic construct
  misc_feature 1..20: note = CRISPR gRNA sequence
  source 1..20: mol_type = other DNA
ccaatgctgggggagtcagg

SEQ ID NO: 55300 - DNA, 20 bp, synthetic construct
  misc_feature 1..20: note = CRISPR gRNA sequence
  source 1..20: mol_type = other DNA
tgggggagtcagggggccca

SEQ ID NO: 55301 - DNA, 20 bp, synthetic construct
  misc_feature 1..20: note = CRISPR gRNA sequence
  source 1..20: mol_type = other DNA
agtcagggggcccacagacc

SEQ ID NO: 55302 - DNA, 20 bp, synthetic construct
  misc_feature 1..20: note = CRISPR gRNA sequence
  source 1..20: mol_type = other DNA
gtcagggggcccacagacct

SEQ ID NO: 55303 - DNA, 20 bp, synthetic construct
  misc_feature 1..20: note = CRISPR gRNA sequence
  source 1..20: mol_type = other DNA
cacagacctgggtctaatcc

SEQ ID NO: 55304 - DNA, 20 bp, synthetic construct
  misc_feature 1..20: note = CRISPR gRNA sequence
  source 1..20: mol_type = other DNA
ctaatcctagccacacctct

SEQ ID NO: 55305 - DNA, 20 bp, synthetic construct
  misc_feature 1..20: note = CRISPR gRNA sequence
  source 1..20: mol_type = other DNA
atcctagccacacctcttag

SEQ ID NO: 55306 - DNA, 20 bp, synthetic construct
  misc_feature 1..20: note = CRISPR gRNA sequence
  source 1..20: mol_type = other DNA
tagccacacctcttagtagc

SEQ ID NO: 55307 - DNA, 20 bp, synthetic construct
  misc_feature 1..20: note = CRISPR gRNA sequence
  source 1..20: mol_type = other DNA
agccacacctcttagtagct

SEQ ID NO: 55308 - DNA, 20 bp, synthetic construct
  misc_feature 1..20: note = CRISPR gRNA sequence
  source 1..20: mol_type = other DNA
cttagtagctgggtgatctt

SEQ ID NO: 55309 - DNA, 20 bp, synthetic construct
  misc_feature 1..20: note = CRISPR gRNA sequence
  source 1..20: mol_type = other DNA
gtagctgggtgatcttgagc

SEQ ID NO: 55310 - DNA, 20 bp, synthetic construct
  misc_feature 1..20: note = CRISPR gRNA sequence
  source 1..20: mol_type = other DNA
tagctgggtgatcttgagca

SEQ ID NO: 55311 - DNA, 20 bp, synthetic construct
  misc_feature 1..20: note = CRISPR gRNA sequence
  source 1..20: mol_type = other DNA
agctgggtgatcttgagcaa

SEQ ID NO: 55312 - DNA, 20 bp, synthetic construct
  misc_feature 1..20: note = CRISPR gRNA sequence
  source 1..20: mol_type = other DNA
gcaagggacttaacctgtct

SEQ ID NO: 55313 - DNA, 20 bp, synthetic construct
  misc_feature 1..20: note = CRISPR gRNA sequence
  source 1..20: mol_type = other DNA
gacttaacctgtctgagact

SEQ ID NO: 55314 - DNA, 20 bp, synthetic construct
  misc_feature 1..20: note = CRISPR gRNA sequence
  source 1..20: mol_type = other DNA
ctcagtttcctcctccctca

SEQ ID NO: 55315 - DNA, 20 bp, synthetic construct
  misc_feature 1..20: note = CRISPR gRNA sequence
  source 1..20: mol_type = other DNA
tcagtttcctcctccctcaa

SEQ ID NO: 55316 - DNA, 20 bp, synthetic construct
  misc_feature 1..20: note = CRISPR gRNA sequence
  source 1..20: mol_type = other DNA
cagtttcctcctccctcaaa

SEQ ID NO: 55317 - DNA, 20 bp, synthetic construct
  misc_feature 1..20: note = CRISPR gRNA sequence
  source 1..20: mol_type = other DNA
agtttcctcctccctcaaag

SEQ ID NO: 55318 - DNA, 20 bp, synthetic construct
  misc_feature 1..20: note = CRISPR gRNA sequence
  source 1..20: mol_type = other DNA
gaataataatgtgtacttca

SEQ ID NO: 55319 - DNA, 20 bp, synthetic construct
  misc_feature 1..20: note = CRISPR gRNA sequence
  source 1..20: mol_type = other DNA
ataataatgtgtacttcaca

SEQ ID NO: 55320 - DNA, 20 bp, synthetic construct
  misc_feature 1..20: note = CRISPR gRNA sequence
  source 1..20: mol_type = other DNA
tgtacttcacagagattcta

SEQ ID NO: 55321 - DNA, 20 bp, synthetic construct
  misc_feature 1..20: note = CRISPR gRNA sequence
  source 1..20: mol_type = other DNA
gtacttcacagagattctaa

SEQ ID NO: 55322 - DNA, 20 bp, synthetic construct
  misc_feature 1..20: note = CRISPR gRNA sequence
  source 1..20: mol_type = other DNA
cagagattctaaaggaatta

SEQ ID NO: 55323 - DNA, 20 bp, synthetic construct
  misc_feature 1..20: note = CRISPR gRNA sequence
  source 1..20: mol_type = other DNA
gattctaaaggaattacagt

SEQ ID NO: 55324 - DNA, 20 bp, synthetic construct
  misc_feature 1..20: note = CRISPR gRNA sequence
  source 1..20: mol_type = other DNA
attctaaaggaattacagtg

SEQ ID NO: 55325 - DNA, 20 bp, synthetic construct
  misc_feature 1..20: note = CRISPR gRNA sequence
  source 1..20: mol_type = other DNA
aaggaattacagtgaggtaa

SEQ ID NO: 55326 - DNA, 20 bp, synthetic construct
  misc_feature 1..20: note = CRISPR gRNA sequence
  source 1..20: mol_type = other DNA
ggtaatggatgtaaaacatc

SEQ ID NO: 55327 - DNA, 20 bp, synthetic construct
  misc_feature 1..20: note = CRISPR gRNA sequence
  source 1..20: mol_type = other DNA
aaaacatctagtgcaatgcc

SEQ ID NO: 55328 - DNA, 20 bp, synthetic construct
  misc_feature 1..20: note = CRISPR gRNA sequence
  source 1..20: mol_type = other DNA
ctagtgcaatgcccggcata

SEQ ID NO: 55329 - DNA, 20 bp, synthetic construct
  misc_feature 1..20: note = CRISPR gRNA sequence
  source 1..20: mol_type = other DNA
tgcaatgcccggcatataga

SEQ ID NO: 55330 - DNA, 20 bp, synthetic construct
  misc_feature 1..20: note = CRISPR gRNA sequence
  source 1..20: mol_type = other DNA
atgcccggcatatagatagc

SEQ ID NO: 55331 - DNA, 20 bp, synthetic construct
  misc_feature 1..20: note = CRISPR gRNA sequence
  source 1..20: mol_type = other DNA
tatagatagccggttccatt

SEQ ID NO: 55332 - DNA, 20 bp, synthetic construct
  misc_feature 1..20: note = CRISPR gRNA sequence
  source 1..20: mol_type = other DNA
tagccggttccattaagttg

SEQ ID NO: 55333 - DNA, 20 bp, synthetic construct
  misc_feature 1..20: note = CRISPR gRNA sequence
  source 1..20: mol_type = other DNA
tgcagctattgttattatga

SEQ ID NO: 55334 - DNA, 20 bp, synthetic construct
  misc_feature 1..20: note = CRISPR gRNA sequence
  source 1..20: mol_type = other DNA
atgacagatgctccttattc

SEQ ID NO: 55335 - DNA, 20 bp, synthetic construct
  misc_feature 1..20: note = CRISPR gRNA sequence
  source 1..20: mol_type = other DNA
cagatgctccttattcaagc

SEQ ID NO: 55336 - DNA, 20 bp, synthetic construct
  misc_feature 1..20: note = CRISPR gRNA sequence
  source 1..20: mol_type = other DNA
agatgctccttattcaagcc

SEQ ID NO: 55337 - DNA, 20 bp, synthetic construct
  misc_feature 1..20: note = CRISPR gRNA sequence
  source 1..20: mol_type = other DNA
gctccttattcaagccagga

SEQ ID NO: 55338 - DNA, 20 bp, synthetic construct
  misc_feature 1..20: note = CRISPR gRNA sequence
  source 1..20: mol_type = other DNA
ctccttattcaagccaggat

SEQ ID NO: 55339 - DNA, 20 bp, synthetic construct
  misc_feature 1..20: note = CRISPR gRNA sequence
  source 1..20: mol_type = other DNA
tcaagccaggatgggctatc

SEQ ID NO: 55340 - DNA, 20 bp, synthetic construct
  misc_feature 1..20: note = CRISPR gRNA sequence
  source 1..20: mol_type = other DNA
caagccaggatgggctatcc

SEQ ID NO: 55341 - DNA, 20 bp, synthetic construct
  misc_feature 1..20: note = CRISPR gRNA sequence
  source 1..20: mol_type = other DNA
ccaggatgggctatccagga

SEQ ID NO: 55342 - DNA, 20 bp, synthetic construct
  misc_feature 1..20: note = CRISPR gRNA sequence
  source 1..20: mol_type = other DNA
caggatgggctatccaggat

SEQ ID NO: 55343 - DNA, 20 bp, synthetic construct
  misc_feature 1..20: note = CRISPR gRNA sequence
  source 1..20: mol_type = other DNA
tccaggatgggcaccacacc

SEQ ID NO: 55344 - DNA, 20 bp, synthetic construct
  misc_feature 1..20: note = CRISPR gRNA sequence
  source 1..20: mol_type = other DNA
gcccctgctctcccttgcct

SEQ ID NO: 55345 - DNA, 20 bp, synthetic construct
  misc_feature 1..20: note = CRISPR gRNA sequence
  source 1..20: mol_type = other DNA
ccatatcatatccctctcct

SEQ ID NO: 55346 - DNA, 20 bp, synthetic construct
  misc_feature 1..20: note = CRISPR gRNA sequence
  source 1..20: mol_type = other DNA
catatcatatccctctccta

SEQ ID NO: 55347 - DNA, 20 bp, synthetic construct
  misc_feature 1..20: note = CRISPR gRNA sequence
  source 1..20: mol_type = other DNA
atatccctctcctaaggcaa

SEQ ID NO: 55348 - DNA, 20 bp, synthetic construct
  misc_feature 1..20: note = CRISPR gRNA sequence
  source 1..20: mol_type = other DNA
ctaaggcaatagatccctcc

SEQ ID NO: 55349 - DNA, 20 bp, synthetic construct
  misc_feature 1..20: note = CRISPR gRNA sequence
  source 1..20: mol_type = other DNA
taaggcaatagatccctcca

SEQ ID NO: 55350 - DNA, 20 bp, synthetic construct
  misc_feature 1..20: note = CRISPR gRNA sequence
  source 1..20: mol_type = other DNA
tagatccctccaaggtacct

SEQ ID NO: 55351 - DNA, 20 bp, synthetic construct
  misc_feature 1..20: note = CRISPR gRNA sequence
  source 1..20: mol_type = other DNA
ctccaaggtacctgagcgtc

SEQ ID NO: 55352 - DNA, 20 bp, synthetic construct
  misc_feature 1..20: note = CRISPR gRNA sequence
  source 1..20: mol_type = other DNA
gagcgtcaagcttctgctct

SEQ ID NO: 55353 - DNA, 20 bp, synthetic construct
  misc_feature 1..20: note = CRISPR gRNA sequence
  source 1..20: mol_type = other DNA
tgctctgagcccctttcctc

SEQ ID NO: 55354 - DNA, 20 bp, synthetic construct
  misc_feature 1..20: note = CRISPR gRNA sequence
  source 1..20: mol_type = other DNA
ctctggccgtcactttcctg

SEQ ID NO: 55355 - DNA, 20 bp, synthetic construct
  misc_feature 1..20: note = CRISPR gRNA sequence
  source 1..20: mol_type = other DNA
tctggccgtcactttcctgc

SEQ ID NO: 55356 - DNA, 20 bp, synthetic construct
  misc_feature 1..20: note = CRISPR gRNA sequence
  source 1..20: mol_type = other DNA
ccgtcactttcctgcaggtc

SEQ ID NO: 55357 - DNA, 20 bp, synthetic construct
  misc_feature 1..20: note = CRISPR gRNA sequence
  source 1..20: mol_type = other DNA
gtcactttcctgcaggtctg

SEQ ID NO: 55358 - DNA, 20 bp, synthetic construct
  misc_feature 1..20: note = CRISPR gRNA sequence
  source 1..20: mol_type = other DNA
ttcctgcaggtctggagctc

SEQ ID NO: 55359 - DNA, 20 bp, synthetic construct
  misc_feature 1..20: note = CRISPR gRNA sequence
  source 1..20: mol_type = other DNA
tgcaggtctggagctctggc

SEQ ID NO: 55360 - DNA, 20 bp, synthetic construct
  misc_feature 1..20: note = CRISPR gRNA sequence
  source 1..20: mol_type = other DNA
agctctggcaagaacaaatc

SEQ ID NO: 55361 - DNA, 20 bp, synthetic construct
  misc_feature 1..20: note = CRISPR gRNA sequence
  source 1..20: mol_type = other DNA
ggcaagaacaaatcaagcat

SEQ ID NO: 55362 - DNA, 20 bp, synthetic construct
  misc_feature 1..20: note = CRISPR gRNA sequence
  source 1..20: mol_type = other DNA
gaacaaatcaagcattggcc

SEQ ID NO: 55363 - DNA, 20 bp, synthetic construct
  misc_feature 1..20: note = CRISPR gRNA sequence
  source 1..20: mol_type = other DNA
aacaaatcaagcattggcct

SEQ ID NO: 55364 - DNA, 20 bp, synthetic construct
  misc_feature 1..20: note = CRISPR gRNA sequence
  source 1..20: mol_type = other DNA
atcaagcattggcctgggct

SEQ ID NO: 55365 - DNA, 20 bp, synthetic construct
  misc_feature 1..20: note = CRISPR gRNA sequence
  source 1..20: mol_type = other DNA
tcaagcattggcctgggctc

SEQ ID NO: 55366 - DNA, 20 bp, synthetic construct
  misc_feature 1..20: note = CRISPR gRNA sequence
  source 1..20: mol_type = other DNA
ttggcctgggctcaggcatc

SEQ ID NO: 55367 - DNA, 20 bp, synthetic construct
  misc_feature 1..20: note = CRISPR gRNA sequence
  source 1..20: mol_type = other DNA
tggcctgggctcaggcatct

SEQ ID NO: 55368 - DNA, 20 bp, synthetic construct
  misc_feature 1..20: note = CRISPR gRNA sequence
  source 1..20: mol_type = other DNA
ggcctgggctcaggcatcta

SEQ ID NO: 55369 - DNA, 20 bp, synthetic construct
  misc_feature 1..20: note = CRISPR gRNA sequence
  source 1..20: mol_type = other DNA
gggctcaggcatctagggcc

SEQ ID NO: 55370 - DNA, 20 bp, synthetic construct
  misc_feature 1..20: note = CRISPR gRNA sequence
  source 1..20: mol_type = other DNA
ctcaggcatctagggcctgg

SEQ ID NO: 55371 - DNA, 20 bp, synthetic construct
  misc_feature 1..20: note = CRISPR gRNA sequence
  source 1..20: mol_type = other DNA
catctagggcctggtggatc

SEQ ID NO: 55372 - DNA, 20 bp, synthetic construct
  misc_feature 1..20: note = CRISPR gRNA sequence
  source 1..20: mol_type = other DNA
gtggatcaagcctctttcct

SEQ ID NO: 55373 - DNA, 20 bp, synthetic construct
  misc_feature 1..20: note = CRISPR gRNA sequence
  source 1..20: mol_type = other DNA
aagcctctttccttggcttc

SEQ ID NO: 55374 - DNA, 20 bp, synthetic construct
  misc_feature 1..20: note = CRISPR gRNA sequence
  source 1..20: mol_type = other DNA
gcctctttccttggcttcta

SEQ ID NO: 55375 - DNA, 20 bp, synthetic construct
  misc_feature 1..20: note = CRISPR gRNA sequence
  source 1..20: mol_type = other DNA
cctctttccttggcttctag

SEQ ID NO: 55376 - DNA, 20 bp, synthetic construct
  misc_feature 1..20: note = CRISPR gRNA sequence
  source 1..20: mol_type = other DNA
tccttggcttctagaggctg

SEQ ID NO: 55377 - DNA, 20 bp, synthetic construct
  misc_feature 1..20: note = CRISPR gRNA sequence
  source 1..20: mol_type = other DNA
tctagaggctgaagaccctg

SEQ ID NO: 55378 - DNA, 20 bp, synthetic construct
  misc_feature 1..20: note = CRISPR gRNA sequence
  source 1..20: mol_type = other DNA
agaccctgaagcacaaccca

SEQ ID NO: 55379 - DNA, 20 bp, synthetic construct
  misc_feature 1..20: note = CRISPR gRNA sequence
  source 1..20: mol_type = other DNA
cctgaagcacaacccaaagt

SEQ ID NO: 55380 - DNA, 20 bp, synthetic construct
  misc_feature 1..20: note = CRISPR gRNA sequence
  source 1..20: mol_type = other DNA
aagcacaacccaaagtgagt

SEQ ID NO: 55381 - DNA, 20 bp, synthetic construct
  misc_feature 1..20: note = CRISPR gRNA sequence
  source 1..20: mol_type = other DNA
cccaaagtgagtcggtaaca

SEQ ID NO: 55382 - DNA, 20 bp, synthetic construct
  misc_feature 1..20: note = CRISPR gRNA sequence
  source 1..20: mol_type = other DNA
ccaaagtgagtcggtaacaa

SEQ ID NO: 55383 - DNA, 20 bp, synthetic construct
  misc_feature 1..20: note = CRISPR gRNA sequence
  source 1..20: mol_type = other DNA
aaagtgagtcggtaacaaag

SEQ ID NO: 55384 - DNA, 20 bp, synthetic construct
  misc_feature 1..20: note = CRISPR gRNA sequence
  source 1..20: mol_type = other DNA
gtaacaaaggagactgcttg

SEQ ID NO: 55385 - DNA, 20 bp, synthetic construct
  misc_feature 1..20: note = CRISPR gRNA sequence
  source 1..20: mol_type = other DNA
gagactgcttgcagatgctc

SEQ ID NO: 55386 - DNA, 20 bp, synthetic construct
  misc_feature 1..20: note = CRISPR gRNA sequence
  source 1..20: mol_type = other DNA
cagatgctcaagatgtgatt

SEQ ID NO: 55387 - DNA, 20 bp, synthetic construct
  misc_feature 1..20: note = CRISPR gRNA sequence
  source 1..20: mol_type = other DNA
atgctcaagatgtgattcag

SEQ ID NO: 55388 - DNA, 20 bp, synthetic construct
  misc_feature 1..20: note = CRISPR gRNA sequence
  source 1..20: mol_type = other DNA
gctcaagatgtgattcagca

SEQ ID NO: 55389 - DNA, 20 bp, synthetic construct
  misc_feature 1..20: note = CRISPR gRNA sequence
  source 1..20: mol_type = other DNA
caagatgtgattcagcagag

SEQ ID NO: 55390 - DNA, 20 bp, synthetic construct
  misc_feature 1..20: note = CRISPR gRNA sequence
  source 1..20: mol_type = other DNA
aagatgtgattcagcagagc

SEQ ID NO: 55391 - DNA, 20 bp, synthetic construct
  misc_feature 1..20: note = CRISPR gRNA sequence
  source 1..20: mol_type = other DNA
gatgtgattcagcagagcag

SEQ ID NO: 55392 - DNA, 20 bp, synthetic construct
  misc_feature 1..20: note = CRISPR gRNA sequence
  source 1..20: mol_type = other DNA
atgtgattcagcagagcagg

SEQ ID NO: 55393 - DNA, 20 bp, synthetic construct
  misc_feature 1..20: note = CRISPR gRNA sequence
  source 1..20: mol_type = other DNA
tgtgattcagcagagcagga

SEQ ID NO: 55394 - DNA, 20 bp, synthetic construct
  misc_feature 1..20: note = CRISPR gRNA sequence
  source 1..20: mol_type = other DNA
gtgattcagcagagcaggag

SEQ ID NO: 55395 - DNA, 20 bp, synthetic construct
  misc_feature 1..20: note = CRISPR gRNA sequence
  source 1..20: mol_type = other DNA
cagcagagcaggaggggcaa

SEQ ID NO: 55396 - DNA, 20 bp, synthetic construct
  misc_feature 1..20: note = CRISPR gRNA sequence
  source 1..20: mol_type = other DNA
agcagagcaggaggggcaac

SEQ ID NO: 55397 - DNA, 20 bp, synthetic construct
  misc_feature 1..20: note = CRISPR gRNA sequence
  source 1..20: mol_type = other DNA
gcaggaggggcaacaggttt

SEQ ID NO: 55398 - DNA, 20 bp, synthetic construct
  misc_feature 1..20: note = CRISPR gRNA sequence
  source 1..20: mol_type = other DNA
caggaggggcaacaggtttg

SEQ ID NO: 55399 - DNA, 20 bp, synthetic construct
  misc_feature 1..20: note = CRISPR gRNA sequence
  source 1..20: mol_type = other DNA
gcaacaggtttgaggtcaaa

SEQ ID NO: 55400 - DNA, 20 bp, synthetic construct
  misc_feature 1..20: note = CRISPR gRNA sequence
  source 1..20: mol_type = other DNA
tggaacctttattcaaattt

SEQ ID NO: 55401 - DNA, 20 bp, synthetic construct
  misc_feature 1..20: note = CRISPR gRNA sequence
  source 1..20: mol_type = other DNA
aattttggctctgccatgta

SEQ ID NO: 55402 - DNA, 20 bp, synthetic construct
  misc_feature 1..20: note = CRISPR gRNA sequence
  source 1..20: mol_type = other DNA
ctctgccatgtatagccatg

SEQ ID NO: 55403 - DNA, 20 bp, synthetic construct
  misc_feature 1..20: note = CRISPR gRNA sequence
  source 1..20: mol_type = other DNA
catgtatagccatgtggcct

SEQ ID NO: 55404 - DNA, 20 bp, synthetic construct
  misc_feature 1..20: note = CRISPR gRNA sequence
  source 1..20: mol_type = other DNA
atgtatagccatgtggcctt

SEQ ID NO: 55405 - DNA, 20 bp, synthetic construct
  misc_feature 1..20: note = CRISPR gRNA sequence
  source 1..20: mol_type = other DNA
tggccttgggcaaatcactg

SEQ ID NO: 55406 - DNA, 20 bp, synthetic construct
  misc_feature 1..20: note = CRISPR gRNA sequence
  source 1..20: mol_type = other DNA
cttgggcaaatcactgcagt

SEQ ID NO: 55407 - DNA, 20 bp, synthetic construct
  misc_feature 1..20: note = CRISPR gRNA sequence
  source 1..20: mol_type = other DNA
cccttttctcttttctaaaa

SEQ ID NO: 55408 - DNA, 20 bp, synthetic construct
  misc_feature 1..20: note = CRISPR gRNA sequence
  source 1..20: mol_type = other DNA
ctaaaacggatgacaacatc

SEQ ID NO: 55409 - DNA, 20 bp, synthetic construct
  misc_feature 1..20: note = CRISPR gRNA sequence
  source 1..20: mol_type = other DNA
ggatgacaacatctagcaca

SEQ ID NO: 55410 - DNA, 20 bp, synthetic construct
  misc_feature 1..20: note = CRISPR gRNA sequence
  source 1..20: mol_type = other DNA
gatgacaacatctagcacat

SEQ ID NO: 55411 - DNA, 20 bp, synthetic construct
  misc_feature 1..20: note = CRISPR gRNA sequence
  source 1..20: mol_type = other DNA
atctagcacataggtacctg

SEQ ID NO: 55412 - DNA, 20 bp, synthetic construct
  misc_feature 1..20: note = CRISPR gRNA sequence
  source 1..20: mol_type = other DNA
tctagcacataggtacctga

SEQ ID NO: 55413 - DNA, 20 bp, synthetic construct
  misc_feature 1..20: note = CRISPR gRNA sequence
  source 1..20: mol_type = other DNA
aggtacctgaaggattgaat

SEQ ID NO: 55414 - DNA, 20 bp, synthetic construct
  misc_feature 1..20: note = CRISPR gRNA sequence
  source 1..20: mol_type = other DNA
gaatgagacaatgtatgtcc

SEQ ID NO: 55415 - DNA, 20 bp, synthetic construct
  misc_feature 1..20: note = CRISPR gRNA sequence
  source 1..20: mol_type = other DNA
acaatgtatgtccaagtacc

SEQ ID NO: 55416 - DNA, 20 bp, synthetic construct
  misc_feature 1..20: note = CRISPR gRNA sequence
  source 1..20: mol_type = other DNA
gtatgtccaagtacccagca

SEQ ID NO: 55417 - DNA, 20 bp, synthetic construct
  misc_feature 1..20: note = CRISPR gRNA sequence
  source 1..20: mol_type = other DNA
tatgtccaagtacccagcat

SEQ ID NO: 55418 - DNA, 20 bp, synthetic construct
  misc_feature 1..20: note = CRISPR gRNA sequence
  source 1..20: mol_type = other DNA
ccagcataggtgtaaaatcg

SEQ ID NO: 55419 - DNA, 20 bp, synthetic construct
  misc_feature 1..20: note = CRISPR gRNA sequence
  source 1..20: mol_type = other DNA
cagcataggtgtaaaatcga

SEQ ID NO: 55420 - DNA, 20 bp, synthetic construct
  misc_feature 1..20: note = CRISPR gRNA sequence
  source 1..20: mol_type = other DNA
ataggtgtaaaatcgaaggt

SEQ ID NO: 55421 - DNA, 20 bp, synthetic construct
  misc_feature 1..20: note = CRISPR gRNA sequence
  source 1..20: mol_type = other DNA
taaaatcgaaggttagtaaa

SEQ ID NO: 55422 - DNA, 20 bp, synthetic construct
  misc_feature 1..20: note = CRISPR gRNA sequence
  source 1..20: mol_type = other DNA
aatcgaaggttagtaaacag

SEQ ID NO: 55423 - DNA, 20 bp, synthetic construct
  misc_feature 1..20: note = CRISPR gRNA sequence
  source 1..20: mol_type = other DNA
tgctattgtcgatgatgtga

SEQ ID NO: 55424 - DNA, 20 bp, synthetic construct
  misc_feature 1..20: note = CRISPR gRNA sequence
  source 1..20: mol_type = other DNA
gatgtgatggtctccatttg

SEQ ID NO: 55425 - DNA, 20 bp, synthetic construct
  misc_feature 1..20: note = CRISPR gRNA sequence
  source 1..20: mol_type = other DNA
atttgtggatgtgctgtctg

SEQ ID NO: 55426 - DNA, 20 bp, synthetic construct
  misc_feature 1..20: note = CRISPR gRNA sequence
  source 1..20: mol_type = other DNA
tggatgtgctgtctgtggtt

SEQ ID NO: 55427 - DNA, 20 bp, synthetic construct
  misc_feature 1..20: note = CRISPR gRNA sequence
  source 1..20: mol_type = other DNA
atgtgctgtctgtggttcag

SEQ ID NO: 55428 - DNA, 20 bp, synthetic construct
  misc_feature 1..20: note = CRISPR gRNA sequence
  source 1..20: mol_type = other DNA
tgtgctgtctgtggttcaga

SEQ ID NO: 55429 - DNA, 20 bp, synthetic construct
  misc_feature 1..20: note = CRISPR gRNA sequence
  source 1..20: mol_type = other DNA
ctgtctgtggttcagaaggc

SEQ ID NO: 55430 - DNA, 20 bp, synthetic construct
  misc_feature 1..20: note = CRISPR gRNA sequence
  source 1..20: mol_type = other DNA
tgtctgtggttcagaaggcg

SEQ ID NO: 55431 - DNA, 20 bp, synthetic construct
  misc_feature 1..20: note = CRISPR gRNA sequence
  source 1..20: mol_type = other DNA
tctgtggttcagaaggcgag

SEQ ID NO: 55432 - DNA, 20 bp, synthetic construct
  misc_feature 1..20: note = CRISPR gRNA sequence
  source 1..20: mol_type = other DNA
gttcagaaggcgaggagcat

SEQ ID NO: 55433 - DNA, 20 bp, synthetic construct
  misc_feature 1..20: note = CRISPR gRNA sequence
  source 1..20: mol_type = other DNA
cgaggagcatgagctgtatg

SEQ ID NO: 55434 - DNA, 20 bp, synthetic construct
  misc_feature 1..20: note = CRISPR gRNA sequence
  source 1..20: mol_type = other DNA
gagcatgagctgtatgcagt

SEQ ID NO: 55435 - DNA, 20 bp, synthetic construct
  misc_feature 1..20: note = CRISPR gRNA sequence
  source 1..20: mol_type = other DNA
tgagctgtatgcagtgagtc

SEQ ID NO: 55436 - DNA, 20 bp, synthetic construct
  misc_feature 1..20: note = CRISPR gRNA sequence
  source 1..20: mol_type = other DNA
gagctgtatgcagtgagtcc

SEQ ID NO: 55437 - DNA, 20 bp, synthetic construct
  misc_feature 1..20: note = CRISPR gRNA sequence
  source 1..20: mol_type = other DNA
tatgcagtgagtccaggcta

SEQ ID NO: 55438 - DNA, 20 bp, synthetic construct
  misc_feature 1..20: note = CRISPR gRNA sequence
  source 1..20: mol_type = other DNA
gtccaggctatggtaaacca

SEQ ID NO: 55439 - DNA, 20 bp, synthetic construct
  misc_feature 1..20: note = CRISPR gRNA sequence
  source 1..20: mol_type = other DNA
aaccacagactctctcccac

SEQ ID NO: 55440 - DNA, 20 bp, synthetic construct
  misc_feature 1..20: note = CRISPR gRNA sequence
  source 1..20: mol_type = other DNA
accacagactctctcccact

SEQ ID NO: 55441 - DNA, 20 bp, synthetic construct
  misc_feature 1..20: note = CRISPR gRNA sequence
  source 1..20: mol_type = other DNA
agactctctcccactgggct

SEQ ID NO: 55442 - DNA, 20 bp, synthetic construct
  misc_feature 1..20: note = CRISPR gRNA sequence
  source 1..20: mol_type = other DNA
gactctctcccactgggctg

SEQ ID NO: 55443 - DNA, 20 bp, synthetic construct
  misc_feature 1..20: note = CRISPR gRNA sequence
  source 1..20: mol_type = other DNA
actctctcccactgggctga

SEQ ID NO: 55444 - DNA, 20 bp, synthetic construct
  misc_feature 1..20: note = CRISPR gRNA sequence
  source 1..20: mol_type = other DNA
tctctcccactgggctgagg

SEQ ID NO: 55445 - DNA, 20 bp, synthetic construct
  misc_feature 1..20: note = CRISPR gRNA sequence
  source 1..20: mol_type = other DNA
ccactgggctgagggagcgt

SEQ ID NO: 55446 - DNA, 20 bp, synthetic construct
  misc_feature 1..20: note = CRISPR gRNA sequence
  source 1..20: mol_type = other DNA
cactgggctgagggagcgtt

SEQ ID NO: 55447 - DNA, 20 bp, synthetic construct
  misc_feature 1..20: note = CRISPR gRNA sequence
  source 1..20: mol_type = other DNA
actgggctgagggagcgtta

SEQ ID NO: 55448 - DNA, 20 bp, synthetic construct
  misc_feature 1..20: note = CRISPR gRNA sequence
  source 1..20: mol_type = other DNA
ctgggctgagggagcgttag

SEQ ID NO: 55449 - DNA, 20 bp, synthetic construct
  misc_feature 1..20: note = CRISPR gRNA sequence
  source 1..20: mol_type = other DNA
tgagggagcgttaggggatg

SEQ ID NO: 55450 - DNA, 20 bp, synthetic construct
  misc_feature 1..20: note = CRISPR gRNA sequence
  source 1..20: mol_type = other DNA
gagggagcgttaggggatgc

SEQ ID NO: 55451 - DNA, 20 bp, synthetic construct
  misc_feature 1..20: note = CRISPR gRNA sequence
  source 1..20: mol_type = other DNA
agggagcgttaggggatgca

SEQ ID NO: 55452 - DNA, 20 bp, synthetic construct
  misc_feature 1..20: note = CRISPR gRNA sequence
  source 1..20: mol_type = other DNA
gagcgttaggggatgcaggg

SEQ ID NO: 55453 - DNA, 20 bp, synthetic construct
  misc_feature 1..20: note = CRISPR gRNA sequence
  source 1..20: mol_type = other DNA
gttaggggatgcagggaagc

SEQ ID NO: 55454 - DNA, 20 bp, synthetic construct
  misc_feature 1..20: note = CRISPR gRNA sequence
  source 1..20: mol_type = other DNA
ttaggggatgcagggaagct

SEQ ID NO: 55455 - DNA, 20 bp, synthetic construct
  misc_feature 1..20: note = CRISPR gRNA sequence
  source 1..20: mol_type = other DNA
cagggaagctaggacatcat

SEQ ID NO: 55456 - DNA, 20 bp, synthetic construct
  misc_feature 1..20: note = CRISPR gRNA sequence
  source 1..20: mol_type = other DNA
gaagctaggacatcatgagc

SEQ ID NO: 55457 - DNA, 20 bp, synthetic construct
  misc_feature 1..20: note = CRISPR gRNA sequence
  source 1..20: mol_type = other DNA
aagctaggacatcatgagcc

SEQ ID NO: 55458 - DNA, 20 bp, synthetic construct
  misc_feature 1..20: note = CRISPR gRNA sequence
  source 1..20: mol_type = other DNA
acatcatgagccaggtttca

SEQ ID NO: 55459 - DNA, 20 bp, synthetic construct
  misc_feature 1..20: note = CRISPR gRNA sequence
  source 1..20: mol_type = other DNA
gccaggtttcacagactttt

SEQ ID NO: 55460 - DNA, 20 bp, synthetic construct
  misc_feature 1..20: note = CRISPR gRNA sequence
  source 1..20: mol_type = other DNA
gtttcacagactttttggat

SEQ ID NO: 55461 - DNA, 20 bp, synthetic construct
  misc_feature 1..20: note = CRISPR gRNA sequence
  source 1..20: mol_type = other DNA
gctaaccatttttttttttt

SEQ ID NO: 55462 - DNA, 20 bp, synthetic construct
  misc_feature 1..20: note = CRISPR gRNA sequence
  source 1..20: mol_type = other DNA
taaccattttttttttttta

SEQ ID NO: 55463 - DNA, 20 bp, synthetic construct
  misc_feature 1..20: note = CRISPR gRNA sequence
  source 1..20: mol_type = other DNA
catttttttttttttagaga

SEQ ID NO: 55464 - DNA, 20 bp, synthetic construct
  misc_feature 1..20: note = CRISPR gRNA sequence
  source 1..20: mol_type = other DNA
atttttttttttttagagac

SEQ ID NO: 55465 - DNA, 20 bp, synthetic construct
  misc_feature 1..20: note = CRISPR gRNA sequence
  source 1..20: mol_type = other DNA
tttttttttttttagagaca

SEQ ID NO: 55466 - DNA, 20 bp, synthetic construct
  misc_feature 1..20: note = CRISPR gRNA sequence
  source 1..20: mol_type = other DNA
tttagagacagggtcccact

SEQ ID NO: 55467 - DNA, 20 bp, synthetic construct
  misc_feature 1..20: note = CRISPR gRNA sequence
  source 1..20: mol_type = other DNA
cagggtcccactcagtcccc

SEQ ID NO: 55468 - DNA, 20 bp, synthetic construct
  misc_feature 1..20: note = CRISPR gRNA sequence
  source 1..20: mol_type = other DNA
gtcccactcagtccccaagc

SEQ ID NO: 55469 - DNA, 20 bp, synthetic construct
  misc_feature 1..20: note = CRISPR gRNA sequence
  source 1..20: mol_type = other DNA
cccactcagtccccaagctg

SEQ ID NO: 55470 - DNA, 20 bp, synthetic construct
  misc_feature 1..20: note = CRISPR gRNA sequence
  source 1..20: mol_type = other DNA
tcagtccccaagctggagtg

SEQ ID NO: 55471 - DNA, 20 bp, synthetic construct
  misc_feature 1..20: note = CRISPR gRNA sequence
  source 1..20: mol_type = other DNA
gtccccaagctggagtgcag

SEQ ID NO: 55472 - DNA, 20 bp, synthetic construct
  misc_feature 1..20: note = CRISPR gRNA sequence
  source 1..20: mol_type = other DNA
ggagtgcagtggctctatcc

SEQ ID NO: 55473 - DNA, 20 bp, synthetic construct
  misc_feature 1..20: note = CRISPR gRNA sequence
  source 1..20: mol_type = other DNA
ggctctatcccagttcactg

SEQ ID NO: 55474 - DNA, 20 bp, synthetic construct
  misc_feature 1..20: note = CRISPR gRNA sequence
  source 1..20: mol_type = other DNA
tcactgcagcctcaaactcc

SEQ ID NO: 55475 - DNA, 20 bp, synthetic construct
  misc_feature 1..20: note = CRISPR gRNA sequence
  source 1..20: mol_type = other DNA
cactgcagcctcaaactcct

SEQ ID NO: 55476 - DNA, 20 bp, synthetic construct
  misc_feature 1..20: note = CRISPR gRNA sequence
  source 1..20: mol_type = other DNA
agcctcaaactcctgggctc

SEQ ID NO: 55477 - DNA, 20 bp, synthetic construct
  misc_feature 1..20: note = CRISPR gRNA sequence
  source 1..20: mol_type = other DNA
ctcaagtgatcctcccacct

SEQ ID NO: 55478 - DNA, 20 bp, synthetic construct
  misc_feature 1..20: note = CRISPR gRNA sequence
  source 1..20: mol_type = other DNA
tcctcccaccttggcttcct

SEQ ID NO: 55479 - DNA, 20 bp, synthetic construct
  misc_feature 1..20: note = CRISPR gRNA sequence
  source 1..20: mol_type = other DNA
accttggcttcctgagtaac

SEQ ID NO: 55480 - DNA, 20 bp, synthetic construct
  misc_feature 1..20: note = CRISPR gRNA sequence
  source 1..20: mol_type = other DNA
ttcctgagtaactggtacta

SEQ ID NO: 55481 - DNA, 20 bp, synthetic construct
  misc_feature 1..20: note = CRISPR gRNA sequence
  source 1..20: mol_type = other DNA
tcctgagtaactggtactat

SEQ ID NO: 55482 - DNA, 20 bp, synthetic construct
  misc_feature 1..20: note = CRISPR gRNA sequence
  source 1..20: mol_type = other DNA
ctgagtaactggtactatag

SEQ ID NO: 55483 - DNA, 20 bp, synthetic construct
  misc_feature 1..20: note = CRISPR gRNA sequence
  source 1..20: mol_type = other DNA
taggagtgaatcaccatgcc

SEQ ID NO: 55484 - DNA, 20 bp, synthetic construct
  misc_feature 1..20: note = CRISPR gRNA sequence
  source 1..20: mol_type = other DNA
ctattttttttttttttttg

SEQ ID NO: 55485 - DNA, 20 bp, synthetic construct
  misc_feature 1..20: note = CRISPR gRNA sequence
  source 1..20: mol_type = other DNA
attttttttttttttttgta

SEQ ID NO: 55486 - DNA, 20 bp, synthetic construct
  misc_feature 1..20: note = CRISPR gRNA sequence
  source 1..20: mol_type = other DNA
tttttttttttttgtagaga

SEQ ID NO: 55487 - DNA, 20 bp, synthetic construct
  misc_feature 1..20: note = CRISPR gRNA sequence
  source 1..20: mol_type = other DNA
ttttttttttttgtagagat

SEQ ID NO: 55488 - DNA, 20 bp, synthetic construct
  misc_feature 1..20: note = CRISPR gRNA sequence
  source 1..20: mol_type = other DNA
tttttttttttgtagagatg

SEQ ID NO: 55489 - DNA, 20 bp, synthetic construct
  misc_feature 1..20: note = CRISPR gRNA sequence
  source 1..20: mol_type = other DNA
ttttttttttgtagagatgg

SEQ ID NO: 55490 - DNA, 20 bp, synthetic construct
  misc_feature 1..20: note = CRISPR gRNA sequence
  source 1..20: mol_type = other DNA
gggggtctcactttgttgcc

SEQ ID NO: 55491 - DNA, 20 bp, synthetic construct
  misc_feature 1..20: note = CRISPR gRNA sequence
  source 1..20: mol_type = other DNA
ggggtctcactttgttgccc

SEQ ID NO: 55492 - DNA, 20 bp, synthetic construct
  misc_feature 1..20: note = CRISPR gRNA sequence
  source 1..20: mol_type = other DNA
tctcactttgttgcccaggc

SEQ ID NO: 55493 - DNA, 20 bp, synthetic construct
  misc_feature 1..20: note = CRISPR gRNA sequence
  source 1..20: mol_type = other DNA
ccaggctggtcttgaactcc

SEQ ID NO: 55494 - DNA, 20 bp, synthetic construct
  misc_feature 1..20: note = CRISPR gRNA sequence
  source 1..20: mol_type = other DNA
ggtcttgaactcctagcttc

SEQ ID NO: 55495 - DNA, 20 bp, synthetic construct
  misc_feature 1..20: note = CRISPR gRNA sequence
  source 1..20: mol_type = other DNA
ttcaagcgatcctgccccct

SEQ ID NO: 55496 - DNA, 20 bp, synthetic construct
  misc_feature 1..20: note = CRISPR gRNA sequence
  source 1..20: mol_type = other DNA
cctgccccctcagcctctca

SEQ ID NO: 55497 - DNA, 20 bp, synthetic construct
  misc_feature 1..20: note = CRISPR gRNA sequence
  source 1..20: mol_type = other DNA
ccctcagcctctcaaagtgc

SEQ ID NO: 55498 - DNA, 20 bp, synthetic construct
  misc_feature 1..20: note = CRISPR gRNA sequence
  source 1..20: mol_type = other DNA
cctcagcctctcaaagtgct

SEQ ID NO: 55499 - DNA, 20 bp, synthetic construct
  misc_feature 1..20: note = CRISPR gRNA sequence
  source 1..20: mol_type = other DNA
ctcagcctctcaaagtgctg

SEQ ID NO: 55500 - DNA, 20 bp, synthetic construct
  misc_feature 1..20: note = CRISPR gRNA sequence
  source 1..20: mol_type = other DNA
ctctcaaagtgctggggtta

SEQ ID NO: 55501 - DNA, 20 bp, synthetic construct
  misc_feature 1..20: note = CRISPR gRNA sequence
  source 1..20: mol_type = other DNA
agtgctggggttacagacat

SEQ ID NO: 55502 - DNA, 20 bp, synthetic construct
  misc_feature 1..20: note = CRISPR gRNA sequence
  source 1..20: mol_type = other DNA
acagacatgagccaccatgc

SEQ ID NO: 55503 - DNA, 20 bp, synthetic construct
  misc_feature 1..20: note = CRISPR gRNA sequence
  source 1..20: mol_type = other DNA
caccatgccagcctgtttaa

SEQ ID NO: 55504 - DNA, 20 bp, synthetic construct
  misc_feature 1..20: note = CRISPR gRNA sequence
  source 1..20: mol_type = other DNA
aatagaactttctgcaatga

SEQ ID NO: 55505 - DNA, 20 bp, synthetic construct
  misc_feature 1..20: note = CRISPR gRNA sequence
  source 1..20: mol_type = other DNA
ctgcaatgatggaaatgtcc

SEQ ID NO: 55506 - DNA, 20 bp, synthetic construct
  misc_feature 1..20: note = CRISPR gRNA sequence
  source 1..20: mol_type = other DNA
ggcatctgtaccacttgcta

SEQ ID NO: 55507 - DNA, 20 bp, synthetic construct
  misc_feature 1..20: note = CRISPR gRNA sequence
  source 1..20: mol_type = other DNA
gcatctgtaccacttgctat

SEQ ID NO: 55508 - DNA, 20 bp, synthetic construct
  misc_feature 1..20: note = CRISPR gRNA sequence
  source 1..20: mol_type = other DNA
atctgtaccacttgctatgg

SEQ ID NO: 55509 - DNA, 20 bp, synthetic construct
  misc_feature 1..20: note = CRISPR gRNA sequence
  source 1..20: mol_type = other DNA
ccacttgctatgggagccac

SEQ ID NO: 55510 - DNA, 20 bp, synthetic construct
  misc_feature 1..20: note = CRISPR gRNA sequence
  source 1..20: mol_type = other DNA
tgggagccactagccaccta

SEQ ID NO: 55511 - DNA, 20 bp, synthetic construct
  misc_feature 1..20: note = CRISPR gRNA sequence
  source 1..20: mol_type = other DNA
actagccacctatggccact

SEQ ID NO: 55512 - DNA, 20 bp, synthetic construct
  misc_feature 1..20: note = CRISPR gRNA sequence
  source 1..20: mol_type = other DNA
agccacctatggccactgag

SEQ ID NO: 55513 - DNA, 20 bp, synthetic construct
  misc_feature 1..20: note = CRISPR gRNA sequence
  source 1..20: mol_type = other DNA
gccactgagcagttgaaata

SEQ ID NO: 55514 - DNA, 20 bp, synthetic construct
  misc_feature 1..20: note = CRISPR gRNA sequence
  source 1..20: mol_type = other DNA
ttaatttatttaaattaaaa

SEQ ID NO: 55515 - DNA, 20 bp, synthetic construct
  misc_feature 1..20: note = CRISPR gRNA sequence
  source 1..20: mol_type = other DNA
ttaatttatttaaattgaaa

SEQ ID NO: 55516 - DNA, 20 bp, synthetic construct
  misc_feature 1..20: note = CRISPR gRNA sequence
  source 1..20: mol_type = other DNA
ttaatttatttaaattgaaa

SEQ ID NO: 55517 - DNA, 20 bp, synthetic construct
  misc_feature 1..20: note = CRISPR gRNA sequence
  source 1..20: mol_type = other DNA
tttaaattgaaatagccata

SEQ ID NO: 55518 - DNA, 20 bp, synthetic construct
  misc_feature 1..20: note = CRISPR gRNA sequence
  source 1..20: mol_type = other DNA
ttaaattgaaatagccatat

SEQ ID NO: 55519 - DNA, 20 bp, synthetic construct
  misc_feature 1..20: note = CRISPR gRNA sequence
  source 1..20: mol_type = other DNA
taaattgaaatagccatatg

SEQ ID NO: 55520 - DNA, 20 bp, synthetic construct
  misc_feature 1..20: note = CRISPR gRNA sequence
  source 1..20: mol_type = other DNA
ttgaaatagccatatggggc

SEQ ID NO: 55521 - DNA, 20 bp, synthetic construct
  misc_feature 1..20: note = CRISPR gRNA sequence
  source 1..20: mol_type = other DNA
aaatagccatatggggctag

SEQ ID NO: 55522 - DNA, 20 bp, synthetic construct
  misc_feature 1..20: note = CRISPR gRNA sequence
  source 1..20: mol_type = other DNA
gggctagtggctatcctact

SEQ ID NO: 55523 - DNA, 20 bp, synthetic construct
  misc_feature 1..20: note = CRISPR gRNA sequence
  source 1..20: mol_type = other DNA
ggctatcctactgagcatca

SEQ ID NO: 55524 - DNA, 20 bp, synthetic construct
  misc_feature 1..20: note = CRISPR gRNA sequence
  source 1..20: mol_type = other DNA
ctactgagcatcacagcttt

SEQ ID NO: 55525 - DNA, 20 bp, synthetic construct
  misc_feature 1..20: note = CRISPR gRNA sequence
  source 1..20: mol_type = other DNA
ctgagcatcacagctttaag

SEQ ID NO: 55526 - DNA, 20 bp, synthetic construct
  misc_feature 1..20: note = CRISPR gRNA sequence
  source 1..20: mol_type = other DNA
gcatcacagctttaagcagt

SEQ ID NO: 55527 - DNA, 20 bp, synthetic construct
  misc_feature 1..20: note = CRISPR gRNA sequence
  source 1..20: mol_type = other DNA
atcacagctttaagcagtta

SEQ ID NO: 55528 - DNA, 20 bp, synthetic construct
  misc_feature 1..20: note = CRISPR gRNA sequence
  source 1..20: mol_type = other DNA
tcacagctttaagcagttag

SEQ ID NO: 55529 - DNA, 20 bp, synthetic construct
  misc_feature 1..20: note = CRISPR gRNA sequence
  source 1..20: mol_type = other DNA
cacagctttaagcagttaga

SEQ ID NO: 55530 - DNA, 20 bp, synthetic construct
  misc_feature 1..20: note = CRISPR gRNA sequence
  source 1..20: mol_type = other DNA
ctttaagcagttagagggaa

SEQ ID NO: 55531 - DNA, 20 bp, synthetic construct
  misc_feature 1..20: note = CRISPR gRNA sequence
  source 1..20: mol_type = other DNA
aagcagttagagggaaaaga

SEQ ID NO: 55532 - DNA, 20 bp, synthetic construct
  misc_feature 1..20: note = CRISPR gRNA sequence
  source 1..20: mol_type = other DNA
gagggaaaagaaagtgacac

SEQ ID NO: 55533 - DNA, 20 bp, synthetic construct
  misc_feature 1..20: note = CRISPR gRNA sequence
  source 1..20: mol_type = other DNA
aaagaaagtgacactggtcc

SEQ ID NO: 55534 - DNA, 20 bp, synthetic construct
  misc_feature 1..20: note = CRISPR gRNA sequence
  source 1..20: mol_type = other DNA
gaaagtgacactggtcctag

SEQ ID NO: 55535 - DNA, 20 bp, synthetic construct
  misc_feature 1..20: note = CRISPR gRNA sequence
  source 1..20: mol_type = other DNA
aaagtgacactggtcctagt

SEQ ID NO: 55536 - DNA, 20 bp, synthetic construct
  misc_feature 1..20: note = CRISPR gRNA sequence
  source 1..20: mol_type = other DNA
gtcctagtgggtcatttttt

SEQ ID NO: 55537 - DNA, 20 bp, synthetic construct
  misc_feature 1..20: note = CRISPR gRNA sequence
  source 1..20: mol_type = other DNA
tagtgggtcattttttgaga

SEQ ID NO: 55538 - DNA, 20 bp, synthetic construct
  misc_feature 1..20: note = CRISPR gRNA sequence
  source 1..20: mol_type = other DNA
gtgggtcattttttgagaca

SEQ ID NO: 55539 - DNA, 20 bp, synthetic construct
  misc_feature 1..20: note = CRISPR gRNA sequence
  source 1..20: mol_type = other DNA
cagagtccctctctgtcacc

SEQ ID NO: 55540 - DNA, 20 bp, synthetic construct
  misc_feature 1..20: note = CRISPR gRNA sequence
  source 1..20: mol_type = other DNA
agagtccctctctgtcaccc

SEQ ID NO: 55541 - DNA, 20 bp, synthetic construct
  misc_feature 1..20: note = CRISPR gRNA sequence
  source 1..20: mol_type = other DNA
tccctctctgtcacccaggc

SEQ ID NO: 55542 - DNA, 20 bp, synthetic construct
  misc_feature 1..20: note = CRISPR gRNA sequence
  source 1..20: mol_type = other DNA
cctctctgtcacccaggctg

SEQ ID NO: 55543 - DNA, 20 bp, synthetic construct
  misc_feature 1..20: note = CRISPR gRNA sequence
  source 1..20: mol_type = other DNA
ctgtcacccaggctggagta

SEQ ID NO: 55544 - DNA, 20 bp, synthetic construct
  misc_feature 1..20: note = CRISPR gRNA sequence
  source 1..20: mol_type = other DNA
tcacccaggctggagtacag

SEQ ID NO: 55545 - DNA, 20 bp, synthetic construct
  misc_feature 1..20: note = CRISPR gRNA sequence
  source 1..20: mol_type = other DNA
ggagtacagtggtgtgatca

SEQ ID NO: 55546 - DNA, 20 bp, synthetic construct
  misc_feature 1..20: note = CRISPR gRNA sequence
  source 1..20: mol_type = other DNA
cagtggtgtgatcatggctc

SEQ ID NO: 55547 - DNA, 20 bp, synthetic construct
  misc_feature 1..20: note = CRISPR gRNA sequence
  source 1..20: mol_type = other DNA
gtgatcatggctcaagctcc

SEQ ID NO: 55548 - DNA, 20 bp, synthetic construct
  misc_feature 1..20: note = CRISPR gRNA sequence
  source 1..20: mol_type = other DNA
tgatcatggctcaagctccc

SEQ ID NO: 55549 - DNA, 20 bp, synthetic construct
  misc_feature 1..20: note = CRISPR gRNA sequence
  source 1..20: mol_type = other DNA
tggctcaagctcccaggctc

SEQ ID NO: 55550 - DNA, 20 bp, synthetic construct
  misc_feature 1..20: note = CRISPR gRNA sequence
  source 1..20: mol_type = other DNA
tcaagcgatcctcccaacgt

SEQ ID NO: 55551 - DNA, 20 bp, synthetic construct
  misc_feature 1..20: note = CRISPR gRNA sequence
  source 1..20: mol_type = other DNA
cctcccaacgtcagcatctt

SEQ ID NO: 55552 - DNA, 20 bp, synthetic construct
  misc_feature 1..20: note = CRISPR gRNA sequence
  source 1..20: mol_type = other DNA
cccaacgtcagcatcttgag

SEQ ID NO: 55553 - DNA, 20 bp, synthetic construct
  misc_feature 1..20: note = CRISPR gRNA sequence
  source 1..20: mol_type = other DNA
acgtcagcatcttgagtagc

SEQ ID NO: 55554 - DNA, 20 bp, synthetic construct
  misc_feature 1..20: note = CRISPR gRNA sequence
  source 1..20: mol_type = other DNA
cgtcagcatcttgagtagct

SEQ ID NO: 55555 - DNA, 20 bp, synthetic construct
  misc_feature 1..20: note = CRISPR gRNA sequence
  source 1..20: mol_type = other DNA
atcttgagtagctgggacta

SEQ ID NO: 55556 - DNA, 20 bp, synthetic construct
  misc_feature 1..20: note = CRISPR gRNA sequence
  source 1..20: mol_type = other DNA
tcttgagtagctgggactac

SEQ ID NO: 55557 - DNA, 20 bp, synthetic construct
  misc_feature 1..20: note = CRISPR gRNA sequence
  source 1..20: mol_type = other DNA
ccacgcctgccttttttttt

SEQ ID NO: 55558 - DNA, 20 bp, synthetic construct
  misc_feature 1..20: note = CRISPR gRNA sequence
  source 1..20: mol_type = other DNA
acgcctgcctttttttttta

SEQ ID NO: 55559 - DNA, 20 bp, synthetic construct
  misc_feature 1..20: note = CRISPR gRNA sequence
  source 1..20: mol_type = other DNA
ctgccttttttttttagaga

SEQ ID NO: 55560 - DNA, 20 bp, synthetic construct
  misc_feature 1..20: note = CRISPR gRNA sequence
  source 1..20: mol_type = other DNA
tgccttttttttttagagat

SEQ ID NO: 55561 - DNA, 20 bp, synthetic construct
  misc_feature 1..20: note = CRISPR gRNA sequence
  source 1..20: mol_type = other DNA
gccttttttttttagagatg

SEQ ID NO: 55562 - DNA, 20 bp, synthetic construct
  misc_feature 1..20: note = CRISPR gRNA sequence
  source 1..20: mol_type = other DNA
tggggtcttgctatgttgcc

SEQ ID NO: 55563 - DNA, 20 bp, synthetic construct
  misc_feature 1..20: note = CRISPR gRNA sequence
  source 1..20: mol_type = other DNA
ggggtcttgctatgttgccc

SEQ ID NO: 55564 - DNA, 20 bp, synthetic construct
  misc_feature 1..20: note = CRISPR gRNA sequence
  source 1..20: mol_type = other DNA
tcttgctatgttgcccaggc

SEQ ID NO: 55565 - DNA, 20 bp, synthetic construct
  misc_feature 1..20: note = CRISPR gRNA sequence
  source 1..20: mol_type = other DNA
ccaggctggtcttgaacacc

SEQ ID NO: 55566 - DNA, 20 bp, synthetic construct
  misc_feature 1..20: note = CRISPR gRNA sequence
  source 1..20: mol_type = other DNA
ggtcttgaacacctggaatc

SEQ ID NO: 55567 - DNA, 20 bp, synthetic construct
  misc_feature 1..20: note = CRISPR gRNA sequence
  source 1..20: mol_type = other DNA
tcttgaacacctggaatcaa

SEQ ID NO: 55568 - DNA, 20 bp, synthetic construct
  misc_feature 1..20: note = CRISPR gRNA sequence
  source 1..20: mol_type = other DNA
aatcaagagattctcgtgct

SEQ ID NO: 55569 - DNA, 20 bp, synthetic construct
  misc_feature 1..20: note = CRISPR gRNA sequence
  source 1..20: mol_type = other DNA
ttctcgtgcttggcgttcca

SEQ ID NO: 55570 - DNA, 20 bp, synthetic construct
  misc_feature 1..20: note = CRISPR gRNA sequence
  source 1..20: mol_type = other DNA
tgcttggcgttccaaagtgc

SEQ ID NO: 55571 - DNA, 20 bp, synthetic construct
  misc_feature 1..20: note = CRISPR gRNA sequence
  source 1..20: mol_type = other DNA
gcttggcgttccaaagtgct

SEQ ID NO: 55572 - DNA, 20 bp, synthetic construct
  misc_feature 1..20: note = CRISPR gRNA sequence
  source 1..20: mol_type = other DNA
gttccaaagtgctaggatta

SEQ ID NO: 55573 - DNA, 20 bp, synthetic construct
  misc_feature 1..20: note = CRISPR gRNA sequence
  source 1..20: mol_type = other DNA
ttccaaagtgctaggattac

SEQ ID NO: 55574 - DNA, 20 bp, synthetic construct
  misc_feature 1..20: note = CRISPR gRNA sequence
  source 1..20: mol_type = other DNA
agtgctaggattacaggcat

SEQ ID NO: 55575 - DNA, 20 bp, synthetic construct
  misc_feature 1..20: note = CRISPR gRNA sequence
  source 1..20: mol_type = other DNA
caggcatgagccaccgcacc

SEQ ID NO: 55576 - DNA, 20 bp, synthetic construct
  misc_feature 1..20: note = CRISPR gRNA sequence
  source 1..20: mol_type = other DNA
gccaccgcacccagcaacat

SEQ ID NO: 55577 - DNA, 20 bp, synthetic construct
  misc_feature 1..20: note = CRISPR gRNA sequence
  source 1..20: mol_type = other DNA
caacattggtcctacactac

SEQ ID NO: 55578 - DNA, 20 bp, synthetic construct
  misc_feature 1..20: note = CRISPR gRNA sequence
  source 1..20: mol_type = other DNA
aacattggtcctacactacc

SEQ ID NO: 55579 - DNA, 20 bp, synthetic construct
  misc_feature 1..20: note = CRISPR gRNA sequence
  source 1..20: mol_type = other DNA
acactaccaggtcattatac

SEQ ID NO: 55580 - DNA, 20 bp, synthetic construct
  misc_feature 1..20: note = CRISPR gRNA sequence
  source 1..20: mol_type = other DNA
taccaggtcattatacaagc

SEQ ID NO: 55581 - DNA, 20 bp, synthetic construct
  misc_feature 1..20: note = CRISPR gRNA sequence
  source 1..20: mol_type = other DNA
accaggtcattatacaagca

SEQ ID NO: 55582 - DNA, 20 bp, synthetic construct
  misc_feature 1..20: note = CRISPR gRNA sequence
  source 1..20: mol_type = other DNA
cattatacaagcaaggaatc

SEQ ID NO: 55583 - DNA, 20 bp, synthetic construct
  misc_feature 1..20: note = CRISPR gRNA sequence
  source 1..20: mol_type = other DNA
acaagcaaggaatcgagatc

SEQ ID NO: 55584 - DNA, 20 bp, synthetic construct
  misc_feature 1..20: note = CRISPR gRNA sequence
  source 1..20: mol_type = other DNA
aagcaaggaatcgagatcca

SEQ ID NO: 55585 - DNA, 20 bp, synthetic construct
  misc_feature 1..20: note = CRISPR gRNA sequence
  source 1..20: mol_type = other DNA
caaggaatcgagatccagag

SEQ ID NO: 55586 - DNA, 20 bp, synthetic construct
  misc_feature 1..20: note = CRISPR gRNA sequence
  source 1..20: mol_type = other DNA
aaggaatcgagatccagaga

SEQ ID NO: 55587 - DNA, 20 bp, synthetic construct
  misc_feature 1..20: note = CRISPR gRNA sequence
  source 1..20: mol_type = other DNA
aggaatcgagatccagagaa

SEQ ID NO: 55588 - DNA, 20 bp, synthetic construct
  misc_feature 1..20: note = CRISPR gRNA sequence
  source 1..20: mol_type = other DNA
atcgagatccagagaaggga

SEQ ID NO: 55589 - DNA, 20 bp, synthetic construct
  misc_feature 1..20: note = CRISPR gRNA sequence
  source 1..20: mol_type = other DNA
cgagatccagagaagggaaa

SEQ ID NO: 55590 - DNA, 20 bp, synthetic construct
  misc_feature 1..20: note = CRISPR gRNA sequence
  source 1..20: mol_type = other DNA
gagaagggaaagagattgct

SEQ ID NO: 55591 - DNA, 20 bp, synthetic construct
  misc_feature 1..20: note = CRISPR gRNA sequence
  source 1..20: mol_type = other DNA
agaagggaaagagattgctc

SEQ ID NO: 55592 - DNA, 20 bp, synthetic construct
  misc_feature 1..20: note = CRISPR gRNA sequence
  source 1..20: mol_type = other DNA
gaagggaaagagattgctca

SEQ ID NO: 55593 - DNA, 20 bp, synthetic construct
  misc_feature 1..20: note = CRISPR gRNA sequence
  source 1..20: mol_type = other DNA
aagggaaagagattgctcag

SEQ ID NO: 55594 - DNA, 20 bp, synthetic construct
  misc_feature 1..20: note = CRISPR gRNA sequence
  source 1..20: mol_type = other DNA
gcatacatacatctgtctct

SEQ ID NO: 55595 - DNA, 20 bp, synthetic construct
  misc_feature 1..20: note = CRISPR gRNA sequence
  source 1..20: mol_type = other DNA
atacatctgtctctgagtct

SEQ ID NO: 55596 - DNA, 20 bp, synthetic construct
  misc_feature 1..20: note = CRISPR gRNA sequence
  source 1..20: mol_type = other DNA
atctgtctctgagtcttagc

SEQ ID NO: 55597 - DNA, 20 bp, synthetic construct
  misc_feature 1..20: note = CRISPR gRNA sequence
  source 1..20: mol_type = other DNA
tctgtctctgagtcttagcc

SEQ ID NO: 55598 - DNA, 20 bp, synthetic construct
  misc_feature 1..20: note = CRISPR gRNA sequence
  source 1..20: mol_type = other DNA
tgtctctgagtcttagccag

SEQ ID NO: 55599 - DNA, 20 bp, synthetic construct
  misc_feature 1..20: note = CRISPR gRNA sequence
  source 1..20: mol_type = other DNA
tctctgagtcttagccagga

SEQ ID NO: 55600 - DNA, 20 bp, synthetic construct
  misc_feature 1..20: note = CRISPR gRNA sequence
  source 1..20: mol_type = other DNA
gagtcttagccaggagagca

SEQ ID NO: 55601 - DNA, 20 bp, synthetic construct
  misc_feature 1..20: note = CRISPR gRNA sequence
  source 1..20: mol_type = other DNA
ttagccaggagagcaaagtg

SEQ ID NO: 55602 - DNA, 20 bp, synthetic construct
  misc_feature 1..20: note = CRISPR gRNA sequence
  source 1..20: mol_type = other DNA
gccaggagagcaaagtgtgg

SEQ ID NO: 55603 - DNA, 20 bp, synthetic construct
  misc_feature 1..20: note = CRISPR gRNA sequence
  source 1..20: mol_type = other DNA
caggagagcaaagtgtggta

SEQ ID NO: 55604 - DNA, 20 bp, synthetic construct
  misc_feature 1..20: note = CRISPR gRNA sequence
  source 1..20: mol_type = other DNA
gagcaaagtgtggtagagca

SEQ ID NO: 55605 - DNA, 20 bp, synthetic construct
  misc_feature 1..20: note = CRISPR gRNA sequence
  source 1..20: mol_type = other DNA
aaagtgtggtagagcacagt

SEQ ID NO: 55606 - DNA, 20 bp, synthetic construct
  misc_feature 1..20: note = CRISPR gRNA sequence
  source 1..20: mol_type = other DNA
aagtgtggtagagcacagtt

SEQ ID NO: 55607 - DNA, 20 bp, synthetic construct
  misc_feature 1..20: note = CRISPR gRNA sequence
  source 1..20: mol_type = other DNA
gtggtagagcacagttggga

SEQ ID NO: 55608 - DNA, 20 bp, synthetic construct
  misc_feature 1..20: note = CRISPR gRNA sequence
  source 1..20: mol_type = other DNA
gcacagttgggatggtcttt

SEQ ID NO: 55609 - DNA, 20 bp, synthetic construct
  misc_feature 1..20: note = CRISPR gRNA sequence
  source 1..20: mol_type = other DNA
cacagttgggatggtctttt

SEQ ID NO: 55610 - DNA, 20 bp, synthetic construct
  misc_feature 1..20: note = CRISPR gRNA sequence
  source 1..20: mol_type = other DNA
acagttgggatggtctttta

SEQ ID NO: 55611 - DNA, 20 bp, synthetic construct
  misc_feature 1..20: note = CRISPR gRNA sequence
  source 1..20: mol_type = other DNA
tgggatggtcttttagggaa

SEQ ID NO: 55612 - DNA, 20 bp, synthetic construct
  misc_feature 1..20: note = CRISPR gRNA sequence
  source 1..20: mol_type = other DNA
gatggtcttttagggaaaag

SEQ ID NO: 55613 - DNA, 20 bp, synthetic construct
  misc_feature 1..20: note = CRISPR gRNA sequence
  source 1..20: mol_type = other DNA
gaaaagcagctcccttttct

SEQ ID NO: 55614 - DNA, 20 bp, synthetic construct
  misc_feature 1..20: note = CRISPR gRNA sequence
  source 1..20: mol_type = other DNA
tcccttttctcagcccatcc

SEQ ID NO: 55615 - DNA, 20 bp, synthetic construct
  misc_feature 1..20: note = CRISPR gRNA sequence
  source 1..20: mol_type = other DNA
tttctcagcccatccaagac

SEQ ID NO: 55616 - DNA, 20 bp, synthetic construct
  misc_feature 1..20: note = CRISPR gRNA sequence
  source 1..20: mol_type = other DNA
cagcccatccaagactggcc

SEQ ID NO: 55617 - DNA, 20 bp, synthetic construct
  misc_feature 1..20: note = CRISPR gRNA sequence
  source 1..20: mol_type = other DNA
ccatccaagactggccaagc

SEQ ID NO: 55618 - DNA, 20 bp, synthetic construct
  misc_feature 1..20: note = CRISPR gRNA sequence
  source 1..20: mol_type = other DNA
gccaagctggaatccatgca

SEQ ID NO: 55619 - DNA, 20 bp, synthetic construct
  misc_feature 1..20: note = CRISPR gRNA sequence
  source 1..20: mol_type = other DNA
agctggaatccatgcacagc

SEQ ID NO: 55620 - DNA, 20 bp, synthetic construct
  misc_feature 1..20: note = CRISPR gRNA sequence
  source 1..20: mol_type = other DNA
gaatccatgcacagctggaa

SEQ ID NO: 55621 - DNA, 20 bp, synthetic construct
  misc_feature 1..20: note = CRISPR gRNA sequence
  source 1..20: mol_type = other DNA
ccatgcacagctggaatagc

SEQ ID NO: 55622 - DNA, 20 bp, synthetic construct
  misc_feature 1..20: note = CRISPR gRNA sequence
  source 1..20: mol_type = other DNA
gactgcccactgcatgccaa

SEQ ID NO: 55623 - DNA, 20 bp, synthetic construct
  misc_feature 1..20: note = CRISPR gRNA sequence
  source 1..20: mol_type = other DNA
aacagtgctctaaactcctt

SEQ ID NO: 55624 - DNA, 20 bp, synthetic construct
  misc_feature 1..20: note = CRISPR gRNA sequence
  source 1..20: mol_type = other DNA
tgctctaaactccttaagtg

SEQ ID NO: 55625 - DNA, 20 bp, synthetic construct
  misc_feature 1..20: note = CRISPR gRNA sequence
  source 1..20: mol_type = other DNA
gtagtaactcatttaattct

SEQ ID NO: 55626 - DNA, 20 bp, synthetic construct
  misc_feature 1..20: note = CRISPR gRNA sequence
  source 1..20: mol_type = other DNA
ttaattctcagaacaaccct

SEQ ID NO: 55627 - DNA, 20 bp, synthetic construct
  misc_feature 1..20: note = CRISPR gRNA sequence
  source 1..20: mol_type = other DNA
ctcagaacaaccctaagatg

SEQ ID NO: 55628 - DNA, 20 bp, synthetic construct
  misc_feature 1..20: note = CRISPR gRNA sequence
  source 1..20: mol_type = other DNA
tcagaacaaccctaagatgt

SEQ ID NO: 55629 - DNA, 20 bp, synthetic construct
  misc_feature 1..20: note = CRISPR gRNA sequence
  source 1..20: mol_type = other DNA
ttgccctccctgtctttttt

SEQ ID NO: 55630 - DNA, 20 bp, synthetic construct
  misc_feature 1..20: note = CRISPR gRNA sequence
  source 1..20: mol_type = other DNA
ccctgtcttttttcagttgt

SEQ ID NO: 55631 - DNA, 20 bp, synthetic construct
  misc_feature 1..20: note = CRISPR gRNA sequence
  source 1..20: mol_type = other DNA
cctgtcttttttcagttgta

SEQ ID NO: 55632 - DNA, 20 bp, synthetic construct
  misc_feature 1..20: note = CRISPR gRNA sequence
  source 1..20: mol_type = other DNA
ctgtcttttttcagttgtaa

SEQ ID NO: 55633 - DNA, 20 bp, synthetic construct
  misc_feature 1..20: note = CRISPR gRNA sequence
  source 1..20: mol_type = other DNA
ttcagttgtaagggcttttc

SEQ ID NO: 55634 - DNA, 20 bp, synthetic construct
  misc_feature 1..20: note = CRISPR gRNA sequence
  source 1..20: mol_type = other DNA
cagttgtaagggcttttcca

SEQ ID NO: 55635 - DNA, 20 bp, synthetic construct
  misc_feature 1..20: note = CRISPR gRNA sequence
  source 1..20: mol_type = other DNA
tttccagagttttcaccatc

SEQ ID NO: 55636 - DNA, 20 bp, synthetic construct
  misc_feature 1..20: note = CRISPR gRNA sequence
  source 1..20: mol_type = other DNA
ttttcaccatctagtaatgc

SEQ ID NO: 55637 - DNA, 20 bp, synthetic construct
  misc_feature 1..20: note = CRISPR gRNA sequence
  source 1..20: mol_type = other DNA
atctagtaatgccagtctaa

SEQ ID NO: 55638 - DNA, 20 bp, synthetic construct
  misc_feature 1..20: note = CRISPR gRNA sequence
  source 1..20: mol_type = other DNA
agtatctttatgttctcccc

SEQ ID NO: 55639 - DNA, 20 bp, synthetic construct
  misc_feature 1..20: note = CRISPR gRNA sequence
  source 1..20: mol_type = other DNA
gtatctttatgttctcccca

SEQ ID NO: 55640 - DNA, 20 bp, synthetic construct
  misc_feature 1..20: note = CRISPR gRNA sequence
  source 1..20: mol_type = other DNA
tatctttatgttctccccaa

SEQ ID NO: 55641 - DNA, 20 bp, synthetic construct
  misc_feature 1..20: note = CRISPR gRNA sequence
  source 1..20: mol_type = other DNA
ccaagggtttgccttcctct

SEQ ID NO: 55642 - DNA, 20 bp, synthetic construct
  misc_feature 1..20: note = CRISPR gRNA sequence
  source 1..20: mol_type = other DNA
ttgccttcctctgagtcttc

SEQ ID NO: 55643 - DNA, 20 bp, synthetic construct
  misc_feature 1..20: note = CRISPR gRNA sequence
  source 1..20: mol_type = other DNA
tgccttcctctgagtcttct

SEQ ID NO: 55644 - DNA, 20 bp, synthetic construct
  misc_feature 1..20: note = CRISPR gRNA sequence
  source 1..20: mol_type = other DNA
gccttcctctgagtcttctg

SEQ ID NO: 55645 - DNA, 20 bp, synthetic construct
  misc_feature 1..20: note = CRISPR gRNA sequence
  source 1..20: mol_type = other DNA
tctggggatgcttccttcca

SEQ ID NO: 55646 - DNA, 20 bp, synthetic construct
  misc_feature 1..20: note = CRISPR gRNA sequence
  source 1..20: mol_type = other DNA
ctggggatgcttccttccac

SEQ ID NO: 55647 - DNA, 20 bp, synthetic construct
  misc_feature 1..20: note = CRISPR gRNA sequence
  source 1..20: mol_type = other DNA
tggggatgcttccttccaca

SEQ ID NO: 55648 - DNA, 20 bp, synthetic construct
  misc_feature 1..20: note = CRISPR gRNA sequence
  source 1..20: mol_type = other DNA
atgcttccttccacagggac

SEQ ID NO: 55649 - DNA, 20 bp, synthetic construct
  misc_feature 1..20: note = CRISPR gRNA sequence
  source 1..20: mol_type = other DNA
ccttccacagggaccagatg

SEQ ID NO: 55650 - DNA, 20 bp, synthetic construct
  misc_feature 1..20: note = CRISPR gRNA sequence
  source 1..20: mol_type = other DNA
cacagggaccagatgtggtc

SEQ ID NO: 55651 - DNA, 20 bp, synthetic construct
  misc_feature 1..20: note = CRISPR gRNA sequence
  source 1..20: mol_type = other DNA
cagatgtggtctggacacgc

SEQ ID NO: 55652 - DNA, 20 bp, synthetic construct
  misc_feature 1..20: note = CRISPR gRNA sequence
  source 1..20: mol_type = other DNA
gatgtggtctggacacgcta

SEQ ID NO: 55653 - DNA, 20 bp, synthetic construct
  misc_feature 1..20: note = CRISPR gRNA sequence
  source 1..20: mol_type = other DNA
atgtggtctggacacgctag

SEQ ID NO: 55654 - DNA, 20 bp, synthetic construct
  misc_feature 1..20: note = CRISPR gRNA sequence
  source 1..20: mol_type = other DNA
tggtctggacacgctagagg

SEQ ID NO: 55655 - DNA, 20 bp, synthetic construct
  misc_feature 1..20: note = CRISPR gRNA sequence
  source 1..20: mol_type = other DNA
ttaaaatcctttgccaacct

SEQ ID NO: 55656 - DNA, 20 bp, synthetic construct
  misc_feature 1..20: note = CRISPR gRNA sequence
  source 1..20: mol_type = other DNA
aaatcctttgccaacctaag

SEQ ID NO: 55657 - DNA, 20 bp, synthetic construct
  misc_feature 1..20: note = CRISPR gRNA sequence
  source 1..20: mol_type = other DNA
ctaagcagtaattcattcct

SEQ ID NO: 55658 - DNA, 20 bp, synthetic construct
  misc_feature 1..20: note = CRISPR gRNA sequence
  source 1..20: mol_type = other DNA
cagtaattcattcctcagtg

SEQ ID NO: 55659 - DNA, 20 bp, synthetic construct
  misc_feature 1..20: note = CRISPR gRNA sequence
  source 1..20: mol_type = other DNA
taattcattcctcagtgcag

SEQ ID NO: 55660 - DNA, 20 bp, synthetic construct
  misc_feature 1..20: note = CRISPR gRNA sequence
  source 1..20: mol_type = other DNA
ttcattcctcagtgcagcag

SEQ ID NO: 55661 - DNA, 20 bp, synthetic construct
  misc_feature 1..20: note = CRISPR gRNA sequence
  source 1..20: mol_type = other DNA
attcctcagtgcagcagtag

SEQ ID NO: 55662 - DNA, 20 bp, synthetic construct
  misc_feature 1..20: note = CRISPR gRNA sequence
  source 1..20: mol_type = other DNA
ttcctcagtgcagcagtagc

SEQ ID NO: 55663 - DNA, 20 bp, synthetic construct
  misc_feature 1..20: note = CRISPR gRNA sequence
  source 1..20: mol_type = other DNA
ctcagtgcagcagtagcagg

SEQ ID NO: 55664 - DNA, 20 bp, synthetic construct
  misc_feature 1..20: note = CRISPR gRNA sequence
  source 1..20: mol_type = other DNA
caggaagaattcccataccc

SEQ ID NO: 55665 - DNA, 20 bp, synthetic construct
  misc_feature 1..20: note = CRISPR gRNA sequence
  source 1..20: mol_type = other DNA
tcccataccccagctcttcc

SEQ ID NO: 55666 - DNA, 20 bp, synthetic construct
  misc_feature 1..20: note = CRISPR gRNA sequence
  source 1..20: mol_type = other DNA
cccagctcttcctagtctct

SEQ ID NO: 55667 - DNA, 20 bp, synthetic construct
  misc_feature 1..20: note = CRISPR gRNA sequence
  source 1..20: mol_type = other DNA
acctttcccctcaactgcct

SEQ ID NO: 55668 - DNA, 20 bp, synthetic construct
  misc_feature 1..20: note = CRISPR gRNA sequence
  source 1..20: mol_type = other DNA
cccctcaactgcctgagccc

SEQ ID NO: 55669 - DNA, 20 bp, synthetic construct
  misc_feature 1..20: note = CRISPR gRNA sequence
  source 1..20: mol_type = other DNA
cctgagcccaagttgcttct

SEQ ID NO: 55670 - DNA, 20 bp, synthetic construct
  misc_feature 1..20: note = CRISPR gRNA sequence
  source 1..20: mol_type = other DNA
ctgagcccaagttgcttcta

SEQ ID NO: 55671 - DNA, 20 bp, synthetic construct
  misc_feature 1..20: note = CRISPR gRNA sequence
  source 1..20: mol_type = other DNA
gcccaagttgcttctaagga

SEQ ID NO: 55672 - DNA, 20 bp, synthetic construct
  misc_feature 1..20: note = CRISPR gRNA sequence
  source 1..20: mol_type = other DNA
gttgcttctaaggatggccc

SEQ ID NO: 55673 - DNA, 20 bp, synthetic construct
  misc_feature 1..20: note = CRISPR gRNA sequence
  source 1..20: mol_type = other DNA
ttgcttctaaggatggcccc

SEQ ID NO: 55674 - DNA, 20 bp, synthetic construct
  misc_feature 1..20: note = CRISPR gRNA sequence
  source 1..20: mol_type = other DNA
gccccaggcccaccgcctct

SEQ ID NO: 55675 - DNA, 20 bp, synthetic construct
  misc_feature 1..20: note = CRISPR gRNA sequence
  source 1..20: mol_type = other DNA
ctcttggcttcttacctttg

SEQ ID NO: 55676 - DNA, 20 bp, synthetic construct
  misc_feature 1..20: note = CRISPR gRNA sequence
  source 1..20: mol_type = other DNA
ttcttacctttgtagctctg

SEQ ID NO: 55677 - DNA, 20 bp, synthetic construct
  misc_feature 1..20: note = CRISPR gRNA sequence
  source 1..20: mol_type = other DNA
tagctctgcagttgtctctg

SEQ ID NO: 55678 - DNA, 20 bp, synthetic construct
  misc_feature 1..20: note = CRISPR gRNA sequence
  source 1..20: mol_type = other DNA
agctctgcagttgtctctgt

SEQ ID NO: 55679 - DNA, 20 bp, synthetic construct
  misc_feature 1..20: note = CRISPR gRNA sequence
  source 1..20: mol_type = other DNA
tctgcagttgtctctgtggg

SEQ ID NO: 55680 - DNA, 20 bp, synthetic construct
  misc_feature 1..20: note = CRISPR gRNA sequence
  source 1..20: mol_type = other DNA
ctgcagttgtctctgtgggc

SEQ ID NO: 55681 - DNA, 20 bp, synthetic construct
  misc_feature 1..20: note = CRISPR gRNA sequence
  source 1..20: mol_type = other DNA
tgcagttgtctctgtgggcg

SEQ ID NO: 55682 - DNA, 20 bp, synthetic construct
  misc_feature 1..20: note = CRISPR gRNA sequence
  source 1..20: mol_type = other DNA
gttgtctctgtgggcgggga

SEQ ID NO: 55683 - DNA, 20 bp, synthetic construct
  misc_feature 1..20: note = CRISPR gRNA sequence
  source 1..20: mol_type = other DNA
gtctctgtgggcggggaaag

SEQ ID NO: 55684 - DNA, 20 bp, synthetic construct
  misc_feature 1..20: note = CRISPR gRNA sequence
  source 1..20: mol_type = other DNA
tctctgtgggcggggaaaga

SEQ ID NO: 55685 - DNA, 20 bp, synthetic construct
  misc_feature 1..20: note = CRISPR gRNA sequence
  source 1..20: mol_type = other DNA
ctgtgggcggggaaagaagg

SEQ ID NO: 55686 - DNA, 20 bp, synthetic construct
  misc_feature 1..20: note = CRISPR gRNA sequence
  source 1..20: mol_type = other DNA
ggcggggaaagaaggaagat

SEQ ID NO: 55687 - DNA, 20 bp, synthetic construct
  misc_feature 1..20: note = CRISPR gRNA sequence
  source 1..20: mol_type = other DNA
gcggggaaagaaggaagatg

SEQ ID NO: 55688 - DNA, 20 bp, synthetic construct
  misc_feature 1..20: note = CRISPR gRNA sequence
  source 1..20: mol_type = other DNA
agatgaggtccgcctccctg

SEQ ID NO: 55689 - DNA, 20 bp, synthetic construct
  misc_feature 1..20: note = CRISPR gRNA sequence
  source 1..20: mol_type = other DNA
gatgaggtccgcctccctgc

SEQ ID NO: 55690 - DNA, 20 bp, synthetic construct
  misc_feature 1..20: note = CRISPR gRNA sequence
  source 1..20: mol_type = other DNA
ggtccgcctccctgcaggat

SEQ ID NO: 55691 - DNA, 20 bp, synthetic construct
  misc_feature 1..20: note = CRISPR gRNA sequence
  source 1..20: mol_type = other DNA
tccctgcaggatcagatacc

SEQ ID NO: 55692 - DNA, 20 bp, synthetic construct
  misc_feature 1..20: note = CRISPR gRNA sequence
  source 1..20: mol_type = other DNA
agataccaagccatgaaacc

SEQ ID NO: 55693 - DNA, 20 bp, synthetic construct
  misc_feature 1..20: note = CRISPR gRNA sequence
  source 1..20: mol_type = other DNA
ataccaagccatgaaaccca

SEQ ID NO: 55694 - DNA, 20 bp, synthetic construct
  misc_feature 1..20: note = CRISPR gRNA sequence
  source 1..20: mol_type = other DNA
aagccatgaaacccagagac

SEQ ID NO: 55695 - DNA, 20 bp, synthetic construct
  misc_feature 1..20: note = CRISPR gRNA sequence
  source 1..20: mol_type = other DNA
gaaacccagagactggaaac

SEQ ID NO: 55696 - DNA, 20 bp, synthetic construct
  misc_feature 1..20: note = CRISPR gRNA sequence
  source 1..20: mol_type = other DNA
aaccagcacatcacccacca

SEQ ID NO: 55697 - DNA, 20 bp, synthetic construct
  misc_feature 1..20: note = CRISPR gRNA sequence
  source 1..20: mol_type = other DNA
accagcacatcacccaccac

SEQ ID NO: 55698 - DNA, 20 bp, synthetic construct
  misc_feature 1..20: note = CRISPR gRNA sequence
  source 1..20: mol_type = other DNA
gccccaaatgttcaaacatc

SEQ ID NO: 55699 - DNA, 20 bp, synthetic construct
  misc_feature 1..20: note = CRISPR gRNA sequence
  source 1..20: mol_type = other DNA
aatgttcaaacatccagata

SEQ ID NO: 55700 - DNA, 20 bp, synthetic construct
  misc_feature 1..20: note = CRISPR gRNA sequence
  source 1..20: mol_type = other DNA
aaagctgattttgcaattga

SEQ ID NO: 55701 - DNA, 20 bp, synthetic construct
  misc_feature 1..20: note = CRISPR gRNA sequence
  source 1..20: mol_type = other DNA
aagctgattttgcaattgac

SEQ ID NO: 55702 - DNA, 20 bp, synthetic construct
  misc_feature 1..20: note = CRISPR gRNA sequence
  source 1..20: mol_type = other DNA
agctgattttgcaattgaca

SEQ ID NO: 55703 - DNA, 20 bp, synthetic construct
  misc_feature 1..20: note = CRISPR gRNA sequence
  source 1..20: mol_type = other DNA
caattgacagggaaacataa

SEQ ID NO: 55704 - DNA, 20 bp, synthetic construct
  misc_feature 1..20: note = CRISPR gRNA sequence
  source 1..20: mol_type = other DNA
acagggaaacataacggaac

SEQ ID NO: 55705 - DNA, 20 bp, synthetic construct
  misc_feature 1..20: note = CRISPR gRNA sequence
  source 1..20: mol_type = other DNA
aaacataacggaactagcaa

SEQ ID NO: 55706 - DNA, 20 bp, synthetic construct
  misc_feature 1..20: note = CRISPR gRNA sequence
  source 1..20: mol_type = other DNA
ctagcaaaagtgttttaaat

SEQ ID NO: 55707 - DNA, 20 bp, synthetic construct
  misc_feature 1..20: note = CRISPR gRNA sequence
  source 1..20: mol_type = other DNA
tagcaaaagtgttttaaatc

SEQ ID NO: 55708 - DNA, 20 bp, synthetic construct
  misc_feature 1..20: note = CRISPR gRNA sequence
  source 1..20: mol_type = other DNA
ctttgcttgatgaatcctgc

SEQ ID NO: 55709 - DNA, 20 bp, synthetic construct
  misc_feature 1..20: note = CRISPR gRNA sequence
  source 1..20: mol_type = other DNA
ttgcttgatgaatcctgcaa

SEQ ID NO: 55710 - DNA, 20 bp, synthetic construct
  misc_feature 1..20: note = CRISPR gRNA sequence
  source 1..20: mol_type = other DNA
tcctgcaagagtgttttaaa

SEQ ID NO: 55711 - DNA, 20 bp, synthetic construct
  misc_feature 1..20: note = CRISPR gRNA sequence
  source 1..20: mol_type = other DNA
gcaagagtgttttaaaaagt

SEQ ID NO: 55712 - DNA, 20 bp, synthetic construct
  misc_feature 1..20: note = CRISPR gRNA sequence
  source 1..20: mol_type = other DNA
gtcagaaaaacaattttcac

SEQ ID NO: 55713 - DNA, 20 bp, synthetic construct
  misc_feature 1..20: note = CRISPR gRNA sequence
  source 1..20: mol_type = other DNA
caagaaatataataaaaatt

SEQ ID NO: 55714 - DNA, 20 bp, synthetic construct
  misc_feature 1..20: note = CRISPR gRNA sequence
  source 1..20: mol_type = other DNA
ataaaaattaagaatgttgt

SEQ ID NO: 55715 - DNA, 20 bp, synthetic construct
  misc_feature 1..20: note = CRISPR gRNA sequence
  source 1..20: mol_type = other DNA
tttcctttctttttaaattt

SEQ ID NO: 55716 - DNA, 20 bp, synthetic construct
  misc_feature 1..20: note = CRISPR gRNA sequence
  source 1..20: mol_type = other DNA
ctttctttttaaatttgaga

SEQ ID NO: 55717 - DNA, 20 bp, synthetic construct
  misc_feature 1..20: note = CRISPR gRNA sequence
  source 1..20: mol_type = other DNA
ttctttttaaatttgagatg

SEQ ID NO: 55718 - DNA, 20 bp, synthetic construct
  misc_feature 1..20: note = CRISPR gRNA sequence
  source 1..20: mol_type = other DNA
ggagatctcactctgctact

SEQ ID NO: 55719 - DNA, 20 bp, synthetic construct
  misc_feature 1..20: note = CRISPR gRNA sequence
  source 1..20: mol_type = other DNA
gagatctcactctgctactc

SEQ ID NO: 55720 - DNA, 20 bp, synthetic construct
  misc_feature 1..20: note = CRISPR gRNA sequence
  source 1..20: mol_type = other DNA
tctcactctgctactcaggc

SEQ ID NO: 55721 - DNA, 20 bp, synthetic construct
  misc_feature 1..20: note = CRISPR gRNA sequence
  source 1..20: mol_type = other DNA
tcactctgctactcaggctg

SEQ ID NO: 55722 - DNA, 20 bp, synthetic construct
  misc_feature 1..20: note = CRISPR gRNA sequence
  source 1..20: mol_type = other DNA
ctgctactcaggctggagtg

SEQ ID NO: 55723 - DNA, 20 bp, synthetic construct
  misc_feature 1..20: note = CRISPR gRNA sequence
  source 1..20: mol_type = other DNA
ctactcaggctggagtgcag

SEQ ID NO: 55724 - DNA, 20 bp, synthetic construct
  misc_feature 1..20: note = CRISPR gRNA sequence
  source 1..20: mol_type = other DNA
ggtgtgttcacacctcactg

SEQ ID NO: 55725 - DNA, 20 bp, synthetic construct
  misc_feature 1..20: note = CRISPR gRNA sequence
  source 1..20: mol_type = other DNA
cactgcagcctcaacctcca

SEQ ID NO: 55726 - DNA, 20 bp, synthetic construct
  misc_feature 1..20: note = CRISPR gRNA sequence
  source 1..20: mol_type = other DNA
agcctcaacctccacggctc

SEQ ID NO: 55727 - DNA, 20 bp, synthetic construct
  misc_feature 1..20: note = CRISPR gRNA sequence
  source 1..20: mol_type = other DNA
ctcaagcaatcttcccacct

SEQ ID NO: 55728 - DNA, 20 bp, synthetic construct
  misc_feature 1..20: note = CRISPR gRNA sequence
  source 1..20: mol_type = other DNA
tcccacctcagcctcccaaa

SEQ ID NO: 55729 - DNA, 20 bp, synthetic construct
  misc_feature 1..20: note = CRISPR gRNA sequence
  source 1..20: mol_type = other DNA
acctcagcctcccaaatagc

SEQ ID NO: 55730 - DNA, 20 bp, synthetic construct
  misc_feature 1..20: note = CRISPR gRNA sequence
  source 1..20: mol_type = other DNA
ctcccaaatagctggaacca

SEQ ID NO: 55731 - DNA, 20 bp, synthetic construct
  misc_feature 1..20: note = CRISPR gRNA sequence
  source 1..20: mol_type = other DNA
tcccaaatagctggaaccac

SEQ ID NO: 55732 - DNA, 20 bp, synthetic construct
  misc_feature 1..20: note = CRISPR gRNA sequence
  source 1..20: mol_type = other DNA
ttaattttgttcattttttg

SEQ ID NO: 55733 - DNA, 20 bp, synthetic construct
  misc_feature 1..20: note = CRISPR gRNA sequence
  source 1..20: mol_type = other DNA
aattttgttcattttttgta

SEQ ID NO: 55734 - DNA, 20 bp, synthetic construct
  misc_feature 1..20: note = CRISPR gRNA sequence
  source 1..20: mol_type = other DNA
tttgtagagactatgttgcc

SEQ ID NO: 55735 - DNA, 20 bp, synthetic construct
  misc_feature 1..20: note = CRISPR gRNA sequence
  source 1..20: mol_type = other DNA
ttgtagagactatgttgccc

SEQ ID NO: 55736 - DNA, 20 bp, synthetic construct
  misc_feature 1..20: note = CRISPR gRNA sequence
  source 1..20: mol_type = other DNA
agagactatgttgcccaggt

SEQ ID NO: 55737 - DNA, 20 bp, synthetic construct
  misc_feature 1..20: note = CRISPR gRNA sequence
  source 1..20: mol_type = other DNA
caggttggtctcgaactcct

SEQ ID NO: 55738 - DNA, 20 bp, synthetic construct
  misc_feature 1..20: note = CRISPR gRNA sequence
  source 1..20: mol_type = other DNA
ggtctcgaactcctgagctc

SEQ ID NO: 55739 - DNA, 20 bp, synthetic construct
  misc_feature 1..20: note = CRISPR gRNA sequence
  source 1..20: mol_type = other DNA
ctcaagtaatcctcttgcct

SEQ ID NO: 55740 - DNA, 20 bp, synthetic construct
  misc_feature 1..20: note = CRISPR gRNA sequence
  source 1..20: mol_type = other DNA
cctcttgccttggccttcca

SEQ ID NO: 55741 - DNA, 20 bp, synthetic construct
  misc_feature 1..20: note = CRISPR gRNA sequence
  source 1..20: mol_type = other DNA
gccttggccttccaaagtgt

SEQ ID NO: 55742 - DNA, 20 bp, synthetic construct
  misc_feature 1..20: note = CRISPR gRNA sequence
  source 1..20: mol_type = other DNA
cttccaaagtgttggaatta

SEQ ID NO: 55743 - DNA, 20 bp, synthetic construct
  misc_feature 1..20: note = CRISPR gRNA sequence
  source 1..20: mol_type = other DNA
ttccaaagtgttggaattac

SEQ ID NO: 55744 - DNA, 20 bp, synthetic construct
  misc_feature 1..20: note = CRISPR gRNA sequence
  source 1..20: mol_type = other DNA
agtgttggaattacaggcat

SEQ ID NO: 55745 - DNA, 20 bp, synthetic construct
  misc_feature 1..20: note = CRISPR gRNA sequence
  source 1..20: mol_type = other DNA
aattacaggcatgagccact

SEQ ID NO: 55746 - DNA, 20 bp, synthetic construct
  misc_feature 1..20: note = CRISPR gRNA sequence
  source 1..20: mol_type = other DNA
caggcatgagccactgagcc

SEQ ID NO: 55747 - DNA, 20 bp, synthetic construct
  misc_feature 1..20: note = CRISPR gRNA sequence
  source 1..20: mol_type = other DNA
cccggctgaattttttttaa

SEQ ID NO: 55748 - DNA, 20 bp, synthetic construct
  misc_feature 1..20: note = CRISPR gRNA sequence
  source 1..20: mol_type = other DNA
tttttaatagaaatttttat

SEQ ID NO: 55749 - DNA, 20 bp, synthetic construct
  misc_feature 1..20: note = CRISPR gRNA sequence
  source 1..20: mol_type = other DNA
taatagaaatttttatgagt

SEQ ID NO: 55750 - DNA, 20 bp, synthetic construct
  misc_feature 1..20: note = CRISPR gRNA sequence
  source 1..20: mol_type = other DNA
acctaccccatgatcaaaac

SEQ ID NO: 55751 - DNA, 20 bp, synthetic construct
  misc_feature 1..20: note = CRISPR gRNA sequence
  source 1..20: mol_type = other DNA
atgatcaaaactggctatat

SEQ ID NO: 55752 - DNA, 20 bp, synthetic construct
  misc_feature 1..20: note = CRISPR gRNA sequence
  source 1..20: mol_type = other DNA
caaaactggctatattggtt

SEQ ID NO: 55753 - DNA, 20 bp, synthetic construct
  misc_feature 1..20: note = CRISPR gRNA sequence
  source 1..20: mol_type = other DNA
gctatattggttcagcacca

SEQ ID NO: 55754 - DNA, 20 bp, synthetic construct
  misc_feature 1..20: note = CRISPR gRNA sequence
  source 1..20: mol_type = other DNA
tatattggttcagcaccatg

SEQ ID NO: 55755 - DNA, 20 bp, synthetic construct
  misc_feature 1..20: note = CRISPR gRNA sequence
  source 1..20: mol_type = other DNA
atattggttcagcaccatgg

SEQ ID NO: 55756 - DNA, 20 bp, synthetic construct
  misc_feature 1..20: note = CRISPR gRNA sequence
  source 1..20: mol_type = other DNA
tattggttcagcaccatgga

SEQ ID NO: 55757 - DNA, 20 bp, synthetic construct
  misc_feature 1..20: note = CRISPR gRNA sequence
  source 1..20: mol_type = other DNA
gcaccatggagggcaacaca

SEQ ID NO: 55758 - DNA, 20 bp, synthetic construct
  misc_feature 1..20: note = CRISPR gRNA sequence
  source 1..20: mol_type = other DNA
cacacagctaattattcctt

SEQ ID NO: 55759 - DNA, 20 bp, synthetic construct
  misc_feature 1..20: note = CRISPR gRNA sequence
  source 1..20: mol_type = other DNA
ttggctatgcctgtgcttcg

SEQ ID NO: 55760 - DNA, 20 bp, synthetic construct
  misc_feature 1..20: note = CRISPR gRNA sequence
  source 1..20: mol_type = other DNA
cacacacctatccatctttt

SEQ ID NO: 55761 - DNA, 20 bp, synthetic construct
  misc_feature 1..20: note = CRISPR gRNA sequence
  source 1..20: mol_type = other DNA
cacctatccatcttttcagc

SEQ ID NO: 55762 - DNA, 20 bp, synthetic construct
  misc_feature 1..20: note = CRISPR gRNA sequence
  source 1..20: mol_type = other DNA
catccacccatccatctttt

SEQ ID NO: 55763 - DNA, 20 bp, synthetic construct
  misc_feature 1..20: note = CRISPR gRNA sequence
  source 1..20: mol_type = other DNA
catccacccatccatctttt

SEQ ID NO: 55764 - DNA, 20 bp, synthetic construct
  misc_feature 1..20: note = CRISPR gRNA sequence
  source 1..20: mol_type = other DNA
catccacccatccatctttt

SEQ ID NO: 55765 - DNA, 20 bp, synthetic construct
  misc_feature 1..20: note = CRISPR gRNA sequence
  source 1..20: mol_type = other DNA
ccattaattcaatatatacc

SEQ ID NO: 55766 - DNA, 20 bp, synthetic construct
  misc_feature 1..20: note = CRISPR gRNA sequence
  source 1..20: mol_type = other DNA
attcaatatataccaagtac

SEQ ID NO: 55767 - DNA, 20 bp, synthetic construct
  misc_feature 1..20: note = CRISPR gRNA sequence
  source 1..20: mol_type = other DNA
ttcaatatataccaagtacc

SEQ ID NO: 55768 - DNA, 20 bp, synthetic construct
  misc_feature 1..20: note = CRISPR gRNA sequence
  source 1..20: mol_type = other DNA
tataccaagtaccaggtgcc

SEQ ID NO: 55769 - DNA, 20 bp, synthetic construct
  misc_feature 1..20: note = CRISPR gRNA sequence
  source 1..20: mol_type = other DNA
aagtaccaggtgccaagcct

SEQ ID NO: 55770 - DNA, 20 bp, synthetic construct
  misc_feature 1..20: note = CRISPR gRNA sequence
  source 1..20: mol_type = other DNA
accaggtgccaagcctgagc

SEQ ID NO: 55771 - DNA, 20 bp, synthetic construct
  misc_feature 1..20: note = CRISPR gRNA sequence
  source 1..20: mol_type = other DNA
ccaggtgccaagcctgagct

SEQ ID NO: 55772 - DNA, 20 bp, synthetic construct
  misc_feature 1..20: note = CRISPR gRNA sequence
  source 1..20: mol_type = other DNA
caagcctgagctaggttctg

SEQ ID NO: 55773 - DNA, 20 bp, synthetic construct
  misc_feature 1..20: note = CRISPR gRNA sequence
  source 1..20: mol_type = other DNA
aagcctgagctaggttctga

SEQ ID NO: 55774 - DNA, 20 bp, synthetic construct
  misc_feature 1..20: note = CRISPR gRNA sequence
  source 1..20: mol_type = other DNA
tgagctaggttctgaaggta

SEQ ID NO: 55775 - DNA, 20 bp, synthetic construct
  misc_feature 1..20: note = CRISPR gRNA sequence
  source 1..20: mol_type = other DNA
ggttctgaaggtaaagctgt

SEQ ID NO: 55776 - DNA, 20 bp, synthetic construct
  misc_feature 1..20: note = CRISPR gRNA sequence
  source 1..20: mol_type = other DNA
aggtaaagctgtgagtaaaa

SEQ ID NO: 55777 - DNA, 20 bp, synthetic construct
  misc_feature 1..20: note = CRISPR gRNA sequence
  source 1..20: mol_type = other DNA
taaagctgtgagtaaaacag

SEQ ID NO: 55778 - DNA, 20 bp, synthetic construct
  misc_feature 1..20: note = CRISPR gRNA sequence
  source 1..20: mol_type = other DNA
aaagctgtgagtaaaacagt

SEQ ID NO: 55779 - DNA, 20 bp, synthetic construct
  misc_feature 1..20: note = CRISPR gRNA sequence
  source 1..20: mol_type = other DNA
aagctgtgagtaaaacagta

SEQ ID NO: 55780 - DNA, 20 bp, synthetic construct
  misc_feature 1..20: note = CRISPR gRNA sequence
  source 1..20: mol_type = other DNA
gtaaaacagtagggtatgca

SEQ ID NO: 55781 - DNA, 20 bp, synthetic construct
  misc_feature 1..20: note = CRISPR gRNA sequence
  source 1..20: mol_type = other DNA
gtatgcacagatttatcctg

SEQ ID NO: 55782 - DNA, 20 bp, synthetic construct
  misc_feature 1..20: note = CRISPR gRNA sequence
  source 1..20: mol_type = other DNA
cacagatttatcctgcagac

SEQ ID NO: 55783 - DNA, 20 bp, synthetic construct
  misc_feature 1..20: note = CRISPR gRNA sequence
  source 1..20: mol_type = other DNA
acagatttatcctgcagacg

SEQ ID NO: 55784 - DNA, 20 bp, synthetic construct
  misc_feature 1..20: note = CRISPR gRNA sequence
  source 1..20: mol_type = other DNA
cagatttatcctgcagacga

SEQ ID NO: 55785 - DNA, 20 bp, synthetic construct
  misc_feature 1..20: note = CRISPR gRNA sequence
  source 1..20: mol_type = other DNA
agatttatcctgcagacgag

SEQ ID NO: 55786 - DNA, 20 bp, synthetic construct
  misc_feature 1..20: note = CRISPR gRNA sequence
  source 1..20: mol_type = other DNA
ctttcccctcctcttttctc

SEQ ID NO: 55787 - DNA, 20 bp, synthetic construct
  misc_feature 1..20: note = CRISPR gRNA sequence
  source 1..20: mol_type = other DNA
tttcccctcctcttttctca

SEQ ID NO: 55788 - DNA, 20 bp, synthetic construct
  misc_feature 1..20: note = CRISPR gRNA sequence
  source 1..20: mol_type = other DNA
cctcttttctcaaggcccat

SEQ ID NO: 55789 - DNA, 20 bp, synthetic construct
  misc_feature 1..20: note = CRISPR gRNA sequence
  source 1..20: mol_type = other DNA
ctcttttctcaaggcccata

SEQ ID NO: 55790 - DNA, 20 bp, synthetic construct
  misc_feature 1..20: note = CRISPR gRNA sequence
  source 1..20: mol_type = other DNA
ttctcaaggcccataaggcc

SEQ ID NO: 55791 - DNA, 20 bp, synthetic construct
  misc_feature 1..20: note = CRISPR gRNA sequence
  source 1..20: mol_type = other DNA
tccctttccttctgctcacc

SEQ ID NO: 55792 - DNA, 20 bp, synthetic construct
  misc_feature 1..20: note = CRISPR gRNA sequence
  source 1..20: mol_type = other DNA
ccttctgctcacctggcctg

SEQ ID NO: 55793 - DNA, 20 bp, synthetic construct
  misc_feature 1..20: note = CRISPR gRNA sequence
  source 1..20: mol_type = other DNA
cctggcctgaagcatcctga

SEQ ID NO: 55794 - DNA, 20 bp, synthetic construct
  misc_feature 1..20: note = CRISPR gRNA sequence
  source 1..20: mol_type = other DNA
ggcctgaagcatcctgacgg

SEQ ID NO: 55795 - DNA, 20 bp, synthetic construct
  misc_feature 1..20: note = CRISPR gRNA sequence
  source 1..20: mol_type = other DNA
gcctgaagcatcctgacggt

SEQ ID NO: 55796 - DNA, 20 bp, synthetic construct
  misc_feature 1..20: note = CRISPR gRNA sequence
  source 1..20: mol_type = other DNA
acgtgactgccacccttgcc

SEQ ID NO: 55797 - DNA, 20 bp, synthetic construct
  misc_feature 1..20: note = CRISPR gRNA sequence
  source 1..20: mol_type = other DNA
tgactgccacccttgccaag

SEQ ID NO: 55798 - DNA, 20 bp, synthetic construct
  misc_feature 1..20: note = CRISPR gRNA sequence
  source 1..20: mol_type = other DNA
actgccacccttgccaagca

SEQ ID NO: 55799 - DNA, 20 bp, synthetic construct
  misc_feature 1..20: note = CRISPR gRNA sequence
  source 1..20: mol_type = other DNA
gccacccttgccaagcagag

SEQ ID NO: 55800 - DNA, 20 bp, synthetic construct
  misc_feature 1..20: note = CRISPR gRNA sequence
  source 1..20: mol_type = other DNA
ccacccttgccaagcagagt

SEQ ID NO: 55801 - DNA, 20 bp, synthetic construct
  misc_feature 1..20: note = CRISPR gRNA sequence
  source 1..20: mol_type = other DNA
cacccttgccaagcagagta

SEQ ID NO: 55802 - DNA, 20 bp, synthetic construct
  misc_feature 1..20: note = CRISPR gRNA sequence
  source 1..20: mol_type = other DNA
agcagagtagggttgacacg

SEQ ID NO: 55803 - DNA, 20 bp, synthetic construct
  misc_feature 1..20: note = CRISPR gRNA sequence
  source 1..20: mol_type = other DNA
acgcagatgctgttgctgct

SEQ ID NO: 55804 - DNA, 20 bp, synthetic construct
  misc_feature 1..20: note = CRISPR gRNA sequence
  source 1..20: mol_type = other DNA
cgcagatgctgttgctgctc

SEQ ID NO: 55805 - DNA, 20 bp, synthetic construct
  misc_feature 1..20: note = CRISPR gRNA sequence
  source 1..20: mol_type = other DNA
gctgttgctgctcaggctgc

SEQ ID NO: 55806 - DNA, 20 bp, synthetic construct
  misc_feature 1..20: note = CRISPR gRNA sequence
  source 1..20: mol_type = other DNA
ctgctcaggctgcaagattg

SEQ ID NO: 55807 - DNA, 20 bp, synthetic construct
  misc_feature 1..20: note = CRISPR gRNA sequence
  source 1..20: mol_type = other DNA
caggctgcaagattgtggca

SEQ ID NO: 55808 - DNA, 20 bp, synthetic construct
  misc_feature 1..20: note = CRISPR gRNA sequence
  source 1..20: mol_type = other DNA
aggctgcaagattgtggcaa

SEQ ID NO: 55809 - DNA, 20 bp, synthetic construct
  misc_feature 1..20: note = CRISPR gRNA sequence
  source 1..20: mol_type = other DNA
caagattgtggcaaaggtgt

SEQ ID NO: 55810 - DNA, 20 bp, synthetic construct
  misc_feature 1..20: note = CRISPR gRNA sequence
  source 1..20: mol_type = other DNA
aagattgtggcaaaggtgtc

SEQ ID NO: 55811 - DNA, 20 bp, synthetic construct
  misc_feature 1..20: note = CRISPR gRNA sequence
  source 1..20: mol_type = other DNA
gattgtggcaaaggtgtcag

SEQ ID NO: 55812 - DNA, 20 bp, synthetic construct
  misc_feature 1..20: note = CRISPR gRNA sequence
  source 1..20: mol_type = other DNA
tgtggcaaaggtgtcaggag

SEQ ID NO: 55813 - DNA, 20 bp, synthetic construct
  misc_feature 1..20: note = CRISPR gRNA sequence
  source 1..20: mol_type = other DNA
aggagtggaatcccctaccc

SEQ ID NO: 55814 - DNA, 20 bp, synthetic construct
  misc_feature 1..20: note = CRISPR gRNA sequence
  source 1..20: mol_type = other DNA
ggagtggaatcccctacccc

SEQ ID NO: 55815 - DNA, 20 bp, synthetic construct
  misc_feature 1..20: note = CRISPR gRNA sequence
  source 1..20: mol_type = other DNA
gagtggaatcccctacccca

SEQ ID NO: 55816 - DNA, 20 bp, synthetic construct
  misc_feature 1..20: note = CRISPR gRNA sequence
  source 1..20: mol_type = other DNA
agtggaatcccctaccccag

SEQ ID NO: 55817 - DNA, 20 bp, synthetic construct
  misc_feature 1..20: note = CRISPR gRNA sequence
  source 1..20: mol_type = other DNA
atcccctaccccaggggccc

SEQ ID NO: 55818 - DNA, 20 bp, synthetic construct
  misc_feature 1..20: note = CRISPR gRNA sequence
  source 1..20: mol_type = other DNA
ccagaccttccttgccttgc

SEQ ID NO: 55819 - DNA, 20 bp, synthetic construct
  misc_feature 1..20: note = CRISPR gRNA sequence
  source 1..20: mol_type = other DNA
cagaccttccttgccttgca

SEQ ID NO: 55820 - DNA, 20 bp, synthetic construct
  misc_feature 1..20: note = CRISPR gRNA sequence
  source 1..20: mol_type = other DNA
agaccttccttgccttgcaa

SEQ ID NO: 55821 - DNA, 20 bp, synthetic construct
  misc_feature 1..20: note = CRISPR gRNA sequence
  source 1..20: mol_type = other DNA
accttccttgccttgcaagg

SEQ ID NO: 55822 - DNA, 20 bp, synthetic construct
  misc_feature 1..20: note = CRISPR gRNA sequence
  source 1..20: mol_type = other DNA
ttccttgccttgcaagggag

SEQ ID NO: 55823 - DNA, 20 bp, synthetic construct
  misc_feature 1..20: note = CRISPR gRNA sequence
  source 1..20: mol_type = other DNA
tccttgccttgcaagggagt

SEQ ID NO: 55824 - DNA, 20 bp, synthetic construct
  misc_feature 1..20: note = CRISPR gRNA sequence
  source 1..20: mol_type = other DNA
ccttgccttgcaagggagtg

SEQ ID NO: 55825 - DNA, 20 bp, synthetic construct
  misc_feature 1..20: note = CRISPR gRNA sequence
  source 1..20: mol_type = other DNA
tgcaagggagtggggtgaat

SEQ ID NO: 55826 - DNA, 20 bp, synthetic construct
  misc_feature 1..20: note = CRISPR gRNA sequence
  source 1..20: mol_type = other DNA
gcaagggagtggggtgaatc

SEQ ID NO: 55827 - DNA, 20 bp, synthetic construct
  misc_feature 1..20: note = CRISPR gRNA sequence
  source 1..20: mol_type = other DNA
ggagtggggtgaatcaggta

SEQ ID NO: 55828 - DNA, 20 bp, synthetic construct
  misc_feature 1..20: note = CRISPR gRNA sequence
  source 1..20: mol_type = other DNA
agtggggtgaatcaggtata

SEQ ID NO: 55829 - DNA, 20 bp, synthetic construct
  misc_feature 1..20: note = CRISPR gRNA sequence
  source 1..20: mol_type = other DNA
tggggtgaatcaggtataga

SEQ ID NO: 55830 - DNA, 20 bp, synthetic construct
  misc_feature 1..20: note = CRISPR gRNA sequence
  source 1..20: mol_type = other DNA
ggggtgaatcaggtatagag

SEQ ID NO: 55831 - DNA, 20 bp, synthetic construct
  misc_feature 1..20: note = CRISPR gRNA sequence
  source 1..20: mol_type = other DNA
gggtgaatcaggtatagaga

SEQ ID NO: 55832 - DNA, 20 bp, synthetic construct
  misc_feature 1..20: note = CRISPR gRNA sequence
  source 1..20: mol_type = other DNA
aatcaggtatagagagggac

SEQ ID NO: 55833 - DNA, 20 bp, synthetic construct
  misc_feature 1..20: note = CRISPR gRNA sequence
  source 1..20: mol_type = other DNA
atcaggtatagagagggact

SEQ ID NO: 55834 - DNA, 20 bp, synthetic construct
  misc_feature 1..20: note = CRISPR gRNA sequence
  source 1..20: mol_type = other DNA
tatagagagggactgggctg

SEQ ID NO: 55835 - DNA, 20 bp, synthetic construct
  misc_feature 1..20: note = CRISPR gRNA sequence
  source 1..20: mol_type = other DNA
tagagagggactgggctgca

SEQ ID NO: 55836 - DNA, 20 bp, synthetic construct
  misc_feature 1..20: note = CRISPR gRNA sequence
  source 1..20: mol_type = other DNA
agagagggactgggctgcag

SEQ ID NO: 55837 - DNA, 20 bp, synthetic construct
  misc_feature 1..20: note = CRISPR gRNA sequence
  source 1..20: mol_type = other DNA
gagggactgggctgcagagg

SEQ ID NO: 55838 - DNA, 20 bp, synthetic construct
  misc_feature 1..20: note = CRISPR gRNA sequence
  source 1..20: mol_type = other DNA
ggactgggctgcagaggcag

SEQ ID NO: 55839 - DNA, 20 bp, synthetic construct
  misc_feature 1..20: note = CRISPR gRNA sequence
  source 1..20: mol_type = other DNA
tgggctgcagaggcagtgga

SEQ ID NO: 55840 - DNA, 20 bp, synthetic construct
  misc_feature 1..20: note = CRISPR gRNA sequence
  source 1..20: mol_type = other DNA
agtggaaagatcacttactc

SEQ ID NO: 55841 - DNA, 20 bp, synthetic construct
  misc_feature 1..20: note = CRISPR gRNA sequence
  source 1..20: mol_type = other DNA
agatcacttactcaagcttc

SEQ ID NO: 55842 - DNA, 20 bp, synthetic construct
  misc_feature 1..20: note = CRISPR gRNA sequence
  source 1..20: mol_type = other DNA
atcacttactcaagcttccg

SEQ ID NO: 55843 - DNA, 20 bp, synthetic construct
  misc_feature 1..20: note = CRISPR gRNA sequence
  source 1..20: mol_type = other DNA
tactcaagcttccggagccg

SEQ ID NO: 55844 - DNA, 20 bp, synthetic construct
  misc_feature 1..20: note = CRISPR gRNA sequence
  source 1..20: mol_type = other DNA
tcaagcttccggagccgtgg

SEQ ID NO: 55845 - DNA, 20 bp, synthetic construct
  misc_feature 1..20: note = CRISPR gRNA sequence
  source 1..20: mol_type = other DNA
caagcttccggagccgtggt

SEQ ID NO: 55846 - DNA, 20 bp, synthetic construct
  misc_feature 1..20: note = CRISPR gRNA sequence
  source 1..20: mol_type = other DNA
cttccggagccgtggtaggt

SEQ ID NO: 55847 - DNA, 20 bp, synthetic construct
  misc_feature 1..20: note = CRISPR gRNA sequence
  source 1..20: mol_type = other DNA
ttccggagccgtggtaggtg

SEQ ID NO: 55848 - DNA, 20 bp, synthetic construct
  misc_feature 1..20: note = CRISPR gRNA sequence
  source 1..20: mol_type = other DNA
tccggagccgtggtaggtga

SEQ ID NO: 55849 - DNA, 20 bp, synthetic construct
  misc_feature 1..20: note = CRISPR gRNA sequence
  source 1..20: mol_type = other DNA
cggagccgtggtaggtgagg

SEQ ID NO: 55850 - DNA, 20 bp, synthetic construct
  misc_feature 1..20: note = CRISPR gRNA sequence
  source 1..20: mol_type = other DNA
gggagaacctccacaatgtt

SEQ ID NO: 55851 - DNA, 20 bp, synthetic construct
  misc_feature 1..20: note = CRISPR gRNA sequence
  source 1..20: mol_type = other DNA
ccacaatgttcagcaccacc

SEQ ID NO: 55852 - DNA, 20 bp, synthetic construct
  misc_feature 1..20: note = CRISPR gRNA sequence
  source 1..20: mol_type = other DNA
ttcagcaccacctggtcact

SEQ ID NO: 55853 - DNA, 20 bp, synthetic construct
  misc_feature 1..20: note = CRISPR gRNA sequence
  source 1..20: mol_type = other DNA
gcaccacctggtcactgagc

SEQ ID NO: 55854 - DNA, 20 bp, synthetic construct
  misc_feature 1..20: note = CRISPR gRNA sequence
  source 1..20: mol_type = other DNA
ctggttgtcccgaaaactgc

SEQ ID NO: 55855 - DNA, 20 bp, synthetic construct
  misc_feature 1..20: note = CRISPR gRNA sequence
  source 1..20: mol_type = other DNA
tggttgtcccgaaaactgcg

SEQ ID NO: 55856 - DNA, 20 bp, synthetic construct
  misc_feature 1..20: note = CRISPR gRNA sequence
  source 1..20: mol_type = other DNA
gttgtcccgaaaactgcgag

SEQ ID NO: 55857 - DNA, 20 bp, synthetic construct
  misc_feature 1..20: note = CRISPR gRNA sequence
  source 1..20: mol_type = other DNA
ccgaaaactgcgaggagacc

SEQ ID NO: 55858 - DNA, 20 bp, synthetic construct
  misc_feature 1..20: note = CRISPR gRNA sequence
  source 1..20: mol_type = other DNA
cgaaaactgcgaggagacca

SEQ ID NO: 55859 - DNA, 20 bp, synthetic construct
  misc_feature 1..20: note = CRISPR gRNA sequence
  source 1..20: mol_type = other DNA
actgcgaggagaccaaggcc

SEQ ID NO: 55860 - DNA, 20 bp, synthetic construct
  misc_feature 1..20: note = CRISPR gRNA sequence
  source 1..20: mol_type = other DNA
aaggcccagtccctttgccc

SEQ ID NO: 55861 - DNA, 20 bp, synthetic construct
  misc_feature 1..20: note = CRISPR gRNA sequence
  source 1..20: mol_type = other DNA
aggcccagtccctttgccct

SEQ ID NO: 55862 - DNA, 20 bp, synthetic construct
  misc_feature 1..20: note = CRISPR gRNA sequence
  source 1..20: mol_type = other DNA
ggcccagtccctttgccctg

SEQ ID NO: 55863 - DNA, 20 bp, synthetic construct
  misc_feature 1..20: note = CRISPR gRNA sequence
  source 1..20: mol_type = other DNA
cagtccctttgccctggggt

SEQ ID NO: 55864 - DNA, 20 bp, synthetic construct
  misc_feature 1..20: note = CRISPR gRNA sequence
  source 1..20: mol_type = other DNA
agtccctttgccctggggtt

SEQ ID NO: 55865 - DNA, 20 bp, synthetic construct
  misc_feature 1..20: note = CRISPR gRNA sequence
  source 1..20: mol_type = other DNA
gtccctttgccctggggttg

SEQ ID NO: 55866 - DNA, 20 bp, synthetic construct
  misc_feature 1..20: note = CRISPR gRNA sequence
  source 1..20: mol_type = other DNA
cctggggttggggcacttgc

SEQ ID NO: 55867 - DNA, 20 bp, synthetic construct
  misc_feature 1..20: note = CRISPR gRNA sequence
  source 1..20: mol_type = other DNA
gttggggcacttgcaagccc

SEQ ID NO: 55868 - DNA, 20 bp, synthetic construct
  misc_feature 1..20: note = CRISPR gRNA sequence
  source 1..20: mol_type = other DNA
gggcacttgcaagccccagt

SEQ ID NO: 55869 - DNA, 20 bp, synthetic construct
  misc_feature 1..20: note = CRISPR gRNA sequence
  source 1..20: mol_type = other DNA
acttgcaagccccagttagc

SEQ ID NO: 55870 - DNA, 20 bp, synthetic construct
  misc_feature 1..20: note = CRISPR gRNA sequence
  source 1..20: mol_type = other DNA
aagccccagttagcaagtga

SEQ ID NO: 55871 - DNA, 20 bp, synthetic construct
  misc_feature 1..20: note = CRISPR gRNA sequence
  source 1..20: mol_type = other DNA
agccccagttagcaagtgac

SEQ ID NO: 55872 - DNA, 20 bp, synthetic construct
  misc_feature 1..20: note = CRISPR gRNA sequence
  source 1..20: mol_type = other DNA
ccagttagcaagtgacagga

SEQ ID NO: 55873 - DNA, 20 bp, synthetic construct
  misc_feature 1..20: note = CRISPR gRNA sequence
  source 1..20: mol_type = other DNA
acaggatggccaccctcatg

SEQ ID NO: 55874 - DNA, 20 bp, synthetic construct
  misc_feature 1..20: note = CRISPR gRNA sequence
  source 1..20: mol_type = other DNA
caggatggccaccctcatgt

SEQ ID NO: 55875 - DNA, 20 bp, synthetic construct
  misc_feature 1..20: note = CRISPR gRNA sequence
  source 1..20: mol_type = other DNA
ggatggccaccctcatgtgg

SEQ ID NO: 55876 - DNA, 20 bp, synthetic construct
  misc_feature 1..20: note = CRISPR gRNA sequence
  source 1..20: mol_type = other DNA
caccctcatgtgggagacat

SEQ ID NO: 55877 - DNA, 20 bp, synthetic construct
  misc_feature 1..20: note = CRISPR gRNA sequence
  source 1..20: mol_type = other DNA
ctcatgtgggagacataaga

SEQ ID NO: 55878 - DNA, 20 bp, synthetic construct
  misc_feature 1..20: note = CRISPR gRNA sequence
  source 1..20: mol_type = other DNA
tcatgtgggagacataagac

SEQ ID NO: 55879 - DNA, 20 bp, synthetic construct
  misc_feature 1..20: note = CRISPR gRNA sequence
  source 1..20: mol_type = other DNA
catgtgggagacataagaca

SEQ ID NO: 55880 - DNA, 20 bp, synthetic construct
  misc_feature 1..20: note = CRISPR gRNA sequence
  source 1..20: mol_type = other DNA
atgtgggagacataagacag

SEQ ID NO: 55881 - DNA, 20 bp, synthetic construct
  misc_feature 1..20: note = CRISPR gRNA sequence
  source 1..20: mol_type = other DNA
ggagacataagacaggggcc

SEQ ID NO: 55882 - DNA, 20 bp, synthetic construct
  misc_feature 1..20: note = CRISPR gRNA sequence
  source 1..20: mol_type = other DNA
acataagacaggggcccaga

SEQ ID NO: 55883 - DNA, 20 bp, synthetic construct
  misc_feature 1..20: note = CRISPR gRNA sequence
  source 1..20: mol_type = other DNA
ataagacaggggcccagaaa

SEQ ID NO: 55884 - DNA, 20 bp, synthetic construct
  misc_feature 1..20: note = CRISPR gRNA sequence
  source 1..20: mol_type = other DNA
aggggcccagaaagagctga

SEQ ID NO: 55885 - DNA, 20 bp, synthetic construct
  misc_feature 1..20: note = CRISPR gRNA sequence
  source 1..20: mol_type = other DNA
agagctgatggcctgctcgc

SEQ ID NO: 55886 - DNA, 20 bp, synthetic construct
  misc_feature 1..20: note = CRISPR gRNA sequence
  source 1..20: mol_type = other DNA
atggcctgctcgccggattc

SEQ ID NO: 55887 - DNA, 20 bp, synthetic construct
  misc_feature 1..20: note = CRISPR gRNA sequence
  source 1..20: mol_type = other DNA
gcctgctcgccggattccag

SEQ ID NO: 55888 - DNA, 20 bp, synthetic construct
  misc_feature 1..20: note = CRISPR gRNA sequence
  source 1..20: mol_type = other DNA
cctgctcgccggattccagc

SEQ ID NO: 55889 - DNA, 20 bp, synthetic construct
  misc_feature 1..20: note = CRISPR gRNA sequence
  source 1..20: mol_type = other DNA
tcgccggattccagcaggca

SEQ ID NO: 55890 - DNA, 20 bp, synthetic construct
  misc_feature 1..20: note = CRISPR gRNA sequence
  source 1..20: mol_type = other DNA
cggattccagcaggcacggc

SEQ ID NO: 55891 - DNA, 20 bp, synthetic construct
  misc_feature 1..20: note = CRISPR gRNA sequence
  source 1..20: mol_type = other DNA
ggattccagcaggcacggct

SEQ ID NO: 55892 - DNA, 20 bp, synthetic construct
  misc_feature 1..20: note = CRISPR gRNA sequence
  source 1..20: mol_type = other DNA
attccagcaggcacggctag

SEQ ID NO: 55893 - DNA, 20 bp, synthetic construct
  misc_feature 1..20: note = CRISPR gRNA sequence
  source 1..20: mol_type = other DNA
ttccagcaggcacggctagg

SEQ ID NO: 55894 - DNA, 20 bp, synthetic construct
  misc_feature 1..20: note = CRISPR gRNA sequence
  source 1..20: mol_type = other DNA
agcaggcacggctaggagga

SEQ ID NO: 55895 - DNA, 20 bp, synthetic construct
  misc_feature 1..20: note = CRISPR gRNA sequence
  source 1..20: mol_type = other DNA
taggaggaaagaccctctgc

SEQ ID NO: 55896 - DNA, 20 bp, synthetic construct
  misc_feature 1..20: note = CRISPR gRNA sequence
  source 1..20: mol_type = other DNA
ccctctgctggcctcaattc

SEQ ID NO: 55897 - DNA, 20 bp, synthetic construct
  misc_feature 1..20: note = CRISPR gRNA sequence
  source 1..20: mol_type = other DNA
cctctgctggcctcaattct

SEQ ID NO: 55898 - DNA, 20 bp, synthetic construct
  misc_feature 1..20: note = CRISPR gRNA sequence
  source 1..20: mol_type = other DNA
ctgggtctattctgttccta

SEQ ID NO: 55899 - DNA, 20 bp, synthetic construct
  misc_feature 1..20: note = CRISPR gRNA sequence
  source 1..20: mol_type = other DNA
tgggtctattctgttcctat

SEQ ID NO: 55900 - DNA, 20 bp, synthetic construct
  misc_feature 1..20: note = CRISPR gRNA sequence
  source 1..20: mol_type = other DNA
gggtctattctgttcctatg

SEQ ID NO: 55901 - DNA, 20 bp, synthetic construct
  misc_feature 1..20: note = CRISPR gRNA sequence
  source 1..20: mol_type = other DNA
tctattctgttcctatgggg

SEQ ID NO: 55902 - DNA, 20 bp, synthetic construct
  misc_feature 1..20: note = CRISPR gRNA sequence
  source 1..20: mol_type = other DNA
cctatggggaagtttttgcc

SEQ ID NO: 55903 - DNA, 20 bp, synthetic construct
  misc_feature 1..20: note = CRISPR gRNA sequence
  source 1..20: mol_type = other DNA
atggggaagtttttgcctgg

SEQ ID NO: 55904 - DNA, 20 bp, synthetic construct
  misc_feature 1..20: note = CRISPR gRNA sequence
  source 1..20: mol_type = other DNA
aagtttttgcctggcggctc

SEQ ID NO: 55905 - DNA, 20 bp, synthetic construct
  misc_feature 1..20: note = CRISPR gRNA sequence
  source 1..20: mol_type = other DNA
agtttttgcctggcggctca

SEQ ID NO: 55906 - DNA, 20 bp, synthetic construct
  misc_feature 1..20: note = CRISPR gRNA sequence
  source 1..20: mol_type = other DNA
gtttttgcctggcggctcaa

SEQ ID NO: 55907 - DNA, 20 bp, synthetic construct
  misc_feature 1..20: note = CRISPR gRNA sequence
  source 1..20: mol_type = other DNA
gcctggcggctcaagggatc

SEQ ID NO: 55908 - DNA, 20 bp, synthetic construct
  misc_feature 1..20: note = CRISPR gRNA sequence
  source 1..20: mol_type = other DNA
tggcggctcaagggatctag

SEQ ID NO: 55909 - DNA, 20 bp, synthetic construct
  misc_feature 1..20: note = CRISPR gRNA sequence
  source 1..20: mol_type = other DNA
ggctcaagggatctagaaga

SEQ ID NO: 55910 - DNA, 20 bp, synthetic construct
  misc_feature 1..20: note = CRISPR gRNA sequence
  source 1..20: mol_type = other DNA
ggatctagaagacagactga

SEQ ID NO: 55911 - DNA, 20 bp, synthetic construct
  misc_feature 1..20: note = CRISPR gRNA sequence
  source 1..20: mol_type = other DNA
cagactgacggcctcttcat

SEQ ID NO: 55912 - DNA, 20 bp, synthetic construct
  misc_feature 1..20: note = CRISPR gRNA sequence
  source 1..20: mol_type = other DNA
agactgacggcctcttcatg

SEQ ID NO: 55913 - DNA, 20 bp, synthetic construct
  misc_feature 1..20: note = CRISPR gRNA sequence
  source 1..20: mol_type = other DNA
gcctcttcatgaggcacaat

SEQ ID NO: 55914 - DNA, 20 bp, synthetic construct
  misc_feature 1..20: note = CRISPR gRNA sequence
  source 1..20: mol_type = other DNA
cctcttcatgaggcacaatg

SEQ ID NO: 55915 - DNA, 20 bp, synthetic construct
  misc_feature 1..20: note = CRISPR gRNA sequence
  source 1..20: mol_type = other DNA
tcttcatgaggcacaatgag

SEQ ID NO: 55916 - DNA, 20 bp, synthetic construct
  misc_feature 1..20: note = CRISPR gRNA sequence
  source 1..20: mol_type = other DNA
tgaggcacaatgaggagacc

SEQ ID NO: 55917 - DNA, 20 bp, synthetic construct
  misc_feature 1..20: note = CRISPR gRNA sequence
  source 1..20: mol_type = other DNA
gagacctagcaccctgctcc

SEQ ID NO: 55918 - DNA, 20 bp, synthetic construct
  misc_feature 1..20: note = CRISPR gRNA sequence
  source 1..20: mol_type = other DNA
agacctagcaccctgctccc

SEQ ID NO: 55919 - DNA, 20 bp, synthetic construct
  misc_feature 1..20: note = CRISPR gRNA sequence
  source 1..20: mol_type = other DNA
gacctagcaccctgctccca

SEQ ID NO: 55920 - DNA, 20 bp, synthetic construct
  misc_feature 1..20: note = CRISPR gRNA sequence
  source 1..20: mol_type = other DNA
ctgctcccagggcttatgcc

SEQ ID NO: 55921 - DNA, 20 bp, synthetic construct
  misc_feature 1..20: note = CRISPR gRNA sequence
  source 1..20: mol_type = other DNA
tgctcccagggcttatgcct

SEQ ID NO: 55922 - DNA, 20 bp, synthetic construct
  misc_feature 1..20: note = CRISPR gRNA sequence
  source 1..20: mol_type = other DNA
gcttatgcctgggatgtgcc

SEQ ID NO: 55923 - DNA, 20 bp, synthetic construct
  misc_feature 1..20: note = CRISPR gRNA sequence
  source 1..20: mol_type = other DNA
cttatgcctgggatgtgcct

SEQ ID NO: 55924 - DNA, 20 bp, synthetic construct
  misc_feature 1..20: note = CRISPR gRNA sequence
  source 1..20: mol_type = other DNA
tgcctgggatgtgcctggga

SEQ ID NO: 55925 - DNA, 20 bp, synthetic construct
  misc_feature 1..20: note = CRISPR gRNA sequence
  source 1..20: mol_type = other DNA
gcctgggatgtgcctgggat

SEQ ID NO: 55926 - DNA, 20 bp, synthetic construct
  misc_feature 1..20: note = CRISPR gRNA sequence
  source 1..20: mol_type = other DNA
tgtgcctgggataggccccc

SEQ ID NO: 55927 - DNA, 20 bp, synthetic construct
  misc_feature 1..20: note = CRISPR gRNA sequence
  source 1..20: mol_type = other DNA
gtgcctgggataggcccccc

SEQ ID NO: 55928 - DNA, 20 bp, synthetic construct
  misc_feature 1..20: note = CRISPR gRNA sequence
  source 1..20: mol_type = other DNA
ggataggccccccaggcaat

SEQ ID NO: 55929 - DNA, 20 bp, synthetic construct
  misc_feature 1..20: note = CRISPR gRNA sequence
  source 1..20: mol_type = other DNA
ggccccccaggcaatgagta

SEQ ID NO: 55930 - DNA, 20 bp, synthetic construct
  misc_feature 1..20: note = CRISPR gRNA sequence
  source 1..20: mol_type = other DNA
cccaggcaatgagtaaagtc

SEQ ID NO: 55931 - DNA, 20 bp, synthetic construct
  misc_feature 1..20: note = CRISPR gRNA sequence
  source 1..20: mol_type = other DNA
gcaatgagtaaagtctagac

SEQ ID NO: 55932 - DNA, 20 bp, synthetic construct
  misc_feature 1..20: note = CRISPR gRNA sequence
  source 1..20: mol_type = other DNA
caatgagtaaagtctagact

SEQ ID NO: 55933 - DNA, 20 bp, synthetic construct
  misc_feature 1..20: note = CRISPR gRNA sequence
  source 1..20: mol_type = other DNA
aagtctagactgggacgctg

SEQ ID NO: 55934 - DNA, 20 bp, synthetic construct
  misc_feature 1..20: note = CRISPR gRNA sequence
  source 1..20: mol_type = other DNA
gacgctgcagacatcgcttc

SEQ ID NO: 55935 - DNA, 20 bp, synthetic construct
  misc_feature 1..20: note = CRISPR gRNA sequence
  source 1..20: mol_type = other DNA
gcagacatcgcttccagcct

SEQ ID NO: 55936 - DNA, 20 bp, synthetic construct
  misc_feature 1..20: note = CRISPR gRNA sequence
  source 1..20: mol_type = other DNA
atcgcttccagcctcggctg

SEQ ID NO: 55937 - DNA, 20 bp, synthetic construct
  misc_feature 1..20: note = CRISPR gRNA sequence
  source 1..20: mol_type = other DNA
ggctgtggccctgactcacc

SEQ ID NO: 55938 - DNA, 20 bp, synthetic construct
  misc_feature 1..20: note = CRISPR gRNA sequence
  source 1..20: mol_type = other DNA
ctgtggccctgactcaccca

SEQ ID NO: 55939 - DNA, 20 bp, synthetic construct
  misc_feature 1..20: note = CRISPR gRNA sequence
  source 1..20: mol_type = other DNA
cctgactcacccagagccct

SEQ ID NO: 55940 - DNA, 20 bp, synthetic construct
  misc_feature 1..20: note = CRISPR gRNA sequence
  source 1..20: mol_type = other DNA
ctcacccagagccctgagcc

SEQ ID NO: 55941 - DNA, 20 bp, synthetic construct
  misc_feature 1..20: note = CRISPR gRNA sequence
  source 1..20: mol_type = other DNA
cactttccccacctgttcac

SEQ ID NO: 55942 - DNA, 20 bp, synthetic construct
  misc_feature 1..20: note = CRISPR gRNA sequence
  source 1..20: mol_type = other DNA
ttccccacctgttcacaagc

SEQ ID NO: 55943 - DNA, 20 bp, synthetic construct
  misc_feature 1..20: note = CRISPR gRNA sequence
  source 1..20: mol_type = other DNA
gttcacaagccagccttgcc

SEQ ID NO: 55944 - DNA, 20 bp, synthetic construct
  misc_feature 1..20: note = CRISPR gRNA sequence
  source 1..20: mol_type = other DNA
ttcacaagccagccttgcct

SEQ ID NO: 55945 - DNA, 20 bp, synthetic construct
  misc_feature 1..20: note = CRISPR gRNA sequence
  source 1..20: mol_type = other DNA
gccagccttgcctgggttcc

SEQ ID NO: 55946 - DNA, 20 bp, synthetic construct
  misc_feature 1..20: note = CRISPR gRNA sequence
  source 1..20: mol_type = other DNA
gccttgcctgggttcctagc

SEQ ID NO: 55947 - DNA, 20 bp, synthetic construct
  misc_feature 1..20: note = CRISPR gRNA sequence
  source 1..20: mol_type = other DNA
ccttgcctgggttcctagct

SEQ ID NO: 55948 - DNA, 20 bp, synthetic construct
  misc_feature 1..20: note = CRISPR gRNA sequence
  source 1..20: mol_type = other DNA
cttgcctgggttcctagctg

SEQ ID NO: 55949 - DNA, 20 bp, synthetic construct
  misc_feature 1..20: note = CRISPR gRNA sequence
  source 1..20: mol_type = other DNA
tgcctgggttcctagctggg

SEQ ID NO: 55950 - DNA, 20 bp, synthetic construct
  misc_feature 1..20: note = CRISPR gRNA sequence
  source 1..20: mol_type = other DNA
tgggttcctagctggggaga

SEQ ID NO: 55951 - DNA, 20 bp, synthetic construct
  misc_feature 1..20: note = CRISPR gRNA sequence
  source 1..20: mol_type = other DNA
tcctagctggggagacagat

SEQ ID NO: 55952 - DNA, 20 bp, synthetic construct
  misc_feature 1..20: note = CRISPR gRNA sequence
  source 1..20: mol_type = other DNA
gctggggagacagatgagtt

SEQ ID NO: 55953 - DNA, 20 bp, synthetic construct
  misc_feature 1..20: note = CRISPR gRNA sequence
  source 1..20: mol_type = other DNA
ctggggagacagatgagttg

SEQ ID NO: 55954 - DNA, 20 bp, synthetic construct
  misc_feature 1..20: note = CRISPR gRNA sequence
  source 1..20: mol_type = other DNA
tggggagacagatgagttga

SEQ ID NO: 55955 - DNA, 20 bp, synthetic construct
  misc_feature 1..20: note = CRISPR gRNA sequence
  source 1..20: mol_type = other DNA
ggggagacagatgagttgag

SEQ ID NO: 55956 - DNA, 20 bp, synthetic construct
  misc_feature 1..20: note = CRISPR gRNA sequence
  source 1..20: mol_type = other DNA
ggagacagatgagttgaggg

SEQ ID NO: 55957 - DNA, 20 bp, synthetic construct
  misc_feature 1..20: note = CRISPR gRNA sequence
  source 1..20: mol_type = other DNA
acagatgagttgaggggagt

SEQ ID NO: 55958 - DNA, 20 bp, synthetic construct
  misc_feature 1..20: note = CRISPR gRNA sequence
  source 1..20: mol_type = other DNA
cagatgagttgaggggagtg

SEQ ID NO: 55959 - DNA, 20 bp, synthetic construct
  misc_feature 1..20: note = CRISPR gRNA sequence
  source 1..20: mol_type = other DNA
agatgagttgaggggagtga

SEQ ID NO: 55960 - DNA, 20 bp, synthetic construct
  misc_feature 1..20: note = CRISPR gRNA sequence
  source 1..20: mol_type = other DNA
tgaggggagtgagggtgatt

SEQ ID NO: 55961 - DNA, 20 bp, synthetic construct
  misc_feature 1..20: note = CRISPR gRNA sequence
  source 1..20: mol_type = other DNA
gtgagggtgattaagaacaa

SEQ ID NO: 55962 - DNA, 20 bp, synthetic construct
  misc_feature 1..20: note = CRISPR gRNA sequence
  source 1..20: mol_type = other DNA
agggtgattaagaacaatgg

SEQ ID NO: 55963 - DNA, 20 bp, synthetic construct
  misc_feature 1..20: note = CRISPR gRNA sequence
  source 1..20: mol_type = other DNA
gggtgattaagaacaatggt

SEQ ID NO: 55964 - DNA, 20 bp, synthetic construct
  misc_feature 1..20: note = CRISPR gRNA sequence
  source 1..20: mol_type = other DNA
agaacaatggtgggtgatga

SEQ ID NO: 55965 - DNA, 20 bp, synthetic construct
  misc_feature 1..20: note = CRISPR gRNA sequence
  source 1..20: mol_type = other DNA
ggtgatgaaagacaaaatta

SEQ ID NO: 55966 - DNA, 20 bp, synthetic construct
  misc_feature 1..20: note = CRISPR gRNA sequence
  source 1..20: mol_type = other DNA
aaaattaaagtcactttcaa

SEQ ID NO: 55967 - DNA, 20 bp, synthetic construct
  misc_feature 1..20: note = CRISPR gRNA sequence
  source 1..20: mol_type = other DNA
ttaaagtcactttcaatagc

SEQ ID NO: 55968 - DNA, 20 bp, synthetic construct
  misc_feature 1..20: note = CRISPR gRNA sequence
  source 1..20: mol_type = other DNA
taaagtcactttcaatagcc

SEQ ID NO: 55969 - DNA, 20 bp, synthetic construct
  misc_feature 1..20: note = CRISPR gRNA sequence
  source 1..20: mol_type = other DNA
aaagtcactttcaatagcca

SEQ ID NO: 55970 - DNA, 20 bp, synthetic construct
  misc_feature 1..20: note = CRISPR gRNA sequence
  source 1..20: mol_type = other DNA
gtcactttcaatagccaggg

SEQ ID NO: 55971 - DNA, 20 bp, synthetic construct
  misc_feature 1..20: note = CRISPR gRNA sequence
  source 1..20: mol_type = other DNA
cagggaagaaaaatgtcaac

SEQ ID NO: 55972 - DNA, 20 bp, synthetic construct
  misc_feature 1..20: note = CRISPR gRNA sequence
  source 1..20: mol_type = other DNA
aagaaaaatgtcaacaagtt

SEQ ID NO: 55973 - DNA, 20 bp, synthetic construct
  misc_feature 1..20: note = CRISPR gRNA sequence
  source 1..20: mol_type = other DNA
agttcagtacttctgaacct

SEQ ID NO: 55974 - DNA, 20 bp, synthetic construct
  misc_feature 1..20: note = CRISPR gRNA sequence
  source 1..20: mol_type = other DNA
tctgaaccttggcttaatca

SEQ ID NO: 55975 - DNA, 20 bp, synthetic construct
  misc_feature 1..20: note = CRISPR gRNA sequence
  source 1..20: mol_type = other DNA
cttggcttaatcacggttca

SEQ ID NO: 55976 - DNA, 20 bp, synthetic construct
  misc_feature 1..20: note = CRISPR gRNA sequence
  source 1..20: mol_type = other DNA
aatcacggttcacagatgcc

SEQ ID NO: 55977 - DNA, 20 bp, synthetic construct
  misc_feature 1..20: note = CRISPR gRNA sequence
  source 1..20: mol_type = other DNA
cggttcacagatgcccagcc

SEQ ID NO: 55978 - DNA, 20 bp, synthetic construct
  misc_feature 1..20: note = CRISPR gRNA sequence
  source 1..20: mol_type = other DNA
atgcccagccgagacgacaa

SEQ ID NO: 55979 - DNA, 20 bp, synthetic construct
  misc_feature 1..20: note = CRISPR gRNA sequence
  source 1..20: mol_type = other DNA
tgcccagccgagacgacaat

SEQ ID NO: 55980 - DNA, 20 bp, synthetic construct
  misc_feature 1..20: note = CRISPR gRNA sequence
  source 1..20: mol_type = other DNA
gcccagccgagacgacaata

SEQ ID NO: 55981 - DNA, 20 bp, synthetic construct
  misc_feature 1..20: note = CRISPR gRNA sequence
  source 1..20: mol_type = other DNA
cgagacgacaatagggactg

SEQ ID NO: 55982 - DNA, 20 bp, synthetic construct
  misc_feature 1..20: note = CRISPR gRNA sequence
  source 1..20: mol_type = other DNA
acttattattttcactcaac

SEQ ID NO: 55983 - DNA, 20 bp, synthetic construct
  misc_feature 1..20: note = CRISPR gRNA sequence
  source 1..20: mol_type = other DNA
actcaacaagtgctgaacct

SEQ ID NO: 55984 - DNA, 20 bp, synthetic construct
  misc_feature 1..20: note = CRISPR gRNA sequence
  source 1..20: mol_type = other DNA
caagtgctgaaccttagtga

SEQ ID NO: 55985 - DNA, 20 bp, synthetic construct
  misc_feature 1..20: note = CRISPR gRNA sequence
  source 1..20: mol_type = other DNA
aagtgctgaaccttagtgac

SEQ ID NO: 55986 - DNA, 20 bp, synthetic construct
  misc_feature 1..20: note = CRISPR gRNA sequence
  source 1..20: mol_type = other DNA
agtgacaggctgcatctgtg

SEQ ID NO: 55987 - DNA, 20 bp, synthetic construct
  misc_feature 1..20: note = CRISPR gRNA sequence
  source 1..20: mol_type = other DNA
aggctgcatctgtgtggatg

SEQ ID NO: 55988 - DNA, 20 bp, synthetic construct
  misc_feature 1..20: note = CRISPR gRNA sequence
  source 1..20: mol_type = other DNA
ctgcatctgtgtggatgaag

SEQ ID NO: 55989 - DNA, 20 bp, synthetic construct
  misc_feature 1..20: note = CRISPR gRNA sequence
  source 1..20: mol_type = other DNA
tgccttctctaaatgtcata

SEQ ID NO: 55990 - DNA, 20 bp, synthetic construct
  misc_feature 1..20: note = CRISPR gRNA sequence
  source 1..20: mol_type = other DNA
gccttctctaaatgtcataa

SEQ ID NO: 55991 - DNA, 20 bp, synthetic construct
  misc_feature 1..20: note = CRISPR gRNA sequence
  source 1..20: mol_type = other DNA
cataaaggtgccatataaac

SEQ ID NO: 55992 - DNA, 20 bp, synthetic construct
  misc_feature 1..20: note = CRISPR gRNA sequence
  source 1..20: mol_type = other DNA
aaaggtgccatataaactag

SEQ ID NO: 55993 - DNA, 20 bp, synthetic construct
  misc_feature 1..20: note = CRISPR gRNA sequence
  source 1..20: mol_type = other DNA
ataaactagcagcgttctgc

SEQ ID NO: 55994 - DNA, 20 bp, synthetic construct
  misc_feature 1..20: note = CRISPR gRNA sequence
  source 1..20: mol_type = other DNA
taaactagcagcgttctgcc

SEQ ID NO: 55995 - DNA, 20 bp, synthetic construct
  misc_feature 1..20: note = CRISPR gRNA sequence
  source 1..20: mol_type = other DNA
aaactagcagcgttctgcca

SEQ ID NO: 55996 - DNA, 20 bp, synthetic construct
  misc_feature 1..20: note = CRISPR gRNA sequence
  source 1..20: mol_type = other DNA
actagcagcgttctgccagg

SEQ ID NO: 55997 - DNA, 20 bp, synthetic construct
  misc_feature 1..20: note = CRISPR gRNA sequence
  source 1..20: mol_type = other DNA
ctagcagcgttctgccaggg

SEQ ID NO: 55998 - DNA, 20 bp, synthetic construct
  misc_feature 1..20: note = CRISPR gRNA sequence
  source 1..20: mol_type = other DNA
agcagcgttctgccagggag

SEQ ID NO: 55999 - DNA, 20 bp, synthetic construct
  misc_feature 1..20: note = CRISPR gRNA sequence
  source 1..20: mol_type = other DNA
gcagcgttctgccagggagg

SEQ ID NO: 56000 - DNA, 20 bp, synthetic construct
  misc_feature 1..20: note = CRISPR gRNA sequence
  source 1..20: mol_type = other DNA
cagcgttctgccagggagga

SEQ ID NO: 56001 - DNA, 20 bp, synthetic construct
  misc_feature 1..20: note = CRISPR gRNA sequence
  source 1..20: mol_type = other DNA
ctgccagggaggagggtcac

SEQ ID NO: 56002 - DNA, 20 bp, synthetic construct
  misc_feature 1..20: note = CRISPR gRNA sequence
  source 1..20: mol_type = other DNA
actggtcccactcctcccca

SEQ ID NO: 56003 - DNA, 20 bp, synthetic construct
  misc_feature 1..20: note = CRISPR gRNA sequence
  source 1..20: mol_type = other DNA
ccactcctccccatggtact

SEQ ID NO: 56004 - DNA, 20 bp, synthetic construct
  misc_feature 1..20: note = CRISPR gRNA sequence
  source 1..20: mol_type = other DNA
ctccccatggtactgagtcc

SEQ ID NO: 56005 - DNA, 20 bp, synthetic construct
  misc_feature 1..20: note = CRISPR gRNA sequence
  source 1..20: mol_type = other DNA
atggtactgagtcccagaca

SEQ ID NO: 56006 - DNA, 20 bp, synthetic construct
  misc_feature 1..20: note = CRISPR gRNA sequence
  source 1..20: mol_type = other DNA
tggtactgagtcccagacac

SEQ ID NO: 56007 - DNA, 20 bp, synthetic construct
  misc_feature 1..20: note = CRISPR gRNA sequence
  source 1..20: mol_type = other DNA
ggtactgagtcccagacaca

SEQ ID NO: 56008 - DNA, 20 bp, synthetic construct
  misc_feature 1..20: note = CRISPR gRNA sequence
  source 1..20: mol_type = other DNA
actgagtcccagacacaggg

SEQ ID NO: 56009 - DNA, 20 bp, synthetic construct
  misc_feature 1..20: note = CRISPR gRNA sequence
  source 1..20: mol_type = other DNA
ctgagtcccagacacagggc

SEQ ID NO: 56010 - DNA, 20 bp, synthetic construct
  misc_feature 1..20: note = CRISPR gRNA sequence
  source 1..20: mol_type = other DNA
gagtcccagacacagggcag

SEQ ID NO: 56011 - DNA, 20 bp, synthetic construct
  misc_feature 1..20: note = CRISPR gRNA sequence
  source 1..20: mol_type = other DNA
aggagtatatttgtgcatac

SEQ ID NO: 56012 - DNA, 20 bp, synthetic construct
  misc_feature 1..20: note = CRISPR gRNA sequence
  source 1..20: mol_type = other DNA
tatatttgtgcatacaagct

SEQ ID NO: 56013 - DNA, 20 bp, synthetic construct
  misc_feature 1..20: note = CRISPR gRNA sequence
  source 1..20: mol_type = other DNA
tttgtgcatacaagcttagt

SEQ ID NO: 56014 - DNA, 20 bp, synthetic construct
  misc_feature 1..20: note = CRISPR gRNA sequence
  source 1..20: mol_type = other DNA
tgcatacaagcttagttagt

SEQ ID NO: 56015 - DNA, 20 bp, synthetic construct
  misc_feature 1..20: note = CRISPR gRNA sequence
  source 1..20: mol_type = other DNA
catacaagcttagttagtta

SEQ ID NO: 56016 - DNA, 20 bp, synthetic construct
  misc_feature 1..20: note = CRISPR gRNA sequence
  source 1..20: mol_type = other DNA
cttagttagttagagtgtgc

SEQ ID NO: 56017 - DNA, 20 bp, synthetic construct
  misc_feature 1..20: note = CRISPR gRNA sequence
  source 1..20: mol_type = other DNA
ggcatcaaaatgtgtacatg

SEQ ID NO: 56018 - DNA, 20 bp, synthetic construct
  misc_feature 1..20: note = CRISPR gRNA sequence
  source 1..20: mol_type = other DNA
aaaatgtgtacatgtagtta

SEQ ID NO: 56019 - DNA, 20 bp, synthetic construct
  misc_feature 1..20: note = CRISPR gRNA sequence
  source 1..20: mol_type = other DNA
aaatgtgtacatgtagttaa

SEQ ID NO: 56020 - DNA, 20 bp, synthetic construct
  misc_feature 1..20: note = CRISPR gRNA sequence
  source 1..20: mol_type = other DNA
gcatacatgtgcacacctat

SEQ ID NO: 56021 - DNA, 20 bp, synthetic construct
  misc_feature 1..20: note = CRISPR gRNA sequence
  source 1..20: mol_type = other DNA
tacatgtgcacacctatgag

SEQ ID NO: 56022 - DNA, 20 bp, synthetic construct
  misc_feature 1..20: note = CRISPR gRNA sequence
  source 1..20: mol_type = other DNA
acatgtgcacacctatgagt

SEQ ID NO: 56023 - DNA, 20 bp, synthetic construct
  misc_feature 1..20: note = CRISPR gRNA sequence
  source 1..20: mol_type = other DNA
cacctatgagtgggcatgtg

SEQ ID NO: 56024 - DNA, 20 bp, synthetic construct
  misc_feature 1..20: note = CRISPR gRNA sequence
  source 1..20: mol_type = other DNA
acctatgagtgggcatgtgt

SEQ ID NO: 56025 - DNA, 20 bp, synthetic construct
  misc_feature 1..20: note = CRISPR gRNA sequence
  source 1..20: mol_type = other DNA
atgcctgtgtacttctgtgc

SEQ ID NO: 56026 - DNA, 20 bp, synthetic construct
  misc_feature 1..20: note = CRISPR gRNA sequence
  source 1..20: mol_type = other DNA
tgtgtacttctgtgcaagtg

SEQ ID NO: 56027 - DNA, 20 bp, synthetic construct
  misc_feature 1..20: note = CRISPR gRNA sequence
  source 1..20: mol_type = other DNA
gacatgtgtgaacaaatgtg

SEQ ID NO: 56028 - DNA, 20 bp, synthetic construct
  misc_feature 1..20: note = CRISPR gRNA sequence
  source 1..20: mol_type = other DNA
acatgtgtgaacaaatgtga

SEQ ID NO: 56029 - DNA, 20 bp, synthetic construct
  misc_feature 1..20: note = CRISPR gRNA sequence
  source 1..20: mol_type = other DNA
tgaacaaatgtgaaggtgtg

SEQ ID NO: 56030 - DNA, 20 bp, synthetic construct
  misc_feature 1..20: note = CRISPR gRNA sequence
  source 1..20: mol_type = other DNA
aaggtgtgtggtgcttcatg

SEQ ID NO: 56031 - DNA, 20 bp, synthetic construct
  misc_feature 1..20: note = CRISPR gRNA sequence
  source 1..20: mol_type = other DNA
catgtagttatgtgtaccca

SEQ ID NO: 56032 - DNA, 20 bp, synthetic construct
  misc_feature 1..20: note = CRISPR gRNA sequence
  source 1..20: mol_type = other DNA
cgcactgctatcccttctcc

SEQ ID NO: 56033 - DNA, 20 bp, synthetic construct
  misc_feature 1..20: note = CRISPR gRNA sequence
  source 1..20: mol_type = other DNA
gcactgctatcccttctcct

SEQ ID NO: 56034 - DNA, 20 bp, synthetic construct
  misc_feature 1..20: note = CRISPR gRNA sequence
  source 1..20: mol_type = other DNA
tatcccttctcctgggattt

SEQ ID NO: 56035 - DNA, 20 bp, synthetic construct
  misc_feature 1..20: note = CRISPR gRNA sequence
  source 1..20: mol_type = other DNA
ccttctcctgggatttcaga

SEQ ID NO: 56036 - DNA, 20 bp, synthetic construct
  misc_feature 1..20: note = CRISPR gRNA sequence
  source 1..20: mol_type = other DNA
ttctcctgggatttcagaaa

SEQ ID NO: 56037 - DNA, 20 bp, synthetic construct
  misc_feature 1..20: note = CRISPR gRNA sequence
  source 1..20: mol_type = other DNA
tctcctgggatttcagaaag

SEQ ID NO: 56038 - DNA, 20 bp, synthetic construct
  misc_feature 1..20: note = CRISPR gRNA sequence
  source 1..20: mol_type = other DNA
ctcctgggatttcagaaaga

SEQ ID NO: 56039 - DNA, 20 bp, synthetic construct
  misc_feature 1..20: note = CRISPR gRNA sequence
  source 1..20: mol_type = other DNA
cctgggatttcagaaagagg

SEQ ID NO: 56040 - DNA, 20 bp, synthetic construct
  misc_feature 1..20: note = CRISPR gRNA sequence
  source 1..20: mol_type = other DNA
ctgggatttcagaaagaggg

SEQ ID NO: 56041 - DNA, 20 bp, synthetic construct
  misc_feature 1..20: note = CRISPR gRNA sequence
  source 1..20: mol_type = other DNA
tgggatttcagaaagaggga

SEQ ID NO: 56042 - DNA, 20 bp, synthetic construct
  misc_feature 1..20: note = CRISPR gRNA sequence
  source 1..20: mol_type = other DNA
ggatttcagaaagagggagg

SEQ ID NO: 56043 - DNA, 20 bp, synthetic construct
  misc_feature 1..20: note = CRISPR gRNA sequence
  source 1..20: mol_type = other DNA
cttaacactcatgctcctcc

SEQ ID NO: 56044 - DNA, 20 bp, synthetic construct
  misc_feature 1..20: note = CRISPR gRNA sequence
  source 1..20: mol_type = other DNA
acactcatgctcctccaaga

SEQ ID NO: 56045 - DNA, 20 bp, synthetic construct
  misc_feature 1..20: note = CRISPR gRNA sequence
  source 1..20: mol_type = other DNA
tccaagacagtctaaaatat

SEQ ID NO: 56046 - DNA, 20 bp, synthetic construct
  misc_feature 1..20: note = CRISPR gRNA sequence
  source 1..20: mol_type = other DNA
acagtctaaaatattagatg

SEQ ID NO: 56047 - DNA, 20 bp, synthetic construct
  misc_feature 1..20: note = CRISPR gRNA sequence
  source 1..20: mol_type = other DNA
cagtctaaaatattagatga

SEQ ID NO: 56048 - DNA, 20 bp, synthetic construct
  misc_feature 1..20: note = CRISPR gRNA sequence
  source 1..20: mol_type = other DNA
tctaaaatattagatgaagg

SEQ ID NO: 56049 - DNA, 20 bp, synthetic construct
  misc_feature 1..20: note = CRISPR gRNA sequence
  source 1..20: mol_type = other DNA
agatgaaggaagccttgctc

SEQ ID NO: 56050 - DNA, 20 bp, synthetic construct
  misc_feature 1..20: note = CRISPR gRNA sequence
  source 1..20: mol_type = other DNA
gatgaaggaagccttgctct

SEQ ID NO: 56051 - DNA, 20 bp, synthetic construct
  misc_feature 1..20: note = CRISPR gRNA sequence
  source 1..20: mol_type = other DNA
atgaaggaagccttgctctg

SEQ ID NO: 56052 - DNA, 20 bp, synthetic construct
  misc_feature 1..20: note = CRISPR gRNA sequence
  source 1..20: mol_type = other DNA
aagccttgctctggggactc

SEQ ID NO: 56053 - DNA, 20 bp, synthetic construct
  misc_feature 1..20: note = CRISPR gRNA sequence
  source 1..20: mol_type = other DNA
agccttgctctggggactct

SEQ ID NO: 56054 - DNA, 20 bp, synthetic construct
  misc_feature 1..20: note = CRISPR gRNA sequence
  source 1..20: mol_type = other DNA
ccttgctctggggactctgg

SEQ ID NO: 56055 - DNA, 20 bp, synthetic construct
  misc_feature 1..20: note = CRISPR gRNA sequence
  source 1..20: mol_type = other DNA
tctggggactctgggagcct

SEQ ID NO: 56056 - DNA, 20 bp, synthetic construct
  misc_feature 1..20: note = CRISPR gRNA sequence
  source 1..20: mol_type = other DNA
ctggggactctgggagcctt

SEQ ID NO: 56057 - DNA, 20 bp, synthetic construct
  misc_feature 1..20: note = CRISPR gRNA sequence
  source 1..20: mol_type = other DNA
gactctgggagccttgggtt

SEQ ID NO: 56058 - DNA, 20 bp, synthetic construct
  misc_feature 1..20: note = CRISPR gRNA sequence
  source 1..20: mol_type = other DNA
gggagccttgggtttggact

SEQ ID NO: 56059 - DNA, 20 bp, synthetic construct
  misc_feature 1..20: note = CRISPR gRNA sequence
  source 1..20: mol_type = other DNA
ggtttggactcagccctact

SEQ ID NO: 56060 - DNA, 20 bp, synthetic construct
  misc_feature 1..20: note = CRISPR gRNA sequence
  source 1..20: mol_type = other DNA
actcagccctactgagtact

SEQ ID NO: 56061 - DNA, 20 bp, synthetic construct
  misc_feature 1..20: note = CRISPR gRNA sequence
  source 1..20: mol_type = other DNA
ggactgatgccttccctctc

SEQ ID NO: 56062 - DNA, 20 bp, synthetic construct
  misc_feature 1..20: note = CRISPR gRNA sequence
  source 1..20: mol_type = other DNA
gactgatgccttccctctct

SEQ ID NO: 56063 - DNA, 20 bp, synthetic construct
  misc_feature 1..20: note = CRISPR gRNA sequence
  source 1..20: mol_type = other DNA
gggtctcactgaaaaactac

SEQ ID NO: 56064 - DNA, 20 bp, synthetic construct
  misc_feature 1..20: note = CRISPR gRNA sequence
  source 1..20: mol_type = other DNA
ctcactgaaaaactactggt

SEQ ID NO: 56065 - DNA, 20 bp, synthetic construct
  misc_feature 1..20: note = CRISPR gRNA sequence
  source 1..20: mol_type = other DNA
gaaaaactactggtcagact

SEQ ID NO: 56066 - DNA, 20 bp, synthetic construct
  misc_feature 1..20: note = CRISPR gRNA sequence
  source 1..20: mol_type = other DNA
aaaactactggtcagacttg

SEQ ID NO: 56067 - DNA, 20 bp, synthetic construct
  misc_feature 1..20: note = CRISPR gRNA sequence
  source 1..20: mol_type = other DNA
aaactactggtcagacttgg

SEQ ID NO: 56068 - DNA, 20 bp, synthetic construct
  misc_feature 1..20: note = CRISPR gRNA sequence
  source 1..20: mol_type = other DNA
gtcagacttggaggaacatg

SEQ ID NO: 56069 - DNA, 20 bp, synthetic construct
  misc_feature 1..20: note = CRISPR gRNA sequence
  source 1..20: mol_type = other DNA
tcagacttggaggaacatgc

SEQ ID NO: 56070 - DNA, 20 bp, synthetic construct
  misc_feature 1..20: note = CRISPR gRNA sequence
  source 1..20: mol_type = other DNA
ttggaggaacatgcaggccc

SEQ ID NO: 56071 - DNA, 20 bp, synthetic construct
  misc_feature 1..20: note = CRISPR gRNA sequence
  source 1..20: mol_type = other DNA
tggaggaacatgcaggcccc

SEQ ID NO: 56072 - DNA, 20 bp, synthetic construct
  misc_feature 1..20: note = CRISPR gRNA sequence
  source 1..20: mol_type = other DNA
ggaggaacatgcaggcccca

SEQ ID NO: 56073 - DNA, 20 bp, synthetic construct
  misc_feature 1..20: note = CRISPR gRNA sequence
  source 1..20: mol_type = other DNA
gaggaacatgcaggccccag

SEQ ID NO: 56074 - DNA, 20 bp, synthetic construct
  misc_feature 1..20: note = CRISPR gRNA sequence
  source 1..20: mol_type = other DNA
aggaacatgcaggccccagg

SEQ ID NO: 56075 - DNA, 20 bp, synthetic construct
  misc_feature 1..20: note = CRISPR gRNA sequence
  source 1..20: mol_type = other DNA
tgcaggccccagggggactc

SEQ ID NO: 56076 - DNA, 20 bp, synthetic construct
  misc_feature 1..20: note = CRISPR gRNA sequence
  source 1..20: mol_type = other DNA
gcaggccccagggggactct

SEQ ID NO: 56077 - DNA, 20 bp, synthetic construct
  misc_feature 1..20: note = CRISPR gRNA sequence
  source 1..20: mol_type = other DNA
cccagggggactctgggacc

SEQ ID NO: 56078 - DNA, 20 bp, synthetic construct
  misc_feature 1..20: note = CRISPR gRNA sequence
  source 1..20: mol_type = other DNA
ccagggggactctgggacct

SEQ ID NO: 56079 - DNA, 20 bp, synthetic construct
  misc_feature 1..20: note = CRISPR gRNA sequence
  source 1..20: mol_type = other DNA
gggggactctgggacctggg

SEQ ID NO: 56080 - DNA, 20 bp, synthetic construct
  misc_feature 1..20: note = CRISPR gRNA sequence
  source 1..20: mol_type = other DNA
ggactctgggacctgggcag

SEQ ID NO: 56081 - DNA, 20 bp, synthetic construct
  misc_feature 1..20: note = CRISPR gRNA sequence
  source 1..20: mol_type = other DNA
tgggcagtggctcatctccc

SEQ ID NO: 56082 - DNA, 20 bp, synthetic construct
  misc_feature 1..20: note = CRISPR gRNA sequence
  source 1..20: mol_type = other DNA
cagtggctcatctccccagt

SEQ ID NO: 56083 - DNA, 20 bp, synthetic construct
  misc_feature 1..20: note = CRISPR gRNA sequence
  source 1..20: mol_type = other DNA
ggctcatctccccagtcagt

SEQ ID NO: 56084 - DNA, 20 bp, synthetic construct
  misc_feature 1..20: note = CRISPR gRNA sequence
  source 1..20: mol_type = other DNA
ccccagtcagtgagccctcc

SEQ ID NO: 56085 - DNA, 20 bp, synthetic construct
  misc_feature 1..20: note = CRISPR gRNA sequence
  source 1..20: mol_type = other DNA
ccagtcagtgagccctcctg

SEQ ID NO: 56086 - DNA, 20 bp, synthetic construct
  misc_feature 1..20: note = CRISPR gRNA sequence
  source 1..20: mol_type = other DNA
atcactcacctgacttcttt

SEQ ID NO: 56087 - DNA, 20 bp, synthetic construct
  misc_feature 1..20: note = CRISPR gRNA sequence
  source 1..20: mol_type = other DNA
cacctgacttctttcagctg

SEQ ID NO: 56088 - DNA, 20 bp, synthetic construct
  misc_feature 1..20: note = CRISPR gRNA sequence
  source 1..20: mol_type = other DNA
tgacttctttcagctgtgga

SEQ ID NO: 56089 - DNA, 20 bp, synthetic construct
  misc_feature 1..20: note = CRISPR gRNA sequence
  source 1..20: mol_type = other DNA
acttctttcagctgtggaca

SEQ ID NO: 56090 - DNA, 20 bp, synthetic construct
  misc_feature 1..20: note = CRISPR gRNA sequence
  source 1..20: mol_type = other DNA
ttctttcagctgtggacaga

SEQ ID NO: 56091 - DNA, 20 bp, synthetic construct
  misc_feature 1..20: note = CRISPR gRNA sequence
  source 1..20: mol_type = other DNA
tctttcagctgtggacagag

SEQ ID NO: 56092 - DNA, 20 bp, synthetic construct
  misc_feature 1..20: note = CRISPR gRNA sequence
  source 1..20: mol_type = other DNA
cagctgtggacagagaggca

SEQ ID NO: 56093 - DNA, 20 bp, synthetic construct
  misc_feature 1..20: note = CRISPR gRNA sequence
  source 1..20: mol_type = other DNA
cagagaggcaaagctttcac

SEQ ID NO: 56094 - DNA, 20 bp, synthetic construct
  misc_feature 1..20: note = CRISPR gRNA sequence
  source 1..20: mol_type = other DNA
agagaggcaaagctttcacc

SEQ ID NO: 56095 - DNA, 20 bp, synthetic construct
  misc_feature 1..20: note = CRISPR gRNA sequence
  source 1..20: mol_type = other DNA
gaggcaaagctttcaccagg

SEQ ID NO: 56096 - DNA, 20 bp, synthetic construct
  misc_feature 1..20: note = CRISPR gRNA sequence
  source 1..20: mol_type = other DNA
tcaccaggtggctgatgcct

SEQ ID NO: 56097 - DNA, 20 bp, synthetic construct
  misc_feature 1..20: note = CRISPR gRNA sequence
  source 1..20: mol_type = other DNA
caccaggtggctgatgcctc

SEQ ID NO: 56098 - DNA, 20 bp, synthetic construct
  misc_feature 1..20: note = CRISPR gRNA sequence
  source 1..20: mol_type = other DNA
caggtggctgatgcctcggg

SEQ ID NO: 56099 - DNA, 20 bp, synthetic construct
  misc_feature 1..20: note = CRISPR gRNA sequence
  source 1..20: mol_type = other DNA
ttttacttcctgctaaccta

SEQ ID NO: 56100 - DNA, 20 bp, synthetic construct
  misc_feature 1..20: note = CRISPR gRNA sequence
  source 1..20: mol_type = other DNA
ttacttcctgctaacctaca

SEQ ID NO: 56101 - DNA, 20 bp, synthetic construct
  misc_feature 1..20: note = CRISPR gRNA sequence
  source 1..20: mol_type = other DNA
ttcctgctaacctacagagt

SEQ ID NO: 56102 - DNA, 20 bp, synthetic construct
  misc_feature 1..20: note = CRISPR gRNA sequence
  source 1..20: mol_type = other DNA
gctaacctacagagtaagca

SEQ ID NO: 56103 - DNA, 20 bp, synthetic construct
  misc_feature 1..20: note = CRISPR gRNA sequence
  source 1..20: mol_type = other DNA
acctacagagtaagcaaaga

SEQ ID NO: 56104 - DNA, 20 bp, synthetic construct
  misc_feature 1..20: note = CRISPR gRNA sequence
  source 1..20: mol_type = other DNA
tacagagtaagcaaagatgg

SEQ ID NO: 56105 - DNA, 20 bp, synthetic construct
  misc_feature 1..20: note = CRISPR gRNA sequence
  source 1..20: mol_type = other DNA
acagagtaagcaaagatggt

SEQ ID NO: 56106 - DNA, 20 bp, synthetic construct
  misc_feature 1..20: note = CRISPR gRNA sequence
  source 1..20: mol_type = other DNA
cagagtaagcaaagatggtg

SEQ ID NO: 56107 - DNA, 20 bp, synthetic construct
  misc_feature 1..20: note = CRISPR gRNA sequence
  source 1..20: mol_type = other DNA
gagtaagcaaagatggtggg

SEQ ID NO: 56108 - DNA, 20 bp, synthetic construct
  misc_feature 1..20: note = CRISPR gRNA sequence
  source 1..20: mol_type = other DNA
agtaagcaaagatggtgggg

SEQ ID NO: 56109 - DNA, 20 bp, synthetic construct
  misc_feature 1..20: note = CRISPR gRNA sequence
  source 1..20: mol_type = other DNA
caaagatggtggggaggaac

SEQ ID NO: 56110 - DNA, 20 bp, synthetic construct
  misc_feature 1..20: note = CRISPR gRNA sequence
  source 1..20: mol_type = other DNA
aaagatggtggggaggaacg

SEQ ID NO: 56111 - DNA, 20 bp, synthetic construct
  misc_feature 1..20: note = CRISPR gRNA sequence
  source 1..20: mol_type = other DNA
agatggtggggaggaacgag

SEQ ID NO: 56112 - DNA, 20 bp, synthetic construct
  misc_feature 1..20: note = CRISPR gRNA sequence
  source 1..20: mol_type = other DNA
gatggtggggaggaacgagg

SEQ ID NO: 56113 - DNA, 20 bp, synthetic construct
  misc_feature 1..20: note = CRISPR gRNA sequence
  source 1..20: mol_type = other DNA
atggtggggaggaacgagga

SEQ ID NO: 56114 - DNA, 20 bp, synthetic construct
  misc_feature 1..20: note = CRISPR gRNA sequence
  source 1..20: mol_type = other DNA
tggtggggaggaacgaggag

SEQ ID NO: 56115 - DNA, 20 bp, synthetic construct
  misc_feature 1..20: note = CRISPR gRNA sequence
  source 1..20: mol_type = other DNA
gggaggaacgaggaggggaa

SEQ ID NO: 56116 - DNA, 20 bp, synthetic construct
  misc_feature 1..20: note = CRISPR gRNA sequence
  source 1..20: mol_type = other DNA
ggaggaacgaggaggggaaa

SEQ ID NO: 56117 - DNA, 20 bp, synthetic construct
  misc_feature 1..20: note = CRISPR gRNA sequence
  source 1..20: mol_type = other DNA
gaggaacgaggaggggaaaa

SEQ ID NO: 56118 - DNA, 20 bp, synthetic construct
  misc_feature 1..20: note = CRISPR gRNA sequence
  source 1..20: mol_type = other DNA
gaacgaggaggggaaaaggg

SEQ ID NO: 56119 - DNA, 20 bp, synthetic construct
  misc_feature 1..20: note = CRISPR gRNA sequence
  source 1..20: mol_type = other DNA
aacgaggaggggaaaagggc

SEQ ID NO: 56120 - DNA, 20 bp, synthetic construct
  misc_feature 1..20: note = CRISPR gRNA sequence
  source 1..20: mol_type = other DNA
acgaggaggggaaaagggcg

SEQ ID NO: 56121 - DNA, 20 bp, synthetic construct
  misc_feature 1..20: note = CRISPR gRNA sequence
  source 1..20: mol_type = other DNA
ggaggggaaaagggcggggc

SEQ ID NO: 56122 - DNA, 20 bp, synthetic construct
  misc_feature 1..20: note = CRISPR gRNA sequence
  source 1..20: mol_type = other DNA
gaggggaaaagggcggggcc

SEQ ID NO: 56123 - DNA, 20 bp, synthetic construct
  misc_feature 1..20: note = CRISPR gRNA sequence
  source 1..20: mol_type = other DNA
ggccaggaatctgccttgtg

SEQ ID NO: 56124 - DNA, 20 bp, synthetic construct
  misc_feature 1..20: note = CRISPR gRNA sequence
  source 1..20: mol_type = other DNA
gccaggaatctgccttgtgt

SEQ ID NO: 56125 - DNA, 20 bp, synthetic construct
  misc_feature 1..20: note = CRISPR gRNA sequence
  source 1..20: mol_type = other DNA
aatctgccttgtgtaggatt

SEQ ID NO: 56126 - DNA, 20 bp, synthetic construct
  misc_feature 1..20: note = CRISPR gRNA sequence
  source 1..20: mol_type = other DNA
atctgccttgtgtaggatta

SEQ ID NO: 56127 - DNA, 20 bp, synthetic construct
  misc_feature 1..20: note = CRISPR gRNA sequence
  source 1..20: mol_type = other DNA
ctgccttgtgtaggattaag

SEQ ID NO: 56128 - DNA, 20 bp, synthetic construct
  misc_feature 1..20: note = CRISPR gRNA sequence
  source 1..20: mol_type = other DNA
gccttgtgtaggattaagga

SEQ ID NO: 56129 - DNA, 20 bp, synthetic construct
  misc_feature 1..20: note = CRISPR gRNA sequence
  source 1..20: mol_type = other DNA
ccttgtgtaggattaaggag

SEQ ID NO: 56130 - DNA, 20 bp, synthetic construct
  misc_feature 1..20: note = CRISPR gRNA sequence
  source 1..20: mol_type = other DNA
cttgtgtaggattaaggaga

SEQ ID NO: 56131 - DNA, 20 bp, synthetic construct
  misc_feature 1..20: note = CRISPR gRNA sequence
  source 1..20: mol_type = other DNA
tgtgtaggattaaggagagg

SEQ ID NO: 56132 - DNA, 20 bp, synthetic construct
  misc_feature 1..20: note = CRISPR gRNA sequence
  source 1..20: mol_type = other DNA
gtgtaggattaaggagaggg

SEQ ID NO: 56133 - DNA, 20 bp, synthetic construct
  misc_feature 1..20: note = CRISPR gRNA sequence
  source 1..20: mol_type = other DNA
gtaggattaaggagagggag

SEQ ID NO: 56134 - DNA, 20 bp, synthetic construct
  misc_feature 1..20: note = CRISPR gRNA sequence
  source 1..20: mol_type = other DNA
aggattaaggagagggagga

SEQ ID NO: 56135 - DNA, 20 bp, synthetic construct
  misc_feature 1..20: note = CRISPR gRNA sequence
  source 1..20: mol_type = other DNA
aaggagagggaggagagtac

SEQ ID NO: 56136 - DNA, 20 bp, synthetic construct
  misc_feature 1..20: note = CRISPR gRNA sequence
  source 1..20: mol_type = other DNA
aggagagggaggagagtacc

SEQ ID NO: 56137 - DNA, 20 bp, synthetic construct
  misc_feature 1..20: note = CRISPR gRNA sequence
  source 1..20: mol_type = other DNA
aggagagtaccaggcatccc

SEQ ID NO: 56138 - DNA, 20 bp, synthetic construct
  misc_feature 1..20: note = CRISPR gRNA sequence
  source 1..20: mol_type = other DNA
gtaccaggcatccccagctg

SEQ ID NO: 56139 - DNA, 20 bp, synthetic construct
  misc_feature 1..20: note = CRISPR gRNA sequence
  source 1..20: mol_type = other DNA
ccccagctgaagacccttct

SEQ ID NO: 56140 - DNA, 20 bp, synthetic construct
  misc_feature 1..20: note = CRISPR gRNA sequence
  source 1..20: mol_type = other DNA
tgaagacccttctcagctcc

SEQ ID NO: 56141 - DNA, 20 bp, synthetic construct
  misc_feature 1..20: note = CRISPR gRNA sequence
  source 1..20: mol_type = other DNA
gaagacccttctcagctcca

SEQ ID NO: 56142 - DNA, 20 bp, synthetic construct
  misc_feature 1..20: note = CRISPR gRNA sequence
  source 1..20: mol_type = other DNA
cccttctcagctccaaggcc

SEQ ID NO: 56143 - DNA, 20 bp, synthetic construct
  misc_feature 1..20: note = CRISPR gRNA sequence
  source 1..20: mol_type = other DNA
ctccaaggcctggctcaccc

SEQ ID NO: 56144 - DNA, 20 bp, synthetic construct
  misc_feature 1..20: note = CRISPR gRNA sequence
  source 1..20: mol_type = other DNA
ctggctcaccccagcatctg

SEQ ID NO: 56145 - DNA, 20 bp, synthetic construct
  misc_feature 1..20: note = CRISPR gRNA sequence
  source 1..20: mol_type = other DNA
atctgcagcctccccattgt

SEQ ID NO: 56146 - DNA, 20 bp, synthetic construct
  misc_feature 1..20: note = CRISPR gRNA sequence
  source 1..20: mol_type = other DNA
gcagcctccccattgtcggc

SEQ ID NO: 56147 - DNA, 20 bp, synthetic construct
  misc_feature 1..20: note = CRISPR gRNA sequence
  source 1..20: mol_type = other DNA
ccccattgtcggcaagctcc

SEQ ID NO: 56148 - DNA, 20 bp, synthetic construct
  misc_feature 1..20: note = CRISPR gRNA sequence
  source 1..20: mol_type = other DNA
ccattgtcggcaagctcctg

SEQ ID NO: 56149 - DNA, 20 bp, synthetic construct
  misc_feature 1..20: note = CRISPR gRNA sequence
  source 1..20: mol_type = other DNA
attgtcggcaagctcctgga

SEQ ID NO: 56150 - DNA, 20 bp, synthetic construct
  misc_feature 1..20: note = CRISPR gRNA sequence
  source 1..20: mol_type = other DNA
ttgtcggcaagctcctggag

SEQ ID NO: 56151 - DNA, 20 bp, synthetic construct
  misc_feature 1..20: note = CRISPR gRNA sequence
  source 1..20: mol_type = other DNA
tgtcggcaagctcctggaga

SEQ ID NO: 56152 - DNA, 20 bp, synthetic construct
  misc_feature 1..20: note = CRISPR gRNA sequence
  source 1..20: mol_type = other DNA
tcctggagagggcttctgca

SEQ ID NO: 56153 - DNA, 20 bp, synthetic construct
  misc_feature 1..20: note = CRISPR gRNA sequence
  source 1..20: mol_type = other DNA
cctggagagggcttctgcaa

SEQ ID NO: 56154 - DNA, 20 bp, synthetic construct
  misc_feature 1..20: note = CRISPR gRNA sequence
  source 1..20: mol_type = other DNA
ccccacacttcctgctctta

SEQ ID NO: 56155 - DNA, 20 bp, synthetic construct
  misc_feature 1..20: note = CRISPR gRNA sequence
  source 1..20: mol_type = other DNA
cctgctcttaaagctgccat

SEQ ID NO: 56156 - DNA, 20 bp, synthetic construct
  misc_feature 1..20: note = CRISPR gRNA sequence
  source 1..20: mol_type = other DNA
gctcttaaagctgccataag

SEQ ID NO: 56157 - DNA, 20 bp, synthetic construct
  misc_feature 1..20: note = CRISPR gRNA sequence
  source 1..20: mol_type = other DNA
cttaaagctgccataagaag

SEQ ID NO: 56158 - DNA, 20 bp, synthetic construct
  misc_feature 1..20: note = CRISPR gRNA sequence
  source 1..20: mol_type = other DNA
agctgccataagaagaagcg

SEQ ID NO: 56159 - DNA, 20 bp, synthetic construct
  misc_feature 1..20: note = CRISPR gRNA sequence
  source 1..20: mol_type = other DNA
cataagaagaagcgaagtgt

SEQ ID NO: 56160 - DNA, 20 bp, synthetic construct
  misc_feature 1..20: note = CRISPR gRNA sequence
  source 1..20: mol_type = other DNA
taagaagaagcgaagtgtca

SEQ ID NO: 56161 - DNA, 20 bp, synthetic construct
  misc_feature 1..20: note = CRISPR gRNA sequence
  source 1..20: mol_type = other DNA
aagaagaagcgaagtgtcag

SEQ ID NO: 56162 - DNA, 20 bp, synthetic construct
  misc_feature 1..20: note = CRISPR gRNA sequence
  source 1..20: mol_type = other DNA
gaagcgaagtgtcagaggat

SEQ ID NO: 56163 - DNA, 20 bp, synthetic construct
  misc_feature 1..20: note = CRISPR gRNA sequence
  source 1..20: mol_type = other DNA
aagtgtcagaggatcagtgc

SEQ ID NO: 56164 - DNA, 20 bp, synthetic construct
  misc_feature 1..20: note = CRISPR gRNA sequence
  source 1..20: mol_type = other DNA
agtgtcagaggatcagtgct

SEQ ID NO: 56165 - DNA, 20 bp, synthetic construct
  misc_feature 1..20: note = CRISPR gRNA sequence
  source 1..20: mol_type = other DNA
gtcagaggatcagtgctggg

SEQ ID NO: 56166 - DNA, 20 bp, synthetic construct
  misc_feature 1..20: note = CRISPR gRNA sequence
  source 1..20: mol_type = other DNA
cagaggatcagtgctgggca

SEQ ID NO: 56167 - DNA, 20 bp, synthetic construct
  misc_feature 1..20: note = CRISPR gRNA sequence
  source 1..20: mol_type = other DNA
gatcagtgctgggcagagct

SEQ ID NO: 56168 - DNA, 20 bp, synthetic construct
  misc_feature 1..20: note = CRISPR gRNA sequence
  source 1..20: mol_type = other DNA
cagtgctgggcagagctgag

SEQ ID NO: 56169 - DNA, 20 bp, synthetic construct
  misc_feature 1..20: note = CRISPR gRNA sequence
  source 1..20: mol_type = other DNA
agaagtcatcgccatcccct

SEQ ID NO: 56170 - DNA, 20 bp, synthetic construct
  misc_feature 1..20: note = CRISPR gRNA sequence
  source 1..20: mol_type = other DNA
aagtcatcgccatcccctca

SEQ ID NO: 56171 - DNA, 20 bp, synthetic construct
  misc_feature 1..20: note = CRISPR gRNA sequence
  source 1..20: mol_type = other DNA
gtcatcgccatcccctcaga

SEQ ID NO: 56172 - DNA, 20 bp, synthetic construct
  misc_feature 1..20: note = CRISPR gRNA sequence
  source 1..20: mol_type = other DNA
tcgccatcccctcagagaga

SEQ ID NO: 56173 - DNA, 20 bp, synthetic construct
  misc_feature 1..20: note = CRISPR gRNA sequence
  source 1..20: mol_type = other DNA
cgccatcccctcagagagat

SEQ ID NO: 56174 - DNA, 20 bp, synthetic construct
  misc_feature 1..20: note = CRISPR gRNA sequence
  source 1..20: mol_type = other DNA
gccatcccctcagagagatg

SEQ ID NO: 56175 - DNA, 20 bp, synthetic construct
  misc_feature 1..20: note = CRISPR gRNA sequence
  source 1..20: mol_type = other DNA
cagagagatggggcttaata

SEQ ID NO: 56176 - DNA, 20 bp, synthetic construct
  misc_feature 1..20: note = CRISPR gRNA sequence
  source 1..20: mol_type = other DNA
agagatggggcttaatacag

SEQ ID NO: 56177 - DNA, 20 bp, synthetic construct
  misc_feature 1..20: note = CRISPR gRNA sequence
  source 1..20: mol_type = other DNA
gtactaacaaatacatatta

SEQ ID NO: 56178 - DNA, 20 bp, synthetic construct
  misc_feature 1..20: note = CRISPR gRNA sequence
  source 1..20: mol_type = other DNA
aacaaatacatattatggcc

SEQ ID NO: 56179 - DNA, 20 bp, synthetic construct
  misc_feature 1..20: note = CRISPR gRNA sequence
  source 1..20: mol_type = other DNA
agacttctaatcgtccacca

SEQ ID NO: 56180 - DNA, 20 bp, synthetic construct
  misc_feature 1..20: note = CRISPR gRNA sequence
  source 1..20: mol_type = other DNA
cccattctccacttcatcta

SEQ ID NO: 56181 - DNA, 20 bp, synthetic construct
  misc_feature 1..20: note = CRISPR gRNA sequence
  source 1..20: mol_type = other DNA
ctccacttcatctacagcaa

SEQ ID NO: 56182 - DNA, 20 bp, synthetic construct
  misc_feature 1..20: note = CRISPR gRNA sequence
  source 1..20: mol_type = other DNA
ccacttcatctacagcaata

SEQ ID NO: 56183 - DNA, 20 bp, synthetic construct
  misc_feature 1..20: note = CRISPR gRNA sequence
  source 1..20: mol_type = other DNA
tacagcaatagagctatcat

SEQ ID NO: 56184 - DNA, 20 bp, synthetic construct
  misc_feature 1..20: note = CRISPR gRNA sequence
  source 1..20: mol_type = other DNA
acagcaatagagctatcatg

SEQ ID NO: 56185 - DNA, 20 bp, synthetic construct
  misc_feature 1..20: note = CRISPR gRNA sequence
  source 1..20: mol_type = other DNA
tagagctatcatgaggaaca

SEQ ID NO: 56186 - DNA, 20 bp, synthetic construct
  misc_feature 1..20: note = CRISPR gRNA sequence
  source 1..20: mol_type = other DNA
tcatgaggaacatggtttcc

SEQ ID NO: 56187 - DNA, 20 bp, synthetic construct
  misc_feature 1..20: note = CRISPR gRNA sequence
  source 1..20: mol_type = other DNA
gaggaacatggtttcccagc

SEQ ID NO: 56188 - DNA, 20 bp, synthetic construct
  misc_feature 1..20: note = CRISPR gRNA sequence
  source 1..20: mol_type = other DNA
ggaacatggtttcccagcca

SEQ ID NO: 56189 - DNA, 20 bp, synthetic construct
  misc_feature 1..20: note = CRISPR gRNA sequence
  source 1..20: mol_type = other DNA
cagccagagatcacatttcc

SEQ ID NO: 56190 - DNA, 20 bp, synthetic construct
  misc_feature 1..20: note = CRISPR gRNA sequence
  source 1..20: mol_type = other DNA
acatttcccagcctcccttg

SEQ ID NO: 56191 - DNA, 20 bp, synthetic construct
  misc_feature 1..20: note = CRISPR gRNA sequence
  source 1..20: mol_type = other DNA
tcccagcctcccttgcagct

SEQ ID NO: 56192 - DNA, 20 bp, synthetic construct
  misc_feature 1..20: note = CRISPR gRNA sequence
  source 1..20: mol_type = other DNA
gcctcccttgcagctcagtg

SEQ ID NO: 56193 - DNA, 20 bp, synthetic construct
  misc_feature 1..20: note = CRISPR gRNA sequence
  source 1..20: mol_type = other DNA
cccttgcagctcagtgtggc

SEQ ID NO: 56194 - DNA, 20 bp, synthetic construct
  misc_feature 1..20: note = CRISPR gRNA sequence
  source 1..20: mol_type = other DNA
ccttgcagctcagtgtggcc

SEQ ID NO: 56195 - DNA, 20 bp, synthetic construct
  misc_feature 1..20: note = CRISPR gRNA sequence
  source 1..20: mol_type = other DNA
ggtgactatgttctcaccaa

SEQ ID NO: 56196 - DNA, 20 bp, synthetic construct
  misc_feature 1..20: note = CRISPR gRNA sequence
  source 1..20: mol_type = other DNA
tgttctcaccaatggaatgt

SEQ ID NO: 56197 - DNA, 20 bp, synthetic construct
  misc_feature 1..20: note = CRISPR gRNA sequence
  source 1..20: mol_type = other DNA
tctcaccaatggaatgtgag

SEQ ID NO: 56198 - DNA, 20 bp, synthetic construct
  misc_feature 1..20: note = CRISPR gRNA sequence
  source 1..20: mol_type = other DNA
caccaatggaatgtgagtgg

SEQ ID NO: 56199 - DNA, 20 bp, synthetic construct
  misc_feature 1..20: note = CRISPR gRNA sequence
  source 1..20: mol_type = other DNA
accaatggaatgtgagtgga

SEQ ID NO: 56200 - DNA, 20 bp, synthetic construct
  misc_feature 1..20: note = CRISPR gRNA sequence
  source 1..20: mol_type = other DNA
ccaatggaatgtgagtggaa

SEQ ID NO: 56201 - DNA, 20 bp, synthetic construct
  misc_feature 1..20: note = CRISPR gRNA sequence
  source 1..20: mol_type = other DNA
tgagtggaagggatgtatcc

SEQ ID NO: 56202 - DNA, 20 bp, synthetic construct
  misc_feature 1..20: note = CRISPR gRNA sequence
  source 1..20: mol_type = other DNA
gaagggatgtatcctagttt

SEQ ID NO: 56203 - DNA, 20 bp, synthetic construct
  misc_feature 1..20: note = CRISPR gRNA sequence
  source 1..20: mol_type = other DNA
aagggatgtatcctagtttc

SEQ ID NO: 56204 - DNA, 20 bp, synthetic construct
  misc_feature 1..20: note = CRISPR gRNA sequence
  source 1..20: mol_type = other DNA
catgctctttccttgttccc

SEQ ID NO: 56205 - DNA, 20 bp, synthetic construct
  misc_feature 1..20: note = CRISPR gRNA sequence
  source 1..20: mol_type = other DNA
ctctttccttgttcccaagc

SEQ ID NO: 56206 - DNA, 20 bp, synthetic construct
  misc_feature 1..20: note = CRISPR gRNA sequence
  source 1..20: mol_type = other DNA
ctttccttgttcccaagcca

SEQ ID NO: 56207 - DNA, 20 bp, synthetic construct
  misc_feature 1..20: note = CRISPR gRNA sequence
  source 1..20: mol_type = other DNA
cttgttcccaagccagagca

SEQ ID NO: 56208 - DNA, 20 bp, synthetic construct
  misc_feature 1..20: note = CRISPR gRNA sequence
  source 1..20: mol_type = other DNA
gcacagatatacccatgacg

SEQ ID NO: 56209 - DNA, 20 bp, synthetic construct
  misc_feature 1..20: note = CRISPR gRNA sequence
  source 1..20: mol_type = other DNA
atgacgtagctttgactgtg

SEQ ID NO: 56210 - DNA, 20 bp, synthetic construct
  misc_feature 1..20: note = CRISPR gRNA sequence
  source 1..20: mol_type = other DNA
cgtagctttgactgtgcaga

SEQ ID NO: 56211 - DNA, 20 bp, synthetic construct
  misc_feature 1..20: note = CRISPR gRNA sequence
  source 1..20: mol_type = other DNA
gtagctttgactgtgcagat

SEQ ID NO: 56212 - DNA, 20 bp, synthetic construct
  misc_feature 1..20: note = CRISPR gRNA sequence
  source 1..20: mol_type = other DNA
actgtgcagataggattccc

SEQ ID NO: 56213 - DNA, 20 bp, synthetic construct
  misc_feature 1..20: note = CRISPR gRNA sequence
  source 1..20: mol_type = other DNA
ctgtgcagataggattccca

SEQ ID NO: 56214 - DNA, 20 bp, synthetic construct
  misc_feature 1..20: note = CRISPR gRNA sequence
  source 1..20: mol_type = other DNA
tgtgcagataggattcccaa

SEQ ID NO: 56215 - DNA, 20 bp, synthetic construct
  misc_feature 1..20: note = CRISPR gRNA sequence
  source 1..20: mol_type = other DNA
gtgcagataggattcccaag

SEQ ID NO: 56216 - DNA, 20 bp, synthetic construct
  misc_feature 1..20: note = CRISPR gRNA sequence
  source 1..20: mol_type = other DNA
taggattcccaaggggataa

SEQ ID NO: 56217 - DNA, 20 bp, synthetic construct
  misc_feature 1..20: note = CRISPR gRNA sequence
  source 1..20: mol_type = other DNA
ggattcccaaggggataatg

SEQ ID NO: 56218 - DNA, 20 bp, synthetic construct
  misc_feature 1..20: note = CRISPR gRNA sequence
  source 1..20: mol_type = other DNA
aaggggataatggagcaaaa

SEQ ID NO: 56219 - DNA, 20 bp, synthetic construct
  misc_feature 1..20: note = CRISPR gRNA sequence
  source 1..20: mol_type = other DNA
aggggataatggagcaaaat

SEQ ID NO: 56220 - DNA, 20 bp, synthetic construct
  misc_feature 1..20: note = CRISPR gRNA sequence
  source 1..20: mol_type = other DNA
gggataatggagcaaaatgg

SEQ ID NO: 56221 - DNA, 20 bp, synthetic construct
  misc_feature 1..20: note = CRISPR gRNA sequence
  source 1..20: mol_type = other DNA
ggataatggagcaaaatggg

SEQ ID NO: 56222 - DNA, 20 bp, synthetic construct
  misc_feature 1..20: note = CRISPR gRNA sequence
  source 1..20: mol_type = other DNA
gataatggagcaaaatggga

SEQ ID NO: 56223 - DNA, 20 bp, synthetic construct
  misc_feature 1..20: note = CRISPR gRNA sequence
  source 1..20: mol_type = other DNA
ggagcaaaatgggagggacc

SEQ ID NO: 56224 - DNA, 20 bp, synthetic construct
  misc_feature 1..20: note = CRISPR gRNA sequence
  source 1..20: mol_type = other DNA
gagcaaaatgggagggacct

SEQ ID NO: 56225 - DNA, 20 bp, synthetic construct
  misc_feature 1..20: note = CRISPR gRNA sequence
  source 1..20: mol_type = other DNA
tgggtacctgcatgactgcg

SEQ ID NO: 56226 - DNA, 20 bp, synthetic construct
  misc_feature 1..20: note = CRISPR gRNA sequence
  source 1..20: mol_type = other DNA
ggtacctgcatgactgcgtg

SEQ ID NO: 56227 - DNA, 20 bp, synthetic construct
  misc_feature 1..20: note = CRISPR gRNA sequence
  source 1..20: mol_type = other DNA
ctgcatgactgcgtggagct

SEQ ID NO: 56228 - DNA, 20 bp, synthetic construct
  misc_feature 1..20: note = CRISPR gRNA sequence
  source 1..20: mol_type = other DNA
gctgagccattccactgacc

SEQ ID NO: 56229 - DNA, 20 bp, synthetic construct
  misc_feature 1..20: note = CRISPR gRNA sequence
  source 1..20: mol_type = other DNA
cctacctctgactcttccat

SEQ ID NO: 56230 - DNA, 20 bp, synthetic construct
  misc_feature 1..20: note = CRISPR gRNA sequence
  source 1..20: mol_type = other DNA
tacctctgactcttccatga

SEQ ID NO: 56231 - DNA, 20 bp, synthetic construct
  misc_feature 1..20: note = CRISPR gRNA sequence
  source 1..20: mol_type = other DNA
cctctgactcttccatgaga

SEQ ID NO: 56232 - DNA, 20 bp, synthetic construct
  misc_feature 1..20: note = CRISPR gRNA sequence
  source 1..20: mol_type = other DNA
attatttaacctactgtatt

SEQ ID NO: 56233 - DNA, 20 bp, synthetic construct
  misc_feature 1..20: note = CRISPR gRNA sequence
  source 1..20: mol_type = other DNA
ttatttaacctactgtattt

SEQ ID NO: 56234 - DNA, 20 bp, synthetic construct
  misc_feature 1..20: note = CRISPR gRNA sequence
  source 1..20: mol_type = other DNA
tatttaacctactgtatttg

SEQ ID NO: 56235 - DNA, 20 bp, synthetic construct
  misc_feature 1..20: note = CRISPR gRNA sequence
  source 1..20: mol_type = other DNA
tttaacctactgtatttggg

SEQ ID NO: 56236 - DNA, 20 bp, synthetic construct
  misc_feature 1..20: note = CRISPR gRNA sequence
  source 1..20: mol_type = other DNA
ttaacctactgtatttgggg

SEQ ID NO: 56237 - DNA, 20 bp, synthetic construct
  misc_feature 1..20: note = CRISPR gRNA sequence
  source 1..20: mol_type = other DNA
aacctactgtatttggggag

SEQ ID NO: 56238 - DNA, 20 bp, synthetic construct
  misc_feature 1..20: note = CRISPR gRNA sequence
  source 1..20: mol_type = other DNA
acctactgtatttggggagg

SEQ ID NO: 56239 - DNA, 20 bp, synthetic construct
  misc_feature 1..20: note = CRISPR gRNA sequence
  source 1..20: mol_type = other DNA
aggaggtttctctgttactg

SEQ ID NO: 56240 - DNA, 20 bp, synthetic construct
  misc_feature 1..20: note = CRISPR gRNA sequence
  source 1..20: mol_type = other DNA
gtttctctgttactgcagcc

SEQ ID NO: 56241 - DNA, 20 bp, synthetic construct
  misc_feature 1..20: note = CRISPR gRNA sequence
  source 1..20: mol_type = other DNA
ctgcagcctagccttttctc

SEQ ID NO: 56242 - DNA, 20 bp, synthetic construct
  misc_feature 1..20: note = CRISPR gRNA sequence
  source 1..20: mol_type = other DNA
ctctagctaatatgcacact

SEQ ID NO: 56243 - DNA, 20 bp, synthetic construct
  misc_feature 1..20: note = CRISPR gRNA sequence
  source 1..20: mol_type = other DNA
actgagcctttgctctgtgc

SEQ ID NO: 56244 - DNA, 20 bp, synthetic construct
  misc_feature 1..20: note = CRISPR gRNA sequence
  source 1..20: mol_type = other DNA
ctgagcctttgctctgtgct

SEQ ID NO: 56245 - DNA, 20 bp, synthetic construct
  misc_feature 1..20: note = CRISPR gRNA sequence
  source 1..20: mol_type = other DNA
cattcttgcaatgaccatat

SEQ ID NO: 56246 - DNA, 20 bp, synthetic construct
  misc_feature 1..20: note = CRISPR gRNA sequence
  source 1..20: mol_type = other DNA
cttgcaatgaccatatgagt

SEQ ID NO: 56247 - DNA, 20 bp, synthetic construct
  misc_feature 1..20: note = CRISPR gRNA sequence
  source 1..20: mol_type = other DNA
atatgagttggctattgtta

SEQ ID NO: 56248 - DNA, 20 bp, synthetic construct
  misc_feature 1..20: note = CRISPR gRNA sequence
  source 1..20: mol_type = other DNA
ctattgttacagattcgttt

SEQ ID NO: 56249 - DNA, 20 bp, synthetic construct
  misc_feature 1..20: note = CRISPR gRNA sequence
  source 1..20: mol_type = other DNA
tattgttacagattcgtttt

SEQ ID NO: 56250 - DNA, 20 bp, synthetic construct
  misc_feature 1..20: note = CRISPR gRNA sequence
  source 1..20: mol_type = other DNA
acagattcgttttaggaacg

SEQ ID NO: 56251 - DNA, 20 bp, synthetic construct
  misc_feature 1..20: note = CRISPR gRNA sequence
  source 1..20: mol_type = other DNA
ttttaggaacgaagaaactc

SEQ ID NO: 56252 - DNA, 20 bp, synthetic construct
  misc_feature 1..20: note = CRISPR gRNA sequence
  source 1..20: mol_type = other DNA
ggaacgaagaaactctggcc

SEQ ID NO: 56253 - DNA, 20 bp, synthetic construct
  misc_feature 1..20: note = CRISPR gRNA sequence
  source 1..20: mol_type = other DNA
cgaagaaactctggcctaga

SEQ ID NO: 56254 - DNA, 20 bp, synthetic construct
  misc_feature 1..20: note = CRISPR gRNA sequence
  source 1..20: mol_type = other DNA
gtgctccatatacttgccca

SEQ ID NO: 56255 - DNA, 20 bp, synthetic construct
  misc_feature 1..20: note = CRISPR gRNA sequence
  source 1..20: mol_type = other DNA
tatacttgcccaaagtccac

SEQ ID NO: 56256 - DNA, 20 bp, synthetic construct
  misc_feature 1..20: note = CRISPR gRNA sequence
  source 1..20: mol_type = other DNA
ccaaagtccaccagcctcta

SEQ ID NO: 56257 - DNA, 20 bp, synthetic construct
  misc_feature 1..20: note = CRISPR gRNA sequence
  source 1..20: mol_type = other DNA
agtccaccagcctctataga

SEQ ID NO: 56258 - DNA, 20 bp, synthetic construct
  misc_feature 1..20: note = CRISPR gRNA sequence
  source 1..20: mol_type = other DNA
accagcctctatagacagcc

SEQ ID NO: 56259 - DNA, 20 bp, synthetic construct
  misc_feature 1..20: note = CRISPR gRNA sequence
  source 1..20: mol_type = other DNA
ctatagacagcctggatctg

SEQ ID NO: 56260 - DNA, 20 bp, synthetic construct
  misc_feature 1..20: note = CRISPR gRNA sequence
  source 1..20: mol_type = other DNA
acagcctggatctgtggttt

SEQ ID NO: 56261 - DNA, 20 bp, synthetic construct
  misc_feature 1..20: note = CRISPR gRNA sequence
  source 1..20: mol_type = other DNA
tggtttcagcccatgattga

SEQ ID NO: 56262 - DNA, 20 bp, synthetic construct
  misc_feature 1..20: note = CRISPR gRNA sequence
  source 1..20: mol_type = other DNA
gtttcagcccatgattgaca

SEQ ID NO: 56263 - DNA, 20 bp, synthetic construct
  misc_feature 1..20: note = CRISPR gRNA sequence
  source 1..20: mol_type = other DNA
ttcagcccatgattgacaga

SEQ ID NO: 56264 - DNA, 20 bp, synthetic construct
  misc_feature 1..20: note = CRISPR gRNA sequence
  source 1..20: mol_type = other DNA
ccatgattgacagagagact

SEQ ID NO: 56265 - DNA, 20 bp, synthetic construct
  misc_feature 1..20: note = CRISPR gRNA sequence
  source 1..20: mol_type = other DNA
atgattgacagagagactga

SEQ ID NO: 56266 - DNA, 20 bp, synthetic construct
  misc_feature 1..20: note = CRISPR gRNA sequence
  source 1..20: mol_type = other DNA
tgacagagagactgagagtc

SEQ ID NO: 56267 - DNA, 20 bp, synthetic construct
  misc_feature 1..20: note = CRISPR gRNA sequence
  source 1..20: mol_type = other DNA
gactgagagtccagaaacca

SEQ ID NO: 56268 - DNA, 20 bp, synthetic construct
  misc_feature 1..20: note = CRISPR gRNA sequence
  source 1..20: mol_type = other DNA
agagtccagaaaccacagac

SEQ ID NO: 56269 - DNA, 20 bp, synthetic construct
  misc_feature 1..20: note = CRISPR gRNA sequence
  source 1..20: mol_type = other DNA
agtccagaaaccacagacaa

SEQ ID NO: 56270 - DNA, 20 bp, synthetic construct
  misc_feature 1..20: note = CRISPR gRNA sequence
  source 1..20: mol_type = other DNA
gtccagaaaccacagacaag

SEQ ID NO: 56271 - DNA, 20 bp, synthetic construct
  misc_feature 1..20: note = CRISPR gRNA sequence
  source 1..20: mol_type = other DNA
ccagaaaccacagacaagag

SEQ ID NO: 56272 - DNA, 20 bp, synthetic construct
  misc_feature 1..20: note = CRISPR gRNA sequence
  source 1..20: mol_type = other DNA
cagaaaccacagacaagagg

SEQ ID NO: 56273 - DNA, 20 bp, synthetic construct
  misc_feature 1..20: note = CRISPR gRNA sequence
  source 1..20: mol_type = other DNA
agacaagaggaggatccatt

SEQ ID NO: 56274 - DNA, 20 bp, synthetic construct
  misc_feature 1..20: note = CRISPR gRNA sequence
  source 1..20: mol_type = other DNA
aggaggatccatttggactc

SEQ ID NO: 56275 - DNA, 20 bp, synthetic construct
  misc_feature 1..20: note = CRISPR gRNA sequence
  source 1..20: mol_type = other DNA
gaggatccatttggactcca

SEQ ID NO: 56276 - DNA, 20 bp, synthetic construct
  misc_feature 1..20: note = CRISPR gRNA sequence
  source 1..20: mol_type = other DNA
aggatccatttggactccag

SEQ ID NO: 56277 - DNA, 20 bp, synthetic construct
  misc_feature 1..20: note = CRISPR gRNA sequence
  source 1..20: mol_type = other DNA
tggactccagaggtcctgtc

SEQ ID NO: 56278 - DNA, 20 bp, synthetic construct
  misc_feature 1..20: note = CRISPR gRNA sequence
  source 1..20: mol_type = other DNA
ggactccagaggtcctgtca

SEQ ID NO: 56279 - DNA, 20 bp, synthetic construct
  misc_feature 1..20: note = CRISPR gRNA sequence
  source 1..20: mol_type = other DNA
ccagaggtcctgtcaaggta

SEQ ID NO: 56280 - DNA, 20 bp, synthetic construct
  misc_feature 1..20: note = CRISPR gRNA sequence
  source 1..20: mol_type = other DNA
agaggtcctgtcaaggtatg

SEQ ID NO: 56281 - DNA, 20 bp, synthetic construct
  misc_feature 1..20: note = CRISPR gRNA sequence
  source 1..20: mol_type = other DNA
gagcttcctctcttgcattg

SEQ ID NO: 56282 - DNA, 20 bp, synthetic construct
  misc_feature 1..20: note = CRISPR gRNA sequence
  source 1..20: mol_type = other DNA
agcttcctctcttgcattgc

SEQ ID NO: 56283 - DNA, 20 bp, synthetic construct
  misc_feature 1..20: note = CRISPR gRNA sequence
  source 1..20: mol_type = other DNA
gccattatgttctgatattc

SEQ ID NO: 56284 - DNA, 20 bp, synthetic construct
  misc_feature 1..20: note = CRISPR gRNA sequence
  source 1..20: mol_type = other DNA
tgatattcaagattcttatc

SEQ ID NO: 56285 - DNA, 20 bp, synthetic construct
  misc_feature 1..20: note = CRISPR gRNA sequence
  source 1..20: mol_type = other DNA
agattcttatccagtcctct

SEQ ID NO: 56286 - DNA, 20 bp, synthetic construct
  misc_feature 1..20: note = CRISPR gRNA sequence
  source 1..20: mol_type = other DNA
ttcttatccagtcctcttgg

SEQ ID NO: 56287 - DNA, 20 bp, synthetic construct
  misc_feature 1..20: note = CRISPR gRNA sequence
  source 1..20: mol_type = other DNA
cttatccagtcctcttggca

SEQ ID NO: 56288 - DNA, 20 bp, synthetic construct
  misc_feature 1..20: note = CRISPR gRNA sequence
  source 1..20: mol_type = other DNA
ttatccagtcctcttggcag

SEQ ID NO: 56289 - DNA, 20 bp, synthetic construct
  misc_feature 1..20: note = CRISPR gRNA sequence
  source 1..20: mol_type = other DNA
tcctcttggcagaggtttgc

SEQ ID NO: 56290 - DNA, 20 bp, synthetic construct
  misc_feature 1..20: note = CRISPR gRNA sequence
  source 1..20: mol_type = other DNA
ttggcagaggtttgctagac

SEQ ID NO: 56291 - DNA, 20 bp, synthetic construct
  misc_feature 1..20: note = CRISPR gRNA sequence
  source 1..20: mol_type = other DNA
cagaggtttgctagactggt

SEQ ID NO: 56292 - DNA, 20 bp, synthetic construct
  misc_feature 1..20: note = CRISPR gRNA sequence
  source 1..20: mol_type = other DNA
gttggcctctgctcccccaa

SEQ ID NO: 56293 - DNA, 20 bp, synthetic construct
  misc_feature 1..20: note = CRISPR gRNA sequence
  source 1..20: mol_type = other DNA
caaaagcccaatcccctccc

SEQ ID NO: 56294 - DNA, 20 bp, synthetic construct
  misc_feature 1..20: note = CRISPR gRNA sequence
  source 1..20: mol_type = other DNA
tcctccactcttactcacct

SEQ ID NO: 56295 - DNA, 20 bp, synthetic construct
  misc_feature 1..20: note = CRISPR gRNA sequence
  source 1..20: mol_type = other DNA
tgagattctctatctgccca

SEQ ID NO: 56296 - DNA, 20 bp, synthetic construct
  misc_feature 1..20: note = CRISPR gRNA sequence
  source 1..20: mol_type = other DNA
tctatctgcccacagcctac

SEQ ID NO: 56297 - DNA, 20 bp, synthetic construct
  misc_feature 1..20: note = CRISPR gRNA sequence
  source 1..20: mol_type = other DNA
tatctgcccacagcctacca

SEQ ID NO: 56298 - DNA, 20 bp, synthetic construct
  misc_feature 1..20: note = CRISPR gRNA sequence
  source 1..20: mol_type = other DNA
cccacagcctaccagagcct

SEQ ID NO: 56299 - DNA, 20 bp, synthetic construct
  misc_feature 1..20: note = CRISPR gRNA sequence
  source 1..20: mol_type = other DNA
ccacagcctaccagagcctc

SEQ ID NO: 56300 - DNA, 20 bp, synthetic construct
  misc_feature 1..20: note = CRISPR gRNA sequence
  source 1..20: mol_type = other DNA
cacagcctaccagagcctca

SEQ ID NO: 56301 - DNA, 20 bp, synthetic construct
  misc_feature 1..20: note = CRISPR gRNA sequence
  source 1..20: mol_type = other DNA
agcctaccagagcctcaggg

SEQ ID NO: 56302 - DNA, 20 bp, synthetic construct
  misc_feature 1..20: note = CRISPR gRNA sequence
  source 1..20: mol_type = other DNA
ctaccagagcctcagggcag

SEQ ID NO: 56303 - DNA, 20 bp, synthetic construct
  misc_feature 1..20: note = CRISPR gRNA sequence
  source 1..20: mol_type = other DNA
taccagagcctcagggcagt

SEQ ID NO: 56304 - DNA, 20 bp, synthetic construct
  misc_feature 1..20: note = CRISPR gRNA sequence
  source 1..20: mol_type = other DNA
accagagcctcagggcagtg

SEQ ID NO: 56305 - DNA, 20 bp, synthetic construct
  misc_feature 1..20: note = CRISPR gRNA sequence
  source 1..20: mol_type = other DNA
gcctcagggcagtggggctc

SEQ ID NO: 56306 - DNA, 20 bp, synthetic construct
  misc_feature 1..20: note = CRISPR gRNA sequence
  source 1..20: mol_type = other DNA
cctcagggcagtggggctcc

SEQ ID NO: 56307 - DNA, 20 bp, synthetic construct
  misc_feature 1..20: note = CRISPR gRNA sequence
  source 1..20: mol_type = other DNA
ctcagggcagtggggctcca

SEQ ID NO: 56308 - DNA, 20 bp, synthetic construct
  misc_feature 1..20: note = CRISPR gRNA sequence
  source 1..20: mol_type = other DNA
tcagggcagtggggctccag

SEQ ID NO: 56309 - DNA, 20 bp, synthetic construct
  misc_feature 1..20: note = CRISPR gRNA sequence
  source 1..20: mol_type = other DNA
ggcagtggggctccagggga

SEQ ID NO: 56310 - DNA, 20 bp, synthetic construct
  misc_feature 1..20: note = CRISPR gRNA sequence
  source 1..20: mol_type = other DNA
aggggacagccatcaaaatc

SEQ ID NO: 56311 - DNA, 20 bp, synthetic construct
  misc_feature 1..20: note = CRISPR gRNA sequence
  source 1..20: mol_type = other DNA
ggggacagccatcaaaatcc

SEQ ID NO: 56312 - DNA, 20 bp, synthetic construct
  misc_feature 1..20: note = CRISPR gRNA sequence
  source 1..20: mol_type = other DNA
gacagccatcaaaatccagg

SEQ ID NO: 56313 - DNA, 20 bp, synthetic construct
  misc_feature 1..20: note = CRISPR gRNA sequence
  source 1..20: mol_type = other DNA
gccatcaaaatccaggtgga

SEQ ID NO: 56314 - DNA, 20 bp, synthetic construct
  misc_feature 1..20: note = CRISPR gRNA sequence
  source 1..20: mol_type = other DNA
ccatcaaaatccaggtggat

SEQ ID NO: 56315 - DNA, 20 bp, synthetic construct
  misc_feature 1..20: note = CRISPR gRNA sequence
  source 1..20: mol_type = other DNA
catcaaaatccaggtggatg

SEQ ID NO: 56316 - DNA, 20 bp, synthetic construct
  misc_feature 1..20: note = CRISPR gRNA sequence
  source 1..20: mol_type = other DNA
atcaaaatccaggtggatgg

SEQ ID NO: 56317 - DNA, 20 bp, synthetic construct
  misc_feature 1..20: note = CRISPR gRNA sequence
  source 1..20: mol_type = other DNA
atgggggcctccctgtgctc

SEQ ID NO: 56318 - DNA, 20 bp, synthetic construct
  misc_feature 1..20: note = CRISPR gRNA sequence
  source 1..20: mol_type = other DNA
tgggggcctccctgtgctct

SEQ ID NO: 56319 - DNA, 20 bp, synthetic construct
  misc_feature 1..20: note = CRISPR gRNA sequence
  source 1..20: mol_type = other DNA
ctccctgtgctctaggatgt

SEQ ID NO: 56320 - DNA, 20 bp, synthetic construct
  misc_feature 1..20: note = CRISPR gRNA sequence
  source 1..20: mol_type = other DNA
ctgtgctctaggatgttggt

SEQ ID NO: 56321 - DNA, 20 bp, synthetic construct
  misc_feature 1..20: note = CRISPR gRNA sequence
  source 1..20: mol_type = other DNA
tgtgctctaggatgttggtc

SEQ ID NO: 56322 - DNA, 20 bp, synthetic construct
  misc_feature 1..20: note = CRISPR gRNA sequence
  source 1..20: mol_type = other DNA
gtgctctaggatgttggtca

SEQ ID NO: 56323 - DNA, 20 bp, synthetic construct
  misc_feature 1..20: note = CRISPR gRNA sequence
  source 1..20: mol_type = other DNA
ctctaggatgttggtcaggg

SEQ ID NO: 56324 - DNA, 20 bp, synthetic construct
  misc_feature 1..20: note = CRISPR gRNA sequence
  source 1..20: mol_type = other DNA
aggatgttggtcagggtggc

SEQ ID NO: 56325 - DNA, 20 bp, synthetic construct
  misc_feature 1..20: note = CRISPR gRNA sequence
  source 1..20: mol_type = other DNA
ggatgttggtcagggtggcc

SEQ ID NO: 56326 - DNA, 20 bp, synthetic construct
  misc_feature 1..20: note = CRISPR gRNA sequence
  source 1..20: mol_type = other DNA
gttggtcagggtggccaggt

SEQ ID NO: 56327 - DNA, 20 bp, synthetic construct
  misc_feature 1..20: note = CRISPR gRNA sequence
  source 1..20: mol_type = other DNA
tcagggtggccaggtcggtg

SEQ ID NO: 56328 - DNA, 20 bp, synthetic construct
  misc_feature 1..20: note = CRISPR gRNA sequence
  source 1..20: mol_type = other DNA
cagggtggccaggtcggtgc

SEQ ID NO: 56329 - DNA, 20 bp, synthetic construct
  misc_feature 1..20: note = CRISPR gRNA sequence
  source 1..20: mol_type = other DNA
gtggccaggtcggtgcaggt

SEQ ID NO: 56330 - DNA, 20 bp, synthetic construct
  misc_feature 1..20: note = CRISPR gRNA sequence
  source 1..20: mol_type = other DNA
gccaggtcggtgcaggtcag

SEQ ID NO: 56331 - DNA, 20 bp, synthetic construct
  misc_feature 1..20: note = CRISPR gRNA sequence
  source 1..20: mol_type = other DNA
ccaggtcggtgcaggtcagt

SEQ ID NO: 56332 - DNA, 20 bp, synthetic construct
  misc_feature 1..20: note = CRISPR gRNA sequence
  source 1..20: mol_type = other DNA
tgcaggtcagtgggaaattg

SEQ ID NO: 56333 - DNA, 20 bp, synthetic construct
  misc_feature 1..20: note = CRISPR gRNA sequence
  source 1..20: mol_type = other DNA
aggtcagtgggaaattgtgg

SEQ ID NO: 56334 - DNA, 20 bp, synthetic construct
  misc_feature 1..20: note = CRISPR gRNA sequence
  source 1..20: mol_type = other DNA
ggtcagtgggaaattgtgga

SEQ ID NO: 56335 - DNA, 20 bp, synthetic construct
  misc_feature 1..20: note = CRISPR gRNA sequence
  source 1..20: mol_type = other DNA
gtcagtgggaaattgtggaa

SEQ ID NO: 56336 - DNA, 20 bp, synthetic construct
  misc_feature 1..20: note = CRISPR gRNA sequence
  source 1..20: mol_type = other DNA
agtgggaaattgtggaaggg

SEQ ID NO: 56337 - DNA, 20 bp, synthetic construct
  misc_feature 1..20: note = CRISPR gRNA sequence
  source 1..20: mol_type = other DNA
aattgtggaagggcagttga

SEQ ID NO: 56338 - DNA, 20 bp, synthetic construct
  misc_feature 1..20: note = CRISPR gRNA sequence
  source 1..20: mol_type = other DNA
attgtggaagggcagttgat

SEQ ID NO: 56339 - DNA, 20 bp, synthetic construct
  misc_feature 1..20: note = CRISPR gRNA sequence
  source 1..20: mol_type = other DNA
ttgtggaagggcagttgata

SEQ ID NO: 56340 - DNA, 20 bp, synthetic construct
  misc_feature 1..20: note = CRISPR gRNA sequence
  source 1..20: mol_type = other DNA
tgtggaagggcagttgatag

SEQ ID NO: 56341 - DNA, 20 bp, synthetic construct
  misc_feature 1..20: note = CRISPR gRNA sequence
  source 1..20: mol_type = other DNA
tggaagggcagttgataggg

SEQ ID NO: 56342 - DNA, 20 bp, synthetic construct
  misc_feature 1..20: note = CRISPR gRNA sequence
  source 1..20: mol_type = other DNA
ggaagggcagttgatagggg

SEQ ID NO: 56343 - DNA, 20 bp, synthetic construct
  misc_feature 1..20: note = CRISPR gRNA sequence
  source 1..20: mol_type = other DNA
ttgataggggaggctttgtg

SEQ ID NO: 56344 - DNA, 20 bp, synthetic construct
  misc_feature 1..20: note = CRISPR gRNA sequence
  source 1..20: mol_type = other DNA
taggggaggctttgtgcggt

SEQ ID NO: 56345 - DNA, 20 bp, synthetic construct
  misc_feature 1..20: note = CRISPR gRNA sequence
  source 1..20: mol_type = other DNA
gaggctttgtgcggtgagac

SEQ ID NO: 56346 - DNA, 20 bp, synthetic construct
  misc_feature 1..20: note = CRISPR gRNA sequence
  source 1..20: mol_type = other DNA
ctttgtgcggtgagactggc

SEQ ID NO: 56347 - DNA, 20 bp, synthetic construct
  misc_feature 1..20: note = CRISPR gRNA sequence
  source 1..20: mol_type = other DNA
tgcggtgagactggccagct

SEQ ID NO: 56348 - DNA, 20 bp, synthetic construct
  misc_feature 1..20: note = CRISPR gRNA sequence
  source 1..20: mol_type = other DNA
gcggtgagactggccagctc

SEQ ID NO: 56349 - DNA, 20 bp, synthetic construct
  misc_feature 1..20: note = CRISPR gRNA sequence
  source 1..20: mol_type = other DNA
gctcctgtgtctcatccaca

SEQ ID NO: 56350 - DNA, 20 bp, synthetic construct
  misc_feature 1..20: note = CRISPR gRNA sequence
  source 1..20: mol_type = other DNA
gtctcatccacacagtgaca

SEQ ID NO: 56351 - DNA, 20 bp, synthetic construct
  misc_feature 1..20: note = CRISPR gRNA sequence
  source 1..20: mol_type = other DNA
tgacacagctctacaacctt

SEQ ID NO: 56352 - DNA, 20 bp, synthetic construct
  misc_feature 1..20: note = CRISPR gRNA sequence
  source 1..20: mol_type = other DNA
tctacaacctttggccctgt

SEQ ID NO: 56353 - DNA, 20 bp, synthetic construct
  misc_feature 1..20: note = CRISPR gRNA sequence
  source 1..20: mol_type = other DNA
cctttggccctgtgagcttg

SEQ ID NO: 56354 - DNA, 20 bp, synthetic construct
  misc_feature 1..20: note = CRISPR gRNA sequence
  source 1..20: mol_type = other DNA
ctttggccctgtgagcttgc

SEQ ID NO: 56355 - DNA, 20 bp, synthetic construct
  misc_feature 1..20: note = CRISPR gRNA sequence
  source 1..20: mol_type = other DNA
tggccctgtgagcttgcggg

SEQ ID NO: 56356 - DNA, 20 bp, synthetic construct
  misc_feature 1..20: note = CRISPR gRNA sequence
  source 1..20: mol_type = other DNA
cttcttcaacacctgcacta

SEQ ID NO: 56357 - DNA, 20 bp, synthetic construct
  misc_feature 1..20: note = CRISPR gRNA sequence
  source 1..20: mol_type = other DNA
cttcaacacctgcactacag

SEQ ID NO: 56358 - DNA, 20 bp, synthetic construct
  misc_feature 1..20: note = CRISPR gRNA sequence
  source 1..20: mol_type = other DNA
ctgcactacagcagcctgct

SEQ ID NO: 56359 - DNA, 20 bp, synthetic construct
  misc_feature 1..20: note = CRISPR gRNA sequence
  source 1..20: mol_type = other DNA
cagcctgcttggcacccaca

SEQ ID NO: 56360 - DNA, 20 bp, synthetic construct
  misc_feature 1..20: note = CRISPR gRNA sequence
  source 1..20: mol_type = other DNA
cagtcctcattgccctgcgc

SEQ ID NO: 56361 - DNA, 20 bp, synthetic construct
  misc_feature 1..20: note = CRISPR gRNA sequence
  source 1..20: mol_type = other DNA
agtcctcattgccctgcgcc

SEQ ID NO: 56362 - DNA, 20 bp, synthetic construct
  misc_feature 1..20: note = CRISPR gRNA sequence
  source 1..20: mol_type = other DNA
cctcattgccctgcgccagg

SEQ ID NO: 56363 - DNA, 20 bp, synthetic construct
  misc_feature 1..20: note = CRISPR gRNA sequence
  source 1..20: mol_type = other DNA
ttgccctgcgccaggtggct

SEQ ID NO: 56364 - DNA, 20 bp, synthetic construct
  misc_feature 1..20: note = CRISPR gRNA sequence
  source 1..20: mol_type = other DNA
tgccctgcgccaggtggcta

SEQ ID NO: 56365 - DNA, 20 bp, synthetic construct
  misc_feature 1..20: note = CRISPR gRNA sequence
  source 1..20: mol_type = other DNA
cctgcgccaggtggctaagg

SEQ ID NO: 56366 - DNA, 20 bp, synthetic construct
  misc_feature 1..20: note = CRISPR gRNA sequence
  source 1..20: mol_type = other DNA
ctgcgccaggtggctaagga

SEQ ID NO: 56367 - DNA, 20 bp, synthetic construct
  misc_feature 1..20: note = CRISPR gRNA sequence
  source 1..20: mol_type = other DNA
tgcgccaggtggctaaggaa

SEQ ID NO: 56368 - DNA, 20 bp, synthetic construct
  misc_feature 1..20: note = CRISPR gRNA sequence
  source 1..20: mol_type = other DNA
gcgccaggtggctaaggaag

SEQ ID NO: 56369 - DNA, 20 bp, synthetic construct
  misc_feature 1..20: note = CRISPR gRNA sequence
  source 1..20: mol_type = other DNA
ccaggtggctaaggaagggg

SEQ ID NO: 56370 - DNA, 20 bp, synthetic construct
  misc_feature 1..20: note = CRISPR gRNA sequence
  source 1..20: mol_type = other DNA
ggtggctaaggaaggggcgg

SEQ ID NO: 56371 - DNA, 20 bp, synthetic construct
  misc_feature 1..20: note = CRISPR gRNA sequence
  source 1..20: mol_type = other DNA
gtggctaaggaaggggcggc

SEQ ID NO: 56372 - DNA, 20 bp, synthetic construct
  misc_feature 1..20: note = CRISPR gRNA sequence
  source 1..20: mol_type = other DNA
taaggaaggggcggcaggtg

SEQ ID NO: 56373 - DNA, 20 bp, synthetic construct
  misc_feature 1..20: note = CRISPR gRNA sequence
  source 1..20: mol_type = other DNA
aaggaaggggcggcaggtgc

SEQ ID NO: 56374 - DNA, 20 bp, synthetic construct
  misc_feature 1..20: note = CRISPR gRNA sequence
  source 1..20: mol_type = other DNA
gggcggcaggtgcaggatgc

SEQ ID NO: 56375 - DNA, 20 bp, synthetic construct
  misc_feature 1..20: note = CRISPR gRNA sequence
  source 1..20: mol_type = other DNA
ggcggcaggtgcaggatgcc

SEQ ID NO: 56376 - DNA, 20 bp, synthetic construct
  misc_feature 1..20: note = CRISPR gRNA sequence
  source 1..20: mol_type = other DNA
gtgcaggatgccaggcccgc

SEQ ID NO: 56377 - DNA, 20 bp, synthetic construct
  misc_feature 1..20: note = CRISPR gRNA sequence
  source 1..20: mol_type = other DNA
tgcaggatgccaggcccgcc

SEQ ID NO: 56378 - DNA, 20 bp, synthetic construct
  misc_feature 1..20: note = CRISPR gRNA sequence
  source 1..20: mol_type = other DNA
aggatgccaggcccgccagg

SEQ ID NO: 56379 - DNA, 20 bp, synthetic construct
  misc_feature 1..20: note = CRISPR gRNA sequence
  source 1..20: mol_type = other DNA
ggatgccaggcccgccagga

SEQ ID NO: 56380 - DNA, 20 bp, synthetic construct
  misc_feature 1..20: note = CRISPR gRNA sequence
  source 1..20: mol_type = other DNA
tgccaggcccgccaggaagg

SEQ ID NO: 56381 - DNA, 20 bp, synthetic construct
  misc_feature 1..20: note = CRISPR gRNA sequence
  source 1..20: mol_type = other DNA
gccaggcccgccaggaaggt

SEQ ID NO: 56382 - DNA, 20 bp, synthetic construct
  misc_feature 1..20: note = CRISPR gRNA sequence
  source 1..20: mol_type = other DNA
ccaggcccgccaggaaggtg

SEQ ID NO: 56383 - DNA, 20 bp, synthetic construct
  misc_feature 1..20: note = CRISPR gRNA sequence
  source 1..20: mol_type = other DNA
aggcccgccaggaaggtggg

SEQ ID NO: 56384 - DNA, 20 bp, synthetic construct
  misc_feature 1..20: note = CRISPR gRNA sequence
  source 1..20: mol_type = other DNA
ggcccgccaggaaggtgggg

SEQ ID NO: 56385 - DNA, 20 bp, synthetic construct
  misc_feature 1..20: note = CRISPR gRNA sequence
  source 1..20: mol_type = other DNA
ccgccaggaaggtggggagg

SEQ ID NO: 56386 - DNA, 20 bp, synthetic construct
  misc_feature 1..20: note = CRISPR gRNA sequence
  source 1..20: mol_type = other DNA
ggaaggtggggaggtggtct

SEQ ID NO: 56387 - DNA, 20 bp, synthetic construct
  misc_feature 1..20: note = CRISPR gRNA sequence
  source 1..20: mol_type = other DNA
aaggtggggaggtggtctga

SEQ ID NO: 56388 - DNA, 20 bp, synthetic construct
  misc_feature 1..20: note = CRISPR gRNA sequence
  source 1..20: mol_type = other DNA
aggtggggaggtggtctgag

SEQ ID NO: 56389 - DNA, 20 bp, synthetic construct
  misc_feature 1..20: note = CRISPR gRNA sequence
  source 1..20: mol_type = other DNA
gggaggtggtctgagaggcc

SEQ ID NO: 56390 - DNA, 20 bp, synthetic construct
  misc_feature 1..20: note = CRISPR gRNA sequence
  source 1..20: mol_type = other DNA
gtggtctgagaggcccagtc

SEQ ID NO: 56391 - DNA, 20 bp, synthetic construct
  misc_feature 1..20: note = CRISPR gRNA sequence
  source 1..20: mol_type = other DNA
tgagaggcccagtctagctt

SEQ ID NO: 56392 - DNA, 20 bp, synthetic construct
  misc_feature 1..20: note = CRISPR gRNA sequence
  source 1..20: mol_type = other DNA
tagctttggtccgctgtacc

SEQ ID NO: 56393 - DNA, 20 bp, synthetic construct
  misc_feature 1..20: note = CRISPR gRNA sequence
  source 1..20: mol_type = other DNA
ctttggtccgctgtacccag

SEQ ID NO: 56394 - DNA, 20 bp, synthetic construct
  misc_feature 1..20: note = CRISPR gRNA sequence
  source 1..20: mol_type = other DNA
tttggtccgctgtacccagc

SEQ ID NO: 56395 - DNA, 20 bp, synthetic construct
  misc_feature 1..20: note = CRISPR gRNA sequence
  source 1..20: mol_type = other DNA
tccgctgtacccagcgggaa

SEQ ID NO: 56396 - DNA, 20 bp, synthetic construct
  misc_feature 1..20: note = CRISPR gRNA sequence
  source 1..20: mol_type = other DNA
cgctgtacccagcgggaatg

SEQ ID NO: 56397 - DNA, 20 bp, synthetic construct
  misc_feature 1..20: note = CRISPR gRNA sequence
  source 1..20: mol_type = other DNA
gctgtacccagcgggaatgg

SEQ ID NO: 56398 - DNA, 20 bp, synthetic construct
  misc_feature 1..20: note = CRISPR gRNA sequence
  source 1..20: mol_type = other DNA
ctgtacccagcgggaatgga

SEQ ID NO: 56399 - DNA, 20 bp, synthetic construct
  misc_feature 1..20: note = CRISPR gRNA sequence
  source 1..20: mol_type = other DNA
gggaatggagggtaacatac

SEQ ID NO: 56400 - DNA, 20 bp, synthetic construct
  misc_feature 1..20: note = CRISPR gRNA sequence
  source 1..20: mol_type = other DNA
ggaatggagggtaacatact

SEQ ID NO: 56401 - DNA, 20 bp, synthetic construct
  misc_feature 1..20: note = CRISPR gRNA sequence
  source 1..20: mol_type = other DNA
tggagggtaacatactgggt

SEQ ID NO: 56402 - DNA, 20 bp, synthetic construct
  misc_feature 1..20: note = CRISPR gRNA sequence
  source 1..20: mol_type = other DNA
aagtgtgtctttgttcacct

SEQ ID NO: 56403 - DNA, 20 bp, synthetic construct
  misc_feature 1..20: note = CRISPR gRNA sequence
  source 1..20: mol_type = other DNA
agtgtgtctttgttcacctt

SEQ ID NO: 56404 - DNA, 20 bp, synthetic construct
  misc_feature 1..20: note = CRISPR gRNA sequence
  source 1..20: mol_type = other DNA
gtgtgtctttgttcaccttg

SEQ ID NO: 56405 - DNA, 20 bp, synthetic construct
  misc_feature 1..20: note = CRISPR gRNA sequence
  source 1..20: mol_type = other DNA
gtctttgttcaccttggggc

SEQ ID NO: 56406 - DNA, 20 bp, synthetic construct
  misc_feature 1..20: note = CRISPR gRNA sequence
  source 1..20: mol_type = other DNA
ttcaccttggggctggccat

SEQ ID NO: 56407 - DNA, 20 bp, synthetic construct
  misc_feature 1..20: note = CRISPR gRNA sequence
  source 1..20: mol_type = other DNA
tcaccttggggctggccatc

SEQ ID NO: 56408 - DNA, 20 bp, synthetic construct
  misc_feature 1..20: note = CRISPR gRNA sequence
  source 1..20: mol_type = other DNA
ttggggctggccatcaggtg

SEQ ID NO: 56409 - DNA, 20 bp, synthetic construct
  misc_feature 1..20: note = CRISPR gRNA sequence
  source 1..20: mol_type = other DNA
tggggctggccatcaggtgc

SEQ ID NO: 56410 - DNA, 20 bp, synthetic construct
  misc_feature 1..20: note = CRISPR gRNA sequence
  source 1..20: mol_type = other DNA
ggggctggccatcaggtgca

SEQ ID NO: 56411 - DNA, 20 bp, synthetic construct
  misc_feature 1..20: note = CRISPR gRNA sequence
  source 1..20: mol_type = other DNA
gctggccatcaggtgcaggg

SEQ ID NO: 56412 - DNA, 20 bp, synthetic construct
  misc_feature 1..20: note = CRISPR gRNA sequence
  source 1..20: mol_type = other DNA
gccatcaggtgcagggcagc

SEQ ID NO: 56413 - DNA, 20 bp, synthetic construct
  misc_feature 1..20: note = CRISPR gRNA sequence
  source 1..20: mol_type = other DNA
agggcagcaagaaactcctg

SEQ ID NO: 56414 - DNA, 20 bp, synthetic construct
  misc_feature 1..20: note = CRISPR gRNA sequence
  source 1..20: mol_type = other DNA
gggcagcaagaaactcctgc

SEQ ID NO: 56415 - DNA, 20 bp, synthetic construct
  misc_feature 1..20: note = CRISPR gRNA sequence
  source 1..20: mol_type = other DNA
gcaagaaactcctgcaggct

SEQ ID NO: 56416 - DNA, 20 bp, synthetic construct
  misc_feature 1..20: note = CRISPR gRNA sequence
  source 1..20: mol_type = other DNA
caagaaactcctgcaggctg

SEQ ID NO: 56417 - DNA, 20 bp, synthetic construct
  misc_feature 1..20: note = CRISPR gRNA sequence
  source 1..20: mol_type = other DNA
gaaactcctgcaggctgagg

SEQ ID NO: 56418 - DNA, 20 bp, synthetic construct
  misc_feature 1..20: note = CRISPR gRNA sequence
  source 1..20: mol_type = other DNA
aaactcctgcaggctgaggt

SEQ ID NO: 56419 - DNA, 20 bp, synthetic construct
  misc_feature 1..20: note = CRISPR gRNA sequence
  source 1..20: mol_type = other DNA
ctgcaggctgaggtgggtga

SEQ ID NO: 56420 - DNA, 20 bp, synthetic construct
  misc_feature 1..20: note = CRISPR gRNA sequence
  source 1..20: mol_type = other DNA
ggctgaggtgggtgaaagca

SEQ ID NO: 56421 - DNA, 20 bp, synthetic construct
  misc_feature 1..20: note = CRISPR gRNA sequence
  source 1..20: mol_type = other DNA
tgaaagcatagcctgtctgc

SEQ ID NO: 56422 - DNA, 20 bp, synthetic construct
  misc_feature 1..20: note = CRISPR gRNA sequence
  source 1..20: mol_type = other DNA
atagcctgtctgctggtgcc

SEQ ID NO: 56423 - DNA, 20 bp, synthetic construct
  misc_feature 1..20: note = CRISPR gRNA sequence
  source 1..20: mol_type = other DNA
tagcctgtctgctggtgccc

SEQ ID NO: 56424 - DNA, 20 bp, synthetic construct
  misc_feature 1..20: note = CRISPR gRNA sequence
  source 1..20: mol_type = other DNA
agcctgtctgctggtgccca

SEQ ID NO: 56425 - DNA, 20 bp, synthetic construct
  misc_feature 1..20: note = CRISPR gRNA sequence
  source 1..20: mol_type = other DNA
gctggtgcccagggcctgtg

SEQ ID NO: 56426 - DNA, 20 bp, synthetic construct
  misc_feature 1..20: note = CRISPR gRNA sequence
  source 1..20: mol_type = other DNA
gcccagggcctgtgcagacg

SEQ ID NO: 56427 - DNA, 20 bp, synthetic construct
  misc_feature 1..20: note = CRISPR gRNA sequence
  source 1..20: mol_type = other DNA
cagggcctgtgcagacgcag

SEQ ID NO: 56428 - DNA, 20 bp, synthetic construct
  misc_feature 1..20: note = CRISPR gRNA sequence
  source 1..20: mol_type = other DNA
agggcctgtgcagacgcaga

SEQ ID NO: 56429 - DNA, 20 bp, synthetic construct
  misc_feature 1..20: note = CRISPR gRNA sequence
  source 1..20: mol_type = other DNA
gcctgtgcagacgcagaagg

SEQ ID NO: 56430 - DNA, 20 bp, synthetic construct
  misc_feature 1..20: note = CRISPR gRNA sequence
  source 1..20: mol_type = other DNA
gtgcagacgcagaaggaagt

SEQ ID NO: 56431 - DNA, 20 bp, synthetic construct
  misc_feature 1..20: note = CRISPR gRNA sequence
  source 1..20: mol_type = other DNA
cagacgcagaaggaagtcag

SEQ ID NO: 56432 - DNA, 20 bp, synthetic construct
  misc_feature 1..20: note = CRISPR gRNA sequence
  source 1..20: mol_type = other DNA
agacgcagaaggaagtcagc

SEQ ID NO: 56433 - DNA, 20 bp, synthetic construct
  misc_feature 1..20: note = CRISPR gRNA sequence
  source 1..20: mol_type = other DNA
gaaggaagtcagcaggctgt

SEQ ID NO: 56434 - DNA, 20 bp, synthetic construct
  misc_feature 1..20: note = CRISPR gRNA sequence
  source 1..20: mol_type = other DNA
ggaagtcagcaggctgtgag

SEQ ID NO: 56435 - DNA, 20 bp, synthetic construct
  misc_feature 1..20: note = CRISPR gRNA sequence
  source 1..20: mol_type = other DNA
caggctgtgagtggccccaa

SEQ ID NO: 56436 - DNA, 20 bp, synthetic construct
  misc_feature 1..20: note = CRISPR gRNA sequence
  source 1..20: mol_type = other DNA
gagtggccccaaaagctatc

SEQ ID NO: 56437 - DNA, 20 bp, synthetic construct
  misc_feature 1..20: note = CRISPR gRNA sequence
  source 1..20: mol_type = other DNA
agtggccccaaaagctatca

SEQ ID NO: 56438 - DNA, 20 bp, synthetic construct
  misc_feature 1..20: note = CRISPR gRNA sequence
  source 1..20: mol_type = other DNA
gtggccccaaaagctatcaa

SEQ ID NO: 56439 - DNA, 20 bp, synthetic construct
  misc_feature 1..20: note = CRISPR gRNA sequence
  source 1..20: mol_type = other DNA
gccccaaaagctatcaaggg

SEQ ID NO: 56440 - DNA, 20 bp, synthetic construct
  misc_feature 1..20: note = CRISPR gRNA sequence
  source 1..20: mol_type = other DNA
cccaaaagctatcaagggtg

SEQ ID NO: 56441 - DNA, 20 bp, synthetic construct
  misc_feature 1..20: note = CRISPR gRNA sequence
  source 1..20: mol_type = other DNA
gtggagcaatatcttttgca

SEQ ID NO: 56442 - DNA, 20 bp, synthetic construct
  misc_feature 1..20: note = CRISPR gRNA sequence
  source 1..20: mol_type = other DNA
gagcaatatcttttgcatag

SEQ ID NO: 56443 - DNA, 20 bp, synthetic construct
  misc_feature 1..20: note = CRISPR gRNA sequence
  source 1..20: mol_type = other DNA
aagataaccttccctgtctc

SEQ ID NO: 56444 - DNA, 20 bp, synthetic construct
  misc_feature 1..20: note = CRISPR gRNA sequence
  source 1..20: mol_type = other DNA
agataaccttccctgtctcc

SEQ ID NO: 56445 - DNA, 20 bp, synthetic construct
  misc_feature 1..20: note = CRISPR gRNA sequence
  source 1..20: mol_type = other DNA
ttccctgtctccaggcccct

SEQ ID NO: 56446 - DNA, 20 bp, synthetic construct
  misc_feature 1..20: note = CRISPR gRNA sequence
  source 1..20: mol_type = other DNA
tccctgtctccaggcccctc

SEQ ID NO: 56447 - DNA, 20 bp, synthetic construct
  misc_feature 1..20: note = CRISPR gRNA sequence
  source 1..20: mol_type = other DNA
ccctgtctccaggcccctca

SEQ ID NO: 56448 - DNA, 20 bp, synthetic construct
  misc_feature 1..20: note = CRISPR gRNA sequence
  source 1..20: mol_type = other DNA
cccctcagggccacctcccc

SEQ ID NO: 56449 - DNA, 20 bp, synthetic construct
  misc_feature 1..20: note = CRISPR gRNA sequence
  source 1..20: mol_type = other DNA
ccctcagggccacctccccc

SEQ ID NO: 56450 - DNA, 20 bp, synthetic construct
  misc_feature 1..20: note = CRISPR gRNA sequence
  source 1..20: mol_type = other DNA
agggccacctcccccaggtc

SEQ ID NO: 56451 - DNA, 20 bp, synthetic construct
  misc_feature 1..20: note = CRISPR gRNA sequence
  source 1..20: mol_type = other DNA
gccacctcccccaggtccag

SEQ ID NO: 56452 - DNA, 20 bp, synthetic construct
  misc_feature 1..20: note = CRISPR gRNA sequence
  source 1..20: mol_type = other DNA
ccacctcccccaggtccagt

SEQ ID NO: 56453 - DNA, 20 bp, synthetic construct
  misc_feature 1..20: note = CRISPR gRNA sequence
  source 1..20: mol_type = other DNA
cacctcccccaggtccagta

SEQ ID NO: 56454 - DNA, 20 bp, synthetic construct
  misc_feature 1..20: note = CRISPR gRNA sequence
  source 1..20: mol_type = other DNA
cccccaggtccagtagggac

SEQ ID NO: 56455 - DNA, 20 bp, synthetic construct
  misc_feature 1..20: note = CRISPR gRNA sequence
  source 1..20: mol_type = other DNA
ccccaggtccagtagggacg

SEQ ID NO: 56456 - DNA, 20 bp, synthetic construct
  misc_feature 1..20: note = CRISPR gRNA sequence
  source 1..20: mol_type = other DNA
caggtccagtagggacgagg

SEQ ID NO: 56457 - DNA, 20 bp, synthetic construct
  misc_feature 1..20: note = CRISPR gRNA sequence
  source 1..20: mol_type = other DNA
aggtccagtagggacgaggt

SEQ ID NO: 56458 - DNA, 20 bp, synthetic construct
  misc_feature 1..20: note = CRISPR gRNA sequence
  source 1..20: mol_type = other DNA
ccagtagggacgaggtgggc

SEQ ID NO: 56459 - DNA, 20 bp, synthetic construct
  misc_feature 1..20: note = CRISPR gRNA sequence
  source 1..20: mol_type = other DNA
ggacgaggtgggcaagtgcc

SEQ ID NO: 56460 - DNA, 20 bp, synthetic construct
  misc_feature 1..20: note = CRISPR gRNA sequence
  source 1..20: mol_type = other DNA
gacgaggtgggcaagtgccc

SEQ ID NO: 56461 - DNA, 20 bp, synthetic construct
  misc_feature 1..20: note = CRISPR gRNA sequence
  source 1..20: mol_type = other DNA
acgaggtgggcaagtgccca

SEQ ID NO: 56462 - DNA, 20 bp, synthetic construct
  misc_feature 1..20: note = CRISPR gRNA sequence
  source 1..20: mol_type = other DNA
cgaggtgggcaagtgcccag

SEQ ID NO: 56463 - DNA, 20 bp, synthetic construct
  misc_feature 1..20: note = CRISPR gRNA sequence
  source 1..20: mol_type = other DNA
gaggtgggcaagtgcccagg

SEQ ID NO: 56464 - DNA, 20 bp, synthetic construct
  misc_feature 1..20: note = CRISPR gRNA sequence
  source 1..20: mol_type = other DNA
aggtgggcaagtgcccaggg

SEQ ID NO: 56465 - DNA, 20 bp, synthetic construct
  misc_feature 1..20: note = CRISPR gRNA sequence
  source 1..20: mol_type = other DNA
ggcaagtgcccaggggggct

SEQ ID NO: 56466 - DNA, 20 bp, synthetic construct
  misc_feature 1..20: note = CRISPR gRNA sequence
  source 1..20: mol_type = other DNA
gcaagtgcccaggggggctg

SEQ ID NO: 56467 - DNA, 20 bp, synthetic construct
  misc_feature 1..20: note = CRISPR gRNA sequence
  source 1..20: mol_type = other DNA
caagtgcccaggggggctga

SEQ ID NO: 56468 - DNA, 20 bp, synthetic construct
  misc_feature 1..20: note = CRISPR gRNA sequence
  source 1..20: mol_type = other DNA
tgcccaggggggctgagggc

SEQ ID NO: 56469 - DNA, 20 bp, synthetic construct
  misc_feature 1..20: note = CRISPR gRNA sequence
  source 1..20: mol_type = other DNA
gggcgagcaccatctgcata

SEQ ID NO: 56470 - DNA, 20 bp, synthetic construct
  misc_feature 1..20: note = CRISPR gRNA sequence
  source 1..20: mol_type = other DNA
gcgagcaccatctgcatata

SEQ ID NO: 56471 - DNA, 20 bp, synthetic construct
  misc_feature 1..20: note = CRISPR gRNA sequence
  source 1..20: mol_type = other DNA
caccatctgcatatagagct

SEQ ID NO: 56472 - DNA, 20 bp, synthetic construct
  misc_feature 1..20: note = CRISPR gRNA sequence
  source 1..20: mol_type = other DNA
catatagagctgagtcatgt

SEQ ID NO: 56473 - DNA, 20 bp, synthetic construct
  misc_feature 1..20: note = CRISPR gRNA sequence
  source 1..20: mol_type = other DNA
atatagagctgagtcatgtt

SEQ ID NO: 56474 - DNA, 20 bp, synthetic construct
  misc_feature 1..20: note = CRISPR gRNA sequence
  source 1..20: mol_type = other DNA
tagagctgagtcatgttggg

SEQ ID NO: 56475 - DNA, 20 bp, synthetic construct
  misc_feature 1..20: note = CRISPR gRNA sequence
  source 1..20: mol_type = other DNA
agagctgagtcatgttgggc

SEQ ID NO: 56476 - DNA, 20 bp, synthetic construct
  misc_feature 1..20: note = CRISPR gRNA sequence
  source 1..20: mol_type = other DNA
agctgagtcatgttgggcag

SEQ ID NO: 56477 - DNA, 20 bp, synthetic construct
  misc_feature 1..20: note = CRISPR gRNA sequence
  source 1..20: mol_type = other DNA
gctgagtcatgttgggcagg

SEQ ID NO: 56478 - DNA, 20 bp, synthetic construct
  misc_feature 1..20: note = CRISPR gRNA sequence
  source 1..20: mol_type = other DNA
ctgagtcatgttgggcagga

SEQ ID NO: 56479 - DNA, 20 bp, synthetic construct
  misc_feature 1..20: note = CRISPR gRNA sequence
  source 1..20: mol_type = other DNA
catgttgggcaggagggcca

SEQ ID NO: 56480 - DNA, 20 bp, synthetic construct
  misc_feature 1..20: note = CRISPR gRNA sequence
  source 1..20: mol_type = other DNA
tgggcaggagggccacagac

SEQ ID NO: 56481 - DNA, 20 bp, synthetic construct
  misc_feature 1..20: note = CRISPR gRNA sequence
  source 1..20: mol_type = other DNA
aggagggccacagactggcc

SEQ ID NO: 56482 - DNA, 20 bp, synthetic construct
  misc_feature 1..20: note = CRISPR gRNA sequence
  source 1..20: mol_type = other DNA
ggagggccacagactggcct

SEQ ID NO: 56483 - DNA, 20 bp, synthetic construct
  misc_feature 1..20: note = CRISPR gRNA sequence
  source 1..20: mol_type = other DNA
gagggccacagactggcctg

SEQ ID NO: 56484 - DNA, 20 bp, synthetic construct
  misc_feature 1..20: note = CRISPR gRNA sequence
  source 1..20: mol_type = other DNA
ccacagactggcctggggcg

SEQ ID NO: 56485 - DNA, 20 bp, synthetic construct
  misc_feature 1..20: note = CRISPR gRNA sequence
  source 1..20: mol_type = other DNA
agactggcctggggcgtggt

SEQ ID NO: 56486 - DNA, 20 bp, synthetic construct
  misc_feature 1..20: note = CRISPR gRNA sequence
  source 1..20: mol_type = other DNA
gactggcctggggcgtggtc

SEQ ID NO: 56487 - DNA, 20 bp, synthetic construct
  misc_feature 1..20: note = CRISPR gRNA sequence
  source 1..20: mol_type = other DNA
tggcctggggcgtggtcagg

SEQ ID NO: 56488 - DNA, 20 bp, synthetic construct
  misc_feature 1..20: note = CRISPR gRNA sequence
  source 1..20: mol_type = other DNA
cctggggcgtggtcaggaag

SEQ ID NO: 56489 - DNA, 20 bp, synthetic construct
  misc_feature 1..20: note = CRISPR gRNA sequence
  source 1..20: mol_type = other DNA
gggcgtggtcaggaagcaga

SEQ ID NO: 56490 - DNA, 20 bp, synthetic construct
  misc_feature 1..20: note = CRISPR gRNA sequence
  source 1..20: mol_type = other DNA
cgtggtcaggaagcagatgg

SEQ ID NO: 56491 - DNA, 20 bp, synthetic construct
  misc_feature 1..20: note = CRISPR gRNA sequence
  source 1..20: mol_type = other DNA
tggtcaggaagcagatggtg

SEQ ID NO: 56492 - DNA, 20 bp, synthetic construct
  misc_feature 1..20: note = CRISPR gRNA sequence
  source 1..20: mol_type = other DNA
ggtcaggaagcagatggtgg

SEQ ID NO: 56493 - DNA, 20 bp, synthetic construct
  misc_feature 1..20: note = CRISPR gRNA sequence
  source 1..20: mol_type = other DNA
caggaagcagatggtggagg

SEQ ID NO: 56494 - DNA, 20 bp, synthetic construct
  misc_feature 1..20: note = CRISPR gRNA sequence
  source 1..20: mol_type = other DNA
ggaagcagatggtggaggca

SEQ ID NO: 56495 - DNA, 20 bp, synthetic construct
  misc_feature 1..20: note = CRISPR gRNA sequence
  source 1..20: mol_type = other DNA
gcagatggtggaggcagaga

SEQ ID NO: 56496 - DNA, 20 bp, synthetic construct
  misc_feature 1..20: note = CRISPR gRNA sequence
  source 1..20: mol_type = other DNA
cagatggtggaggcagagac

SEQ ID NO: 56497 - DNA, 20 bp, synthetic construct
  misc_feature 1..20: note = CRISPR gRNA sequence
  source 1..20: mol_type = other DNA
ggaggcagagacaggcgact

SEQ ID NO: 56498 - DNA, 20 bp, synthetic construct
  misc_feature 1..20: note = CRISPR gRNA sequence
  source 1..20: mol_type = other DNA
cagagacaggcgacttggca

SEQ ID NO: 56499 - DNA, 20 bp, synthetic construct
  misc_feature 1..20: note = CRISPR gRNA sequence
  source 1..20: mol_type = other DNA
acaggcgacttggcacagtg

SEQ ID NO: 56500 - DNA, 20 bp, synthetic construct
  misc_feature 1..20: note = CRISPR gRNA sequence
  source 1..20: mol_type = other DNA
caggcgacttggcacagtgc

SEQ ID NO: 56501 - DNA, 20 bp, synthetic construct
  misc_feature 1..20: note = CRISPR gRNA sequence
  source 1..20: mol_type = other DNA
cacagtgcgggcaccgcaca

SEQ ID NO: 56502 - DNA, 20 bp, synthetic construct
  misc_feature 1..20: note = CRISPR gRNA sequence
  source 1..20: mol_type = other DNA
acagtgcgggcaccgcacac

SEQ ID NO: 56503 - DNA, 20 bp, synthetic construct
  misc_feature 1..20: note = CRISPR gRNA sequence
  source 1..20: mol_type = other DNA
cgggcaccgcacacaggctt

SEQ ID NO: 56504 - DNA, 20 bp, synthetic construct
  misc_feature 1..20: note = CRISPR gRNA sequence
  source 1..20: mol_type = other DNA
ggcaccgcacacaggcttcg

SEQ ID NO: 56505 - DNA, 20 bp, synthetic construct
  misc_feature 1..20: note = CRISPR gRNA sequence
  source 1..20: mol_type = other DNA
ccatttgtctgtaactccac

SEQ ID NO: 56506 - DNA, 20 bp, synthetic construct
  misc_feature 1..20: note = CRISPR gRNA sequence
  source 1..20: mol_type = other DNA
catttgtctgtaactccacc

SEQ ID NO: 56507 - DNA, 20 bp, synthetic construct
  misc_feature 1..20: note = CRISPR gRNA sequence
  source 1..20: mol_type = other DNA
atttgtctgtaactccacca

SEQ ID NO: 56508 - DNA, 20 bp, synthetic construct
  misc_feature 1..20: note = CRISPR gRNA sequence
  source 1..20: mol_type = other DNA
accagggccccctcccgcga

SEQ ID NO: 56509 - DNA, 20 bp, synthetic construct
  misc_feature 1..20: note = CRISPR gRNA sequence
  source 1..20: mol_type = other DNA
gggccccctcccgcgatggc

SEQ ID NO: 56510 - DNA, 20 bp, synthetic construct
  misc_feature 1..20: note = CRISPR gRNA sequence
  source 1..20: mol_type = other DNA
ggccccctcccgcgatggct

SEQ ID NO: 56511 - DNA, 20 bp, synthetic construct
  misc_feature 1..20: note = CRISPR gRNA sequence
  source 1..20: mol_type = other DNA
cccgcgatggctgggcgctg

SEQ ID NO: 56512 - DNA, 20 bp, synthetic construct
  misc_feature 1..20: note = CRISPR gRNA sequence
  source 1..20: mol_type = other DNA
gcgatggctgggcgctgaag

SEQ ID NO: 56513 - DNA, 20 bp, synthetic construct
  misc_feature 1..20: note = CRISPR gRNA sequence
  source 1..20: mol_type = other DNA
ttcacatattcttccacccg

SEQ ID NO: 56514 - DNA, 20 bp, synthetic construct
  misc_feature 1..20: note = CRISPR gRNA sequence
  source 1..20: mol_type = other DNA
cttccacccgtggcccatca

SEQ ID NO: 56515 - DNA, 20 bp, synthetic construct
  misc_feature 1..20: note = CRISPR gRNA sequence
  source 1..20: mol_type = other DNA
gcccatcaaagcccaacatg

SEQ ID NO: 56516 - DNA, 20 bp, synthetic construct
  misc_feature 1..20: note = CRISPR gRNA sequence
  source 1..20: mol_type = other DNA
aaagcccaacatgtggacca

SEQ ID NO: 56517 - DNA, 20 bp, synthetic construct
  misc_feature 1..20: note = CRISPR gRNA sequence
  source 1..20: mol_type = other DNA
gtggaccatggctgcctctg

SEQ ID NO: 56518 - DNA, 20 bp, synthetic construct
  misc_feature 1..20: note = CRISPR gRNA sequence
  source 1..20: mol_type = other DNA
tggaccatggctgcctctgc

SEQ ID NO: 56519 - DNA, 20 bp, synthetic construct
  misc_feature 1..20: note = CRISPR gRNA sequence
  source 1..20: mol_type = other DNA
accatggctgcctctgcagg

SEQ ID NO: 56520 - DNA, 20 bp, synthetic construct
  misc_feature 1..20: note = CRISPR gRNA sequence
  source 1..20: mol_type = other DNA
ccatggctgcctctgcaggc

SEQ ID NO: 56521 - DNA, 20 bp, synthetic construct
  misc_feature 1..20: note = CRISPR gRNA sequence
  source 1..20: mol_type = other DNA
tggctgcctctgcaggcagg

SEQ ID NO: 56522 - DNA, 20 bp, synthetic construct
  misc_feature 1..20: note = CRISPR gRNA sequence
  source 1..20: mol_type = other DNA
ggctgcctctgcaggcaggc

SEQ ID NO: 56523 - DNA, 20 bp, synthetic construct
  misc_feature 1..20: note = CRISPR gRNA sequence
  source 1..20: mol_type = other DNA
tgcctctgcaggcaggcagg

SEQ ID NO: 56524 - DNA, 20 bp, synthetic construct
  misc_feature 1..20: note = CRISPR gRNA sequence
  source 1..20: mol_type = other DNA
gcctctgcaggcaggcaggc

SEQ ID NO: 56525 - DNA, 20 bp, synthetic construct
  misc_feature 1..20: note = CRISPR gRNA sequence
  source 1..20: mol_type = other DNA
tctgcaggcaggcaggcagg

SEQ ID NO: 56526 - DNA, 20 bp, synthetic construct
  misc_feature 1..20: note = CRISPR gRNA sequence
  source 1..20: mol_type = other DNA
aggcaggcaggcagcttccc

SEQ ID NO: 56527 - DNA, 20 bp, synthetic construct
  misc_feature 1..20: note = CRISPR gRNA sequence
  source 1..20: mol_type = other DNA
aggcaggcagcttccctgga

SEQ ID NO: 56528 - DNA, 20 bp, synthetic construct
  misc_feature 1..20: note = CRISPR gRNA sequence
  source 1..20: mol_type = other DNA
ggcaggcagcttccctggac

SEQ ID NO: 56529 - DNA, 20 bp, synthetic construct
  misc_feature 1..20: note = CRISPR gRNA sequence
  source 1..20: mol_type = other DNA
caggcagcttccctggacgg

SEQ ID NO: 56530 - DNA, 20 bp, synthetic construct
  misc_feature 1..20: note = CRISPR gRNA sequence
  source 1..20: mol_type = other DNA
aggcagcttccctggacggg

SEQ ID NO: 56531 - DNA, 20 bp, synthetic construct
  misc_feature 1..20: note = CRISPR gRNA sequence
  source 1..20: mol_type = other DNA
cagcttccctggacgggagg

SEQ ID NO: 56532 - DNA, 20 bp, synthetic construct
  misc_feature 1..20: note = CRISPR gRNA sequence
  source 1..20: mol_type = other DNA
gacgggaggtagccatcacc

SEQ ID NO: 56533 - DNA, 20 bp, synthetic construct
  misc_feature 1..20: note = CRISPR gRNA sequence
  source 1..20: mol_type = other DNA
gggaggtagccatcacccgg

SEQ ID NO: 56534 - DNA, 20 bp, synthetic construct
  misc_feature 1..20: note = CRISPR gRNA sequence
  source 1..20: mol_type = other DNA
ggtagccatcacccggcagc

SEQ ID NO: 56535 - DNA, 20 bp, synthetic construct
  misc_feature 1..20: note = CRISPR gRNA sequence
  source 1..20: mol_type = other DNA
gtagccatcacccggcagcc

SEQ ID NO: 56536 - DNA, 20 bp, synthetic construct
  misc_feature 1..20: note = CRISPR gRNA sequence
  source 1..20: mol_type = other DNA
gccatcacccggcagccagg

SEQ ID NO: 56537 - DNA, 20 bp, synthetic construct
  misc_feature 1..20: note = CRISPR gRNA sequence
  source 1..20: mol_type = other DNA
ccatcacccggcagccaggc

SEQ ID NO: 56538 - DNA, 20 bp, synthetic construct
  misc_feature 1..20: note = CRISPR gRNA sequence
  source 1..20: mol_type = other DNA
atcacccggcagccaggcag

SEQ ID NO: 56539 - DNA, 20 bp, synthetic construct
  misc_feature 1..20: note = CRISPR gRNA sequence
  source 1..20: mol_type = other DNA
tcacccggcagccaggcagg

SEQ ID NO: 56540 - DNA, 20 bp, synthetic construct
  misc_feature 1..20: note = CRISPR gRNA sequence
  source 1..20: mol_type = other DNA
cacccggcagccaggcagga

SEQ ID NO: 56541 - DNA, 20 bp, synthetic construct
  misc_feature 1..20: note = CRISPR gRNA sequence
  source 1..20: mol_type = other DNA
caggcaggagggtcccattg

SEQ ID NO: 56542 - DNA, 20 bp, synthetic construct
  misc_feature 1..20: note = CRISPR gRNA sequence
  source 1..20: mol_type = other DNA
ggcaggagggtcccattgca

SEQ ID NO: 56543 - DNA, 20 bp, synthetic construct
  misc_feature 1..20: note = CRISPR gRNA sequence
  source 1..20: mol_type = other DNA
ggagggtcccattgcagaga

SEQ ID NO: 56544 - DNA, 20 bp, synthetic construct
  misc_feature 1..20: note = CRISPR gRNA sequence
  source 1..20: mol_type = other DNA
gagggtcccattgcagagat

SEQ ID NO: 56545 - DNA, 20 bp, synthetic construct
  misc_feature 1..20: note = CRISPR gRNA sequence
  source 1..20: mol_type = other DNA
gggtcccattgcagagatgg

SEQ ID NO: 56546 - DNA, 20 bp, synthetic construct
  misc_feature 1..20: note = CRISPR gRNA sequence
  source 1..20: mol_type = other DNA
ccattgcagagatgggagaa

SEQ ID NO: 56547 - DNA, 20 bp, synthetic construct
  misc_feature 1..20: note = CRISPR gRNA sequence
  source 1..20: mol_type = other DNA
cattgcagagatgggagaaa

SEQ ID NO: 56548 - DNA, 20 bp, synthetic construct
  misc_feature 1..20: note = CRISPR gRNA sequence
  source 1..20: mol_type = other DNA
attgcagagatgggagaaaa

SEQ ID NO: 56549 - DNA, 20 bp, synthetic construct
  misc_feature 1..20: note = CRISPR gRNA sequence
  source 1..20: mol_type = other DNA
cagagatgggagaaaagggt

SEQ ID NO: 56550 - DNA, 20 bp, synthetic construct
  misc_feature 1..20: note = CRISPR gRNA sequence
  source 1..20: mol_type = other DNA
agagatgggagaaaagggtg

SEQ ID NO: 56551 - DNA, 20 bp, synthetic construct
  misc_feature 1..20: note = CRISPR gRNA sequence
  source 1..20: mol_type = other DNA
tgggagaaaagggtgaggac

SEQ ID NO: 56552 - DNA, 20 bp, synthetic construct
  misc_feature 1..20: note = CRISPR gRNA sequence
  source 1..20: mol_type = other DNA
gggagaaaagggtgaggact

SEQ ID NO: 56553 - DNA, 20 bp, synthetic construct
  misc_feature 1..20: note = CRISPR gRNA sequence
  source 1..20: mol_type = other DNA
aaaagggtgaggactgggcc

SEQ ID NO: 56554 - DNA, 20 bp, synthetic construct
  misc_feature 1..20: note = CRISPR gRNA sequence
  source 1..20: mol_type = other DNA
aaagggtgaggactgggcct

SEQ ID NO: 56555 - DNA, 20 bp, synthetic construct
  misc_feature 1..20: note = CRISPR gRNA sequence
  source 1..20: mol_type = other DNA
gaggactgggcctgggccat

SEQ ID NO: 56556 - DNA, 20 bp, synthetic construct
  misc_feature 1..20: note = CRISPR gRNA sequence
  source 1..20: mol_type = other DNA
aggactgggcctgggccatc

SEQ ID NO: 56557 - DNA, 20 bp, synthetic construct
  misc_feature 1..20: note = CRISPR gRNA sequence
  source 1..20: mol_type = other DNA
gcctgggccatcaggaccca

SEQ ID NO: 56558 - DNA, 20 bp, synthetic construct
  misc_feature 1..20: note = CRISPR gRNA sequence
  source 1..20: mol_type = other DNA
cctgggccatcaggacccat

SEQ ID NO: 56559 - DNA, 20 bp, synthetic construct
  misc_feature 1..20: note = CRISPR gRNA sequence
  source 1..20: mol_type = other DNA
ggccatcaggacccataggc

SEQ ID NO: 56560 - DNA, 20 bp, synthetic construct
  misc_feature 1..20: note = CRISPR gRNA sequence
  source 1..20: mol_type = other DNA
ccatcaggacccataggctg

SEQ ID NO: 56561 - DNA, 20 bp, synthetic construct
  misc_feature 1..20: note = CRISPR gRNA sequence
  source 1..20: mol_type = other DNA
catcaggacccataggctgg

SEQ ID NO: 56562 - DNA, 20 bp, synthetic construct
  misc_feature 1..20: note = CRISPR gRNA sequence
  source 1..20: mol_type = other DNA
atcaggacccataggctgga

SEQ ID NO: 56563 - DNA, 20 bp, synthetic construct
  misc_feature 1..20: note = CRISPR gRNA sequence
  source 1..20: mol_type = other DNA
ataggctggagggcctcatc

SEQ ID NO: 56564 - DNA, 20 bp, synthetic construct
  misc_feature 1..20: note = CRISPR gRNA sequence
  source 1..20: mol_type = other DNA
gggcctcatctagcccatca

SEQ ID NO: 56565 - DNA, 20 bp, synthetic construct
  misc_feature 1..20: note = CRISPR gRNA sequence
  source 1..20: mol_type = other DNA
tcatctagcccatcaaagat

SEQ ID NO: 56566 - DNA, 20 bp, synthetic construct
  misc_feature 1..20: note = CRISPR gRNA sequence
  source 1..20: mol_type = other DNA
tctagcccatcaaagatcag

SEQ ID NO: 56567 - DNA, 20 bp, synthetic construct
  misc_feature 1..20: note = CRISPR gRNA sequence
  source 1..20: mol_type = other DNA
ctagcccatcaaagatcagc

SEQ ID NO: 56568 - DNA, 20 bp, synthetic construct
  misc_feature 1..20: note = CRISPR gRNA sequence
  source 1..20: mol_type = other DNA
catcaaagatcagcaggact

SEQ ID NO: 56569 - DNA, 20 bp, synthetic construct
  misc_feature 1..20: note = CRISPR gRNA sequence
  source 1..20: mol_type = other DNA
aaagatcagcaggacttggt

SEQ ID NO: 56570 - DNA, 20 bp, synthetic construct
  misc_feature 1..20: note = CRISPR gRNA sequence
  source 1..20: mol_type = other DNA
acttggtcagcgttcttctc

SEQ ID NO: 56571 - DNA, 20 bp, synthetic construct
  misc_feature 1..20: note = CRISPR gRNA sequence
  source 1..20: mol_type = other DNA
cttggtcagcgttcttctcc

SEQ ID NO: 56572 - DNA, 20 bp, synthetic construct
  misc_feature 1..20: note = CRISPR gRNA sequence
  source 1..20: mol_type = other DNA
cagcgttcttctccaggtac

SEQ ID NO: 56573 - DNA, 20 bp, synthetic construct
  misc_feature 1..20: note = CRISPR gRNA sequence
  source 1..20: mol_type = other DNA
cgttcttctccaggtactgg

SEQ ID NO: 56574 - DNA, 20 bp, synthetic construct
  misc_feature 1..20: note = CRISPR gRNA sequence
  source 1..20: mol_type = other DNA
cttctccaggtactggaaga

SEQ ID NO: 56575 - DNA, 20 bp, synthetic construct
  misc_feature 1..20: note = CRISPR gRNA sequence
  source 1..20: mol_type = other DNA
ggtactggaagacagtgtcg

SEQ ID NO: 56576 - DNA, 20 bp, synthetic construct
  misc_feature 1..20: note = CRISPR gRNA sequence
  source 1..20: mol_type = other DNA
gacagtgtcgtggtccgatt

SEQ ID NO: 56577 - DNA, 20 bp, synthetic construct
  misc_feature 1..20: note = CRISPR gRNA sequence
  source 1..20: mol_type = other DNA
acagtgtcgtggtccgattc

SEQ ID NO: 56578 - DNA, 20 bp, synthetic construct
  misc_feature 1..20: note = CRISPR gRNA sequence
  source 1..20: mol_type = other DNA
cagtgtcgtggtccgattca

SEQ ID NO: 56579 - DNA, 20 bp, synthetic construct
  misc_feature 1..20: note = CRISPR gRNA sequence
  source 1..20: mol_type = other DNA
tcgtggtccgattcagggct

SEQ ID NO: 56580 - DNA, 20 bp, synthetic construct
  misc_feature 1..20: note = CRISPR gRNA sequence
  source 1..20: mol_type = other DNA
cgtggtccgattcagggctc

SEQ ID NO: 56581 - DNA, 20 bp, synthetic construct
  misc_feature 1..20: note = CRISPR gRNA sequence
  source 1..20: mol_type = other DNA
tccgattcagggctcaggta

SEQ ID NO: 56582 - DNA, 20 bp, synthetic construct
  misc_feature 1..20: note = CRISPR gRNA sequence
  source 1..20: mol_type = other DNA
gggctcaggtacagatcaaa

SEQ ID NO: 56583 - DNA, 20 bp, synthetic construct
  misc_feature 1..20: note = CRISPR gRNA sequence
  source 1..20: mol_type = other DNA
ggctcaggtacagatcaaaa

SEQ ID NO: 56584 - DNA, 20 bp, synthetic construct
  misc_feature 1..20: note = CRISPR gRNA sequence
  source 1..20: mol_type = other DNA
ctcaggtacagatcaaaaag

SEQ ID NO: 56585 - DNA, 20 bp, synthetic construct
  misc_feature 1..20: note = CRISPR gRNA sequence
  source 1..20: mol_type = other DNA
gtacagatcaaaaaggagct

SEQ ID NO: 56586 - DNA, 20 bp, synthetic construct
  misc_feature 1..20: note = CRISPR gRNA sequence
  source 1..20: mol_type = other DNA
agatcaaaaaggagctcgga

SEQ ID NO: 56587 - DNA, 20 bp, synthetic construct
  misc_feature 1..20: note = CRISPR gRNA sequence
  source 1..20: mol_type = other DNA
aaaaggagctcggacggtgt

SEQ ID NO: 56588 - DNA, 20 bp, synthetic construct
  misc_feature 1..20: note = CRISPR gRNA sequence
  source 1..20: mol_type = other DNA
aaaggagctcggacggtgtc

SEQ ID NO: 56589 - DNA, 20 bp, synthetic construct
  misc_feature 1..20: note = CRISPR gRNA sequence
  source 1..20: mol_type = other DNA
gtgtcaggaacctcgtgatc

SEQ ID NO: 56590 - DNA, 20 bp, synthetic construct
  misc_feature 1..20: note = CRISPR gRNA sequence
  source 1..20: mol_type = other DNA
aggaacctcgtgatcaagtt

SEQ ID NO: 56591 - DNA, 20 bp, synthetic construct
  misc_feature 1..20: note = CRISPR gRNA sequence
  source 1..20: mol_type = other DNA
acctcgtgatcaagttgagc

SEQ ID NO: 56592 - DNA, 20 bp, synthetic construct
  misc_feature 1..20: note = CRISPR gRNA sequence
  source 1..20: mol_type = other DNA
tcgtgatcaagttgagctgg

SEQ ID NO: 56593 - DNA, 20 bp, synthetic construct
  misc_feature 1..20: note = CRISPR gRNA sequence
  source 1..20: mol_type = other DNA
ttgagctggcggaattcaaa

SEQ ID NO: 56594 - DNA, 20 bp, synthetic construct
  misc_feature 1..20: note = CRISPR gRNA sequence
  source 1..20: mol_type = other DNA
tgagctggcggaattcaaaa

SEQ ID NO: 56595 - DNA, 20 bp, synthetic construct
  misc_feature 1..20: note = CRISPR gRNA sequence
  source 1..20: mol_type = other DNA
tggcggaattcaaaaaggaa

SEQ ID NO: 56596 - DNA, 20 bp, synthetic construct
  misc_feature 1..20: note = CRISPR gRNA sequence
  source 1..20: mol_type = other DNA
ggcggaattcaaaaaggaac

SEQ ID NO: 56597 - DNA, 20 bp, synthetic construct
  misc_feature 1..20: note = CRISPR gRNA sequence
  source 1..20: mol_type = other DNA
gcggaattcaaaaaggaaca

SEQ ID NO: 56598 - DNA, 20 bp, synthetic construct
  misc_feature 1..20: note = CRISPR gRNA sequence
  source 1..20: mol_type = other DNA
attcaaaaaggaacagggcc

SEQ ID NO: 56599 - DNA, 20 bp, synthetic construct
  misc_feature 1..20: note = CRISPR gRNA sequence
  source 1..20: mol_type = other DNA
aaaggaacagggcctggaaa

SEQ ID NO: 56600 - DNA, 20 bp, synthetic construct
  misc_feature 1..20: note = CRISPR gRNA sequence
  source 1..20: mol_type = other DNA
aacagggcctggaaacagtt

SEQ ID NO: 56601 - DNA, 20 bp, synthetic construct
  misc_feature 1..20: note = CRISPR gRNA sequence
  source 1..20: mol_type = other DNA
gggcctggaaacagttcaga

SEQ ID NO: 56602 - DNA, 20 bp, synthetic construct
  misc_feature 1..20: note = CRISPR gRNA sequence
  source 1..20: mol_type = other DNA
gatggccctctgcccacttc

SEQ ID NO: 56603 - DNA, 20 bp, synthetic construct
  misc_feature 1..20: note = CRISPR gRNA sequence
  source 1..20: mol_type = other DNA
ggccctctgcccacttctgg

SEQ ID NO: 56604 - DNA, 20 bp, synthetic construct
  misc_feature 1..20: note = CRISPR gRNA sequence
  source 1..20: mol_type = other DNA
ccctctgcccacttctggca

SEQ ID NO: 56605 - DNA, 20 bp, synthetic construct
  misc_feature 1..20: note = CRISPR gRNA sequence
  source 1..20: mol_type = other DNA
ctgcccacttctggcagagc

SEQ ID NO: 56606 - DNA, 20 bp, synthetic construct
  misc_feature 1..20: note = CRISPR gRNA sequence
  source 1..20: mol_type = other DNA
cccacttctggcagagccgg

SEQ ID NO: 56607 - DNA, 20 bp, synthetic construct
  misc_feature 1..20: note = CRISPR gRNA sequence
  source 1..20: mol_type = other DNA
ccacttctggcagagccggt

SEQ ID NO: 56608 - DNA, 20 bp, synthetic construct
  misc_feature 1..20: note = CRISPR gRNA sequence
  source 1..20: mol_type = other DNA
ttctggcagagccggtgggc

SEQ ID NO: 56609 - DNA, 20 bp, synthetic construct
  misc_feature 1..20: note = CRISPR gRNA sequence
  source 1..20: mol_type = other DNA
gcagagccggtgggccagcg

SEQ ID NO: 56610 - DNA, 20 bp, synthetic construct
  misc_feature 1..20: note = CRISPR gRNA sequence
  source 1..20: mol_type = other DNA
cagcgtggtcttgcccatgc

SEQ ID NO: 56611 - DNA, 20 bp, synthetic construct
  misc_feature 1..20: note = CRISPR gRNA sequence
  source 1..20: mol_type = other DNA
cccatgccagccttccccaa

SEQ ID NO: 56612 - DNA, 20 bp, synthetic construct
  misc_feature 1..20: note = CRISPR gRNA sequence
  source 1..20: mol_type = other DNA
gccagccttccccaaaagca

SEQ ID NO: 56613 - DNA, 20 bp, synthetic construct
  misc_feature 1..20: note = CRISPR gRNA sequence
  source 1..20: mol_type = other DNA
cccaaaagcacggtcaccct

SEQ ID NO: 56614 - DNA, 20 bp, synthetic construct
  misc_feature 1..20: note = CRISPR gRNA sequence
  source 1..20: mol_type = other DNA
ccaaaagcacggtcaccctc

SEQ ID NO: 56615 - DNA, 20 bp, synthetic construct
  misc_feature 1..20: note = CRISPR gRNA sequence
  source 1..20: mol_type = other DNA
cctcgggcccttgttaaccc

SEQ ID NO: 56616 - DNA, 20 bp, synthetic construct
  misc_feature 1..20: note = CRISPR gRNA sequence
  source 1..20: mol_type = other DNA
ccttgttaaccctggtgttg

SEQ ID NO: 56617 - DNA, 20 bp, synthetic construct
  misc_feature 1..20: note = CRISPR gRNA sequence
  source 1..20: mol_type = other DNA
ttgttaaccctggtgttgaa

SEQ ID NO: 56618 - DNA, 20 bp, synthetic construct
  misc_feature 1..20: note = CRISPR gRNA sequence
  source 1..20: mol_type = other DNA
tgttaaccctggtgttgaag

SEQ ID NO: 56619 - DNA, 20 bp, synthetic construct
  misc_feature 1..20: note = CRISPR gRNA sequence
  source 1..20: mol_type = other DNA
ccctggtgttgaagaggtcc

SEQ ID NO: 56620 - DNA, 20 bp, synthetic construct
  misc_feature 1..20: note = CRISPR gRNA sequence
  source 1..20: mol_type = other DNA
gaggtccgagatgctcacgt

SEQ ID NO: 56621 - DNA, 20 bp, synthetic construct
  misc_feature 1..20: note = CRISPR gRNA sequence
  source 1..20: mol_type = other DNA
caccttgacgtcccccataa

SEQ ID NO: 56622 - DNA, 20 bp, synthetic construct
  misc_feature 1..20: note = CRISPR gRNA sequence
  source 1..20: mol_type = other DNA
tcccccataatggccccctc

SEQ ID NO: 56623 - DNA, 20 bp, synthetic construct
  misc_feature 1..20: note = CRISPR gRNA sequence
  source 1..20: mol_type = other DNA
ccccataatggccccctccg

SEQ ID NO: 56624 - DNA, 20 bp, synthetic construct
  misc_feature 1..20: note = CRISPR gRNA sequence
  source 1..20: mol_type = other DNA
tggccccctccggagtgtct

SEQ ID NO: 56625 - DNA, 20 bp, synthetic construct
  misc_feature 1..20: note = CRISPR gRNA sequence
  source 1..20: mol_type = other DNA
ggccccctccggagtgtcta

SEQ ID NO: 56626 - DNA, 20 bp, synthetic construct
  misc_feature 1..20: note = CRISPR gRNA sequence
  source 1..20: mol_type = other DNA
cggagtgtctaaggatgctg

SEQ ID NO: 56627 - DNA, 20 bp, synthetic construct
  misc_feature 1..20: note = CRISPR gRNA sequence
  source 1..20: mol_type = other DNA
tgtctaaggatgctgtggcc

SEQ ID NO: 56628 - DNA, 20 bp, synthetic construct
  misc_feature 1..20: note = CRISPR gRNA sequence
  source 1..20: mol_type = other DNA
aaggatgctgtggcccggcg

SEQ ID NO: 56629 - DNA, 20 bp, synthetic construct
  misc_feature 1..20: note = CRISPR gRNA sequence
  source 1..20: mol_type = other DNA
aggatgctgtggcccggcgc

SEQ ID NO: 56630 - DNA, 20 bp, synthetic construct
  misc_feature 1..20: note = CRISPR gRNA sequence
  source 1..20: mol_type = other DNA
gctgtggcccggcgcaggat

SEQ ID NO: 56631 - DNA, 20 bp, synthetic construct
  misc_feature 1..20: note = CRISPR gRNA sequence
  source 1..20: mol_type = other DNA
tgtggcccggcgcaggattg

SEQ ID NO: 56632 - DNA, 20 bp, synthetic construct
  misc_feature 1..20: note = CRISPR gRNA sequence
  source 1..20: mol_type = other DNA
gtggcccggcgcaggattgg

SEQ ID NO: 56633 - DNA, 20 bp, synthetic construct
  misc_feature 1..20: note = CRISPR gRNA sequence
  source 1..20: mol_type = other DNA
tggcccggcgcaggattgga

SEQ ID NO: 56634 - DNA, 20 bp, synthetic construct
  misc_feature 1..20: note = CRISPR gRNA sequence
  source 1..20: mol_type = other DNA
ggcgcaggattggagggaca

SEQ ID NO: 56635 - DNA, 20 bp, synthetic construct
  misc_feature 1..20: note = CRISPR gRNA sequence
  source 1..20: mol_type = other DNA
ggattggagggacatagacc

SEQ ID NO: 56636 - DNA, 20 bp, synthetic construct
  misc_feature 1..20: note = CRISPR gRNA sequence
  source 1..20: mol_type = other DNA
ttggagggacatagacctgg

SEQ ID NO: 56637 - DNA, 20 bp, synthetic construct
  misc_feature 1..20: note = CRISPR gRNA sequence
  source 1..20: mol_type = other DNA
gagggacatagacctggtgg

SEQ ID NO: 56638 - DNA, 20 bp, synthetic construct
  misc_feature 1..20: note = CRISPR gRNA sequence
  source 1..20: mol_type = other DNA
agggacatagacctggtgga

SEQ ID NO: 56639 - DNA, 20 bp, synthetic construct
  misc_feature 1..20: note = CRISPR gRNA sequence
  source 1..20: mol_type = other DNA
catagacctggtggaaggcg

SEQ ID NO: 56640 - DNA, 20 bp, synthetic construct
  misc_feature 1..20: note = CRISPR gRNA sequence
  source 1..20: mol_type = other DNA
atagacctggtggaaggcgt

SEQ ID NO: 56641 - DNA, 20 bp, synthetic construct
  misc_feature 1..20: note = CRISPR gRNA sequence
  source 1..20: mol_type = other DNA
tagacctggtggaaggcgtg

SEQ ID NO: 56642 - DNA, 20 bp, synthetic construct
  misc_feature 1..20: note = CRISPR gRNA sequence
  source 1..20: mol_type = other DNA
ggcgtggggctgccctgacc

SEQ ID NO: 56643 - DNA, 20 bp, synthetic construct
  misc_feature 1..20: note = CRISPR gRNA sequence
  source 1..20: mol_type = other DNA
gcgtggggctgccctgaccc

SEQ ID NO: 56644 - DNA, 20 bp, synthetic construct
  misc_feature 1..20: note = CRISPR gRNA sequence
  source 1..20: mol_type = other DNA
cgtggggctgccctgaccca

SEQ ID NO: 56645 - DNA, 20 bp, synthetic construct
  misc_feature 1..20: note = CRISPR gRNA sequence
  source 1..20: mol_type = other DNA
gctgccctgacccagggatt

SEQ ID NO: 56646 - DNA, 20 bp, synthetic construct
  misc_feature 1..20: note = CRISPR gRNA sequence
  source 1..20: mol_type = other DNA
acccagggatttggctcctg

SEQ ID NO: 56647 - DNA, 20 bp, synthetic construct
  misc_feature 1..20: note = CRISPR gRNA sequence
  source 1..20: mol_type = other DNA
tttggctcctgtagcgctgc

SEQ ID NO: 56648 - DNA, 20 bp, synthetic construct
  misc_feature 1..20: note = CRISPR gRNA sequence
  source 1..20: mol_type = other DNA
ttggctcctgtagcgctgct

SEQ ID NO: 56649 - DNA, 20 bp, synthetic construct
  misc_feature 1..20: note = CRISPR gRNA sequence
  source 1..20: mol_type = other DNA
gctcctgtagcgctgctggg

SEQ ID NO: 56650 - DNA, 20 bp, synthetic construct
  misc_feature 1..20: note = CRISPR gRNA sequence
  source 1..20: mol_type = other DNA
tcctgtagcgctgctgggca

SEQ ID NO: 56651 - DNA, 20 bp, synthetic construct
  misc_feature 1..20: note = CRISPR gRNA sequence
  source 1..20: mol_type = other DNA
cctgtagcgctgctgggcag

SEQ ID NO: 56652 - DNA, 20 bp, synthetic construct
  misc_feature 1..20: note = CRISPR gRNA sequence
  source 1..20: mol_type = other DNA
cgctgctgggcagaggtccg

SEQ ID NO: 56653 - DNA, 20 bp, synthetic construct
  misc_feature 1..20: note = CRISPR gRNA sequence
  source 1..20: mol_type = other DNA
gctgctgggcagaggtccgc

SEQ ID NO: 56654 - DNA, 20 bp, synthetic construct
  misc_feature 1..20: note = CRISPR gRNA sequence
  source 1..20: mol_type = other DNA
tgctgggcagaggtccgcag

SEQ ID NO: 56655 - DNA, 20 bp, synthetic construct
  misc_feature 1..20: note = CRISPR gRNA sequence
  source 1..20: mol_type = other DNA
gcagaggtccgcaggagctg

SEQ ID NO: 56656 - DNA, 20 bp, synthetic construct
  misc_feature 1..20: note = CRISPR gRNA sequence
  source 1..20: mol_type = other DNA
cagaggtccgcaggagctgc

SEQ ID NO: 56657 - DNA, 20 bp, synthetic construct
  misc_feature 1..20: note = CRISPR gRNA sequence
  source 1..20: mol_type = other DNA
caggagctgcaggtacttct

SEQ ID NO: 56658 - DNA, 20 bp, synthetic construct
  misc_feature 1..20: note = CRISPR gRNA sequence
  source 1..20: mol_type = other DNA
tacttcttggccaactctgc

SEQ ID NO: 56659 - DNA, 20 bp, synthetic construct
  misc_feature 1..20: note = CRISPR gRNA sequence
  source 1..20: mol_type = other DNA
acttcttggccaactctgca

SEQ ID NO: 56660 - DNA, 20 bp, synthetic construct
  misc_feature 1..20: note = CRISPR gRNA sequence
  source 1..20: mol_type = other DNA
cttcttggccaactctgcaa

SEQ ID NO: 56661 - DNA, 20 bp, synthetic construct
  misc_feature 1..20: note = CRISPR gRNA sequence
  source 1..20: mol_type = other DNA
ttcttggccaactctgcaag

SEQ ID NO: 56662 - DNA, 20 bp, synthetic construct
  misc_feature 1..20: note = CRISPR gRNA sequence
  source 1..20: mol_type = other DNA
ttggccaactctgcaagggg

SEQ ID NO: 56663 - DNA, 20 bp, synthetic construct
  misc_feature 1..20: note = CRISPR gRNA sequence
  source 1..20: mol_type = other DNA
tggccaactctgcaaggggc

SEQ ID NO: 56664 - DNA, 20 bp, synthetic construct
  misc_feature 1..20: note = CRISPR gRNA sequence
  source 1..20: mol_type = other DNA
ggccaactctgcaaggggca

SEQ ID NO: 56665 - DNA, 20 bp, synthetic construct
  misc_feature 1..20: note = CRISPR gRNA sequence
  source 1..20: mol_type = other DNA
ctctgcaaggggcagggaca

SEQ ID NO: 56666 - DNA, 20 bp, synthetic construct
  misc_feature 1..20: note = CRISPR gRNA sequence
  source 1..20: mol_type = other DNA
aaggggcagggacatggcat

SEQ ID NO: 56667 - DNA, 20 bp, synthetic construct
  misc_feature 1..20: note = CRISPR gRNA sequence
  source 1..20: mol_type = other DNA
aggggcagggacatggcatg

SEQ ID NO: 56668 - DNA, 20 bp, synthetic construct
  misc_feature 1..20: note = CRISPR gRNA sequence
  source 1..20: mol_type = other DNA
gggcagggacatggcatgag

SEQ ID NO: 56669 - DNA, 20 bp, synthetic construct
  misc_feature 1..20: note = CRISPR gRNA sequence
  source 1..20: mol_type = other DNA
gcagggacatggcatgagga

SEQ ID NO: 56670 - DNA, 20 bp, synthetic construct
  misc_feature 1..20: note = CRISPR gRNA sequence
  source 1..20: mol_type = other DNA
cagggacatggcatgaggag

SEQ ID NO: 56671 - DNA, 20 bp, synthetic construct
  misc_feature 1..20: note = CRISPR gRNA sequence
  source 1..20: mol_type = other DNA
ggcatgaggagaggaccccc

SEQ ID NO: 56672 - DNA, 20 bp, synthetic construct
  misc_feature 1..20: note = CRISPR gRNA sequence
  source 1..20: mol_type = other DNA
ctgctcatgtcttcttgccc

SEQ ID NO: 56673 - DNA, 20 bp, synthetic construct
  misc_feature 1..20: note = CRISPR gRNA sequence
  source 1..20: mol_type = other DNA
atgtcttcttgccccagtat

SEQ ID NO: 56674 - DNA, 20 bp, synthetic construct
  misc_feature 1..20: note = CRISPR gRNA sequence
  source 1..20: mol_type = other DNA
tgtcttcttgccccagtatt

SEQ ID NO: 56675 - DNA, 20 bp, synthetic construct
  misc_feature 1..20: note = CRISPR gRNA sequence
  source 1..20: mol_type = other DNA
ttgccccagtattgggctgt

SEQ ID NO: 56676 - DNA, 20 bp, synthetic construct
  misc_feature 1..20: note = CRISPR gRNA sequence
  source 1..20: mol_type = other DNA
tgccccagtattgggctgtt

SEQ ID NO: 56677 - DNA, 20 bp, synthetic construct
  misc_feature 1..20: note = CRISPR gRNA sequence
  source 1..20: mol_type = other DNA
ccccagtattgggctgttgg

SEQ ID NO: 56678 - DNA, 20 bp, synthetic construct
  misc_feature 1..20: note = CRISPR gRNA sequence
  source 1..20: mol_type = other DNA
attgggctgttgggagcctg

SEQ ID NO: 56679 - DNA, 20 bp, synthetic construct
  misc_feature 1..20: note = CRISPR gRNA sequence
  source 1..20: mol_type = other DNA
ctgttgggagcctgtagccc

SEQ ID NO: 56680 - DNA, 20 bp, synthetic construct
  misc_feature 1..20: note = CRISPR gRNA sequence
  source 1..20: mol_type = other DNA
ccccagatgtgtatgtatga

SEQ ID NO: 56681 - DNA, 20 bp, synthetic construct
  misc_feature 1..20: note = CRISPR gRNA sequence
  source 1..20: mol_type = other DNA
cccagatgtgtatgtatgat

SEQ ID NO: 56682 - DNA, 20 bp, synthetic construct
  misc_feature 1..20: note = CRISPR gRNA sequence
  source 1..20: mol_type = other DNA
ccagatgtgtatgtatgatg

SEQ ID NO: 56683 - DNA, 20 bp, synthetic construct
  misc_feature 1..20: note = CRISPR gRNA sequence
  source 1..20: mol_type = other DNA
atgtgtatgtatgatggggt

SEQ ID NO: 56684 - DNA, 20 bp, synthetic construct
  misc_feature 1..20: note = CRISPR gRNA sequence
  source 1..20: mol_type = other DNA
tgtgtatgtatgatggggtg

SEQ ID NO: 56685 - DNA, 20 bp, synthetic construct
  misc_feature 1..20: note = CRISPR gRNA sequence
  source 1..20: mol_type = other DNA
gtgtatgtatgatggggtga

SEQ ID NO: 56686 - DNA, 20 bp, synthetic construct
  misc_feature 1..20: note = CRISPR gRNA sequence
  source 1..20: mol_type = other DNA
tatgtatgatggggtgaggg

SEQ ID NO: 56687 - DNA, 20 bp, synthetic construct
  misc_feature 1..20: note = CRISPR gRNA sequence
  source 1..20: mol_type = other DNA
atgtatgatggggtgagggt

SEQ ID NO: 56688 - DNA, 20 bp, synthetic construct
  misc_feature 1..20: note = CRISPR gRNA sequence
  source 1..20: mol_type = other DNA
tgtatgatggggtgagggtg

SEQ ID NO: 56689 - DNA, 20 bp, synthetic construct
  misc_feature 1..20: note = CRISPR gRNA sequence
  source 1..20: mol_type = other DNA
gtatgatggggtgagggtgg

SEQ ID NO: 56690 - DNA, 20 bp, synthetic construct
  misc_feature 1..20: note = CRISPR gRNA sequence
  source 1..20: mol_type = other DNA
ggggtgagggtgggggtgtc

SEQ ID NO: 56691 - DNA, 20 bp, synthetic construct
  misc_feature 1..20: note = CRISPR gRNA sequence
  source 1..20: mol_type = other DNA
ggtgagggtgggggtgtcaa

SEQ ID NO: 56692 - DNA, 20 bp, synthetic construct
  misc_feature 1..20: note = CRISPR gRNA sequence
  source 1..20: mol_type = other DNA
tgggggtgtcaagagcacca

SEQ ID NO: 56693 - DNA, 20 bp, synthetic construct
  misc_feature 1..20: note = CRISPR gRNA sequence
  source 1..20: mol_type = other DNA
gggggtgtcaagagcaccat

SEQ ID NO: 56694 - DNA, 20 bp, synthetic construct
  misc_feature 1..20: note = CRISPR gRNA sequence
  source 1..20: mol_type = other DNA
ggggtgtcaagagcaccata

SEQ ID NO: 56695 - DNA, 20 bp, synthetic construct
  misc_feature 1..20: note = CRISPR gRNA sequence
  source 1..20: mol_type = other DNA
gggtgtcaagagcaccatag

SEQ ID NO: 56696 - DNA, 20 bp, synthetic construct
  misc_feature 1..20: note = CRISPR gRNA sequence
  source 1..20: mol_type = other DNA
ggtgtcaagagcaccatagg

SEQ ID NO: 56697 - DNA, 20 bp, synthetic construct
  misc_feature 1..20: note = CRISPR gRNA sequence
  source 1..20: mol_type = other DNA
atctgtgccaccccaacttc

SEQ ID NO: 56698 - DNA, 20 bp, synthetic construct
  misc_feature 1..20: note = CRISPR gRNA sequence
  source 1..20: mol_type = other DNA
tgtgccaccccaacttccag

SEQ ID NO: 56699 - DNA, 20 bp, synthetic construct
  misc_feature 1..20: note = CRISPR gRNA sequence
  source 1..20: mol_type = other DNA
gtgccaccccaacttccaga

SEQ ID NO: 56700 - DNA, 20 bp, synthetic construct
  misc_feature 1..20: note = CRISPR gRNA sequence
  source 1..20: mol_type = other DNA
ccccaacttccagaaggaat

SEQ ID NO: 56701 - DNA, 20 bp, synthetic construct
  misc_feature 1..20: note = CRISPR gRNA sequence
  source 1..20: mol_type = other DNA
ttccagaaggaatcagttct

SEQ ID NO: 56702 - DNA, 20 bp, synthetic construct
  misc_feature 1..20: note = CRISPR gRNA sequence
  source 1..20: mol_type = other DNA
tccagaaggaatcagttcta

SEQ ID NO: 56703 - DNA, 20 bp, synthetic construct
  misc_feature 1..20: note = CRISPR gRNA sequence
  source 1..20: mol_type = other DNA
ccagaaggaatcagttctaa

SEQ ID NO: 56704 - DNA, 20 bp, synthetic construct
  misc_feature 1..20: note = CRISPR gRNA sequence
  source 1..20: mol_type = other DNA
agaaggaatcagttctaagg

SEQ ID NO: 56705 - DNA, 20 bp, synthetic construct
  misc_feature 1..20: note = CRISPR gRNA sequence
  source 1..20: mol_type = other DNA
gaatcagttctaagggagca

SEQ ID NO: 56706 - DNA, 20 bp, synthetic construct
  misc_feature 1..20: note = CRISPR gRNA sequence
  source 1..20: mol_type = other DNA
aatcagttctaagggagcat

SEQ ID NO: 56707 - DNA, 20 bp, synthetic construct
  misc_feature 1..20: note = CRISPR gRNA sequence
  source 1..20: mol_type = other DNA
ctaagggagcataggctctc

SEQ ID NO: 56708 - DNA, 20 bp, synthetic construct
  misc_feature 1..20: note = CRISPR gRNA sequence
  source 1..20: mol_type = other DNA
agggagcataggctctccgg

SEQ ID NO: 56709 - DNA, 20 bp, synthetic construct
  misc_feature 1..20: note = CRISPR gRNA sequence
  source 1..20: mol_type = other DNA
ctctccggtagctatttaaa

SEQ ID NO: 56710 - DNA, 20 bp, synthetic construct
  misc_feature 1..20: note = CRISPR gRNA sequence
  source 1..20: mol_type = other DNA
tctccggtagctatttaaac

SEQ ID NO: 56711 - DNA, 20 bp, synthetic construct
  misc_feature 1..20: note = CRISPR gRNA sequence
  source 1..20: mol_type = other DNA
ccggtagctatttaaacagg

SEQ ID NO: 56712 - DNA, 20 bp, synthetic construct
  misc_feature 1..20: note = CRISPR gRNA sequence
  source 1..20: mol_type = other DNA
cggtagctatttaaacaggc

SEQ ID NO: 56713 - DNA, 20 bp, synthetic construct
  misc_feature 1..20: note = CRISPR gRNA sequence
  source 1..20: mol_type = other DNA
tagctatttaaacaggcagg

SEQ ID NO: 56714 - DNA, 20 bp, synthetic construct
  misc_feature 1..20: note = CRISPR gRNA sequence
  source 1..20: mol_type = other DNA
agctatttaaacaggcaggt

SEQ ID NO: 56715 - DNA, 20 bp, synthetic construct
  misc_feature 1..20: note = CRISPR gRNA sequence
  source 1..20: mol_type = other DNA
tttaaacaggcaggtgggaa

SEQ ID NO: 56716 - DNA, 20 bp, synthetic construct
  misc_feature 1..20: note = CRISPR gRNA sequence
  source 1..20: mol_type = other DNA
ttaaacaggcaggtgggaat

SEQ ID NO: 56717 - DNA, 20 bp, synthetic construct
  misc_feature 1..20: note = CRISPR gRNA sequence
  source 1..20: mol_type = other DNA
taaacaggcaggtgggaatg

SEQ ID NO: 56718 - DNA, 20 bp, synthetic construct
  misc_feature 1..20: note = CRISPR gRNA sequence
  source 1..20: mol_type = other DNA
acaggcaggtgggaatgggg

SEQ ID NO: 56719 - DNA, 20 bp, synthetic construct
  misc_feature 1..20: note = CRISPR gRNA sequence
  source 1..20: mol_type = other DNA
caggtgggaatggggaagtg

SEQ ID NO: 56720 - DNA, 20 bp, synthetic construct
  misc_feature 1..20: note = CRISPR gRNA sequence
  source 1..20: mol_type = other DNA
aggtgggaatggggaagtgt

SEQ ID NO: 56721 - DNA, 20 bp, synthetic construct
  misc_feature 1..20: note = CRISPR gRNA sequence
  source 1..20: mol_type = other DNA
gaatggggaagtgtgggtca

SEQ ID NO: 56722 - DNA, 20 bp, synthetic construct
  misc_feature 1..20: note = CRISPR gRNA sequence
  source 1..20: mol_type = other DNA
cggttctatccattctgcaa

SEQ ID NO: 56723 - DNA, 20 bp, synthetic construct
  misc_feature 1..20: note = CRISPR gRNA sequence
  source 1..20: mol_type = other DNA
ccattctgcaatagtacacg

SEQ ID NO: 56724 - DNA, 20 bp, synthetic construct
  misc_feature 1..20: note = CRISPR gRNA sequence
  source 1..20: mol_type = other DNA
tgcaatagtacacgtggtgt

SEQ ID NO: 56725 - DNA, 20 bp, synthetic construct
  misc_feature 1..20: note = CRISPR gRNA sequence
  source 1..20: mol_type = other DNA
gcaatagtacacgtggtgta

SEQ ID NO: 56726 - DNA, 20 bp, synthetic construct
  misc_feature 1..20: note = CRISPR gRNA sequence
  source 1..20: mol_type = other DNA
caatagtacacgtggtgtaa

SEQ ID NO: 56727 - DNA, 20 bp, synthetic construct
  misc_feature 1..20: note = CRISPR gRNA sequence
  source 1..20: mol_type = other DNA
gtacacgtggtgtaagggtt

SEQ ID NO: 56728 - DNA, 20 bp, synthetic construct
  misc_feature 1..20: note = CRISPR gRNA sequence
  source 1..20: mol_type = other DNA
acgtggtgtaagggttcagt

SEQ ID NO: 56729 - DNA, 20 bp, synthetic construct
  misc_feature 1..20: note = CRISPR gRNA sequence
  source 1..20: mol_type = other DNA
ggtgtaagggttcagtaaga

SEQ ID NO: 56730 - DNA, 20 bp, synthetic construct
  misc_feature 1..20: note = CRISPR gRNA sequence
  source 1..20: mol_type = other DNA
gtgtaagggttcagtaagat

SEQ ID NO: 56731 - DNA, 20 bp, synthetic construct
  misc_feature 1..20: note = CRISPR gRNA sequence
  source 1..20: mol_type = other DNA
tgtaagggttcagtaagatg

SEQ ID NO: 56732 - DNA, 20 bp, synthetic construct
  misc_feature 1..20: note = CRISPR gRNA sequence
  source 1..20: mol_type = other DNA
gtaagggttcagtaagatgg

SEQ ID NO: 56733 - DNA, 20 bp, synthetic construct
  misc_feature 1..20: note = CRISPR gRNA sequence
  source 1..20: mol_type = other DNA
taagggttcagtaagatggg

SEQ ID NO: 56734 - DNA, 20 bp, synthetic construct
  misc_feature 1..20: note = CRISPR gRNA sequence
  source 1..20: mol_type = other DNA
agggttcagtaagatggggg

SEQ ID NO: 56735 - DNA, 20 bp, synthetic construct
  misc_feature 1..20: note = CRISPR gRNA sequence
  source 1..20: mol_type = other DNA
gggttcagtaagatgggggg

SEQ ID NO: 56736 - DNA, 20 bp, synthetic construct
  misc_feature 1..20: note = CRISPR gRNA sequence
  source 1..20: mol_type = other DNA
ggttcagtaagatgggggga

SEQ ID NO: 56737 - DNA, 20 bp, synthetic construct
  misc_feature 1..20: note = CRISPR gRNA sequence
  source 1..20: mol_type = other DNA
gttcagtaagatggggggag

SEQ ID NO: 56738 - DNA, 20 bp, synthetic construct
  misc_feature 1..20: note = CRISPR gRNA sequence
  source 1..20: mol_type = other DNA
gtaagatggggggaggggaa

SEQ ID NO: 56739 - DNA, 20 bp, synthetic construct
  misc_feature 1..20: note = CRISPR gRNA sequence
  source 1..20: mol_type = other DNA
taagatggggggaggggaat

SEQ ID NO: 56740 - DNA, 20 bp, synthetic construct
  misc_feature 1..20: note = CRISPR gRNA sequence
  source 1..20: mol_type = other DNA
aagatggggggaggggaata

SEQ ID NO: 56741 - DNA, 20 bp, synthetic construct
  misc_feature 1..20: note = CRISPR gRNA sequence
  source 1..20: mol_type = other DNA
ctcttttttttcttttttcc

SEQ ID NO: 56742 - DNA, 20 bp, synthetic construct
  misc_feature 1..20: note = CRISPR gRNA sequence
  source 1..20: mol_type = other DNA
cttttttttcttttttccca

SEQ ID NO: 56743 - DNA, 20 bp, synthetic construct
  misc_feature 1..20: note = CRISPR gRNA sequence
  source 1..20: mol_type = other DNA
tttttcttttttcccagaga

SEQ ID NO: 56744 - DNA, 20 bp, synthetic construct
  misc_feature 1..20: note = CRISPR gRNA sequence
  source 1..20: mol_type = other DNA
tttcttttttcccagagaca

SEQ ID NO: 56745 - DNA, 20 bp, synthetic construct
  misc_feature 1..20: note = CRISPR gRNA sequence
  source 1..20: mol_type = other DNA
ttttcccagagacagagtct

SEQ ID NO: 56746 - DNA, 20 bp, synthetic construct
  misc_feature 1..20: note = CRISPR gRNA sequence
  source 1..20: mol_type = other DNA
gacagagtctcagtcttgcc

SEQ ID NO: 56747 - DNA, 20 bp, synthetic construct
  misc_feature 1..20: note = CRISPR gRNA sequence
  source 1..20: mol_type = other DNA
acagagtctcagtcttgccc

SEQ ID NO: 56748 - DNA, 20 bp, synthetic construct
  misc_feature 1..20: note = CRISPR gRNA sequence
  source 1..20: mol_type = other DNA
tctcagtcttgcccaggctc

SEQ ID NO: 56749 - DNA, 20 bp, synthetic construct
  misc_feature 1..20: note = CRISPR gRNA sequence
  source 1..20: mol_type = other DNA
gtcttgcccaggctccagtg

SEQ ID NO: 56750 - DNA, 20 bp, synthetic construct
  misc_feature 1..20: note = CRISPR gRNA sequence
  source 1..20: mol_type = other DNA
ttgcccaggctccagtgcag

SEQ ID NO: 56751 - DNA, 20 bp, synthetic construct
  misc_feature 1..20: note = CRISPR gRNA sequence
  source 1..20: mol_type = other DNA
ccagtgcagtggcacgatcc

SEQ ID NO: 56752 - DNA, 20 bp, synthetic construct
  misc_feature 1..20: note = CRISPR gRNA sequence
  source 1..20: mol_type = other DNA
ggcacgatcctagcttactg

SEQ ID NO: 56753 - DNA, 20 bp, synthetic construct
  misc_feature 1..20: note = CRISPR gRNA sequence
  source 1..20: mol_type = other DNA
ttactgtagccgcaaactcc

SEQ ID NO: 56754 - DNA, 20 bp, synthetic construct
  misc_feature 1..20: note = CRISPR gRNA sequence
  source 1..20: mol_type = other DNA
agccgcaaactcctggtctc

SEQ ID NO: 56755 - DNA, 20 bp, synthetic construct
  misc_feature 1..20: note = CRISPR gRNA sequence
  source 1..20: mol_type = other DNA
ctcaagtgatcctcctgcct

SEQ ID NO: 56756 - DNA, 20 bp, synthetic construct
  misc_feature 1..20: note = CRISPR gRNA sequence
  source 1..20: mol_type = other DNA
tcctcctgcctcagcctcct

SEQ ID NO: 56757 - DNA, 20 bp, synthetic construct
  misc_feature 1..20: note = CRISPR gRNA sequence
  source 1..20: mol_type = other DNA
tcctgcctcagcctcctgag

SEQ ID NO: 56758 - DNA, 20 bp, synthetic construct
  misc_feature 1..20: note = CRISPR gRNA sequence
  source 1..20: mol_type = other DNA
gcctcagcctcctgagtagc

SEQ ID NO: 56759 - DNA, 20 bp, synthetic construct
  misc_feature 1..20: note = CRISPR gRNA sequence
  source 1..20: mol_type = other DNA
cctcagcctcctgagtagct

SEQ ID NO: 56760 - DNA, 20 bp, synthetic construct
  misc_feature 1..20: note = CRISPR gRNA sequence
  source 1..20: mol_type = other DNA
ctcctgagtagctgggacta

SEQ ID NO: 56761 - DNA, 20 bp, synthetic construct
  misc_feature 1..20: note = CRISPR gRNA sequence
  source 1..20: mol_type = other DNA
tcctgagtagctgggactac

SEQ ID NO: 56762 - DNA, 20 bp, synthetic construct
  misc_feature 1..20: note = CRISPR gRNA sequence
  source 1..20: mol_type = other DNA
caggtgcacaccaccacacc

SEQ ID NO: 56763 - DNA, 20 bp, synthetic construct
  misc_feature 1..20: note = CRISPR gRNA sequence
  source 1..20: mol_type = other DNA
ccagctaatttttgtatttt

SEQ ID NO: 56764 - DNA, 20 bp, synthetic construct
  misc_feature 1..20: note = CRISPR gRNA sequence
  source 1..20: mol_type = other DNA
gctaatttttgtatttttag

SEQ ID NO: 56765 - DNA, 20 bp, synthetic construct
  misc_feature 1..20: note = CRISPR gRNA sequence
  source 1..20: mol_type = other DNA
taatttttgtatttttagta

SEQ ID NO: 56766 - DNA, 20 bp, synthetic construct
  misc_feature 1..20: note = CRISPR gRNA sequence
  source 1..20: mol_type = other DNA
tttgtatttttagtagagac

SEQ ID NO: 56767 - DNA, 20 bp, synthetic construct
  misc_feature 1..20: note = CRISPR gRNA sequence
  source 1..20: mol_type = other DNA
ttgtatttttagtagagaca

SEQ ID NO: 56768 - DNA, 20 bp, synthetic construct
  misc_feature 1..20: note = CRISPR gRNA sequence
  source 1..20: mol_type = other DNA
gagacaaggttttgtcacgt

SEQ ID NO: 56769 - DNA, 20 bp, synthetic construct
  misc_feature 1..20: note = CRISPR gRNA sequence
  source 1..20: mol_type = other DNA
caaggttttgtcacgttggc

SEQ ID NO: 56770 - DNA, 20 bp, synthetic construct
  misc_feature 1..20: note = CRISPR gRNA sequence
  source 1..20: mol_type = other DNA
aaggttttgtcacgttggcc

SEQ ID NO: 56771 - DNA, 20 bp, synthetic construct
  misc_feature 1..20: note = CRISPR gRNA sequence
  source 1..20: mol_type = other DNA
ttttgtcacgttggccaggc

SEQ ID NO: 56772 - DNA, 20 bp, synthetic construct
  misc_feature 1..20: note = CRISPR gRNA sequence
  source 1..20: mol_type = other DNA
ccaggctagtattgaattcc

SEQ ID NO: 56773 - DNA, 20 bp, synthetic construct
  misc_feature 1..20: note = CRISPR gRNA sequence
  source 1..20: mol_type = other DNA
caggctagtattgaattcct

SEQ ID NO: 56774 - DNA, 20 bp, synthetic construct
  misc_feature 1..20: note = CRISPR gRNA sequence
  source 1..20: mol_type = other DNA
ctcaactgatccacctgcct

SEQ ID NO: 56775 - DNA, 20 bp, synthetic construct
  misc_feature 1..20: note = CRISPR gRNA sequence
  source 1..20: mol_type = other DNA
ccacctgcctcagccctcca

SEQ ID NO: 56776 - DNA, 20 bp, synthetic construct
  misc_feature 1..20: note = CRISPR gRNA sequence
  source 1..20: mol_type = other DNA
gcctcagccctccaaagtgc

SEQ ID NO: 56777 - DNA, 20 bp, synthetic construct
  misc_feature 1..20: note = CRISPR gRNA sequence
  source 1..20: mol_type = other DNA
cctcagccctccaaagtgct

SEQ ID NO: 56778 - DNA, 20 bp, synthetic construct
  misc_feature 1..20: note = CRISPR gRNA sequence
  source 1..20: mol_type = other DNA
cctccaaagtgctgggatta

SEQ ID NO: 56779 - DNA, 20 bp, synthetic construct
  misc_feature 1..20: note = CRISPR gRNA sequence
  source 1..20: mol_type = other DNA
ctccaaagtgctgggattac

SEQ ID NO: 56780 - DNA, 20 bp, synthetic construct
  misc_feature 1..20: note = CRISPR gRNA sequence
  source 1..20: mol_type = other DNA
agtgctgggattacaggtgt

SEQ ID NO: 56781 - DNA, 20 bp, synthetic construct
  misc_feature 1..20: note = CRISPR gRNA sequence
  source 1..20: mol_type = other DNA
caggtgtgagccaccgcgcc

SEQ ID NO: 56782 - DNA, 20 bp, synthetic construct
  misc_feature 1..20: note = CRISPR gRNA sequence
  source 1..20: mol_type = other DNA
caacctctttctgtaatatc

SEQ ID NO: 56783 - DNA, 20 bp, synthetic construct
  misc_feature 1..20: note = CRISPR gRNA sequence
  source 1..20: mol_type = other DNA
ttctgtaatatctggatccc

SEQ ID NO: 56784 - DNA, 20 bp, synthetic construct
  misc_feature 1..20: note = CRISPR gRNA sequence
  source 1..20: mol_type = other DNA
agtgcctcttcccaatattt

SEQ ID NO: 56785 - DNA, 20 bp, synthetic construct
  misc_feature 1..20: note = CRISPR gRNA sequence
  source 1..20: mol_type = other DNA
tatttcagttctgcaatgcc

SEQ ID NO: 56786 - DNA, 20 bp, synthetic construct
  misc_feature 1..20: note = CRISPR gRNA sequence
  source 1..20: mol_type = other DNA
atttcagttctgcaatgccc

SEQ ID NO: 56787 - DNA, 20 bp, synthetic construct
  misc_feature 1..20: note = CRISPR gRNA sequence
  source 1..20: mol_type = other DNA
tttcagttctgcaatgccca

SEQ ID NO: 56788 - DNA, 20 bp, synthetic construct
  misc_feature 1..20: note = CRISPR gRNA sequence
  source 1..20: mol_type = other DNA
ttcagttctgcaatgcccag

SEQ ID NO: 56789 - DNA, 20 bp, synthetic construct
  misc_feature 1..20: note = CRISPR gRNA sequence
  source 1..20: mol_type = other DNA
gttctgcaatgcccaggggt

SEQ ID NO: 56790 - DNA, 20 bp, synthetic construct
  misc_feature 1..20: note = CRISPR gRNA sequence
  source 1..20: mol_type = other DNA
gggtgagcactaacaacctg

SEQ ID NO: 56791 - DNA, 20 bp, synthetic construct
  misc_feature 1..20: note = CRISPR gRNA sequence
  source 1..20: mol_type = other DNA
ggtgagcactaacaacctgt

SEQ ID NO: 56792 - DNA, 20 bp, synthetic construct
  misc_feature 1..20: note = CRISPR gRNA sequence
  source 1..20: mol_type = other DNA
gcactaacaacctgtaggcc

SEQ ID NO: 56793 - DNA, 20 bp, synthetic construct
  misc_feature 1..20: note = CRISPR gRNA sequence
  source 1..20: mol_type = other DNA
cactaacaacctgtaggcct

SEQ ID NO: 56794 - DNA, 20 bp, synthetic construct
  misc_feature 1..20: note = CRISPR gRNA sequence
  source 1..20: mol_type = other DNA
taggcctaggcattaccgat

SEQ ID NO: 56795 - DNA, 20 bp, synthetic construct
  misc_feature 1..20: note = CRISPR gRNA sequence
  source 1..20: mol_type = other DNA
ggcattaccgatcggaactg

SEQ ID NO: 56796 - DNA, 20 bp, synthetic construct
  misc_feature 1..20: note = CRISPR gRNA sequence
  source 1..20: mol_type = other DNA
gcattaccgatcggaactgt

SEQ ID NO: 56797 - DNA, 20 bp, synthetic construct
  misc_feature 1..20: note = CRISPR gRNA sequence
  source 1..20: mol_type = other DNA
attaccgatcggaactgtgg

SEQ ID NO: 56798 - DNA, 20 bp, synthetic construct
  misc_feature 1..20: note = CRISPR gRNA sequence
  source 1..20: mol_type = other DNA
ccgatcggaactgtgggagc

SEQ ID NO: 56799 - DNA, 20 bp, synthetic construct
  misc_feature 1..20: note = CRISPR gRNA sequence
  source 1..20: mol_type = other DNA
cgatcggaactgtgggagct

SEQ ID NO: 56800 - DNA, 20 bp, synthetic construct
  misc_feature 1..20: note = CRISPR gRNA sequence
  source 1..20: mol_type = other DNA
ctgtgggagctgggccccta

SEQ ID NO: 56801 - DNA, 20 bp, synthetic construct
  misc_feature 1..20: note = CRISPR gRNA sequence
  source 1..20: mol_type = other DNA
gagctgggcccctacagtgc

SEQ ID NO: 56802 - DNA, 20 bp, synthetic construct
  misc_feature 1..20: note = CRISPR gRNA sequence
  source 1..20: mol_type = other DNA
gatgttaaccttttaattcc

SEQ ID NO: 56803 - DNA, 20 bp, synthetic construct
  misc_feature 1..20: note = CRISPR gRNA sequence
  source 1..20: mol_type = other DNA
atgttaaccttttaattcct

SEQ ID NO: 56804 - DNA, 20 bp, synthetic construct
  misc_feature 1..20: note = CRISPR gRNA sequence
  source 1..20: mol_type = other DNA
cttttaattcctgggtcatt

SEQ ID NO: 56805 - DNA, 20 bp, synthetic construct
  misc_feature 1..20: note = CRISPR gRNA sequence
  source 1..20: mol_type = other DNA
tttaattcctgggtcattga

SEQ ID NO: 56806 - DNA, 20 bp, synthetic construct
  misc_feature 1..20: note = CRISPR gRNA sequence
  source 1..20: mol_type = other DNA
ttaattcctgggtcattgag

SEQ ID NO: 56807 - DNA, 20 bp, synthetic construct
  misc_feature 1..20: note = CRISPR gRNA sequence
  source 1..20: mol_type = other DNA
cctgggtcattgagaggtct

SEQ ID NO: 56808 - DNA, 20 bp, synthetic construct
  misc_feature 1..20: note = CRISPR gRNA sequence
  source 1..20: mol_type = other DNA
ctgggtcattgagaggtctc

SEQ ID NO: 56809 - DNA, 20 bp, synthetic construct
  misc_feature 1..20: note = CRISPR gRNA sequence
  source 1..20: mol_type = other DNA
ttgagaggtctcaggtgacc

SEQ ID NO: 56810 - DNA, 20 bp, synthetic construct
  misc_feature 1..20: note = CRISPR gRNA sequence
  source 1..20: mol_type = other DNA
tgagaggtctcaggtgaccc

SEQ ID NO: 56811 - DNA, 20 bp, synthetic construct
  misc_feature 1..20: note = CRISPR gRNA sequence
  source 1..20: mol_type = other DNA
gagaggtctcaggtgaccca

SEQ ID NO: 56812 - DNA, 20 bp, synthetic construct
  misc_feature 1..20: note = CRISPR gRNA sequence
  source 1..20: mol_type = other DNA
ggtctcaggtgacccaggga

SEQ ID NO: 56813 - DNA, 20 bp, synthetic construct
  misc_feature 1..20: note = CRISPR gRNA sequence
  source 1..20: mol_type = other DNA
gtctcaggtgacccagggaa

SEQ ID NO: 56814 - DNA, 20 bp, synthetic construct
  misc_feature 1..20: note = CRISPR gRNA sequence
  source 1..20: mol_type = other DNA
tctcaggtgacccagggaaa

SEQ ID NO: 56815 - DNA, 20 bp, synthetic construct
  misc_feature 1..20: note = CRISPR gRNA sequence
  source 1..20: mol_type = other DNA
aggtgacccagggaaagggc

SEQ ID NO: 56816 - DNA, 20 bp, synthetic construct
  misc_feature 1..20: note = CRISPR gRNA sequence
  source 1..20: mol_type = other DNA
ggtgacccagggaaagggct

SEQ ID NO: 56817 - DNA, 20 bp, synthetic construct
  misc_feature 1..20: note = CRISPR gRNA sequence
  source 1..20: mol_type = other DNA
gtgacccagggaaagggctg

SEQ ID NO: 56818 - DNA, 20 bp, synthetic construct
  misc_feature 1..20: note = CRISPR gRNA sequence
  source 1..20: mol_type = other DNA
gaaagggctggggctgcttt

SEQ ID NO: 56819 - DNA, 20 bp, synthetic construct
  misc_feature 1..20: note = CRISPR gRNA sequence
  source 1..20: mol_type = other DNA
aaagggctggggctgctttt

SEQ ID NO: 56820 - DNA, 20 bp, synthetic construct
  misc_feature 1..20: note = CRISPR gRNA sequence
  source 1..20: mol_type = other DNA
aagggctggggctgcttttg

SEQ ID NO: 56821 - DNA, 20 bp, synthetic construct
  misc_feature 1..20: note = CRISPR gRNA sequence
  source 1..20: mol_type = other DNA
agggctggggctgcttttgg

SEQ ID NO: 56822 - DNA, 20 bp, synthetic construct
  misc_feature 1..20: note = CRISPR gRNA sequence
  source 1..20: mol_type = other DNA
ctgcttttgggggaacccta

SEQ ID NO: 56823 - DNA, 20 bp, synthetic construct
  misc_feature 1..20: note = CRISPR gRNA sequence
  source 1..20: mol_type = other DNA
tgcttttgggggaaccctat

SEQ ID NO: 56824 - DNA, 20 bp, synthetic construct
  misc_feature 1..20: note = CRISPR gRNA sequence
  source 1..20: mol_type = other DNA
gcttttgggggaaccctatg

SEQ ID NO: 56825 - DNA, 20 bp, synthetic construct
  misc_feature 1..20: note = CRISPR gRNA sequence
  source 1..20: mol_type = other DNA
ttgggggaaccctatgggga

SEQ ID NO: 56826 - DNA, 20 bp, synthetic construct
  misc_feature 1..20: note = CRISPR gRNA sequence
  source 1..20: mol_type = other DNA
tgggggaaccctatggggaa

SEQ ID NO: 56827 - DNA, 20 bp, synthetic construct
  misc_feature 1..20: note = CRISPR gRNA sequence
  source 1..20: mol_type = other DNA
gaaccctatggggaaaggcc

SEQ ID NO: 56828 - DNA, 20 bp, synthetic construct
  misc_feature 1..20: note = CRISPR gRNA sequence
  source 1..20: mol_type = other DNA
aaccctatggggaaaggcca

SEQ ID NO: 56829 - DNA, 20 bp, synthetic construct
  misc_feature 1..20: note = CRISPR gRNA sequence
  source 1..20: mol_type = other DNA
cctatggggaaaggccaagg

SEQ ID NO: 56830 - DNA, 20 bp, synthetic construct
  misc_feature 1..20: note = CRISPR gRNA sequence
  source 1..20: mol_type = other DNA
ccaaggtagtgaactatttt

SEQ ID NO: 56831 - DNA, 20 bp, synthetic construct
  misc_feature 1..20: note = CRISPR gRNA sequence
  source 1..20: mol_type = other DNA
aggtagtgaactattttgag

SEQ ID NO: 56832 - DNA, 20 bp, synthetic construct
  misc_feature 1..20: note = CRISPR gRNA sequence
  source 1..20: mol_type = other DNA
ttgagcggatgtgaatcctc

SEQ ID NO: 56833 - DNA, 20 bp, synthetic construct
  misc_feature 1..20: note = CRISPR gRNA sequence
  source 1..20: mol_type = other DNA
ggatgtgaatcctctggtta

SEQ ID NO: 56834 - DNA, 20 bp, synthetic construct
  misc_feature 1..20: note = CRISPR gRNA sequence
  source 1..20: mol_type = other DNA
gaatcctctggttatagcca

SEQ ID NO: 56835 - DNA, 20 bp, synthetic construct
  misc_feature 1..20: note = CRISPR gRNA sequence
  source 1..20: mol_type = other DNA
cctctggttatagccatggt

SEQ ID NO: 56836 - DNA, 20 bp, synthetic construct
  misc_feature 1..20: note = CRISPR gRNA sequence
  source 1..20: mol_type = other DNA
ctggttatagccatggttgg

SEQ ID NO: 56837 - DNA, 20 bp, synthetic construct
  misc_feature 1..20: note = CRISPR gRNA sequence
  source 1..20: mol_type = other DNA
gttatagccatggttggcag

SEQ ID NO: 56838 - DNA, 20 bp, synthetic construct
  misc_feature 1..20: note = CRISPR gRNA sequence
  source 1..20: mol_type = other DNA
atagccatggttggcagcag

SEQ ID NO: 56839 - DNA, 20 bp, synthetic construct
  misc_feature 1..20: note = CRISPR gRNA sequence
  source 1..20: mol_type = other DNA
tagccatggttggcagcagt

SEQ ID NO: 56840 - DNA, 20 bp, synthetic construct
  misc_feature 1..20: note = CRISPR gRNA sequence
  source 1..20: mol_type = other DNA
agccatggttggcagcagtg

SEQ ID NO: 56841 - DNA, 20 bp, synthetic construct
  misc_feature 1..20: note = CRISPR gRNA sequence
  source 1..20: mol_type = other DNA
gccatggttggcagcagtgg

SEQ ID NO: 56842 - DNA, 20 bp, synthetic construct
  misc_feature 1..20: note = CRISPR gRNA sequence
  source 1..20: mol_type = other DNA
atggttggcagcagtggggg

SEQ ID NO: 56843 - DNA, 20 bp, synthetic construct
  misc_feature 1..20: note = CRISPR gRNA sequence
  source 1..20: mol_type = other DNA
ggttggcagcagtgggggca

SEQ ID NO: 56844 - DNA, 20 bp, synthetic construct
  misc_feature 1..20: note = CRISPR gRNA sequence
  source 1..20: mol_type = other DNA
tggcagcagtgggggcagag

SEQ ID NO: 56845 - DNA, 20 bp, synthetic construct
  misc_feature 1..20: note = CRISPR gRNA sequence
  source 1..20: mol_type = other DNA
ggcagcagtgggggcagaga

SEQ ID NO: 56846 - DNA, 20 bp, synthetic construct
  misc_feature 1..20: note = CRISPR gRNA sequence
  source 1..20: mol_type = other DNA
agtgggggcagagaaggctc

SEQ ID NO: 56847 - DNA, 20 bp, synthetic construct
  misc_feature 1..20: note = CRISPR gRNA sequence
  source 1..20: mol_type = other DNA
ggggcagagaaggctctagt

SEQ ID NO: 56848 - DNA, 20 bp, synthetic construct
  misc_feature 1..20: note = CRISPR gRNA sequence
  source 1..20: mol_type = other DNA
gcagagaaggctctagttag

SEQ ID NO: 56849 - DNA, 20 bp, synthetic construct
  misc_feature 1..20: note = CRISPR gRNA sequence
  source 1..20: mol_type = other DNA
cagagaaggctctagttagt

SEQ ID NO: 56850 - DNA, 20 bp, synthetic construct
  misc_feature 1..20: note = CRISPR gRNA sequence
  source 1..20: mol_type = other DNA
ctagttagtgggacaactcg

SEQ ID NO: 56851 - DNA, 20 bp, synthetic construct
  misc_feature 1..20: note = CRISPR gRNA sequence
  source 1..20: mol_type = other DNA
agttagtgggacaactcgtg

SEQ ID NO: 56852 - DNA, 20 bp, synthetic construct
  misc_feature 1..20: note = CRISPR gRNA sequence
  source 1..20: mol_type = other DNA
tgggacaactcgtggagaac

SEQ ID NO: 56853 - DNA, 20 bp, synthetic construct
  misc_feature 1..20: note = CRISPR gRNA sequence
  source 1..20: mol_type = other DNA
gggacaactcgtggagaacg

SEQ ID NO: 56854 - DNA, 20 bp, synthetic construct
  misc_feature 1..20: note = CRISPR gRNA sequence
  source 1..20: mol_type = other DNA
tggagaacgaggaccattct

SEQ ID NO: 56855 - DNA, 20 bp, synthetic construct
  misc_feature 1..20: note = CRISPR gRNA sequence
  source 1..20: mol_type = other DNA
acgaggaccattctgagaac

SEQ ID NO: 56856 - DNA, 20 bp, synthetic construct
  misc_feature 1..20: note = CRISPR gRNA sequence
  source 1..20: mol_type = other DNA
gaccattctgagaactggtc

SEQ ID NO: 56857 - DNA, 20 bp, synthetic construct
  misc_feature 1..20: note = CRISPR gRNA sequence
  source 1..20: mol_type = other DNA
tctgagaactggtcaagaat

SEQ ID NO: 56858 - DNA, 20 bp, synthetic construct
  misc_feature 1..20: note = CRISPR gRNA sequence
  source 1..20: mol_type = other DNA
tgagaactggtcaagaatga

SEQ ID NO: 56859 - DNA, 20 bp, synthetic construct
  misc_feature 1..20: note = CRISPR gRNA sequence
  source 1..20: mol_type = other DNA
gaactggtcaagaatgagag

SEQ ID NO: 56860 - DNA, 20 bp, synthetic construct
  misc_feature 1..20: note = CRISPR gRNA sequence
  source 1..20: mol_type = other DNA
agtcccctttcttctctcac

SEQ ID NO: 56861 - DNA, 20 bp, synthetic construct
  misc_feature 1..20: note = CRISPR gRNA sequence
  source 1..20: mol_type = other DNA
cctttcttctctcactggcc

SEQ ID NO: 56862 - DNA, 20 bp, synthetic construct
  misc_feature 1..20: note = CRISPR gRNA sequence
  source 1..20: mol_type = other DNA
tcactggcctggcctgccct

SEQ ID NO: 56863 - DNA, 20 bp, synthetic construct
  misc_feature 1..20: note = CRISPR gRNA sequence
  source 1..20: mol_type = other DNA
ctggcctggcctgccctaag

SEQ ID NO: 56864 - DNA, 20 bp, synthetic construct
  misc_feature 1..20: note = CRISPR gRNA sequence
  source 1..20: mol_type = other DNA
agcagctccatgtctcccca

SEQ ID NO: 56865 - DNA, 20 bp, synthetic construct
  misc_feature 1..20: note = CRISPR gRNA sequence
  source 1..20: mol_type = other DNA
gcagctccatgtctccccat

SEQ ID NO: 56866 - DNA, 20 bp, synthetic construct
  misc_feature 1..20: note = CRISPR gRNA sequence
  source 1..20: mol_type = other DNA
catgtctccccatgggcccc

SEQ ID NO: 56867 - DNA, 20 bp, synthetic construct
  misc_feature 1..20: note = CRISPR gRNA sequence
  source 1..20: mol_type = other DNA
atgtctccccatgggccccc

SEQ ID NO: 56868 - DNA, 20 bp, synthetic construct
  misc_feature 1..20: note = CRISPR gRNA sequence
  source 1..20: mol_type = other DNA
tgtctccccatgggccccca

SEQ ID NO: 56869 - DNA, 20 bp, synthetic construct
  misc_feature 1..20: note = CRISPR gRNA sequence
  source 1..20: mol_type = other DNA
cccccagggcctctgtcttg

SEQ ID NO: 56870 - DNA, 20 bp, synthetic construct
  misc_feature 1..20: note = CRISPR gRNA sequence
  source 1..20: mol_type = other DNA
ccccagggcctctgtcttga

SEQ ID NO: 56871 - DNA, 20 bp, synthetic construct
  misc_feature 1..20: note = CRISPR gRNA sequence
  source 1..20: mol_type = other DNA
tctgtcttgaaggtttctcc

SEQ ID NO: 56872 - DNA, 20 bp, synthetic construct
  misc_feature 1..20: note = CRISPR gRNA sequence
  source 1..20: mol_type = other DNA
ctgtcttgaaggtttctccc

SEQ ID NO: 56873 - DNA, 20 bp, synthetic construct
  misc_feature 1..20: note = CRISPR gRNA sequence
  source 1..20: mol_type = other DNA
atccctgctcacccccaaac

SEQ ID NO: 56874 - DNA, 20 bp, synthetic construct
  misc_feature 1..20: note = CRISPR gRNA sequence
  source 1..20: mol_type = other DNA
ccccaaactggtctcctccc

SEQ ID NO: 56875 - DNA, 20 bp, synthetic construct
  misc_feature 1..20: note = CRISPR gRNA sequence
  source 1..20: mol_type = other DNA
cccaaactggtctcctccct

SEQ ID NO: 56876 - DNA, 20 bp, synthetic construct
  misc_feature 1..20: note = CRISPR gRNA sequence
  source 1..20: mol_type = other DNA
cctgggtctccttcaacact

SEQ ID NO: 56877 - DNA, 20 bp, synthetic construct
  misc_feature 1..20: note = CRISPR gRNA sequence
  source 1..20: mol_type = other DNA
ctgggtctccttcaacactg

SEQ ID NO: 56878 - DNA, 20 bp, synthetic construct
  misc_feature 1..20: note = CRISPR gRNA sequence
  source 1..20: mol_type = other DNA
ctccttcaacactgaggaca

SEQ ID NO: 56879 - DNA, 20 bp, synthetic construct
  misc_feature 1..20: note = CRISPR gRNA sequence
  source 1..20: mol_type = other DNA
tccttcaacactgaggacat

SEQ ID NO: 56880 - DNA, 20 bp, synthetic construct
  misc_feature 1..20: note = CRISPR gRNA sequence
  source 1..20: mol_type = other DNA
ccttcaacactgaggacata

SEQ ID NO: 56881 - DNA, 20 bp, synthetic construct
  misc_feature 1..20: note = CRISPR gRNA sequence
  source 1..20: mol_type = other DNA
ctgaggacatagggtgtccc

SEQ ID NO: 56882 - DNA, 20 bp, synthetic construct
  misc_feature 1..20: note = CRISPR gRNA sequence
  source 1..20: mol_type = other DNA
gacatagggtgtccctggaa

SEQ ID NO: 56883 - DNA, 20 bp, synthetic construct
  misc_feature 1..20: note = CRISPR gRNA sequence
  source 1..20: mol_type = other DNA
agggtgtccctggaaaagcc

SEQ ID NO: 56884 - DNA, 20 bp, synthetic construct
  misc_feature 1..20: note = CRISPR gRNA sequence
  source 1..20: mol_type = other DNA
tgtccctggaaaagcctgga

SEQ ID NO: 56885 - DNA, 20 bp, synthetic construct
  misc_feature 1..20: note = CRISPR gRNA sequence
  source 1..20: mol_type = other DNA
ctggaaaagcctggacagcg

SEQ ID NO: 56886 - DNA, 20 bp, synthetic construct
  misc_feature 1..20: note = CRISPR gRNA sequence
  source 1..20: mol_type = other DNA
aaagcctggacagcgaagct

SEQ ID NO: 56887 - DNA, 20 bp, synthetic construct
  misc_feature 1..20: note = CRISPR gRNA sequence
  source 1..20: mol_type = other DNA
cagcgaagctgagacctgta

SEQ ID NO: 56888 - DNA, 20 bp, synthetic construct
  misc_feature 1..20: note = CRISPR gRNA sequence
  source 1..20: mol_type = other DNA
tgagacctgtatggtgcttc

SEQ ID NO: 56889 - DNA, 20 bp, synthetic construct
  misc_feature 1..20: note = CRISPR gRNA sequence
  source 1..20: mol_type = other DNA
tatggtgcttccagctcctt

SEQ ID NO: 56890 - DNA, 20 bp, synthetic construct
  misc_feature 1..20: note = CRISPR gRNA sequence
  source 1..20: mol_type = other DNA
ggtgcttccagctccttcag

SEQ ID NO: 56891 - DNA, 20 bp, synthetic construct
  misc_feature 1..20: note = CRISPR gRNA sequence
  source 1..20: mol_type = other DNA
tgcttccagctccttcagcg

SEQ ID NO: 56892 - DNA, 20 bp, synthetic construct
  misc_feature 1..20: note = CRISPR gRNA sequence
  source 1..20: mol_type = other DNA
tccttcagcggagccctctt

SEQ ID NO: 56893 - DNA, 20 bp, synthetic construct
  misc_feature 1..20: note = CRISPR gRNA sequence
  source 1..20: mol_type = other DNA
cttcagcggagccctcttca

SEQ ID NO: 56894 - DNA, 20 bp, synthetic construct
  misc_feature 1..20: note = CRISPR gRNA sequence
  source 1..20: mol_type = other DNA
cagcggagccctcttcagag

SEQ ID NO: 56895 - DNA, 20 bp, synthetic construct
  misc_feature 1..20: note = CRISPR gRNA sequence
  source 1..20: mol_type = other DNA
tcttcagagaagtccccatg

SEQ ID NO: 56896 - DNA, 20 bp, synthetic construct
  misc_feature 1..20: note = CRISPR gRNA sequence
  source 1..20: mol_type = other DNA
cagagaagtccccatgcagc

SEQ ID NO: 56897 - DNA, 20 bp, synthetic construct
  misc_feature 1..20: note = CRISPR gRNA sequence
  source 1..20: mol_type = other DNA
gaagtccccatgcagccaga

SEQ ID NO: 56898 - DNA, 20 bp, synthetic construct
  misc_feature 1..20: note = CRISPR gRNA sequence
  source 1..20: mol_type = other DNA
aagtccccatgcagccagat

SEQ ID NO: 56899 - DNA, 20 bp, synthetic construct
  misc_feature 1..20: note = CRISPR gRNA sequence
  source 1..20: mol_type = other DNA
tccccatgcagccagatggg

SEQ ID NO: 56900 - DNA, 20 bp, synthetic construct
  misc_feature 1..20: note = CRISPR gRNA sequence
  source 1..20: mol_type = other DNA
ccccatgcagccagatgggt

SEQ ID NO: 56901 - DNA, 20 bp, synthetic construct
  misc_feature 1..20: note = CRISPR gRNA sequence
  source 1..20: mol_type = other DNA
cccatgcagccagatgggtg

SEQ ID NO: 56902 - DNA, 20 bp, synthetic construct
  misc_feature 1..20: note = CRISPR gRNA sequence
  source 1..20: mol_type = other DNA
catgcagccagatgggtggg

SEQ ID NO: 56903 - DNA, 20 bp, synthetic construct
  misc_feature 1..20: note = CRISPR gRNA sequence
  source 1..20: mol_type = other DNA
gtggggagccccttcgctgc

SEQ ID NO: 56904 - DNA, 20 bp, synthetic construct
  misc_feature 1..20: note = CRISPR gRNA sequence
  source 1..20: mol_type = other DNA
gagccccttcgctgccagcc

SEQ ID NO: 56905 - DNA, 20 bp, synthetic construct
  misc_feature 1..20: note = CRISPR gRNA sequence
  source 1..20: mol_type = other DNA
agccccttcgctgccagccc

SEQ ID NO: 56906 - DNA, 20 bp, synthetic construct
  misc_feature 1..20: note = CRISPR gRNA sequence
  source 1..20: mol_type = other DNA
ggcctctcctctgcctgtgc

SEQ ID NO: 56907 - DNA, 20 bp, synthetic construct
  misc_feature 1..20: note = CRISPR gRNA sequence
  source 1..20: mol_type = other DNA
ctctgcctgtgcaagacctc

SEQ ID NO: 56908 - DNA, 20 bp, synthetic construct
  misc_feature 1..20: note = CRISPR gRNA sequence
  source 1..20: mol_type = other DNA
gacctccagtccttttctcc

SEQ ID NO: 56909 - DNA, 20 bp, synthetic construct
  misc_feature 1..20: note = CRISPR gRNA sequence
  source 1..20: mol_type = other DNA
cttttctcctggaaacttgc

SEQ ID NO: 56910 - DNA, 20 bp, synthetic construct
  misc_feature 1..20: note = CRISPR gRNA sequence
  source 1..20: mol_type = other DNA
ctcctggaaacttgcgagac

SEQ ID NO: 56911 - DNA, 20 bp, synthetic construct
  misc_feature 1..20: note = CRISPR gRNA sequence
  source 1..20: mol_type = other DNA
cctggaaacttgcgagacaa

SEQ ID NO: 56912 - DNA, 20 bp, synthetic construct
  misc_feature 1..20: note = CRISPR gRNA sequence
  source 1..20: mol_type = other DNA
acttgcgagacaagagtcac

SEQ ID NO: 56913 - DNA, 20 bp, synthetic construct
  misc_feature 1..20: note = CRISPR gRNA sequence
  source 1..20: mol_type = other DNA
cttgcgagacaagagtcact

SEQ ID NO: 56914 - DNA, 20 bp, synthetic construct
  misc_feature 1..20: note = CRISPR gRNA sequence
  source 1..20: mol_type = other DNA
gacaagagtcactgggcctc

SEQ ID NO: 56915 - DNA, 20 bp, synthetic construct
  misc_feature 1..20: note = CRISPR gRNA sequence
  source 1..20: mol_type = other DNA
caagagtcactgggcctctg

SEQ ID NO: 56916 - DNA, 20 bp, synthetic construct
  misc_feature 1..20: note = CRISPR gRNA sequence
  source 1..20: mol_type = other DNA
aagagtcactgggcctctgg

SEQ ID NO: 56917 - DNA, 20 bp, synthetic construct
  misc_feature 1..20: note = CRISPR gRNA sequence
  source 1..20: mol_type = other DNA
ctgggcctctggaggcttat

SEQ ID NO: 56918 - DNA, 20 bp, synthetic construct
  misc_feature 1..20: note = CRISPR gRNA sequence
  source 1..20: mol_type = other DNA
ggcctctggaggcttattgg

SEQ ID NO: 56919 - DNA, 20 bp, synthetic construct
  misc_feature 1..20: note = CRISPR gRNA sequence
  source 1..20: mol_type = other DNA
gcctctggaggcttattggc

SEQ ID NO: 56920 - DNA, 20 bp, synthetic construct
  misc_feature 1..20: note = CRISPR gRNA sequence
  source 1..20: mol_type = other DNA
cctctggaggcttattggca

SEQ ID NO: 56921 - DNA, 20 bp, synthetic construct
  misc_feature 1..20: note = CRISPR gRNA sequence
  source 1..20: mol_type = other DNA
ctctggaggcttattggcag

SEQ ID NO: 56922 - DNA, 20 bp, synthetic construct
  misc_feature 1..20: note = CRISPR gRNA sequence
  source 1..20: mol_type = other DNA
gaggcttattggcaggggac

SEQ ID NO: 56923 - DNA, 20 bp, synthetic construct
  misc_feature 1..20: note = CRISPR gRNA sequence
  source 1..20: mol_type = other DNA
aggcttattggcaggggaca

SEQ ID NO: 56924 - DNA, 20 bp, synthetic construct
  misc_feature 1..20: note = CRISPR gRNA sequence
  source 1..20: mol_type = other DNA
tattggcaggggacaaggtc

SEQ ID NO: 56925 - DNA, 20 bp, synthetic construct
  misc_feature 1..20: note = CRISPR gRNA sequence
  source 1..20: mol_type = other DNA
attggcaggggacaaggtcc

SEQ ID NO: 56926 - DNA, 20 bp, synthetic construct
  misc_feature 1..20: note = CRISPR gRNA sequence
  source 1..20: mol_type = other DNA
ttggcaggggacaaggtcca

SEQ ID NO: 56927 - DNA, 20 bp, synthetic construct
  misc_feature 1..20: note = CRISPR gRNA sequence
  source 1..20: mol_type = other DNA
aggggacaaggtccagggtc

SEQ ID NO: 56928 - DNA, 20 bp, synthetic construct
  misc_feature 1..20: note = CRISPR gRNA sequence
  source 1..20: mol_type = other DNA
ggggacaaggtccagggtcc

SEQ ID NO: 56929 - DNA, 20 bp, synthetic construct
  misc_feature 1..20: note = CRISPR gRNA sequence
  source 1..20: mol_type = other DNA
aaggtccagggtccgggtct

SEQ ID NO: 56930 - DNA, 20 bp, synthetic construct
  misc_feature 1..20: note = CRISPR gRNA sequence
  source 1..20: mol_type = other DNA
agggtccgggtcttggcccc

SEQ ID NO: 56931 - DNA, 20 bp, synthetic construct
  misc_feature 1..20: note = CRISPR gRNA sequence
  source 1..20: mol_type = other DNA
gggtccgggtcttggccccc

SEQ ID NO: 56932 - DNA, 20 bp, synthetic construct
  misc_feature 1..20: note = CRISPR gRNA sequence
  source 1..20: mol_type = other DNA
gtttatgttcctccccacac

SEQ ID NO: 56933 - DNA, 20 bp, synthetic construct
  misc_feature 1..20: note = CRISPR gRNA sequence
  source 1..20: mol_type = other DNA
tccccacactggtacccacc

SEQ ID NO: 56934 - DNA, 20 bp, synthetic construct
  misc_feature 1..20: note = CRISPR gRNA sequence
  source 1..20: mol_type = other DNA
gctgcttcttgcactgcttc

SEQ ID NO: 56935 - DNA, 20 bp, synthetic construct
  misc_feature 1..20: note = CRISPR gRNA sequence
  source 1..20: mol_type = other DNA
gcttcttgcactgcttccgg

SEQ ID NO: 56936 - DNA, 20 bp, synthetic construct
  misc_feature 1..20: note = CRISPR gRNA sequence
  source 1..20: mol_type = other DNA
cttcttgcactgcttccggc

SEQ ID NO: 56937 - DNA, 20 bp, synthetic construct
  misc_feature 1..20: note = CRISPR gRNA sequence
  source 1..20: mol_type = other DNA
ttcttgcactgcttccggcg

SEQ ID NO: 56938 - DNA, 20 bp, synthetic construct
  misc_feature 1..20: note = CRISPR gRNA sequence
  source 1..20: mol_type = other DNA
tgcactgcttccggcggggt

SEQ ID NO: 56939 - DNA, 20 bp, synthetic construct
  misc_feature 1..20: note = CRISPR gRNA sequence
  source 1..20: mol_type = other DNA
gcactgcttccggcggggtg

SEQ ID NO: 56940 - DNA, 20 bp, synthetic construct
  misc_feature 1..20: note = CRISPR gRNA sequence
  source 1..20: mol_type = other DNA
tccggcggggtgaggaccca

SEQ ID NO: 56941 - DNA, 20 bp, synthetic construct
  misc_feature 1..20: note = CRISPR gRNA sequence
  source 1..20: mol_type = other DNA
gaggacccacagctctgatg

SEQ ID NO: 56942 - DNA, 20 bp, synthetic construct
  misc_feature 1..20: note = CRISPR gRNA sequence
  source 1..20: mol_type = other DNA
aggacccacagctctgatgt

SEQ ID NO: 56943 - DNA, 20 bp, synthetic construct
  misc_feature 1..20: note = CRISPR gRNA sequence
  source 1..20: mol_type = other DNA
cagctctgatgtgggcgctt

SEQ ID NO: 56944 - DNA, 20 bp, synthetic construct
  misc_feature 1..20: note = CRISPR gRNA sequence
  source 1..20: mol_type = other DNA
agctctgatgtgggcgcttc

SEQ ID NO: 56945 - DNA, 20 bp, synthetic construct
  misc_feature 1..20: note = CRISPR gRNA sequence
  source 1..20: mol_type = other DNA
tgggcgcttcaggcctgaaa

SEQ ID NO: 56946 - DNA, 20 bp, synthetic construct
  misc_feature 1..20: note = CRISPR gRNA sequence
  source 1..20: mol_type = other DNA
gcttcaggcctgaaaaagca

SEQ ID NO: 56947 - DNA, 20 bp, synthetic construct
  misc_feature 1..20: note = CRISPR gRNA sequence
  source 1..20: mol_type = other DNA
cttcaggcctgaaaaagcaa

SEQ ID NO: 56948 - DNA, 20 bp, synthetic construct
  misc_feature 1..20: note = CRISPR gRNA sequence
  source 1..20: mol_type = other DNA
caggcctgaaaaagcaaagg

SEQ ID NO: 56949 - DNA, 20 bp, synthetic construct
  misc_feature 1..20: note = CRISPR gRNA sequence
  source 1..20: mol_type = other DNA
aggcctgaaaaagcaaagga

SEQ ID NO: 56950 - DNA, 20 bp, synthetic construct
  misc_feature 1..20: note = CRISPR gRNA sequence
  source 1..20: mol_type = other DNA
ggcctgaaaaagcaaaggaa

SEQ ID NO: 56951 - DNA, 20 bp, synthetic construct
  misc_feature 1..20: note = CRISPR gRNA sequence
  source 1..20: mol_type = other DNA
gcctgaaaaagcaaaggaag

SEQ ID NO: 56952 - DNA, 20 bp, synthetic construct
  misc_feature 1..20: note = CRISPR gRNA sequence
  source 1..20: mol_type = other DNA
tgaaaaagcaaaggaagggg

SEQ ID NO: 56953 - DNA, 20 bp, synthetic construct
  misc_feature 1..20: note = CRISPR gRNA sequence
  source 1..20: mol_type = other DNA
aaaaagcaaaggaaggggtg

SEQ ID NO: 56954 - DNA, 20 bp, synthetic construct
  misc_feature 1..20: note = CRISPR gRNA sequence
  source 1..20: mol_type = other DNA
aaaagcaaaggaaggggtgg

SEQ ID NO: 56955 - DNA, 20 bp, synthetic construct
  misc_feature 1..20: note = CRISPR gRNA sequence
  source 1..20: mol_type = other DNA
aagcaaaggaaggggtggag

SEQ ID NO: 56956 - DNA, 20 bp, synthetic construct
  misc_feature 1..20: note = CRISPR gRNA sequence
  source 1..20: mol_type = other DNA
caaaggaaggggtggaggag

SEQ ID NO: 56957 - DNA, 20 bp, synthetic construct
  misc_feature 1..20: note = CRISPR gRNA sequence
  source 1..20: mol_type = other DNA
aaaggaaggggtggaggagt

SEQ ID NO: 56958 - DNA, 20 bp, synthetic construct
  misc_feature 1..20: note = CRISPR gRNA sequence
  source 1..20: mol_type = other DNA
aaggaaggggtggaggagtg

SEQ ID NO: 56959 - DNA, 20 bp, synthetic construct
  misc_feature 1..20: note = CRISPR gRNA sequence
  source 1..20: mol_type = other DNA
aggggtggaggagtggggtc

SEQ ID NO: 56960 - DNA, 20 bp, synthetic construct
  misc_feature 1..20: note = CRISPR gRNA sequence
  source 1..20: mol_type = other DNA
ggggtggaggagtggggtct

SEQ ID NO: 56961 - DNA, 20 bp, synthetic construct
  misc_feature 1..20: note = CRISPR gRNA sequence
  source 1..20: mol_type = other DNA
gggtggaggagtggggtctg

SEQ ID NO: 56962 - DNA, 20 bp, synthetic construct
  misc_feature 1..20: note = CRISPR gRNA sequence
  source 1..20: mol_type = other DNA
aggagtggggtctggggatc

SEQ ID NO: 56963 - DNA, 20 bp, synthetic construct
  misc_feature 1..20: note = CRISPR gRNA sequence
  source 1..20: mol_type = other DNA
ggagtggggtctggggatct

SEQ ID NO: 56964 - DNA, 20 bp, synthetic construct
  misc_feature 1..20: note = CRISPR gRNA sequence
  source 1..20: mol_type = other DNA
ggggtctggggatctgggct

SEQ ID NO: 56965 - DNA, 20 bp, synthetic construct
  misc_feature 1..20: note = CRISPR gRNA sequence
  source 1..20: mol_type = other DNA
gggtctggggatctgggctg

SEQ ID NO: 56966 - DNA, 20 bp, synthetic construct
  misc_feature 1..20: note = CRISPR gRNA sequence
  source 1..20: mol_type = other DNA
ggtctggggatctgggctga

SEQ ID NO: 56967 - DNA, 20 bp, synthetic construct
  misc_feature 1..20: note = CRISPR gRNA sequence
  source 1..20: mol_type = other DNA
gtctggggatctgggctgag

SEQ ID NO: 56968 - DNA, 20 bp, synthetic construct
  misc_feature 1..20: note = CRISPR gRNA sequence
  source 1..20: mol_type = other DNA
atctgggctgaggggttacc

SEQ ID NO: 56969 - DNA, 20 bp, synthetic construct
  misc_feature 1..20: note = CRISPR gRNA sequence
  source 1..20: mol_type = other DNA
gaggggttacccagaacctt

SEQ ID NO: 56970 - DNA, 20 bp, synthetic construct
  misc_feature 1..20: note = CRISPR gRNA sequence
  source 1..20: mol_type = other DNA
aggggttacccagaaccttt

SEQ ID NO: 56971 - DNA, 20 bp, synthetic construct
  misc_feature 1..20: note = CRISPR gRNA sequence
  source 1..20: mol_type = other DNA
ggggttacccagaacctttg

SEQ ID NO: 56972 - DNA, 20 bp, synthetic construct
  misc_feature 1..20: note = CRISPR gRNA sequence
  source 1..20: mol_type = other DNA
ccagaacctttggggaactc

SEQ ID NO: 56973 - DNA, 20 bp, synthetic construct
  misc_feature 1..20: note = CRISPR gRNA sequence
  source 1..20: mol_type = other DNA
ctttggggaactccagtcca

SEQ ID NO: 56974 - DNA, 20 bp, synthetic construct
  misc_feature 1..20: note = CRISPR gRNA sequence
  source 1..20: mol_type = other DNA
ggggaactccagtccacaga

SEQ ID NO: 56975 - DNA, 20 bp, synthetic construct
  misc_feature 1..20: note = CRISPR gRNA sequence
  source 1..20: mol_type = other DNA
gggaactccagtccacagac

SEQ ID NO: 56976 - DNA, 20 bp, synthetic construct
  misc_feature 1..20: note = CRISPR gRNA sequence
  source 1..20: mol_type = other DNA
aactccagtccacagacagg

SEQ ID NO: 56977 - DNA, 20 bp, synthetic construct
  misc_feature 1..20: note = CRISPR gRNA sequence
  source 1..20: mol_type = other DNA
tccagtccacagacaggtgg

SEQ ID NO: 56978 - DNA, 20 bp, synthetic construct
  misc_feature 1..20: note = CRISPR gRNA sequence
  source 1..20: mol_type = other DNA
ccagtccacagacaggtggc

SEQ ID NO: 56979 - DNA, 20 bp, synthetic construct
  misc_feature 1..20: note = CRISPR gRNA sequence
  source 1..20: mol_type = other DNA
gtccacagacaggtggcagg

SEQ ID NO: 56980 - DNA, 20 bp, synthetic construct
  misc_feature 1..20: note = CRISPR gRNA sequence
  source 1..20: mol_type = other DNA
cagacaggtggcaggcagcc

SEQ ID NO: 56981 - DNA, 20 bp, synthetic construct
  misc_feature 1..20: note = CRISPR gRNA sequence
  source 1..20: mol_type = other DNA
cagccaagtacacccacatg

SEQ ID NO: 56982 - DNA, 20 bp, synthetic construct
  misc_feature 1..20: note = CRISPR gRNA sequence
  source 1..20: mol_type = other DNA
agccaagtacacccacatgc

SEQ ID NO: 56983 - DNA, 20 bp, synthetic construct
  misc_feature 1..20: note = CRISPR gRNA sequence
  source 1..20: mol_type = other DNA
gccaagtacacccacatgca

SEQ ID NO: 56984 - DNA, 20 bp, synthetic construct
  misc_feature 1..20: note = CRISPR gRNA sequence
  source 1..20: mol_type = other DNA
gtacacccacatgcagggac

SEQ ID NO: 56985 - DNA, 20 bp, synthetic construct
  misc_feature 1..20: note = CRISPR gRNA sequence
  source 1..20: mol_type = other DNA
acccacatgcagggactgga

SEQ ID NO: 56986 - DNA, 20 bp, synthetic construct
  misc_feature 1..20: note = CRISPR gRNA sequence
  source 1..20: mol_type = other DNA
cccacatgcagggactggaa

SEQ ID NO: 56987 - DNA, 20 bp, synthetic construct
  misc_feature 1..20: note = CRISPR gRNA sequence
  source 1..20: mol_type = other DNA
acatgcagggactggaaagg

SEQ ID NO: 56988 - DNA, 20 bp, synthetic construct
  misc_feature 1..20: note = CRISPR gRNA sequence
  source 1..20: mol_type = other DNA
catgcagggactggaaaggc

SEQ ID NO: 56989 - DNA, 20 bp, synthetic construct
  misc_feature 1..20: note = CRISPR gRNA sequence
  source 1..20: mol_type = other DNA
gcagggactggaaaggcagg

SEQ ID NO: 56990 - DNA, 20 bp, synthetic construct
  misc_feature 1..20: note = CRISPR gRNA sequence
  source 1..20: mol_type = other DNA
gggactggaaaggcaggcag

SEQ ID NO: 56991 - DNA, 20 bp, synthetic construct
  misc_feature 1..20: note = CRISPR gRNA sequence
  source 1..20: mol_type = other DNA
ggactggaaaggcaggcagc

SEQ ID NO: 56992 - DNA, 20 bp, synthetic construct
  misc_feature 1..20: note = CRISPR gRNA sequence
  source 1..20: mol_type = other DNA
ctggaaaggcaggcagcagg

SEQ ID NO: 56993 - DNA, 20 bp, synthetic construct
  misc_feature 1..20: note = CRISPR gRNA sequence
  source 1..20: mol_type = other DNA
ggaaaggcaggcagcaggca

SEQ ID NO: 56994 - DNA, 20 bp, synthetic construct
  misc_feature 1..20: note = CRISPR gRNA sequence
  source 1..20: mol_type = other DNA
gaaaggcaggcagcaggcag

SEQ ID NO: 56995 - DNA, 20 bp, synthetic construct
  misc_feature 1..20: note = CRISPR gRNA sequence
  source 1..20: mol_type = other DNA
ggcaggcagcaggcagaggc

SEQ ID NO: 56996 - DNA, 20 bp, synthetic construct
  misc_feature 1..20: note = CRISPR gRNA sequence
  source 1..20: mol_type = other DNA
gcaggcagcaggcagaggct

SEQ ID NO: 56997 - DNA, 20 bp, synthetic construct
  misc_feature 1..20: note = CRISPR gRNA sequence
  source 1..20: mol_type = other DNA
ggcagaggctgggtcaacac

SEQ ID NO: 56998 - DNA, 20 bp, synthetic construct
  misc_feature 1..20: note = CRISPR gRNA sequence
  source 1..20: mol_type = other DNA
tcaacaccagcttctatttg

SEQ ID NO: 56999 - DNA, 20 bp, synthetic construct
  misc_feature 1..20: note = CRISPR gRNA sequence
  source 1..20: mol_type = other DNA
aacaccagcttctatttgca

SEQ ID NO: 57000 - DNA, 20 bp, synthetic construct
  misc_feature 1..20: note = CRISPR gRNA sequence
  source 1..20: mol_type = other DNA
accagcttctatttgcagag

SEQ ID NO: 57001 - DNA, 20 bp, synthetic construct
  misc_feature 1..20: note = CRISPR gRNA sequence
  source 1..20: mol_type = other DNA
ctatttgcagagtggacttc

SEQ ID NO: 57002 - DNA, 20 bp, synthetic construct
  misc_feature 1..20: note = CRISPR gRNA sequence
  source 1..20: mol_type = other DNA
tatttgcagagtggacttct

SEQ ID NO: 57003 - DNA, 20 bp, synthetic construct
  misc_feature 1..20: note = CRISPR gRNA sequence
  source 1..20: mol_type = other DNA
ggacttctaggcacccccat

SEQ ID NO: 57004 - DNA, 20 bp, synthetic construct
  misc_feature 1..20: note = CRISPR gRNA sequence
  source 1..20: mol_type = other DNA
cttctaggcacccccattgg

SEQ ID NO: 57005 - DNA, 20 bp, synthetic construct
  misc_feature 1..20: note = CRISPR gRNA sequence
  source 1..20: mol_type = other DNA
ttctaggcacccccattgga

SEQ ID NO: 57006 - DNA, 20 bp, synthetic construct
  misc_feature 1..20: note = CRISPR gRNA sequence
  source 1..20: mol_type = other DNA
taggcacccccattggaagg

SEQ ID NO: 57007 - DNA, 20 bp, synthetic construct
  misc_feature 1..20: note = CRISPR gRNA sequence
  source 1..20: mol_type = other DNA
ccattggaaggtggatgttc

SEQ ID NO: 57008 - DNA, 20 bp, synthetic construct
  misc_feature 1..20: note = CRISPR gRNA sequence
  source 1..20: mol_type = other DNA
cattggaaggtggatgttct

SEQ ID NO: 57009 - DNA, 20 bp, synthetic construct
  misc_feature 1..20: note = CRISPR gRNA sequence
  source 1..20: mol_type = other DNA
gaaggtggatgttctgggcc

SEQ ID NO: 57010 - DNA, 20 bp, synthetic construct
  misc_feature 1..20: note = CRISPR gRNA sequence
  source 1..20: mol_type = other DNA
ggtggatgttctgggcctgg

SEQ ID NO: 57011 - DNA, 20 bp, synthetic construct
  misc_feature 1..20: note = CRISPR gRNA sequence
  source 1..20: mol_type = other DNA
ttctgggcctggcagtcttg

SEQ ID NO: 57012 - DNA, 20 bp, synthetic construct
  misc_feature 1..20: note = CRISPR gRNA sequence
  source 1..20: mol_type = other DNA
ggcctggcagtcttgcagtc

SEQ ID NO: 57013 - DNA, 20 bp, synthetic construct
  misc_feature 1..20: note = CRISPR gRNA sequence
  source 1..20: mol_type = other DNA
gcctggcagtcttgcagtcc

SEQ ID NO: 57014 - DNA, 20 bp, synthetic construct
  misc_feature 1..20: note = CRISPR gRNA sequence
  source 1..20: mol_type = other DNA
cagtcttgcagtccaggatg

SEQ ID NO: 57015 - DNA, 20 bp, synthetic construct
  misc_feature 1..20: note = CRISPR gRNA sequence
  source 1..20: mol_type = other DNA
agtcttgcagtccaggatgc

SEQ ID NO: 57016 - DNA, 20 bp, synthetic construct
  misc_feature 1..20: note = CRISPR gRNA sequence
  source 1..20: mol_type = other DNA
cttgcagtccaggatgcagg

SEQ ID NO: 57017 - DNA, 20 bp, synthetic construct
  misc_feature 1..20: note = CRISPR gRNA sequence
  source 1..20: mol_type = other DNA
gcagtccaggatgcaggaag

SEQ ID NO: 57018 - DNA, 20 bp, synthetic construct
  misc_feature 1..20: note = CRISPR gRNA sequence
  source 1..20: mol_type = other DNA
cagtccaggatgcaggaagc

SEQ ID NO: 57019 - DNA, 20 bp, synthetic construct
  misc_feature 1..20: note = CRISPR gRNA sequence
  source 1..20: mol_type = other DNA
agtccaggatgcaggaagca

SEQ ID NO: 57020 - DNA, 20 bp, synthetic construct
  misc_feature 1..20: note = CRISPR gRNA sequence
  source 1..20: mol_type = other DNA
gatgcaggaagcagggccaa

SEQ ID NO: 57021 - DNA, 20 bp, synthetic construct
  misc_feature 1..20: note = CRISPR gRNA sequence
  source 1..20: mol_type = other DNA
caggaagcagggccaacagc

SEQ ID NO: 57022 - DNA, 20 bp, synthetic construct
  misc_feature 1..20: note = CRISPR gRNA sequence
  source 1..20: mol_type = other DNA
gaagcagggccaacagccag

SEQ ID NO: 57023 - DNA, 20 bp, synthetic construct
  misc_feature 1..20: note = CRISPR gRNA sequence
  source 1..20: mol_type = other DNA
ggccaacagccagcagcccc

SEQ ID NO: 57024 - DNA, 20 bp, synthetic construct
  misc_feature 1..20: note = CRISPR gRNA sequence
  source 1..20: mol_type = other DNA
cagcagcccccagaaacact

SEQ ID NO: 57025 - DNA, 20 bp, synthetic construct
  misc_feature 1..20: note = CRISPR gRNA sequence
  source 1..20: mol_type = other DNA
ccccagaaacactcagctcc

SEQ ID NO: 57026 - DNA, 20 bp, synthetic construct
  misc_feature 1..20: note = CRISPR gRNA sequence
  source 1..20: mol_type = other DNA
actcagctccaagcactaaa

SEQ ID NO: 57027 - DNA, 20 bp, synthetic construct
  misc_feature 1..20: note = CRISPR gRNA sequence
  source 1..20: mol_type = other DNA
ctaaatggccatctgtccat

SEQ ID NO: 57028 - DNA, 20 bp, synthetic construct
  misc_feature 1..20: note = CRISPR gRNA sequence
  source 1..20: mol_type = other DNA
taaatggccatctgtccatc

SEQ ID NO: 57029 - DNA, 20 bp, synthetic construct
  misc_feature 1..20: note = CRISPR gRNA sequence
  source 1..20: mol_type = other DNA
aaatggccatctgtccatca

SEQ ID NO: 57030 - DNA, 20 bp, synthetic construct
  misc_feature 1..20: note = CRISPR gRNA sequence
  source 1..20: mol_type = other DNA
tggccatctgtccatcaggg

SEQ ID NO: 57031 - DNA, 20 bp, synthetic construct
  misc_feature 1..20: note = CRISPR gRNA sequence
  source 1..20: mol_type = other DNA
ggccatctgtccatcaggga

SEQ ID NO: 57032 - DNA, 20 bp, synthetic construct
  misc_feature 1..20: note = CRISPR gRNA sequence
  source 1..20: mol_type = other DNA
ctgtccatcagggaaggacc

SEQ ID NO: 57033 - DNA, 20 bp, synthetic construct
  misc_feature 1..20: note = CRISPR gRNA sequence
  source 1..20: mol_type = other DNA
cagggaaggaccaagctcta

SEQ ID NO: 57034 - DNA, 20 bp, synthetic construct
  misc_feature 1..20: note = CRISPR gRNA sequence
  source 1..20: mol_type = other DNA
ggaaggaccaagctctatgg

SEQ ID NO: 57035 - DNA, 20 bp, synthetic construct
  misc_feature 1..20: note = CRISPR gRNA sequence
  source 1..20: mol_type = other DNA
ccaagctctatggaagccgc

SEQ ID NO: 57036 - DNA, 20 bp, synthetic construct
  misc_feature 1..20: note = CRISPR gRNA sequence
  source 1..20: mol_type = other DNA
agctctatggaagccgccgg

SEQ ID NO: 57037 - DNA, 20 bp, synthetic construct
  misc_feature 1..20: note = CRISPR gRNA sequence
  source 1..20: mol_type = other DNA
gaagccgccggtggtcatat

SEQ ID NO: 57038 - DNA, 20 bp, synthetic construct
  misc_feature 1..20: note = CRISPR gRNA sequence
  source 1..20: mol_type = other DNA
cgccggtggtcatataagtg

SEQ ID NO: 57039 - DNA, 20 bp, synthetic construct
  misc_feature 1..20: note = CRISPR gRNA sequence
  source 1..20: mol_type = other DNA
ggtcatataagtgaagttcc

SEQ ID NO: 57040 - DNA, 20 bp, synthetic construct
  misc_feature 1..20: note = CRISPR gRNA sequence
  source 1..20: mol_type = other DNA
atataagtgaagttcccagt

SEQ ID NO: 57041 - DNA, 20 bp, synthetic construct
  misc_feature 1..20: note = CRISPR gRNA sequence
  source 1..20: mol_type = other DNA
agtgaagttcccagtgagtt

SEQ ID NO: 57042 - DNA, 20 bp, synthetic construct
  misc_feature 1..20: note = CRISPR gRNA sequence
  source 1..20: mol_type = other DNA
aagttcccagtgagtttggc

SEQ ID NO: 57043 - DNA, 20 bp, synthetic construct
  misc_feature 1..20: note = CRISPR gRNA sequence
  source 1..20: mol_type = other DNA
agttcccagtgagtttggcc

SEQ ID NO: 57044 - DNA, 20 bp, synthetic construct
  misc_feature 1..20: note = CRISPR gRNA sequence
  source 1..20: mol_type = other DNA
ctgcaacctccctcctctgt

SEQ ID NO: 57045 - DNA, 20 bp, synthetic construct
  misc_feature 1..20: note = CRISPR gRNA sequence
  source 1..20: mol_type = other DNA
tgcaacctccctcctctgtt

SEQ ID NO: 57046 - DNA, 20 bp, synthetic construct
  misc_feature 1..20: note = CRISPR gRNA sequence
  source 1..20: mol_type = other DNA
gcaacctccctcctctgtta

SEQ ID NO: 57047 - DNA, 20 bp, synthetic construct
  misc_feature 1..20: note = CRISPR gRNA sequence
  source 1..20: mol_type = other DNA
catttcctcacttcccttaa

SEQ ID NO: 57048 - DNA, 20 bp, synthetic construct
  misc_feature 1..20: note = CRISPR gRNA sequence
  source 1..20: mol_type = other DNA
tcacttcccttaatagtttc

SEQ ID NO: 57049 - DNA, 20 bp, synthetic construct
  misc_feature 1..20: note = CRISPR gRNA sequence
  source 1..20: mol_type = other DNA
acttcccttaatagtttctg

SEQ ID NO: 57050 - DNA, 20 bp, synthetic construct
  misc_feature 1..20: note = CRISPR gRNA sequence
  source 1..20: mol_type = other DNA
tggagtcttgtctcattgta

SEQ ID NO: 57051 - DNA, 20 bp, synthetic construct
  misc_feature 1..20: note = CRISPR gRNA sequence
  source 1..20: mol_type = other DNA
caatcactttaatgcctttc

SEQ ID NO: 57052 - DNA, 20 bp, synthetic construct
  misc_feature 1..20: note = CRISPR gRNA sequence
  source 1..20: mol_type = other DNA
tcactttaatgcctttctgg

SEQ ID NO: 57053 - DNA, 20 bp, synthetic construct
  misc_feature 1..20: note = CRISPR gRNA sequence
  source 1..20: mol_type = other DNA
actttaatgcctttctggaa

SEQ ID NO: 57054 - DNA, 20 bp, synthetic construct
  misc_feature 1..20: note = CRISPR gRNA sequence
  source 1..20: mol_type = other DNA
atgcctttctggaagagttt

SEQ ID NO: 57055 - DNA, 20 bp, synthetic construct
  misc_feature 1..20: note = CRISPR gRNA sequence
  source 1..20: mol_type = other DNA
ctttctggaagagtttgaga

SEQ ID NO: 57056 - DNA, 20 bp, synthetic construct
  misc_feature 1..20: note = CRISPR gRNA sequence
  source 1..20: mol_type = other DNA
tttctggaagagtttgagaa

SEQ ID NO: 57057 - DNA, 20 bp, synthetic construct
  misc_feature 1..20: note = CRISPR gRNA sequence
  source 1..20: mol_type = other DNA
ctggaagagtttgagaaagg

SEQ ID NO: 57058 - DNA, 20 bp, synthetic construct
  misc_feature 1..20: note = CRISPR gRNA sequence
  source 1..20: mol_type = other DNA
gaagagtttgagaaaggaag

SEQ ID NO: 57059 - DNA, 20 bp, synthetic construct
  misc_feature 1..20: note = CRISPR gRNA sequence
  source 1..20: mol_type = other DNA
aagagtttgagaaaggaaga

SEQ ID NO: 57060 - DNA, 20 bp, synthetic construct
  misc_feature 1..20: note = CRISPR gRNA sequence
  source 1..20: mol_type = other DNA
gagaaaggaagaaggaaaac

SEQ ID NO: 57061 - DNA, 20 bp, synthetic construct
  misc_feature 1..20: note = CRISPR gRNA sequence
  source 1..20: mol_type = other DNA
aaaggaagaaggaaaacaag

SEQ ID NO: 57062 - DNA, 20 bp, synthetic construct
  misc_feature 1..20: note = CRISPR gRNA sequence
  source 1..20: mol_type = other DNA
aaggaagaaggaaaacaaga

SEQ ID NO: 57063 - DNA, 20 bp, synthetic construct
  misc_feature 1..20: note = CRISPR gRNA sequence
  source 1..20: mol_type = other DNA
gaagaaggaaaacaagaagg

SEQ ID NO: 57064 - DNA, 20 bp, synthetic construct
  misc_feature 1..20: note = CRISPR gRNA sequence
  source 1..20: mol_type = other DNA
aagaaggaaaacaagaagga

SEQ ID NO: 57065 - DNA, 20 bp, synthetic construct
  misc_feature 1..20: note = CRISPR gRNA sequence
  source 1..20: mol_type = other DNA
agaaggaaaacaagaaggaa

SEQ ID NO: 57066 - DNA, 20 bp, synthetic construct
  misc_feature 1..20: note = CRISPR gRNA sequence
  source 1..20: mol_type = other DNA
gaaggaaaacaagaaggaag

SEQ ID NO: 57067 - DNA, 20 bp, synthetic construct
  misc_feature 1..20: note = CRISPR gRNA sequence
  source 1..20: mol_type = other DNA
aaacaagaaggaaggggacc

SEQ ID NO: 57068 - DNA, 20 bp, synthetic construct
  misc_feature 1..20: note = CRISPR gRNA sequence
  source 1..20: mol_type = other DNA
aagaaggaaggggacccaga

SEQ ID NO: 57069 - DNA, 20 bp, synthetic construct
  misc_feature 1..20: note = CRISPR gRNA sequence
  source 1..20: mol_type = other DNA
agaaggaaggggacccagaa

SEQ ID NO: 57070 - DNA, 20 bp, synthetic construct
  misc_feature 1..20: note = CRISPR gRNA sequence
  source 1..20: mol_type = other DNA
aggaaggggacccagaaagg

SEQ ID NO: 57071 - DNA, 20 bp, synthetic construct
  misc_feature 1..20: note = CRISPR gRNA sequence
  source 1..20: mol_type = other DNA
ggaaggggacccagaaagga

SEQ ID NO: 57072 - DNA, 20 bp, synthetic construct
  misc_feature 1..20: note = CRISPR gRNA sequence
  source 1..20: mol_type = other DNA
gaaggggacccagaaaggaa

SEQ ID NO: 57073 - DNA, 20 bp, synthetic construct
  misc_feature 1..20: note = CRISPR gRNA sequence
  source 1..20: mol_type = other DNA
aggggacccagaaaggaagg

SEQ ID NO: 57074 - DNA, 20 bp, synthetic construct
  misc_feature 1..20: note = CRISPR gRNA sequence
  source 1..20: mol_type = other DNA
ggggacccagaaaggaaggg

SEQ ID NO: 57075 - DNA, 20 bp, synthetic construct
  misc_feature 1..20: note = CRISPR gRNA sequence
  source 1..20: mol_type = other DNA
gggacccagaaaggaaggga

SEQ ID NO: 57076 - DNA, 20 bp, synthetic construct
  misc_feature 1..20: note = CRISPR gRNA sequence
  source 1..20: mol_type = other DNA
gacccagaaaggaagggagg

SEQ ID NO: 57077 - DNA, 20 bp, synthetic construct
  misc_feature 1..20: note = CRISPR gRNA sequence
  source 1..20: mol_type = other DNA
cagaaaggaagggagggaga

SEQ ID NO: 57078 - DNA, 20 bp, synthetic construct
  misc_feature 1..20: note = CRISPR gRNA sequence
  source 1..20: mol_type = other DNA
agaaaggaagggagggagaa

SEQ ID NO: 57079 - DNA, 20 bp, synthetic construct
  misc_feature 1..20: note = CRISPR gRNA sequence
  source 1..20: mol_type = other DNA
aggaagggagggagaaagga

SEQ ID NO: 57080 - DNA, 20 bp, synthetic construct
  misc_feature 1..20: note = CRISPR gRNA sequence
  source 1..20: mol_type = other DNA
gaagggagggagaaaggaaa

SEQ ID NO: 57081 - DNA, 20 bp, synthetic construct
  misc_feature 1..20: note = CRISPR gRNA sequence
  source 1..20: mol_type = other DNA
aagggagggagaaaggaaag

SEQ ID NO: 57082 - DNA, 20 bp, synthetic construct
  misc_feature 1..20: note = CRISPR gRNA sequence
  source 1..20: mol_type = other DNA
gggagaaaggaaagaggact

SEQ ID NO: 57083 - DNA, 20 bp, synthetic construct
  misc_feature 1..20: note = CRISPR gRNA sequence
  source 1..20: mol_type = other DNA
ggagaaaggaaagaggactc

SEQ ID NO: 57084 - DNA, 20 bp, synthetic construct
  misc_feature 1..20: note = CRISPR gRNA sequence
  source 1..20: mol_type = other DNA
aaaggaaagaggactcagga

SEQ ID NO: 57085 - DNA, 20 bp, synthetic construct
  misc_feature 1..20: note = CRISPR gRNA sequence
  source 1..20: mol_type = other DNA
aggactcaggaaagaatttt

SEQ ID NO: 57086 - DNA, 20 bp, synthetic construct
  misc_feature 1..20: note = CRISPR gRNA sequence
  source 1..20: mol_type = other DNA
actcaggaaagaattttaag

SEQ ID NO: 57087 - DNA, 20 bp, synthetic construct
  misc_feature 1..20: note = CRISPR gRNA sequence
  source 1..20: mol_type = other DNA
ggaaagaattttaagaagtc

SEQ ID NO: 57088 - DNA, 20 bp, synthetic construct
  misc_feature 1..20: note = CRISPR gRNA sequence
  source 1..20: mol_type = other DNA
aagaattttaagaagtcaag

SEQ ID NO: 57089 - DNA, 20 bp, synthetic construct
  misc_feature 1..20: note = CRISPR gRNA sequence
  source 1..20: mol_type = other DNA
agaattttaagaagtcaagc

SEQ ID NO: 57090 - DNA, 20 bp, synthetic construct
  misc_feature 1..20: note = CRISPR gRNA sequence
  source 1..20: mol_type = other DNA
gaattttaagaagtcaagca

SEQ ID NO: 57091 - DNA, 20 bp, synthetic construct
  misc_feature 1..20: note = CRISPR gRNA sequence
  source 1..20: mol_type = other DNA
agtcaagcagggtcctccta

SEQ ID NO: 57092 - DNA, 20 bp, synthetic construct
  misc_feature 1..20: note = CRISPR gRNA sequence
  source 1..20: mol_type = other DNA
agcagggtcctcctacagct

SEQ ID NO: 57093 - DNA, 20 bp, synthetic construct
  misc_feature 1..20: note = CRISPR gRNA sequence
  source 1..20: mol_type = other DNA
ggtcctcctacagctaagct

SEQ ID NO: 57094 - DNA, 20 bp, synthetic construct
  misc_feature 1..20: note = CRISPR gRNA sequence
  source 1..20: mol_type = other DNA
cagctaagctaagtgaccaa

SEQ ID NO: 57095 - DNA, 20 bp, synthetic construct
  misc_feature 1..20: note = CRISPR gRNA sequence
  source 1..20: mol_type = other DNA
agctaagctaagtgaccaat

SEQ ID NO: 57096 - DNA, 20 bp, synthetic construct
  misc_feature 1..20: note = CRISPR gRNA sequence
  source 1..20: mol_type = other DNA
agctaagtgaccaataggaa

SEQ ID NO: 57097 - DNA, 20 bp, synthetic construct
  misc_feature 1..20: note = CRISPR gRNA sequence
  source 1..20: mol_type = other DNA
tgaccaataggaacagcccc

SEQ ID NO: 57098 - DNA, 20 bp, synthetic construct
  misc_feature 1..20: note = CRISPR gRNA sequence
  source 1..20: mol_type = other DNA
accaataggaacagcccctg

SEQ ID NO: 57099 - DNA, 20 bp, synthetic construct
  misc_feature 1..20: note = CRISPR gRNA sequence
  source 1..20: mol_type = other DNA
aataggaacagcccctggag

SEQ ID NO: 57100 - DNA, 20 bp, synthetic construct
  misc_feature 1..20: note = CRISPR gRNA sequence
  source 1..20: mol_type = other DNA
ataggaacagcccctggagc

SEQ ID NO: 57101 - DNA, 20 bp, synthetic construct
  misc_feature 1..20: note = CRISPR gRNA sequence
  source 1..20: mol_type = other DNA
taggaacagcccctggagca

SEQ ID NO: 57102 - DNA, 20 bp, synthetic construct
  misc_feature 1..20: note = CRISPR gRNA sequence
  source 1..20: mol_type = other DNA
cagcccctggagcagggccc

SEQ ID NO: 57103 - DNA, 20 bp, synthetic construct
  misc_feature 1..20: note = CRISPR gRNA sequence
  source 1..20: mol_type = other DNA
agcccctggagcagggccct

SEQ ID NO: 57104 - DNA, 20 bp, synthetic construct
  misc_feature 1..20: note = CRISPR gRNA sequence
  source 1..20: mol_type = other DNA
agggccctgggctccttgtc

SEQ ID NO: 57105 - DNA, 20 bp, synthetic construct
  misc_feature 1..20: note = CRISPR gRNA sequence
  source 1..20: mol_type = other DNA
ccctgggctccttgtccagc

SEQ ID NO: 57106 - DNA, 20 bp, synthetic construct
  misc_feature 1..20: note = CRISPR gRNA sequence
  source 1..20: mol_type = other DNA
cctgggctccttgtccagct

SEQ ID NO: 57107 - DNA, 20 bp, synthetic construct
  misc_feature 1..20: note = CRISPR gRNA sequence
  source 1..20: mol_type = other DNA
tgggctccttgtccagctag

SEQ ID NO: 57108 - DNA, 20 bp, synthetic construct
  misc_feature 1..20: note = CRISPR gRNA sequence
  source 1..20: mol_type = other DNA
gggctccttgtccagctagg

SEQ ID NO: 57109 - DNA, 20 bp, synthetic construct
  misc_feature 1..20: note = CRISPR gRNA sequence
  source 1..20: mol_type = other DNA
tccttgtccagctaggaggc

SEQ ID NO: 57110 - DNA, 20 bp, synthetic construct
  misc_feature 1..20: note = CRISPR gRNA sequence
  source 1..20: mol_type = other DNA
tccagctaggaggctggaac

SEQ ID NO: 57111 - DNA, 20 bp, synthetic construct
  misc_feature 1..20: note = CRISPR gRNA sequence
  source 1..20: mol_type = other DNA
taggaggctggaaccagttc

SEQ ID NO: 57112 - DNA, 20 bp, synthetic construct
  misc_feature 1..20: note = CRISPR gRNA sequence
  source 1..20: mol_type = other DNA
ggaggctggaaccagttcga

SEQ ID NO: 57113 - DNA, 20 bp, synthetic construct
  misc_feature 1..20: note = CRISPR gRNA sequence
  source 1..20: mol_type = other DNA
ttaacaaatcctatattaaa

SEQ ID NO: 57114 - DNA, 20 bp, synthetic construct
  misc_feature 1..20: note = CRISPR gRNA sequence
  source 1..20: mol_type = other DNA
taacaaatcctatattaaaa

SEQ ID NO: 57115 - DNA, 20 bp, synthetic construct
  misc_feature 1..20: note = CRISPR gRNA sequence
  source 1..20: mol_type = other DNA
aacaaatcctatattaaaaa

SEQ ID NO: 57116 - DNA, 20 bp, synthetic construct
  misc_feature 1..20: note = CRISPR gRNA sequence
  source 1..20: mol_type = other DNA
tatattaaaaagggactcac

SEQ ID NO: 57117 - DNA, 20 bp, synthetic construct
  misc_feature 1..20: note = CRISPR gRNA sequence
  source 1..20: mol_type = other DNA
ctcactggccaaatatcaat

SEQ ID NO: 57118 - DNA, 20 bp, synthetic construct
  misc_feature 1..20: note = CRISPR gRNA sequence
  source 1..20: mol_type = other DNA
ggccaaatatcaatcagatc

SEQ ID NO: 57119 - DNA, 20 bp, synthetic construct
  misc_feature 1..20: note = CRISPR gRNA sequence
  source 1..20: mol_type = other DNA
atatcaatcagatctggtta

SEQ ID NO: 57120 - DNA, 20 bp, synthetic construct
  misc_feature 1..20: note = CRISPR gRNA sequence
  source 1..20: mol_type = other DNA
tcagatctggttacagccat

SEQ ID NO: 57121 - DNA, 20 bp, synthetic construct
  misc_feature 1..20: note = CRISPR gRNA sequence
  source 1..20: mol_type = other DNA
cagccatgagataatgatgc

SEQ ID NO: 57122 - DNA, 20 bp, synthetic construct
  misc_feature 1..20: note = CRISPR gRNA sequence
  source 1..20: mol_type = other DNA
atgagataatgatgccagct

SEQ ID NO: 57123 - DNA, 20 bp, synthetic construct
  misc_feature 1..20: note = CRISPR gRNA sequence
  source 1..20: mol_type = other DNA
atgatgccagctcagtgatg

SEQ ID NO: 57124 - DNA, 20 bp, synthetic construct
  misc_feature 1..20: note = CRISPR gRNA sequence
  source 1..20: mol_type = other DNA
tgatgccagctcagtgatgc

SEQ ID NO: 57125 - DNA, 20 bp, synthetic construct
  misc_feature 1..20: note = CRISPR gRNA sequence
  source 1..20: mol_type = other DNA
gctcagtgatgcgggcctat

SEQ ID NO: 57126 - DNA, 20 bp, synthetic construct
  misc_feature 1..20: note = CRISPR gRNA sequence
  source 1..20: mol_type = other DNA
gtgatgcgggcctattggac

SEQ ID NO: 57127 - DNA, 20 bp, synthetic construct
  misc_feature 1..20: note = CRISPR gRNA sequence
  source 1..20: mol_type = other DNA
tgatgcgggcctattggacc

SEQ ID NO: 57128 - DNA, 20 bp, synthetic construct
  misc_feature 1..20: note = CRISPR gRNA sequence
  source 1..20: mol_type = other DNA
gatgcgggcctattggacca

SEQ ID NO: 57129 - DNA, 20 bp, synthetic construct
  misc_feature 1..20: note = CRISPR gRNA sequence
  source 1..20: mol_type = other DNA
ggcctattggaccagggact

SEQ ID NO: 57130 - DNA, 20 bp, synthetic construct
  misc_feature 1..20: note = CRISPR gRNA sequence
  source 1..20: mol_type = other DNA
tattggaccagggacttgga

SEQ ID NO: 57131 - DNA, 20 bp, synthetic construct
  misc_feature 1..20: note = CRISPR gRNA sequence
  source 1..20: mol_type = other DNA
cttggacagttttgattcac

SEQ ID NO: 57132 - DNA, 20 bp, synthetic construct
  misc_feature 1..20: note = CRISPR gRNA sequence
  source 1..20: mol_type = other DNA
ttggacagttttgattcact

SEQ ID NO: 57133 - DNA, 20 bp, synthetic construct
  misc_feature 1..20: note = CRISPR gRNA sequence
  source 1..20: mol_type = other DNA
tggacagttttgattcactg

SEQ ID NO: 57134 - DNA, 20 bp, synthetic construct
  misc_feature 1..20: note = CRISPR gRNA sequence
  source 1..20: mol_type = other DNA
gacagttttgattcactggg

SEQ ID NO: 57135 - DNA, 20 bp, synthetic construct
  misc_feature 1..20: note = CRISPR gRNA sequence
  source 1..20: mol_type = other DNA
ttttgattcactggggagct

SEQ ID NO: 57136 - DNA, 20 bp, synthetic construct
  misc_feature 1..20: note = CRISPR gRNA sequence
  source 1..20: mol_type = other DNA
tttgattcactggggagctg

SEQ ID NO: 57137 - DNA, 20 bp, synthetic construct
  misc_feature 1..20: note = CRISPR gRNA sequence
  source 1..20: mol_type = other DNA
tcactggggagctgaggtta

SEQ ID NO: 57138 - DNA, 20 bp, synthetic construct
  misc_feature 1..20: note = CRISPR gRNA sequence
  source 1..20: mol_type = other DNA
cactggggagctgaggttat

SEQ ID NO: 57139 - DNA, 20 bp, synthetic construct
  misc_feature 1..20: note = CRISPR gRNA sequence
  source 1..20: mol_type = other DNA
actggggagctgaggttata

SEQ ID NO: 57140 - DNA, 20 bp, synthetic construct
  misc_feature 1..20: note = CRISPR gRNA sequence
  source 1..20: mol_type = other DNA
ggggagctgaggttataggg

SEQ ID NO: 57141 - DNA, 20 bp, synthetic construct
  misc_feature 1..20: note = CRISPR gRNA sequence
  source 1..20: mol_type = other DNA
gggagctgaggttatagggt

SEQ ID NO: 57142 - DNA, 20 bp, synthetic construct
  misc_feature 1..20: note = CRISPR gRNA sequence
  source 1..20: mol_type = other DNA
ttatagggtgggttttctgt

SEQ ID NO: 57143 - DNA, 20 bp, synthetic construct
  misc_feature 1..20: note = CRISPR gRNA sequence
  source 1..20: mol_type = other DNA
gttggcattactgccatgca

SEQ ID NO: 57144 - DNA, 20 bp, synthetic construct
  misc_feature 1..20: note = CRISPR gRNA sequence
  source 1..20: mol_type = other DNA
ttactgccatgcacagcgat

SEQ ID NO: 57145 - DNA, 20 bp, synthetic construct
  misc_feature 1..20: note = CRISPR gRNA sequence
  source 1..20: mol_type = other DNA
gccatgcacagcgataagta

SEQ ID NO: 57146 - DNA, 20 bp, synthetic construct
  misc_feature 1..20: note = CRISPR gRNA sequence
  source 1..20: mol_type = other DNA
aagtaaagtcaatgcttctg

SEQ ID NO: 57147 - DNA, 20 bp, synthetic construct
  misc_feature 1..20: note = CRISPR gRNA sequence
  source 1..20: mol_type = other DNA
tcaatgcttctgtagaaatc

SEQ ID NO: 57148 - DNA, 20 bp, synthetic construct
  misc_feature 1..20: note = CRISPR gRNA sequence
  source 1..20: mol_type = other DNA
caatgcttctgtagaaatca

SEQ ID NO: 57149 - DNA, 20 bp, synthetic construct
  misc_feature 1..20: note = CRISPR gRNA sequence
  source 1..20: mol_type = other DNA
tctgtagaaatcaaggtgct

SEQ ID NO: 57150 - DNA, 20 bp, synthetic construct
  misc_feature 1..20: note = CRISPR gRNA sequence
  source 1..20: mol_type = other DNA
aaatcaaggtgctgagatga

SEQ ID NO: 57151 - DNA, 20 bp, synthetic construct
  misc_feature 1..20: note = CRISPR gRNA sequence
  source 1..20: mol_type = other DNA
tgaaagtgtgacccacgaat

SEQ ID NO: 57152 - DNA, 20 bp, synthetic construct
  misc_feature 1..20: note = CRISPR gRNA sequence
  source 1..20: mol_type = other DNA
aagtgtgacccacgaatcag

SEQ ID NO: 57153 - DNA, 20 bp, synthetic construct
  misc_feature 1..20: note = CRISPR gRNA sequence
  source 1..20: mol_type = other DNA
agtgtgacccacgaatcagt

SEQ ID NO: 57154 - DNA, 20 bp, synthetic construct
  misc_feature 1..20: note = CRISPR gRNA sequence
  source 1..20: mol_type = other DNA
gtgacccacgaatcagtagg

SEQ ID NO: 57155 - DNA, 20 bp, synthetic construct
  misc_feature 1..20: note = CRISPR gRNA sequence
  source 1..20: mol_type = other DNA
ggtggtcattatttaatcac

SEQ ID NO: 57156 - DNA, 20 bp, synthetic construct
  misc_feature 1..20: note = CRISPR gRNA sequence
  source 1..20: mol_type = other DNA
atttaatcactggcccttcc

SEQ ID NO: 57157 - DNA, 20 bp, synthetic construct
  misc_feature 1..20: note = CRISPR gRNA sequence
  source 1..20: mol_type = other DNA
ctggcccttccgagctcctt

SEQ ID NO: 57158 - DNA, 20 bp, synthetic construct
  misc_feature 1..20: note = CRISPR gRNA sequence
  source 1..20: mol_type = other DNA
tccgagctccttcagaaaat

SEQ ID NO: 57159 - DNA, 20 bp, synthetic construct
  misc_feature 1..20: note = CRISPR gRNA sequence
  source 1..20: mol_type = other DNA
ctccttcagaaaatcagcca

SEQ ID NO: 57160 - DNA, 20 bp, synthetic construct
  misc_feature 1..20: note = CRISPR gRNA sequence
  source 1..20: mol_type = other DNA
tccttcagaaaatcagccaa

SEQ ID NO: 57161 - DNA, 20 bp, synthetic construct
  misc_feature 1..20: note = CRISPR gRNA sequence
  source 1..20: mol_type = other DNA
agccaaaggctcccccgctg

SEQ ID NO: 57162 - DNA, 20 bp, synthetic construct
  misc_feature 1..20: note = CRISPR gRNA sequence
  source 1..20: mol_type = other DNA
aaaggctcccccgctgaaga

SEQ ID NO: 57163 - DNA, 20 bp, synthetic construct
  misc_feature 1..20: note = CRISPR gRNA sequence
  source 1..20: mol_type = other DNA
ggctcccccgctgaagacag

SEQ ID NO: 57164 - DNA, 20 bp, synthetic construct
  misc_feature 1..20: note = CRISPR gRNA sequence
  source 1..20: mol_type = other DNA
cccgctgaagacagcagctg

SEQ ID NO: 57165 - DNA, 20 bp, synthetic construct
  misc_feature 1..20: note = CRISPR gRNA sequence
  source 1..20: mol_type = other DNA
ccgctgaagacagcagctgt

SEQ ID NO: 57166 - DNA, 20 bp, synthetic construct
  misc_feature 1..20: note = CRISPR gRNA sequence
  source 1..20: mol_type = other DNA
tgaagacagcagctgtgggt

SEQ ID NO: 57167 - DNA, 20 bp, synthetic construct
  misc_feature 1..20: note = CRISPR gRNA sequence
  source 1..20: mol_type = other DNA
agcagctgtgggtgagtgtc

SEQ ID NO: 57168 - DNA, 20 bp, synthetic construct
  misc_feature 1..20: note = CRISPR gRNA sequence
  source 1..20: mol_type = other DNA
tgtgggtgagtgtcaagtcc

SEQ ID NO: 57169 - DNA, 20 bp, synthetic construct
  misc_feature 1..20: note = CRISPR gRNA sequence
  source 1..20: mol_type = other DNA
gtgggtgagtgtcaagtcca

SEQ ID NO: 57170 - DNA, 20 bp, synthetic construct
  misc_feature 1..20: note = CRISPR gRNA sequence
  source 1..20: mol_type = other DNA
gtgtcaagtccaaggtgtac

SEQ ID NO: 57171 - DNA, 20 bp, synthetic construct
  misc_feature 1..20: note = CRISPR gRNA sequence
  source 1..20: mol_type = other DNA
caagtccaaggtgtacaagt

SEQ ID NO: 57172 - DNA, 20 bp, synthetic construct
  misc_feature 1..20: note = CRISPR gRNA sequence
  source 1..20: mol_type = other DNA
aagtccaaggtgtacaagtc

SEQ ID NO: 57173 - DNA, 20 bp, synthetic construct
  misc_feature 1..20: note = CRISPR gRNA sequence
  source 1..20: mol_type = other DNA
gtccaaggtgtacaagtcgg

SEQ ID NO: 57174 - DNA, 20 bp, synthetic construct
  misc_feature 1..20: note = CRISPR gRNA sequence
  source 1..20: mol_type = other DNA
tccaaggtgtacaagtcggg

SEQ ID NO: 57175 - DNA, 20 bp, synthetic construct
  misc_feature 1..20: note = CRISPR gRNA sequence
  source 1..20: mol_type = other DNA
ccaaggtgtacaagtcggga

SEQ ID NO: 57176 - DNA, 20 bp, synthetic construct
  misc_feature 1..20: note = CRISPR gRNA sequence
  source 1..20: mol_type = other DNA
caaggtgtacaagtcgggag

SEQ ID NO: 57177 - DNA, 20 bp, synthetic construct
  misc_feature 1..20: note = CRISPR gRNA sequence
  source 1..20: mol_type = other DNA
aaggtgtacaagtcgggagg

SEQ ID NO: 57178 - DNA, 20 bp, synthetic construct
  misc_feature 1..20: note = CRISPR gRNA sequence
  source 1..20: mol_type = other DNA
gtgtacaagtcgggaggggg

SEQ ID NO: 57179 - DNA, 20 bp, synthetic construct
  misc_feature 1..20: note = CRISPR gRNA sequence
  source 1..20: mol_type = other DNA
acaagtcgggagggggtggt

SEQ ID NO: 57180 - DNA, 20 bp, synthetic construct
  misc_feature 1..20: note = CRISPR gRNA sequence
  source 1..20: mol_type = other DNA
caagtcgggagggggtggtt

SEQ ID NO: 57181 - DNA, 20 bp, synthetic construct
  misc_feature 1..20: note = CRISPR gRNA sequence
  source 1..20: mol_type = other DNA
aagtcgggagggggtggtta

SEQ ID NO: 57182 - DNA, 20 bp, synthetic construct
  misc_feature 1..20: note = CRISPR gRNA sequence
  source 1..20: mol_type = other DNA
gtggttagggcttccccatg

SEQ ID NO: 57183 - DNA, 20 bp, synthetic construct
  misc_feature 1..20: note = CRISPR gRNA sequence
  source 1..20: mol_type = other DNA
ccccatgaagcctgacactt

SEQ ID NO: 57184 - DNA, 20 bp, synthetic construct
  misc_feature 1..20: note = CRISPR gRNA sequence
  source 1..20: mol_type = other DNA
cccatgaagcctgacacttt

SEQ ID NO: 57185 - DNA, 20 bp, synthetic construct
  misc_feature 1..20: note = CRISPR gRNA sequence
  source 1..20: mol_type = other DNA
ccatgaagcctgacactttg

SEQ ID NO: 57186 - DNA, 20 bp, synthetic construct
  misc_feature 1..20: note = CRISPR gRNA sequence
  source 1..20: mol_type = other DNA
gaagcctgacactttggggc

SEQ ID NO: 57187 - DNA, 20 bp, synthetic construct
  misc_feature 1..20: note = CRISPR gRNA sequence
  source 1..20: mol_type = other DNA
aagcctgacactttggggct

SEQ ID NO: 57188 - DNA, 20 bp, synthetic construct
  misc_feature 1..20: note = CRISPR gRNA sequence
  source 1..20: mol_type = other DNA
gcctgacactttggggctgg

SEQ ID NO: 57189 - DNA, 20 bp, synthetic construct
  misc_feature 1..20: note = CRISPR gRNA sequence
  source 1..20: mol_type = other DNA
acactttggggctgggagat

SEQ ID NO: 57190 - DNA, 20 bp, synthetic construct
  misc_feature 1..20: note = CRISPR gRNA sequence
  source 1..20: mol_type = other DNA
cactttggggctgggagatg

SEQ ID NO: 57191 - DNA, 20 bp, synthetic construct
  misc_feature 1..20: note = CRISPR gRNA sequence
  source 1..20: mol_type = other DNA
ggctgggagatgaggccctg

SEQ ID NO: 57192 - DNA, 20 bp, synthetic construct
  misc_feature 1..20: note = CRISPR gRNA sequence
  source 1..20: mol_type = other DNA
gctgggagatgaggccctgc

SEQ ID NO: 57193 - DNA, 20 bp, synthetic construct
  misc_feature 1..20: note = CRISPR gRNA sequence
  source 1..20: mol_type = other DNA
agatgaggccctgcgggttg

SEQ ID NO: 57194 - DNA, 20 bp, synthetic construct
  misc_feature 1..20: note = CRISPR gRNA sequence
  source 1..20: mol_type = other DNA
gatgaggccctgcgggttgc

SEQ ID NO: 57195 - DNA, 20 bp, synthetic construct
  misc_feature 1..20: note = CRISPR gRNA sequence
  source 1..20: mol_type = other DNA
gaggccctgcgggttgcggg

SEQ ID NO: 57196 - DNA, 20 bp, synthetic construct
  misc_feature 1..20: note = CRISPR gRNA sequence
  source 1..20: mol_type = other DNA
aggccctgcgggttgcgggc

SEQ ID NO: 57197 - DNA, 20 bp, synthetic construct
  misc_feature 1..20: note = CRISPR gRNA sequence
  source 1..20: mol_type = other DNA
cctgcgggttgcgggcagga

SEQ ID NO: 57198 - DNA, 20 bp, synthetic construct
  misc_feature 1..20: note = CRISPR gRNA sequence
  source 1..20: mol_type = other DNA
cgggttgcgggcaggaaagt

SEQ ID NO: 57199 - DNA, 20 bp, synthetic construct
  misc_feature 1..20: note = CRISPR gRNA sequence
  source 1..20: mol_type = other DNA
tgcgggcaggaaagtgagaa

SEQ ID NO: 57200 - DNA, 20 bp, synthetic construct
  misc_feature 1..20: note = CRISPR gRNA sequence
  source 1..20: mol_type = other DNA
gcgggcaggaaagtgagaac

SEQ ID NO: 57201 - DNA, 20 bp, synthetic construct
  misc_feature 1..20: note = CRISPR gRNA sequence
  source 1..20: mol_type = other DNA
aaagtgagaacaggcttcct

SEQ ID NO: 57202 - DNA, 20 bp, synthetic construct
  misc_feature 1..20: note = CRISPR gRNA sequence
  source 1..20: mol_type = other DNA
aagtgagaacaggcttcctg

SEQ ID NO: 57203 - DNA, 20 bp, synthetic construct
  misc_feature 1..20: note = CRISPR gRNA sequence
  source 1..20: mol_type = other DNA
agtgagaacaggcttcctga

SEQ ID NO: 57204 - DNA, 20 bp, synthetic construct
  misc_feature 1..20: note = CRISPR gRNA sequence
  source 1..20: mol_type = other DNA
gtgagaacaggcttcctgag

SEQ ID NO: 57205 - DNA, 20 bp, synthetic construct
  misc_feature 1..20: note = CRISPR gRNA sequence
  source 1..20: mol_type = other DNA
acaggcttcctgaggggttc

SEQ ID NO: 57206 - DNA, 20 bp, synthetic construct
  misc_feature 1..20: note = CRISPR gRNA sequence
  source 1..20: mol_type = other DNA
caggcttcctgaggggttcc

SEQ ID NO: 57207 - DNA, 20 bp, synthetic construct
  misc_feature 1..20: note = CRISPR gRNA sequence
  source 1..20: mol_type = other DNA
cttcctgaggggttccaggt

SEQ ID NO: 57208 - DNA, 20 bp, synthetic construct
  misc_feature 1..20: note = CRISPR gRNA sequence
  source 1..20: mol_type = other DNA
gggttccaggttagaccctt

SEQ ID NO: 57209 - DNA, 20 bp, synthetic construct
  misc_feature 1..20: note = CRISPR gRNA sequence
  source 1..20: mol_type = other DNA
caggttagaccctttagaat

SEQ ID NO: 57210 - DNA, 20 bp, synthetic construct
  misc_feature 1..20: note = CRISPR gRNA sequence
  source 1..20: mol_type = other DNA
agaccctttagaattggtaa

SEQ ID NO: 57211 - DNA, 20 bp, synthetic construct
  misc_feature 1..20: note = CRISPR gRNA sequence
  source 1..20: mol_type = other DNA
gaccctttagaattggtaac

SEQ ID NO: 57212 - DNA, 20 bp, synthetic construct
  misc_feature 1..20: note = CRISPR gRNA sequence
  source 1..20: mol_type = other DNA
tttagaattggtaacgggac

SEQ ID NO: 57213 - DNA, 20 bp, synthetic construct
  misc_feature 1..20: note = CRISPR gRNA sequence
  source 1..20: mol_type = other DNA
attggtaacgggacaagcta

SEQ ID NO: 57214 - DNA, 20 bp, synthetic construct
  misc_feature 1..20: note = CRISPR gRNA sequence
  source 1..20: mol_type = other DNA
gggacaagctaaagccttga

SEQ ID NO: 57215 - DNA, 20 bp, synthetic construct
  misc_feature 1..20: note = CRISPR gRNA sequence
  source 1..20: mol_type = other DNA
taaagccttgaaagtcactg

SEQ ID NO: 57216 - DNA, 20 bp, synthetic construct
  misc_feature 1..20: note = CRISPR gRNA sequence
  source 1..20: mol_type = other DNA
aaagccttgaaagtcactgc

SEQ ID NO: 57217 - DNA, 20 bp, synthetic construct
  misc_feature 1..20: note = CRISPR gRNA sequence
  source 1..20: mol_type = other DNA
agccttgaaagtcactgcag

SEQ ID NO: 57218 - DNA, 20 bp, synthetic construct
  misc_feature 1..20: note = CRISPR gRNA sequence
  source 1..20: mol_type = other DNA
gccttgaaagtcactgcagg

SEQ ID NO: 57219 - DNA, 20 bp, synthetic construct
  misc_feature 1..20: note = CRISPR gRNA sequence
  source 1..20: mol_type = other DNA
cttgaaagtcactgcaggag

SEQ ID NO: 57220 - DNA, 20 bp, synthetic construct
  misc_feature 1..20: note = CRISPR gRNA sequence
  source 1..20: mol_type = other DNA
ttgaaagtcactgcaggagg

SEQ ID NO: 57221 - DNA, 20 bp, synthetic construct
  misc_feature 1..20: note = CRISPR gRNA sequence
  source 1..20: mol_type = other DNA
aaagtcactgcaggaggagg

SEQ ID NO: 57222 - DNA, 20 bp, synthetic construct
  misc_feature 1..20: note = CRISPR gRNA sequence
  source 1..20: mol_type = other DNA
aagtcactgcaggaggaggt

SEQ ID NO: 57223 - DNA, 20 bp, synthetic construct
  misc_feature 1..20: note = CRISPR gRNA sequence
  source 1..20: mol_type = other DNA
agtcactgcaggaggaggtg

SEQ ID NO: 57224 - DNA, 20 bp, synthetic construct
  misc_feature 1..20: note = CRISPR gRNA sequence
  source 1..20: mol_type = other DNA
actgcaggaggaggtggggc

SEQ ID NO: 57225 - DNA, 20 bp, synthetic construct
  misc_feature 1..20: note = CRISPR gRNA sequence
  source 1..20: mol_type = other DNA
ctgcaggaggaggtggggct

SEQ ID NO: 57226 - DNA, 20 bp, synthetic construct
  misc_feature 1..20: note = CRISPR gRNA sequence
  source 1..20: mol_type = other DNA
gcaggaggaggtggggctgg

SEQ ID NO: 57227 - DNA, 20 bp, synthetic construct
  misc_feature 1..20: note = CRISPR gRNA sequence
  source 1..20: mol_type = other DNA
ggaggtggggctgggagaca

SEQ ID NO: 57228 - DNA, 20 bp, synthetic construct
  misc_feature 1..20: note = CRISPR gRNA sequence
  source 1..20: mol_type = other DNA
gtggggctgggagacacagt

SEQ ID NO: 57229 - DNA, 20 bp, synthetic construct
  misc_feature 1..20: note = CRISPR gRNA sequence
  source 1..20: mol_type = other DNA
tggggctgggagacacagtt

SEQ ID NO: 57230 - DNA, 20 bp, synthetic construct
  misc_feature 1..20: note = CRISPR gRNA sequence
  source 1..20: mol_type = other DNA
ggggctgggagacacagtta

SEQ ID NO: 57231 - DNA, 20 bp, synthetic construct
  misc_feature 1..20: note = CRISPR gRNA sequence
  source 1..20: mol_type = other DNA
gggctgggagacacagttag

SEQ ID NO: 57232 - DNA, 20 bp, synthetic construct
  misc_feature 1..20: note = CRISPR gRNA sequence
  source 1..20: mol_type = other DNA
gggcttgacacacttgcaaa

SEQ ID NO: 57233 - DNA, 20 bp, synthetic construct
  misc_feature 1..20: note = CRISPR gRNA sequence
  source 1..20: mol_type = other DNA
ggcttgacacacttgcaaat

SEQ ID NO: 57234 - DNA, 20 bp, synthetic construct
  misc_feature 1..20: note = CRISPR gRNA sequence
  source 1..20: mol_type = other DNA
tgacacacttgcaaatgggt

SEQ ID NO: 57235 - DNA, 20 bp, synthetic construct
  misc_feature 1..20: note = CRISPR gRNA sequence
  source 1..20: mol_type = other DNA
gacacacttgcaaatgggtc

SEQ ID NO: 57236 - DNA, 20 bp, synthetic construct
  misc_feature 1..20: note = CRISPR gRNA sequence
  source 1..20: mol_type = other DNA
acacacttgcaaatgggtca

SEQ ID NO: 57237 - DNA, 20 bp, synthetic construct
  misc_feature 1..20: note = CRISPR gRNA sequence
  source 1..20: mol_type = other DNA
acttgcaaatgggtcaggga

SEQ ID NO: 57238 - DNA, 20 bp, synthetic construct
  misc_feature 1..20: note = CRISPR gRNA sequence
  source 1..20: mol_type = other DNA
aaatgggtcagggacagacg

SEQ ID NO: 57239 - DNA, 20 bp, synthetic construct
  misc_feature 1..20: note = CRISPR gRNA sequence
  source 1..20: mol_type = other DNA
atgggtcagggacagacgaa

SEQ ID NO: 57240 - DNA, 20 bp, synthetic construct
  misc_feature 1..20: note = CRISPR gRNA sequence
  source 1..20: mol_type = other DNA
tcagggacagacgaagagca

SEQ ID NO: 57241 - DNA, 20 bp, synthetic construct
  misc_feature 1..20: note = CRISPR gRNA sequence
  source 1..20: mol_type = other DNA
agacgaagagcatggcctat

SEQ ID NO: 57242 - DNA, 20 bp, synthetic construct
  misc_feature 1..20: note = CRISPR gRNA sequence
  source 1..20: mol_type = other DNA
agagcatggcctatgagaaa

SEQ ID NO: 57243 - DNA, 20 bp, synthetic construct
  misc_feature 1..20: note = CRISPR gRNA sequence
  source 1..20: mol_type = other DNA
ctatgagaaatggctgtgac

SEQ ID NO: 57244 - DNA, 20 bp, synthetic construct
  misc_feature 1..20: note = CRISPR gRNA sequence
  source 1..20: mol_type = other DNA
atggctgtgaccagccacca

SEQ ID NO: 57245 - DNA, 20 bp, synthetic construct
  misc_feature 1..20: note = CRISPR gRNA sequence
  source 1..20: mol_type = other DNA
accagccaccacagcctcca

SEQ ID NO: 57246 - DNA, 20 bp, synthetic construct
  misc_feature 1..20: note = CRISPR gRNA sequence
  source 1..20: mol_type = other DNA
acagcctccacagcctcctc

SEQ ID NO: 57247 - DNA, 20 bp, synthetic construct
  misc_feature 1..20: note = CRISPR gRNA sequence
  source 1..20: mol_type = other DNA
ctccacagcctcctccagct

SEQ ID NO: 57248 - DNA, 20 bp, synthetic construct
  misc_feature 1..20: note = CRISPR gRNA sequence
  source 1..20: mol_type = other DNA
cacagcctcctccagcttgg

SEQ ID NO: 57249 - DNA, 20 bp, synthetic construct
  misc_feature 1..20: note = CRISPR gRNA sequence
  source 1..20: mol_type = other DNA
agcctcctccagcttggaag

SEQ ID NO: 57250 - DNA, 20 bp, synthetic construct
  misc_feature 1..20: note = CRISPR gRNA sequence
  source 1..20: mol_type = other DNA
gcctcctccagcttggaagt

SEQ ID NO: 57251 - DNA, 20 bp, synthetic construct
  misc_feature 1..20: note = CRISPR gRNA sequence
  source 1..20: mol_type = other DNA
cctcctccagcttggaagtg

SEQ ID NO: 57252 - DNA, 20 bp, synthetic construct
  misc_feature 1..20: note = CRISPR gRNA sequence
  source 1..20: mol_type = other DNA
gcttggaagtggggacttca

SEQ ID NO: 57253 - DNA, 20 bp, synthetic construct
  misc_feature 1..20: note = CRISPR gRNA sequence
  source 1..20: mol_type = other DNA
cccttcccaccccccaactc

SEQ ID NO: 57254 - DNA, 20 bp, synthetic construct
  misc_feature 1..20: note = CRISPR gRNA sequence
  source 1..20: mol_type = other DNA
cccaactccagtcctcacca

SEQ ID NO: 57255 - DNA, 20 bp, synthetic construct
  misc_feature 1..20: note = CRISPR gRNA sequence
  source 1..20: mol_type = other DNA
aactccagtcctcaccatgg

SEQ ID NO: 57256 - DNA, 20 bp, synthetic construct
  misc_feature 1..20: note = CRISPR gRNA sequence
  source 1..20: mol_type = other DNA
ctccagtcctcaccatggtg

SEQ ID NO: 57257 - DNA, 20 bp, synthetic construct
  misc_feature 1..20: note = CRISPR gRNA sequence
  source 1..20: mol_type = other DNA
gtcctcaccatggtggagct

SEQ ID NO: 57258 - DNA, 20 bp, synthetic construct
  misc_feature 1..20: note = CRISPR gRNA sequence
  source 1..20: mol_type = other DNA
accatggtggagctgagatt

SEQ ID NO: 57259 - DNA, 20 bp, synthetic construct
  misc_feature 1..20: note = CRISPR gRNA sequence
  source 1..20: mol_type = other DNA
ccatggtggagctgagattc

SEQ ID NO: 57260 - DNA, 20 bp, synthetic construct
  misc_feature 1..20: note = CRISPR gRNA sequence
  source 1..20: mol_type = other DNA
ggtggagctgagattcaggt

SEQ ID NO: 57261 - DNA, 20 bp, synthetic construct
  misc_feature 1..20: note = CRISPR gRNA sequence
  source 1..20: mol_type = other DNA
ttcaggttggcttttcccct

SEQ ID NO: 57262 - DNA, 20 bp, synthetic construct
  misc_feature 1..20: note = CRISPR gRNA sequence
  source 1..20: mol_type = other DNA
tggcttttcccctcagctcc

SEQ ID NO: 57263 - DNA, 20 bp, synthetic construct
  misc_feature 1..20: note = CRISPR gRNA sequence
  source 1..20: mol_type = other DNA
ttttcccctcagctcccagc

SEQ ID NO: 57264 - DNA, 20 bp, synthetic construct
  misc_feature 1..20: note = CRISPR gRNA sequence
  source 1..20: mol_type = other DNA
cccctcagctcccagctggc

SEQ ID NO: 57265 - DNA, 20 bp, synthetic construct
  misc_feature 1..20: note = CRISPR gRNA sequence
  source 1..20: mol_type = other DNA
agctggctggtgaaccctgc

SEQ ID NO: 57266 - DNA, 20 bp, synthetic construct
  misc_feature 1..20: note = CRISPR gRNA sequence
  source 1..20: mol_type = other DNA
ctggctggtgaaccctgcaa

SEQ ID NO: 57267 - DNA, 20 bp, synthetic construct
  misc_feature 1..20: note = CRISPR gRNA sequence
  source 1..20: mol_type = other DNA
ggctggtgaaccctgcaaga

SEQ ID NO: 57268 - DNA, 20 bp, synthetic construct
  misc_feature 1..20: note = CRISPR gRNA sequence
  source 1..20: mol_type = other DNA
gctggtgaaccctgcaagag

SEQ ID NO: 57269 - DNA, 20 bp, synthetic construct
  misc_feature 1..20: note = CRISPR gRNA sequence
  source 1..20: mol_type = other DNA
ctggtgaaccctgcaagaga

SEQ ID NO: 57270 - DNA, 20 bp, synthetic construct
  misc_feature 1..20: note = CRISPR gRNA sequence
  source 1..20: mol_type = other DNA
tggtgaaccctgcaagagag

SEQ ID NO: 57271 - DNA, 20 bp, synthetic construct
  misc_feature 1..20: note = CRISPR gRNA sequence
  source 1..20: mol_type = other DNA
gtgaaccctgcaagagaggg

SEQ ID NO: 57272 - DNA, 20 bp, synthetic construct
  misc_feature 1..20: note = CRISPR gRNA sequence
  source 1..20: mol_type = other DNA
gaaccctgcaagagagggga

SEQ ID NO: 57273 - DNA, 20 bp, synthetic construct
  misc_feature 1..20: note = CRISPR gRNA sequence
  source 1..20: mol_type = other DNA
agagaggggagagtataatg

SEQ ID NO: 57274 - DNA, 20 bp, synthetic construct
  misc_feature 1..20: note = CRISPR gRNA sequence
  source 1..20: mol_type = other DNA
ggggagagtataatgtggta

SEQ ID NO: 57275 - DNA, 20 bp, synthetic construct
  misc_feature 1..20: note = CRISPR gRNA sequence
  source 1..20: mol_type = other DNA
gggagagtataatgtggtat

SEQ ID NO: 57276 - DNA, 20 bp, synthetic construct
  misc_feature 1..20: note = CRISPR gRNA sequence
  source 1..20: mol_type = other DNA
ggagagtataatgtggtatg

SEQ ID NO: 57277 - DNA, 20 bp, synthetic construct
  misc_feature 1..20: note = CRISPR gRNA sequence
  source 1..20: mol_type = other DNA
taatgtggtatggggctgtc

SEQ ID NO: 57278 - DNA, 20 bp, synthetic construct
  misc_feature 1..20: note = CRISPR gRNA sequence
  source 1..20: mol_type = other DNA
aatgtggtatggggctgtcg

SEQ ID NO: 57279 - DNA, 20 bp, synthetic construct
  misc_feature 1..20: note = CRISPR gRNA sequence
  source 1..20: mol_type = other DNA
atgtggtatggggctgtcga

SEQ ID NO: 57280 - DNA, 20 bp, synthetic construct
  misc_feature 1..20: note = CRISPR gRNA sequence
  source 1..20: mol_type = other DNA
atggggctgtcgagggatgc

SEQ ID NO: 57281 - DNA, 20 bp, synthetic construct
  misc_feature 1..20: note = CRISPR gRNA sequence
  source 1..20: mol_type = other DNA
tggggctgtcgagggatgct

SEQ ID NO: 57282 - DNA, 20 bp, synthetic construct
  misc_feature 1..20: note = CRISPR gRNA sequence
  source 1..20: mol_type = other DNA
ggggctgtcgagggatgctg

SEQ ID NO: 57283 - DNA, 20 bp, synthetic construct
  misc_feature 1..20: note = CRISPR gRNA sequence
  source 1..20: mol_type = other DNA
tgtcgagggatgctggggac

SEQ ID NO: 57284 - DNA, 20 bp, synthetic construct
  misc_feature 1..20: note = CRISPR gRNA sequence
  source 1..20: mol_type = other DNA
gggatgctggggaccagctc

SEQ ID NO: 57285 - DNA, 20 bp, synthetic construct
  misc_feature 1..20: note = CRISPR gRNA sequence
  source 1..20: mol_type = other DNA
gctggggaccagctctggcc

SEQ ID NO: 57286 - DNA, 20 bp, synthetic construct
  misc_feature 1..20: note = CRISPR gRNA sequence
  source 1..20: mol_type = other DNA
accagctctggcctggcgcc

SEQ ID NO: 57287 - DNA, 20 bp, synthetic construct
  misc_feature 1..20: note = CRISPR gRNA sequence
  source 1..20: mol_type = other DNA
ctctggcctggcgcctggct

SEQ ID NO: 57288 - DNA, 20 bp, synthetic construct
  misc_feature 1..20: note = CRISPR gRNA sequence
  source 1..20: mol_type = other DNA
tctggcctggcgcctggctc

SEQ ID NO: 57289 - DNA, 20 bp, synthetic construct
  misc_feature 1..20: note = CRISPR gRNA sequence
  source 1..20: mol_type = other DNA
ctggcctggcgcctggctca

SEQ ID NO: 57290 - DNA, 20 bp, synthetic construct
  misc_feature 1..20: note = CRISPR gRNA sequence
  source 1..20: mol_type = other DNA
ctggctcagggctcatctca

SEQ ID NO: 57291 - DNA, 20 bp, synthetic construct
  misc_feature 1..20: note = CRISPR gRNA sequence
  source 1..20: mol_type = other DNA
tggctcagggctcatctcac

SEQ ID NO: 57292 - DNA, 20 bp, synthetic construct
  misc_feature 1..20: note = CRISPR gRNA sequence
  source 1..20: mol_type = other DNA
ggctcagggctcatctcaca

SEQ ID NO: 57293 - DNA, 20 bp, synthetic construct
  misc_feature 1..20: note = CRISPR gRNA sequence
  source 1..20: mol_type = other DNA
ctcagggctcatctcacagg

SEQ ID NO: 57294 - DNA, 20 bp, synthetic construct
  misc_feature 1..20: note = CRISPR gRNA sequence
  source 1..20: mol_type = other DNA
tcatctcacagggagatacc

SEQ ID NO: 57295 - DNA, 20 bp, synthetic construct
  misc_feature 1..20: note = CRISPR gRNA sequence
  source 1..20: mol_type = other DNA
ctcacagggagatacccagc

SEQ ID NO: 57296 - DNA, 20 bp, synthetic construct
  misc_feature 1..20: note = CRISPR gRNA sequence
  source 1..20: mol_type = other DNA
tcacagggagatacccagca

SEQ ID NO: 57297 - DNA, 20 bp, synthetic construct
  misc_feature 1..20: note = CRISPR gRNA sequence
  source 1..20: mol_type = other DNA
cacagggagatacccagcaa

SEQ ID NO: 57298 - DNA, 20 bp, synthetic construct
  misc_feature 1..20: note = CRISPR gRNA sequence
  source 1..20: mol_type = other DNA
cagggagatacccagcaagg

SEQ ID NO: 57299 - DNA, 20 bp, synthetic construct
  misc_feature 1..20: note = CRISPR gRNA sequence
  source 1..20: mol_type = other DNA
cccagcaagggagaactaaa

SEQ ID NO: 57300 - DNA, 20 bp, synthetic construct
  misc_feature 1..20: note = CRISPR gRNA sequence
  source 1..20: mol_type = other DNA
ggagaactaaatggaacact

SEQ ID NO: 57301 - DNA, 20 bp, synthetic construct
  misc_feature 1..20: note = CRISPR gRNA sequence
  source 1..20: mol_type = other DNA
gaacactcagttatctgttg

SEQ ID NO: 57302 - DNA, 20 bp, synthetic construct
  misc_feature 1..20: note = CRISPR gRNA sequence
  source 1..20: mol_type = other DNA
acactcagttatctgttgtg

SEQ ID NO: 57303 - DNA, 20 bp, synthetic construct
  misc_feature 1..20: note = CRISPR gRNA sequence
  source 1..20: mol_type = other DNA
tatctgttgtggagaaaatg

SEQ ID NO: 57304 - DNA, 20 bp, synthetic construct
  misc_feature 1..20: note = CRISPR gRNA sequence
  source 1..20: mol_type = other DNA
ctgttgtggagaaaatgtgg

SEQ ID NO: 57305 - DNA, 20 bp, synthetic construct
  misc_feature 1..20: note = CRISPR gRNA sequence
  source 1..20: mol_type = other DNA
tgtggagaaaatgtggtggt

SEQ ID NO: 57306 - DNA, 20 bp, synthetic construct
  misc_feature 1..20: note = CRISPR gRNA sequence
  source 1..20: mol_type = other DNA
aaatgtggtggtgagctttg

SEQ ID NO: 57307 - DNA, 20 bp, synthetic construct
  misc_feature 1..20: note = CRISPR gRNA sequence
  source 1..20: mol_type = other DNA
aatgtggtggtgagctttga

SEQ ID NO: 57308 - DNA, 20 bp, synthetic construct
  misc_feature 1..20: note = CRISPR gRNA sequence
  source 1..20: mol_type = other DNA
gtggtggtgagctttgaagg

SEQ ID NO: 57309 - DNA, 20 bp, synthetic construct
  misc_feature 1..20: note = CRISPR gRNA sequence
  source 1..20: mol_type = other DNA
gtgagctttgaaggcagtgc

SEQ ID NO: 57310 - DNA, 20 bp, synthetic construct
  misc_feature 1..20: note = CRISPR gRNA sequence
  source 1..20: mol_type = other DNA
tgagctttgaaggcagtgct

SEQ ID NO: 57311 - DNA, 20 bp, synthetic construct
  misc_feature 1..20: note = CRISPR gRNA sequence
  source 1..20: mol_type = other DNA
gctttgaaggcagtgctggg

SEQ ID NO: 57312 - DNA, 20 bp, synthetic construct
  misc_feature 1..20: note = CRISPR gRNA sequence
  source 1..20: mol_type = other DNA
gcagaaatgtgtgtatatgc

SEQ ID NO: 57313 - DNA, 20 bp, synthetic construct
  misc_feature 1..20: note = CRISPR gRNA sequence
  source 1..20: mol_type = other DNA
gtgtatatgcaagtgcatgc

SEQ ID NO: 57314 - DNA, 20 bp, synthetic construct
  misc_feature 1..20: note = CRISPR gRNA sequence
  source 1..20: mol_type = other DNA
agtttatgtatgtgtgtgca

SEQ ID NO: 57315 - DNA, 20 bp, synthetic construct
  misc_feature 1..20: note = CRISPR gRNA sequence
  source 1..20: mol_type = other DNA
gtttatgtatgtgtgtgcac

SEQ ID NO: 57316 - DNA, 20 bp, synthetic construct
  misc_feature 1..20: note = CRISPR gRNA sequence
  source 1..20: mol_type = other DNA
gcatgcatgtgttatgcatg

SEQ ID NO: 57317 - DNA, 20 bp, synthetic construct
  misc_feature 1..20: note = CRISPR gRNA sequence
  source 1..20: mol_type = other DNA
catgcatgtgttatgcatgt

SEQ ID NO: 57318 - DNA, 20 bp, synthetic construct
  misc_feature 1..20: note = CRISPR gRNA sequence
  source 1..20: mol_type = other DNA
cacttgcatgcatgtgtaca

SEQ ID NO: 57319 - DNA, 20 bp, synthetic construct
  misc_feature 1..20: note = CRISPR gRNA sequence
  source 1..20: mol_type = other DNA
acttgcatgcatgtgtacat

SEQ ID NO: 57320 - DNA, 20 bp, synthetic construct
  misc_feature 1..20: note = CRISPR gRNA sequence
  source 1..20: mol_type = other DNA
aattcccacactctgccttg

SEQ ID NO: 57321 - DNA, 20 bp, synthetic construct
  misc_feature 1..20: note = CRISPR gRNA sequence
  source 1..20: mol_type = other DNA
tcccacactctgccttgaag

SEQ ID NO: 57322 - DNA, 20 bp, synthetic construct
  misc_feature 1..20: note = CRISPR gRNA sequence
  source 1..20: mol_type = other DNA
cccacactctgccttgaagt

SEQ ID NO: 57323 - DNA, 20 bp, synthetic construct
  misc_feature 1..20: note = CRISPR gRNA sequence
  source 1..20: mol_type = other DNA
ccacactctgccttgaagta

SEQ ID NO: 57324 - DNA, 20 bp, synthetic construct
  misc_feature 1..20: note = CRISPR gRNA sequence
  source 1..20: mol_type = other DNA
tgccttgaagtagggttctt

SEQ ID NO: 57325 - DNA, 20 bp, synthetic construct
  misc_feature 1..20: note = CRISPR gRNA sequence
  source 1..20: mol_type = other DNA
ttgaagtagggttcttaagt

SEQ ID NO: 57326 - DNA, 20 bp, synthetic construct
  misc_feature 1..20: note = CRISPR gRNA sequence
  source 1..20: mol_type = other DNA
caatgtcctgtgtttcccct

SEQ ID NO: 57327 - DNA, 20 bp, synthetic construct
  misc_feature 1..20: note = CRISPR gRNA sequence
  source 1..20: mol_type = other DNA
tcccctcagtgctgtgcaaa

SEQ ID NO: 57328 - DNA, 20 bp, synthetic construct
  misc_feature 1..20: note = CRISPR gRNA sequence
  source 1..20: mol_type = other DNA
cctcagtgctgtgcaaacag

SEQ ID NO: 57329 - DNA, 20 bp, synthetic construct
  misc_feature 1..20: note = CRISPR gRNA sequence
  source 1..20: mol_type = other DNA
ctcagtgctgtgcaaacaga

SEQ ID NO: 57330 - DNA, 20 bp, synthetic construct
  misc_feature 1..20: note = CRISPR gRNA sequence
  source 1..20: mol_type = other DNA
tgtgcaaacagaaggtgccc

SEQ ID NO: 57331 - DNA, 20 bp, synthetic construct
  misc_feature 1..20: note = CRISPR gRNA sequence
  source 1..20: mol_type = other DNA
aggtgcccaagaaatcccca

SEQ ID NO: 57332 - DNA, 20 bp, synthetic construct
  misc_feature 1..20: note = CRISPR gRNA sequence
  source 1..20: mol_type = other DNA
cccaagaaatccccacggat

SEQ ID NO: 57333 - DNA, 20 bp, synthetic construct
  misc_feature 1..20: note = CRISPR gRNA sequence
  source 1..20: mol_type = other DNA
aagaaatccccacggatcag

SEQ ID NO: 57334 - DNA, 20 bp, synthetic construct
  misc_feature 1..20: note = CRISPR gRNA sequence
  source 1..20: mol_type = other DNA
gaaatccccacggatcagta

SEQ ID NO: 57335 - DNA, 20 bp, synthetic construct
  misc_feature 1..20: note = CRISPR gRNA sequence
  source 1..20: mol_type = other DNA
aaatccccacggatcagtag

SEQ ID NO: 57336 - DNA, 20 bp, synthetic construct
  misc_feature 1..20: note = CRISPR gRNA sequence
  source 1..20: mol_type = other DNA
aatccccacggatcagtaga

SEQ ID NO: 57337 - DNA, 20 bp, synthetic construct
  misc_feature 1..20: note = CRISPR gRNA sequence
  source 1..20: mol_type = other DNA
ccccacggatcagtagaggg

SEQ ID NO: 57338 - DNA, 20 bp, synthetic construct
  misc_feature 1..20: note = CRISPR gRNA sequence
  source 1..20: mol_type = other DNA
cacggatcagtagagggcag

SEQ ID NO: 57339 - DNA, 20 bp, synthetic construct
  misc_feature 1..20: note = CRISPR gRNA sequence
  source 1..20: mol_type = other DNA
acggatcagtagagggcaga

SEQ ID NO: 57340 - DNA, 20 bp, synthetic construct
  misc_feature 1..20: note = CRISPR gRNA sequence
  source 1..20: mol_type = other DNA
caaacaaacaaaaacacctc

SEQ ID NO: 57341 - DNA, 20 bp, synthetic construct
  misc_feature 1..20: note = CRISPR gRNA sequence
  source 1..20: mol_type = other DNA
caaacaaaaacacctctagc

SEQ ID NO: 57342 - DNA, 20 bp, synthetic construct
  misc_feature 1..20: note = CRISPR gRNA sequence
  source 1..20: mol_type = other DNA
aaacaaaaacacctctagcc

SEQ ID NO: 57343 - DNA, 20 bp, synthetic construct
  misc_feature 1..20: note = CRISPR gRNA sequence
  source 1..20: mol_type = other DNA
acacctctagccaggtgtga

SEQ ID NO: 57344 - DNA, 20 bp, synthetic construct
  misc_feature 1..20: note = CRISPR gRNA sequence
  source 1..20: mol_type = other DNA
atggctcacatctataatcc

SEQ ID NO: 57345 - DNA, 20 bp, synthetic construct
  misc_feature 1..20: note = CRISPR gRNA sequence
  source 1..20: mol_type = other DNA
catctataatcccagcactt

SEQ ID NO: 57346 - DNA, 20 bp, synthetic construct
  misc_feature 1..20: note = CRISPR gRNA sequence
  source 1..20: mol_type = other DNA
atctataatcccagcacttt

SEQ ID NO: 57347 - DNA, 20 bp, synthetic construct
  misc_feature 1..20: note = CRISPR gRNA sequence
  source 1..20: mol_type = other DNA
ctataatcccagcactttgg

SEQ ID NO: 57348 - DNA, 20 bp, synthetic construct
  misc_feature 1..20: note = CRISPR gRNA sequence
  source 1..20: mol_type = other DNA
tataatcccagcactttggg

SEQ ID NO: 57349 - DNA, 20 bp, synthetic construct
  misc_feature 1..20: note = CRISPR gRNA sequence
  source 1..20: mol_type = other DNA
tcccagcactttgggaggcc

SEQ ID NO: 57350 - DNA, 20 bp, synthetic construct
  misc_feature 1..20: note = CRISPR gRNA sequence
  source 1..20: mol_type = other DNA
cccagcactttgggaggcca

SEQ ID NO: 57351 - DNA, 20 bp, synthetic construct
  misc_feature 1..20: note = CRISPR gRNA sequence
  source 1..20: mol_type = other DNA
ccagcactttgggaggccaa

SEQ ID NO: 57352 - DNA, 20 bp, synthetic construct
  misc_feature 1..20: note = CRISPR gRNA sequence
  source 1..20: mol_type = other DNA
agcactttgggaggccaagg

SEQ ID NO: 57353 - DNA, 20 bp, synthetic construct
  misc_feature 1..20: note = CRISPR gRNA sequence
  source 1..20: mol_type = other DNA
gcactttgggaggccaaggg

SEQ ID NO: 57354 - DNA, 20 bp, synthetic construct
  misc_feature 1..20: note = CRISPR gRNA sequence
  source 1..20: mol_type = other DNA
actttgggaggccaagggag

SEQ ID NO: 57355 - DNA, 20 bp, synthetic construct
  misc_feature 1..20: note = CRISPR gRNA sequence
  source 1..20: mol_type = other DNA
ctttgggaggccaagggagg

SEQ ID NO: 57356 - DNA, 20 bp, synthetic construct
  misc_feature 1..20: note = CRISPR gRNA sequence
  source 1..20: mol_type = other DNA
ccaagggaggaggatcactt

SEQ ID NO: 57357 - DNA, 20 bp, synthetic construct
  misc_feature 1..20: note = CRISPR gRNA sequence
  source 1..20: mol_type = other DNA
caagggaggaggatcactta

SEQ ID NO: 57358 - DNA, 20 bp, synthetic construct
  misc_feature 1..20: note = CRISPR gRNA sequence
  source 1..20: mol_type = other DNA
ggaggaggatcacttaaggc

SEQ ID NO: 57359 - DNA, 20 bp, synthetic construct
  misc_feature 1..20: note = CRISPR gRNA sequence
  source 1..20: mol_type = other DNA
gaggaggatcacttaaggcc

SEQ ID NO: 57360 - DNA, 20 bp, synthetic construct
  misc_feature 1..20: note = CRISPR gRNA sequence
  source 1..20: mol_type = other DNA
ggaggatcacttaaggccag

SEQ ID NO: 57361 - DNA, 20 bp, synthetic construct
  misc_feature 1..20: note = CRISPR gRNA sequence
  source 1..20: mol_type = other DNA
tcacttaaggccaggagttc

SEQ ID NO: 57362 - DNA, 20 bp, synthetic construct
  misc_feature 1..20: note = CRISPR gRNA sequence
  source 1..20: mol_type = other DNA
taaggccaggagttcaagac

SEQ ID NO: 57363 - DNA, 20 bp, synthetic construct
  misc_feature 1..20: note = CRISPR gRNA sequence
  source 1..20: mol_type = other DNA
ccaggagttcaagaccagcc

SEQ ID NO: 57364 - DNA, 20 bp, synthetic construct
  misc_feature 1..20: note = CRISPR gRNA sequence
  source 1..20: mol_type = other DNA
caggagttcaagaccagcct

SEQ ID NO: 57365 - DNA, 20 bp, synthetic construct
  misc_feature 1..20: note = CRISPR gRNA sequence
  source 1..20: mol_type = other DNA
caagaccagcctgggcaaca

SEQ ID NO: 57366 - DNA, 20 bp, synthetic construct
  misc_feature 1..20: note = CRISPR gRNA sequence
  source 1..20: mol_type = other DNA
gtgatgtcctgtctctacaa

SEQ ID NO: 57367 - DNA, 20 bp, synthetic construct
  misc_feature 1..20: note = CRISPR gRNA sequence
  source 1..20: mol_type = other DNA
tctacaaaagaatgaaaaat

SEQ ID NO: 57368 - DNA, 20 bp, synthetic construct
  misc_feature 1..20: note = CRISPR gRNA sequence
  source 1..20: mol_type = other DNA
aatgaaaaattagcctaatg

SEQ ID NO: 57369 - DNA, 20 bp, synthetic construct
  misc_feature 1..20: note = CRISPR gRNA sequence
  source 1..20: mol_type = other DNA
gaaaaattagcctaatgtgg

SEQ ID NO: 57370 - DNA, 20 bp, synthetic construct
  misc_feature 1..20: note = CRISPR gRNA sequence
  source 1..20: mol_type = other DNA
aatgtggtggcatgcaccta

SEQ ID NO: 57371 - DNA, 20 bp, synthetic construct
  misc_feature 1..20: note = CRISPR gRNA sequence
  source 1..20: mol_type = other DNA
atgcacctatagttctactg

SEQ ID NO: 57372 - DNA, 20 bp, synthetic construct
  misc_feature 1..20: note = CRISPR gRNA sequence
  source 1..20: mol_type = other DNA
ctatagttctactgtagtct

SEQ ID NO: 57373 - DNA, 20 bp, synthetic construct
  misc_feature 1..20: note = CRISPR gRNA sequence
  source 1..20: mol_type = other DNA
ctactgtagtctcagctact

SEQ ID NO: 57374 - DNA, 20 bp, synthetic construct
  misc_feature 1..20: note = CRISPR gRNA sequence
  source 1..20: mol_type = other DNA
tactgtagtctcagctactt

SEQ ID NO: 57375 - DNA, 20 bp, synthetic construct
  misc_feature 1..20: note = CRISPR gRNA sequence
  source 1..20: mol_type = other DNA
ctgtagtctcagctacttgg

SEQ ID NO: 57376 - DNA, 20 bp, synthetic construct
  misc_feature 1..20: note = CRISPR gRNA sequence
  source 1..20: mol_type = other DNA
tgtagtctcagctacttggg

SEQ ID NO: 57377 - DNA, 20 bp, synthetic construct
  misc_feature 1..20: note = CRISPR gRNA sequence
  source 1..20: mol_type = other DNA
ctcagctacttgggaggctg

SEQ ID NO: 57378 - DNA, 20 bp, synthetic construct
  misc_feature 1..20: note = CRISPR gRNA sequence
  source 1..20: mol_type = other DNA
agctacttgggaggctgaag

SEQ ID NO: 57379 - DNA, 20 bp, synthetic construct
  misc_feature 1..20: note = CRISPR gRNA sequence
  source 1..20: mol_type = other DNA
gctacttgggaggctgaagt

SEQ ID NO: 57380 - DNA, 20 bp, synthetic construct
  misc_feature 1..20: note = CRISPR gRNA sequence
  source 1..20: mol_type = other DNA
acttgggaggctgaagtggg

SEQ ID NO: 57381 - DNA, 20 bp, synthetic construct
  misc_feature 1..20: note = CRISPR gRNA sequence
  source 1..20: mol_type = other DNA
cttgggaggctgaagtggga

SEQ ID NO: 57382 - DNA, 20 bp, synthetic construct
  misc_feature 1..20: note = CRISPR gRNA sequence
  source 1..20: mol_type = other DNA
tgaagtgggaaggatcacct

SEQ ID NO: 57383 - DNA, 20 bp, synthetic construct
  misc_feature 1..20: note = CRISPR gRNA sequence
  source 1..20: mol_type = other DNA
gggaaggatcacctgagtcc

SEQ ID NO: 57384 - DNA, 20 bp, synthetic construct
  misc_feature 1..20: note = CRISPR gRNA sequence
  source 1..20: mol_type = other DNA
gaaggatcacctgagtcctg

SEQ ID NO: 57385 - DNA, 20 bp, synthetic construct
  misc_feature 1..20: note = CRISPR gRNA sequence
  source 1..20: mol_type = other DNA
gatcacctgagtcctggagt

SEQ ID NO: 57386 - DNA, 20 bp, synthetic construct
  misc_feature 1..20: note = CRISPR gRNA sequence
  source 1..20: mol_type = other DNA
agtcctggagttggatgctg

SEQ ID NO: 57387 - DNA, 20 bp, synthetic construct
  misc_feature 1..20: note = CRISPR gRNA sequence
  source 1..20: mol_type = other DNA
ctggagttggatgctgtagt

SEQ ID NO: 57388 - DNA, 20 bp, synthetic construct
  misc_feature 1..20: note = CRISPR gRNA sequence
  source 1..20: mol_type = other DNA
atgattgtgccactgcactc

SEQ ID NO: 57389 - DNA, 20 bp, synthetic construct
  misc_feature 1..20: note = CRISPR gRNA sequence
  source 1..20: mol_type = other DNA
tgtgccactgcactccagcc

SEQ ID NO: 57390 - DNA, 20 bp, synthetic construct
  misc_feature 1..20: note = CRISPR gRNA sequence
  source 1..20: mol_type = other DNA
gtgccactgcactccagcct

SEQ ID NO: 57391 - DNA, 20 bp, synthetic construct
  misc_feature 1..20: note = CRISPR gRNA sequence
  source 1..20: mol_type = other DNA
ctgcactccagcctaggcaa

SEQ ID NO: 57392 - DNA, 20 bp, synthetic construct
  misc_feature 1..20: note = CRISPR gRNA sequence
  source 1..20: mol_type = other DNA
gcactccagcctaggcaaca

SEQ ID NO: 57393 - DNA, 20 bp, synthetic construct
  misc_feature 1..20: note = CRISPR gRNA sequence
  source 1..20: mol_type = other DNA
tccagcctaggcaacagagc

SEQ ID NO: 57394 - DNA, 20 bp, synthetic construct
  misc_feature 1..20: note = CRISPR gRNA sequence
  source 1..20: mol_type = other DNA
acaaacaaacaaaacccaac

SEQ ID NO: 57395 - DNA, 20 bp, synthetic construct
  misc_feature 1..20: note = CRISPR gRNA sequence
  source 1..20: mol_type = other DNA
aaacaaacaaaacccaacaa

SEQ ID NO: 57396 - DNA, 20 bp, synthetic construct
  misc_feature 1..20: note = CRISPR gRNA sequence
  source 1..20: mol_type = other DNA
cccccccacccccgccaaaa

SEQ ID NO: 57397 - DNA, 20 bp, synthetic construct
  misc_feature 1..20: note = CRISPR gRNA sequence
  source 1..20: mol_type = other DNA
ccccacccccgccaaaaaag

SEQ ID NO: 57398 - DNA, 20 bp, synthetic construct
  misc_feature 1..20: note = CRISPR gRNA sequence
  source 1..20: mol_type = other DNA
aaaagaagaaataaatctct

SEQ ID NO: 57399 - DNA, 20 bp, synthetic construct
  misc_feature 1..20: note = CRISPR gRNA sequence
  source 1..20: mol_type = other DNA
aaagaagaaataaatctctc

SEQ ID NO: 57400 - DNA, 20 bp, synthetic construct
  misc_feature 1..20: note = CRISPR gRNA sequence
  source 1..20: mol_type = other DNA
aataaatctctcgggcatta

SEQ ID NO: 57401 - DNA, 20 bp, synthetic construct
  misc_feature 1..20: note = CRISPR gRNA sequence
  source 1..20: mol_type = other DNA
ataaatctctcgggcattat

SEQ ID NO: 57402 - DNA, 20 bp, synthetic construct
  misc_feature 1..20: note = CRISPR gRNA sequence
  source 1..20: mol_type = other DNA
ctcgggcattatgggctatg

SEQ ID NO: 57403 - DNA, 20 bp, synthetic construct
  misc_feature 1..20: note = CRISPR gRNA sequence
  source 1..20: mol_type = other DNA
tcgggcattatgggctatgt

SEQ ID NO: 57404 - DNA, 20 bp, synthetic construct
  misc_feature 1..20: note = CRISPR gRNA sequence
  source 1..20: mol_type = other DNA
atgggctatgtgggattttg

SEQ ID NO: 57405 - DNA, 20 bp, synthetic construct
  misc_feature 1..20: note = CRISPR gRNA sequence
  source 1..20: mol_type = other DNA
gctatgtgggattttgtggc

SEQ ID NO: 57406 - DNA, 20 bp, synthetic construct
  misc_feature 1..20: note = CRISPR gRNA sequence
  source 1..20: mol_type = other DNA
atgtgggattttgtggctgg

SEQ ID NO: 57407 - DNA, 20 bp, synthetic construct
  misc_feature 1..20: note = CRISPR gRNA sequence
  source 1..20: mol_type = other DNA
tgggattttgtggctggaag

SEQ ID NO: 57408 - DNA, 20 bp, synthetic construct
  misc_feature 1..20: note = CRISPR gRNA sequence
  source 1..20: mol_type = other DNA
tgtggctggaagcagtcact

SEQ ID NO: 57409 - DNA, 20 bp, synthetic construct
  misc_feature 1..20: note = CRISPR gRNA sequence
  source 1..20: mol_type = other DNA
aagcagtcactcagcaattc

SEQ ID NO: 57410 - DNA, 20 bp, synthetic construct
  misc_feature 1..20: note = CRISPR gRNA sequence
  source 1..20: mol_type = other DNA
ctcagcaattcgagcaattc

SEQ ID NO: 57411 - DNA, 20 bp, synthetic construct
  misc_feature 1..20: note = CRISPR gRNA sequence
  source 1..20: mol_type = other DNA
caattcgagcaattcgagtg

SEQ ID NO: 57412 - DNA, 20 bp, synthetic construct
  misc_feature 1..20: note = CRISPR gRNA sequence
  source 1..20: mol_type = other DNA
tcgagcaattcgagtgaagc

SEQ ID NO: 57413 - DNA, 20 bp, synthetic construct
  misc_feature 1..20: note = CRISPR gRNA sequence
  source 1..20: mol_type = other DNA
cgagcaattcgagtgaagcc

SEQ ID NO: 57414 - DNA, 20 bp, synthetic construct
  misc_feature 1..20: note = CRISPR gRNA sequence
  source 1..20: mol_type = other DNA
gcaattcgagtgaagccagg

SEQ ID NO: 57415 - DNA, 20 bp, synthetic construct
  misc_feature 1..20: note = CRISPR gRNA sequence
  source 1..20: mol_type = other DNA
attcgagtgaagccaggtag

SEQ ID NO: 57416 - DNA, 20 bp, synthetic construct
  misc_feature 1..20: note = CRISPR gRNA sequence
  source 1..20: mol_type = other DNA
ttcgagtgaagccaggtaga

SEQ ID NO: 57417 - DNA, 20 bp, synthetic construct
  misc_feature 1..20: note = CRISPR gRNA sequence
  source 1..20: mol_type = other DNA
cgagtgaagccaggtagaag

SEQ ID NO: 57418 - DNA, 20 bp, synthetic construct
  misc_feature 1..20: note = CRISPR gRNA sequence
  source 1..20: mol_type = other DNA
gagtgaagccaggtagaagg

SEQ ID NO: 57419 - DNA, 20 bp, synthetic construct
  misc_feature 1..20: note = CRISPR gRNA sequence
  source 1..20: mol_type = other DNA
agtgaagccaggtagaagga

SEQ ID NO: 57420 - DNA, 20 bp, synthetic construct
  misc_feature 1..20: note = CRISPR gRNA sequence
  source 1..20: mol_type = other DNA
gtgaagccaggtagaaggag

SEQ ID NO: 57421 - DNA, 20 bp, synthetic construct
  misc_feature 1..20: note = CRISPR gRNA sequence
  source 1..20: mol_type = other DNA
aggtagaaggaggggtcctc

SEQ ID NO: 57422 - DNA, 20 bp, synthetic construct
  misc_feature 1..20: note = CRISPR gRNA sequence
  source 1..20: mol_type = other DNA
ggtagaaggaggggtcctcc

SEQ ID NO: 57423 - DNA, 20 bp, synthetic construct
  misc_feature 1..20: note = CRISPR gRNA sequence
  source 1..20: mol_type = other DNA
aggaggggtcctccaggccc

SEQ ID NO: 57424 - DNA, 20 bp, synthetic construct
  misc_feature 1..20: note = CRISPR gRNA sequence
  source 1..20: mol_type = other DNA
aggggtcctccaggccccag

SEQ ID NO: 57425 - DNA, 20 bp, synthetic construct
  misc_feature 1..20: note = CRISPR gRNA sequence
  source 1..20: mol_type = other DNA
cctccaggccccagcagatt

SEQ ID NO: 57426 - DNA, 20 bp, synthetic construct
  misc_feature 1..20: note = CRISPR gRNA sequence
  source 1..20: mol_type = other DNA
ctccaggccccagcagattt

SEQ ID NO: 57427 - DNA, 20 bp, synthetic construct
  misc_feature 1..20: note = CRISPR gRNA sequence
  source 1..20: mol_type = other DNA
cccagcagatttgggcgcat

SEQ ID NO: 57428 - DNA, 20 bp, synthetic construct
  misc_feature 1..20: note = CRISPR gRNA sequence
  source 1..20: mol_type = other DNA
ccagcagatttgggcgcatt

SEQ ID NO: 57429 - DNA, 20 bp, synthetic construct
  misc_feature 1..20: note = CRISPR gRNA sequence
  source 1..20: mol_type = other DNA
gcgcattaggaaatttgttc

SEQ ID NO: 57430 - DNA, 20 bp, synthetic construct
  misc_feature 1..20: note = CRISPR gRNA sequence
  source 1..20: mol_type = other DNA
cgcattaggaaatttgttct

SEQ ID NO: 57431 - DNA, 20 bp, synthetic construct
  misc_feature 1..20: note = CRISPR gRNA sequence
  source 1..20: mol_type = other DNA
attaggaaatttgttctggg

SEQ ID NO: 57432 - DNA, 20 bp, synthetic construct
  misc_feature 1..20: note = CRISPR gRNA sequence
  source 1..20: mol_type = other DNA
aatttgttctgggaagtgtc

SEQ ID NO: 57433 - DNA, 20 bp, synthetic construct
  misc_feature 1..20: note = CRISPR gRNA sequence
  source 1..20: mol_type = other DNA
ctgggaagtgtccagaaata

SEQ ID NO: 57434 - DNA, 20 bp, synthetic construct
  misc_feature 1..20: note = CRISPR gRNA sequence
  source 1..20: mol_type = other DNA
gggaagtgtccagaaatata

SEQ ID NO: 57435 - DNA, 20 bp, synthetic construct
  misc_feature 1..20: note = CRISPR gRNA sequence
  source 1..20: mol_type = other DNA
gtgtccagaaatatagagtt

SEQ ID NO: 57436 - DNA, 20 bp, synthetic construct
  misc_feature 1..20: note = CRISPR gRNA sequence
  source 1..20: mol_type = other DNA
gaaatatagagttgagatcg

SEQ ID NO: 57437 - DNA, 20 bp, synthetic construct
  misc_feature 1..20: note = CRISPR gRNA sequence
  source 1..20: mol_type = other DNA
tatagagttgagatcgtggc

SEQ ID NO: 57438 - DNA, 20 bp, synthetic construct
  misc_feature 1..20: note = CRISPR gRNA sequence
  source 1..20: mol_type = other DNA
atagagttgagatcgtggct

SEQ ID NO: 57439 - DNA, 20 bp, synthetic construct
  misc_feature 1..20: note = CRISPR gRNA sequence
  source 1..20: mol_type = other DNA
gctacaccctctctctgact

SEQ ID NO: 57440 - DNA, 20 bp, synthetic construct
  misc_feature 1..20: note = CRISPR gRNA sequence
  source 1..20: mol_type = other DNA
ctacaccctctctctgactt

SEQ ID NO: 57441 - DNA, 20 bp, synthetic construct
  misc_feature 1..20: note = CRISPR gRNA sequence
  source 1..20: mol_type = other DNA
caccctctctctgacttagg

SEQ ID NO: 57442 - DNA, 20 bp, synthetic construct
  misc_feature 1..20: note = CRISPR gRNA sequence
  source 1..20: mol_type = other DNA
accctctctctgacttaggt

SEQ ID NO: 57443 - DNA, 20 bp, synthetic construct
  misc_feature 1..20: note = CRISPR gRNA sequence
  source 1..20: mol_type = other DNA
ctctgacttaggtgggtccc

SEQ ID NO: 57444 - DNA, 20 bp, synthetic construct
  misc_feature 1..20: note = CRISPR gRNA sequence
  source 1..20: mol_type = other DNA
tctgacttaggtgggtccct

SEQ ID NO: 57445 - DNA, 20 bp, synthetic construct
  misc_feature 1..20: note = CRISPR gRNA sequence
  source 1..20: mol_type = other DNA
gtgggtccctgggctcctcc

SEQ ID NO: 57446 - DNA, 20 bp, synthetic construct
  misc_feature 1..20: note = CRISPR gRNA sequence
  source 1..20: mol_type = other DNA
cctcccggctccccatgacg

SEQ ID NO: 57447 - DNA, 20 bp, synthetic construct
  misc_feature 1..20: note = CRISPR gRNA sequence
  source 1..20: mol_type = other DNA
ctcccggctccccatgacgc

SEQ ID NO: 57448 - DNA, 20 bp, synthetic construct
  misc_feature 1..20: note = CRISPR gRNA sequence
  source 1..20: mol_type = other DNA
gctccccatgacgcaggtac

SEQ ID NO: 57449 - DNA, 20 bp, synthetic construct
  misc_feature 1..20: note = CRISPR gRNA sequence
  source 1..20: mol_type = other DNA
ccatgacgcaggtactggcc

SEQ ID NO: 57450 - DNA, 20 bp, synthetic construct
  misc_feature 1..20: note = CRISPR gRNA sequence
  source 1..20: mol_type = other DNA
acctgcccttaccatcatca

SEQ ID NO: 57451 - DNA, 20 bp, synthetic construct
  misc_feature 1..20: note = CRISPR gRNA sequence
  source 1..20: mol_type = other DNA
cttaccatcatcatagccaa

SEQ ID NO: 57452 - DNA, 20 bp, synthetic construct
  misc_feature 1..20: note = CRISPR gRNA sequence
  source 1..20: mol_type = other DNA
tcatcatagccaaaagtact

SEQ ID NO: 57453 - DNA, 20 bp, synthetic construct
  misc_feature 1..20: note = CRISPR gRNA sequence
  source 1..20: mol_type = other DNA
tcatagccaaaagtactcag

SEQ ID NO: 57454 - DNA, 20 bp, synthetic construct
  misc_feature 1..20: note = CRISPR gRNA sequence
  source 1..20: mol_type = other DNA
tagccaaaagtactcagcag

SEQ ID NO: 57455 - DNA, 20 bp, synthetic construct
  misc_feature 1..20: note = CRISPR gRNA sequence
  source 1..20: mol_type = other DNA
gtactcagcagcagcacctc

SEQ ID NO: 57456 - DNA, 20 bp, synthetic construct
  misc_feature 1..20: note = CRISPR gRNA sequence
  source 1..20: mol_type = other DNA
tactcagcagcagcacctcc

SEQ ID NO: 57457 - DNA, 20 bp, synthetic construct
  misc_feature 1..20: note = CRISPR gRNA sequence
  source 1..20: mol_type = other DNA
agcagcagcacctccaggtc

SEQ ID NO: 57458 - DNA, 20 bp, synthetic construct
  misc_feature 1..20: note = CRISPR gRNA sequence
  source 1..20: mol_type = other DNA
cagcagcacctccaggtcca

SEQ ID NO: 57459 - DNA, 20 bp, synthetic construct
  misc_feature 1..20: note = CRISPR gRNA sequence
  source 1..20: mol_type = other DNA
agcagcacctccaggtccag

SEQ ID NO: 57460 - DNA, 20 bp, synthetic construct
  misc_feature 1..20: note = CRISPR gRNA sequence
  source 1..20: mol_type = other DNA
tccaggtccagaggcacctc

SEQ ID NO: 57461 - DNA, 20 bp, synthetic construct
  misc_feature 1..20: note = CRISPR gRNA sequence
  source 1..20: mol_type = other DNA
catgcacacacaatgaatga

SEQ ID NO: 57462 - DNA, 20 bp, synthetic construct
  misc_feature 1..20: note = CRISPR gRNA sequence
  source 1..20: mol_type = other DNA
cacaatgaatgaaagactgc

SEQ ID NO: 57463 - DNA, 20 bp, synthetic construct
  misc_feature 1..20: note = CRISPR gRNA sequence
  source 1..20: mol_type = other DNA
acaatgaatgaaagactgcc

SEQ ID NO: 57464 - DNA, 20 bp, synthetic construct
  misc_feature 1..20: note = CRISPR gRNA sequence
  source 1..20: mol_type = other DNA
actgccaggtgtccgaaccc

SEQ ID NO: 57465 - DNA, 20 bp, synthetic construct
  misc_feature 1..20: note = CRISPR gRNA sequence
  source 1..20: mol_type = other DNA
gtgtccgaaccctggacatg

SEQ ID NO: 57466 - DNA, 20 bp, synthetic construct
  misc_feature 1..20: note = CRISPR gRNA sequence
  source 1..20: mol_type = other DNA
ccctggacatgcagcttgtt

SEQ ID NO: 57467 - DNA, 20 bp, synthetic construct
  misc_feature 1..20: note = CRISPR gRNA sequence
  source 1..20: mol_type = other DNA
acatgcagcttgttgagttg

SEQ ID NO: 57468 - DNA, 20 bp, synthetic construct
  misc_feature 1..20: note = CRISPR gRNA sequence
  source 1..20: mol_type = other DNA
catgcagcttgttgagttgc

SEQ ID NO: 57469 - DNA, 20 bp, synthetic construct
  misc_feature 1..20: note = CRISPR gRNA sequence
  source 1..20: mol_type = other DNA
ttgcaggatgactctctgtt

SEQ ID NO: 57470 - DNA, 20 bp, synthetic construct
  misc_feature 1..20: note = CRISPR gRNA sequence
  source 1..20: mol_type = other DNA
tgcaggatgactctctgttc

SEQ ID NO: 57471 - DNA, 20 bp, synthetic construct
  misc_feature 1..20: note = CRISPR gRNA sequence
  source 1..20: mol_type = other DNA
gcaggatgactctctgttca

SEQ ID NO: 57472 - DNA, 20 bp, synthetic construct
  misc_feature 1..20: note = CRISPR gRNA sequence
  source 1..20: mol_type = other DNA
tgactctctgttcagggtcc

SEQ ID NO: 57473 - DNA, 20 bp, synthetic construct
  misc_feature 1..20: note = CRISPR gRNA sequence
  source 1..20: mol_type = other DNA
gactctctgttcagggtcca

SEQ ID NO: 57474 - DNA, 20 bp, synthetic construct
  misc_feature 1..20: note = CRISPR gRNA sequence
  source 1..20: mol_type = other DNA
agggtccaaggtctcgttcc

SEQ ID NO: 57475 - DNA, 20 bp, synthetic construct
  misc_feature 1..20: note = CRISPR gRNA sequence
  source 1..20: mol_type = other DNA
aaggtctcgttcctggaatc

SEQ ID NO: 57476 - DNA, 20 bp, synthetic construct
  misc_feature 1..20: note = CRISPR gRNA sequence
  source 1..20: mol_type = other DNA
aggtctcgttcctggaatcc

SEQ ID NO: 57477 - DNA, 20 bp, synthetic construct
  misc_feature 1..20: note = CRISPR gRNA sequence
  source 1..20: mol_type = other DNA
cctggaatccaggtccgtgt

SEQ ID NO: 57478 - DNA, 20 bp, synthetic construct
  misc_feature 1..20: note = CRISPR gRNA sequence
  source 1..20: mol_type = other DNA
ctggaatccaggtccgtgtt

SEQ ID NO: 57479 - DNA, 20 bp, synthetic construct
  misc_feature 1..20: note = CRISPR gRNA sequence
  source 1..20: mol_type = other DNA
tggaatccaggtccgtgttg

SEQ ID NO: 57480 - DNA, 20 bp, synthetic construct
  misc_feature 1..20: note = CRISPR gRNA sequence
  source 1..20: mol_type = other DNA
gaatccaggtccgtgttggg

SEQ ID NO: 57481 - DNA, 20 bp, synthetic construct
  misc_feature 1..20: note = CRISPR gRNA sequence
  source 1..20: mol_type = other DNA
aatccaggtccgtgttgggg

SEQ ID NO: 57482 - DNA, 20 bp, synthetic construct
  misc_feature 1..20: note = CRISPR gRNA sequence
  source 1..20: mol_type = other DNA
ccaggtccgtgttggggagg

SEQ ID NO: 57483 - DNA, 20 bp, synthetic construct
  misc_feature 1..20: note = CRISPR gRNA sequence
  source 1..20: mol_type = other DNA
ggggaggaagaacttcatct

SEQ ID NO: 57484 - DNA, 20 bp, synthetic construct
  misc_feature 1..20: note = CRISPR gRNA sequence
  source 1..20: mol_type = other DNA
aagaacttcatcttggcgtt

SEQ ID NO: 57485 - DNA, 20 bp, synthetic construct
  misc_feature 1..20: note = CRISPR gRNA sequence
  source 1..20: mol_type = other DNA
atcttggcgttcagccattc

SEQ ID NO: 57486 - DNA, 20 bp, synthetic construct
  misc_feature 1..20: note = CRISPR gRNA sequence
  source 1..20: mol_type = other DNA
tcttggcgttcagccattct

SEQ ID NO: 57487 - DNA, 20 bp, synthetic construct
  misc_feature 1..20: note = CRISPR gRNA sequence
  source 1..20: mol_type = other DNA
gttcagccattctgggtctt

SEQ ID NO: 57488 - DNA, 20 bp, synthetic construct
  misc_feature 1..20: note = CRISPR gRNA sequence
  source 1..20: mol_type = other DNA
agccattctgggtctttggt

SEQ ID NO: 57489 - DNA, 20 bp, synthetic construct
  misc_feature 1..20: note = CRISPR gRNA sequence
  source 1..20: mol_type = other DNA
cattctgggtctttggtgag

SEQ ID NO: 57490 - DNA, 20 bp, synthetic construct
  misc_feature 1..20: note = CRISPR gRNA sequence
  source 1..20: mol_type = other DNA
tctttggtgagcagcctcac

SEQ ID NO: 57491 - DNA, 20 bp, synthetic construct
  misc_feature 1..20: note = CRISPR gRNA sequence
  source 1..20: mol_type = other DNA
tggtgagcagcctcacaaga

SEQ ID NO: 57492 - DNA, 20 bp, synthetic construct
  misc_feature 1..20: note = CRISPR gRNA sequence
  source 1..20: mol_type = other DNA
agcctcacaagacagctcca

SEQ ID NO: 57493 - DNA, 20 bp, synthetic construct
  misc_feature 1..20: note = CRISPR gRNA sequence
  source 1..20: mol_type = other DNA
gcctcacaagacagctccac

SEQ ID NO: 57494 - DNA, 20 bp, synthetic construct
  misc_feature 1..20: note = CRISPR gRNA sequence
  source 1..20: mol_type = other DNA
ctccacaggttcttgttgcc

SEQ ID NO: 57495 - DNA, 20 bp, synthetic construct
  misc_feature 1..20: note = CRISPR gRNA sequence
  source 1..20: mol_type = other DNA
acaggttcttgttgccgagc

SEQ ID NO: 57496 - DNA, 20 bp, synthetic construct
  misc_feature 1..20: note = CRISPR gRNA sequence
  source 1..20: mol_type = other DNA
aggttcttgttgccgagctg

SEQ ID NO: 57497 - DNA, 20 bp, synthetic construct
  misc_feature 1..20: note = CRISPR gRNA sequence
  source 1..20: mol_type = other DNA
ggttcttgttgccgagctgg

SEQ ID NO: 57498 - DNA, 20 bp, synthetic construct
  misc_feature 1..20: note = CRISPR gRNA sequence
  source 1..20: mol_type = other DNA
gttgccgagctggaggccaa

SEQ ID NO: 57499 - DNA, 20 bp, synthetic construct
  misc_feature 1..20: note = CRISPR gRNA sequence
  source 1..20: mol_type = other DNA
ttgccgagctggaggccaac

SEQ ID NO: 57500 - DNA, 20 bp, synthetic construct
  misc_feature 1..20: note = CRISPR gRNA sequence
  source 1..20: mol_type = other DNA
tgccgagctggaggccaacg

SEQ ID NO: 57501 - DNA, 20 bp, synthetic construct
  misc_feature 1..20: note = CRISPR gRNA sequence
  source 1..20: mol_type = other DNA
tggaggccaacggggtccat

SEQ ID NO: 57502 - DNA, 20 bp, synthetic construct
  misc_feature 1..20: note = CRISPR gRNA sequence
  source 1..20: mol_type = other DNA
ggaggccaacggggtccatg

SEQ ID NO: 57503 - DNA, 20 bp, synthetic construct
  misc_feature 1..20: note = CRISPR gRNA sequence
  source 1..20: mol_type = other DNA
aggccaacggggtccatgag

SEQ ID NO: 57504 - DNA, 20 bp, synthetic construct
  misc_feature 1..20: note = CRISPR gRNA sequence
  source 1..20: mol_type = other DNA
caacggggtccatgaggagc

SEQ ID NO: 57505 - DNA, 20 bp, synthetic construct
  misc_feature 1..20: note = CRISPR gRNA sequence
  source 1..20: mol_type = other DNA
ggtccatgaggagccagccc

SEQ ID NO: 57506 - DNA, 20 bp, synthetic construct
  misc_feature 1..20: note = CRISPR gRNA sequence
  source 1..20: mol_type = other DNA
tccatgaggagccagccctg

SEQ ID NO: 57507 - DNA, 20 bp, synthetic construct
  misc_feature 1..20: note = CRISPR gRNA sequence
  source 1..20: mol_type = other DNA
ccatgaggagccagccctgg

SEQ ID NO: 57508 - DNA, 20 bp, synthetic construct
  misc_feature 1..20: note = CRISPR gRNA sequence
  source 1..20: mol_type = other DNA
catgaggagccagccctgga

SEQ ID NO: 57509 - DNA, 20 bp, synthetic construct
  misc_feature 1..20: note = CRISPR gRNA sequence
  source 1..20: mol_type = other DNA
aggagccagccctggaggga

SEQ ID NO: 57510 - DNA, 20 bp, synthetic construct
  misc_feature 1..20: note = CRISPR gRNA sequence
  source 1..20: mol_type = other DNA
ggagccagccctggagggac

SEQ ID NO: 57511 - DNA, 20 bp, synthetic construct
  misc_feature 1..20: note = CRISPR gRNA sequence
  source 1..20: mol_type = other DNA
gagccagccctggagggaca

SEQ ID NO: 57512 - DNA, 20 bp, synthetic construct
  misc_feature 1..20: note = CRISPR gRNA sequence
  source 1..20: mol_type = other DNA
ccagccctggagggacaggg

SEQ ID NO: 57513 - DNA, 20 bp, synthetic construct
  misc_feature 1..20: note = CRISPR gRNA sequence
  source 1..20: mol_type = other DNA
ccctggagggacagggaaga

SEQ ID NO: 57514 - DNA, 20 bp, synthetic construct
  misc_feature 1..20: note = CRISPR gRNA sequence
  source 1..20: mol_type = other DNA
cctggagggacagggaagat

SEQ ID NO: 57515 - DNA, 20 bp, synthetic construct
  misc_feature 1..20: note = CRISPR gRNA sequence
  source 1..20: mol_type = other DNA
gagggacagggaagataggt

SEQ ID NO: 57516 - DNA, 20 bp, synthetic construct
  misc_feature 1..20: note = CRISPR gRNA sequence
  source 1..20: mol_type = other DNA
acagggaagataggtgagtt

SEQ ID NO: 57517 - DNA, 20 bp, synthetic construct
  misc_feature 1..20: note = CRISPR gRNA sequence
  source 1..20: mol_type = other DNA
cagggaagataggtgagttg

SEQ ID NO: 57518 - DNA, 20 bp, synthetic construct
  misc_feature 1..20: note = CRISPR gRNA sequence
  source 1..20: mol_type = other DNA
agggaagataggtgagttga

SEQ ID NO: 57519 - DNA, 20 bp, synthetic construct
  misc_feature 1..20: note = CRISPR gRNA sequence
  source 1..20: mol_type = other DNA
gggaagataggtgagttgag

SEQ ID NO: 57520 - DNA, 20 bp, synthetic construct
  misc_feature 1..20: note = CRISPR gRNA sequence
  source 1..20: mol_type = other DNA
ggaagataggtgagttgagg

SEQ ID NO: 57521 - DNA, 20 bp, synthetic construct
  misc_feature 1..20: note = CRISPR gRNA sequence
  source 1..20: mol_type = other DNA
gataggtgagttgaggggga

SEQ ID NO: 57522 - DNA, 20 bp, synthetic construct
  misc_feature 1..20: note = CRISPR gRNA sequence
  source 1..20: mol_type = other DNA
ataggtgagttgagggggac

SEQ ID NO: 57523 - DNA, 20 bp, synthetic construct
  misc_feature 1..20: note = CRISPR gRNA sequence
  source 1..20: mol_type = other DNA
gttgagggggacaggtaaac

SEQ ID NO: 57524 - DNA, 20 bp, synthetic construct
  misc_feature 1..20: note = CRISPR gRNA sequence
  source 1..20: mol_type = other DNA
ttgagggggacaggtaaact

SEQ ID NO: 57525 - DNA, 20 bp, synthetic construct
  misc_feature 1..20: note = CRISPR gRNA sequence
  source 1..20: mol_type = other DNA
tgagggggacaggtaaactg

SEQ ID NO: 57526 - DNA, 20 bp, synthetic construct
  misc_feature 1..20: note = CRISPR gRNA sequence
  source 1..20: mol_type = other DNA
gagggggacaggtaaactgg

SEQ ID NO: 57527 - DNA, 20 bp, synthetic construct
  misc_feature 1..20: note = CRISPR gRNA sequence
  source 1..20: mol_type = other DNA
ggggacaggtaaactggggg

SEQ ID NO: 57528 - DNA, 20 bp, synthetic construct
  misc_feature 1..20: note = CRISPR gRNA sequence
  source 1..20: mol_type = other DNA
caggtaaactgggggcagat

SEQ ID NO: 57529 - DNA, 20 bp, synthetic construct
  misc_feature 1..20: note = CRISPR gRNA sequence
  source 1..20: mol_type = other DNA
aaactgggggcagatgagct

SEQ ID NO: 57530 - DNA, 20 bp, synthetic construct
  misc_feature 1..20: note = CRISPR gRNA sequence
  source 1..20: mol_type = other DNA
aactgggggcagatgagctg

SEQ ID NO: 57531 - DNA, 20 bp, synthetic construct
  misc_feature 1..20: note = CRISPR gRNA sequence
  source 1..20: mol_type = other DNA
actgggggcagatgagctga

SEQ ID NO: 57532 - DNA, 20 bp, synthetic construct
  misc_feature 1..20: note = CRISPR gRNA sequence
  source 1..20: mol_type = other DNA
ggggcagatgagctgaggga

SEQ ID NO: 57533 - DNA, 20 bp, synthetic construct
  misc_feature 1..20: note = CRISPR gRNA sequence
  source 1..20: mol_type = other DNA
gggcagatgagctgagggac

SEQ ID NO: 57534 - DNA, 20 bp, synthetic construct
  misc_feature 1..20: note = CRISPR gRNA sequence
  source 1..20: mol_type = other DNA
ggcagatgagctgagggaca

SEQ ID NO: 57535 - DNA, 20 bp, synthetic construct
  misc_feature 1..20: note = CRISPR gRNA sequence
  source 1..20: mol_type = other DNA
gcagatgagctgagggacag

SEQ ID NO: 57536 - DNA, 20 bp, synthetic construct
  misc_feature 1..20: note = CRISPR gRNA sequence
  source 1..20: mol_type = other DNA
agctgagggacaggggaact

SEQ ID NO: 57537 - DNA, 20 bp, synthetic construct
  misc_feature 1..20: note = CRISPR gRNA sequence
  source 1..20: mol_type = other DNA
gctgagggacaggggaactt

SEQ ID NO: 57538 - DNA, 20 bp, synthetic construct
  misc_feature 1..20: note = CRISPR gRNA sequence
  source 1..20: mol_type = other DNA
ctgagggacaggggaacttg

SEQ ID NO: 57539 - DNA, 20 bp, synthetic construct
  misc_feature 1..20: note = CRISPR gRNA sequence
  source 1..20: mol_type = other DNA
tgagggacaggggaacttgg

SEQ ID NO: 57540 - DNA, 20 bp, synthetic construct
  misc_feature 1..20: note = CRISPR gRNA sequence
  source 1..20: mol_type = other DNA
gagggacaggggaacttggg

SEQ ID NO: 57541 - DNA, 20 bp, synthetic construct
  misc_feature 1..20: note = CRISPR gRNA sequence
  source 1..20: mol_type = other DNA
gggacaggggaacttggggg

SEQ ID NO: 57542 - DNA, 20 bp, synthetic construct
  misc_feature 1..20: note = CRISPR gRNA sequence
  source 1..20: mol_type = other DNA
aggggaacttggggggagtt

SEQ ID NO: 57543 - DNA, 20 bp, synthetic construct
  misc_feature 1..20: note = CRISPR gRNA sequence
  source 1..20: mol_type = other DNA
gaacttggggggagttgagc

SEQ ID NO: 57544 - DNA, 20 bp, synthetic construct
  misc_feature 1..20: note = CRISPR gRNA sequence
  source 1..20: mol_type = other DNA
aacttggggggagttgagct

SEQ ID NO: 57545 - DNA, 20 bp, synthetic construct
  misc_feature 1..20: note = CRISPR gRNA sequence
  source 1..20: mol_type = other DNA
acttggggggagttgagctg

SEQ ID NO: 57546 - DNA, 20 bp, synthetic construct
  misc_feature 1..20: note = CRISPR gRNA sequence
  source 1..20: mol_type = other DNA
cttggggggagttgagctgg

SEQ ID NO: 57547 - DNA, 20 bp, synthetic construct
  misc_feature 1..20: note = CRISPR gRNA sequence
  source 1..20: mol_type = other DNA
gggggagttgagctggggga

SEQ ID NO: 57548 - DNA, 20 bp, synthetic construct
  misc_feature 1..20: note = CRISPR gRNA sequence
  source 1..20: mol_type = other DNA
ggggagttgagctgggggac

SEQ ID NO: 57549 - DNA, 20 bp, synthetic construct
  misc_feature 1..20: note = CRISPR gRNA sequence
  source 1..20: mol_type = other DNA
gagctgggggacaggcaaac

SEQ ID NO: 57550 - DNA, 20 bp, synthetic construct
  misc_feature 1..20: note = CRISPR gRNA sequence
  source 1..20: mol_type = other DNA
agctgggggacaggcaaact

SEQ ID NO: 57551 - DNA, 20 bp, synthetic construct
  misc_feature 1..20: note = CRISPR gRNA sequence
  source 1..20: mol_type = other DNA
gctgggggacaggcaaactg

SEQ ID NO: 57552 - DNA, 20 bp, synthetic construct
  misc_feature 1..20: note = CRISPR gRNA sequence
  source 1..20: mol_type = other DNA
ctgggggacaggcaaactgg

SEQ ID NO: 57553 - DNA, 20 bp, synthetic construct
  misc_feature 1..20: note = CRISPR gRNA sequence
  source 1..20: mol_type = other DNA
tgggggacaggcaaactggg

SEQ ID NO: 57554 - DNA, 20 bp, synthetic construct
  misc_feature 1..20: note = CRISPR gRNA sequence
  source 1..20: mol_type = other DNA
ggggacaggcaaactggggg

SEQ ID NO: 57555 - DNA, 20 bp, synthetic construct
  misc_feature 1..20: note = CRISPR gRNA sequence
  source 1..20: mol_type = other DNA
gggacaggcaaactgggggg

SEQ ID NO: 57556 - DNA, 20 bp, synthetic construct
  misc_feature 1..20: note = CRISPR gRNA sequence
  source 1..20: mol_type = other DNA
caggcaaactggggggaggt

SEQ ID NO: 57557 - DNA, 20 bp, synthetic construct
  misc_feature 1..20: note = CRISPR gRNA sequence
  source 1..20: mol_type = other DNA
caaactggggggaggtgagc

SEQ ID NO: 57558 - DNA, 20 bp, synthetic construct
  misc_feature 1..20: note = CRISPR gRNA sequence
  source 1..20: mol_type = other DNA
aaactggggggaggtgagct

SEQ ID NO: 57559 - DNA, 20 bp, synthetic construct
  misc_feature 1..20: note = CRISPR gRNA sequence
  source 1..20: mol_type = other DNA
aactggggggaggtgagctg

SEQ ID NO: 57560 - DNA, 20 bp, synthetic construct
  misc_feature 1..20: note = CRISPR gRNA sequence
  source 1..20: mol_type = other DNA
actggggggaggtgagctgg

SEQ ID NO: 57561 - DNA, 20 bp, synthetic construct
  misc_feature 1..20: note = CRISPR gRNA sequence
  source 1..20: mol_type = other DNA
gggggaggtgagctggggga

SEQ ID NO: 57562 - DNA, 20 bp, synthetic construct
  misc_feature 1..20: note = CRISPR gRNA sequence
  source 1..20: mol_type = other DNA
ggggaggtgagctgggggac

SEQ ID NO: 57563 - DNA, 20 bp, synthetic construct
  misc_feature 1..20: note = CRISPR gRNA sequence
  source 1..20: mol_type = other DNA
gagctgggggacaggtaaac

SEQ ID NO: 57564 - DNA, 20 bp, synthetic construct
  misc_feature 1..20: note = CRISPR gRNA sequence
  source 1..20: mol_type = other DNA
agctgggggacaggtaaact

SEQ ID NO: 57565 - DNA, 20 bp, synthetic construct
  misc_feature 1..20: note = CRISPR gRNA sequence
  source 1..20: mol_type = other DNA
gctgggggacaggtaaactg

SEQ ID NO: 57566 - DNA, 20 bp, synthetic construct
  misc_feature 1..20: note = CRISPR gRNA sequence
  source 1..20: mol_type = other DNA
ctgggggacaggtaaactgg

SEQ ID NO: 57567 - DNA, 20 bp, synthetic construct
  misc_feature 1..20: note = CRISPR gRNA sequence
  source 1..20: mol_type = other DNA
tgggggacaggtaaactggg

SEQ ID NO: 57568 - DNA, 20 bp, synthetic construct
  misc_feature 1..20: note = CRISPR gRNA sequence
  source 1..20: mol_type = other DNA
gggggacaggtaaactgggg

SEQ ID NO: 57569 - DNA, 20 bp, synthetic construct
  misc_feature 1..20: note = CRISPR gRNA sequence
  source 1..20: mol_type = other DNA
gggacaggtaaactgggggg

SEQ ID NO: 57570 - DNA, 20 bp, synthetic construct
  misc_feature 1..20: note = CRISPR gRNA sequence
  source 1..20: mol_type = other DNA
ggacaggtaaactggggggg

SEQ ID NO: 57571 - DNA, 20 bp, synthetic construct
  misc_feature 1..20: note = CRISPR gRNA sequence
  source 1..20: mol_type = other DNA
aggtaaactgggggggaggt

SEQ ID NO: 57572 - DNA, 20 bp, synthetic construct
  misc_feature 1..20: note = CRISPR gRNA sequence
  source 1..20: mol_type = other DNA
aaactgggggggaggtgagc

SEQ ID NO: 57573 - DNA, 20 bp, synthetic construct
  misc_feature 1..20: note = CRISPR gRNA sequence
  source 1..20: mol_type = other DNA
aactgggggggaggtgagct

SEQ ID NO: 57574 - DNA, 20 bp, synthetic construct
  misc_feature 1..20: note = CRISPR gRNA sequence
  source 1..20: mol_type = other DNA
actgggggggaggtgagcta

SEQ ID NO: 57575 - DNA, 20 bp, synthetic construct
  misc_feature 1..20: note = CRISPR gRNA sequence
  source 1..20: mol_type = other DNA
ctgggggggaggtgagctag

SEQ ID NO: 57576 - DNA, 20 bp, synthetic construct
  misc_feature 1..20: note = CRISPR gRNA sequence
  source 1..20: mol_type = other DNA
gggggaggtgagctagggga

SEQ ID NO: 57577 - DNA, 20 bp, synthetic construct
  misc_feature 1..20: note = CRISPR gRNA sequence
  source 1..20: mol_type = other DNA
ggggaggtgagctaggggac

SEQ ID NO: 57578 - DNA, 20 bp, synthetic construct
  misc_feature 1..20: note = CRISPR gRNA sequence
  source 1..20: mol_type = other DNA
gagctaggggacaggtaaac

SEQ ID NO: 57579 - DNA, 20 bp, synthetic construct
  misc_feature 1..20: note = CRISPR gRNA sequence
  source 1..20: mol_type = other DNA
agctaggggacaggtaaact

SEQ ID NO: 57580 - DNA, 20 bp, synthetic construct
  misc_feature 1..20: note = CRISPR gRNA sequence
  source 1..20: mol_type = other DNA
gctaggggacaggtaaactg

SEQ ID NO: 57581 - DNA, 20 bp, synthetic construct
  misc_feature 1..20: note = CRISPR gRNA sequence
  source 1..20: mol_type = other DNA
ctaggggacaggtaaactgg

SEQ ID NO: 57582 - DNA, 20 bp, synthetic construct
  misc_feature 1..20: note = CRISPR gRNA sequence
  source 1..20: mol_type = other DNA
ggggacaggtaaactggggg

SEQ ID NO: 57583 - DNA, 20 bp, synthetic construct
  misc_feature 1..20: note = CRISPR gRNA sequence
  source 1..20: mol_type = other DNA
caggtaaactgggggcagat

SEQ ID NO: 57584 - DNA, 20 bp, synthetic construct
  misc_feature 1..20: note = CRISPR gRNA sequence
  source 1..20: mol_type = other DNA
taaactgggggcagatgagc

SEQ ID NO: 57585 - DNA, 20 bp, synthetic construct
  misc_feature 1..20: note = CRISPR gRNA sequence
  source 1..20: mol_type = other DNA
aaactgggggcagatgagct

SEQ ID NO: 57586 - DNA, 20 bp, synthetic construct
  misc_feature 1..20: note = CRISPR gRNA sequence
  source 1..20: mol_type = other DNA
aactgggggcagatgagctg

SEQ ID NO: 57587 - DNA, 20 bp, synthetic construct
  misc_feature 1..20: note = CRISPR gRNA sequence
  source 1..20: mol_type = other DNA
actgggggcagatgagctgg

SEQ ID NO: 57588 - DNA, 20 bp, synthetic construct
  misc_feature 1..20: note = CRISPR gRNA sequence
  source 1..20: mol_type = other DNA
ggggcagatgagctggggga

SEQ ID NO: 57589 - DNA, 20 bp, synthetic construct
  misc_feature 1..20: note = CRISPR gRNA sequence
  source 1..20: mol_type = other DNA
gggcagatgagctgggggac

SEQ ID NO: 57590 - DNA, 20 bp, synthetic construct
  misc_feature 1..20: note = CRISPR gRNA sequence
  source 1..20: mol_type = other DNA
gcagatgagctgggggacag

SEQ ID NO: 57591 - DNA, 20 bp, synthetic construct
  misc_feature 1..20: note = CRISPR gRNA sequence
  source 1..20: mol_type = other DNA
agatgagctgggggacagga

SEQ ID NO: 57592 - DNA, 20 bp, synthetic construct
  misc_feature 1..20: note = CRISPR gRNA sequence
  source 1..20: mol_type = other DNA
agctgggggacaggagagct

SEQ ID NO: 57593 - DNA, 20 bp, synthetic construct
  misc_feature 1..20: note = CRISPR gRNA sequence
  source 1..20: mol_type = other DNA
gctgggggacaggagagctg

SEQ ID NO: 57594 - DNA, 20 bp, synthetic construct
  misc_feature 1..20: note = CRISPR gRNA sequence
  source 1..20: mol_type = other DNA
ctgggggacaggagagctga

SEQ ID NO: 57595 - DNA, 20 bp, synthetic construct
  misc_feature 1..20: note = CRISPR gRNA sequence
  source 1..20: mol_type = other DNA
tgggggacaggagagctgag

SEQ ID NO: 57596 - DNA, 20 bp, synthetic construct
  misc_feature 1..20: note = CRISPR gRNA sequence
  source 1..20: mol_type = other DNA
gggggacaggagagctgagg

SEQ ID NO: 57597 - DNA, 20 bp, synthetic construct
  misc_feature 1..20: note = CRISPR gRNA sequence
  source 1..20: mol_type = other DNA
gggacaggagagctgagggg

SEQ ID NO: 57598 - DNA, 20 bp, synthetic construct
  misc_feature 1..20: note = CRISPR gRNA sequence
  source 1..20: mol_type = other DNA
ggacaggagagctgaggggg

SEQ ID NO: 57599 - DNA, 20 bp, synthetic construct
  misc_feature 1..20: note = CRISPR gRNA sequence
  source 1..20: mol_type = other DNA
aggagagctgagggggaggt

SEQ ID NO: 57600 - DNA, 20 bp, synthetic construct
  misc_feature 1..20: note = CRISPR gRNA sequence
  source 1..20: mol_type = other DNA
gagctgagggggaggtgagc

SEQ ID NO: 57601 - DNA, 20 bp, synthetic construct
  misc_feature 1..20: note = CRISPR gRNA sequence
  source 1..20: mol_type = other DNA
agctgagggggaggtgagct

SEQ ID NO: 57602 - DNA, 20 bp, synthetic construct
  misc_feature 1..20: note = CRISPR gRNA sequence
  source 1..20: mol_type = other DNA
gctgagggggaggtgagctg

SEQ ID NO: 57603 - DNA, 20 bp, synthetic construct
  misc_feature 1..20: note = CRISPR gRNA sequence
  source 1..20: mol_type = other DNA
ctgagggggaggtgagctgg

SEQ ID NO: 57604 - DNA, 20 bp, synthetic construct
  misc_feature 1..20: note = CRISPR gRNA sequence
  source 1..20: mol_type = other DNA
gggggaggtgagctggggga

SEQ ID NO: 57605 - DNA, 20 bp, synthetic construct
  misc_feature 1..20: note = CRISPR gRNA sequence
  source 1..20: mol_type = other DNA
ggggaggtgagctgggggac

SEQ ID NO: 57606 - DNA, 20 bp, synthetic construct
  misc_feature 1..20: note = CRISPR gRNA sequence
  source 1..20: mol_type = other DNA
gggaggtgagctgggggaca

SEQ ID NO: 57607 - DNA, 20 bp, synthetic construct
  misc_feature 1..20: note = CRISPR gRNA sequence
  source 1..20: mol_type = other DNA
ggaggtgagctgggggacag

SEQ ID NO: 57608 - DNA, 20 bp, synthetic construct
  misc_feature 1..20: note = CRISPR gRNA sequence
  source 1..20: mol_type = other DNA
gagctgggggacaggggaac

SEQ ID NO: 57609 - DNA, 20 bp, synthetic construct
  misc_feature 1..20: note = CRISPR gRNA sequence
  source 1..20: mol_type = other DNA
agctgggggacaggggaact

SEQ ID NO: 57610 - DNA, 20 bp, synthetic construct
  misc_feature 1..20: note = CRISPR gRNA sequence
  source 1..20: mol_type = other DNA
gctgggggacaggggaactg

SEQ ID NO: 57611 - DNA, 20 bp, synthetic construct
  misc_feature 1..20: note = CRISPR gRNA sequence
  source 1..20: mol_type = other DNA
ctgggggacaggggaactgg

SEQ ID NO: 57612 - DNA, 20 bp, synthetic construct
  misc_feature 1..20: note = CRISPR gRNA sequence
  source 1..20: mol_type = other DNA
gggacaggggaactggggga

SEQ ID NO: 57613 - DNA, 20 bp, synthetic construct
  misc_feature 1..20: note = CRISPR gRNA sequence
  source 1..20: mol_type = other DNA
ggacaggggaactgggggac

SEQ ID NO: 57614 - DNA, 20 bp, synthetic construct
  misc_feature 1..20: note = CRISPR gRNA sequence
  source 1..20: mol_type = other DNA
gacaggggaactgggggaca

SEQ ID NO: 57615 - DNA, 20 bp, synthetic construct
  misc_feature 1..20: note = CRISPR gRNA sequence
  source 1..20: mol_type = other DNA
acaggggaactgggggacag

SEQ ID NO: 57616 - DNA, 20 bp, synthetic construct
  misc_feature 1..20: note = CRISPR gRNA sequence
  source 1..20: mol_type = other DNA
aggggaactgggggacaggg

SEQ ID NO: 57617 - DNA, 20 bp, synthetic construct
  misc_feature 1..20: note = CRISPR gRNA sequence
  source 1..20: mol_type = other DNA
gaactgggggacaggggagc

SEQ ID NO: 57618 - DNA, 20 bp, synthetic construct
  misc_feature 1..20: note = CRISPR gRNA sequence
  source 1..20: mol_type = other DNA
aactgggggacaggggagct

SEQ ID NO: 57619 - DNA, 20 bp, synthetic construct
  misc_feature 1..20: note = CRISPR gRNA sequence
  source 1..20: mol_type = other DNA
actgggggacaggggagctg

SEQ ID NO: 57620 - DNA, 20 bp, synthetic construct
  misc_feature 1..20: note = CRISPR gRNA sequence
  source 1..20: mol_type = other DNA
gggacaggggagctggggca

SEQ ID NO: 57621 - DNA, 20 bp, synthetic construct
  misc_feature 1..20: note = CRISPR gRNA sequence
  source 1..20: mol_type = other DNA
ggacaggggagctggggcac

SEQ ID NO: 57622 - DNA, 20 bp, synthetic construct
  misc_feature 1..20: note = CRISPR gRNA sequence
  source 1..20: mol_type = other DNA
aggggagctggggcacaggt

SEQ ID NO: 57623 - DNA, 20 bp, synthetic construct
  misc_feature 1..20: note = CRISPR gRNA sequence
  source 1..20: mol_type = other DNA
gagctggggcacaggtgagc

SEQ ID NO: 57624 - DNA, 20 bp, synthetic construct
  misc_feature 1..20: note = CRISPR gRNA sequence
  source 1..20: mol_type = other DNA
agctggggcacaggtgagct

SEQ ID NO: 57625 - DNA, 20 bp, synthetic construct
  misc_feature 1..20: note = CRISPR gRNA sequence
  source 1..20: mol_type = other DNA
gctggggcacaggtgagcta

SEQ ID NO: 57626 - DNA, 20 bp, synthetic construct
  misc_feature 1..20: note = CRISPR gRNA sequence
  source 1..20: mol_type = other DNA
ctggggcacaggtgagctag

SEQ ID NO: 57627 - DNA, 20 bp, synthetic construct
  misc_feature 1..20: note = CRISPR gRNA sequence
  source 1..20: mol_type = other DNA
ggcacaggtgagctagggga

SEQ ID NO: 57628 - DNA, 20 bp, synthetic construct
  misc_feature 1..20: note = CRISPR gRNA sequence
  source 1..20: mol_type = other DNA
gcacaggtgagctaggggac

SEQ ID NO: 57629 - DNA, 20 bp, synthetic construct
  misc_feature 1..20: note = CRISPR gRNA sequence
  source 1..20: mol_type = other DNA
cacaggtgagctaggggaca

SEQ ID NO: 57630 - DNA, 20 bp, synthetic construct
  misc_feature 1..20: note = CRISPR gRNA sequence
  source 1..20: mol_type = other DNA
acaggtgagctaggggacag

SEQ ID NO: 57631 - DNA, 20 bp, synthetic construct
  misc_feature 1..20: note = CRISPR gRNA sequence
  source 1..20: mol_type = other DNA
aggtgagctaggggacaggg

SEQ ID NO: 57632 - DNA, 20 bp, synthetic construct
  misc_feature 1..20: note = CRISPR gRNA sequence
  source 1..20: mol_type = other DNA
gagctaggggacaggggagc

SEQ ID NO: 57633 - DNA, 20 bp, synthetic construct
  misc_feature 1..20: note = CRISPR gRNA sequence
  source 1..20: mol_type = other DNA
agctaggggacaggggagct

SEQ ID NO: 57634 - DNA, 20 bp, synthetic construct
  misc_feature 1..20: note = CRISPR gRNA sequence
  source 1..20: mol_type = other DNA
ctaggggacaggggagctag

SEQ ID NO: 57635 - DNA, 20 bp, synthetic construct
  misc_feature 1..20: note = CRISPR gRNA sequence
  source 1..20: mol_type = other DNA
taggggacaggggagctagg

SEQ ID NO: 57636 - DNA, 20 bp, synthetic construct
  misc_feature 1..20: note = CRISPR gRNA sequence
  source 1..20: mol_type = other DNA
gggacaggggagctaggagg

SEQ ID NO: 57637 - DNA, 20 bp, synthetic construct
  misc_feature 1..20: note = CRISPR gRNA sequence
  source 1..20: mol_type = other DNA
gagctaggaggaagatgaac

SEQ ID NO: 57638 - DNA, 20 bp, synthetic construct
  misc_feature 1..20: note = CRISPR gRNA sequence
  source 1..20: mol_type = other DNA
agctaggaggaagatgaact

SEQ ID NO: 57639 - DNA, 20 bp, synthetic construct
  misc_feature 1..20: note = CRISPR gRNA sequence
  source 1..20: mol_type = other DNA
gctaggaggaagatgaactg

SEQ ID NO: 57640 - DNA, 20 bp, synthetic construct
  misc_feature 1..20: note = CRISPR gRNA sequence
  source 1..20: mol_type = other DNA
ctaggaggaagatgaactgg

SEQ ID NO: 57641 - DNA, 20 bp, synthetic construct
  misc_feature 1..20: note = CRISPR gRNA sequence
  source 1..20: mol_type = other DNA
gaggaagatgaactggggga

SEQ ID NO: 57642 - DNA, 20 bp, synthetic construct
  misc_feature 1..20: note = CRISPR gRNA sequence
  source 1..20: mol_type = other DNA
aggaagatgaactgggggac

SEQ ID NO: 57643 - DNA, 20 bp, synthetic construct
  misc_feature 1..20: note = CRISPR gRNA sequence
  source 1..20: mol_type = other DNA
aactgggggacaggtgaact

SEQ ID NO: 57644 - DNA, 20 bp, synthetic construct
  misc_feature 1..20: note = CRISPR gRNA sequence
  source 1..20: mol_type = other DNA
actgggggacaggtgaactg

SEQ ID NO: 57645 - DNA, 20 bp, synthetic construct
  misc_feature 1..20: note = CRISPR gRNA sequence
  source 1..20: mol_type = other DNA
ctgggggacaggtgaactga

SEQ ID NO: 57646 - DNA, 20 bp, synthetic construct
  misc_feature 1..20: note = CRISPR gRNA sequence
  source 1..20: mol_type = other DNA
ggggacaggtgaactgaggg

SEQ ID NO: 57647 - DNA, 20 bp, synthetic construct
  misc_feature 1..20: note = CRISPR gRNA sequence
  source 1..20: mol_type = other DNA
gggacaggtgaactgagggc

SEQ ID NO: 57648 - DNA, 20 bp, synthetic construct
  misc_feature 1..20: note = CRISPR gRNA sequence
  source 1..20: mol_type = other DNA
acaggtgaactgagggcagg

SEQ ID NO: 57649 - DNA, 20 bp, synthetic construct
  misc_feature 1..20: note = CRISPR gRNA sequence
  source 1..20: mol_type = other DNA
caggtgaactgagggcaggc

SEQ ID NO: 57650 - DNA, 20 bp, synthetic construct
  misc_feature 1..20: note = CRISPR gRNA sequence
  source 1..20: mol_type = other DNA
tgaactgagggcaggcaggt

SEQ ID NO: 57651 - DNA, 20 bp, synthetic construct
  misc_feature 1..20: note = CRISPR gRNA sequence
  source 1..20: mol_type = other DNA
ctgagggcaggcaggtgagc

SEQ ID NO: 57652 - DNA, 20 bp, synthetic construct
  misc_feature 1..20: note = CRISPR gRNA sequence
  source 1..20: mol_type = other DNA
tgagggcaggcaggtgagct

SEQ ID NO: 57653 - DNA, 20 bp, synthetic construct
  misc_feature 1..20: note = CRISPR gRNA sequence
  source 1..20: mol_type = other DNA
gagggcaggcaggtgagctg

SEQ ID NO: 57654 - DNA, 20 bp, synthetic construct
  misc_feature 1..20: note = CRISPR gRNA sequence
  source 1..20: mol_type = other DNA
agggcaggcaggtgagctgg

SEQ ID NO: 57655 - DNA, 20 bp, synthetic construct
  misc_feature 1..20: note = CRISPR gRNA sequence
  source 1..20: mol_type = other DNA
caggcaggtgagctggggga

SEQ ID NO: 57656 - DNA, 20 bp, synthetic construct
  misc_feature 1..20: note = CRISPR gRNA sequence
  source 1..20: mol_type = other DNA
aggcaggtgagctgggggac

SEQ ID NO: 57657 - DNA, 20 bp, synthetic construct
  misc_feature 1..20: note = CRISPR gRNA sequence
  source 1..20: mol_type = other DNA
ggcaggtgagctgggggaca

SEQ ID NO: 57658 - DNA, 20 bp, synthetic construct
  misc_feature 1..20: note = CRISPR gRNA sequence
  source 1..20: mol_type = other DNA
gcaggtgagctgggggacag

SEQ ID NO: 57659 - DNA, 20 bp, synthetic construct
  misc_feature 1..20: note = CRISPR gRNA sequence
  source 1..20: mol_type = other DNA
gagctgggggacaggggaac

SEQ ID NO: 57660 - DNA, 20 bp, synthetic construct
  misc_feature 1..20: note = CRISPR gRNA sequence
  source 1..20: mol_type = other DNA
ctgggggacaggggaactgg

SEQ ID NO: 57661 - DNA, 20 bp, synthetic construct
  misc_feature 1..20: note = CRISPR gRNA sequence
  source 1..20: mol_type = other DNA
tgggggacaggggaactgga

SEQ ID NO: 57662 - DNA, 20 bp, synthetic construct
  misc_feature 1..20: note = CRISPR gRNA sequence
  source 1..20: mol_type = other DNA
gggacaggggaactggaagg

SEQ ID NO: 57663 - DNA, 20 bp, synthetic construct
  misc_feature 1..20: note = CRISPR gRNA sequence
  source 1..20: mol_type = other DNA
aggggaactggaaggaagat

SEQ ID NO: 57664 - DNA, 20 bp, synthetic construct
  misc_feature 1..20: note = CRISPR gRNA sequence
  source 1..20: mol_type = other DNA
gaactggaaggaagatgagc

SEQ ID NO: 57665 - DNA, 20 bp, synthetic construct
  misc_feature 1..20: note = CRISPR gRNA sequence
  source 1..20: mol_type = other DNA
aactggaaggaagatgagct

SEQ ID NO: 57666 - DNA, 20 bp, synthetic construct
  misc_feature 1..20: note = CRISPR gRNA sequence
  source 1..20: mol_type = other DNA
actggaaggaagatgagctg

SEQ ID NO: 57667 - DNA, 20 bp, synthetic construct
  misc_feature 1..20: note = CRISPR gRNA sequence
  source 1..20: mol_type = other DNA
aggaagatgagctggggaac

SEQ ID NO: 57668 - DNA, 20 bp, synthetic construct
  misc_feature 1..20: note = CRISPR gRNA sequence
  source 1..20: mol_type = other DNA
agatgagctggggaaccggt

SEQ ID NO: 57669 - DNA, 20 bp, synthetic construct
  misc_feature 1..20: note = CRISPR gRNA sequence
  source 1..20: mol_type = other DNA
gagctggggaaccggtgagc

SEQ ID NO: 57670 - DNA, 20 bp, synthetic construct
  misc_feature 1..20: note = CRISPR gRNA sequence
  source 1..20: mol_type = other DNA
gctggggaaccggtgagctg

SEQ ID NO: 57671 - DNA, 20 bp, synthetic construct
  misc_feature 1..20: note = CRISPR gRNA sequence
  source 1..20: mol_type = other DNA
ctggggaaccggtgagctgg

SEQ ID NO: 57672 - DNA, 20 bp, synthetic construct
  misc_feature 1..20: note = CRISPR gRNA sequence
  source 1..20: mol_type = other DNA
gaaccggtgagctggaggac

SEQ ID NO: 57673 - DNA, 20 bp, synthetic construct
  misc_feature 1..20: note = CRISPR gRNA sequence
  source 1..20: mol_type = other DNA
gagctggaggacaagcaaat

SEQ ID NO: 57674 - DNA, 20 bp, synthetic construct
  misc_feature 1..20: note = CRISPR gRNA sequence
  source 1..20: mol_type = other DNA
agctggaggacaagcaaatt

SEQ ID NO: 57675 - DNA, 20 bp, synthetic construct
  misc_feature 1..20: note = CRISPR gRNA sequence
  source 1..20: mol_type = other DNA
gctggaggacaagcaaattg

SEQ ID NO: 57676 - DNA, 20 bp, synthetic construct
  misc_feature 1..20: note = CRISPR gRNA sequence
  source 1..20: mol_type = other DNA
ctggaggacaagcaaattgg

SEQ ID NO: 57677 - DNA, 20 bp, synthetic construct
  misc_feature 1..20: note = CRISPR gRNA sequence
  source 1..20: mol_type = other DNA
gaggacaagcaaattggggg

SEQ ID NO: 57678 - DNA, 20 bp, synthetic construct
  misc_feature 1..20: note = CRISPR gRNA sequence
  source 1..20: mol_type = other DNA
aggacaagcaaattgggggc

SEQ ID NO: 57679 - DNA, 20 bp, synthetic construct
  misc_feature 1..20: note = CRISPR gRNA sequence
  source 1..20: mol_type = other DNA
caaattgggggcaggtgatt

SEQ ID NO: 57680 - DNA, 20 bp, synthetic construct
  misc_feature 1..20: note = CRISPR gRNA sequence
  source 1..20: mol_type = other DNA
aaattgggggcaggtgattt

SEQ ID NO: 57681 - DNA, 20 bp, synthetic construct
  misc_feature 1..20: note = CRISPR gRNA sequence
  source 1..20: mol_type = other DNA
aattgggggcaggtgatttg

SEQ ID NO: 57682 - DNA, 20 bp, synthetic construct
  misc_feature 1..20: note = CRISPR gRNA sequence
  source 1..20: mol_type = other DNA
attgggggcaggtgatttgg

SEQ ID NO: 57683 - DNA, 20 bp, synthetic construct
  misc_feature 1..20: note = CRISPR gRNA sequence
  source 1..20: mol_type = other DNA
ggggcaggtgatttggggga

SEQ ID NO: 57684 - DNA, 20 bp, synthetic construct
  misc_feature 1..20: note = CRISPR gRNA sequence
  source 1..20: mol_type = other DNA
gggcaggtgatttgggggac

SEQ ID NO: 57685 - DNA, 20 bp, synthetic construct
  misc_feature 1..20: note = CRISPR gRNA sequence
  source 1..20: mol_type = other DNA
ggcaggtgatttgggggaca

SEQ ID NO: 57686 - DNA, 20 bp, synthetic construct
  misc_feature 1..20: note = CRISPR gRNA sequence
  source 1..20: mol_type = other DNA
gcaggtgatttgggggacag

SEQ ID NO: 57687 - DNA, 20 bp, synthetic construct
  misc_feature 1..20: note = CRISPR gRNA sequence
  source 1..20: mol_type = other DNA
aggtgatttgggggacaggg

SEQ ID NO: 57688 - DNA, 20 bp, synthetic construct
  misc_feature 1..20: note = CRISPR gRNA sequence
  source 1..20: mol_type = other DNA
gatttgggggacaggggagc

SEQ ID NO: 57689 - DNA, 20 bp, synthetic construct
  misc_feature 1..20: note = CRISPR gRNA sequence
  source 1..20: mol_type = other DNA
atttgggggacaggggagct

SEQ ID NO: 57690 - DNA, 20 bp, synthetic construct
  misc_feature 1..20: note = CRISPR gRNA sequence
  source 1..20: mol_type = other DNA
ttgggggacaggggagctgg

SEQ ID NO: 57691 - DNA, 20 bp, synthetic construct
  misc_feature 1..20: note = CRISPR gRNA sequence
  source 1..20: mol_type = other DNA
tgggggacaggggagctggg

SEQ ID NO: 57692 - DNA, 20 bp, synthetic construct
  misc_feature 1..20: note = CRISPR gRNA sequence
  source 1..20: mol_type = other DNA
gggacaggggagctgggagg

SEQ ID NO: 57693 - DNA, 20 bp, synthetic construct
  misc_feature 1..20: note = CRISPR gRNA sequence
  source 1..20: mol_type = other DNA
aggggagctgggaggaagat

SEQ ID NO: 57694 - DNA, 20 bp, synthetic construct
  misc_feature 1..20: note = CRISPR gRNA sequence
  source 1..20: mol_type = other DNA
gagctgggaggaagattaga

SEQ ID NO: 57695 - DNA, 20 bp, synthetic construct
  misc_feature 1..20: note = CRISPR gRNA sequence
  source 1..20: mol_type = other DNA
gctgggaggaagattagatg

SEQ ID NO: 57696 - DNA, 20 bp, synthetic construct
  misc_feature 1..20: note = CRISPR gRNA sequence
  source 1..20: mol_type = other DNA
gaggaagattagatggagaa

SEQ ID NO: 57697 - DNA, 20 bp, synthetic construct
  misc_feature 1..20: note = CRISPR gRNA sequence
  source 1..20: mol_type = other DNA
aggaagattagatggagaac

SEQ ID NO: 57698 - DNA, 20 bp, synthetic construct
  misc_feature 1..20: note = CRISPR gRNA sequence
  source 1..20: mol_type = other DNA
agattagatggagaacaggt

SEQ ID NO: 57699 - DNA, 20 bp, synthetic construct
  misc_feature 1..20: note = CRISPR gRNA sequence
  source 1..20: mol_type = other DNA
gatggagaacaggtgagttg

SEQ ID NO: 57700 - DNA, 20 bp, synthetic construct
  misc_feature 1..20: note = CRISPR gRNA sequence
  source 1..20: mol_type = other DNA
atggagaacaggtgagttgt

SEQ ID NO: 57701 - DNA, 20 bp, synthetic construct
  misc_feature 1..20: note = CRISPR gRNA sequence
  source 1..20: mol_type = other DNA
tggagaacaggtgagttgtg

SEQ ID NO: 57702 - DNA, 20 bp, synthetic construct
  misc_feature 1..20: note = CRISPR gRNA sequence
  source 1..20: mol_type = other DNA
agaacaggtgagttgtgggg

SEQ ID NO: 57703 - DNA, 20 bp, synthetic construct
  misc_feature 1..20: note = CRISPR gRNA sequence
  source 1..20: mol_type = other DNA
gaacaggtgagttgtggggc

SEQ ID NO: 57704 - DNA, 20 bp, synthetic construct
  misc_feature 1..20: note = CRISPR gRNA sequence
  source 1..20: mol_type = other DNA
agttgtggggcaggtgacct

SEQ ID NO: 57705 - DNA, 20 bp, synthetic construct
  misc_feature 1..20: note = CRISPR gRNA sequence
  source 1..20: mol_type = other DNA
gttgtggggcaggtgacctg

SEQ ID NO: 57706 - DNA, 20 bp, synthetic construct
  misc_feature 1..20: note = CRISPR gRNA sequence
  source 1..20: mol_type = other DNA
ttgtggggcaggtgacctga

SEQ ID NO: 57707 - DNA, 20 bp, synthetic construct
  misc_feature 1..20: note = CRISPR gRNA sequence
  source 1..20: mol_type = other DNA
tggggcaggtgacctgaggg

SEQ ID NO: 57708 - DNA, 20 bp, synthetic construct
  misc_feature 1..20: note = CRISPR gRNA sequence
  source 1..20: mol_type = other DNA
ggggcaggtgacctgagggc

SEQ ID NO: 57709 - DNA, 20 bp, synthetic construct
  misc_feature 1..20: note = CRISPR gRNA sequence
  source 1..20: mol_type = other DNA
caggtgacctgagggcaggt

SEQ ID NO: 57710 - DNA, 20 bp, synthetic construct
  misc_feature 1..20: note = CRISPR gRNA sequence
  source 1..20: mol_type = other DNA
gtgacctgagggcaggtgag

SEQ ID NO: 57711 - DNA, 20 bp, synthetic construct
  misc_feature 1..20: note = CRISPR gRNA sequence
  source 1..20: mol_type = other DNA
tgacctgagggcaggtgagt

SEQ ID NO: 57712 - DNA, 20 bp, synthetic construct
  misc_feature 1..20: note = CRISPR gRNA sequence
  source 1..20: mol_type = other DNA
gacctgagggcaggtgagtg

SEQ ID NO: 57713 - DNA, 20 bp, synthetic construct
  misc_feature 1..20: note = CRISPR gRNA sequence
  source 1..20: mol_type = other DNA
gagggcaggtgagtggggta

SEQ ID NO: 57714 - DNA, 20 bp, synthetic construct
  misc_feature 1..20: note = CRISPR gRNA sequence
  source 1..20: mol_type = other DNA
tgagtggggtacagatgaac

SEQ ID NO: 57715 - DNA, 20 bp, synthetic construct
  misc_feature 1..20: note = CRISPR gRNA sequence
  source 1..20: mol_type = other DNA
gagtggggtacagatgaact

SEQ ID NO: 57716 - DNA, 20 bp, synthetic construct
  misc_feature 1..20: note = CRISPR gRNA sequence
  source 1..20: mol_type = other DNA
agtggggtacagatgaacta

SEQ ID NO: 57717 - DNA, 20 bp, synthetic construct
  misc_feature 1..20: note = CRISPR gRNA sequence
  source 1..20: mol_type = other DNA
gtggggtacagatgaactag

SEQ ID NO: 57718 - DNA, 20 bp, synthetic construct
  misc_feature 1..20: note = CRISPR gRNA sequence
  source 1..20: mol_type = other DNA
tggggtacagatgaactagg

SEQ ID NO: 57719 - DNA, 20 bp, synthetic construct
  misc_feature 1..20: note = CRISPR gRNA sequence
  source 1..20: mol_type = other DNA
ggtacagatgaactaggggg

SEQ ID NO: 57720 - DNA, 20 bp, synthetic construct
  misc_feature 1..20: note = CRISPR gRNA sequence
  source 1..20: mol_type = other DNA
gtacagatgaactaggggga

SEQ ID NO: 57721 - DNA, 20 bp, synthetic construct
  misc_feature 1..20: note = CRISPR gRNA sequence
  source 1..20: mol_type = other DNA
gaactagggggaaggtgatc

SEQ ID NO: 57722 - DNA, 20 bp, synthetic construct
  misc_feature 1..20: note = CRISPR gRNA sequence
  source 1..20: mol_type = other DNA
aactagggggaaggtgatct

SEQ ID NO: 57723 - DNA, 20 bp, synthetic construct
  misc_feature 1..20: note = CRISPR gRNA sequence
  source 1..20: mol_type = other DNA
actagggggaaggtgatctg

SEQ ID NO: 57724 - DNA, 20 bp, synthetic construct
  misc_feature 1..20: note = CRISPR gRNA sequence
  source 1..20: mol_type = other DNA
agggggaaggtgatctgggg

SEQ ID NO: 57725 - DNA, 20 bp, synthetic construct
  misc_feature 1..20: note = CRISPR gRNA sequence
  source 1..20: mol_type = other DNA
gggggaaggtgatctgggga

SEQ ID NO: 57726 - DNA, 20 bp, synthetic construct
  misc_feature 1..20: note = CRISPR gRNA sequence
  source 1..20: mol_type = other DNA
gaaggtgatctggggaaggt

SEQ ID NO: 57727 - DNA, 20 bp, synthetic construct
  misc_feature 1..20: note = CRISPR gRNA sequence
  source 1..20: mol_type = other DNA
gtgatctggggaaggtgagt

SEQ ID NO: 57728 - DNA, 20 bp, synthetic construct
  misc_feature 1..20: note = CRISPR gRNA sequence
  source 1..20: mol_type = other DNA
tgatctggggaaggtgagtt

SEQ ID NO: 57729 - DNA, 20 bp, synthetic construct
  misc_feature 1..20: note = CRISPR gRNA sequence
  source 1..20: mol_type = other DNA
gatctggggaaggtgagttg

SEQ ID NO: 57730 - DNA, 20 bp, synthetic construct
  misc_feature 1..20: note = CRISPR gRNA sequence
  source 1..20: mol_type = other DNA
atctggggaaggtgagttgg

SEQ ID NO: 57731 - DNA, 20 bp, synthetic construct
  misc_feature 1..20: note = CRISPR gRNA sequence
  source 1..20: mol_type = other DNA
gggaaggtgagttgggggat

SEQ ID NO: 57732 - DNA, 20 bp, synthetic construct
  misc_feature 1..20: note = CRISPR gRNA sequence
  source 1..20: mol_type = other DNA
ggaaggtgagttgggggata

SEQ ID NO: 57733 - DNA, 20 bp, synthetic construct
  misc_feature 1..20: note = CRISPR gRNA sequence
  source 1..20: mol_type = other DNA
gaaggtgagttgggggataa

SEQ ID NO: 57734 - DNA, 20 bp, synthetic construct
  misc_feature 1..20: note = CRISPR gRNA sequence
  source 1..20: mol_type = other DNA
aggtgagttgggggataagg

SEQ ID NO: 57735 - DNA, 20 bp, synthetic construct
  misc_feature 1..20: note = CRISPR gRNA sequence
  source 1..20: mol_type = other DNA
ttgggggataagggagtttc

SEQ ID NO: 57736 - DNA, 20 bp, synthetic construct
  misc_feature 1..20: note = CRISPR gRNA sequence
  source 1..20: mol_type = other DNA
tgggggataagggagtttct

SEQ ID NO: 57737 - DNA, 20 bp, synthetic construct
  misc_feature 1..20: note = CRISPR gRNA sequence
  source 1..20: mol_type = other DNA
gggggataagggagtttcta

SEQ ID NO: 57738 - DNA, 20 bp, synthetic construct
  misc_feature 1..20: note = CRISPR gRNA sequence
  source 1..20: mol_type = other DNA
ggataagggagtttctaggg

SEQ ID NO: 57739 - DNA, 20 bp, synthetic construct
  misc_feature 1..20: note = CRISPR gRNA sequence
  source 1..20: mol_type = other DNA
agggagtttctagggaagtc

SEQ ID NO: 57740 - DNA, 20 bp, synthetic construct
  misc_feature 1..20: note = CRISPR gRNA sequence
  source 1..20: mol_type = other DNA
gagtttctagggaagtcaag

SEQ ID NO: 57741 - DNA, 20 bp, synthetic construct
  misc_feature 1..20: note = CRISPR gRNA sequence
  source 1..20: mol_type = other DNA
tctagggaagtcaagcagtc

SEQ ID NO: 57742 - DNA, 20 bp, synthetic construct
  misc_feature 1..20: note = CRISPR gRNA sequence
  source 1..20: mol_type = other DNA
gaagtcaagcagtcaagaac

SEQ ID NO: 57743 - DNA, 20 bp, synthetic construct
  misc_feature 1..20: note = CRISPR gRNA sequence
  source 1..20: mol_type = other DNA
aagaaccagtccctacattt

SEQ ID NO: 57744 - DNA, 20 bp, synthetic construct
  misc_feature 1..20: note = CRISPR gRNA sequence
  source 1..20: mol_type = other DNA
tacatttgagcgacataaaa

SEQ ID NO: 57745 - DNA, 20 bp, synthetic construct
  misc_feature 1..20: note = CRISPR gRNA sequence
  source 1..20: mol_type = other DNA
acatttgagcgacataaaat

SEQ ID NO: 57746 - DNA, 20 bp, synthetic construct
  misc_feature 1..20: note = CRISPR gRNA sequence
  source 1..20: mol_type = other DNA
tttgagcgacataaaatagg

SEQ ID NO: 57747 - DNA, 20 bp, synthetic construct
  misc_feature 1..20: note = CRISPR gRNA sequence
  source 1..20: mol_type = other DNA
ttgagcgacataaaataggc

SEQ ID NO: 57748 - DNA, 20 bp, synthetic construct
  misc_feature 1..20: note = CRISPR gRNA sequence
  source 1..20: mol_type = other DNA
tgagcgacataaaataggca

SEQ ID NO: 57749 - DNA, 20 bp, synthetic construct
  misc_feature 1..20: note = CRISPR gRNA sequence
  source 1..20: mol_type = other DNA
gcgacataaaataggcaggg

SEQ ID NO: 57750 - DNA, 20 bp, synthetic construct
  misc_feature 1..20: note = CRISPR gRNA sequence
  source 1..20: mol_type = other DNA
acataaaataggcagggaag

SEQ ID NO: 57751 - DNA, 20 bp, synthetic construct
  misc_feature 1..20: note = CRISPR gRNA sequence
  source 1..20: mol_type = other DNA
gcagggaagtggcctctcca

SEQ ID NO: 57752 - DNA, 20 bp, synthetic construct
  misc_feature 1..20: note = CRISPR gRNA sequence
  source 1..20: mol_type = other DNA
agggaagtggcctctccatg

SEQ ID NO: 57753 - DNA, 20 bp, synthetic construct
  misc_feature 1..20: note = CRISPR gRNA sequence
  source 1..20: mol_type = other DNA
ggagtcttgatgtctctgcc

SEQ ID NO: 57754 - DNA, 20 bp, synthetic construct
  misc_feature 1..20: note = CRISPR gRNA sequence
  source 1..20: mol_type = other DNA
gagtcttgatgtctctgccc

SEQ ID NO: 57755 - DNA, 20 bp, synthetic construct
  misc_feature 1..20: note = CRISPR gRNA sequence
  source 1..20: mol_type = other DNA
agtcttgatgtctctgccca

SEQ ID NO: 57756 - DNA, 20 bp, synthetic construct
  misc_feature 1..20: note = CRISPR gRNA sequence
  source 1..20: mol_type = other DNA
tgatgtctctgcccagggat

SEQ ID NO: 57757 - DNA, 20 bp, synthetic construct
  misc_feature 1..20: note = CRISPR gRNA sequence
  source 1..20: mol_type = other DNA
ctctgcccagggatcagctc

SEQ ID NO: 57758 - DNA, 20 bp, synthetic construct
  misc_feature 1..20: note = CRISPR gRNA sequence
  source 1..20: mol_type = other DNA
ctgcccagggatcagctcca

SEQ ID NO: 57759 - DNA, 20 bp, synthetic construct
  misc_feature 1..20: note = CRISPR gRNA sequence
  source 1..20: mol_type = other DNA
cagggatcagctccagagat

SEQ ID NO: 57760 - DNA, 20 bp, synthetic construct
  misc_feature 1..20: note = CRISPR gRNA sequence
  source 1..20: mol_type = other DNA
ctccatttgtgcctgcaccc

SEQ ID NO: 57761 - DNA, 20 bp, synthetic construct
  misc_feature 1..20: note = CRISPR gRNA sequence
  source 1..20: mol_type = other DNA
gtgcctgcaccctggctctc

SEQ ID NO: 57762 - DNA, 20 bp, synthetic construct
  misc_feature 1..20: note = CRISPR gRNA sequence
  source 1..20: mol_type = other DNA
tgcaccctggctctctggaa

SEQ ID NO: 57763 - DNA, 20 bp, synthetic construct
  misc_feature 1..20: note = CRISPR gRNA sequence
  source 1..20: mol_type = other DNA
atggtcttgttcatcccctg

SEQ ID NO: 57764 - DNA, 20 bp, synthetic construct
  misc_feature 1..20: note = CRISPR gRNA sequence
  source 1..20: mol_type = other DNA
tcttgttcatcccctgtgga

SEQ ID NO: 57765 - DNA, 20 bp, synthetic construct
  misc_feature 1..20: note = CRISPR gRNA sequence
  source 1..20: mol_type = other DNA
tcccctgtggacagtcccgt

SEQ ID NO: 57766 - DNA, 20 bp, synthetic construct
  misc_feature 1..20: note = CRISPR gRNA sequence
  source 1..20: mol_type = other DNA
cccctgtggacagtcccgtg

SEQ ID NO: 57767 - DNA, 20 bp, synthetic construct
  misc_feature 1..20: note = CRISPR gRNA sequence
  source 1..20: mol_type = other DNA
tgaaccatttatgctgctct

SEQ ID NO: 57768 - DNA, 20 bp, synthetic construct
  misc_feature 1..20: note = CRISPR gRNA sequence
  source 1..20: mol_type = other DNA
atttatgctgctctcagtct

SEQ ID NO: 57769 - DNA, 20 bp, synthetic construct
  misc_feature 1..20: note = CRISPR gRNA sequence
  source 1..20: mol_type = other DNA
ctcagtctgagctaacctca

SEQ ID NO: 57770 - DNA, 20 bp, synthetic construct
  misc_feature 1..20: note = CRISPR gRNA sequence
  source 1..20: mol_type = other DNA
agtctgagctaacctcatgg

SEQ ID NO: 57771 - DNA, 20 bp, synthetic construct
  misc_feature 1..20: note = CRISPR gRNA sequence
  source 1..20: mol_type = other DNA
tctgagctaacctcatggca

SEQ ID NO: 57772 - DNA, 20 bp, synthetic construct
  misc_feature 1..20: note = CRISPR gRNA sequence
  source 1..20: mol_type = other DNA
aacctcatggcagagacaac

SEQ ID NO: 57773 - DNA, 20 bp, synthetic construct
  misc_feature 1..20: note = CRISPR gRNA sequence
  source 1..20: mol_type = other DNA
tctgttcttcccttcttcct

SEQ ID NO: 57774 - DNA, 20 bp, synthetic construct
  misc_feature 1..20: note = CRISPR gRNA sequence
  source 1..20: mol_type = other DNA
cttcccttcttcctcagtat

SEQ ID NO: 57775 - DNA, 20 bp, synthetic construct
  misc_feature 1..20: note = CRISPR gRNA sequence
  source 1..20: mol_type = other DNA
tagaactactaaatattctc

SEQ ID NO: 57776 - DNA, 20 bp, synthetic construct
  misc_feature 1..20: note = CRISPR gRNA sequence
  source 1..20: mol_type = other DNA
ctaaatattctctggtcatc

SEQ ID NO: 57777 - DNA, 20 bp, synthetic construct
  misc_feature 1..20: note = CRISPR gRNA sequence
  source 1..20: mol_type = other DNA
tattctctggtcatctagaa

SEQ ID NO: 57778 - DNA, 20 bp, synthetic construct
  misc_feature 1..20: note = CRISPR gRNA sequence
  source 1..20: mol_type = other DNA
tagaatagattattatatcc

SEQ ID NO: 57779 - DNA, 20 bp, synthetic construct
  misc_feature 1..20: note = CRISPR gRNA sequence
  source 1..20: mol_type = other DNA
ttatatcccagtctcccttg

SEQ ID NO: 57780 - DNA, 20 bp, synthetic construct
  misc_feature 1..20: note = CRISPR gRNA sequence
  source 1..20: mol_type = other DNA
gtctcccttgcagttatatg

SEQ ID NO: 57781 - DNA, 20 bp, synthetic construct
  misc_feature 1..20: note = CRISPR gRNA sequence
  source 1..20: mol_type = other DNA
ttatatgtagccatgtaatt

SEQ ID NO: 57782 - DNA, 20 bp, synthetic construct
  misc_feature 1..20: note = CRISPR gRNA sequence
  source 1..20: mol_type = other DNA
atgtagccatgtaatttggc

SEQ ID NO: 57783 - DNA, 20 bp, synthetic construct
  misc_feature 1..20: note = CRISPR gRNA sequence
  source 1..20: mol_type = other DNA
tagccatgtaatttggccag

SEQ ID NO: 57784 - DNA, 20 bp, synthetic construct
  misc_feature 1..20: note = CRISPR gRNA sequence
  source 1..20: mol_type = other DNA
taatttggccagtggaatgt

SEQ ID NO: 57785 - DNA, 20 bp, synthetic construct
  misc_feature 1..20: note = CRISPR gRNA sequence
  source 1..20: mol_type = other DNA
tttggccagtggaatgtaag

SEQ ID NO: 57786 - DNA, 20 bp, synthetic construct
  misc_feature 1..20: note = CRISPR gRNA sequence
  source 1..20: mol_type = other DNA
ctttgctccttcctgttgtc

SEQ ID NO: 57787 - DNA, 20 bp, synthetic construct
  misc_feature 1..20: note = CRISPR gRNA sequence
  source 1..20: mol_type = other DNA
cctgttgtctggattgttga

SEQ ID NO: 57788 - DNA, 20 bp, synthetic construct
  misc_feature 1..20: note = CRISPR gRNA sequence
  source 1..20: mol_type = other DNA
ctgttgtctggattgttgat

SEQ ID NO: 57789 - DNA, 20 bp, synthetic construct
  misc_feature 1..20: note = CRISPR gRNA sequence
  source 1..20: mol_type = other DNA
tgtctggattgttgatggga

SEQ ID NO: 57790 - DNA, 20 bp, synthetic construct
  misc_feature 1..20: note = CRISPR gRNA sequence
  source 1..20: mol_type = other DNA
tggattgttgatgggatggc

SEQ ID NO: 57791 - DNA, 20 bp, synthetic construct
  misc_feature 1..20: note = CRISPR gRNA sequence
  source 1..20: mol_type = other DNA
ttgatgggatggctggatct

SEQ ID NO: 57792 - DNA, 20 bp, synthetic construct
  misc_feature 1..20: note = CRISPR gRNA sequence
  source 1..20: mol_type = other DNA
tgatgggatggctggatctt

SEQ ID NO: 57793 - DNA, 20 bp, synthetic construct
  misc_feature 1..20: note = CRISPR gRNA sequence
  source 1..20: mol_type = other DNA
tgggatggctggatcttggg

SEQ ID NO: 57794 - DNA, 20 bp, synthetic construct
  misc_feature 1..20: note = CRISPR gRNA sequence
  source 1..20: mol_type = other DNA
gggcagccatattgaatcat

SEQ ID NO: 57795 - DNA, 20 bp, synthetic construct
  misc_feature 1..20: note = CRISPR gRNA sequence
  source 1..20: mol_type = other DNA
ggcagccatattgaatcatg

SEQ ID NO: 57796 - DNA, 20 bp, synthetic construct
  misc_feature 1..20: note = CRISPR gRNA sequence
  source 1..20: mol_type = other DNA
agccatattgaatcatgagg

SEQ ID NO: 57797 - DNA, 20 bp, synthetic construct
  misc_feature 1..20: note = CRISPR gRNA sequence
  source 1..20: mol_type = other DNA
catgaggtggaacccatact

SEQ ID NO: 57798 - DNA, 20 bp, synthetic construct
  misc_feature 1..20: note = CRISPR gRNA sequence
  source 1..20: mol_type = other DNA
atgaggtggaacccatactg

SEQ ID NO: 57799 - DNA, 20 bp, synthetic construct
  misc_feature 1..20: note = CRISPR gRNA sequence
  source 1..20: mol_type = other DNA
aggtggaacccatactgagg

SEQ ID NO: 57800 - DNA, 20 bp, synthetic construct
  misc_feature 1..20: note = CRISPR gRNA sequence
  source 1..20: mol_type = other DNA
ggtggaacccatactgagga

SEQ ID NO: 57801 - DNA, 20 bp, synthetic construct
  misc_feature 1..20: note = CRISPR gRNA sequence
  source 1..20: mol_type = other DNA
ggaacccatactgaggaagg

SEQ ID NO: 57802 - DNA, 20 bp, synthetic construct
  misc_feature 1..20: note = CRISPR gRNA sequence
  source 1..20: mol_type = other DNA
acccatactgaggaaggtgg

SEQ ID NO: 57803 - DNA, 20 bp, synthetic construct
  misc_feature 1..20: note = CRISPR gRNA sequence
  source 1..20: mol_type = other DNA
cccatactgaggaaggtgga

SEQ ID NO: 57804 - DNA, 20 bp, synthetic construct
  misc_feature 1..20: note = CRISPR gRNA sequence
  source 1..20: mol_type = other DNA
actgaggaaggtggaaggta

SEQ ID NO: 57805 - DNA, 20 bp, synthetic construct
  misc_feature 1..20: note = CRISPR gRNA sequence
  source 1..20: mol_type = other DNA
tgccctgtgctcactgactt

SEQ ID NO: 57806 - DNA, 20 bp, synthetic construct
  misc_feature 1..20: note = CRISPR gRNA sequence
  source 1..20: mol_type = other DNA
gactttggacttctgttaca

SEQ ID NO: 57807 - DNA, 20 bp, synthetic construct
  misc_feature 1..20: note = CRISPR gRNA sequence
  source 1..20: mol_type = other DNA
tttggacttctgttacatgg

SEQ ID NO: 57808 - DNA, 20 bp, synthetic construct
  misc_feature 1..20: note = CRISPR gRNA sequence
  source 1..20: mol_type = other DNA
ttggacttctgttacatggc

SEQ ID NO: 57809 - DNA, 20 bp, synthetic construct
  misc_feature 1..20: note = CRISPR gRNA sequence
  source 1..20: mol_type = other DNA
tggacttctgttacatggca

SEQ ID NO: 57810 - DNA, 20 bp, synthetic construct
  misc_feature 1..20: note = CRISPR gRNA sequence
  source 1..20: mol_type = other DNA
agggaaatacacttccattc

SEQ ID NO: 57811 - DNA, 20 bp, synthetic construct
  misc_feature 1..20: note = CRISPR gRNA sequence
  source 1..20: mol_type = other DNA
aatacacttccattctggtt

SEQ ID NO: 57812 - DNA, 20 bp, synthetic construct
  misc_feature 1..20: note = CRISPR gRNA sequence
  source 1..20: mol_type = other DNA
ctggttaagccactgttgtt

SEQ ID NO: 57813 - DNA, 20 bp, synthetic construct
  misc_feature 1..20: note = CRISPR gRNA sequence
  source 1..20: mol_type = other DNA
ttagtgctttctgctactca

SEQ ID NO: 57814 - DNA, 20 bp, synthetic construct
  misc_feature 1..20: note = CRISPR gRNA sequence
  source 1..20: mol_type = other DNA
ctcacagtgaactctaatcc

SEQ ID NO: 57815 - DNA, 20 bp, synthetic construct
  misc_feature 1..20: note = CRISPR gRNA sequence
  source 1..20: mol_type = other DNA
aactctaatcctagctaaca

SEQ ID NO: 57816 - DNA, 20 bp, synthetic construct
  misc_feature 1..20: note = CRISPR gRNA sequence
  source 1..20: mol_type = other DNA
agaccatcacctcttttgct

SEQ ID NO: 57817 - DNA, 20 bp, synthetic construct
  misc_feature 1..20: note = CRISPR gRNA sequence
  source 1..20: mol_type = other DNA
caaattcttcccttctgaac

SEQ ID NO: 57818 - DNA, 20 bp, synthetic construct
  misc_feature 1..20: note = CRISPR gRNA sequence
  source 1..20: mol_type = other DNA
actggaactctttttttttt

SEQ ID NO: 57819 - DNA, 20 bp, synthetic construct
  misc_feature 1..20: note = CRISPR gRNA sequence
  source 1..20: mol_type = other DNA
gaactcttttttttttgaga

SEQ ID NO: 57820 - DNA, 20 bp, synthetic construct
  misc_feature 1..20: note = CRISPR gRNA sequence
  source 1..20: mol_type = other DNA
actcttttttttttgagaca

SEQ ID NO: 57821 - DNA, 20 bp, synthetic construct
  misc_feature 1..20: note = CRISPR gRNA sequence
  source 1..20: mol_type = other DNA
cagagtctcgctctgtcacc

SEQ ID NO: 57822 - DNA, 20 bp, synthetic construct
  misc_feature 1..20: note = CRISPR gRNA sequence
  source 1..20: mol_type = other DNA
agagtctcgctctgtcaccc

SEQ ID NO: 57823 - DNA, 20 bp, synthetic construct
  misc_feature 1..20: note = CRISPR gRNA sequence
  source 1..20: mol_type = other DNA
tctcgctctgtcacccaggc

SEQ ID NO: 57824 - DNA, 20 bp, synthetic construct
  misc_feature 1..20: note = CRISPR gRNA sequence
  source 1..20: mol_type = other DNA
tcgctctgtcacccaggctg

SEQ ID NO: 57825 - DNA, 20 bp, synthetic construct
  misc_feature 1..20: note = CRISPR gRNA sequence
  source 1..20: mol_type = other DNA
tcacccaggctggagtgcaa

SEQ ID NO: 57826 - DNA, 20 bp, synthetic construct
  misc_feature 1..20: note = CRISPR gRNA sequence
  source 1..20: mol_type = other DNA
ggagtgcaatggtgcaatct

SEQ ID NO: 57827 - DNA, 20 bp, synthetic construct
  misc_feature 1..20: note = CRISPR gRNA sequence
  source 1..20: mol_type = other DNA
ggtgcaatctcggctcactg

SEQ ID NO: 57828 - DNA, 20 bp, synthetic construct
  misc_feature 1..20: note = CRISPR gRNA sequence
  source 1..20: mol_type = other DNA
tcactgcagcctccgcctcc

SEQ ID NO: 57829 - DNA, 20 bp, synthetic construct
  misc_feature 1..20: note = CRISPR gRNA sequence
  source 1..20: mol_type = other DNA
cactgcagcctccgcctccc

SEQ ID NO: 57830 - DNA, 20 bp, synthetic construct
  misc_feature 1..20: note = CRISPR gRNA sequence
  source 1..20: mol_type = other DNA
agcctccgcctcccgggttc

SEQ ID NO: 57831 - DNA, 20 bp, synthetic construct
  misc_feature 1..20: note = CRISPR gRNA sequence
  source 1..20: mol_type = other DNA
ttcaagcgattcttctgcct

SEQ ID NO: 57832 - DNA, 20 bp, synthetic construct
  misc_feature 1..20: note = CRISPR gRNA sequence
  source 1..20: mol_type = other DNA
ttcttctgcctcagcctccc

SEQ ID NO: 57833 - DNA, 20 bp, synthetic construct
  misc_feature 1..20: note = CRISPR gRNA sequence
  source 1..20: mol_type = other DNA
ttctgcctcagcctcccgag

SEQ ID NO: 57834 - DNA, 20 bp, synthetic construct
  misc_feature 1..20: note = CRISPR gRNA sequence
  source 1..20: mol_type = other DNA
gcctcagcctcccgagtagc

SEQ ID NO: 57835 - DNA, 20 bp, synthetic construct
  misc_feature 1..20: note = CRISPR gRNA sequence
  source 1..20: mol_type = other DNA
cctcagcctcccgagtagct

SEQ ID NO: 57836 - DNA, 20 bp, synthetic construct
  misc_feature 1..20: note = CRISPR gRNA sequence
  source 1..20: mol_type = other DNA
ctcccgagtagctgggatta

SEQ ID NO: 57837 - DNA, 20 bp, synthetic construct
  misc_feature 1..20: note = CRISPR gRNA sequence
  source 1..20: mol_type = other DNA
tcccgagtagctgggattac

SEQ ID NO: 57838 - DNA, 20 bp, synthetic construct
  misc_feature 1..20: note = CRISPR gRNA sequence
  source 1..20: mol_type = other DNA
caggtgcacaccacaatgcc

SEQ ID NO: 57839 - DNA, 20 bp, synthetic construct
  misc_feature 1..20: note = CRISPR gRNA sequence
  source 1..20: mol_type = other DNA
cagctaatttttgtaatttt

SEQ ID NO: 57840 - DNA, 20 bp, synthetic construct
  misc_feature 1..20: note = CRISPR gRNA sequence
  source 1..20: mol_type = other DNA
aatttttgtaatttttagta

SEQ ID NO: 57841 - DNA, 20 bp, synthetic construct
  misc_feature 1..20: note = CRISPR gRNA sequence
  source 1..20: mol_type = other DNA
tttgtaatttttagtacaga

SEQ ID NO: 57842 - DNA, 20 bp, synthetic construct
  misc_feature 1..20: note = CRISPR gRNA sequence
  source 1..20: mol_type = other DNA
ttgtaatttttagtacagat

SEQ ID NO: 57843 - DNA, 20 bp, synthetic construct
  misc_feature 1..20: note = CRISPR gRNA sequence
  source 1..20: mol_type = other DNA
tgtaatttttagtacagatg

SEQ ID NO: 57844 - DNA, 20 bp, synthetic construct
  misc_feature 1..20: note = CRISPR gRNA sequence
  source 1..20: mol_type = other DNA
cagatggggtttcaccatgt

SEQ ID NO: 57845 - DNA, 20 bp, synthetic construct
  misc_feature 1..20: note = CRISPR gRNA sequence
  source 1..20: mol_type = other DNA
tggggtttcaccatgttggc

SEQ ID NO: 57846 - DNA, 20 bp, synthetic construct
  misc_feature 1..20: note = CRISPR gRNA sequence
  source 1..20: mol_type = other DNA
ggggtttcaccatgttggcc

SEQ ID NO: 57847 - DNA, 20 bp, synthetic construct
  misc_feature 1..20: note = CRISPR gRNA sequence
  source 1..20: mol_type = other DNA
tttcaccatgttggccaggc

SEQ ID NO: 57848 - DNA, 20 bp, synthetic construct
  misc_feature 1..20: note = CRISPR gRNA sequence
  source 1..20: mol_type = other DNA
ttcaccatgttggccaggct

SEQ ID NO: 57849 - DNA, 20 bp, synthetic construct
  misc_feature 1..20: note = CRISPR gRNA sequence
  source 1..20: mol_type = other DNA
tgggctcaaactcctgacct

SEQ ID NO: 57850 - DNA, 20 bp, synthetic construct
  misc_feature 1..20: note = CRISPR gRNA sequence
  source 1..20: mol_type = other DNA
gggctcaaactcctgacctc

SEQ ID NO: 57851 - DNA, 20 bp, synthetic construct
  misc_feature 1..20: note = CRISPR gRNA sequence
  source 1..20: mol_type = other DNA
ggctcaaactcctgacctca

SEQ ID NO: 57852 - DNA, 20 bp, synthetic construct
  misc_feature 1..20: note = CRISPR gRNA sequence
  source 1..20: mol_type = other DNA
tcagggtgatctgcccacct

SEQ ID NO: 57853 - DNA, 20 bp, synthetic construct
  misc_feature 1..20: note = CRISPR gRNA sequence
  source 1..20: mol_type = other DNA
ctgcccacctcggcctccca

SEQ ID NO: 57854 - DNA, 20 bp, synthetic construct
  misc_feature 1..20: note = CRISPR gRNA sequence
  source 1..20: mol_type = other DNA
acctcggcctcccaaagtgc

SEQ ID NO: 57855 - DNA, 20 bp, synthetic construct
  misc_feature 1..20: note = CRISPR gRNA sequence
  source 1..20: mol_type = other DNA
cctcggcctcccaaagtgct

SEQ ID NO: 57856 - DNA, 20 bp, synthetic construct
  misc_feature 1..20: note = CRISPR gRNA sequence
  source 1..20: mol_type = other DNA
ctcccaaagtgctgggatta

SEQ ID NO: 57857 - DNA, 20 bp, synthetic construct
  misc_feature 1..20: note = CRISPR gRNA sequence
  source 1..20: mol_type = other DNA
tcccaaagtgctgggattac

SEQ ID NO: 57858 - DNA, 20 bp, synthetic construct
  misc_feature 1..20: note = CRISPR gRNA sequence
  source 1..20: mol_type = other DNA
agtgctgggattacaggtgt

SEQ ID NO: 57859 - DNA, 20 bp, synthetic construct
  misc_feature 1..20: note = CRISPR gRNA sequence
  source 1..20: mol_type = other DNA
acaggtgtgagccatcatga

SEQ ID NO: 57860 - DNA, 20 bp, synthetic construct
  misc_feature 1..20: note = CRISPR gRNA sequence
  source 1..20: mol_type = other DNA
agccatcatgatggccgaac

SEQ ID NO: 57861 - DNA, 20 bp, synthetic construct
  misc_feature 1..20: note = CRISPR gRNA sequence
  source 1..20: mol_type = other DNA
actcttaaaccacctccttc

SEQ ID NO: 57862 - DNA, 20 bp, synthetic construct
  misc_feature 1..20: note = CRISPR gRNA sequence
  source 1..20: mol_type = other DNA
cttaaaccacctccttctag

SEQ ID NO: 57863 - DNA, 20 bp, synthetic construct
  misc_feature 1..20: note = CRISPR gRNA sequence
  source 1..20: mol_type = other DNA
cctccttctagaagtaccaa

SEQ ID NO: 57864 - DNA, 20 bp, synthetic construct
  misc_feature 1..20: note = CRISPR gRNA sequence
  source 1..20: mol_type = other DNA
tccttctagaagtaccaata

SEQ ID NO: 57865 - DNA, 20 bp, synthetic construct
  misc_feature 1..20: note = CRISPR gRNA sequence
  source 1..20: mol_type = other DNA
ccttctagaagtaccaatag

SEQ ID NO: 57866 - DNA, 20 bp, synthetic construct
  misc_feature 1..20: note = CRISPR gRNA sequence
  source 1..20: mol_type = other DNA
cttctagaagtaccaataga

SEQ ID NO: 57867 - DNA, 20 bp, synthetic construct
  misc_feature 1..20: note = CRISPR gRNA sequence
  source 1..20: mol_type = other DNA
agaagtaccaatagagggca

SEQ ID NO: 57868 - DNA, 20 bp, synthetic construct
  misc_feature 1..20: note = CRISPR gRNA sequence
  source 1..20: mol_type = other DNA
gaagtaccaatagagggcac

SEQ ID NO: 57869 - DNA, 20 bp, synthetic construct
  misc_feature 1..20: note = CRISPR gRNA sequence
  source 1..20: mol_type = other DNA
aagtaccaatagagggcacg

SEQ ID NO: 57870 - DNA, 20 bp, synthetic construct
  misc_feature 1..20: note = CRISPR gRNA sequence
  source 1..20: mol_type = other DNA
gagggcacggggcatttaca

SEQ ID NO: 57871 - DNA, 20 bp, synthetic construct
  misc_feature 1..20: note = CRISPR gRNA sequence
  source 1..20: mol_type = other DNA
acggggcatttacacagcaa

SEQ ID NO: 57872 - DNA, 20 bp, synthetic construct
  misc_feature 1..20: note = CRISPR gRNA sequence
  source 1..20: mol_type = other DNA
gcaaaagcctaaataatgtg

SEQ ID NO: 57873 - DNA, 20 bp, synthetic construct
  misc_feature 1..20: note = CRISPR gRNA sequence
  source 1..20: mol_type = other DNA
aatgtgcagttcctttgatt

SEQ ID NO: 57874 - DNA, 20 bp, synthetic construct
  misc_feature 1..20: note = CRISPR gRNA sequence
  source 1..20: mol_type = other DNA
tgattcagtaattccatttc

SEQ ID NO: 57875 - DNA, 20 bp, synthetic construct
  misc_feature 1..20: note = CRISPR gRNA sequence
  source 1..20: mol_type = other DNA
gattcagtaattccatttct

SEQ ID NO: 57876 - DNA, 20 bp, synthetic construct
  misc_feature 1..20: note = CRISPR gRNA sequence
  source 1..20: mol_type = other DNA
catttctaggactctaacct

SEQ ID NO: 57877 - DNA, 20 bp, synthetic construct
  misc_feature 1..20: note = CRISPR gRNA sequence
  source 1..20: mol_type = other DNA
atatacaatatttaattgca

SEQ ID NO: 57878 - DNA, 20 bp, synthetic construct
  misc_feature 1..20: note = CRISPR gRNA sequence
  source 1..20: mol_type = other DNA
attgcaaagatgctcactgc

SEQ ID NO: 57879 - DNA, 20 bp, synthetic construct
  misc_feature 1..20: note = CRISPR gRNA sequence
  source 1..20: mol_type = other DNA
tatttataattattaaaaat

SEQ ID NO: 57880 - DNA, 20 bp, synthetic construct
  misc_feature 1..20: note = CRISPR gRNA sequence
  source 1..20: mol_type = other DNA
gaaacaacctaaatgtccaa

SEQ ID NO: 57881 - DNA, 20 bp, synthetic construct
  misc_feature 1..20: note = CRISPR gRNA sequence
  source 1..20: mol_type = other DNA
caacctaaatgtccaacagt

SEQ ID NO: 57882 - DNA, 20 bp, synthetic construct
  misc_feature 1..20: note = CRISPR gRNA sequence
  source 1..20: mol_type = other DNA
aacctaaatgtccaacagtt

SEQ ID NO: 57883 - DNA, 20 bp, synthetic construct
  misc_feature 1..20: note = CRISPR gRNA sequence
  source 1..20: mol_type = other DNA
acctaaatgtccaacagttg

SEQ ID NO: 57884 - DNA, 20 bp, synthetic construct
  misc_feature 1..20: note = CRISPR gRNA sequence
  source 1..20: mol_type = other DNA
aatgtccaacagttggggat

SEQ ID NO: 57885 - DNA, 20 bp, synthetic construct
  misc_feature 1..20: note = CRISPR gRNA sequence
  source 1..20: mol_type = other DNA
ttggggattggccaactaaa

SEQ ID NO: 57886 - DNA, 20 bp, synthetic construct
  misc_feature 1..20: note = CRISPR gRNA sequence
  source 1..20: mol_type = other DNA
gggattggccaactaaatgg

SEQ ID NO: 57887 - DNA, 20 bp, synthetic construct
  misc_feature 1..20: note = CRISPR gRNA sequence
  source 1..20: mol_type = other DNA
ctaaatggtggtccatcatc

SEQ ID NO: 57888 - DNA, 20 bp, synthetic construct
  misc_feature 1..20: note = CRISPR gRNA sequence
  source 1..20: mol_type = other DNA
aatggtggtccatcatctag

SEQ ID NO: 57889 - DNA, 20 bp, synthetic construct
  misc_feature 1..20: note = CRISPR gRNA sequence
  source 1..20: mol_type = other DNA
ggactatgctatcacatttc

SEQ ID NO: 57890 - DNA, 20 bp, synthetic construct
  misc_feature 1..20: note = CRISPR gRNA sequence
  source 1..20: mol_type = other DNA
acatttccggatgtactttc

SEQ ID NO: 57891 - DNA, 20 bp, synthetic construct
  misc_feature 1..20: note = CRISPR gRNA sequence
  source 1..20: mol_type = other DNA
tggtactatgtccttcctca

SEQ ID NO: 57892 - DNA, 20 bp, synthetic construct
  misc_feature 1..20: note = CRISPR gRNA sequence
  source 1..20: mol_type = other DNA
tactatgtccttcctcatag

SEQ ID NO: 57893 - DNA, 20 bp, synthetic construct
  misc_feature 1..20: note = CRISPR gRNA sequence
  source 1..20: mol_type = other DNA
tcctcatagcagtacacact

SEQ ID NO: 57894 - DNA, 20 bp, synthetic construct
  misc_feature 1..20: note = CRISPR gRNA sequence
  source 1..20: mol_type = other DNA
catagcagtacacacttgga

SEQ ID NO: 57895 - DNA, 20 bp, synthetic construct
  misc_feature 1..20: note = CRISPR gRNA sequence
  source 1..20: mol_type = other DNA
ggaaagcactcactgtgtat

SEQ ID NO: 57896 - DNA, 20 bp, synthetic construct
  misc_feature 1..20: note = CRISPR gRNA sequence
  source 1..20: mol_type = other DNA
gaaagcactcactgtgtatt

SEQ ID NO: 57897 - DNA, 20 bp, synthetic construct
  misc_feature 1..20: note = CRISPR gRNA sequence
  source 1..20: mol_type = other DNA
ctgtgtattaggcactgtct

SEQ ID NO: 57898 - DNA, 20 bp, synthetic construct
  misc_feature 1..20: note = CRISPR gRNA sequence
  source 1..20: mol_type = other DNA
ttattttatcctcacaactc

SEQ ID NO: 57899 - DNA, 20 bp, synthetic construct
  misc_feature 1..20: note = CRISPR gRNA sequence
  source 1..20: mol_type = other DNA
attttatcctcacaactcca

SEQ ID NO: 57900 - DNA, 20 bp, synthetic construct
  misc_feature 1..20: note = CRISPR gRNA sequence
  source 1..20: mol_type = other DNA
tttatcctcacaactccaga

SEQ ID NO: 57901 - DNA, 20 bp, synthetic construct
  misc_feature 1..20: note = CRISPR gRNA sequence
  source 1..20: mol_type = other DNA
agtccacctctaactctgaa

SEQ ID NO: 57902 - DNA, 20 bp, synthetic construct
  misc_feature 1..20: note = CRISPR gRNA sequence
  source 1..20: mol_type = other DNA
tccacctctaactctgaaaa

SEQ ID NO: 57903 - DNA, 20 bp, synthetic construct
  misc_feature 1..20: note = CRISPR gRNA sequence
  source 1..20: mol_type = other DNA
acctctaactctgaaaagag

SEQ ID NO: 57904 - DNA, 20 bp, synthetic construct
  misc_feature 1..20: note = CRISPR gRNA sequence
  source 1..20: mol_type = other DNA
cctctaactctgaaaagagt

SEQ ID NO: 57905 - DNA, 20 bp, synthetic construct
  misc_feature 1..20: note = CRISPR gRNA sequence
  source 1..20: mol_type = other DNA
tctaactctgaaaagagtag

SEQ ID NO: 57906 - DNA, 20 bp, synthetic construct
  misc_feature 1..20: note = CRISPR gRNA sequence
  source 1..20: mol_type = other DNA
ctaactctgaaaagagtagg

SEQ ID NO: 57907 - DNA, 20 bp, synthetic construct
  misc_feature 1..20: note = CRISPR gRNA sequence
  source 1..20: mol_type = other DNA
aaaagagtaggaggtccacc

SEQ ID NO: 57908 - DNA, 20 bp, synthetic construct
  misc_feature 1..20: note = CRISPR gRNA sequence
  source 1..20: mol_type = other DNA
agagtaggaggtccacccag

SEQ ID NO: 57909 - DNA, 20 bp, synthetic construct
  misc_feature 1..20: note = CRISPR gRNA sequence
  source 1..20: mol_type = other DNA
taggaggtccacccagaagc

SEQ ID NO: 57910 - DNA, 20 bp, synthetic construct
  misc_feature 1..20: note = CRISPR gRNA sequence
  source 1..20: mol_type = other DNA
aagccagccttcccaattcc

SEQ ID NO: 57911 - DNA, 20 bp, synthetic construct
  misc_feature 1..20: note = CRISPR gRNA sequence
  source 1..20: mol_type = other DNA
gccagccttcccaattccca

SEQ ID NO: 57912 - DNA, 20 bp, synthetic construct
  misc_feature 1..20: note = CRISPR gRNA sequence
  source 1..20: mol_type = other DNA
ccagccttcccaattcccag

SEQ ID NO: 57913 - DNA, 20 bp, synthetic construct
  misc_feature 1..20: note = CRISPR gRNA sequence
  source 1..20: mol_type = other DNA
cttcccaattcccagaggct

SEQ ID NO: 57914 - DNA, 20 bp, synthetic construct
  misc_feature 1..20: note = CRISPR gRNA sequence
  source 1..20: mol_type = other DNA
ttcccaattcccagaggctg

SEQ ID NO: 57915 - DNA, 20 bp, synthetic construct
  misc_feature 1..20: note = CRISPR gRNA sequence
  source 1..20: mol_type = other DNA
caattcccagaggctgaggc

SEQ ID NO: 57916 - DNA, 20 bp, synthetic construct
  misc_feature 1..20: note = CRISPR gRNA sequence
  source 1..20: mol_type = other DNA
gaggccagtactatgcgtcc

SEQ ID NO: 57917 - DNA, 20 bp, synthetic construct
  misc_feature 1..20: note = CRISPR gRNA sequence
  source 1..20: mol_type = other DNA
aggccagtactatgcgtcct

SEQ ID NO: 57918 - DNA, 20 bp, synthetic construct
  misc_feature 1..20: note = CRISPR gRNA sequence
  source 1..20: mol_type = other DNA
ggccagtactatgcgtcctg

SEQ ID NO: 57919 - DNA, 20 bp, synthetic construct
  misc_feature 1..20: note = CRISPR gRNA sequence
  source 1..20: mol_type = other DNA
gtactatgcgtcctggggtt

SEQ ID NO: 57920 - DNA, 20 bp, synthetic construct
  misc_feature 1..20: note = CRISPR gRNA sequence
  source 1..20: mol_type = other DNA
actatgcgtcctggggttta

SEQ ID NO: 57921 - DNA, 20 bp, synthetic construct
  misc_feature 1..20: note = CRISPR gRNA sequence
  source 1..20: mol_type = other DNA
gcgtcctggggtttagagcc

SEQ ID NO: 57922 - DNA, 20 bp, synthetic construct
  misc_feature 1..20: note = CRISPR gRNA sequence
  source 1..20: mol_type = other DNA
tttagagcccagctgctccc

SEQ ID NO: 57923 - DNA, 20 bp, synthetic construct
  misc_feature 1..20: note = CRISPR gRNA sequence
  source 1..20: mol_type = other DNA
ttagagcccagctgctccct

SEQ ID NO: 57924 - DNA, 20 bp, synthetic construct
  misc_feature 1..20: note = CRISPR gRNA sequence
  source 1..20: mol_type = other DNA
ccagctgctccctgggcatg

SEQ ID NO: 57925 - DNA, 20 bp, synthetic construct
  misc_feature 1..20: note = CRISPR gRNA sequence
  source 1..20: mol_type = other DNA
gctgctccctgggcatgcag

SEQ ID NO: 57926 - DNA, 20 bp, synthetic construct
  misc_feature 1..20: note = CRISPR gRNA sequence
  source 1..20: mol_type = other DNA
tgctccctgggcatgcagta

SEQ ID NO: 57927 - DNA, 20 bp, synthetic construct
  misc_feature 1..20: note = CRISPR gRNA sequence
  source 1..20: mol_type = other DNA
gcatgcagtagagacatact

SEQ ID NO: 57928 - DNA, 20 bp, synthetic construct
  misc_feature 1..20: note = CRISPR gRNA sequence
  source 1..20: mol_type = other DNA
gacatacttggatgtactgt

SEQ ID NO: 57929 - DNA, 20 bp, synthetic construct
  misc_feature 1..20: note = CRISPR gRNA sequence
  source 1..20: mol_type = other DNA
ggatgtactgtcagccccac

SEQ ID NO: 57930 - DNA, 20 bp, synthetic construct
  misc_feature 1..20: note = CRISPR gRNA sequence
  source 1..20: mol_type = other DNA
actggtcatttctcctcaac

SEQ ID NO: 57931 - DNA, 20 bp, synthetic construct
  misc_feature 1..20: note = CRISPR gRNA sequence
  source 1..20: mol_type = other DNA
ctggtcatttctcctcaact

SEQ ID NO: 57932 - DNA, 20 bp, synthetic construct
  misc_feature 1..20: note = CRISPR gRNA sequence
  source 1..20: mol_type = other DNA
tttctcctcaactgggctaa

SEQ ID NO: 57933 - DNA, 20 bp, synthetic construct
  misc_feature 1..20: note = CRISPR gRNA sequence
  source 1..20: mol_type = other DNA
ctcaactgggctaatagcaa

SEQ ID NO: 57934 - DNA, 20 bp, synthetic construct
  misc_feature 1..20: note = CRISPR gRNA sequence
  source 1..20: mol_type = other DNA
tcaactgggctaatagcaat

SEQ ID NO: 57935 - DNA, 20 bp, synthetic construct
  misc_feature 1..20: note = CRISPR gRNA sequence
  source 1..20: mol_type = other DNA
aatagcaataggtcctcact

SEQ ID NO: 57936 - DNA, 20 bp, synthetic construct
  misc_feature 1..20: note = CRISPR gRNA sequence
  source 1..20: mol_type = other DNA
atagcaataggtcctcactc

SEQ ID NO: 57937 - DNA, 20 bp, synthetic construct
  misc_feature 1..20: note = CRISPR gRNA sequence
  source 1..20: mol_type = other DNA
gcaataggtcctcactcagg

SEQ ID NO: 57938 - DNA, 20 bp, synthetic construct
  misc_feature 1..20: note = CRISPR gRNA sequence
  source 1..20: mol_type = other DNA
aataggtcctcactcaggca

SEQ ID NO: 57939 - DNA, 20 bp, synthetic construct
  misc_feature 1..20: note = CRISPR gRNA sequence
  source 1..20: mol_type = other DNA
taggtcctcactcaggcaga

SEQ ID NO: 57940 - DNA, 20 bp, synthetic construct
  misc_feature 1..20: note = CRISPR gRNA sequence
  source 1..20: mol_type = other DNA
ctcactcaggcagagagtct

SEQ ID NO: 57941 - DNA, 20 bp, synthetic construct
  misc_feature 1..20: note = CRISPR gRNA sequence
  source 1..20: mol_type = other DNA
catgctcacaccatgatcct

SEQ ID NO: 57942 - DNA, 20 bp, synthetic construct
  misc_feature 1..20: note = CRISPR gRNA sequence
  source 1..20: mol_type = other DNA
atgctcacaccatgatcctc

SEQ ID NO: 57943 - DNA, 20 bp, synthetic construct
  misc_feature 1..20: note = CRISPR gRNA sequence
  source 1..20: mol_type = other DNA
ctcacaccatgatcctcagg

SEQ ID NO: 57944 - DNA, 20 bp, synthetic construct
  misc_feature 1..20: note = CRISPR gRNA sequence
  source 1..20: mol_type = other DNA
tcacaccatgatcctcaggc

SEQ ID NO: 57945 - DNA, 20 bp, synthetic construct
  misc_feature 1..20: note = CRISPR gRNA sequence
  source 1..20: mol_type = other DNA
cacaccatgatcctcaggca

SEQ ID NO: 57946 - DNA, 20 bp, synthetic construct
  misc_feature 1..20: note = CRISPR gRNA sequence
  source 1..20: mol_type = other DNA
cagggatcaccacctccact

SEQ ID NO: 57947 - DNA, 20 bp, synthetic construct
  misc_feature 1..20: note = CRISPR gRNA sequence
  source 1..20: mol_type = other DNA
ggatcaccacctccactaag

SEQ ID NO: 57948 - DNA, 20 bp, synthetic construct
  misc_feature 1..20: note = CRISPR gRNA sequence
  source 1..20: mol_type = other DNA
caccacctccactaagcaga

SEQ ID NO: 57949 - DNA, 20 bp, synthetic construct
  misc_feature 1..20: note = CRISPR gRNA sequence
  source 1..20: mol_type = other DNA
acctccactaagcagacgga

SEQ ID NO: 57950 - DNA, 20 bp, synthetic construct
  misc_feature 1..20: note = CRISPR gRNA sequence
  source 1..20: mol_type = other DNA
ctaagcagacggaaagacca

SEQ ID NO: 57951 - DNA, 20 bp, synthetic construct
  misc_feature 1..20: note = CRISPR gRNA sequence
  source 1..20: mol_type = other DNA
cagacggaaagaccatggcc

SEQ ID NO: 57952 - DNA, 20 bp, synthetic construct
  misc_feature 1..20: note = CRISPR gRNA sequence
  source 1..20: mol_type = other DNA
agacggaaagaccatggcca

SEQ ID NO: 57953 - DNA, 20 bp, synthetic construct
  misc_feature 1..20: note = CRISPR gRNA sequence
  source 1..20: mol_type = other DNA
cggaaagaccatggccaagg

SEQ ID NO: 57954 - DNA, 20 bp, synthetic construct
  misc_feature 1..20: note = CRISPR gRNA sequence
  source 1..20: mol_type = other DNA
ggaaagaccatggccaagga

SEQ ID NO: 57955 - DNA, 20 bp, synthetic construct
  misc_feature 1..20: note = CRISPR gRNA sequence
  source 1..20: mol_type = other DNA
gaaagaccatggccaaggaa

SEQ ID NO: 57956 - DNA, 20 bp, synthetic construct
  misc_feature 1..20: note = CRISPR gRNA sequence
  source 1..20: mol_type = other DNA
accatggccaaggaagggca

SEQ ID NO: 57957 - DNA, 20 bp, synthetic construct
  misc_feature 1..20: note = CRISPR gRNA sequence
  source 1..20: mol_type = other DNA
ccatggccaaggaagggcaa

SEQ ID NO: 57958 - DNA, 20 bp, synthetic construct
  misc_feature 1..20: note = CRISPR gRNA sequence
  source 1..20: mol_type = other DNA
catggccaaggaagggcaaa

SEQ ID NO: 57959 - DNA, 20 bp, synthetic construct
  misc_feature 1..20: note = CRISPR gRNA sequence
  source 1..20: mol_type = other DNA
aagggcaaagggtgtgccca

SEQ ID NO: 57960 - DNA, 20 bp, synthetic construct
  misc_feature 1..20: note = CRISPR gRNA sequence
  source 1..20: mol_type = other DNA
agggtgtgcccacagtcaca

SEQ ID NO: 57961 - DNA, 20 bp, synthetic construct
  misc_feature 1..20: note = CRISPR gRNA sequence
  source 1..20: mol_type = other DNA
tgtgcccacagtcacacagc

SEQ ID NO: 57962 - DNA, 20 bp, synthetic construct
  misc_feature 1..20: note = CRISPR gRNA sequence
  source 1..20: mol_type = other DNA
gtcacacagcaagtccatga

SEQ ID NO: 57963 - DNA, 20 bp, synthetic construct
  misc_feature 1..20: note = CRISPR gRNA sequence
  source 1..20: mol_type = other DNA
cacacagcaagtccatgaca

SEQ ID NO: 57964 - DNA, 20 bp, synthetic construct
  misc_feature 1..20: note = CRISPR gRNA sequence
  source 1..20: mol_type = other DNA
acacagcaagtccatgacag

SEQ ID NO: 57965 - DNA, 20 bp, synthetic construct
  misc_feature 1..20: note = CRISPR gRNA sequence
  source 1..20: mol_type = other DNA
cagcaagtccatgacagagg

SEQ ID NO: 57966 - DNA, 20 bp, synthetic construct
  misc_feature 1..20: note = CRISPR gRNA sequence
  source 1..20: mol_type = other DNA
agcaagtccatgacagaggc

SEQ ID NO: 57967 - DNA, 20 bp, synthetic construct
  misc_feature 1..20: note = CRISPR gRNA sequence
  source 1..20: mol_type = other DNA
caagtccatgacagaggcag

SEQ ID NO: 57968 - DNA, 20 bp, synthetic construct
  misc_feature 1..20: note = CRISPR gRNA sequence
  source 1..20: mol_type = other DNA
aagtccatgacagaggcagg

SEQ ID NO: 57969 - DNA, 20 bp, synthetic construct
  misc_feature 1..20: note = CRISPR gRNA sequence
  source 1..20: mol_type = other DNA
gtccatgacagaggcaggag

SEQ ID NO: 57970 - DNA, 20 bp, synthetic construct
  misc_feature 1..20: note = CRISPR gRNA sequence
  source 1..20: mol_type = other DNA
acagaggcaggaggagaact

SEQ ID NO: 57971 - DNA, 20 bp, synthetic construct
  misc_feature 1..20: note = CRISPR gRNA sequence
  source 1..20: mol_type = other DNA
cagaggcaggaggagaactg

SEQ ID NO: 57972 - DNA, 20 bp, synthetic construct
  misc_feature 1..20: note = CRISPR gRNA sequence
  source 1..20: mol_type = other DNA
aactgaggtttcttgcctcc

SEQ ID NO: 57973 - DNA, 20 bp, synthetic construct
  misc_feature 1..20: note = CRISPR gRNA sequence
  source 1..20: mol_type = other DNA
actgaggtttcttgcctccc

SEQ ID NO: 57974 - DNA, 20 bp, synthetic construct
  misc_feature 1..20: note = CRISPR gRNA sequence
  source 1..20: mol_type = other DNA
aggtttcttgcctcccaggc

SEQ ID NO: 57975 - DNA, 20 bp, synthetic construct
  misc_feature 1..20: note = CRISPR gRNA sequence
  source 1..20: mol_type = other DNA
tcccaggccagtaaatttcc

SEQ ID NO: 57976 - DNA, 20 bp, synthetic construct
  misc_feature 1..20: note = CRISPR gRNA sequence
  source 1..20: mol_type = other DNA
cccaggccagtaaatttcca

SEQ ID NO: 57977 - DNA, 20 bp, synthetic construct
  misc_feature 1..20: note = CRISPR gRNA sequence
  source 1..20: mol_type = other DNA
ccagtaaatttccaaggcct

SEQ ID NO: 57978 - DNA, 20 bp, synthetic construct
  misc_feature 1..20: note = CRISPR gRNA sequence
  source 1..20: mol_type = other DNA
agtaaatttccaaggccttg

SEQ ID NO: 57979 - DNA, 20 bp, synthetic construct
  misc_feature 1..20: note = CRISPR gRNA sequence
  source 1..20: mol_type = other DNA
gtaaatttccaaggccttgg

SEQ ID NO: 57980 - DNA, 20 bp, synthetic construct
  misc_feature 1..20: note = CRISPR gRNA sequence
  source 1..20: mol_type = other DNA
tttccaaggccttggaggcc

SEQ ID NO: 57981 - DNA, 20 bp, synthetic construct
  misc_feature 1..20: note = CRISPR gRNA sequence
  source 1..20: mol_type = other DNA
caaggccttggaggcctaga

SEQ ID NO: 57982 - DNA, 20 bp, synthetic construct
  misc_feature 1..20: note = CRISPR gRNA sequence
  source 1..20: mol_type = other DNA
cttggaggcctagatggcac

SEQ ID NO: 57983 - DNA, 20 bp, synthetic construct
  misc_feature 1..20: note = CRISPR gRNA sequence
  source 1..20: mol_type = other DNA
aggcctagatggcaccagac

SEQ ID NO: 57984 - DNA, 20 bp, synthetic construct
  misc_feature 1..20: note = CRISPR gRNA sequence
  source 1..20: mol_type = other DNA
ggcctagatggcaccagaca

SEQ ID NO: 57985 - DNA, 20 bp, synthetic construct
  misc_feature 1..20: note = CRISPR gRNA sequence
  source 1..20: mol_type = other DNA
agatggcaccagacaaggct

SEQ ID NO: 57986 - DNA, 20 bp, synthetic construct
  misc_feature 1..20: note = CRISPR gRNA sequence
  source 1..20: mol_type = other DNA
accagacaaggctaagtccc

SEQ ID NO: 57987 - DNA, 20 bp, synthetic construct
  misc_feature 1..20: note = CRISPR gRNA sequence
  source 1..20: mol_type = other DNA
ccctggattttgtgtgatct

SEQ ID NO: 57988 - DNA, 20 bp, synthetic construct
  misc_feature 1..20: note = CRISPR gRNA sequence
  source 1..20: mol_type = other DNA
attttgtgtgatctcggcaa

SEQ ID NO: 57989 - DNA, 20 bp, synthetic construct
  misc_feature 1..20: note = CRISPR gRNA sequence
  source 1..20: mol_type = other DNA
ttttgtgtgatctcggcaaa

SEQ ID NO: 57990 - DNA, 20 bp, synthetic construct
  misc_feature 1..20: note = CRISPR gRNA sequence
  source 1..20: mol_type = other DNA
gtgatctcggcaaaaggatg

SEQ ID NO: 57991 - DNA, 20 bp, synthetic construct
  misc_feature 1..20: note = CRISPR gRNA sequence
  source 1..20: mol_type = other DNA
tcggcaaaaggatgtggcca

SEQ ID NO: 57992 - DNA, 20 bp, synthetic construct
  misc_feature 1..20: note = CRISPR gRNA sequence
  source 1..20: mol_type = other DNA
aaaaggatgtggccatagcc

SEQ ID NO: 57993 - DNA, 20 bp, synthetic construct
  misc_feature 1..20: note = CRISPR gRNA sequence
  source 1..20: mol_type = other DNA
aaaggatgtggccatagcct

SEQ ID NO: 57994 - DNA, 20 bp, synthetic construct
  misc_feature 1..20: note = CRISPR gRNA sequence
  source 1..20: mol_type = other DNA
aaggatgtggccatagccta

SEQ ID NO: 57995 - DNA, 20 bp, synthetic construct
  misc_feature 1..20: note = CRISPR gRNA sequence
  source 1..20: mol_type = other DNA
ctagggcataacttcttttc

SEQ ID NO: 57996 - DNA, 20 bp, synthetic construct
  misc_feature 1..20: note = CRISPR gRNA sequence
  source 1..20: mol_type = other DNA
tagggcataacttcttttcc

SEQ ID NO: 57997 - DNA, 20 bp, synthetic construct
  misc_feature 1..20: note = CRISPR gRNA sequence
  source 1..20: mol_type = other DNA
ataacttcttttccaggcta

SEQ ID NO: 57998 - DNA, 20 bp, synthetic construct
  misc_feature 1..20: note = CRISPR gRNA sequence
  source 1..20: mol_type = other DNA
cttttccaggctatggtgtc

SEQ ID NO: 57999 - DNA, 20 bp, synthetic construct
  misc_feature 1..20: note = CRISPR gRNA sequence
  source 1..20: mol_type = other DNA
cagcatccatgctacccatg

SEQ ID NO: 58000 - DNA, 20 bp, synthetic construct
  misc_feature 1..20: note = CRISPR gRNA sequence
  source 1..20: mol_type = other DNA
ccatgctacccatgaagaaa

SEQ ID NO: 58001 - DNA, 20 bp, synthetic construct
  misc_feature 1..20: note = CRISPR gRNA sequence
  source 1..20: mol_type = other DNA
ctacccatgaagaaatggtc

SEQ ID NO: 58002 - DNA, 20 bp, synthetic construct
  misc_feature 1..20: note = CRISPR gRNA sequence
  source 1..20: mol_type = other DNA
tacccatgaagaaatggtcc

SEQ ID NO: 58003 - DNA, 20 bp, synthetic construct
  misc_feature 1..20: note = CRISPR gRNA sequence
  source 1..20: mol_type = other DNA
acccatgaagaaatggtcca

SEQ ID NO: 58004 - DNA, 20 bp, synthetic construct
  misc_feature 1..20: note = CRISPR gRNA sequence
  source 1..20: mol_type = other DNA
catgaagaaatggtccaggg

SEQ ID NO: 58005 - DNA, 20 bp, synthetic construct
  misc_feature 1..20: note = CRISPR gRNA sequence
  source 1..20: mol_type = other DNA
agaaatggtccagggcagca

SEQ ID NO: 58006 - DNA, 20 bp, synthetic construct
  misc_feature 1..20: note = CRISPR gRNA sequence
  source 1..20: mol_type = other DNA
ggtccagggcagcatggcac

SEQ ID NO: 58007 - DNA, 20 bp, synthetic construct
  misc_feature 1..20: note = CRISPR gRNA sequence
  source 1..20: mol_type = other DNA
cagggcagcatggcaccaga

SEQ ID NO: 58008 - DNA, 20 bp, synthetic construct
  misc_feature 1..20: note = CRISPR gRNA sequence
  source 1..20: mol_type = other DNA
ggcagcatggcaccagatgg

SEQ ID NO: 58009 - DNA, 20 bp, synthetic construct
  misc_feature 1..20: note = CRISPR gRNA sequence
  source 1..20: mol_type = other DNA
gcatggcaccagatggaagt

SEQ ID NO: 58010 - DNA, 20 bp, synthetic construct
  misc_feature 1..20: note = CRISPR gRNA sequence
  source 1..20: mol_type = other DNA
tggcaccagatggaagtaag

SEQ ID NO: 58011 - DNA, 20 bp, synthetic construct
  misc_feature 1..20: note = CRISPR gRNA sequence
  source 1..20: mol_type = other DNA
agatggaagtaagtagtgcc

SEQ ID NO: 58012 - DNA, 20 bp, synthetic construct
  misc_feature 1..20: note = CRISPR gRNA sequence
  source 1..20: mol_type = other DNA
ggaagtaagtagtgcctgga

SEQ ID NO: 58013 - DNA, 20 bp, synthetic construct
  misc_feature 1..20: note = CRISPR gRNA sequence
  source 1..20: mol_type = other DNA
tgcctggatggtgtgatttc

SEQ ID NO: 58014 - DNA, 20 bp, synthetic construct
  misc_feature 1..20: note = CRISPR gRNA sequence
  source 1..20: mol_type = other DNA
tcatcctcaaatttctcctc

SEQ ID NO: 58015 - DNA, 20 bp, synthetic construct
  misc_feature 1..20: note = CRISPR gRNA sequence
  source 1..20: mol_type = other DNA
cctcaaatttctcctccagc

SEQ ID NO: 58016 - DNA, 20 bp, synthetic construct
  misc_feature 1..20: note = CRISPR gRNA sequence
  source 1..20: mol_type = other DNA
aatacctttgtttccatcat

SEQ ID NO: 58017 - DNA, 20 bp, synthetic construct
  misc_feature 1..20: note = CRISPR gRNA sequence
  source 1..20: mol_type = other DNA
tcattagtgttctatcccct

SEQ ID NO: 58018 - DNA, 20 bp, synthetic construct
  misc_feature 1..20: note = CRISPR gRNA sequence
  source 1..20: mol_type = other DNA
cattagtgttctatcccctt

SEQ ID NO: 58019 - DNA, 20 bp, synthetic construct
  misc_feature 1..20: note = CRISPR gRNA sequence
  source 1..20: mol_type = other DNA
gatatgacacaaatctcttt

SEQ ID NO: 58020 - DNA, 20 bp, synthetic construct
  misc_feature 1..20: note = CRISPR gRNA sequence
  source 1..20: mol_type = other DNA
atatgacacaaatctcttta

SEQ ID NO: 58021 - DNA, 20 bp, synthetic construct
  misc_feature 1..20: note = CRISPR gRNA sequence
  source 1..20: mol_type = other DNA
tctttaaggctaaccatcct

SEQ ID NO: 58022 - DNA, 20 bp, synthetic construct
  misc_feature 1..20: note = CRISPR gRNA sequence
  source 1..20: mol_type = other DNA
ctttaaggctaaccatcctc

SEQ ID NO: 58023 - DNA, 20 bp, synthetic construct
  misc_feature 1..20: note = CRISPR gRNA sequence
  source 1..20: mol_type = other DNA
ttaaggctaaccatcctcag

SEQ ID NO: 58024 - DNA, 20 bp, synthetic construct
  misc_feature 1..20: note = CRISPR gRNA sequence
  source 1..20: mol_type = other DNA
ctaaccatcctcaggagaaa

SEQ ID NO: 58025 - DNA, 20 bp, synthetic construct
  misc_feature 1..20: note = CRISPR gRNA sequence
  source 1..20: mol_type = other DNA
tcctcaggagaaaaagcaca

SEQ ID NO: 58026 - DNA, 20 bp, synthetic construct
  misc_feature 1..20: note = CRISPR gRNA sequence
  source 1..20: mol_type = other DNA
aaagcacatggcatcattat

SEQ ID NO: 58027 - DNA, 20 bp, synthetic construct
  misc_feature 1..20: note = CRISPR gRNA sequence
  source 1..20: mol_type = other DNA
tggcatcattatcagtcatt

SEQ ID NO: 58028 - DNA, 20 bp, synthetic construct
  misc_feature 1..20: note = CRISPR gRNA sequence
  source 1..20: mol_type = other DNA
atcagtcattgagatttcca

SEQ ID NO: 58029 - DNA, 20 bp, synthetic construct
  misc_feature 1..20: note = CRISPR gRNA sequence
  source 1..20: mol_type = other DNA
tcagtcattgagatttccat

SEQ ID NO: 58030 - DNA, 20 bp, synthetic construct
  misc_feature 1..20: note = CRISPR gRNA sequence
  source 1..20: mol_type = other DNA
cagtcattgagatttccatg

SEQ ID NO: 58031 - DNA, 20 bp, synthetic construct
  misc_feature 1..20: note = CRISPR gRNA sequence
  source 1..20: mol_type = other DNA
atttccatggggaataatct

SEQ ID NO: 58032 - DNA, 20 bp, synthetic construct
  misc_feature 1..20: note = CRISPR gRNA sequence
  source 1..20: mol_type = other DNA
ttccatggggaataatcttg

SEQ ID NO: 58033 - DNA, 20 bp, synthetic construct
  misc_feature 1..20: note = CRISPR gRNA sequence
  source 1..20: mol_type = other DNA
atggggaataatcttggaga

SEQ ID NO: 58034 - DNA, 20 bp, synthetic construct
  misc_feature 1..20: note = CRISPR gRNA sequence
  source 1..20: mol_type = other DNA
ggggaataatcttggagaca

SEQ ID NO: 58035 - DNA, 20 bp, synthetic construct
  misc_feature 1..20: note = CRISPR gRNA sequence
  source 1..20: mol_type = other DNA
gggaataatcttggagacag

SEQ ID NO: 58036 - DNA, 20 bp, synthetic construct
  misc_feature 1..20: note = CRISPR gRNA sequence
  source 1..20: mol_type = other DNA
atcttggagacagaggacga

SEQ ID NO: 58037 - DNA, 20 bp, synthetic construct
  misc_feature 1..20: note = CRISPR gRNA sequence
  source 1..20: mol_type = other DNA
agacagaggacgatggttga

SEQ ID NO: 58038 - DNA, 20 bp, synthetic construct
  misc_feature 1..20: note = CRISPR gRNA sequence
  source 1..20: mol_type = other DNA
gacgatggttgaaagatcca

SEQ ID NO: 58039 - DNA, 20 bp, synthetic construct
  misc_feature 1..20: note = CRISPR gRNA sequence
  source 1..20: mol_type = other DNA
tggttgaaagatccatggcc

SEQ ID NO: 58040 - DNA, 20 bp, synthetic construct
  misc_feature 1..20: note = CRISPR gRNA sequence
  source 1..20: mol_type = other DNA
gctctgttactaattctctg

SEQ ID NO: 58041 - DNA, 20 bp, synthetic construct
  misc_feature 1..20: note = CRISPR gRNA sequence
  source 1..20: mol_type = other DNA
ctgttactaattctctgtgg

SEQ ID NO: 58042 - DNA, 20 bp, synthetic construct
  misc_feature 1..20: note = CRISPR gRNA sequence
  source 1..20: mol_type = other DNA
tgttactaattctctgtggt

SEQ ID NO: 58043 - DNA, 20 bp, synthetic construct
  misc_feature 1..20: note = CRISPR gRNA sequence
  source 1..20: mol_type = other DNA
taattctctgtggtaggcat

SEQ ID NO: 58044 - DNA, 20 bp, synthetic construct
  misc_feature 1..20: note = CRISPR gRNA sequence
  source 1..20: mol_type = other DNA
aattctctgtggtaggcatt

SEQ ID NO: 58045 - DNA, 20 bp, synthetic construct
  misc_feature 1..20: note = CRISPR gRNA sequence
  source 1..20: mol_type = other DNA
attctctgtggtaggcatta

SEQ ID NO: 58046 - DNA, 20 bp, synthetic construct
  misc_feature 1..20: note = CRISPR gRNA sequence
  source 1..20: mol_type = other DNA
gtaggcattagggctgttca

SEQ ID NO: 58047 - DNA, 20 bp, synthetic construct
  misc_feature 1..20: note = CRISPR gRNA sequence
  source 1..20: mol_type = other DNA
gatactctttctcctctttc

SEQ ID NO: 58048 - DNA, 20 bp, synthetic construct
  misc_feature 1..20: note = CRISPR gRNA sequence
  source 1..20: mol_type = other DNA
atactctttctcctctttct

SEQ ID NO: 58049 - DNA, 20 bp, synthetic construct
  misc_feature 1..20: note = CRISPR gRNA sequence
  source 1..20: mol_type = other DNA
ttctcctctttctaggcctt

SEQ ID NO: 58050 - DNA, 20 bp, synthetic construct
  misc_feature 1..20: note = CRISPR gRNA sequence
  source 1..20: mol_type = other DNA
tcctctttctaggcctttgg

SEQ ID NO: 58051 - DNA, 20 bp, synthetic construct
  misc_feature 1..20: note = CRISPR gRNA sequence
  source 1..20: mol_type = other DNA
cctctttctaggcctttggt

SEQ ID NO: 58052 - DNA, 20 bp, synthetic construct
  misc_feature 1..20: note = CRISPR gRNA sequence
  source 1..20: mol_type = other DNA
cttctctgcctccttgaaat

SEQ ID NO: 58053 - DNA, 20 bp, synthetic construct
  misc_feature 1..20: note = CRISPR gRNA sequence
  source 1..20: mol_type = other DNA
ttctctgcctccttgaaatt

SEQ ID NO: 58054 - DNA, 20 bp, synthetic construct
  misc_feature 1..20: note = CRISPR gRNA sequence
  source 1..20: mol_type = other DNA
tgcctccttgaaattgggca

SEQ ID NO: 58055 - DNA, 20 bp, synthetic construct
  misc_feature 1..20: note = CRISPR gRNA sequence
  source 1..20: mol_type = other DNA
cacagccatgaaacttgctt

SEQ ID NO: 58056 - DNA, 20 bp, synthetic construct
  misc_feature 1..20: note = CRISPR gRNA sequence
  source 1..20: mol_type = other DNA
gtcaatgaaacatgctaaaa

SEQ ID NO: 58057 - DNA, 20 bp, synthetic construct
  misc_feature 1..20: note = CRISPR gRNA sequence
  source 1..20: mol_type = other DNA
aaagactcatgtcatgcctg

SEQ ID NO: 58058 - DNA, 20 bp, synthetic construct
  misc_feature 1..20: note = CRISPR gRNA sequence
  source 1..20: mol_type = other DNA
gtcatgcctgtagttgtttt

SEQ ID NO: 58059 - DNA, 20 bp, synthetic construct
  misc_feature 1..20: note = CRISPR gRNA sequence
  source 1..20: mol_type = other DNA
ctgtagttgttttaagaacc

SEQ ID NO: 58060 - DNA, 20 bp, synthetic construct
  misc_feature 1..20: note = CRISPR gRNA sequence
  source 1..20: mol_type = other DNA
tgtagttgttttaagaacca

SEQ ID NO: 58061 - DNA, 20 bp, synthetic construct
  misc_feature 1..20: note = CRISPR gRNA sequence
  source 1..20: mol_type = other DNA
aagaaccaaggtgtaattga

SEQ ID NO: 58062 - DNA, 20 bp, synthetic construct
  misc_feature 1..20: note = CRISPR gRNA sequence
  source 1..20: mol_type = other DNA
ctttttctttttttctactc

SEQ ID NO: 58063 - DNA, 20 bp, synthetic construct
  misc_feature 1..20: note = CRISPR gRNA sequence
  source 1..20: mol_type = other DNA
tttttctttttttctactcc

SEQ ID NO: 58064 - DNA, 20 bp, synthetic construct
  misc_feature 1..20: note = CRISPR gRNA sequence
  source 1..20: mol_type = other DNA
ttttctttttttctactcca

SEQ ID NO: 58065 - DNA, 20 bp, synthetic construct
  misc_feature 1..20: note = CRISPR gRNA sequence
  source 1..20: mol_type = other DNA
tttttttctactccagggac

SEQ ID NO: 58066 - DNA, 20 bp, synthetic construct
  misc_feature 1..20: note = CRISPR gRNA sequence
  source 1..20: mol_type = other DNA
accagaaatattgcaaatca

SEQ ID NO: 58067 - DNA, 20 bp, synthetic construct
  misc_feature 1..20: note = CRISPR gRNA sequence
  source 1..20: mol_type = other DNA
gcaaatcatggctaccctgt

SEQ ID NO: 58068 - DNA, 20 bp, synthetic construct
  misc_feature 1..20: note = CRISPR gRNA sequence
  source 1..20: mol_type = other DNA
catggctaccctgttagcct

SEQ ID NO: 58069 - DNA, 20 bp, synthetic construct
  misc_feature 1..20: note = CRISPR gRNA sequence
  source 1..20: mol_type = other DNA
ctaccctgttagcctgagtg

SEQ ID NO: 58070 - DNA, 20 bp, synthetic construct
  misc_feature 1..20: note = CRISPR gRNA sequence
  source 1..20: mol_type = other DNA
taccctgttagcctgagtgt

SEQ ID NO: 58071 - DNA, 20 bp, synthetic construct
  misc_feature 1..20: note = CRISPR gRNA sequence
  source 1..20: mol_type = other DNA
ccctgttagcctgagtgtgg

SEQ ID NO: 58072 - DNA, 20 bp, synthetic construct
  misc_feature 1..20: note = CRISPR gRNA sequence
  source 1..20: mol_type = other DNA
gttagcctgagtgtgggaga

SEQ ID NO: 58073 - DNA, 20 bp, synthetic construct
  misc_feature 1..20: note = CRISPR gRNA sequence
  source 1..20: mol_type = other DNA
ttagcctgagtgtgggagac

SEQ ID NO: 58074 - DNA, 20 bp, synthetic construct
  misc_feature 1..20: note = CRISPR gRNA sequence
  source 1..20: mol_type = other DNA
gtgtgggagacaggatgatg

SEQ ID NO: 58075 - DNA, 20 bp, synthetic construct
  misc_feature 1..20: note = CRISPR gRNA sequence
  source 1..20: mol_type = other DNA
gtgggagacaggatgatgtg

SEQ ID NO: 58076 - DNA, 20 bp, synthetic construct
  misc_feature 1..20: note = CRISPR gRNA sequence
  source 1..20: mol_type = other DNA
tgggagacaggatgatgtgg

SEQ ID NO: 58077 - DNA, 20 bp, synthetic construct
  misc_feature 1..20: note = CRISPR gRNA sequence
  source 1..20: mol_type = other DNA
ggagacaggatgatgtggag

SEQ ID NO: 58078 - DNA, 20 bp, synthetic construct
  misc_feature 1..20: note = CRISPR gRNA sequence
  source 1..20: mol_type = other DNA
atgatgtggaggagcaatcc

SEQ ID NO: 58079 - DNA, 20 bp, synthetic construct
  misc_feature 1..20: note = CRISPR gRNA sequence
  source 1..20: mol_type = other DNA
caatcccagtcaatccacac

SEQ ID NO: 58080 - DNA, 20 bp, synthetic construct
  misc_feature 1..20: note = CRISPR gRNA sequence
  source 1..20: mol_type = other DNA
cccagtcaatccacacgaga

SEQ ID NO: 58081 - DNA, 20 bp, synthetic construct
  misc_feature 1..20: note = CRISPR gRNA sequence
  source 1..20: mol_type = other DNA
ccagtcaatccacacgagac

SEQ ID NO: 58082 - DNA, 20 bp, synthetic construct
  misc_feature 1..20: note = CRISPR gRNA sequence
  source 1..20: mol_type = other DNA
gtcaatccacacgagacagg

SEQ ID NO: 58083 - DNA, 20 bp, synthetic construct
  misc_feature 1..20: note = CRISPR gRNA sequence
  source 1..20: mol_type = other DNA
atccacacgagacaggaagc

SEQ ID NO: 58084 - DNA, 20 bp, synthetic construct
  misc_feature 1..20: note = CRISPR gRNA sequence
  source 1..20: mol_type = other DNA
ccacacgagacaggaagcaa

SEQ ID NO: 58085 - DNA, 20 bp, synthetic construct
  misc_feature 1..20: note = CRISPR gRNA sequence
  source 1..20: mol_type = other DNA
cacgagacaggaagcaagag

SEQ ID NO: 58086 - DNA, 20 bp, synthetic construct
  misc_feature 1..20: note = CRISPR gRNA sequence
  source 1..20: mol_type = other DNA
acgagacaggaagcaagagc

SEQ ID NO: 58087 - DNA, 20 bp, synthetic construct
  misc_feature 1..20: note = CRISPR gRNA sequence
  source 1..20: mol_type = other DNA
aaataaacttttgttgccat

SEQ ID NO: 58088 - DNA, 20 bp, synthetic construct
  misc_feature 1..20: note = CRISPR gRNA sequence
  source 1..20: mol_type = other DNA
cttttgttgccatgagtcac

SEQ ID NO: 58089 - DNA, 20 bp, synthetic construct
  misc_feature 1..20: note = CRISPR gRNA sequence
  source 1..20: mol_type = other DNA
ttttgttgccatgagtcact

SEQ ID NO: 58090 - DNA, 20 bp, synthetic construct
  misc_feature 1..20: note = CRISPR gRNA sequence
  source 1..20: mol_type = other DNA
gccatgagtcactgggactt

SEQ ID NO: 58091 - DNA, 20 bp, synthetic construct
  misc_feature 1..20: note = CRISPR gRNA sequence
  source 1..20: mol_type = other DNA
catgagtcactgggactttg

SEQ ID NO: 58092 - DNA, 20 bp, synthetic construct
  misc_feature 1..20: note = CRISPR gRNA sequence
  source 1..20: mol_type = other DNA
atgagtcactgggactttgg

SEQ ID NO: 58093 - DNA, 20 bp, synthetic construct
  misc_feature 1..20: note = CRISPR gRNA sequence
  source 1..20: mol_type = other DNA
tgagtcactgggactttgga

SEQ ID NO: 58094 - DNA, 20 bp, synthetic construct
  misc_feature 1..20: note = CRISPR gRNA sequence
  source 1..20: mol_type = other DNA
tttggagggtgcatgtacta

SEQ ID NO: 58095 - DNA, 20 bp, synthetic construct
  misc_feature 1..20: note = CRISPR gRNA sequence
  source 1..20: mol_type = other DNA
gcatgtactacagtgtaacc

SEQ ID NO: 58096 - DNA, 20 bp, synthetic construct
  misc_feature 1..20: note = CRISPR gRNA sequence
  source 1..20: mol_type = other DNA
cagtgtaacctggcctatcc

SEQ ID NO: 58097 - DNA, 20 bp, synthetic construct
  misc_feature 1..20: note = CRISPR gRNA sequence
  source 1..20: mol_type = other DNA
tatcctagctgatacactca

SEQ ID NO: 58098 - DNA, 20 bp, synthetic construct
  misc_feature 1..20: note = CRISPR gRNA sequence
  source 1..20: mol_type = other DNA
tacactcatagtgtgacctt

SEQ ID NO: 58099 - DNA, 20 bp, synthetic construct
  misc_feature 1..20: note = CRISPR gRNA sequence
  source 1..20: mol_type = other DNA
ctcatagtgtgaccttgagc

SEQ ID NO: 58100 - DNA, 20 bp, synthetic construct
  misc_feature 1..20: note = CRISPR gRNA sequence
  source 1..20: mol_type = other DNA
agcaagcctttttcctatat

SEQ ID NO: 58101 - DNA, 20 bp, synthetic construct
  misc_feature 1..20: note = CRISPR gRNA sequence
  source 1..20: mol_type = other DNA
cctttttcctatataagcct

SEQ ID NO: 58102 - DNA, 20 bp, synthetic construct
  misc_feature 1..20: note = CRISPR gRNA sequence
  source 1..20: mol_type = other DNA
cagtcataccatctctaaaa

SEQ ID NO: 58103 - DNA, 20 bp, synthetic construct
  misc_feature 1..20: note = CRISPR gRNA sequence
  source 1..20: mol_type = other DNA
agtcataccatctctaaaat

SEQ ID NO: 58104 - DNA, 20 bp, synthetic construct
  misc_feature 1..20: note = CRISPR gRNA sequence
  source 1..20: mol_type = other DNA
cataccatctctaaaatggg

SEQ ID NO: 58105 - DNA, 20 bp, synthetic construct
  misc_feature 1..20: note = CRISPR gRNA sequence
  source 1..20: mol_type = other DNA
catctctaaaatgggtagat

SEQ ID NO: 58106 - DNA, 20 bp, synthetic construct
  misc_feature 1..20: note = CRISPR gRNA sequence
  source 1..20: mol_type = other DNA
tacattctcatgctgaatga

SEQ ID NO: 58107 - DNA, 20 bp, synthetic construct
  misc_feature 1..20: note = CRISPR gRNA sequence
  source 1..20: mol_type = other DNA
tctcatgctgaatgatggtc

SEQ ID NO: 58108 - DNA, 20 bp, synthetic construct
  misc_feature 1..20: note = CRISPR gRNA sequence
  source 1..20: mol_type = other DNA
ctcatgctgaatgatggtca

SEQ ID NO: 58109 - DNA, 20 bp, synthetic construct
  misc_feature 1..20: note = CRISPR gRNA sequence
  source 1..20: mol_type = other DNA
tcatgctgaatgatggtcaa

SEQ ID NO: 58110 - DNA, 20 bp, synthetic construct
  misc_feature 1..20: note = CRISPR gRNA sequence
  source 1..20: mol_type = other DNA
tgctgaatgatggtcaaggg

SEQ ID NO: 58111 - DNA, 20 bp, synthetic construct
  misc_feature 1..20: note = CRISPR gRNA sequence
  source 1..20: mol_type = other DNA
gctgaatgatggtcaagggc

SEQ ID NO: 58112 - DNA, 20 bp, synthetic construct
  misc_feature 1..20: note = CRISPR gRNA sequence
  source 1..20: mol_type = other DNA
caagggcaggtttgttgtgt

SEQ ID NO: 58113 - DNA, 20 bp, synthetic construct
  misc_feature 1..20: note = CRISPR gRNA sequence
  source 1..20: mol_type = other DNA
aagggcaggtttgttgtgtt

SEQ ID NO: 58114 - DNA, 20 bp, synthetic construct
  misc_feature 1..20: note = CRISPR gRNA sequence
  source 1..20: mol_type = other DNA
agggcaggtttgttgtgttg

SEQ ID NO: 58115 - DNA, 20 bp, synthetic construct
  misc_feature 1..20: note = CRISPR gRNA sequence
  source 1..20: mol_type = other DNA
gggcaggtttgttgtgttgg

SEQ ID NO: 58116 - DNA, 20 bp, synthetic construct
  misc_feature 1..20: note = CRISPR gRNA sequence
  source 1..20: mol_type = other DNA
caggtttgttgtgttggggg

SEQ ID NO: 58117 - DNA, 20 bp, synthetic construct
  misc_feature 1..20: note = CRISPR gRNA sequence
  source 1..20: mol_type = other DNA
ttgttgtgttgggggcagcc

SEQ ID NO: 58118 - DNA, 20 bp, synthetic construct
  misc_feature 1..20: note = CRISPR gRNA sequence
  source 1..20: mol_type = other DNA
tgtgttgggggcagcccagt

SEQ ID NO: 58119 - DNA, 20 bp, synthetic construct
  misc_feature 1..20: note = CRISPR gRNA sequence
  source 1..20: mol_type = other DNA
gtgttgggggcagcccagta

SEQ ID NO: 58120 - DNA, 20 bp, synthetic construct
  misc_feature 1..20: note = CRISPR gRNA sequence
  source 1..20: mol_type = other DNA
ttgggggcagcccagtaagg

SEQ ID NO: 58121 - DNA, 20 bp, synthetic construct
  misc_feature 1..20: note = CRISPR gRNA sequence
  source 1..20: mol_type = other DNA
gcagcccagtaaggcagatt

SEQ ID NO: 58122 - DNA, 20 bp, synthetic construct
  misc_feature 1..20: note = CRISPR gRNA sequence
  source 1..20: mol_type = other DNA
cagcccagtaaggcagattt

SEQ ID NO: 58123 - DNA, 20 bp, synthetic construct
  misc_feature 1..20: note = CRISPR gRNA sequence
  source 1..20: mol_type = other DNA
cccagtaaggcagatttggg

SEQ ID NO: 58124 - DNA, 20 bp, synthetic construct
  misc_feature 1..20: note = CRISPR gRNA sequence
  source 1..20: mol_type = other DNA
ccagtaaggcagatttgggt

SEQ ID NO: 58125 - DNA, 20 bp, synthetic construct
  misc_feature 1..20: note = CRISPR gRNA sequence
  source 1..20: mol_type = other DNA
cagtaaggcagatttgggta

SEQ ID NO: 58126 - DNA, 20 bp, synthetic construct
  misc_feature 1..20: note = CRISPR gRNA sequence
  source 1..20: mol_type = other DNA
aggcagatttgggtagggac

SEQ ID NO: 58127 - DNA, 20 bp, synthetic construct
  misc_feature 1..20: note = CRISPR gRNA sequence
  source 1..20: mol_type = other DNA
atttgggtagggaccagtct

SEQ ID NO: 58128 - DNA, 20 bp, synthetic construct
  misc_feature 1..20: note = CRISPR gRNA sequence
  source 1..20: mol_type = other DNA
tgggtagggaccagtcttgg

SEQ ID NO: 58129 - DNA, 20 bp, synthetic construct
  misc_feature 1..20: note = CRISPR gRNA sequence
  source 1..20: mol_type = other DNA
gtagggaccagtcttggcag

SEQ ID NO: 58130 - DNA, 20 bp, synthetic construct
  misc_feature 1..20: note = CRISPR gRNA sequence
  source 1..20: mol_type = other DNA
tagggaccagtcttggcagt

SEQ ID NO: 58131 - DNA, 20 bp, synthetic construct
  misc_feature 1..20: note = CRISPR gRNA sequence
  source 1..20: mol_type = other DNA
gggaccagtcttggcagtag

SEQ ID NO: 58132 - DNA, 20 bp, synthetic construct
  misc_feature 1..20: note = CRISPR gRNA sequence
  source 1..20: mol_type = other DNA
cagtcttggcagtaggagaa

SEQ ID NO: 58133 - DNA, 20 bp, synthetic construct
  misc_feature 1..20: note = CRISPR gRNA sequence
  source 1..20: mol_type = other DNA
gcagtaggagaaaagtgacg

SEQ ID NO: 58134 - DNA, 20 bp, synthetic construct
  misc_feature 1..20: note = CRISPR gRNA sequence
  source 1..20: mol_type = other DNA
gtaggagaaaagtgacgaag

SEQ ID NO: 58135 - DNA, 20 bp, synthetic construct
  misc_feature 1..20: note = CRISPR gRNA sequence
  source 1..20: mol_type = other DNA
gagaaaagtgacgaagtaga

SEQ ID NO: 58136 - DNA, 20 bp, synthetic construct
  misc_feature 1..20: note = CRISPR gRNA sequence
  source 1..20: mol_type = other DNA
agaaaagtgacgaagtagat

SEQ ID NO: 58137 - DNA, 20 bp, synthetic construct
  misc_feature 1..20: note = CRISPR gRNA sequence
  source 1..20: mol_type = other DNA
aaaagtgacgaagtagatag

SEQ ID NO: 58138 - DNA, 20 bp, synthetic construct
  misc_feature 1..20: note = CRISPR gRNA sequence
  source 1..20: mol_type = other DNA
aaagtgacgaagtagatagg

SEQ ID NO: 58139 - DNA, 20 bp, synthetic construct
  misc_feature 1..20: note = CRISPR gRNA sequence
  source 1..20: mol_type = other DNA
aagtgacgaagtagatagga

SEQ ID NO: 58140 - DNA, 20 bp, synthetic construct
  misc_feature 1..20: note = CRISPR gRNA sequence
  source 1..20: mol_type = other DNA
agtgacgaagtagataggag

SEQ ID NO: 58141 - DNA, 20 bp, synthetic construct
  misc_feature 1..20: note = CRISPR gRNA sequence
  source 1..20: mol_type = other DNA
cgaagtagataggaggggaa

SEQ ID NO: 58142 - DNA, 20 bp, synthetic construct
  misc_feature 1..20: note = CRISPR gRNA sequence
  source 1..20: mol_type = other DNA
aagtagataggaggggaaaa

SEQ ID NO: 58143 - DNA, 20 bp, synthetic construct
  misc_feature 1..20: note = CRISPR gRNA sequence
  source 1..20: mol_type = other DNA
agtagataggaggggaaaag

SEQ ID NO: 58144 - DNA, 20 bp, synthetic construct
  misc_feature 1..20: note = CRISPR gRNA sequence
  source 1..20: mol_type = other DNA
tagataggaggggaaaagag

SEQ ID NO: 58145 - DNA, 20 bp, synthetic construct
  misc_feature 1..20: note = CRISPR gRNA sequence
  source 1..20: mol_type = other DNA
agataggaggggaaaagagg

SEQ ID NO: 58146 - DNA, 20 bp, synthetic construct
  misc_feature 1..20: note = CRISPR gRNA sequence
  source 1..20: mol_type = other DNA
ggaggggaaaagaggaggtg

SEQ ID NO: 58147 - DNA, 20 bp, synthetic construct
  misc_feature 1..20: note = CRISPR gRNA sequence
  source 1..20: mol_type = other DNA
gaggggaaaagaggaggtga

SEQ ID NO: 58148 - DNA, 20 bp, synthetic construct
  misc_feature 1..20: note = CRISPR gRNA sequence
  source 1..20: mol_type = other DNA
aggggaaaagaggaggtgaa

SEQ ID NO: 58149 - DNA, 20 bp, synthetic construct
  misc_feature 1..20: note = CRISPR gRNA sequence
  source 1..20: mol_type = other DNA
ggggaaaagaggaggtgaag

SEQ ID NO: 58150 - DNA, 20 bp, synthetic construct
  misc_feature 1..20: note = CRISPR gRNA sequence
  source 1..20: mol_type = other DNA
ggaaaagaggaggtgaaggg

SEQ ID NO: 58151 - DNA, 20 bp, synthetic construct
  misc_feature 1..20: note = CRISPR gRNA sequence
  source 1..20: mol_type = other DNA
aaaagaggaggtgaagggga

SEQ ID NO: 58152 - DNA, 20 bp, synthetic construct
  misc_feature 1..20: note = CRISPR gRNA sequence
  source 1..20: mol_type = other DNA
ggagagaaaaatcacctact

SEQ ID NO: 58153 - DNA, 20 bp, synthetic construct
  misc_feature 1..20: note = CRISPR gRNA sequence
  source 1..20: mol_type = other DNA
cttggtctcctcgttcatga

SEQ ID NO: 58154 - DNA, 20 bp, synthetic construct
  misc_feature 1..20: note = CRISPR gRNA sequence
  source 1..20: mol_type = other DNA
ttggtctcctcgttcatgat

SEQ ID NO: 58155 - DNA, 20 bp, synthetic construct
  misc_feature 1..20: note = CRISPR gRNA sequence
  source 1..20: mol_type = other DNA
ctcgttcatgataggtgctc

SEQ ID NO: 58156 - DNA, 20 bp, synthetic construct
  misc_feature 1..20: note = CRISPR gRNA sequence
  source 1..20: mol_type = other DNA
tcgttcatgataggtgctct

SEQ ID NO: 58157 - DNA, 20 bp, synthetic construct
  misc_feature 1..20: note = CRISPR gRNA sequence
  source 1..20: mol_type = other DNA
cgttcatgataggtgctcta

SEQ ID NO: 58158 - DNA, 20 bp, synthetic construct
  misc_feature 1..20: note = CRISPR gRNA sequence
  source 1..20: mol_type = other DNA
taggtgctctagggtcccca

SEQ ID NO: 58159 - DNA, 20 bp, synthetic construct
  misc_feature 1..20: note = CRISPR gRNA sequence
  source 1..20: mol_type = other DNA
ggtgctctagggtccccacg

SEQ ID NO: 58160 - DNA, 20 bp, synthetic construct
  misc_feature 1..20: note = CRISPR gRNA sequence
  source 1..20: mol_type = other DNA
tgctctagggtccccacgga

SEQ ID NO: 58161 - DNA, 20 bp, synthetic construct
  misc_feature 1..20: note = CRISPR gRNA sequence
  source 1..20: mol_type = other DNA
gctctagggtccccacggag

SEQ ID NO: 58162 - DNA, 20 bp, synthetic construct
  misc_feature 1..20: note = CRISPR gRNA sequence
  source 1..20: mol_type = other DNA
ctctagggtccccacggaga

SEQ ID NO: 58163 - DNA, 20 bp, synthetic construct
  misc_feature 1..20: note = CRISPR gRNA sequence
  source 1..20: mol_type = other DNA
tccccacggagagggtctca

SEQ ID NO: 58164 - DNA, 20 bp, synthetic construct
  misc_feature 1..20: note = CRISPR gRNA sequence
  source 1..20: mol_type = other DNA
ccccacggagagggtctcat

SEQ ID NO: 58165 - DNA, 20 bp, synthetic construct
  misc_feature 1..20: note = CRISPR gRNA sequence
  source 1..20: mol_type = other DNA
gagagggtctcatgggtgtc

SEQ ID NO: 58166 - DNA, 20 bp, synthetic construct
  misc_feature 1..20: note = CRISPR gRNA sequence
  source 1..20: mol_type = other DNA
agagggtctcatgggtgtct

SEQ ID NO: 58167 - DNA, 20 bp, synthetic construct
  misc_feature 1..20: note = CRISPR gRNA sequence
  source 1..20: mol_type = other DNA
gtctgggctatgtgtgcctt

SEQ ID NO: 58168 - DNA, 20 bp, synthetic construct
  misc_feature 1..20: note = CRISPR gRNA sequence
  source 1..20: mol_type = other DNA
gggctatgtgtgccttgagc

SEQ ID NO: 58169 - DNA, 20 bp, synthetic construct
  misc_feature 1..20: note = CRISPR gRNA sequence
  source 1..20: mol_type = other DNA
tgtgccttgagctggattga

SEQ ID NO: 58170 - DNA, 20 bp, synthetic construct
  misc_feature 1..20: note = CRISPR gRNA sequence
  source 1..20: mol_type = other DNA
gtgccttgagctggattgac

SEQ ID NO: 58171 - DNA, 20 bp, synthetic construct
  misc_feature 1..20: note = CRISPR gRNA sequence
  source 1..20: mol_type = other DNA
ggattgacaggttgtttcca

SEQ ID NO: 58172 - DNA, 20 bp, synthetic construct
  misc_feature 1..20: note = CRISPR gRNA sequence
  source 1..20: mol_type = other DNA
gacaggttgtttccatagtg

SEQ ID NO: 58173 - DNA, 20 bp, synthetic construct
  misc_feature 1..20: note = CRISPR gRNA sequence
  source 1..20: mol_type = other DNA
tttccatagtgcagactcct

SEQ ID NO: 58174 - DNA, 20 bp, synthetic construct
  misc_feature 1..20: note = CRISPR gRNA sequence
  source 1..20: mol_type = other DNA
ttccatagtgcagactccta

SEQ ID NO: 58175 - DNA, 20 bp, synthetic construct
  misc_feature 1..20: note = CRISPR gRNA sequence
  source 1..20: mol_type = other DNA
tccatagtgcagactcctaa

SEQ ID NO: 58176 - DNA, 20 bp, synthetic construct
  misc_feature 1..20: note = CRISPR gRNA sequence
  source 1..20: mol_type = other DNA
ccatagtgcagactcctaag

SEQ ID NO: 58177 - DNA, 20 bp, synthetic construct
  misc_feature 1..20: note = CRISPR gRNA sequence
  source 1..20: mol_type = other DNA
atagtgcagactcctaaggg

SEQ ID NO: 58178 - DNA, 20 bp, synthetic construct
  misc_feature 1..20: note = CRISPR gRNA sequence
  source 1..20: mol_type = other DNA
agtgcagactcctaagggga

SEQ ID NO: 58179 - DNA, 20 bp, synthetic construct
  misc_feature 1..20: note = CRISPR gRNA sequence
  source 1..20: mol_type = other DNA
gcagactcctaaggggagag

SEQ ID NO: 58180 - DNA, 20 bp, synthetic construct
  misc_feature 1..20: note = CRISPR gRNA sequence
  source 1..20: mol_type = other DNA
actcctaaggggagagaaga

SEQ ID NO: 58181 - DNA, 20 bp, synthetic construct
  misc_feature 1..20: note = CRISPR gRNA sequence
  source 1..20: mol_type = other DNA
ctcctaaggggagagaagac

SEQ ID NO: 58182 - DNA, 20 bp, synthetic construct
  misc_feature 1..20: note = CRISPR gRNA sequence
  source 1..20: mol_type = other DNA
tcctaaggggagagaagaca

SEQ ID NO: 58183 - DNA, 20 bp, synthetic construct
  misc_feature 1..20: note = CRISPR gRNA sequence
  source 1..20: mol_type = other DNA
ctaaggggagagaagacagg

SEQ ID NO: 58184 - DNA, 20 bp, synthetic construct
  misc_feature 1..20: note = CRISPR gRNA sequence
  source 1..20: mol_type = other DNA
gggagttttccccactattc

SEQ ID NO: 58185 - DNA, 20 bp, synthetic construct
  misc_feature 1..20: note = CRISPR gRNA sequence
  source 1..20: mol_type = other DNA
cccactattccagactccaa

SEQ ID NO: 58186 - DNA, 20 bp, synthetic construct
  misc_feature 1..20: note = CRISPR gRNA sequence
  source 1..20: mol_type = other DNA
ccactattccagactccaaa

SEQ ID NO: 58187 - DNA, 20 bp, synthetic construct
  misc_feature 1..20: note = CRISPR gRNA sequence
  source 1..20: mol_type = other DNA
ccaaaaggaatgctgtaaac

SEQ ID NO: 58188 - DNA, 20 bp, synthetic construct
  misc_feature 1..20: note = CRISPR gRNA sequence
  source 1..20: mol_type = other DNA
caaaaggaatgctgtaaacc

SEQ ID NO: 58189 - DNA, 20 bp, synthetic construct
  misc_feature 1..20: note = CRISPR gRNA sequence
  source 1..20: mol_type = other DNA
gaatgctgtaaaccaggcac

SEQ ID NO: 58190 - DNA, 20 bp, synthetic construct
  misc_feature 1..20: note = CRISPR gRNA sequence
  source 1..20: mol_type = other DNA
cagcccttgcccctgcctgc

SEQ ID NO: 58191 - DNA, 20 bp, synthetic construct
  misc_feature 1..20: note = CRISPR gRNA sequence
  source 1..20: mol_type = other DNA
gcccttgcccctgcctgccg

SEQ ID NO: 58192 - DNA, 20 bp, synthetic construct
  misc_feature 1..20: note = CRISPR gRNA sequence
  source 1..20: mol_type = other DNA
ctggtttacagcattccttt

SEQ ID NO: 58193 - DNA, 20 bp, synthetic construct
  misc_feature 1..20: note = CRISPR gRNA sequence
  source 1..20: mol_type = other DNA
acagcattccttttggagtc

SEQ ID NO: 58194 - DNA, 20 bp, synthetic construct
  misc_feature 1..20: note = CRISPR gRNA sequence
  source 1..20: mol_type = other DNA
tccctgtcttctctcccctt

SEQ ID NO: 58195 - DNA, 20 bp, synthetic construct
  misc_feature 1..20: note = CRISPR gRNA sequence
  source 1..20: mol_type = other DNA
ccttgaccatcattcagcat

SEQ ID NO: 58196 - DNA, 20 bp, synthetic construct
  misc_feature 1..20: note = CRISPR gRNA sequence
  source 1..20: mol_type = other DNA
atcagacacagaaaatcagg

SEQ ID NO: 58197 - DNA, 20 bp, synthetic construct
  misc_feature 1..20: note = CRISPR gRNA sequence
  source 1..20: mol_type = other DNA
ggcttgctcaaggtcacact

SEQ ID NO: 58198 - DNA, 20 bp, synthetic construct
  misc_feature 1..20: note = CRISPR gRNA sequence
  source 1..20: mol_type = other DNA
cacactatgagtgtatcagc

SEQ ID NO: 58199 - DNA, 20 bp, synthetic construct
  misc_feature 1..20: note = CRISPR gRNA sequence
  source 1..20: mol_type = other DNA
gctcttgcttcctgtctcgt

SEQ ID NO: 58200 - DNA, 20 bp, synthetic construct
  misc_feature 1..20: note = CRISPR gRNA sequence
  source 1..20: mol_type = other DNA
cctgtctcgtgtggattgac

SEQ ID NO: 58201 - DNA, 20 bp, synthetic construct
  misc_feature 1..20: note = CRISPR gRNA sequence
  source 1..20: mol_type = other DNA
gtctcccacactcaggctaa

SEQ ID NO: 58202 - DNA, 20 bp, synthetic construct
  misc_feature 1..20: note = CRISPR gRNA sequence
  source 1..20: mol_type = other DNA
tttgcaatatttctggtccc

SEQ ID NO: 58203 - DNA, 20 bp, synthetic construct
  misc_feature 1..20: note = CRISPR gRNA sequence
  source 1..20: mol_type = other DNA
aaaacaactacaggcatgac

SEQ ID NO: 58204 - DNA, 20 bp, synthetic construct
  misc_feature 1..20: note = CRISPR gRNA sequence
  source 1..20: mol_type = other DNA
aaaggcctagaaagaggaga

SEQ ID NO: 58205 - DNA, 20 bp, synthetic construct
  misc_feature 1..20: note = CRISPR gRNA sequence
  source 1..20: mol_type = other DNA
cagccctaatgcctaccaca

SEQ ID NO: 58206 - DNA, 20 bp, synthetic construct
  misc_feature 1..20: note = CRISPR gRNA sequence
  source 1..20: mol_type = other DNA
attagtaacagagctgggcc

SEQ ID NO: 58207 - DNA, 20 bp, synthetic construct
  misc_feature 1..20: note = CRISPR gRNA sequence
  source 1..20: mol_type = other DNA
tgccatgtgctttttctcct

SEQ ID NO: 58208 - DNA, 20 bp, synthetic construct
  misc_feature 1..20: note = CRISPR gRNA sequence
  source 1..20: mol_type = other DNA
agatttgtgtcatatcctaa

SEQ ID NO: 58209 - DNA, 20 bp, synthetic construct
  misc_feature 1..20: note = CRISPR gRNA sequence
  source 1..20: mol_type = other DNA
actggctggaggagaaattt

SEQ ID NO: 58210 - DNA, 20 bp, synthetic construct
  misc_feature 1..20: note = CRISPR gRNA sequence
  source 1..20: mol_type = other DNA
ctgccctggaccatttcttc

SEQ ID NO: 58211 - DNA, 20 bp, synthetic construct
  misc_feature 1..20: note = CRISPR gRNA sequence
  source 1..20: mol_type = other DNA
accatttcttcatgggtagc

SEQ ID NO: 58212 - DNA, 20 bp, synthetic construct
  misc_feature 1..20: note = CRISPR gRNA sequence
  source 1..20: mol_type = other DNA
ggaggtggtgatccctgcct

SEQ ID NO: 58213 - DNA, 20 bp, synthetic construct
  misc_feature 1..20: note = CRISPR gRNA sequence
  source 1..20: mol_type = other DNA
taaattctaagactctctgc

SEQ ID NO: 58214 - DNA, 20 bp, synthetic construct
  misc_feature 1..20: note = CRISPR gRNA sequence
  source 1..20: mol_type = other DNA
tagtactggcctcagcctct

SEQ ID NO: 58215 - DNA, 20 bp, synthetic construct
  misc_feature 1..20: note = CRISPR gRNA sequence
  source 1..20: mol_type = other DNA
ggaattgggaaggctggctt

SEQ ID NO: 58216 - DNA, 20 bp, synthetic construct
  misc_feature 1..20: note = CRISPR gRNA sequence
  source 1..20: mol_type = other DNA
ggtggacctcctactctttt

SEQ ID NO: 58217 - DNA, 20 bp, synthetic construct
  misc_feature 1..20: note = CRISPR gRNA sequence
  source 1..20: mol_type = other DNA
agagttagaggtggactctc

SEQ ID NO: 58218 - DNA, 20 bp, synthetic construct
  misc_feature 1..20: note = CRISPR gRNA sequence
  source 1..20: mol_type = other DNA
ggtggactctctggagttgt

SEQ ID NO: 58219 - DNA, 20 bp, synthetic construct
  misc_feature 1..20: note = CRISPR gRNA sequence
  source 1..20: mol_type = other DNA
tagacagtgcctaatacaca

SEQ ID NO: 58220 - DNA, 20 bp, synthetic construct
  misc_feature 1..20: note = CRISPR gRNA sequence
  source 1..20: mol_type = other DNA
tcatgatcgtttgccaaggt

SEQ ID NO: 58221 - DNA, 20 bp, synthetic construct
  misc_feature 1..20: note = CRISPR gRNA sequence
  source 1..20: mol_type = other DNA
caaggttagagtcctagaaa

SEQ ID NO: 58222 - DNA, 20 bp, synthetic construct
  misc_feature 1..20: note = CRISPR gRNA sequence
  source 1..20: mol_type = other DNA
gagtcctagaaatggaatta

SEQ ID NO: 58223 - DNA, 20 bp, synthetic construct
  misc_feature 1..20: note = CRISPR gRNA sequence
  source 1..20: mol_type = other DNA
cttctagaaggaggtggttt

SEQ ID NO: 58224 - DNA, 20 bp, synthetic construct
  misc_feature 1..20: note = CRISPR gRNA sequence
  source 1..20: mol_type = other DNA
gggcagatcaccctgaggtc

SEQ ID NO: 58225 - DNA, 20 bp, synthetic construct
  misc_feature 1..20: note = CRISPR gRNA sequence
  source 1..20: mol_type = other DNA
tactcgggaggctgaggcag

SEQ ID NO: 58226 - DNA, 20 bp, synthetic construct
  misc_feature 1..20: note = CRISPR gRNA sequence
  source 1..20: mol_type = other DNA
ttgcaccattgcactccagc

SEQ ID NO: 58227 - DNA, 20 bp, synthetic construct
  misc_feature 1..20: note = CRISPR gRNA sequence
  source 1..20: mol_type = other DNA
agactctgtctcaaaaaaaa

SEQ ID NO: 58228 - DNA, 20 bp, synthetic construct
  misc_feature 1..20: note = CRISPR gRNA sequence
  source 1..20: mol_type = other DNA
agagttccagttcagaaggg

SEQ ID NO: 58229 - DNA, 20 bp, synthetic construct
  misc_feature 1..20: note = CRISPR gRNA sequence
  source 1..20: mol_type = other DNA
aggtgatggtctgtgttagc

SEQ ID NO: 58230 - DNA, 20 bp, synthetic construct
  misc_feature 1..20: note = CRISPR gRNA sequence
  source 1..20: mol_type = other DNA
tggtctgtgttagctaggat

SEQ ID NO: 58231 - DNA, 20 bp, synthetic construct
  misc_feature 1..20: note = CRISPR gRNA sequence
  source 1..20: mol_type = other DNA
agctaggattagagttcact

SEQ ID NO: 58232 - DNA, 20 bp, synthetic construct
  misc_feature 1..20: note = CRISPR gRNA sequence
  source 1..20: mol_type = other DNA
ctaaacaacagtggcttaac

SEQ ID NO: 58233 - DNA, 20 bp, synthetic construct
  misc_feature 1..20: note = CRISPR gRNA sequence
  source 1..20: mol_type = other DNA
taccttccaccttcctcagt

SEQ ID NO: 58234 - DNA, 20 bp, synthetic construct
  misc_feature 1..20: note = CRISPR gRNA sequence
  source 1..20: mol_type = other DNA
gacaacaggaaggagcaaag

SEQ ID NO: 58235 - DNA, 20 bp, synthetic construct
  misc_feature 1..20: note = CRISPR gRNA sequence
  source 1..20: mol_type = other DNA
catataactgcaagggagac

SEQ ID NO: 58236 - DNA, 20 bp, synthetic construct
  misc_feature 1..20: note = CRISPR gRNA sequence
  source 1..20: mol_type = other DNA
taatctattctagatgacca

SEQ ID NO: 58237 - DNA, 20 bp, synthetic construct
  misc_feature 1..20: note = CRISPR gRNA sequence
  source 1..20: mol_type = other DNA
cataaatggttcatggaaat

SEQ ID NO: 58238 - DNA, 20 bp, synthetic construct
  misc_feature 1..20: note = CRISPR gRNA sequence
  source 1..20: mol_type = other DNA
aatggttcatggaaataaga

SEQ ID NO: 58239 - DNA, 20 bp, synthetic construct
  misc_feature 1..20: note = CRISPR gRNA sequence
  source 1..20: mol_type = other DNA
tcctcacgggactgtccaca

SEQ ID NO: 58240 - DNA, 20 bp, synthetic construct
  misc_feature 1..20: note = CRISPR gRNA sequence
  source 1..20: mol_type = other DNA
acaagaccattccagagagc

SEQ ID NO: 58241 - DNA, 20 bp, synthetic construct
  misc_feature 1..20: note = CRISPR gRNA sequence
  source 1..20: mol_type = other DNA
agccagggtgcaggcacaaa

SEQ ID NO: 58242 - DNA, 20 bp, synthetic construct
  misc_feature 1..20: note = CRISPR gRNA sequence
  source 1..20: mol_type = other DNA
aggcacaaatggagtaggga

SEQ ID NO: 58243 - DNA, 20 bp, synthetic construct
  misc_feature 1..20: note = CRISPR gRNA sequence
  source 1..20: mol_type = other DNA
gaggctgctcaccaaagacc

SEQ ID NO: 58244 - DNA, 20 bp, synthetic construct
  misc_feature 1..20: note = CRISPR gRNA sequence
  source 1..20: mol_type = other DNA
tcttcctccccaacacggac

SEQ ID NO: 58245 - DNA, 20 bp, synthetic construct
  misc_feature 1..20: note = CRISPR gRNA sequence
  source 1..20: mol_type = other DNA
gagaccttggaccctgaaca

SEQ ID NO: 58246 - DNA, 20 bp, synthetic construct
  misc_feature 1..20: note = CRISPR gRNA sequence
  source 1..20: mol_type = other DNA
aactcaacaagctgcatgtc

SEQ ID NO: 58247 - DNA, 20 bp, synthetic construct
  misc_feature 1..20: note = CRISPR gRNA sequence
  source 1..20: mol_type = other DNA
tggacctggaggtgctgctg

SEQ ID NO: 58248 - DNA, 20 bp, synthetic construct
  misc_feature 1..20: note = CRISPR gRNA sequence
  source 1..20: mol_type = other DNA
ggacccacctaagtcagaga

SEQ ID NO: 58249 - DNA, 20 bp, synthetic construct
  misc_feature 1..20: note = CRISPR gRNA sequence
  source 1..20: mol_type = other DNA
ctccttctacctggcttcac

SEQ ID NO: 58250 - DNA, 20 bp, synthetic construct
  misc_feature 1..20: note = CRISPR gRNA sequence
  source 1..20: mol_type = other DNA
cctggcttcactcgaattgc

SEQ ID NO: 58251 - DNA, 20 bp, synthetic construct
  misc_feature 1..20: note = CRISPR gRNA sequence
  source 1..20: mol_type = other DNA
cactcgaattgctcgaattg

SEQ ID NO: 58252 - DNA, 20 bp, synthetic construct
  misc_feature 1..20: note = CRISPR gRNA sequence
  source 1..20: mol_type = other DNA
tttatttcttcttttttggc

SEQ ID NO: 58253 - DNA, 20 bp, synthetic construct
  misc_feature 1..20: note = CRISPR gRNA sequence
  source 1..20: mol_type = other DNA
ttcttttttggcgggggtgg

SEQ ID NO: 58254 - DNA, 20 bp, synthetic construct
  misc_feature 1..20: note = CRISPR gRNA sequence
  source 1..20: mol_type = other DNA
tttgtttgttgttgctcttg

SEQ ID NO: 58255 - DNA, 20 bp, synthetic construct
  misc_feature 1..20: note = CRISPR gRNA sequence
  source 1..20: mol_type = other DNA
tcttgctctgttgcctaggc

SEQ ID NO: 58256 - DNA, 20 bp, synthetic construct
  misc_feature 1..20: note = CRISPR gRNA sequence
  source 1..20: mol_type = other DNA
cccttggcctcccaaagtgc

SEQ ID NO: 58257 - DNA, 20 bp, synthetic construct
  misc_feature 1..20: note = CRISPR gRNA sequence
  source 1..20: mol_type = other DNA
tctgccctctactgatccgt

SEQ ID NO: 58258 - DNA, 20 bp, synthetic construct
  misc_feature 1..20: note = CRISPR gRNA sequence
  source 1..20: mol_type = other DNA
ttaagaaccctacttcaagg

SEQ ID NO: 58259 - DNA, 20 bp, synthetic construct
  misc_feature 1..20: note = CRISPR gRNA sequence
  source 1..20: mol_type = other DNA
cctacttcaaggcagagtgt

SEQ ID NO: 58260 - DNA, 20 bp, synthetic construct
  misc_feature 1..20: note = CRISPR gRNA sequence
  source 1..20: mol_type = other DNA
tacacacagtgcatatacat

SEQ ID NO: 58261 - DNA, 20 bp, synthetic construct
  misc_feature 1..20: note = CRISPR gRNA sequence
  source 1..20: mol_type = other DNA
attttctccacaacagataa

SEQ ID NO: 58262 - DNA, 20 bp, synthetic construct
  misc_feature 1..20: note = CRISPR gRNA sequence
  source 1..20: mol_type = other DNA
ttccatttagttctcccttg

SEQ ID NO: 58263 - DNA, 20 bp, synthetic construct
  misc_feature 1..20: note = CRISPR gRNA sequence
  source 1..20: mol_type = other DNA
ttatactctcccctctcttg

SEQ ID NO: 58264 - DNA, 20 bp, synthetic construct
  misc_feature 1..20: note = CRISPR gRNA sequence
  source 1..20: mol_type = other DNA
agctgaggggaaaagccaac

SEQ ID NO: 58265 - DNA, 20 bp, synthetic construct
  misc_feature 1..20: note = CRISPR gRNA sequence
  source 1..20: mol_type = other DNA
agctccaccatggtgaggac

SEQ ID NO: 58266 - DNA, 20 bp, synthetic construct
  misc_feature 1..20: note = CRISPR gRNA sequence
  source 1..20: mol_type = other DNA
catggtgaggactggagttg

SEQ ID NO: 58267 - DNA, 20 bp, synthetic construct
  misc_feature 1..20: note = CRISPR gRNA sequence
  source 1..20: mol_type = other DNA
ctggagttggggggtgggaa

SEQ ID NO: 58268 - DNA, 20 bp, synthetic construct
  misc_feature 1..20: note = CRISPR gRNA sequence
  source 1..20: mol_type = other DNA
ttgtcccgttaccaattcta

SEQ ID NO: 58269 - DNA, 20 bp, synthetic construct
  misc_feature 1..20: note = CRISPR gRNA sequence
  source 1..20: mol_type = other DNA
taatgaccacctactgattc

SEQ ID NO: 58270 - DNA, 20 bp, synthetic construct
  misc_feature 1..20: note = CRISPR gRNA sequence
  source 1..20: mol_type = other DNA
cctataacctcagctcccca

SEQ ID NO: 58271 - DNA, 20 bp, synthetic construct
  misc_feature 1..20: note = CRISPR gRNA sequence
  source 1..20: mol_type = other DNA
atctgattgatatttggcca

SEQ ID NO: 58272 - DNA, 20 bp, synthetic construct
  misc_feature 1..20: note = CRISPR gRNA sequence
  source 1..20: mol_type = other DNA
cagtgagtccctttttaata

SEQ ID NO: 58273 - DNA, 20 bp, synthetic construct
  misc_feature 1..20: note = CRISPR gRNA sequence
  source 1..20: mol_type = other DNA
tgacttcttaaaattctttc

SEQ ID NO: 58274 - DNA, 20 bp, synthetic construct
  misc_feature 1..20: note = CRISPR gRNA sequence
  source 1..20: mol_type = other DNA
ctttctccctcccttccttt

SEQ ID NO: 58275 - DNA, 20 bp, synthetic construct
  misc_feature 1..20: note = CRISPR gRNA sequence
  source 1..20: mol_type = other DNA
attaagggaagtgaggaaat

SEQ ID NO: 58276 - DNA, 20 bp, synthetic construct
  misc_feature 1..20: note = CRISPR gRNA sequence
  source 1..20: mol_type = other DNA
aaatgtgggtgataagaaat

SEQ ID NO: 58277 - DNA, 20 bp, synthetic construct
  misc_feature 1..20: note = CRISPR gRNA sequence
  source 1..20: mol_type = other DNA
tggccatttagtgcttggag

SEQ ID NO: 58278 - DNA, 20 bp, synthetic construct
  misc_feature 1..20: note = CRISPR gRNA sequence
  source 1..20: mol_type = other DNA
cagaacatccaccttccaat

SEQ ID NO: 58279 - DNA, 20 bp, synthetic construct
  misc_feature 1..20: note = CRISPR gRNA sequence
  source 1..20: mol_type = other DNA
tgcctttccagtccctgcat

SEQ ID NO: 58280 - DNA, 20 bp, synthetic construct
  misc_feature 1..20: note = CRISPR gRNA sequence
  source 1..20: mol_type = other DNA
cctgccacctgtctgtggac

SEQ ID NO: 58281 - DNA, 20 bp, synthetic construct
  misc_feature 1..20: note = CRISPR gRNA sequence
  source 1..20: mol_type = other DNA
actggagttccccaaaggtt

SEQ ID NO: 58282 - DNA, 20 bp, synthetic construct
  misc_feature 1..20: note = CRISPR gRNA sequence
  source 1..20: mol_type = other DNA
gaagcgcccacatcagagct

SEQ ID NO: 58283 - DNA, 20 bp, synthetic construct
  misc_feature 1..20: note = CRISPR gRNA sequence
  source 1..20: mol_type = other DNA
gtgcaagaagcagcagctag

SEQ ID NO: 58284 - DNA, 20 bp, synthetic construct
  misc_feature 1..20: note = CRISPR gRNA sequence
  source 1..20: mol_type = other DNA
gaggaacataaacagagaga

SEQ ID NO: 58285 - DNA, 20 bp, synthetic construct
  misc_feature 1..20: note = CRISPR gRNA sequence
  source 1..20: mol_type = other DNA
cccagggaggagaccagttt

SEQ ID NO: 58286 - DNA, 20 bp, synthetic construct
  misc_feature 1..20: note = CRISPR gRNA sequence
  source 1..20: mol_type = other DNA
agaccagtttgggggtgagc

SEQ ID NO: 58287 - DNA, 20 bp, synthetic construct
  misc_feature 1..20: note = CRISPR gRNA sequence
  source 1..20: mol_type = other DNA
gggggtgagcagggatgggg

SEQ ID NO: 58288 - DNA, 20 bp, synthetic construct
  misc_feature 1..20: note = CRISPR gRNA sequence
  source 1..20: mol_type = other DNA
tctcattcttgaccagttct

SEQ ID NO: 58289 - DNA, 20 bp, synthetic construct
  misc_feature 1..20: note = CRISPR gRNA sequence
  source 1..20: mol_type = other DNA
cagaatggtcctcgttctcc

SEQ ID NO: 58290 - DNA, 20 bp, synthetic construct
  misc_feature 1..20: note = CRISPR gRNA sequence
  source 1..20: mol_type = other DNA
gccaaccatggctataacca

SEQ ID NO: 58291 - DNA, 20 bp, synthetic construct
  misc_feature 1..20: note = CRISPR gRNA sequence
  source 1..20: mol_type = other DNA
actaccttggcctttcccca

SEQ ID NO: 58292 - DNA, 20 bp, synthetic construct
  misc_feature 1..20: note = CRISPR gRNA sequence
  source 1..20: mol_type = other DNA
aagcagccccagccctttcc

SEQ ID NO: 58293 - DNA, 20 bp, synthetic construct
  misc_feature 1..20: note = CRISPR gRNA sequence
  source 1..20: mol_type = other DNA
ctgagacctctcaatgaccc

SEQ ID NO: 58294 - DNA, 20 bp, synthetic construct
  misc_feature 1..20: note = CRISPR gRNA sequence
  source 1..20: mol_type = other DNA
aaatattgggaagaggcact

SEQ ID NO: 58295 - DNA, 20 bp, synthetic construct
  misc_feature 1..20: note = CRISPR gRNA sequence
  source 1..20: mol_type = other DNA
actttggagggctgaggcag

SEQ ID NO: 58296 - DNA, 20 bp, synthetic construct
  misc_feature 1..20: note = CRISPR gRNA sequence
  source 1..20: mol_type = other DNA
caggtggatcagttgagccc

SEQ ID NO: 58297 - DNA, 20 bp, synthetic construct
  misc_feature 1..20: note = CRISPR gRNA sequence
  source 1..20: mol_type = other DNA
actaaaaatacaaaaattag

SEQ ID NO: 58298 - DNA, 20 bp, synthetic construct
  misc_feature 1..20: note = CRISPR gRNA sequence
  source 1..20: mol_type = other DNA
tactcaggaggctgaggcag

SEQ ID NO: 58299 - DNA, 20 bp, synthetic construct
  misc_feature 1..20: note = CRISPR gRNA sequence
  source 1..20: mol_type = other DNA
caggaggatcacttgagacc

SEQ ID NO: 58300 - DNA, 20 bp, synthetic construct
  misc_feature 1..20: note = CRISPR gRNA sequence
  source 1..20: mol_type = other DNA
agtttgcggctacagtaagc

SEQ ID NO: 58301 - DNA, 20 bp, synthetic construct
  misc_feature 1..20: note = CRISPR gRNA sequence
  source 1..20: mol_type = other DNA
ttacaccacgtgtactattg

SEQ ID NO: 58302 - DNA, 20 bp, synthetic construct
  misc_feature 1..20: note = CRISPR gRNA sequence
  source 1..20: mol_type = other DNA
accacgtgtactattgcaga

SEQ ID NO: 58303 - DNA, 20 bp, synthetic construct
  misc_feature 1..20: note = CRISPR gRNA sequence
  source 1..20: mol_type = other DNA
aactgattccttctggaagt

SEQ ID NO: 58304 - DNA, 20 bp, synthetic construct
  misc_feature 1..20: note = CRISPR gRNA sequence
  source 1..20: mol_type = other DNA
aagacatgagcagagggccg

SEQ ID NO: 58305 - DNA, 20 bp, synthetic construct
  misc_feature 1..20: note = CRISPR gRNA sequence
  source 1..20: mol_type = other DNA
tgccatgtccctgccccttg

SEQ ID NO: 58306 - DNA, 20 bp, synthetic construct
  misc_feature 1..20: note = CRISPR gRNA sequence
  source 1..20: mol_type = other DNA
gcgctacaggagccaaatcc

SEQ ID NO: 58307 - DNA, 20 bp, synthetic construct
  misc_feature 1..20: note = CRISPR gRNA sequence
  source 1..20: mol_type = other DNA
atctcggacctcttcaacac

SEQ ID NO: 58308 - DNA, 20 bp, synthetic construct
  misc_feature 1..20: note = CRISPR gRNA sequence
  source 1..20: mol_type = other DNA
accagggttaacaagggccc

SEQ ID NO: 58309 - DNA, 20 bp, synthetic construct
  misc_feature 1..20: note = CRISPR gRNA sequence
  source 1..20: mol_type = other DNA
tttccaggccctgttccttt

SEQ ID NO: 58310 - DNA, 20 bp, synthetic construct
  misc_feature 1..20: note = CRISPR gRNA sequence
  source 1..20: mol_type = other DNA
ttttgatctgtacctgagcc

SEQ ID NO: 58311 - DNA, 20 bp, synthetic construct
  misc_feature 1..20: note = CRISPR gRNA sequence
  source 1..20: mol_type = other DNA
tagatgaggccctccagcct

SEQ ID NO: 58312 - DNA, 20 bp, synthetic construct
  misc_feature 1..20: note = CRISPR gRNA sequence
  source 1..20: mol_type = other DNA
gggaccctcctgcctggctg

SEQ ID NO: 58313 - DNA, 20 bp, synthetic construct
  misc_feature 1..20: note = CRISPR gRNA sequence
  source 1..20: mol_type = other DNA
atgttgggctttgatgggcc

SEQ ID NO: 58314 - DNA, 20 bp, synthetic construct
  misc_feature 1..20: note = CRISPR gRNA sequence
  source 1..20: mol_type = other DNA
ctttgatgggccacgggtgg

SEQ ID NO: 58315 - DNA, 20 bp, synthetic construct
  misc_feature 1..20: note = CRISPR gRNA sequence
  source 1..20: mol_type = other DNA
ggccacgggtggaagaatat

SEQ ID NO: 58316 - DNA, 20 bp, synthetic construct
  misc_feature 1..20: note = CRISPR gRNA sequence
  source 1..20: mol_type = other DNA
atcgcgggagggggccctgg

SEQ ID NO: 58317 - DNA, 20 bp, synthetic construct
  misc_feature 1..20: note = CRISPR gRNA sequence
  source 1..20: mol_type = other DNA
tttcacccacctcagcctgc

SEQ ID NO: 58318 - DNA, 20 bp, synthetic construct
  misc_feature 1..20: note = CRISPR gRNA sequence
  source 1..20: mol_type = other DNA
tatgttaccctccattcccg

SEQ ID NO: 58319 - DNA, 20 bp, synthetic construct
  misc_feature 1..20: note = CRISPR gRNA sequence
  source 1..20: mol_type = other DNA
cgcagggcaatgaggactgt

SEQ ID NO: 58320 - DNA, 20 bp, synthetic construct
  misc_feature 1..20: note = CRISPR gRNA sequence
  source 1..20: mol_type = other DNA
ttgtagagctgtgtcactgt

SEQ ID NO: 58321 - DNA, 20 bp, synthetic construct
  misc_feature 1..20: note = CRISPR gRNA sequence
  source 1..20: mol_type = other DNA
acagggaggcccccatccac

SEQ ID NO: 58322 - DNA, 20 bp, synthetic construct
  misc_feature 1..20: note = CRISPR gRNA sequence
  source 1..20: mol_type = other DNA
tggtaggctgtgggcagata

SEQ ID NO: 58323 - DNA, 20 bp, synthetic construct
  misc_feature 1..20: note = CRISPR gRNA sequence
  source 1..20: mol_type = other DNA
gggcagatagagaatctcag

SEQ ID NO: 58324 - DNA, 20 bp, synthetic construct
  misc_feature 1..20: note = CRISPR gRNA sequence
  source 1..20: mol_type = other DNA
atagagaatctcaggtgagt

SEQ ID NO: 58325 - DNA, 20 bp, synthetic construct
  misc_feature 1..20: note = CRISPR gRNA sequence
  source 1..20: mol_type = other DNA
gagtggaggaggaccgggga

SEQ ID NO: 58326 - DNA, 20 bp, synthetic construct
  misc_feature 1..20: note = CRISPR gRNA sequence
  source 1..20: mol_type = other DNA
gcaaacctctgccaagagga

SEQ ID NO: 58327 - DNA, 20 bp, synthetic construct
  misc_feature 1..20: note = CRISPR gRNA sequence
  source 1..20: mol_type = other DNA
ctctgccaagaggactggat

SEQ ID NO: 58328 - DNA, 20 bp, synthetic construct
  misc_feature 1..20: note = CRISPR gRNA sequence
  source 1..20: mol_type = other DNA
aagaggactggataagaatc

SEQ ID NO: 58329 - DNA, 20 bp, synthetic construct
  misc_feature 1..20: note = CRISPR gRNA sequence
  source 1..20: mol_type = other DNA
ccataccttgacaggacctc

SEQ ID NO: 58330 - DNA, 20 bp, synthetic construct
  misc_feature 1..20: note = CRISPR gRNA sequence
  source 1..20: mol_type = other DNA
acaggacctctggagtccaa

SEQ ID NO: 58331 - DNA, 20 bp, synthetic construct
  misc_feature 1..20: note = CRISPR gRNA sequence
  source 1..20: mol_type = other DNA
cacatgcacactgtctaggc

SEQ ID NO: 58332 - DNA, 20 bp, synthetic construct
  misc_feature 1..20: note = CRISPR gRNA sequence
  source 1..20: mol_type = other DNA
agagtttcttcgttcctaaa

SEQ ID NO: 58333 - DNA, 20 bp, synthetic construct
  misc_feature 1..20: note = CRISPR gRNA sequence
  source 1..20: mol_type = other DNA
ccaactcatatggtcattgc

SEQ ID NO: 58334 - DNA, 20 bp, synthetic construct
  misc_feature 1..20: note = CRISPR gRNA sequence
  source 1..20: mol_type = other DNA
tggtcattgcaagaatgaga

SEQ ID NO: 58335 - DNA, 20 bp, synthetic construct
  misc_feature 1..20: note = CRISPR gRNA sequence
  source 1..20: mol_type = other DNA
atacagtaggttaaataatg

SEQ ID NO: 58336 - DNA, 20 bp, synthetic construct
  misc_feature 1..20: note = CRISPR gRNA sequence
  source 1..20: mol_type = other DNA
attttatttctctctcatgg

SEQ ID NO: 58337 - DNA, 20 bp, synthetic construct
  misc_feature 1..20: note = CRISPR gRNA sequence
  source 1..20: mol_type = other DNA
aggtaggtggtccaggtcag

SEQ ID NO: 58338 - DNA, 20 bp, synthetic construct
  misc_feature 1..20: note = CRISPR gRNA sequence
  source 1..20: mol_type = other DNA
ttttgctccattatcccctt

SEQ ID NO: 58339 - DNA, 20 bp, synthetic construct
  misc_feature 1..20: note = CRISPR gRNA sequence
  source 1..20: mol_type = other DNA
tgcacagtcaaagctacgtc

SEQ ID NO: 58340 - DNA, 20 bp, synthetic construct
  misc_feature 1..20: note = CRISPR gRNA sequence
  source 1..20: mol_type = other DNA
ttaaagttcagtcctgaaac

SEQ ID NO: 58341 - DNA, 20 bp, synthetic construct
  misc_feature 1..20: note = CRISPR gRNA sequence
  source 1..20: mol_type = other DNA
ctattgctgtagatgaagtg

SEQ ID NO: 58342 - DNA, 20 bp, synthetic construct
  misc_feature 1..20: note = CRISPR gRNA sequence
  source 1..20: mol_type = other DNA
attaagccccatctctctga

SEQ ID NO: 58343 - DNA, 20 bp, synthetic construct
  misc_feature 1..20: note = CRISPR gRNA sequence
  source 1..20: mol_type = other DNA
gctttaagagcaggaagtgt

SEQ ID NO: 58344 - DNA, 20 bp, synthetic construct
  misc_feature 1..20: note = CRISPR gRNA sequence
  source 1..20: mol_type = other DNA
aatggggaggctgcagatgc

SEQ ID NO: 58345 - DNA, 20 bp, synthetic construct
  misc_feature 1..20: note = CRISPR gRNA sequence
  source 1..20: mol_type = other DNA
agccaggccttggagctgag

SEQ ID NO: 58346 - DNA, 20 bp, synthetic construct
  misc_feature 1..20: note = CRISPR gRNA sequence
  source 1..20: mol_type = other DNA
gctgagaagggtcttcagct

SEQ ID NO: 58347 - DNA, 20 bp, synthetic construct
  misc_feature 1..20: note = CRISPR gRNA sequence
  source 1..20: mol_type = other DNA
ccacagctgaaagaagtcag

SEQ ID NO: 58348 - DNA, 20 bp, synthetic construct
  misc_feature 1..20: note = CRISPR gRNA sequence
  source 1..20: mol_type = other DNA
atgagccactgcccaggtcc

SEQ ID NO: 58349 - DNA, 20 bp, synthetic construct
  misc_feature 1..20: note = CRISPR gRNA sequence
  source 1..20: mol_type = other DNA
agtccaagtactcagtaggg

SEQ ID NO: 58350 - DNA, 20 bp, synthetic construct
  misc_feature 1..20: note = CRISPR gRNA sequence
  source 1..20: mol_type = other DNA
gagtccaaacccaaggctcc

SEQ ID NO: 58351 - DNA, 20 bp, synthetic construct
  misc_feature 1..20: note = CRISPR gRNA sequence
  source 1..20: mol_type = other DNA
ttagactgtcttggaggagc

SEQ ID NO: 58352 - DNA, 20 bp, synthetic construct
  misc_feature 1..20: note = CRISPR gRNA sequence
  source 1..20: mol_type = other DNA
ctttctgaaatcccaggaga

SEQ ID NO: 58353 - DNA, 20 bp, synthetic construct
  misc_feature 1..20: note = CRISPR gRNA sequence
  source 1..20: mol_type = other DNA
agggatagcagtgcgtaggc

SEQ ID NO: 58354 - DNA, 20 bp, synthetic construct
  misc_feature 1..20: note = CRISPR gRNA sequence
  source 1..20: mol_type = other DNA
gtaggcaggaatcaggcact

SEQ ID NO: 58355 - DNA, 20 bp, synthetic construct
  misc_feature 1..20: note = CRISPR gRNA sequence
  source 1..20: mol_type = other DNA
agaagtacacaggcatatgc

SEQ ID NO: 58356 - DNA, 20 bp, synthetic construct
  misc_feature 1..20: note = CRISPR gRNA sequence
  source 1..20: mol_type = other DNA
tgggactcagtaccatgggg

SEQ ID NO: 58357 - DNA, 20 bp, synthetic construct
  misc_feature 1..20: note = CRISPR gRNA sequence
  source 1..20: mol_type = other DNA
tcactaaggttcagcacttg

SEQ ID NO: 58358 - DNA, 20 bp, synthetic construct
  misc_feature 1..20: note = CRISPR gRNA sequence
  source 1..20: mol_type = other DNA
tggggaaagtgaggtcagag

SEQ ID NO: 58359 - DNA, 20 bp, synthetic construct
  misc_feature 1..20: note = CRISPR gRNA sequence
  source 1..20: mol_type = other DNA
aatgcgcttggctcagggct

SEQ ID NO: 58360 - DNA, 20 bp, synthetic construct
  misc_feature 1..20: note = CRISPR gRNA sequence
  source 1..20: mol_type = other DNA
cgcttggctcagggctctgg

SEQ ID NO: 58361 - DNA, 20 bp, synthetic construct
  misc_feature 1..20: note = CRISPR gRNA sequence
  source 1..20: mol_type = other DNA
ccaggcataagccctgggag

SEQ ID NO: 58362 - DNA, 20 bp, synthetic construct
  misc_feature 1..20: note = CRISPR gRNA sequence
  source 1..20: mol_type = other DNA
caaaaacttccccataggaa

SEQ ID NO: 58363 - DNA, 20 bp, synthetic construct
  misc_feature 1..20: note = CRISPR gRNA sequence
  source 1..20: mol_type = other DNA
ccataggaacagaatagacc

SEQ ID NO: 58364 - DNA, 20 bp, synthetic construct
  misc_feature 1..20: note = CRISPR gRNA sequence
  source 1..20: mol_type = other DNA
acccagaattgaggccagca

SEQ ID NO: 58365 - DNA, 20 bp, synthetic construct
  misc_feature 1..20: note = CRISPR gRNA sequence
  source 1..20: mol_type = other DNA
ttcctcctagccgtgcctgc

SEQ ID NO: 58366 - DNA, 20 bp, synthetic construct
  misc_feature 1..20: note = CRISPR gRNA sequence
  source 1..20: mol_type = other DNA
ctgtcttatgtctcccacat

SEQ ID NO: 58367 - DNA, 20 bp, synthetic construct
  misc_feature 1..20: note = CRISPR gRNA sequence
  source 1..20: mol_type = other DNA
cctaccacggctccggaagc

SEQ ID NO: 58368 - DNA, 20 bp, synthetic construct
  misc_feature 1..20: note = CRISPR gRNA sequence
  source 1..20: mol_type = other DNA
caaggaaggtctggggcccc

SEQ ID NO: 58369 - DNA, 20 bp, synthetic construct
  misc_feature 1..20: note = CRISPR gRNA sequence
  source 1..20: mol_type = other DNA
ggtctggggcccctggggta

SEQ ID NO: 58370 - DNA, 20 bp, synthetic construct
  misc_feature 1..20: note = CRISPR gRNA sequence
  source 1..20: mol_type = other DNA
tcaaccctactctgcttggc

SEQ ID NO: 58371 - DNA, 20 bp, synthetic construct
  misc_feature 1..20: note = CRISPR gRNA sequence
  source 1..20: mol_type = other DNA
gcagtcacgtgtcctaccgt

SEQ ID NO: 58372 - DNA, 20 bp, synthetic construct
  misc_feature 1..20: note = CRISPR gRNA sequence
  source 1..20: mol_type = other DNA
ggccaggtgagcagaaggaa

SEQ ID NO: 58373 - DNA, 20 bp, synthetic construct
  misc_feature 1..20: note = CRISPR gRNA sequence
  source 1..20: mol_type = other DNA
gagaaaagaggaggggaaag

SEQ ID NO: 58374 - DNA, 20 bp, synthetic construct
  misc_feature 1..20: note = CRISPR gRNA sequence
  source 1..20: mol_type = other DNA
tggaggaggcccctcgtctg

SEQ ID NO: 58375 - DNA, 20 bp, synthetic construct
  misc_feature 1..20: note = CRISPR gRNA sequence
  source 1..20: mol_type = other DNA
cacctggtacttggtatata

SEQ ID NO: 58376 - DNA, 20 bp, synthetic construct
  misc_feature 1..20: note = CRISPR gRNA sequence
  source 1..20: mol_type = other DNA
acttggtatatattgaatta

SEQ ID NO: 58377 - DNA, 20 bp, synthetic construct
  misc_feature 1..20: note = CRISPR gRNA sequence
  source 1..20: mol_type = other DNA
ggtatatattgaattaatgg

SEQ ID NO: 58378 - DNA, 20 bp, synthetic construct
  misc_feature 1..20: note = CRISPR gRNA sequence
  source 1..20: mol_type = other DNA
attaatggatggatgaaaag

SEQ ID NO: 58379 - DNA, 20 bp, synthetic construct
  misc_feature 1..20: note = CRISPR gRNA sequence
  source 1..20: mol_type = other DNA
atggatgaaaagatggatgt

SEQ ID NO: 58380 - DNA, 20 bp, synthetic construct
  misc_feature 1..20: note = CRISPR gRNA sequence
  source 1..20: mol_type = other DNA
atgaaaagatggatgtatgg

SEQ ID NO: 58381 - DNA, 20 bp, synthetic construct
  misc_feature 1..20: note = CRISPR gRNA sequence
  source 1..20: mol_type = other DNA
atggatggatggctgaaaag

SEQ ID NO: 58382 - DNA, 20 bp, synthetic construct
  misc_feature 1..20: note = CRISPR gRNA sequence
  source 1..20: mol_type = other DNA
atggatggctgaaaagatgg

SEQ ID NO: 58383 - DNA, 20 bp, synthetic construct
  misc_feature 1..20: note = CRISPR gRNA sequence
  source 1..20: mol_type = other DNA
atggctgaaaagatggatgg

SEQ ID NO: 58384 - DNA, 20 bp, synthetic construct
  misc_feature 1..20: note = CRISPR gRNA sequence
  source 1..20: mol_type = other DNA
atggatgggtggatgaaaag

SEQ ID NO: 58385 - DNA, 20 bp, synthetic construct
  misc_feature 1..20: note = CRISPR gRNA sequence
  source 1..20: mol_type = other DNA
atgggtggatgaaaagatgg

SEQ ID NO: 58386 - DNA, 20 bp, synthetic construct
  misc_feature 1..20: note = CRISPR gRNA sequence
  source 1..20: mol_type = other DNA
gtggatgaaaagatggatgg

SEQ ID NO: 58387 - DNA, 20 bp, synthetic construct
  misc_feature 1..20: note = CRISPR gRNA sequence
  source 1..20: mol_type = other DNA
atgaaaagatggatggatga

SEQ ID NO: 58388 - DNA, 20 bp, synthetic construct
  misc_feature 1..20: note = CRISPR gRNA sequence
  source 1..20: mol_type = other DNA
atgaatggatggctgaaaag

SEQ ID NO: 58389 - DNA, 20 bp, synthetic construct
  misc_feature 1..20: note = CRISPR gRNA sequence
  source 1..20: mol_type = other DNA
atggatggctgaaaagatgg

SEQ ID NO: 58390 - DNA, 20 bp, synthetic construct
  misc_feature 1..20: note = CRISPR gRNA sequence
  source 1..20: mol_type = other DNA
atggctgaaaagatggatgg

SEQ ID NO: 58391 - DNA, 20 bp, synthetic construct
  misc_feature 1..20: note = CRISPR gRNA sequence
  source 1..20: mol_type = other DNA
atggatgggtggatgaaaag

SEQ ID NO: 58392 - DNA, 20 bp, synthetic construct
  misc_feature 1..20: note = CRISPR gRNA sequence
  source 1..20: mol_type = other DNA
atgggtggatgaaaagatgg

SEQ ID NO: 58393 - DNA, 20 bp, synthetic construct
  misc_feature 1..20: note = CRISPR gRNA sequence
  source 1..20: mol_type = other DNA
gtggatgaaaagatggatgg

SEQ ID NO: 58394 - DNA, 20 bp, synthetic construct
  misc_feature 1..20: note = CRISPR gRNA sequence
  source 1..20: mol_type = other DNA
atgaaaagatggatggatgg

SEQ ID NO: 58395 - DNA, 20 bp, synthetic construct
  misc_feature 1..20: note = CRISPR gRNA sequence
  source 1..20: mol_type = other DNA
aaagatggatggatggatgg

SEQ ID NO: 58396 - DNA, 20 bp, synthetic construct
  misc_feature 1..20: note = CRISPR gRNA sequence
  source 1..20: mol_type = other DNA
atggatggatggatggatgg

SEQ ID NO: 58397 - DNA, 20 bp, synthetic construct
  misc_feature 1..20: note = CRISPR gRNA sequence
  source 1..20: mol_type = other DNA
atggatggatggctgaaaag

SEQ ID NO: 58398 - DNA, 20 bp, synthetic construct
  misc_feature 1..20: note = CRISPR gRNA sequence
  source 1..20: mol_type = other DNA
atggatggctgaaaagatgg

SEQ ID NO: 58399 - DNA, 20 bp, synthetic construct
  misc_feature 1..20: note = CRISPR gRNA sequence
  source 1..20: mol_type = other DNA
atggctgaaaagatggatgg

SEQ ID NO: 58400 - DNA, 20 bp, synthetic construct
  misc_feature 1..20: note = CRISPR gRNA sequence
  source 1..20: mol_type = other DNA
atggatgggtggatgaaaag

SEQ ID NO: 58401 - DNA, 20 bp, synthetic construct
  misc_feature 1..20: note = CRISPR gRNA sequence
  source 1..20: mol_type = other DNA
atgggtggatgaaaagatgg

SEQ ID NO: 58402 - DNA, 20 bp, synthetic construct
  misc_feature 1..20: note = CRISPR gRNA sequence
  source 1..20: mol_type = other DNA
gtggatgaaaagatggatgg

SEQ ID NO: 58403 - DNA, 20 bp, synthetic construct
  misc_feature 1..20: note = CRISPR gRNA sequence
  source 1..20: mol_type = other DNA
atgaaaagatggatggatgg

SEQ ID NO: 58404 - DNA, 20 bp, synthetic construct
  misc_feature 1..20: note = CRISPR gRNA sequence
  source 1..20: mol_type = other DNA
aaagatggatggatggatgg

SEQ ID NO: 58405 - DNA, 20 bp, synthetic construct
  misc_feature 1..20: note = CRISPR gRNA sequence
  source 1..20: mol_type = other DNA
atggatggatggatggatgg

SEQ ID NO: 58406 - DNA, 20 bp, synthetic construct
  misc_feature 1..20: note = CRISPR gRNA sequence
  source 1..20: mol_type = other DNA
atggatggatggatgaaaag

SEQ ID NO: 58407 - DNA, 20 bp, synthetic construct
  misc_feature 1..20: note = CRISPR gRNA sequence
  source 1..20: mol_type = other DNA
atggatggatgaaaagatgg

SEQ ID NO: 58408 - DNA, 20 bp, synthetic construct
  misc_feature 1..20: note = CRISPR gRNA sequence
  source 1..20: mol_type = other DNA
atggatgaaaagatggatgg

SEQ ID NO: 58409 - DNA, 20 bp, synthetic construct
  misc_feature 1..20: note = CRISPR gRNA sequence
  source 1..20: mol_type = other DNA
atggatgggtggatgaaaag

SEQ ID NO: 58410 - DNA, 20 bp, synthetic construct
  misc_feature 1..20: note = CRISPR gRNA sequence
  source 1..20: mol_type = other DNA
atgggtggatgaaaagatgg

SEQ ID NO: 58411 - DNA, 20 bp, synthetic construct
  misc_feature 1..20: note = CRISPR gRNA sequence
  source 1..20: mol_type = other DNA
gtggatgaaaagatggatgg

SEQ ID NO: 58412 - DNA, 20 bp, synthetic construct
  misc_feature 1..20: note = CRISPR gRNA sequence
  source 1..20: mol_type = other DNA
atgaaaagatggatggatgg

SEQ ID NO: 58413 - DNA, 20 bp, synthetic construct
  misc_feature 1..20: note = CRISPR gRNA sequence
  source 1..20: mol_type = other DNA
aaagatggatggatggatgg

SEQ ID NO: 58414 - DNA, 20 bp, synthetic construct
  misc_feature 1..20: note = CRISPR gRNA sequence
  source 1..20: mol_type = other DNA
atggatggatggaaagattg

SEQ ID NO: 58415 - DNA, 20 bp, synthetic construct
  misc_feature 1..20: note = CRISPR gRNA sequence
  source 1..20: mol_type = other DNA
atggatggaaagattgatgg

SEQ ID NO: 58416 - DNA, 20 bp, synthetic construct
  misc_feature 1..20: note = CRISPR gRNA sequence
  source 1..20: mol_type = other DNA
attgatgggtggatgaaaag

SEQ ID NO: 58417 - DNA, 20 bp, synthetic construct
  misc_feature 1..20: note = CRISPR gRNA sequence
  source 1..20: mol_type = other DNA
atgggtggatgaaaagatga

SEQ ID NO: 58418 - DNA, 20 bp, synthetic construct
  misc_feature 1..20: note = CRISPR gRNA sequence
  source 1..20: mol_type = other DNA
gtggatgaaaagatgaatgg

SEQ ID NO: 58419 - DNA, 20 bp, synthetic construct
  misc_feature 1..20: note = CRISPR gRNA sequence
  source 1..20: mol_type = other DNA
atgaaaagatgaatggatgg

SEQ ID NO: 58420 - DNA, 20 bp, synthetic construct
  misc_feature 1..20: note = CRISPR gRNA sequence
  source 1..20: mol_type = other DNA
atgaatggatggatggatag

SEQ ID NO: 58421 - DNA, 20 bp, synthetic construct
  misc_feature 1..20: note = CRISPR gRNA sequence
  source 1..20: mol_type = other DNA
atggatggatggatagatga

SEQ ID NO: 58422 - DNA, 20 bp, synthetic construct
  misc_feature 1..20: note = CRISPR gRNA sequence
  source 1..20: mol_type = other DNA
atggatggatagatgaatgg

SEQ ID NO: 58423 - DNA, 20 bp, synthetic construct
  misc_feature 1..20: note = CRISPR gRNA sequence
  source 1..20: mol_type = other DNA
atggatagatgaatggatgg

SEQ ID NO: 58424 - DNA, 20 bp, synthetic construct
  misc_feature 1..20: note = CRISPR gRNA sequence
  source 1..20: mol_type = other DNA
atagatggctagctgaaaag

SEQ ID NO: 58425 - DNA, 20 bp, synthetic construct
  misc_feature 1..20: note = CRISPR gRNA sequence
  source 1..20: mol_type = other DNA
atggataggtgtgtgaaaag

SEQ ID NO: 58426 - DNA, 20 bp, synthetic construct
  misc_feature 1..20: note = CRISPR gRNA sequence
  source 1..20: mol_type = other DNA
ataggtgtgtgaaaagatgg

SEQ ID NO: 58427 - DNA, 20 bp, synthetic construct
  misc_feature 1..20: note = CRISPR gRNA sequence
  source 1..20: mol_type = other DNA
gtgtgtgaaaagatggatgg

SEQ ID NO: 58428 - DNA, 20 bp, synthetic construct
  misc_feature 1..20: note = CRISPR gRNA sequence
  source 1..20: mol_type = other DNA
gtgaaaagatggatggatgg

SEQ ID NO: 58429 - DNA, 20 bp, synthetic construct
  misc_feature 1..20: note = CRISPR gRNA sequence
  source 1..20: mol_type = other DNA
aaagatggatggatggatgg

SEQ ID NO: 58430 - DNA, 20 bp, synthetic construct
  misc_feature 1..20: note = CRISPR gRNA sequence
  source 1..20: mol_type = other DNA
atggatggatggatggatgg

SEQ ID NO: 58431 - DNA, 20 bp, synthetic construct
  misc_feature 1..20: note = CRISPR gRNA sequence
  source 1..20: mol_type = other DNA
atggatggatggatggatgg

SEQ ID NO: 58432 - DNA, 20 bp, synthetic construct
  misc_feature 1..20: note = CRISPR gRNA sequence
  source 1..20: mol_type = other DNA
atggatggatggatggatgg

SEQ ID NO: 58433 - DNA, 20 bp, synthetic construct
  misc_feature 1..20: note = CRISPR gRNA sequence
  source 1..20: mol_type = other DNA
atggatggatggatggatgg

SEQ ID NO: 58434 - DNA, 20 bp, synthetic construct
  misc_feature 1..20: note = CRISPR gRNA sequence
  source 1..20: mol_type = other DNA
atggatggatggatggatgg

SEQ ID NO: 58435 - DNA, 20 bp, synthetic construct
  misc_feature 1..20: note = CRISPR gRNA sequence
  source 1..20: mol_type = other DNA
atggatggatggatggatgg

SEQ ID NO: 58436 - DNA, 20 bp, synthetic construct
  misc_feature 1..20: note = CRISPR gRNA sequence
  source 1..20: mol_type = other DNA
atggatggatggatggatgg

SEQ ID NO: 58437 - DNA, 20 bp, synthetic construct
  misc_feature 1..20: note = CRISPR gRNA sequence
  source 1..20: mol_type = other DNA
atggatggatggatggatga

SEQ ID NO: 58438 - DNA, 20 bp, synthetic construct
  misc_feature 1..20: note = CRISPR gRNA sequence
  source 1..20: mol_type = other DNA
atggatggatggatgaagga

SEQ ID NO: 58439 - DNA, 20 bp, synthetic construct
  misc_feature 1..20: note = CRISPR gRNA sequence
  source 1..20: mol_type = other DNA
cgaagcacaggcatagccaa

SEQ ID NO: 58440 - DNA, 20 bp, synthetic construct
  misc_feature 1..20: note = CRISPR gRNA sequence
  source 1..20: mol_type = other DNA
aatatagccagttttgatca

SEQ ID NO: 58441 - DNA, 20 bp, synthetic construct
  misc_feature 1..20: note = CRISPR gRNA sequence
  source 1..20: mol_type = other DNA
actttggaaggccaaggcaa

SEQ ID NO: 58442 - DNA, 20 bp, synthetic construct
  misc_feature 1..20: note = CRISPR gRNA sequence
  source 1..20: mol_type = other DNA
caagaggattacttgagctc

SEQ ID NO: 58443 - DNA, 20 bp, synthetic construct
  misc_feature 1..20: note = CRISPR gRNA sequence
  source 1..20: mol_type = other DNA
acacaccactgcactccagc

SEQ ID NO: 58444 - DNA, 20 bp, synthetic construct
  misc_feature 1..20: note = CRISPR gRNA sequence
  source 1..20: mol_type = other DNA
ctgcactccagcctgagtag

SEQ ID NO: 58445 - DNA, 20 bp, synthetic construct
  misc_feature 1..20: note = CRISPR gRNA sequence
  source 1..20: mol_type = other DNA
gactttttaaaacactcttg

SEQ ID NO: 58446 - DNA, 20 bp, synthetic construct
  misc_feature 1..20: note = CRISPR gRNA sequence
  source 1..20: mol_type = other DNA
aattgcaaaatcagctttat

SEQ ID NO: 58447 - DNA, 20 bp, synthetic construct
  misc_feature 1..20: note = CRISPR gRNA sequence
  source 1..20: mol_type = other DNA
tttgaacatttggggcagaa

SEQ ID NO: 58448 - DNA, 20 bp, synthetic construct
  misc_feature 1..20: note = CRISPR gRNA sequence
  source 1..20: mol_type = other DNA
cagaaaagggtgtgcctgtg

SEQ ID NO: 58449 - DNA, 20 bp, synthetic construct
  misc_feature 1..20: note = CRISPR gRNA sequence
  source 1..20: mol_type = other DNA
gatgtgctggtttccagtct

SEQ ID NO: 58450 - DNA, 20 bp, synthetic construct
  misc_feature 1..20: note = CRISPR gRNA sequence
  source 1..20: mol_type = other DNA
accaagagactaggaagagc

SEQ ID NO: 58451 - DNA, 20 bp, synthetic construct
  misc_feature 1..20: note = CRISPR gRNA sequence
  source 1..20: mol_type = other DNA
actaggaagagctggggtat

SEQ ID NO: 58452 - DNA, 20 bp, synthetic construct
  misc_feature 1..20: note = CRISPR gRNA sequence
  source 1..20: mol_type = other DNA
ttcctgctactgctgcactg

SEQ ID NO: 58453 - DNA, 20 bp, synthetic construct
  misc_feature 1..20: note = CRISPR gRNA sequence
  source 1..20: mol_type = other DNA
tgctactgctgcactgagga

SEQ ID NO: 58454 - DNA, 20 bp, synthetic construct
  misc_feature 1..20: note = CRISPR gRNA sequence
  source 1..20: mol_type = other DNA
aattactgcttaggttggca

SEQ ID NO: 58455 - DNA, 20 bp, synthetic construct
  misc_feature 1..20: note = CRISPR gRNA sequence
  source 1..20: mol_type = other DNA
caattatggtacctacatct

SEQ ID NO: 58456 - DNA, 20 bp, synthetic construct
  misc_feature 1..20: note = CRISPR gRNA sequence
  source 1..20: mol_type = other DNA
ctacatcttagggttgttct

SEQ ID NO: 58457 - DNA, 20 bp, synthetic construct
  misc_feature 1..20: note = CRISPR gRNA sequence
  source 1..20: mol_type = other DNA
agggttgttctgagaattaa

SEQ ID NO: 58458 - DNA, 20 bp, synthetic construct
  misc_feature 1..20: note = CRISPR gRNA sequence
  source 1..20: mol_type = other DNA
taaatgagttactacactta

SEQ ID NO: 58459 - DNA, 20 bp, synthetic construct
  misc_feature 1..20: note = CRISPR gRNA sequence
  source 1..20: mol_type = other DNA
gctggctattccagctgtgc

SEQ ID NO: 58460 - DNA, 20 bp, synthetic construct
  misc_feature 1..20: note = CRISPR gRNA sequence
  source 1..20: mol_type = other DNA
ggattccagcttggccagtc

SEQ ID NO: 58461 - DNA, 20 bp, synthetic construct
  misc_feature 1..20: note = CRISPR gRNA sequence
  source 1..20: mol_type = other DNA
gagcaatctctttcccttct

SEQ ID NO: 58462 - DNA, 20 bp, synthetic construct
  misc_feature 1..20: note = CRISPR gRNA sequence
  source 1..20: mol_type = other DNA
gtagtgtaggaccaatgttg

SEQ ID NO: 58463 - DNA, 20 bp, synthetic construct
  misc_feature 1..20: note = CRISPR gRNA sequence
  source 1..20: mol_type = other DNA
cactttggaacgccaagcac

SEQ ID NO: 58464 - DNA, 20 bp, synthetic construct
  misc_feature 1..20: note = CRISPR gRNA sequence
  source 1..20: mol_type = other DNA
actcaagatgctgacgttgg

SEQ ID NO: 58465 - DNA, 20 bp, synthetic construct
  misc_feature 1..20: note = CRISPR gRNA sequence
  source 1..20: mol_type = other DNA
tcacaccactgtactccagc

SEQ ID NO: 58466 - DNA, 20 bp, synthetic construct
  misc_feature 1..20: note = CRISPR gRNA sequence
  source 1..20: mol_type = other DNA
cttaaagctgtgatgctcag

SEQ ID NO: 58467 - DNA, 20 bp, synthetic construct
  misc_feature 1..20: note = CRISPR gRNA sequence
  source 1..20: mol_type = other DNA
actttgagaggctgaggggg

SEQ ID NO: 58468 - DNA, 20 bp, synthetic construct
  misc_feature 1..20: note = CRISPR gRNA sequence
  source 1..20: mol_type = other DNA
gggcaggatcgcttgaagct

SEQ ID NO: 58469 - DNA, 20 bp, synthetic construct
  misc_feature 1..20: note = CRISPR gRNA sequence
  source 1..20: mol_type = other DNA
tactcaggaagccaaggtgg

SEQ ID NO: 58470 - DNA, 20 bp, synthetic construct
  misc_feature 1..20: note = CRISPR gRNA sequence
  source 1..20: mol_type = other DNA
tgggaggatcacttgagccc

SEQ ID NO: 58471 - DNA, 20 bp, synthetic construct
  misc_feature 1..20: note = CRISPR gRNA sequence
  source 1..20: mol_type = other DNA
agtttgaggctgcagtgaac

SEQ ID NO: 58472 - DNA, 20 bp, synthetic construct
  misc_feature 1..20: note = CRISPR gRNA sequence
  source 1..20: mol_type = other DNA
actgcactccagcttgggga

SEQ ID NO: 58473 - DNA, 20 bp, synthetic construct
  misc_feature 1..20: note = CRISPR gRNA sequence
  source 1..20: mol_type = other DNA
gctccctcagcccagtggga

SEQ ID NO: 58474 - DNA, 20 bp, synthetic construct
  misc_feature 1..20: note = CRISPR gRNA sequence
  source 1..20: mol_type = other DNA
ccttcgattttacacctatg

SEQ ID NO: 58475 - DNA, 20 bp, synthetic construct
  misc_feature 1..20: note = CRISPR gRNA sequence
  source 1..20: mol_type = other DNA
atacatggcagagccaaaat

SEQ ID NO: 58476 - DNA, 20 bp, synthetic construct
  misc_feature 1..20: note = CRISPR gRNA sequence
  source 1..20: mol_type = other DNA
ctgttgcccctcctgctctg

SEQ ID NO: 58477 - DNA, 20 bp, synthetic construct
  misc_feature 1..20: note = CRISPR gRNA sequence
  source 1..20: mol_type = other DNA
tcctttgttaccgactcact

SEQ ID NO: 58478 - DNA, 20 bp, synthetic construct
  misc_feature 1..20: note = CRISPR gRNA sequence
  source 1..20: mol_type = other DNA
actcactttgggttgtgctt

SEQ ID NO: 58479 - DNA, 20 bp, synthetic construct
  misc_feature 1..20: note = CRISPR gRNA sequence
  source 1..20: mol_type = other DNA
ttgacgctcaggtaccttgg

SEQ ID NO: 58480 - DNA, 20 bp, synthetic construct
  misc_feature 1..20: note = CRISPR gRNA sequence
  source 1..20: mol_type = other DNA
gggatctattgccttaggag

SEQ ID NO: 58481 - DNA, 20 bp, synthetic construct
  misc_feature 1..20: note = CRISPR gRNA sequence
  source 1..20: mol_type = other DNA
caagggagagcaggggcagg

SEQ ID NO: 58482 - DNA, 20 bp, synthetic construct
  misc_feature 1..20: note = CRISPR gRNA sequence
  source 1..20: mol_type = other DNA
aagcagatgagggacaggga

SEQ ID NO: 58483 - DNA, 20 bp, synthetic construct
  misc_feature 1..20: note = CRISPR gRNA sequence
  source 1..20: mol_type = other DNA
agggacagggaaaggattag

SEQ ID NO: 58484 - DNA, 20 bp, synthetic construct
  misc_feature 1..20: note = CRISPR gRNA sequence
  source 1..20: mol_type = other DNA
agccgggtgtggtgcccatc

SEQ ID NO: 58485 - DNA, 20 bp, synthetic construct
  misc_feature 1..20: note = CRISPR gRNA sequence
  source 1..20: mol_type = other DNA
cctggatagcccatcctggc

SEQ ID NO: 58486 - DNA, 20 bp, synthetic construct
  misc_feature 1..20: note = CRISPR gRNA sequence
  source 1..20: mol_type = other DNA
ttacctcactgtaattcctt

SEQ ID NO: 58487 - DNA, 20 bp, synthetic construct
  misc_feature 1..20: note = CRISPR gRNA sequence
  source 1..20: mol_type = other DNA
ccctttgagggaggaggaaa

SEQ ID NO: 58488 - DNA, 20 bp, synthetic construct
  misc_feature 1..20: note = CRISPR gRNA sequence
  source 1..20: mol_type = other DNA
cagctactaagaggtgtggc

SEQ ID NO: 58489 - DNA, 20 bp, synthetic construct
  misc_feature 1..20: note = CRISPR gRNA sequence
  source 1..20: mol_type = other DNA
attggaagctggaggggcca

SEQ ID NO: 58490 - DNA, 20 bp, synthetic construct
  misc_feature 1..20: note = CRISPR gRNA sequence
  source 1..20: mol_type = other DNA
aggccctcacctggaggaag

SEQ ID NO: 58491 - DNA, 20 bp, synthetic construct
  misc_feature 1..20: note = CRISPR gRNA sequence
  source 1..20: mol_type = other DNA
cctcacctggaggaagtgga

SEQ ID NO: 58492 - DNA, 20 bp, synthetic construct
  misc_feature 1..20: note = CRISPR gRNA sequence
  source 1..20: mol_type = other DNA
agccaggaaaggaggttgga

SEQ ID NO: 58493 - DNA, 20 bp, synthetic construct
  misc_feature 1..20: note = CRISPR gRNA sequence
  source 1..20: mol_type = other DNA
gggtgggcagggcctcgcct

SEQ ID NO: 58494 - DNA, 20 bp, synthetic construct
  misc_feature 1..20: note = CRISPR gRNA sequence
  source 1..20: mol_type = other DNA
gggcagggcctcgcctttgg

SEQ ID NO: 58495 - DNA, 20 bp, synthetic construct
  misc_feature 1..20: note = CRISPR gRNA sequence
  source 1..20: mol_type = other DNA
gaggggcatgctgcctcatg

SEQ ID NO: 58496 - DNA, 20 bp, synthetic construct
  misc_feature 1..20: note = CRISPR gRNA sequence
  source 1..20: mol_type = other DNA
ctgcctcatgaagaatttgg

SEQ ID NO: 58497 - DNA, 20 bp, synthetic construct
  misc_feature 1..20: note = CRISPR gRNA sequence
  source 1..20: mol_type = other DNA
gctactattcagcacttgtc

SEQ ID NO: 58498 - DNA, 20 bp, synthetic construct
  misc_feature 1..20: note = CRISPR gRNA sequence
  source 1..20: mol_type = other DNA
ctcaaggccacacaggtagg

SEQ ID NO: 58499 - DNA, 20 bp, synthetic construct
  misc_feature 1..20: note = CRISPR gRNA sequence
  source 1..20: mol_type = other DNA
caggtaggaagagtctaggc

SEQ ID NO: 58500 - DNA, 20 bp, synthetic construct
  misc_feature 1..20: note = CRISPR gRNA sequence
  source 1..20: mol_type = other DNA
aagtagaaaccccaccacac

SEQ ID NO: 58501 - DNA, 20 bp, synthetic construct
  misc_feature 1..20: note = CRISPR gRNA sequence
  source 1..20: mol_type = other DNA
cacccccttcatccttctcc

SEQ ID NO: 58502 - DNA, 20 bp, synthetic construct
  misc_feature 1..20: note = CRISPR gRNA sequence
  source 1..20: mol_type = other DNA
ccttcatccttctcccagag

SEQ ID NO: 58503 - DNA, 20 bp, synthetic construct
  misc_feature 1..20: note = CRISPR gRNA sequence
  source 1..20: mol_type = other DNA
atccttctcccagagtagag

SEQ ID NO: 58504 - DNA, 20 bp, synthetic construct
  misc_feature 1..20: note = CRISPR gRNA sequence
  source 1..20: mol_type = other DNA
gtgggataaccttctctttt

SEQ ID NO: 58505 - DNA, 20 bp, synthetic construct
  misc_feature 1..20: note = CRISPR gRNA sequence
  source 1..20: mol_type = other DNA
agcccctggctgaagccaat

SEQ ID NO: 58506 - DNA, 20 bp, synthetic construct
  misc_feature 1..20: note = CRISPR gRNA sequence
  source 1..20: mol_type = other DNA
agccaataagagtagtgctt

SEQ ID NO: 58507 - DNA, 20 bp, synthetic construct
  misc_feature 1..20: note = CRISPR gRNA sequence
  source 1..20: mol_type = other DNA
gaaggcagatgatggaacgc

SEQ ID NO: 58508 - DNA, 20 bp, synthetic construct
  misc_feature 1..20: note = CRISPR gRNA sequence
  source 1..20: mol_type = other DNA
atggaacgccaggatgtgtt

SEQ ID NO: 58509 - DNA, 20 bp, synthetic construct
  misc_feature 1..20: note = CRISPR gRNA sequence
  source 1..20: mol_type = other DNA
acgccaggatgtgttctggg

SEQ ID NO: 58510 - DNA, 20 bp, synthetic construct
  misc_feature 1..20: note = CRISPR gRNA sequence
  source 1..20: mol_type = other DNA
tgggtcgagtggccccacct

SEQ ID NO: 58511 - DNA, 20 bp, synthetic construct
  misc_feature 1..20: note = CRISPR gRNA sequence
  source 1..20: mol_type = other DNA
tggccccacctcagggtaag

SEQ ID NO: 58512 - DNA, 20 bp, synthetic construct
  misc_feature 1..20: note = CRISPR gRNA sequence
  source 1..20: mol_type = other DNA
cacctcagggtaagacggat

SEQ ID NO: 58513 - DNA, 20 bp, synthetic construct
  misc_feature 1..20: note = CRISPR gRNA sequence
  source 1..20: mol_type = other DNA
agggtaagacggataggggt

SEQ ID NO: 58514 - DNA, 20 bp, synthetic construct
  misc_feature 1..20: note = CRISPR gRNA sequence
  source 1..20: mol_type = other DNA
tcccattgggagaaccagga

SEQ ID NO: 58515 - DNA, 20 bp, synthetic construct
  misc_feature 1..20: note = CRISPR gRNA sequence
  source 1..20: mol_type = other DNA
agcactgagcatgcccctcc

SEQ ID NO: 58516 - DNA, 20 bp, synthetic construct
  misc_feature 1..20: note = CRISPR gRNA sequence
  source 1..20: mol_type = other DNA
aacccaccctcatctcttac

SEQ ID NO: 58517 - DNA, 20 bp, synthetic construct
  misc_feature 1..20: note = CRISPR gRNA sequence
  source 1..20: mol_type = other DNA
ctggccacttccacctggca

SEQ ID NO: 58518 - DNA, 20 bp, synthetic construct
  misc_feature 1..20: note = CRISPR gRNA sequence
  source 1..20: mol_type = other DNA
cttcactccttcccactgct

SEQ ID NO: 58519 - DNA, 20 bp, synthetic construct
  misc_feature 1..20: note = CRISPR gRNA sequence
  source 1..20: mol_type = other DNA
tgtgttatgccacagggcct

SEQ ID NO: 58520 - DNA, 20 bp, synthetic construct
  misc_feature 1..20: note = CRISPR gRNA sequence
  source 1..20: mol_type = other DNA
tgtaacttgcagcataaagg

SEQ ID NO: 58521 - DNA, 20 bp, synthetic construct
  misc_feature 1..20: note = CRISPR gRNA sequence
  source 1..20: mol_type = other DNA
tgcagcataaaggaagagtt

SEQ ID NO: 58522 - DNA, 20 bp, synthetic construct
  misc_feature 1..20: note = CRISPR gRNA sequence
  source 1..20: mol_type = other DNA
gggccttgaaggcaggctgc

SEQ ID NO: 58523 - DNA, 20 bp, synthetic construct
  misc_feature 1..20: note = CRISPR gRNA sequence
  source 1..20: mol_type = other DNA
tgcacttaaccactctgcac

SEQ ID NO: 58524 - DNA, 20 bp, synthetic construct
  misc_feature 1..20: note = CRISPR gRNA sequence
  source 1..20: mol_type = other DNA
agtttactcatcagtaaggt

SEQ ID NO: 58525 - DNA, 20 bp, synthetic construct
  misc_feature 1..20: note = CRISPR gRNA sequence
  source 1..20: mol_type = other DNA
gcccacgtcatcggcactat

SEQ ID NO: 58526 - DNA, 20 bp, synthetic construct
  misc_feature 1..20: note = CRISPR gRNA sequence
  source 1..20: mol_type = other DNA
ccaatagtcatagaagaacc

SEQ ID NO: 58527 - DNA, 20 bp, synthetic construct
  misc_feature 1..20: note = CRISPR gRNA sequence
  source 1..20: mol_type = other DNA
atgttgccaggcatgtggta

SEQ ID NO: 58528 - DNA, 20 bp, synthetic construct
  misc_feature 1..20: note = CRISPR gRNA sequence
  source 1..20: mol_type = other DNA
tattatcaaggttcattcct

SEQ ID NO: 58529 - DNA, 20 bp, synthetic construct
  misc_feature 1..20: note = CRISPR gRNA sequence
  source 1..20: mol_type = other DNA
ttgactaaagttagcaaagg

SEQ ID NO: 58530 - DNA, 20 bp, synthetic construct
  misc_feature 1..20: note = CRISPR gRNA sequence
  source 1..20: mol_type = other DNA
gcaaaggaggagtaagtgat

SEQ ID NO: 58531 - DNA, 20 bp, synthetic construct
  misc_feature 1..20: note = CRISPR gRNA sequence
  source 1..20: mol_type = other DNA
gctgcacatcgccaggaagc

SEQ ID NO: 58532 - DNA, 20 bp, synthetic construct
  misc_feature 1..20: note = CRISPR gRNA sequence
  source 1..20: mol_type = other DNA
cacatcgccaggaagctgga

SEQ ID NO: 58533 - DNA, 20 bp, synthetic construct
  misc_feature 1..20: note = CRISPR gRNA sequence
  source 1..20: mol_type = other DNA
gtgagttgtccaccccaccg

SEQ ID NO: 58534 - DNA, 20 bp, synthetic construct
  misc_feature 1..20: note = CRISPR gRNA sequence
  source 1..20: mol_type = other DNA
ccgtgttcgtaatcagcagt

SEQ ID NO: 58535 - DNA, 20 bp, synthetic construct
  misc_feature 1..20: note = CRISPR gRNA sequence
  source 1..20: mol_type = other DNA
gtagctgccctggagcacgg

SEQ ID NO: 58536 - DNA, 20 bp, synthetic construct
  misc_feature 1..20: note = CRISPR gRNA sequence
  source 1..20: mol_type = other DNA
tgccctggagcacggtgggg

SEQ ID NO: 58537 - DNA, 20 bp, synthetic construct
  misc_feature 1..20: note = CRISPR gRNA sequence
  source 1..20: mol_type = other DNA
gtgttgcactggggaggtgt

SEQ ID NO: 58538 - DNA, 20 bp, synthetic construct
  misc_feature 1..20: note = CRISPR gRNA sequence
  source 1..20: mol_type = other DNA
tgcactggggaggtgtcagg

SEQ ID NO: 58539 - DNA, 20 bp, synthetic construct
  misc_feature 1..20: note = CRISPR gRNA sequence
  source 1..20: mol_type = other DNA
tggggaggtgtcagggtggg

SEQ ID NO: 58540 - DNA, 20 bp, synthetic construct
  misc_feature 1..20: note = CRISPR gRNA sequence
  source 1..20: mol_type = other DNA
gcactgtggaggtgtcatgc

SEQ ID NO: 58541 - DNA, 20 bp, synthetic construct
  misc_feature 1..20: note = CRISPR gRNA sequence
  source 1..20: mol_type = other DNA
gaggtgtcatgctggggtgc

SEQ ID NO: 58542 - DNA, 20 bp, synthetic construct
  misc_feature 1..20: note = CRISPR gRNA sequence
  source 1..20: mol_type = other DNA
catgctggggtgctagggta

SEQ ID NO: 58543 - DNA, 20 bp, synthetic construct
  misc_feature 1..20: note = CRISPR gRNA sequence
  source 1..20: mol_type = other DNA
agggagtggtgtgttcctgt

SEQ ID NO: 58544 - DNA, 20 bp, synthetic construct
  misc_feature 1..20: note = CRISPR gRNA sequence
  source 1..20: mol_type = other DNA
ttcctgtggggatacactgt

SEQ ID NO: 58545 - DNA, 20 bp, synthetic construct
  misc_feature 1..20: note = CRISPR gRNA sequence
  source 1..20: mol_type = other DNA
ggggatacactgttggggtg

SEQ ID NO: 58546 - DNA, 20 bp, synthetic construct
  misc_feature 1..20: note = CRISPR gRNA sequence
  source 1..20: mol_type = other DNA
aaaggtaggctattaggctg

SEQ ID NO: 58547 - DNA, 20 bp, synthetic construct
  misc_feature 1..20: note = CRISPR gRNA sequence
  source 1..20: mol_type = other DNA
gggtgtgctgtggtgttgca

SEQ ID NO: 58548 - DNA, 20 bp, synthetic construct
  misc_feature 1..20: note = CRISPR gRNA sequence
  source 1..20: mol_type = other DNA
gctgtggtgttgcatggggt

SEQ ID NO: 58549 - DNA, 20 bp, synthetic construct
  misc_feature 1..20: note = CRISPR gRNA sequence
  source 1..20: mol_type = other DNA
gcatggggtgagggtgatgt

SEQ ID NO: 58550 - DNA, 20 bp, synthetic construct
  misc_feature 1..20: note = CRISPR gRNA sequence
  source 1..20: mol_type = other DNA
ggtgagggtgatgtttgggt

SEQ ID NO: 58551 - DNA, 20 bp, synthetic construct
  misc_feature 1..20: note = CRISPR gRNA sequence
  source 1..20: mol_type = other DNA
tgtttgggtgggggtgtctt

SEQ ID NO: 58552 - DNA, 20 bp, synthetic construct
  misc_feature 1..20: note = CRISPR gRNA sequence
  source 1..20: mol_type = other DNA
tgggggtgtcttgggggtct

SEQ ID NO: 58553 - DNA, 20 bp, synthetic construct
  misc_feature 1..20: note = CRISPR gRNA sequence
  source 1..20: mol_type = other DNA
tgggggtcttaggatcaagt

SEQ ID NO: 58554 - DNA, 20 bp, synthetic construct
  misc_feature 1..20: note = CRISPR gRNA sequence
  source 1..20: mol_type = other DNA
gtcttaggatcaagtgtggg

SEQ ID NO: 58555 - DNA, 20 bp, synthetic construct
  misc_feature 1..20: note = CRISPR gRNA sequence
  source 1..20: mol_type = other DNA
tcaagtgtgggtcgggtttg

SEQ ID NO: 58556 - DNA, 20 bp, synthetic construct
  misc_feature 1..20: note = CRISPR gRNA sequence
  source 1..20: mol_type = other DNA
gggtttggggagtgttgaga

SEQ ID NO: 58557 - DNA, 20 bp, synthetic construct
  misc_feature 1..20: note = CRISPR gRNA sequence
  source 1..20: mol_type = other DNA
agtggtttggggcctcagct

SEQ ID NO: 58558 - DNA, 20 bp, synthetic construct
  misc_feature 1..20: note = CRISPR gRNA sequence
  source 1..20: mol_type = other DNA
ttgtgaacctgggaaagtaa

SEQ ID NO: 58559 - DNA, 20 bp, synthetic construct
  misc_feature 1..20: note = CRISPR gRNA sequence
  source 1..20: mol_type = other DNA
tcggtttcccctctgtaaaa

SEQ ID NO: 58560 - DNA, 20 bp, synthetic construct
  misc_feature 1..20: note = CRISPR gRNA sequence
  source 1..20: mol_type = other DNA
tatgtacaaagccttttgta

SEQ ID NO: 58561 - DNA, 20 bp, synthetic construct
  misc_feature 1..20: note = CRISPR gRNA sequence
  source 1..20: mol_type = other DNA
attttacagatgagaaaact

SEQ ID NO: 58562 - DNA, 20 bp, synthetic construct
  misc_feature 1..20: note = CRISPR gRNA sequence
  source 1..20: mol_type = other DNA
gggtcagagaggtgaaaaca

SEQ ID NO: 58563 - DNA, 20 bp, synthetic construct
  misc_feature 1..20: note = CRISPR gRNA sequence
  source 1..20: mol_type = other DNA
ggacaactttattttccaaa

SEQ ID NO: 58564 - DNA, 20 bp, synthetic construct
  misc_feature 1..20: note = CRISPR gRNA sequence
  source 1..20: mol_type = other DNA
ctttattttccaaatgggat

SEQ ID NO: 58565 - DNA, 20 bp, synthetic construct
  misc_feature 1..20: note = CRISPR gRNA sequence
  source 1..20: mol_type = other DNA
tttggcttactcacacgcac

SEQ ID NO: 58566 - DNA, 20 bp, synthetic construct
  misc_feature 1..20: note = CRISPR gRNA sequence
  source 1..20: mol_type = other DNA
gcaagggacctaggacatcc

SEQ ID NO: 58567 - DNA, 20 bp, synthetic construct
  misc_feature 1..20: note = CRISPR gRNA sequence
  source 1..20: mol_type = other DNA
ggggctagagctggctgggg

SEQ ID NO: 58568 - DNA, 20 bp, synthetic construct
  misc_feature 1..20: note = CRISPR gRNA sequence
  source 1..20: mol_type = other DNA
aacaacgggctttctgtggc

SEQ ID NO: 58569 - DNA, 20 bp, synthetic construct
  misc_feature 1..20: note = CRISPR gRNA sequence
  source 1..20: mol_type = other DNA
tgcattgtgtgctgagggcc

SEQ ID NO: 58570 - DNA, 20 bp, synthetic construct
  misc_feature 1..20: note = CRISPR gRNA sequence
  source 1..20: mol_type = other DNA
catgctctctctgaagccct

SEQ ID NO: 58571 - DNA, 20 bp, synthetic construct
  misc_feature 1..20: note = CRISPR gRNA sequence
  source 1..20: mol_type = other DNA
cacccctcttcctagctgct

SEQ ID NO: 58572 - DNA, 20 bp, synthetic construct
  misc_feature 1..20: note = CRISPR gRNA sequence
  source 1..20: mol_type = other DNA
taagaaccagagacgcctgg

SEQ ID NO: 58573 - DNA, 20 bp, synthetic construct
  misc_feature 1..20: note = CRISPR gRNA sequence
  source 1..20: mol_type = other DNA
acccccactttcccctaacc

SEQ ID NO: 58574 - DNA, 20 bp, synthetic construct
  misc_feature 1..20: note = CRISPR gRNA sequence
  source 1..20: mol_type = other DNA
tatttctgtaagtctcgccg

SEQ ID NO: 58575 - DNA, 20 bp, synthetic construct
  misc_feature 1..20: note = CRISPR gRNA sequence
  source 1..20: mol_type = other DNA
aagcctcattctcaacccag

SEQ ID NO: 58576 - DNA, 20 bp, synthetic construct
  misc_feature 1..20: note = CRISPR gRNA sequence
  source 1..20: mol_type = other DNA
ctgtatatgatgattcaata

SEQ ID NO: 58577 - DNA, 20 bp, synthetic construct
  misc_feature 1..20: note = CRISPR gRNA sequence
  source 1..20: mol_type = other DNA
gtgcaaacacatttagctgt

SEQ ID NO: 58578 - DNA, 20 bp, synthetic construct
  misc_feature 1..20: note = CRISPR gRNA sequence
  source 1..20: mol_type = other DNA
ggaaaaaaaaagaaaatagc

SEQ ID NO: 58579 - DNA, 20 bp, synthetic construct
  misc_feature 1..20: note = CRISPR gRNA sequence
  source 1..20: mol_type = other DNA
atagctggaatgtttaaccg

SEQ ID NO: 58580 - DNA, 20 bp, synthetic construct
  misc_feature 1..20: note = CRISPR gRNA sequence
  source 1..20: mol_type = other DNA
taggtgcagtttcaatatgg

SEQ ID NO: 58581 - DNA, 20 bp, synthetic construct
  misc_feature 1..20: note = CRISPR gRNA sequence
  source 1..20: mol_type = other DNA
ttcaatatggaggggtgacg

SEQ ID NO: 58582 - DNA, 20 bp, synthetic construct
  misc_feature 1..20: note = CRISPR gRNA sequence
  source 1..20: mol_type = other DNA
taaagaaatttctttagaga

SEQ ID NO: 58583 - DNA, 20 bp, synthetic construct
  misc_feature 1..20: note = CRISPR gRNA sequence
  source 1..20: mol_type = other DNA
tcttgctctgttaccaaggc

SEQ ID NO: 58584 - DNA, 20 bp, synthetic construct
  misc_feature 1..20: note = CRISPR gRNA sequence
  source 1..20: mol_type = other DNA
ctcttagtctcccaaagtgc

SEQ ID NO: 58585 - DNA, 20 bp, synthetic construct
  misc_feature 1..20: note = CRISPR gRNA sequence
  source 1..20: mol_type = other DNA
aaagtgctgggattacagtc

SEQ ID NO: 58586 - DNA, 20 bp, synthetic construct
  misc_feature 1..20: note = CRISPR gRNA sequence
  source 1..20: mol_type = other DNA
ttttttatttttagtagaga

SEQ ID NO: 58587 - DNA, 20 bp, synthetic construct
  misc_feature 1..20: note = CRISPR gRNA sequence
  source 1..20: mol_type = other DNA
gccctggcctcccaaagagc

SEQ ID NO: 58588 - DNA, 20 bp, synthetic construct
  misc_feature 1..20: note = CRISPR gRNA sequence
  source 1..20: mol_type = other DNA
tcaagatatgcaatggcaga

SEQ ID NO: 58589 - DNA, 20 bp, synthetic construct
  misc_feature 1..20: note = CRISPR gRNA sequence
  source 1..20: mol_type = other DNA
actttgggaggctgaggcag

SEQ ID NO: 58590 - DNA, 20 bp, synthetic construct
  misc_feature 1..20: note = CRISPR gRNA sequence
  source 1..20: mol_type = other DNA
cagggggatcacctgaggtc

SEQ ID NO: 58591 - DNA, 20 bp, synthetic construct
  misc_feature 1..20: note = CRISPR gRNA sequence
  source 1..20: mol_type = other DNA
ttcaagaccagcctggccaa

SEQ ID NO: 58592 - DNA, 20 bp, synthetic construct
  misc_feature 1..20: note = CRISPR gRNA sequence
  source 1..20: mol_type = other DNA
tactcaggaggctgaggcag

SEQ ID NO: 58593 - DNA, 20 bp, synthetic construct
  misc_feature 1..20: note = CRISPR gRNA sequence
  source 1..20: mol_type = other DNA
aaaaaactaatgtttaaaaa

SEQ ID NO: 58594 - DNA, 20 bp, synthetic construct
  misc_feature 1..20: note = CRISPR gRNA sequence
  source 1..20: mol_type = other DNA
gactcactccaaaggttacc

SEQ ID NO: 58595 - DNA, 20 bp, synthetic construct
  misc_feature 1..20: note = CRISPR gRNA sequence
  source 1..20: mol_type = other DNA
gaacactgactagcagagag

SEQ ID NO: 58596 - DNA, 20 bp, synthetic construct
  misc_feature 1..20: note = CRISPR gRNA sequence
  source 1..20: mol_type = other DNA
tggggctaaaagagagaaca

SEQ ID NO: 58597 - DNA, 20 bp, synthetic construct
  misc_feature 1..20: note = CRISPR gRNA sequence
  source 1..20: mol_type = other DNA
aagctcagaggaagtcagag

SEQ ID NO: 58598 - DNA, 20 bp, synthetic construct
  misc_feature 1..20: note = CRISPR gRNA sequence
  source 1..20: mol_type = other DNA
gtggctgcagctggaggcag

SEQ ID NO: 58599 - DNA, 20 bp, synthetic construct
  misc_feature 1..20: note = CRISPR gRNA sequence
  source 1..20: mol_type = other DNA
ttgagaggtcctcccgggcc

SEQ ID NO: 58600 - DNA, 20 bp, synthetic construct
  misc_feature 1..20: note = CRISPR gRNA sequence
  source 1..20: mol_type = other DNA
actttgggaagcaaaggtgg

SEQ ID NO: 58601 - DNA, 20 bp, synthetic construct
  misc_feature 1..20: note = CRISPR gRNA sequence
  source 1..20: mol_type = other DNA
tgagcccagaagttcgagac

SEQ ID NO: 58602 - DNA, 20 bp, synthetic construct
  misc_feature 1..20: note = CRISPR gRNA sequence
  source 1..20: mol_type = other DNA
tactcaggaggctgaagtgg

SEQ ID NO: 58603 - DNA, 20 bp, synthetic construct
  misc_feature 1..20: note = CRISPR gRNA sequence
  source 1..20: mol_type = other DNA
agtgccagtcagtcaactgc

SEQ ID NO: 58604 - DNA, 20 bp, synthetic construct
  misc_feature 1..20: note = CRISPR gRNA sequence
  source 1..20: mol_type = other DNA
ggaagtgagcaggcttggca

SEQ ID NO: 58605 - DNA, 20 bp, synthetic construct
  misc_feature 1..20: note = CRISPR gRNA sequence
  source 1..20: mol_type = other DNA
aggatgcagccccaaagggg

SEQ ID NO: 58606 - DNA, 20 bp, synthetic construct
  misc_feature 1..20: note = CRISPR gRNA sequence
  source 1..20: mol_type = other DNA
ctgaaaggagccccagtgtg

SEQ ID NO: 58607 - DNA, 20 bp, synthetic construct
  misc_feature 1..20: note = CRISPR gRNA sequence
  source 1..20: mol_type = other DNA
tatagacagcaggccagggc

SEQ ID NO: 58608 - DNA, 20 bp, synthetic construct
  misc_feature 1..20: note = CRISPR gRNA sequence
  source 1..20: mol_type = other DNA
acagcaggccagggcaggag

SEQ ID NO: 58609 - DNA, 20 bp, synthetic construct
  misc_feature 1..20: note = CRISPR gRNA sequence
  source 1..20: mol_type = other DNA
caggagttgggtagccagag

SEQ ID NO: 58610 - DNA, 20 bp, synthetic construct
  misc_feature 1..20: note = CRISPR gRNA sequence
  source 1..20: mol_type = other DNA
agccctccagcttaaaccca

SEQ ID NO: 58611 - DNA, 20 bp, synthetic construct
  misc_feature 1..20: note = CRISPR gRNA sequence
  source 1..20: mol_type = other DNA
cctttcacacaaggacccat

SEQ ID NO: 58612 - DNA, 20 bp, synthetic construct
  misc_feature 1..20: note = CRISPR gRNA sequence
  source 1..20: mol_type = other DNA
cacaaggacccattagggtc

SEQ ID NO: 58613 - DNA, 20 bp, synthetic construct
  misc_feature 1..20: note = CRISPR gRNA sequence
  source 1..20: mol_type = other DNA
ggattgccccagcctagcgc

SEQ ID NO: 58614 - DNA, 20 bp, synthetic construct
  misc_feature 1..20: note = CRISPR gRNA sequence
  source 1..20: mol_type = other DNA
cccacccacaatctcttctg

SEQ ID NO: 58615 - DNA, 20 bp, synthetic construct
  misc_feature 1..20: note = CRISPR gRNA sequence
  source 1..20: mol_type = other DNA
tctgaagcacagatgaggag

SEQ ID NO: 58616 - DNA, 20 bp, synthetic construct
  misc_feature 1..20: note = CRISPR gRNA sequence
  source 1..20: mol_type = other DNA
ataatagcagtcaaggtcaa

SEQ ID NO: 58617 - DNA, 20 bp, synthetic construct
  misc_feature 1..20: note = CRISPR gRNA sequence
  source 1..20: mol_type = other DNA
ttgagaggctgtgatttgtc

SEQ ID NO: 58618 - DNA, 20 bp, synthetic construct
  misc_feature 1..20: note = CRISPR gRNA sequence
  source 1..20: mol_type = other DNA
ggtctgattgactctaggtg

SEQ ID NO: 58619 - DNA, 20 bp, synthetic construct
  misc_feature 1..20: note = CRISPR gRNA sequence
  source 1..20: mol_type = other DNA
cgatggtggaaggccaggct

SEQ ID NO: 58620 - DNA, 20 bp, synthetic construct
  misc_feature 1..20: note = CRISPR gRNA sequence
  source 1..20: mol_type = other DNA
ggtggaaggccaggctgagg

SEQ ID NO: 58621 - DNA, 20 bp, synthetic construct
  misc_feature 1..20: note = CRISPR gRNA sequence
  source 1..20: mol_type = other DNA
gagctgcctctgagctcccg

SEQ ID NO: 58622 - DNA, 20 bp, synthetic construct
  misc_feature 1..20: note = CRISPR gRNA sequence
  source 1..20: mol_type = other DNA
acacctgacctgctgtgtcc

SEQ ID NO: 58623 - DNA, 20 bp, synthetic construct
  misc_feature 1..20: note = CRISPR gRNA sequence
  source 1..20: mol_type = other DNA
tccctgacccccagcagctg

SEQ ID NO: 58624 - DNA, 20 bp, synthetic construct
  misc_feature 1..20: note = CRISPR gRNA sequence
  source 1..20: mol_type = other DNA
ctgcctatatgtgacatcct

SEQ ID NO: 58625 - DNA, 20 bp, synthetic construct
  misc_feature 1..20: note = CRISPR gRNA sequence
  source 1..20: mol_type = other DNA
attctctgcctctgtgtctg

SEQ ID NO: 58626 - DNA, 20 bp, synthetic construct
  misc_feature 1..20: note = CRISPR gRNA sequence
  source 1..20: mol_type = other DNA
ccacctcggtcacctccacc

SEQ ID NO: 58627 - DNA, 20 bp, synthetic construct
  misc_feature 1..20: note = CRISPR gRNA sequence
  source 1..20: mol_type = other DNA
ctcggtcacctccacctcga

SEQ ID NO: 58628 - DNA, 20 bp, synthetic construct
  misc_feature 1..20: note = CRISPR gRNA sequence
  source 1..20: mol_type = other DNA
agtggtttgtgtgttggaag

SEQ ID NO: 58629 - DNA, 20 bp, synthetic construct
  misc_feature 1..20: note = CRISPR gRNA sequence
  source 1..20: mol_type = other DNA
gtttgtgtgttggaaggtgg

SEQ ID NO: 58630 - DNA, 20 bp, synthetic construct
  misc_feature 1..20: note = CRISPR gRNA sequence
  source 1..20: mol_type = other DNA
ggtgggtggggccaattaca

SEQ ID NO: 58631 - DNA, 20 bp, synthetic construct
  misc_feature 1..20: note = CRISPR gRNA sequence
  source 1..20: mol_type = other DNA
cagtgagttagtgttggtgt

SEQ ID NO: 58632 - DNA, 20 bp, synthetic construct
  misc_feature 1..20: note = CRISPR gRNA sequence
  source 1..20: mol_type = other DNA
ctgaagtcagaaaccccttg

SEQ ID NO: 58633 - DNA, 20 bp, synthetic construct
  misc_feature 1..20: note = CRISPR gRNA sequence
  source 1..20: mol_type = other DNA
cctcagaggtccacgaacct

SEQ ID NO: 58634 - DNA, 20 bp, synthetic construct
  misc_feature 1..20: note = CRISPR gRNA sequence
  source 1..20: mol_type = other DNA
ctgtgtccagtttcaggaag

SEQ ID NO: 58635 - DNA, 20 bp, synthetic construct
  misc_feature 1..20: note = CRISPR gRNA sequence
  source 1..20: mol_type = other DNA
gtttcaggaagttgagtaac

SEQ ID NO: 58636 - DNA, 20 bp, synthetic construct
  misc_feature 1..20: note = CRISPR gRNA sequence
  source 1..20: mol_type = other DNA
gcttctcaggcaatgctctg

SEQ ID NO: 58637 - DNA, 20 bp, synthetic construct
  misc_feature 1..20: note = CRISPR gRNA sequence
  source 1..20: mol_type = other DNA
ggagctctgcagtccttgaa

SEQ ID NO: 58638 - DNA, 20 bp, synthetic construct
  misc_feature 1..20: note = CRISPR gRNA sequence
  source 1..20: mol_type = other DNA
tgtcccatccccctctttcc

SEQ ID NO: 58639 - DNA, 20 bp, synthetic construct
  misc_feature 1..20: note = CRISPR gRNA sequence
  source 1..20: mol_type = other DNA
taatagatgattcttactca

SEQ ID NO: 58640 - DNA, 20 bp, synthetic construct
  misc_feature 1..20: note = CRISPR gRNA sequence
  source 1..20: mol_type = other DNA
ccaccctggggagggcaggt

SEQ ID NO: 58641 - DNA, 20 bp, synthetic construct
  misc_feature 1..20: note = CRISPR gRNA sequence
  source 1..20: mol_type = other DNA
ggcagttgttattctggccc

SEQ ID NO: 58642 - DNA, 20 bp, synthetic construct
  misc_feature 1..20: note = CRISPR gRNA sequence
  source 1..20: mol_type = other DNA
gaggggctggggctgttagc

SEQ ID NO: 58643 - DNA, 20 bp, synthetic construct
  misc_feature 1..20: note = CRISPR gRNA sequence
  source 1..20: mol_type = other DNA
gctgttagctggggtatggt

SEQ ID NO: 58644 - DNA, 20 bp, synthetic construct
  misc_feature 1..20: note = CRISPR gRNA sequence
  source 1..20: mol_type = other DNA
gtatggtcagggtagacagg

SEQ ID NO: 58645 - DNA, 20 bp, synthetic construct
  misc_feature 1..20: note = CRISPR gRNA sequence
  source 1..20: mol_type = other DNA
taccagagaggacactcaag

SEQ ID NO: 58646 - DNA, 20 bp, synthetic construct
  misc_feature 1..20: note = CRISPR gRNA sequence
  source 1..20: mol_type = other DNA
gcagggtgcccagggctgcc

SEQ ID NO: 58647 - DNA, 20 bp, synthetic construct
  misc_feature 1..20: note = CRISPR gRNA sequence
  source 1..20: mol_type = other DNA
cccagggctgccaaggatcc

SEQ ID NO: 58648 - DNA, 20 bp, synthetic construct
  misc_feature 1..20: note = CRISPR gRNA sequence
  source 1..20: mol_type = other DNA
ggatccctgagtacctggca

SEQ ID NO: 58649 - DNA, 20 bp, synthetic construct
  misc_feature 1..20: note = CRISPR gRNA sequence
  source 1..20: mol_type = other DNA
cctggcagagagtgtgtagg

SEQ ID NO: 58650 - DNA, 20 bp, synthetic construct
  misc_feature 1..20: note = CRISPR gRNA sequence
  source 1..20: mol_type = other DNA
aaagtttgcctgcaatggac

SEQ ID NO: 58651 - DNA, 20 bp, synthetic construct
  misc_feature 1..20: note = CRISPR gRNA sequence
  source 1..20: mol_type = other DNA
gggcaagttacatcccctct

SEQ ID NO: 58652 - DNA, 20 bp, synthetic construct
  misc_feature 1..20: note = CRISPR gRNA sequence
  source 1..20: mol_type = other DNA
tggtggctacgatctctgaa

SEQ ID NO: 58653 - DNA, 20 bp, synthetic construct
  misc_feature 1..20: note = CRISPR gRNA sequence
  source 1..20: mol_type = other DNA
tgtgcaatgctgggaaggaa

SEQ ID NO: 58654 - DNA, 20 bp, synthetic construct
  misc_feature 1..20: note = CRISPR gRNA sequence
  source 1..20: mol_type = other DNA
gactcgtgacctggtgctgt

SEQ ID NO: 58655 - DNA, 20 bp, synthetic construct
  misc_feature 1..20: note = CRISPR gRNA sequence
  source 1..20: mol_type = other DNA
taccagtgtccccgtgggag

SEQ ID NO: 58656 - DNA, 20 bp, synthetic construct
  misc_feature 1..20: note = CRISPR gRNA sequence
  source 1..20: mol_type = other DNA
ccctgcattttcattttgtc

SEQ ID NO: 58657 - DNA, 20 bp, synthetic construct
  misc_feature 1..20: note = CRISPR gRNA sequence
  source 1..20: mol_type = other DNA
atcacagaccgagggaccca

SEQ ID NO: 58658 - DNA, 20 bp, synthetic construct
  misc_feature 1..20: note = CRISPR gRNA sequence
  source 1..20: mol_type = other DNA
ctccaccatgaggacttgca

SEQ ID NO: 58659 - DNA, 20 bp, synthetic construct
  misc_feature 1..20: note = CRISPR gRNA sequence
  source 1..20: mol_type = other DNA
aggggtgctctctgaccatc

SEQ ID NO: 58660 - DNA, 20 bp, synthetic construct
  misc_feature 1..20: note = CRISPR gRNA sequence
  source 1..20: mol_type = other DNA
ctctgaccatcttgggttca

SEQ ID NO: 58661 - DNA, 20 bp, synthetic construct
  misc_feature 1..20: note = CRISPR gRNA sequence
  source 1..20: mol_type = other DNA
gggttccgtcatctggaacc

SEQ ID NO: 58662 - DNA, 20 bp, synthetic construct
  misc_feature 1..20: note = CRISPR gRNA sequence
  source 1..20: mol_type = other DNA
ccctgtgccctgaccacaaa

SEQ ID NO: 58663 - DNA, 20 bp, synthetic construct
  misc_feature 1..20: note = CRISPR gRNA sequence
  source 1..20: mol_type = other DNA
tgaccacaaagaggatgtgt

SEQ ID NO: 58664 - DNA, 20 bp, synthetic construct
  misc_feature 1..20: note = CRISPR gRNA sequence
  source 1..20: mol_type = other DNA
aaagaggatgtgtttgggtc

SEQ ID NO: 58665 - DNA, 20 bp, synthetic construct
  misc_feature 1..20: note = CRISPR gRNA sequence
  source 1..20: mol_type = other DNA
tcagtgagaacggtttgtcc

SEQ ID NO: 58666 - DNA, 20 bp, synthetic construct
  misc_feature 1..20: note = CRISPR gRNA sequence
  source 1..20: mol_type = other DNA
gtttgtccctggatgccgtg

SEQ ID NO: 58667 - DNA, 20 bp, synthetic construct
  misc_feature 1..20: note = CRISPR gRNA sequence
  source 1..20: mol_type = other DNA
gagcatgtgatgggcgtcca

SEQ ID NO: 58668 - DNA, 20 bp, synthetic construct
  misc_feature 1..20: note = CRISPR gRNA sequence
  source 1..20: mol_type = other DNA
atgtgatgggcgtccactga

SEQ ID NO: 58669 - DNA, 20 bp, synthetic construct
  misc_feature 1..20: note = CRISPR gRNA sequence
  source 1..20: mol_type = other DNA
gatgggcgtccactgaatga

SEQ ID NO: 58670 - DNA, 20 bp, synthetic construct
  misc_feature 1..20: note = CRISPR gRNA sequence
  source 1..20: mol_type = other DNA
ctgaatgaatgaatgatcaa

SEQ ID NO: 58671 - DNA, 20 bp, synthetic construct
  misc_feature 1..20: note = CRISPR gRNA sequence
  source 1..20: mol_type = other DNA
atgaatgaatgatcaaatga

SEQ ID NO: 58672 - DNA, 20 bp, synthetic construct
  misc_feature 1..20: note = CRISPR gRNA sequence
  source 1..20: mol_type = other DNA
gaatgaataagtatggcctc

SEQ ID NO: 58673 - DNA, 20 bp, synthetic construct
  misc_feature 1..20: note = CRISPR gRNA sequence
  source 1..20: mol_type = other DNA
tttctccaaattcaccatta

SEQ ID NO: 58674 - DNA, 20 bp, synthetic construct
  misc_feature 1..20: note = CRISPR gRNA sequence
  source 1..20: mol_type = other DNA
gactctgcctcactcgttct

SEQ ID NO: 58675 - DNA, 20 bp, synthetic construct
  misc_feature 1..20: note = CRISPR gRNA sequence
  source 1..20: mol_type = other DNA
tccttagagatttttttttt

SEQ ID NO: 58676 - DNA, 20 bp, synthetic construct
  misc_feature 1..20: note = CRISPR gRNA sequence
  source 1..20: mol_type = other DNA
aattattatactttaagttc

SEQ ID NO: 58677 - DNA, 20 bp, synthetic construct
  misc_feature 1..20: note = CRISPR gRNA sequence
  source 1..20: mol_type = other DNA
attttgggaggccaaggtgg

SEQ ID NO: 58678 - DNA, 20 bp, synthetic construct
  misc_feature 1..20: note = CRISPR gRNA sequence
  source 1..20: mol_type = other DNA
tgggcggatcacgtgaggtc

SEQ ID NO: 58679 - DNA, 20 bp, synthetic construct
  misc_feature 1..20: note = CRISPR gRNA sequence
  source 1..20: mol_type = other DNA
tttgagaacagcctggccaa

SEQ ID NO: 58680 - DNA, 20 bp, synthetic construct
  misc_feature 1..20: note = CRISPR gRNA sequence
  source 1..20: mol_type = other DNA
ccttgtagtgccagccgctc

SEQ ID NO: 58681 - DNA, 20 bp, synthetic construct
  misc_feature 1..20: note = CRISPR gRNA sequence
  source 1..20: mol_type = other DNA
gccagccgctcaggagtcag

SEQ ID NO: 58682 - DNA, 20 bp, synthetic construct
  misc_feature 1..20: note = CRISPR gRNA sequence
  source 1..20: mol_type = other DNA
ctgcactccagcctgggcga

SEQ ID NO: 58683 - DNA, 20 bp, synthetic construct
  misc_feature 1..20: note = CRISPR gRNA sequence
  source 1..20: mol_type = other DNA
tcttaattgtgggagctgat

SEQ ID NO: 58684 - DNA, 20 bp, synthetic construct
  misc_feature 1..20: note = CRISPR gRNA sequence
  source 1..20: mol_type = other DNA
tcccttccctaaggaccccc

SEQ ID NO: 58685 - DNA, 20 bp, synthetic construct
  misc_feature 1..20: note = CRISPR gRNA sequence
  source 1..20: mol_type = other DNA
ctcatctgtaaaatggagat

SEQ ID NO: 58686 - DNA, 20 bp, synthetic construct
  misc_feature 1..20: note = CRISPR gRNA sequence
  source 1..20: mol_type = other DNA
ggaggccaagacaggaggag

SEQ ID NO: 58687 - DNA, 20 bp, synthetic construct
  misc_feature 1..20: note = CRISPR gRNA sequence
  source 1..20: mol_type = other DNA
gaggaggatcacctgagcct

SEQ ID NO: 58688 - DNA, 20 bp, synthetic construct
  misc_feature 1..20: note = CRISPR gRNA sequence
  source 1..20: mol_type = other DNA
tacttgggaggctgaggtgg

SEQ ID NO: 58689 - DNA, 20 bp, synthetic construct
  misc_feature 1..20: note = CRISPR gRNA sequence
  source 1..20: mol_type = other DNA
ctcaggagatcgaggctaca

SEQ ID NO: 58690 - DNA, 20 bp, synthetic construct
  misc_feature 1..20: note = CRISPR gRNA sequence
  source 1..20: mol_type = other DNA
actttgggaggctaaggcag

SEQ ID NO: 58691 - DNA, 20 bp, synthetic construct
  misc_feature 1..20: note = CRISPR gRNA sequence
  source 1..20: mol_type = other DNA
caggaggatcgtttgagcca

SEQ ID NO: 58692 - DNA, 20 bp, synthetic construct
  misc_feature 1..20: note = CRISPR gRNA sequence
  source 1..20: mol_type = other DNA
tacttgggaggctgaggcag

SEQ ID NO: 58693 - DNA, 20 bp, synthetic construct
  misc_feature 1..20: note = CRISPR gRNA sequence
  source 1..20: mol_type = other DNA
tcttcgaaacaacaacaaag

SEQ ID NO: 58694 - DNA, 20 bp, synthetic construct
  misc_feature 1..20: note = CRISPR gRNA sequence
  source 1..20: mol_type = other DNA
cttacctcattgtttattgt

SEQ ID NO: 58695 - DNA, 20 bp, synthetic construct
  misc_feature 1..20: note = CRISPR gRNA sequence
  source 1..20: mol_type = other DNA
ccctccttgccctgaccagt

SEQ ID NO: 58696 - DNA, 20 bp, synthetic construct
  misc_feature 1..20: note = CRISPR gRNA sequence
  source 1..20: mol_type = other DNA
gcaggtgaggagggaacgct

SEQ ID NO: 58697 - DNA, 20 bp, synthetic construct
  misc_feature 1..20: note = CRISPR gRNA sequence
  source 1..20: mol_type = other DNA
ggagggaacgctcggggtgg

SEQ ID NO: 58698 - DNA, 20 bp, synthetic construct
  misc_feature 1..20: note = CRISPR gRNA sequence
  source 1..20: mol_type = other DNA
aatgcagatgggaggaaggg

SEQ ID NO: 58699 - DNA, 20 bp, synthetic construct
  misc_feature 1..20: note = CRISPR gRNA sequence
  source 1..20: mol_type = other DNA
atttgtgcttctgcgtttcg

SEQ ID NO: 58700 - DNA, 20 bp, synthetic construct
  misc_feature 1..20: note = CRISPR gRNA sequence
  source 1..20: mol_type = other DNA
acgctctgaaggcaggggcc

SEQ ID NO: 58701 - DNA, 20 bp, synthetic construct
  misc_feature 1..20: note = CRISPR gRNA sequence
  source 1..20: mol_type = other DNA
ttgggagcagtggcagcgga

SEQ ID NO: 58702 - DNA, 20 bp, synthetic construct
  misc_feature 1..20: note = CRISPR gRNA sequence
  source 1..20: mol_type = other DNA
gtgggcccatgtgcagctgg

SEQ ID NO: 58703 - DNA, 20 bp, synthetic construct
  misc_feature 1..20: note = CRISPR gRNA sequence
  source 1..20: mol_type = other DNA
tgtgcagctggctgggtgga

SEQ ID NO: 58704 - DNA, 20 bp, synthetic construct
  misc_feature 1..20: note = CRISPR gRNA sequence
  source 1..20: mol_type = other DNA
tgccgtacagatgggctgtc

SEQ ID NO: 58705 - DNA, 20 bp, synthetic construct
  misc_feature 1..20: note = CRISPR gRNA sequence
  source 1..20: mol_type = other DNA
cagatgggctgtcaggagtc

SEQ ID NO: 58706 - DNA, 20 bp, synthetic construct
  misc_feature 1..20: note = CRISPR gRNA sequence
  source 1..20: mol_type = other DNA
gagtcaggggtggctcaagc

SEQ ID NO: 58707 - DNA, 20 bp, synthetic construct
  misc_feature 1..20: note = CRISPR gRNA sequence
  source 1..20: mol_type = other DNA
gcctgggtggtcttgcttcc

SEQ ID NO: 58708 - DNA, 20 bp, synthetic construct
  misc_feature 1..20: note = CRISPR gRNA sequence
  source 1..20: mol_type = other DNA
ggtggtcttgcttcccagga

SEQ ID NO: 58709 - DNA, 20 bp, synthetic construct
  misc_feature 1..20: note = CRISPR gRNA sequence
  source 1..20: mol_type = other DNA
tctctgtttctggggaaccc

SEQ ID NO: 58710 - DNA, 20 bp, synthetic construct
  misc_feature 1..20: note = CRISPR gRNA sequence
  source 1..20: mol_type = other DNA
gtggtcagagaggctctgtc

SEQ ID NO: 58711 - DNA, 20 bp, synthetic construct
  misc_feature 1..20: note = CRISPR gRNA sequence
  source 1..20: mol_type = other DNA
tgaacaatgagggactgagc

SEQ ID NO: 58712 - DNA, 20 bp, synthetic construct
  misc_feature 1..20: note = CRISPR gRNA sequence
  source 1..20: mol_type = other DNA
agccctgactttccaagtct

SEQ ID NO: 58713 - DNA, 20 bp, synthetic construct
  misc_feature 1..20: note = CRISPR gRNA sequence
  source 1..20: mol_type = other DNA
tccaagtctgggagtccaat

SEQ ID NO: 58714 - DNA, 20 bp, synthetic construct
  misc_feature 1..20: note = CRISPR gRNA sequence
  source 1..20: mol_type = other DNA
ttctaaacgatccccctcct

SEQ ID NO: 58715 - DNA, 20 bp, synthetic construct
  misc_feature 1..20: note = CRISPR gRNA sequence
  source 1..20: mol_type = other DNA
aggggtatatgggctgggct

SEQ ID NO: 58716 - DNA, 20 bp, synthetic construct
  misc_feature 1..20: note = CRISPR gRNA sequence
  source 1..20: mol_type = other DNA
gggctgggctgggagtccga

SEQ ID NO: 58717 - DNA, 20 bp, synthetic construct
  misc_feature 1..20: note = CRISPR gRNA sequence
  source 1..20: mol_type = other DNA
ttctaaatgatccccctcct

SEQ ID NO: 58718 - DNA, 20 bp, synthetic construct
  misc_feature 1..20: note = CRISPR gRNA sequence
  source 1..20: mol_type = other DNA
tcctagggatatgtgggcca

SEQ ID NO: 58719 - DNA, 20 bp, synthetic construct
  misc_feature 1..20: note = CRISPR gRNA sequence
  source 1..20: mol_type = other DNA
cccagctgcagccaagttct

SEQ ID NO: 58720 - DNA, 20 bp, synthetic construct
  misc_feature 1..20: note = CRISPR gRNA sequence
  source 1..20: mol_type = other DNA
tgtcccagcccttcttgttt

SEQ ID NO: 58721 - DNA, 20 bp, synthetic construct
  misc_feature 1..20: note = CRISPR gRNA sequence
  source 1..20: mol_type = other DNA
tgtttgggggtaaccataat

SEQ ID NO: 58722 - DNA, 20 bp, synthetic construct
  misc_feature 1..20: note = CRISPR gRNA sequence
  source 1..20: mol_type = other DNA
gctggcagggggctagggct

SEQ ID NO: 58723 - DNA, 20 bp, synthetic construct
  misc_feature 1..20: note = CRISPR gRNA sequence
  source 1..20: mol_type = other DNA
agggggctagggctggggat

SEQ ID NO: 58724 - DNA, 20 bp, synthetic construct
  misc_feature 1..20: note = CRISPR gRNA sequence
  source 1..20: mol_type = other DNA
attgggatagagggaagaga

SEQ ID NO: 58725 - DNA, 20 bp, synthetic construct
  misc_feature 1..20: note = CRISPR gRNA sequence
  source 1..20: mol_type = other DNA
gaaaaggaaaagaaagaggc

SEQ ID NO: 58726 - DNA, 20 bp, synthetic construct
  misc_feature 1..20: note = CRISPR gRNA sequence
  source 1..20: mol_type = other DNA
aagaaagaggcgtgggtgtg

SEQ ID NO: 58727 - DNA, 20 bp, synthetic construct
  misc_feature 1..20: note = CRISPR gRNA sequence
  source 1..20: mol_type = other DNA
gcgtgggtgtgaggggtgct

SEQ ID NO: 58728 - DNA, 20 bp, synthetic construct
  misc_feature 1..20: note = CRISPR gRNA sequence
  source 1..20: mol_type = other DNA
cagctcagccactccctgcc

SEQ ID NO: 58729 - DNA, 20 bp, synthetic construct
  misc_feature 1..20: note = CRISPR gRNA sequence
  source 1..20: mol_type = other DNA
cacccactttccagaaagaa

SEQ ID NO: 58730 - DNA, 20 bp, synthetic construct
  misc_feature 1..20: note = CRISPR gRNA sequence
  source 1..20: mol_type = other DNA
ccagggcaatggggagccac

SEQ ID NO: 58731 - DNA, 20 bp, synthetic construct
  misc_feature 1..20: note = CRISPR gRNA sequence
  source 1..20: mol_type = other DNA
gagacacttgtggggcagag

SEQ ID NO: 58732 - DNA, 20 bp, synthetic construct
  misc_feature 1..20: note = CRISPR gRNA sequence
  source 1..20: mol_type = other DNA
gagagggattaaagggaggc

SEQ ID NO: 58733 - DNA, 20 bp, synthetic construct
  misc_feature 1..20: note = CRISPR gRNA sequence
  source 1..20: mol_type = other DNA
gaggcaagagtggaagccca

SEQ ID NO: 58734 - DNA, 20 bp, synthetic construct
  misc_feature 1..20: note = CRISPR gRNA sequence
  source 1..20: mol_type = other DNA
gagggtgttaaatggtcaag

SEQ ID NO: 58735 - DNA, 20 bp, synthetic construct
  misc_feature 1..20: note = CRISPR gRNA sequence
  source 1..20: mol_type = other DNA
gttaaatggtcaaggtgagt

SEQ ID NO: 58736 - DNA, 20 bp, synthetic construct
  misc_feature 1..20: note = CRISPR gRNA sequence
  source 1..20: mol_type = other DNA
ggggcggtggggaggacttg

SEQ ID NO: 58737 - DNA, 20 bp, synthetic construct
  misc_feature 1..20: note = CRISPR gRNA sequence
  source 1..20: mol_type = other DNA
gacaagggcagctgggaact

SEQ ID NO: 58738 - DNA, 20 bp, synthetic construct
  misc_feature 1..20: note = CRISPR gRNA sequence
  source 1..20: mol_type = other DNA
cactgtcactgtcagggcag

SEQ ID NO: 58739 - DNA, 20 bp, synthetic construct
  misc_feature 1..20: note = CRISPR gRNA sequence
  source 1..20: mol_type = other DNA
aggggagactcgagagggaa

SEQ ID NO: 58740 - DNA, 20 bp, synthetic construct
  misc_feature 1..20: note = CRISPR gRNA sequence
  source 1..20: mol_type = other DNA
ggggcctgtggcctcccact

SEQ ID NO: 58741 - DNA, 20 bp, synthetic construct
  misc_feature 1..20: note = CRISPR gRNA sequence
  source 1..20: mol_type = other DNA
gtggcctcccacttagagtg

SEQ ID NO: 58742 - DNA, 20 bp, synthetic construct
  misc_feature 1..20: note = CRISPR gRNA sequence
  source 1..20: mol_type = other DNA
agagtgagggatgctgggag

SEQ ID NO: 58743 - DNA, 20 bp, synthetic construct
  misc_feature 1..20: note = CRISPR gRNA sequence
  source 1..20: mol_type = other DNA
attgcccctttgcagcctca

SEQ ID NO: 58744 - DNA, 20 bp, synthetic construct
  misc_feature 1..20: note = CRISPR gRNA sequence
  source 1..20: mol_type = other DNA
agccccagagggcaccatgt

SEQ ID NO: 58745 - DNA, 20 bp, synthetic construct
  misc_feature 1..20: note = CRISPR gRNA sequence
  source 1..20: mol_type = other DNA
gcttcttggttagaagacag

SEQ ID NO: 58746 - DNA, 20 bp, synthetic construct
  misc_feature 1..20: note = CRISPR gRNA sequence
  source 1..20: mol_type = other DNA
tcccaccagccctgccccat

SEQ ID NO: 58747 - DNA, 20 bp, synthetic construct
  misc_feature 1..20: note = CRISPR gRNA sequence
  source 1..20: mol_type = other DNA
caaggcacccccactctcct

SEQ ID NO: 58748 - DNA, 20 bp, synthetic construct
  misc_feature 1..20: note = CRISPR gRNA sequence
  source 1..20: mol_type = other DNA
cctcactcgccccagaacat

SEQ ID NO: 58749 - DNA, 20 bp, synthetic construct
  misc_feature 1..20: note = CRISPR gRNA sequence
  source 1..20: mol_type = other DNA
ctgtaaccagagactggacc

SEQ ID NO: 58750 - DNA, 20 bp, synthetic construct
  misc_feature 1..20: note = CRISPR gRNA sequence
  source 1..20: mol_type = other DNA
atcaggactcttggctcaaa

SEQ ID NO: 58751 - DNA, 20 bp, synthetic construct
  misc_feature 1..20: note = CRISPR gRNA sequence
  source 1..20: mol_type = other DNA
tcagcttcttcatctgcaca

SEQ ID NO: 58752 - DNA, 20 bp, synthetic construct
  misc_feature 1..20: note = CRISPR gRNA sequence
  source 1..20: mol_type = other DNA
gataatccggtttgaccccc

SEQ ID NO: 58753 - DNA, 20 bp, synthetic construct
  misc_feature 1..20: note = CRISPR gRNA sequence
  source 1..20: mol_type = other DNA
actattttttttttctgaga

SEQ ID NO: 58754 - DNA, 20 bp, synthetic construct
  misc_feature 1..20: note = CRISPR gRNA sequence
  source 1..20: mol_type = other DNA
tttgctcttgttgcccaggc

SEQ ID NO: 58755 - DNA, 20 bp, synthetic construct
  misc_feature 1..20: note = CRISPR gRNA sequence
  source 1..20: mol_type = other DNA
cttgctgccacctctgcctc

SEQ ID NO: 58756 - DNA, 20 bp, synthetic construct
  misc_feature 1..20: note = CRISPR gRNA sequence
  source 1..20: mol_type = other DNA
aattctcctgcctcagcctc

SEQ ID NO: 58757 - DNA, 20 bp, synthetic construct
  misc_feature 1..20: note = CRISPR gRNA sequence
  source 1..20: mol_type = other DNA
gcctcagcctcctgagtagc

SEQ ID NO: 58758 - DNA, 20 bp, synthetic construct
  misc_feature 1..20: note = CRISPR gRNA sequence
  source 1..20: mol_type = other DNA
ttttgtatttttagtagagg

SEQ ID NO: 58759 - DNA, 20 bp, synthetic construct
  misc_feature 1..20: note = CRISPR gRNA sequence
  source 1..20: mol_type = other DNA
tcctcagcctcccaaagtgt

SEQ ID NO: 58760 - DNA, 20 bp, synthetic construct
  misc_feature 1..20: note = CRISPR gRNA sequence
  source 1..20: mol_type = other DNA
ttgtctcttacctgttttca

SEQ ID NO: 58761 - DNA, 20 bp, synthetic construct
  misc_feature 1..20: note = CRISPR gRNA sequence
  source 1..20: mol_type = other DNA
gttactccaccacacccttc

SEQ ID NO: 58762 - DNA, 20 bp, synthetic construct
  misc_feature 1..20: note = CRISPR gRNA sequence
  source 1..20: mol_type = other DNA
acccttctagagtctagatc

SEQ ID NO: 58763 - DNA, 20 bp, synthetic construct
  misc_feature 1..20: note = CRISPR gRNA sequence
  source 1..20: mol_type = other DNA
ggccacattggaagaagaaa

SEQ ID NO: 58764 - DNA, 20 bp, synthetic construct
  misc_feature 1..20: note = CRISPR gRNA sequence
  source 1..20: mol_type = other DNA
atagtgttttaagaaagttt

SEQ ID NO: 58765 - DNA, 20 bp, synthetic construct
  misc_feature 1..20: note = CRISPR gRNA sequence
  source 1..20: mol_type = other DNA
tcctgggaacacaaggagac

SEQ ID NO: 58766 - DNA, 20 bp, synthetic construct
  misc_feature 1..20: note = CRISPR gRNA sequence
  source 1..20: mol_type = other DNA
actttgggaggccgaggtgg

SEQ ID NO: 58767 - DNA, 20 bp, synthetic construct
  misc_feature 1..20: note = CRISPR gRNA sequence
  source 1..20: mol_type = other DNA
ggtggctggatcatgaggtc

SEQ ID NO: 58768 - DNA, 20 bp, synthetic construct
  misc_feature 1..20: note = CRISPR gRNA sequence
  source 1..20: mol_type = other DNA
tgggcggtctgagcacaggt

SEQ ID NO: 58769 - DNA, 20 bp, synthetic construct
  misc_feature 1..20: note = CRISPR gRNA sequence
  source 1..20: mol_type = other DNA
tggttggggaaagtgcaata

SEQ ID NO: 58770 - DNA, 20 bp, synthetic construct
  misc_feature 1..20: note = CRISPR gRNA sequence
  source 1..20: mol_type = other DNA
tgaaagcactttgtcaactg

SEQ ID NO: 58771 - DNA, 20 bp, synthetic construct
  misc_feature 1..20: note = CRISPR gRNA sequence
  source 1..20: mol_type = other DNA
tagagtactgtgatcacttg

SEQ ID NO: 58772 - DNA, 20 bp, synthetic construct
  misc_feature 1..20: note = CRISPR gRNA sequence
  source 1..20: mol_type = other DNA
gctgaagtccagtgattccc

SEQ ID NO: 58773 - DNA, 20 bp, synthetic construct
  misc_feature 1..20: note = CRISPR gRNA sequence
  source 1..20: mol_type = other DNA
tggggctccatcccccctcc

SEQ ID NO: 58774 - DNA, 20 bp, synthetic construct
  misc_feature 1..20: note = CRISPR gRNA sequence
  source 1..20: mol_type = other DNA
gtacacatgggcataccatg

SEQ ID NO: 58775 - DNA, 20 bp, synthetic construct
  misc_feature 1..20: note = CRISPR gRNA sequence
  source 1..20: mol_type = other DNA
ataccatgtgggatgtggta

SEQ ID NO: 58776 - DNA, 20 bp, synthetic construct
  misc_feature 1..20: note = CRISPR gRNA sequence
  source 1..20: mol_type = other DNA
gctttaaaaaaaaaaaaaag

SEQ ID NO: 58777 - DNA, 20 bp, synthetic construct
  misc_feature 1..20: note = CRISPR gRNA sequence
  source 1..20: mol_type = other DNA
ccagagcccatggtgtattt

SEQ ID NO: 58778 - DNA, 20 bp, synthetic construct
  misc_feature 1..20: note = CRISPR gRNA sequence
  source 1..20: mol_type = other DNA
gggtctggtgggacaccata

SEQ ID NO: 58779 - DNA, 20 bp, synthetic construct
  misc_feature 1..20: note = CRISPR gRNA sequence
  source 1..20: mol_type = other DNA
tgcccagtccctggggcaga

SEQ ID NO: 58780 - DNA, 20 bp, synthetic construct
  misc_feature 1..20: note = CRISPR gRNA sequence
  source 1..20: mol_type = other DNA
agtccctggggcagaaaggg

SEQ ID NO: 58781 - DNA, 20 bp, synthetic construct
  misc_feature 1..20: note = CRISPR gRNA sequence
  source 1..20: mol_type = other DNA
aggggagagggcagcctgca

SEQ ID NO: 58782 - DNA, 20 bp, synthetic construct
  misc_feature 1..20: note = CRISPR gRNA sequence
  source 1..20: mol_type = other DNA
agaacatagtagaggtctgc

SEQ ID NO: 58783 - DNA, 20 bp, synthetic construct
  misc_feature 1..20: note = CRISPR gRNA sequence
  source 1..20: mol_type = other DNA
accccagggaactcagtgtc

SEQ ID NO: 58784 - DNA, 20 bp, synthetic construct
  misc_feature 1..20: note = CRISPR gRNA sequence
  source 1..20: mol_type = other DNA
gagacagcaaggcaggtatc

SEQ ID NO: 58785 - DNA, 20 bp, synthetic construct
  misc_feature 1..20: note = CRISPR gRNA sequence
  source 1..20: mol_type = other DNA
tggagtttctcctaaatgca

SEQ ID NO: 58786 - DNA, 20 bp, synthetic construct
  misc_feature 1..20: note = CRISPR gRNA sequence
  source 1..20: mol_type = other DNA
cctaaatgcactgggttctg

SEQ ID NO: 58787 - DNA, 20 bp, synthetic construct
  misc_feature 1..20: note = CRISPR gRNA sequence
  source 1..20: mol_type = other DNA
cttcgctgacctgttgtatg

SEQ ID NO: 58788 - DNA, 20 bp, synthetic construct
  misc_feature 1..20: note = CRISPR gRNA sequence
  source 1..20: mol_type = other DNA
ccactgtcatatccactcct

SEQ ID NO: 58789 - DNA, 20 bp, synthetic construct
  misc_feature 1..20: note = CRISPR gRNA sequence
  source 1..20: mol_type = other DNA
actcgctctgtcacccaggc

SEQ ID NO: 58790 - DNA, 20 bp, synthetic construct
  misc_feature 1..20: note = CRISPR gRNA sequence
  source 1..20: mol_type = other DNA
gattcccatgcctcagcctc

SEQ ID NO: 58791 - DNA, 20 bp, synthetic construct
  misc_feature 1..20: note = CRISPR gRNA sequence
  source 1..20: mol_type = other DNA
ttcgttttttgtagtagagg

SEQ ID NO: 58792 - DNA, 20 bp, synthetic construct
  misc_feature 1..20: note = CRISPR gRNA sequence
  source 1..20: mol_type = other DNA
cttcctcttcttccagcctc

SEQ ID NO: 58793 - DNA, 20 bp, synthetic construct
  misc_feature 1..20: note = CRISPR gRNA sequence
  source 1..20: mol_type = other DNA
ccatggacccagtgctggga

SEQ ID NO: 58794 - DNA, 20 bp, synthetic construct
  misc_feature 1..20: note = CRISPR gRNA sequence
  source 1..20: mol_type = other DNA
tttgtttcacagattgtcct

SEQ ID NO: 58795 - DNA, 20 bp, synthetic construct
  misc_feature 1..20: note = CRISPR gRNA sequence
  source 1..20: mol_type = other DNA
acagattgtcctgtgagttc

SEQ ID NO: 58796 - DNA, 20 bp, synthetic construct
  misc_feature 1..20: note = CRISPR gRNA sequence
  source 1..20: mol_type = other DNA
tgagcctgctgcagtaagac

SEQ ID NO: 58797 - DNA, 20 bp, synthetic construct
  misc_feature 1..20: note = CRISPR gRNA sequence
  source 1..20: mol_type = other DNA
cagtttcctcatctgacaaa

SEQ ID NO: 58798 - DNA, 20 bp, synthetic construct
  misc_feature 1..20: note = CRISPR gRNA sequence
  source 1..20: mol_type = other DNA
atattccccgcccattcccc

SEQ ID NO: 58799 - DNA, 20 bp, synthetic construct
  misc_feature 1..20: note = CRISPR gRNA sequence
  source 1..20: mol_type = other DNA
ccaacttctccccacccacg

SEQ ID NO: 58800 - DNA, 20 bp, synthetic construct
  misc_feature 1..20: note = CRISPR gRNA sequence
  source 1..20: mol_type = other DNA
caccgtcaaactcgcaaaaa

SEQ ID NO: 58801 - DNA, 20 bp, synthetic construct
  misc_feature 1..20: note = CRISPR gRNA sequence
  source 1..20: mol_type = other DNA
tcgcaaaaagggaatttaag

SEQ ID NO: 58802 - DNA, 20 bp, synthetic construct
  misc_feature 1..20: note = CRISPR gRNA sequence
  source 1..20: mol_type = other DNA
taatttcagctcagactggt

SEQ ID NO: 58803 - DNA, 20 bp, synthetic construct
  misc_feature 1..20: note = CRISPR gRNA sequence
  source 1..20: mol_type = other DNA
cgggcagatcacctgaggtc

SEQ ID NO: 58804 - DNA, 20 bp, synthetic construct
  misc_feature 1..20: note = CRISPR gRNA sequence
  source 1..20: mol_type = other DNA
aaaattagcccggtgtggtg

SEQ ID NO: 58805 - DNA, 20 bp, synthetic construct
  misc_feature 1..20: note = CRISPR gRNA sequence
  source 1..20: mol_type = other DNA
tacttgggaggctgaggcag

SEQ ID NO: 58806 - DNA, 20 bp, synthetic construct
  misc_feature 1..20: note = CRISPR gRNA sequence
  source 1..20: mol_type = other DNA
tgcactccagcttgggcgac

SEQ ID NO: 58807 - DNA, 20 bp, synthetic construct
  misc_feature 1..20: note = CRISPR gRNA sequence
  source 1..20: mol_type = other DNA
aaaagaaaaaaagaaaaaga

SEQ ID NO: 58808 - DNA, 20 bp, synthetic construct
  misc_feature 1..20: note = CRISPR gRNA sequence
  source 1..20: mol_type = other DNA
agaaaaagaaagaattttag

SEQ ID NO: 58809 - DNA, 20 bp, synthetic construct
  misc_feature 1..20: note = CRISPR gRNA sequence
  source 1..20: mol_type = other DNA
agtcttctagtggtgggagg

SEQ ID NO: 58810 - DNA, 20 bp, synthetic construct
  misc_feature 1..20: note = CRISPR gRNA sequence
  source 1..20: mol_type = other DNA
gtgcaaaggctggggctctc

SEQ ID NO: 58811 - DNA, 20 bp, synthetic construct
  misc_feature 1..20: note = CRISPR gRNA sequence
  source 1..20: mol_type = other DNA
aagatggctcgcatcacctc

SEQ ID NO: 58812 - DNA, 20 bp, synthetic construct
  misc_feature 1..20: note = CRISPR gRNA sequence
  source 1..20: mol_type = other DNA
ctccaggatctcgcttatgc

SEQ ID NO: 58813 - DNA, 20 bp, synthetic construct
  misc_feature 1..20: note = CRISPR gRNA sequence
  source 1..20: mol_type = other DNA
tcccaccctgcccggagata

SEQ ID NO: 58814 - DNA, 20 bp, synthetic construct
  misc_feature 1..20: note = CRISPR gRNA sequence
  source 1..20: mol_type = other DNA
cctgactcctcgtccgcctt

SEQ ID NO: 58815 - DNA, 20 bp, synthetic construct
  misc_feature 1..20: note = CRISPR gRNA sequence
  source 1..20: mol_type = other DNA
tggccagcctgaccccttgc

SEQ ID NO: 58816 - DNA, 20 bp, synthetic construct
  misc_feature 1..20: note = CRISPR gRNA sequence
  source 1..20: mol_type = other DNA
atgaacttagccagtgataa

SEQ ID NO: 58817 - DNA, 20 bp, synthetic construct
  misc_feature 1..20: note = CRISPR gRNA sequence
  source 1..20: mol_type = other DNA
cagtgataagagaattttct

SEQ ID NO: 58818 - DNA, 20 bp, synthetic construct
  misc_feature 1..20: note = CRISPR gRNA sequence
  source 1..20: mol_type = other DNA
aattttctcgggatgtggtg

SEQ ID NO: 58819 - DNA, 20 bp, synthetic construct
  misc_feature 1..20: note = CRISPR gRNA sequence
  source 1..20: mol_type = other DNA
atcagggaacatctctgagg

SEQ ID NO: 58820 - DNA, 20 bp, synthetic construct
  misc_feature 1..20: note = CRISPR gRNA sequence
  source 1..20: mol_type = other DNA
ggaggaagagagagatgggc

SEQ ID NO: 58821 - DNA, 20 bp, synthetic construct
  misc_feature 1..20: note = CRISPR gRNA sequence
  source 1..20: mol_type = other DNA
aagagagagatgggctcggg

SEQ ID NO: 58822 - DNA, 20 bp, synthetic construct
  misc_feature 1..20: note = CRISPR gRNA sequence
  source 1..20: mol_type = other DNA
tggggcctggcacccatggg

SEQ ID NO: 58823 - DNA, 20 bp, synthetic construct
  misc_feature 1..20: note = CRISPR gRNA sequence
  source 1..20: mol_type = other DNA
cctgggaacatgaaagggag

SEQ ID NO: 58824 - DNA, 20 bp, synthetic construct
  misc_feature 1..20: note = CRISPR gRNA sequence
  source 1..20: mol_type = other DNA
atgaaagggagaggaataat

SEQ ID NO: 58825 - DNA, 20 bp, synthetic construct
  misc_feature 1..20: note = CRISPR gRNA sequence
  source 1..20: mol_type = other DNA
tttctttcttttttgtgggg

SEQ ID NO: 58826 - DNA, 20 bp, synthetic construct
  misc_feature 1..20: note = CRISPR gRNA sequence
  source 1..20: mol_type = other DNA
tctcgctctgtcacacaggc

SEQ ID NO: 58827 - DNA, 20 bp, synthetic construct
  misc_feature 1..20: note = CRISPR gRNA sequence
  source 1..20: mol_type = other DNA
gcctcagcctcccaagtagc

SEQ ID NO: 58828 - DNA, 20 bp, synthetic construct
  misc_feature 1..20: note = CRISPR gRNA sequence
  source 1..20: mol_type = other DNA
ttttgtatttttagtagaga

SEQ ID NO: 58829 - DNA, 20 bp, synthetic construct
  misc_feature 1..20: note = CRISPR gRNA sequence
  source 1..20: mol_type = other DNA
ccactgcacccgttcctcat

SEQ ID NO: 58830 - DNA, 20 bp, synthetic construct
  misc_feature 1..20: note = CRISPR gRNA sequence
  source 1..20: mol_type = other DNA
tgggttttcaaaagttcaga

SEQ ID NO: 58831 - DNA, 20 bp, synthetic construct
  misc_feature 1..20: note = CRISPR gRNA sequence
  source 1..20: mol_type = other DNA
tcaaaagttcagactgagtg

SEQ ID NO: 58832 - DNA, 20 bp, synthetic construct
  misc_feature 1..20: note = CRISPR gRNA sequence
  source 1..20: mol_type = other DNA
ttcagactgagtgctgggta

SEQ ID NO: 58833 - DNA, 20 bp, synthetic construct
  misc_feature 1..20: note = CRISPR gRNA sequence
  source 1..20: mol_type = other DNA
gactgagtgctgggtagaga

SEQ ID NO: 58834 - DNA, 20 bp, synthetic construct
  misc_feature 1..20: note = CRISPR gRNA sequence
  source 1..20: mol_type = other DNA
tagagaatggattgggagat

SEQ ID NO: 58835 - DNA, 20 bp, synthetic construct
  misc_feature 1..20: note = CRISPR gRNA sequence
  source 1..20: mol_type = other DNA
tgggagatacgagtggaaat

SEQ ID NO: 58836 - DNA, 20 bp, synthetic construct
  misc_feature 1..20: note = CRISPR gRNA sequence
  source 1..20: mol_type = other DNA
gtgggaagagatgtgtgcag

SEQ ID NO: 58837 - DNA, 20 bp, synthetic construct
  misc_feature 1..20: note = CRISPR gRNA sequence
  source 1..20: mol_type = other DNA
gagatgtgtgcagcagggtg

SEQ ID NO: 58838 - DNA, 20 bp, synthetic construct
  misc_feature 1..20: note = CRISPR gRNA sequence
  source 1..20: mol_type = other DNA
tgctgggggctgatcactgc

SEQ ID NO: 58839 - DNA, 20 bp, synthetic construct
  misc_feature 1..20: note = CRISPR gRNA sequence
  source 1..20: mol_type = other DNA
ggggctgatcactgctgggg

SEQ ID NO: 58840 - DNA, 20 bp, synthetic construct
  misc_feature 1..20: note = CRISPR gRNA sequence
  source 1..20: mol_type = other DNA
gggatagaagttggtagact

SEQ ID NO: 58841 - DNA, 20 bp, synthetic construct
  misc_feature 1..20: note = CRISPR gRNA sequence
  source 1..20: mol_type = other DNA
tagaagttggtagactcagg

SEQ ID NO: 58842 - DNA, 20 bp, synthetic construct
  misc_feature 1..20: note = CRISPR gRNA sequence
  source 1..20: mol_type = other DNA
gtagactcagggtggatctt

SEQ ID NO: 58843 - DNA, 20 bp, synthetic construct
  misc_feature 1..20: note = CRISPR gRNA sequence
  source 1..20: mol_type = other DNA
ctcagggtggatcttgagag

SEQ ID NO: 58844 - DNA, 20 bp, synthetic construct
  misc_feature 1..20: note = CRISPR gRNA sequence
  source 1..20: mol_type = other DNA
atttacagacaagctgatag

SEQ ID NO: 58845 - DNA, 20 bp, synthetic construct
  misc_feature 1..20: note = CRISPR gRNA sequence
  source 1..20: mol_type = other DNA
acaagctgatagggggatta

SEQ ID NO: 58846 - DNA, 20 bp, synthetic construct
  misc_feature 1..20: note = CRISPR gRNA sequence
  source 1..20: mol_type = other DNA
gctgaggctgcctctgaggg

SEQ ID NO: 58847 - DNA, 20 bp, synthetic construct
  misc_feature 1..20: note = CRISPR gRNA sequence
  source 1..20: mol_type = other DNA
taaggcagtggtttccaact

SEQ ID NO: 58848 - DNA, 20 bp, synthetic construct
  misc_feature 1..20: note = CRISPR gRNA sequence
  source 1..20: mol_type = other DNA
tgggggtgattttcaccctt

SEQ ID NO: 58849 - DNA, 20 bp, synthetic construct
  misc_feature 1..20: note = CRISPR gRNA sequence
  source 1..20: mol_type = other DNA
tatttttggtggtcatgact

SEQ ID NO: 58850 - DNA, 20 bp, synthetic construct
  misc_feature 1..20: note = CRISPR gRNA sequence
  source 1..20: mol_type = other DNA
ggtggtcatgactgcgggtg

SEQ ID NO: 58851 - DNA, 20 bp, synthetic construct
  misc_feature 1..20: note = CRISPR gRNA sequence
  source 1..20: mol_type = other DNA
gaggggtgctgctactggca

SEQ ID NO: 58852 - DNA, 20 bp, synthetic construct
  misc_feature 1..20: note = CRISPR gRNA sequence
  source 1..20: mol_type = other DNA
ggtgctgctactggcatcga

SEQ ID NO: 58853 - DNA, 20 bp, synthetic construct
  misc_feature 1..20: note = CRISPR gRNA sequence
  source 1..20: mol_type = other DNA
gcatcgaatgaatagagatc

SEQ ID NO: 58854 - DNA, 20 bp, synthetic construct
  misc_feature 1..20: note = CRISPR gRNA sequence
  source 1..20: mol_type = other DNA
gcacaggagagcccacaaca

SEQ ID NO: 58855 - DNA, 20 bp, synthetic construct
  misc_feature 1..20: note = CRISPR gRNA sequence
  source 1..20: mol_type = other DNA
attaaatcctcatatacctc

SEQ ID NO: 58856 - DNA, 20 bp, synthetic construct
  misc_feature 1..20: note = CRISPR gRNA sequence
  source 1..20: mol_type = other DNA
tacctcgagagtcatacatg

SEQ ID NO: 58857 - DNA, 20 bp, synthetic construct
  misc_feature 1..20: note = CRISPR gRNA sequence
  source 1..20: mol_type = other DNA
ttccttgtccactcatcttg

SEQ ID NO: 58858 - DNA, 20 bp, synthetic construct
  misc_feature 1..20: note = CRISPR gRNA sequence
  source 1..20: mol_type = other DNA
aacaccttaagcctgtgtcc

SEQ ID NO: 58859 - DNA, 20 bp, synthetic construct
  misc_feature 1..20: note = CRISPR gRNA sequence
  source 1..20: mol_type = other DNA
tgtgtccacgggttaaaaag

SEQ ID NO: 58860 - DNA, 20 bp, synthetic construct
  misc_feature 1..20: note = CRISPR gRNA sequence
  source 1..20: mol_type = other DNA
gacagccaggactcgtcctg

SEQ ID NO: 58861 - DNA, 20 bp, synthetic construct
  misc_feature 1..20: note = CRISPR gRNA sequence
  source 1..20: mol_type = other DNA
tcgtcctgaagggttgtgcc

SEQ ID NO: 58862 - DNA, 20 bp, synthetic construct
  misc_feature 1..20: note = CRISPR gRNA sequence
  source 1..20: mol_type = other DNA
agggttgtgcctggagtctg

SEQ ID NO: 58863 - DNA, 20 bp, synthetic construct
  misc_feature 1..20: note = CRISPR gRNA sequence
  source 1..20: mol_type = other DNA
ctggagtctggtgggtatga

SEQ ID NO: 58864 - DNA, 20 bp, synthetic construct
  misc_feature 1..20: note = CRISPR gRNA sequence
  source 1..20: mol_type = other DNA
gtctggtgggtatgaggggg

SEQ ID NO: 58865 - DNA, 20 bp, synthetic construct
  misc_feature 1..20: note = CRISPR gRNA sequence
  source 1..20: mol_type = other DNA
agaggctgggcttccggagg

SEQ ID NO: 58866 - DNA, 20 bp, synthetic construct
  misc_feature 1..20: note = CRISPR gRNA sequence
  source 1..20: mol_type = other DNA
ggaggaggaaggcgtgtgct

SEQ ID NO: 58867 - DNA, 20 bp, synthetic construct
  misc_feature 1..20: note = CRISPR gRNA sequence
  source 1..20: mol_type = other DNA
gggaccagtagatctgcctc

SEQ ID NO: 58868 - DNA, 20 bp, synthetic construct
  misc_feature 1..20: note = CRISPR gRNA sequence
  source 1..20: mol_type = other DNA
cagcatgaagaaacacaggt

SEQ ID NO: 58869 - DNA, 20 bp, synthetic construct
  misc_feature 1..20: note = CRISPR gRNA sequence
  source 1..20: mol_type = other DNA
tgaagaaacacaggtccggg

SEQ ID NO: 58870 - DNA, 20 bp, synthetic construct
  misc_feature 1..20: note = CRISPR gRNA sequence
  source 1..20: mol_type = other DNA
gtccgggtgggatctactgt

SEQ ID NO: 58871 - DNA, 20 bp, synthetic construct
  misc_feature 1..20: note = CRISPR gRNA sequence
  source 1..20: mol_type = other DNA
ctactgtgggggtgggagca

SEQ ID NO: 58872 - DNA, 20 bp, synthetic construct
  misc_feature 1..20: note = CRISPR gRNA sequence
  source 1..20: mol_type = other DNA
gtggattctggacacttcca

SEQ ID NO: 58873 - DNA, 20 bp, synthetic construct
  misc_feature 1..20: note = CRISPR gRNA sequence
  source 1..20: mol_type = other DNA
cacttccagagggtccaagc

SEQ ID NO: 58874 - DNA, 20 bp, synthetic construct
  misc_feature 1..20: note = CRISPR gRNA sequence
  source 1..20: mol_type = other DNA
cctgggctagccaggccgga

SEQ ID NO: 58875 - DNA, 20 bp, synthetic construct
  misc_feature 1..20: note = CRISPR gRNA sequence
  source 1..20: mol_type = other DNA
cagcctcagccaggagcacg

SEQ ID NO: 58876 - DNA, 20 bp, synthetic construct
  misc_feature 1..20: note = CRISPR gRNA sequence
  source 1..20: mol_type = other DNA
gtgtaaagacctcagccagg

SEQ ID NO: 58877 - DNA, 20 bp, synthetic construct
  misc_feature 1..20: note = CRISPR gRNA sequence
  source 1..20: mol_type = other DNA
catgcctgaggggcactgaa

SEQ ID NO: 58878 - DNA, 20 bp, synthetic construct
  misc_feature 1..20: note = CRISPR gRNA sequence
  source 1..20: mol_type = other DNA
aggggcactgaagggggtat

SEQ ID NO: 58879 - DNA, 20 bp, synthetic construct
  misc_feature 1..20: note = CRISPR gRNA sequence
  source 1..20: mol_type = other DNA
acctctcaggaccagctgtc

SEQ ID NO: 58880 - DNA, 20 bp, synthetic construct
  misc_feature 1..20: note = CRISPR gRNA sequence
  source 1..20: mol_type = other DNA
ggaccagctgtcagggatgc

SEQ ID NO: 58881 - DNA, 20 bp, synthetic construct
  misc_feature 1..20: note = CRISPR gRNA sequence
  source 1..20: mol_type = other DNA
gtcacatacccaaagcttcc

SEQ ID NO: 58882 - DNA, 20 bp, synthetic construct
  misc_feature 1..20: note = CRISPR gRNA sequence
  source 1..20: mol_type = other DNA
ggcagatgggggctaaaacg

SEQ ID NO: 58883 - DNA, 20 bp, synthetic construct
  misc_feature 1..20: note = CRISPR gRNA sequence
  source 1..20: mol_type = other DNA
ccagcaggtggttaaaagta

SEQ ID NO: 58884 - DNA, 20 bp, synthetic construct
  misc_feature 1..20: note = CRISPR gRNA sequence
  source 1..20: mol_type = other DNA
aggagggacgcagagccagc

SEQ ID NO: 58885 - DNA, 20 bp, synthetic construct
  misc_feature 1..20: note = CRISPR gRNA sequence
  source 1..20: mol_type = other DNA
ggacgcagagccagccaggg

SEQ ID NO: 58886 - DNA, 20 bp, synthetic construct
  misc_feature 1..20: note = CRISPR gRNA sequence
  source 1..20: mol_type = other DNA
tggtatctgcgtggcctgtc

SEQ ID NO: 58887 - DNA, 20 bp, synthetic construct
  misc_feature 1..20: note = CRISPR gRNA sequence
  source 1..20: mol_type = other DNA
ttcaaatagtcagcccctgc

SEQ ID NO: 58888 - DNA, 20 bp, synthetic construct
  misc_feature 1..20: note = CRISPR gRNA sequence
  source 1..20: mol_type = other DNA
atagtcagcccctgcatggg

SEQ ID NO: 58889 - DNA, 20 bp, synthetic construct
  misc_feature 1..20: note = CRISPR gRNA sequence
  source 1..20: mol_type = other DNA
tttttatgtttcccatatcc

SEQ ID NO: 58890 - DNA, 20 bp, synthetic construct
  misc_feature 1..20: note = CRISPR gRNA sequence
  source 1..20: mol_type = other DNA
gatgagggaactgagacaca

SEQ ID NO: 58891 - DNA, 20 bp, synthetic construct
  misc_feature 1..20: note = CRISPR gRNA sequence
  source 1..20: mol_type = other DNA
gtcacacagctagtaaaatg

SEQ ID NO: 58892 - DNA, 20 bp, synthetic construct
  misc_feature 1..20: note = CRISPR gRNA sequence
  source 1..20: mol_type = other DNA
agtccctgctcagacgcatt

SEQ ID NO: 58893 - DNA, 20 bp, synthetic construct
  misc_feature 1..20: note = CRISPR gRNA sequence
  source 1..20: mol_type = other DNA
aaaatgtgactgataaaatc

SEQ ID NO: 58894 - DNA, 20 bp, synthetic construct
  misc_feature 1..20: note = CRISPR gRNA sequence
  source 1..20: mol_type = other DNA
tttcttttttttttaagacc

SEQ ID NO: 58895 - DNA, 20 bp, synthetic construct
  misc_feature 1..20: note = CRISPR gRNA sequence
  source 1..20: mol_type = other DNA
tctcactctgttgcccaggc

SEQ ID NO: 58896 - DNA, 20 bp, synthetic construct
  misc_feature 1..20: note = CRISPR gRNA sequence
  source 1..20: mol_type = other DNA
gatcctcccacctcagcctc

SEQ ID NO: 58897 - DNA, 20 bp, synthetic construct
  misc_feature 1..20: note = CRISPR gRNA sequence
  source 1..20: mol_type = other DNA
caggcatgagccgctgtgct

SEQ ID NO: 58898 - DNA, 20 bp, synthetic construct
  misc_feature 1..20: note = CRISPR gRNA sequence
  source 1..20: mol_type = other DNA
ggaatgtattttaaacagat

SEQ ID NO: 58899 - DNA, 20 bp, synthetic construct
  misc_feature 1..20: note = CRISPR gRNA sequence
  source 1..20: mol_type = other DNA
tatgaataagaaatatgtct

SEQ ID NO: 58900 - DNA, 20 bp, synthetic construct
  misc_feature 1..20: note = CRISPR gRNA sequence
  source 1..20: mol_type = other DNA
tttctttctttttttttaga

SEQ ID NO: 58901 - DNA, 20 bp, synthetic construct
  misc_feature 1..20: note = CRISPR gRNA sequence
  source 1..20: mol_type = other DNA
tctttctctgctgcccaggc

SEQ ID NO: 58902 - DNA, 20 bp, synthetic construct
  misc_feature 1..20: note = CRISPR gRNA sequence
  source 1..20: mol_type = other DNA
tttggtatttttagtagaga

SEQ ID NO: 58903 - DNA, 20 bp, synthetic construct
  misc_feature 1..20: note = CRISPR gRNA sequence
  source 1..20: mol_type = other DNA
gcctcgccctcccaaagtgc

SEQ ID NO: 58904 - DNA, 20 bp, synthetic construct
  misc_feature 1..20: note = CRISPR gRNA sequence
  source 1..20: mol_type = other DNA
cagcactttgggaggccaaa

SEQ ID NO: 58905 - DNA, 20 bp, synthetic construct
  misc_feature 1..20: note = CRISPR gRNA sequence
  source 1..20: mol_type = other DNA
actttgggaggccaaagcgg

SEQ ID NO: 58906 - DNA, 20 bp, synthetic construct
  misc_feature 1..20: note = CRISPR gRNA sequence
  source 1..20: mol_type = other DNA
cgggtggatcacctgaggtc

SEQ ID NO: 58907 - DNA, 20 bp, synthetic construct
  misc_feature 1..20: note = CRISPR gRNA sequence
  source 1..20: mol_type = other DNA
tacttgggaggctgaggcag

SEQ ID NO: 58908 - DNA, 20 bp, synthetic construct
  misc_feature 1..20: note = CRISPR gRNA sequence
  source 1..20: mol_type = other DNA
taaataaataaataaaacca

SEQ ID NO: 58909 - DNA, 20 bp, synthetic construct
  misc_feature 1..20: note = CRISPR gRNA sequence
  source 1..20: mol_type = other DNA
cagattaaaagaagaaatct

SEQ ID NO: 58910 - DNA, 20 bp, synthetic construct
  misc_feature 1..20: note = CRISPR gRNA sequence
  source 1..20: mol_type = other DNA
cctgcaaacatttttttttc

SEQ ID NO: 58911 - DNA, 20 bp, synthetic construct
  misc_feature 1..20: note = CRISPR gRNA sequence
  source 1..20: mol_type = other DNA
tttcctctcattcaaaaact

SEQ ID NO: 58912 - DNA, 20 bp, synthetic construct
  misc_feature 1..20: note = CRISPR gRNA sequence
  source 1..20: mol_type = other DNA
ctgctggaggcacctgagct

SEQ ID NO: 58913 - DNA, 20 bp, synthetic construct
  misc_feature 1..20: note = CRISPR gRNA sequence
  source 1..20: mol_type = other DNA
ccgatatggaagaggaccaa

SEQ ID NO: 58914 - DNA, 20 bp, synthetic construct
  misc_feature 1..20: note = CRISPR gRNA sequence
  source 1..20: mol_type = other DNA
tatggaagaggaccaagagg

SEQ ID NO: 58915 - DNA, 20 bp, synthetic construct
  misc_feature 1..20: note = CRISPR gRNA sequence
  source 1..20: mol_type = other DNA
gtttactgtggtgctgggga

SEQ ID NO: 58916 - DNA, 20 bp, synthetic construct
  misc_feature 1..20: note = CRISPR gRNA sequence
  source 1..20: mol_type = other DNA
gggatagtagcagagaacgt

SEQ ID NO: 58917 - DNA, 20 bp, synthetic construct
  misc_feature 1..20: note = CRISPR gRNA sequence
  source 1..20: mol_type = other DNA
gtcattctagtggtgatgga

SEQ ID NO: 58918 - DNA, 20 bp, synthetic construct
  misc_feature 1..20: note = CRISPR gRNA sequence
  source 1..20: mol_type = other DNA
tggtactgggcttggtggtg

SEQ ID NO: 58919 - DNA, 20 bp, synthetic construct
  misc_feature 1..20: note = CRISPR gRNA sequence
  source 1..20: mol_type = other DNA
tggcgctggtgaccctgaca

SEQ ID NO: 58920 - DNA, 20 bp, synthetic construct
  misc_feature 1..20: note = CRISPR gRNA sequence
  source 1..20: mol_type = other DNA
ggggtccagtagcagtgaca

SEQ ID NO: 58921 - DNA, 20 bp, synthetic construct
  misc_feature 1..20: note = CRISPR gRNA sequence
  source 1..20: mol_type = other DNA
cagcggactcagatgccttc

SEQ ID NO: 58922 - DNA, 20 bp, synthetic construct
  misc_feature 1..20: note = CRISPR gRNA sequence
  source 1..20: mol_type = other DNA
ggtgcccatctccggtttgc

SEQ ID NO: 58923 - DNA, 20 bp, synthetic construct
  misc_feature 1..20: note = CRISPR gRNA sequence
  source 1..20: mol_type = other DNA
ttgccttcactcccctggcc

SEQ ID NO: 58924 - DNA, 20 bp, synthetic construct
  misc_feature 1..20: note = CRISPR gRNA sequence
  source 1..20: mol_type = other DNA
agagaggctgtgattcgtgg

SEQ ID NO: 58925 - DNA, 20 bp, synthetic construct
  misc_feature 1..20: note = CRISPR gRNA sequence
  source 1..20: mol_type = other DNA
ccatccccaaccagctgatg

SEQ ID NO: 58926 - DNA, 20 bp, synthetic construct
  misc_feature 1..20: note = CRISPR gRNA sequence
  source 1..20: mol_type = other DNA
ccatctctcccgtgacctgc

SEQ ID NO: 58927 - DNA, 20 bp, synthetic construct
  misc_feature 1..20: note = CRISPR gRNA sequence
  source 1..20: mol_type = other DNA
ggcaactgagcttcgtgctc

SEQ ID NO: 58928 - DNA, 20 bp, synthetic construct
  misc_feature 1..20: note = CRISPR gRNA sequence
  source 1..20: mol_type = other DNA
cagaccacaggggcagcggg

SEQ ID NO: 58929 - DNA, 20 bp, synthetic construct
  misc_feature 1..20: note = CRISPR gRNA sequence
  source 1..20: mol_type = other DNA
ccacaggggcagcgggcagg

SEQ ID NO: 58930 - DNA, 20 bp, synthetic construct
  misc_feature 1..20: note = CRISPR gRNA sequence
  source 1..20: mol_type = other DNA
gagtgcagcgctcaaggact

SEQ ID NO: 58931 - DNA, 20 bp, synthetic construct
  misc_feature 1..20: note = CRISPR gRNA sequence
  source 1..20: mol_type = other DNA
ggtgccagttctgcctgtgt

SEQ ID NO: 58932 - DNA, 20 bp, synthetic construct
  misc_feature 1..20: note = CRISPR gRNA sequence
  source 1..20: mol_type = other DNA
ggcctcagtgtgtccatctg

SEQ ID NO: 58933 - DNA, 20 bp, synthetic construct
  misc_feature 1..20: note = CRISPR gRNA sequence
  source 1..20: mol_type = other DNA
atctccatttcccttctagt

SEQ ID NO: 58934 - DNA, 20 bp, synthetic construct
  misc_feature 1..20: note = CRISPR gRNA sequence
  source 1..20: mol_type = other DNA
gggaggcctcagtgaagtaa

SEQ ID NO: 58935 - DNA, 20 bp, synthetic construct
  misc_feature 1..20: note = CRISPR gRNA sequence
  source 1..20: mol_type = other DNA
cacactttgtggccttccat

SEQ ID NO: 58936 - DNA, 20 bp, synthetic construct
  misc_feature 1..20: note = CRISPR gRNA sequence
  source 1..20: mol_type = other DNA
ggagcaacctctgcctttct

SEQ ID NO: 58937 - DNA, 20 bp, synthetic construct
  misc_feature 1..20: note = CRISPR gRNA sequence
  source 1..20: mol_type = other DNA
ctctgcctttctctgaatct

SEQ ID NO: 58938 - DNA, 20 bp, synthetic construct
  misc_feature 1..20: note = CRISPR gRNA sequence
  source 1..20: mol_type = other DNA
atctcagggtttcctgggca

SEQ ID NO: 58939 - DNA, 20 bp, synthetic construct
  misc_feature 1..20: note = CRISPR gRNA sequence
  source 1..20: mol_type = other DNA
taatttctatcccctgatgc

SEQ ID NO: 58940 - DNA, 20 bp, synthetic construct
  misc_feature 1..20: note = CRISPR gRNA sequence
  source 1..20: mol_type = other DNA
catggggaccatggaggcca

SEQ ID NO: 58941 - DNA, 20 bp, synthetic construct
  misc_feature 1..20: note = CRISPR gRNA sequence
  source 1..20: mol_type = other DNA
gccaggtattgccatgctca

SEQ ID NO: 58942 - DNA, 20 bp, synthetic construct
  misc_feature 1..20: note = CRISPR gRNA sequence
  source 1..20: mol_type = other DNA
ggtattgccatgctcacaga

SEQ ID NO: 58943 - DNA, 20 bp, synthetic construct
  misc_feature 1..20: note = CRISPR gRNA sequence
  source 1..20: mol_type = other DNA
catgctcacagaatgagttt

SEQ ID NO: 58944 - DNA, 20 bp, synthetic construct
  misc_feature 1..20: note = CRISPR gRNA sequence
  source 1..20: mol_type = other DNA
ctccatcctcccttgtcctt

SEQ ID NO: 58945 - DNA, 20 bp, synthetic construct
  misc_feature 1..20: note = CRISPR gRNA sequence
  source 1..20: mol_type = other DNA
cgcttccctctctgtgccct

SEQ ID NO: 58946 - DNA, 20 bp, synthetic construct
  misc_feature 1..20: note = CRISPR gRNA sequence
  source 1..20: mol_type = other DNA
ctgggctctgagcagagctt

SEQ ID NO: 58947 - DNA, 20 bp, synthetic construct
  misc_feature 1..20: note = CRISPR gRNA sequence
  source 1..20: mol_type = other DNA
agacactcaggtaatccctg

SEQ ID NO: 58948 - DNA, 20 bp, synthetic construct
  misc_feature 1..20: note = CRISPR gRNA sequence
  source 1..20: mol_type = other DNA
agcagcttcaagctcactgc

SEQ ID NO: 58949 - DNA, 20 bp, synthetic construct
  misc_feature 1..20: note = CRISPR gRNA sequence
  source 1..20: mol_type = other DNA
gactacaggccttgaggctt

SEQ ID NO: 58950 - DNA, 20 bp, synthetic construct
  misc_feature 1..20: note = CRISPR gRNA sequence
  source 1..20: mol_type = other DNA
tggccctggacaagtaaaat

SEQ ID NO: 58951 - DNA, 20 bp, synthetic construct
  misc_feature 1..20: note = CRISPR gRNA sequence
  source 1..20: mol_type = other DNA
taataacacaacctacccct

SEQ ID NO: 58952 - DNA, 20 bp, synthetic construct
  misc_feature 1..20: note = CRISPR gRNA sequence
  source 1..20: mol_type = other DNA
ctaccccttagggttattgt

SEQ ID NO: 58953 - DNA, 20 bp, synthetic construct
  misc_feature 1..20: note = CRISPR gRNA sequence
  source 1..20: mol_type = other DNA
agggttattgtgaggattaa

SEQ ID NO: 58954 - DNA, 20 bp, synthetic construct
  misc_feature 1..20: note = CRISPR gRNA sequence
  source 1..20: mol_type = other DNA
caggaaaaggtctggctcat

SEQ ID NO: 58955 - DNA, 20 bp, synthetic construct
  misc_feature 1..20: note = CRISPR gRNA sequence
  source 1..20: mol_type = other DNA
attcactccacagcccccag

SEQ ID NO: 58956 - DNA, 20 bp, synthetic construct
  misc_feature 1..20: note = CRISPR gRNA sequence
  source 1..20: mol_type = other DNA
cagtggctccccattaaccc

SEQ ID NO: 58957 - DNA, 20 bp, synthetic construct
  misc_feature 1..20: note = CRISPR gRNA sequence
  source 1..20: mol_type = other DNA
tcccagcagccctgcctcat

SEQ ID NO: 58958 - DNA, 20 bp, synthetic construct
  misc_feature 1..20: note = CRISPR gRNA sequence
  source 1..20: mol_type = other DNA
ctggacagcagagccccacg

SEQ ID NO: 58959 - DNA, 20 bp, synthetic construct
  misc_feature 1..20: note = CRISPR gRNA sequence
  source 1..20: mol_type = other DNA
ctcagccagtgctggtccgg

SEQ ID NO: 58960 - DNA, 20 bp, synthetic construct
  misc_feature 1..20: note = CRISPR gRNA sequence
  source 1..20: mol_type = other DNA
taaggcagtggttaagagct

SEQ ID NO: 58961 - DNA, 20 bp, synthetic construct
  misc_feature 1..20: note = CRISPR gRNA sequence
  source 1..20: mol_type = other DNA
gggtctgcagtcagactgac

SEQ ID NO: 58962 - DNA, 20 bp, synthetic construct
  misc_feature 1..20: note = CRISPR gRNA sequence
  source 1..20: mol_type = other DNA
ttcttatctgctgtgtgtcc

SEQ ID NO: 58963 - DNA, 20 bp, synthetic construct
  misc_feature 1..20: note = CRISPR gRNA sequence
  source 1..20: mol_type = other DNA
ccacctctaattggtgctat

SEQ ID NO: 58964 - DNA, 20 bp, synthetic construct
  misc_feature 1..20: note = CRISPR gRNA sequence
  source 1..20: mol_type = other DNA
tgagaattaaaggagaccct

SEQ ID NO: 58965 - DNA, 20 bp, synthetic construct
  misc_feature 1..20: note = CRISPR gRNA sequence
  source 1..20: mol_type = other DNA
ggctggcacagtgcctgacc

SEQ ID NO: 58966 - DNA, 20 bp, synthetic construct
  misc_feature 1..20: note = CRISPR gRNA sequence
  source 1..20: mol_type = other DNA
actcctaatactttcttaca

SEQ ID NO: 58967 - DNA, 20 bp, synthetic construct
  misc_feature 1..20: note = CRISPR gRNA sequence
  source 1..20: mol_type = other DNA
caggcctttgccctcagagg

SEQ ID NO: 58968 - DNA, 20 bp, synthetic construct
  misc_feature 1..20: note = CRISPR gRNA sequence
  source 1..20: mol_type = other DNA
gctttctgccctcaggctaa

SEQ ID NO: 58969 - DNA, 20 bp, synthetic construct
  misc_feature 1..20: note = CRISPR gRNA sequence
  source 1..20: mol_type = other DNA
ctgcagctgacggagctcac

SEQ ID NO: 58970 - DNA, 20 bp, synthetic construct
  misc_feature 1..20: note = CRISPR gRNA sequence
  source 1..20: mol_type = other DNA
ccagcccgtgaggacagcag

SEQ ID NO: 58971 - DNA, 20 bp, synthetic construct
  misc_feature 1..20: note = CRISPR gRNA sequence
  source 1..20: mol_type = other DNA
cctccgggaggggccatggc

SEQ ID NO: 58972 - DNA, 20 bp, synthetic construct
  misc_feature 1..20: note = CRISPR gRNA sequence
  source 1..20: mol_type = other DNA
gccatggcatgaatgggagc

SEQ ID NO: 58973 - DNA, 20 bp, synthetic construct
  misc_feature 1..20: note = CRISPR gRNA sequence
  source 1..20: mol_type = other DNA
atgggagcaggggtgggcac

SEQ ID NO: 58974 - DNA, 20 bp, synthetic construct
  misc_feature 1..20: note = CRISPR gRNA sequence
  source 1..20: mol_type = other DNA
gcactggagtaagaggcccc

SEQ ID NO: 58975 - DNA, 20 bp, synthetic construct
  misc_feature 1..20: note = CRISPR gRNA sequence
  source 1..20: mol_type = other DNA
cacactggaggcctgtgctt

SEQ ID NO: 58976 - DNA, 20 bp, synthetic construct
  misc_feature 1..20: note = CRISPR gRNA sequence
  source 1..20: mol_type = other DNA
aagaaagaaagaaggtttca

SEQ ID NO: 58977 - DNA, 20 bp, synthetic construct
  misc_feature 1..20: note = CRISPR gRNA sequence
  source 1..20: mol_type = other DNA
aaagaagataccgaagtaga

SEQ ID NO: 58978 - DNA, 20 bp, synthetic construct
  misc_feature 1..20: note = CRISPR gRNA sequence
  source 1..20: mol_type = other DNA
cagttagcgattccttagtg

SEQ ID NO: 58979 - DNA, 20 bp, synthetic construct
  misc_feature 1..20: note = CRISPR gRNA sequence
  source 1..20: mol_type = other DNA
cagataagacagctggcttt

SEQ ID NO: 58980 - DNA, 20 bp, synthetic construct
  misc_feature 1..20: note = CRISPR gRNA sequence
  source 1..20: mol_type = other DNA
gacagctggcttttgggatc

SEQ ID NO: 58981 - DNA, 20 bp, synthetic construct
  misc_feature 1..20: note = CRISPR gRNA sequence
  source 1..20: mol_type = other DNA
acatctggtctgcatttgca

SEQ ID NO: 58982 - DNA, 20 bp, synthetic construct
  misc_feature 1..20: note = CRISPR gRNA sequence
  source 1..20: mol_type = other DNA
catttctaagtgtaccattc

SEQ ID NO: 58983 - DNA, 20 bp, synthetic construct
  misc_feature 1..20: note = CRISPR gRNA sequence
  source 1..20: mol_type = other DNA
actcttttcctcttgcaaaa

SEQ ID NO: 58984 - DNA, 20 bp, synthetic construct
  misc_feature 1..20: note = CRISPR gRNA sequence
  source 1..20: mol_type = other DNA
ccattctgctttctgtctct

SEQ ID NO: 58985 - DNA, 20 bp, synthetic construct
  misc_feature 1..20: note = CRISPR gRNA sequence
  source 1..20: mol_type = other DNA
gactgctctaaatagtttat

SEQ ID NO: 58986 - DNA, 20 bp, synthetic construct
  misc_feature 1..20: note = CRISPR gRNA sequence
  source 1..20: mol_type = other DNA
ctctaaatagtttatatgag

SEQ ID NO: 58987 - DNA, 20 bp, synthetic construct
  misc_feature 1..20: note = CRISPR gRNA sequence
  source 1..20: mol_type = other DNA
ttttttttttttttttgaga

SEQ ID NO: 58988 - DNA, 20 bp, synthetic construct
  misc_feature 1..20: note = CRISPR gRNA sequence
  source 1..20: mol_type = other DNA
ctcactcttgtcacctgggc

SEQ ID NO: 58989 - DNA, 20 bp, synthetic construct
  misc_feature 1..20: note = CRISPR gRNA sequence
  source 1..20: mol_type = other DNA
ctcactgcaccctccacctc

SEQ ID NO: 58990 - DNA, 20 bp, synthetic construct
  misc_feature 1..20: note = CRISPR gRNA sequence
  source 1..20: mol_type = other DNA
gattctcctgcctcagcctc

SEQ ID NO: 58991 - DNA, 20 bp, synthetic construct
  misc_feature 1..20: note = CRISPR gRNA sequence
  source 1..20: mol_type = other DNA
gcctcagcctccggagtagc

SEQ ID NO: 58992 - DNA, 20 bp, synthetic construct
  misc_feature 1..20: note = CRISPR gRNA sequence
  source 1..20: mol_type = other DNA
tttttgtatttttgtagaga

SEQ ID NO: 58993 - DNA, 20 bp, synthetic construct
  misc_feature 1..20: note = CRISPR gRNA sequence
  source 1..20: mol_type = other DNA
gtttcggccttccaaagtgc

SEQ ID NO: 58994 - DNA, 20 bp, synthetic construct
  misc_feature 1..20: note = CRISPR gRNA sequence
  source 1..20: mol_type = other DNA
gctgcataatattccattgt

SEQ ID NO: 58995 - DNA, 20 bp, synthetic construct
  misc_feature 1..20: note = CRISPR gRNA sequence
  source 1..20: mol_type = other DNA
acttatccatcaattgacac

SEQ ID NO: 58996 - DNA, 20 bp, synthetic construct
  misc_feature 1..20: note = CRISPR gRNA sequence
  source 1..20: mol_type = other DNA
tgaggtctcactgttttgcc

SEQ ID NO: 58997 - DNA, 20 bp, synthetic construct
  misc_feature 1..20: note = CRISPR gRNA sequence
  source 1..20: mol_type = other DNA
aattattttggttatatatc

SEQ ID NO: 58998 - DNA, 20 bp, synthetic construct
  misc_feature 1..20: note = CRISPR gRNA sequence
  source 1..20: mol_type = other DNA
ataactttttttttttgaga

SEQ ID NO: 58999 - DNA, 20 bp, synthetic construct
  misc_feature 1..20: note = CRISPR gRNA sequence
  source 1..20: mol_type = other DNA
tctcgctctgttgcccaggt

SEQ ID NO: 59000 - DNA, 20 bp, synthetic construct
  misc_feature 1..20: note = CRISPR gRNA sequence
  source 1..20: mol_type = other DNA
ctcactgcaagctccgcctc

SEQ ID NO: 59001 - DNA, 20 bp, synthetic construct
  misc_feature 1..20: note = CRISPR gRNA sequence
  source 1..20: mol_type = other DNA
cattctcctgcctcagcctc

SEQ ID NO: 59002 - DNA, 20 bp, synthetic construct
  misc_feature 1..20: note = CRISPR gRNA sequence
  source 1..20: mol_type = other DNA
ttttgtatttttagtagaga

SEQ ID NO: 59003 - DNA, 20 bp, synthetic construct
  misc_feature 1..20: note = CRISPR gRNA sequence
  source 1..20: mol_type = other DNA
cggggtttcaccatgttagc

SEQ ID NO: 59004 - DNA, 20 bp, synthetic construct
  misc_feature 1..20: note = CRISPR gRNA sequence
  source 1..20: mol_type = other DNA
acctcagcctcccaaagtgc

SEQ ID NO: 59005 - DNA, 20 bp, synthetic construct
  misc_feature 1..20: note = CRISPR gRNA sequence
  source 1..20: mol_type = other DNA
ataaaataaaaatcactcat

SEQ ID NO: 59006 - DNA, 20 bp, synthetic construct
  misc_feature 1..20: note = CRISPR gRNA sequence
  source 1..20: mol_type = other DNA
ctttttttgaaatgcaaaat

SEQ ID NO: 59007 - DNA, 20 bp, synthetic construct
  misc_feature 1..20: note = CRISPR gRNA sequence
  source 1..20: mol_type = other DNA
cctttgtgatgtaacattat

SEQ ID NO: 59008 - DNA, 20 bp, synthetic construct
  misc_feature 1..20: note = CRISPR gRNA sequence
  source 1..20: mol_type = other DNA
actttgggaggccgaggcag

SEQ ID NO: 59009 - DNA, 20 bp, synthetic construct
  misc_feature 1..20: note = CRISPR gRNA sequence
  source 1..20: mol_type = other DNA
caggtggatcacttgaggtc

SEQ ID NO: 59010 - DNA, 20 bp, synthetic construct
  misc_feature 1..20: note = CRISPR gRNA sequence
  source 1..20: mol_type = other DNA
tacttgggaggctgaggcag

SEQ ID NO: 59011 - DNA, 20 bp, synthetic construct
  misc_feature 1..20: note = CRISPR gRNA sequence
  source 1..20: mol_type = other DNA
taaaaaataatattttctgt

SEQ ID NO: 59012 - DNA, 20 bp, synthetic construct
  misc_feature 1..20: note = CRISPR gRNA sequence
  source 1..20: mol_type = other DNA
attgtcacaacaatagttgt

SEQ ID NO: 59013 - DNA, 20 bp, synthetic construct
  misc_feature 1..20: note = CRISPR gRNA sequence
  source 1..20: mol_type = other DNA
acaacaatagttgttggaat

SEQ ID NO: 59014 - DNA, 20 bp, synthetic construct
  misc_feature 1..20: note = CRISPR gRNA sequence
  source 1..20: mol_type = other DNA
atctgtgtccccttctgtga

SEQ ID NO: 59015 - DNA, 20 bp, synthetic construct
  misc_feature 1..20: note = CRISPR gRNA sequence
  source 1..20: mol_type = other DNA
gagccgtgggcggacagagc

SEQ ID NO: 59016 - DNA, 20 bp, synthetic construct
  misc_feature 1..20: note = CRISPR gRNA sequence
  source 1..20: mol_type = other DNA
ggcagtgtcactgaaatcag

SEQ ID NO: 59017 - DNA, 20 bp, synthetic construct
  misc_feature 1..20: note = CRISPR gRNA sequence
  source 1..20: mol_type = other DNA
gtccagagaagaggcccctt

SEQ ID NO: 59018 - DNA, 20 bp, synthetic construct
  misc_feature 1..20: note = CRISPR gRNA sequence
  source 1..20: mol_type = other DNA
cttgaccttccctcatcctg

SEQ ID NO: 59019 - DNA, 20 bp, synthetic construct
  misc_feature 1..20: note = CRISPR gRNA sequence
  source 1..20: mol_type = other DNA
cagctagttttccatgtccc

SEQ ID NO: 59020 - DNA, 20 bp, synthetic construct
  misc_feature 1..20: note = CRISPR gRNA sequence
  source 1..20: mol_type = other DNA
gtgtcagaggaagacatccc

SEQ ID NO: 59021 - DNA, 20 bp, synthetic construct
  misc_feature 1..20: note = CRISPR gRNA sequence
  source 1..20: mol_type = other DNA
agaatcaaaacaaagggcta

SEQ ID NO: 59022 - DNA, 20 bp, synthetic construct
  misc_feature 1..20: note = CRISPR gRNA sequence
  source 1..20: mol_type = other DNA
ggatccaggcagacatggct

SEQ ID NO: 59023 - DNA, 20 bp, synthetic construct
  misc_feature 1..20: note = CRISPR gRNA sequence
  source 1..20: mol_type = other DNA
agaaataacacaatgacaca

SEQ ID NO: 59024 - DNA, 20 bp, synthetic construct
  misc_feature 1..20: note = CRISPR gRNA sequence
  source 1..20: mol_type = other DNA
cctcaacctcctgctcttaa

SEQ ID NO: 59025 - DNA, 20 bp, synthetic construct
  misc_feature 1..20: note = CRISPR gRNA sequence
  source 1..20: mol_type = other DNA
acggccctttgcagggctgg

SEQ ID NO: 59026 - DNA, 20 bp, synthetic construct
  misc_feature 1..20: note = CRISPR gRNA sequence
  source 1..20: mol_type = other DNA
gcttcttccttctctcctcc

SEQ ID NO: 59027 - DNA, 20 bp, synthetic construct
  misc_feature 1..20: note = CRISPR gRNA sequence
  source 1..20: mol_type = other DNA
tctcctccaggagtgagcaa

SEQ ID NO: 59028 - DNA, 20 bp, synthetic construct
  misc_feature 1..20: note = CRISPR gRNA sequence
  source 1..20: mol_type = other DNA
agaaaattctggaactgccc

SEQ ID NO: 59029 - DNA, 20 bp, synthetic construct
  misc_feature 1..20: note = CRISPR gRNA sequence
  source 1..20: mol_type = other DNA
actttgggaggccgaggcag

SEQ ID NO: 59030 - DNA, 20 bp, synthetic construct
  misc_feature 1..20: note = CRISPR gRNA sequence
  source 1..20: mol_type = other DNA
gcaggaggatcactgaagcc

SEQ ID NO: 59031 - DNA, 20 bp, synthetic construct
  misc_feature 1..20: note = CRISPR gRNA sequence
  source 1..20: mol_type = other DNA
attgttgaaaaggcactact

SEQ ID NO: 59032 - DNA, 20 bp, synthetic construct
  misc_feature 1..20: note = CRISPR gRNA sequence
  source 1..20: mol_type = other DNA
gaaggggacccaggcaaagt

SEQ ID NO: 59033 - DNA, 20 bp, synthetic construct
  misc_feature 1..20: note = CRISPR gRNA sequence
  source 1..20: mol_type = other DNA
acccaggcaaagtgagagtt

SEQ ID NO: 59034 - DNA, 20 bp, synthetic construct
  misc_feature 1..20: note = CRISPR gRNA sequence
  source 1..20: mol_type = other DNA
gcagcagctctgtgtccagc

SEQ ID NO: 59035 - DNA, 20 bp, synthetic construct
  misc_feature 1..20: note = CRISPR gRNA sequence
  source 1..20: mol_type = other DNA
tggaatttcctcgccaggaa

SEQ ID NO: 59036 - DNA, 20 bp, synthetic construct
  misc_feature 1..20: note = CRISPR gRNA sequence
  source 1..20: mol_type = other DNA
ccaccctgcccagagacctt

SEQ ID NO: 59037 - DNA, 20 bp, synthetic construct
  misc_feature 1..20: note = CRISPR gRNA sequence
  source 1..20: mol_type = other DNA
cacaggctgtgctctctgcc

SEQ ID NO: 59038 - DNA, 20 bp, synthetic construct
  misc_feature 1..20: note = CRISPR gRNA sequence
  source 1..20: mol_type = other DNA
ttatccactcttatagatcc

SEQ ID NO: 59039 - DNA, 20 bp, synthetic construct
  misc_feature 1..20: note = CRISPR gRNA sequence
  source 1..20: mol_type = other DNA
gaaattaaaatgtcaccctt

SEQ ID NO: 59040 - DNA, 20 bp, synthetic construct
  misc_feature 1..20: note = CRISPR gRNA sequence
  source 1..20: mol_type = other DNA
ttaaaatgtcacccttttga

SEQ ID NO: 59041 - DNA, 20 bp, synthetic construct
  misc_feature 1..20: note = CRISPR gRNA sequence
  source 1..20: mol_type = other DNA
ttctgggaaatagagcatgg

SEQ ID NO: 59042 - DNA, 20 bp, synthetic construct
  misc_feature 1..20: note = CRISPR gRNA sequence
  source 1..20: mol_type = other DNA
cttcctagcacttctcataa

SEQ ID NO: 59043 - DNA, 20 bp, synthetic construct
  misc_feature 1..20: note = CRISPR gRNA sequence
  source 1..20: mol_type = other DNA
aagctccttgcaggcagata

SEQ ID NO: 59044 - DNA, 20 bp, synthetic construct
  misc_feature 1..20: note = CRISPR gRNA sequence
  source 1..20: mol_type = other DNA
tggaaactctgtgtggggcc

SEQ ID NO: 59045 - DNA, 20 bp, synthetic construct
  misc_feature 1..20: note = CRISPR gRNA sequence
  source 1..20: mol_type = other DNA
gtggaggggagggagagccc

SEQ ID NO: 59046 - DNA, 20 bp, synthetic construct
  misc_feature 1..20: note = CRISPR gRNA sequence
  source 1..20: mol_type = other DNA
agggtggctcaggggagctc

SEQ ID NO: 59047 - DNA, 20 bp, synthetic construct
  misc_feature 1..20: note = CRISPR gRNA sequence
  source 1..20: mol_type = other DNA
tcctctcttggcaccccctt

SEQ ID NO: 59048 - DNA, 20 bp, synthetic construct
  misc_feature 1..20: note = CRISPR gRNA sequence
  source 1..20: mol_type = other DNA
gtgtccagcctgaaatcctc

SEQ ID NO: 59049 - DNA, 20 bp, synthetic construct
  misc_feature 1..20: note = CRISPR gRNA sequence
  source 1..20: mol_type = other DNA
tggccctggagatgattttt

SEQ ID NO: 59050 - DNA, 20 bp, synthetic construct
  misc_feature 1..20: note = CRISPR gRNA sequence
  source 1..20: mol_type = other DNA
actttgggaggccgaggcag

SEQ ID NO: 59051 - DNA, 20 bp, synthetic construct
  misc_feature 1..20: note = CRISPR gRNA sequence
  source 1..20: mol_type = other DNA
caggtggattgcctgagctc

SEQ ID NO: 59052 - DNA, 20 bp, synthetic construct
  misc_feature 1..20: note = CRISPR gRNA sequence
  source 1..20: mol_type = other DNA
taattgggaggctgaggcac

SEQ ID NO: 59053 - DNA, 20 bp, synthetic construct
  misc_feature 1..20: note = CRISPR gRNA sequence
  source 1..20: mol_type = other DNA
ctttacccgttaacatttca

SEQ ID NO: 59054 - DNA, 20 bp, synthetic construct
  misc_feature 1..20: note = CRISPR gRNA sequence
  source 1..20: mol_type = other DNA
attgcatttttttcccagtt

SEQ ID NO: 59055 - DNA, 20 bp, synthetic construct
  misc_feature 1..20: note = CRISPR gRNA sequence
  source 1..20: mol_type = other DNA
tcccagttgtggatccaatc

SEQ ID NO: 59056 - DNA, 20 bp, synthetic construct
  misc_feature 1..20: note = CRISPR gRNA sequence
  source 1..20: mol_type = other DNA
tttacaggccagttatttta

SEQ ID NO: 59057 - DNA, 20 bp, synthetic construct
  misc_feature 1..20: note = CRISPR gRNA sequence
  source 1..20: mol_type = other DNA
tttatagaatgtccttccac

SEQ ID NO: 59058 - DNA, 20 bp, synthetic construct
  misc_feature 1..20: note = CRISPR gRNA sequence
  source 1..20: mol_type = other DNA
gtccaatgtttcctcatgtt

SEQ ID NO: 59059 - DNA, 20 bp, synthetic construct
  misc_feature 1..20: note = CRISPR gRNA sequence
  source 1..20: mol_type = other DNA
tgtttcctcatgtttagagt

SEQ ID NO: 59060 - DNA, 20 bp, synthetic construct
  misc_feature 1..20: note = CRISPR gRNA sequence
  source 1..20: mol_type = other DNA
ttagagtctgccctttgggc

SEQ ID NO: 59061 - DNA, 20 bp, synthetic construct
  misc_feature 1..20: note = CRISPR gRNA sequence
  source 1..20: mol_type = other DNA
catcggggcacatgatgtgt

SEQ ID NO: 59062 - DNA, 20 bp, synthetic construct
  misc_feature 1..20: note = CRISPR gRNA sequence
  source 1..20: mol_type = other DNA
aataaatcttacttaaatcg

SEQ ID NO: 59063 - DNA, 20 bp, synthetic construct
  misc_feature 1..20: note = CRISPR gRNA sequence
  source 1..20: mol_type = other DNA
aggaaaaatcgcttgagccc

SEQ ID NO: 59064 - DNA, 20 bp, synthetic construct
  misc_feature 1..20: note = CRISPR gRNA sequence
  source 1..20: mol_type = other DNA
cagtatttgctttaaagatg

SEQ ID NO: 59065 - DNA, 20 bp, synthetic construct
  misc_feature 1..20: note = CRISPR gRNA sequence
  source 1..20: mol_type = other DNA
ttaagttgtgaagttgctac

SEQ ID NO: 59066 - DNA, 20 bp, synthetic construct
  misc_feature 1..20: note = CRISPR gRNA sequence
  source 1..20: mol_type = other DNA
ccaagctctgtggtggctta

SEQ ID NO: 59067 - DNA, 20 bp, synthetic construct
  misc_feature 1..20: note = CRISPR gRNA sequence
  source 1..20: mol_type = other DNA
ctgccaccacttggaggagc

SEQ ID NO: 59068 - DNA, 20 bp, synthetic construct
  misc_feature 1..20: note = CRISPR gRNA sequence
  source 1..20: mol_type = other DNA
caccacttggaggagctgga

SEQ ID NO: 59069 - DNA, 20 bp, synthetic construct
  misc_feature 1..20: note = CRISPR gRNA sequence
  source 1..20: mol_type = other DNA
ggaggagctggagtgagttg

SEQ ID NO: 59070 - DNA, 20 bp, synthetic construct
  misc_feature 1..20: note = CRISPR gRNA sequence
  source 1..20: mol_type = other DNA
tggagtgagttgcagagtgg

SEQ ID NO: 59071 - DNA, 20 bp, synthetic construct
  misc_feature 1..20: note = CRISPR gRNA sequence
  source 1..20: mol_type = other DNA
tggggacaagtggcccagct

SEQ ID NO: 59072 - DNA, 20 bp, synthetic construct
  misc_feature 1..20: note = CRISPR gRNA sequence
  source 1..20: mol_type = other DNA
aagtggcccagctgagggtg

SEQ ID NO: 59073 - DNA, 20 bp, synthetic construct
  misc_feature 1..20: note = CRISPR gRNA sequence
  source 1..20: mol_type = other DNA
cctgatgaagtgcagcagtt

SEQ ID NO: 59074 - DNA, 20 bp, synthetic construct
  misc_feature 1..20: note = CRISPR gRNA sequence
  source 1..20: mol_type = other DNA
aagagcaccacagttttggt

SEQ ID NO: 59075 - DNA, 20 bp, synthetic construct
  misc_feature 1..20: note = CRISPR gRNA sequence
  source 1..20: mol_type = other DNA
tgctctgctgggctggctgt

SEQ ID NO: 59076 - DNA, 20 bp, synthetic construct
  misc_feature 1..20: note = CRISPR gRNA sequence
  source 1..20: mol_type = other DNA
cggagagggctgaagaacaa

SEQ ID NO: 59077 - DNA, 20 bp, synthetic construct
  misc_feature 1..20: note = CRISPR gRNA sequence
  source 1..20: mol_type = other DNA
agagcctgagccctggagct

SEQ ID NO: 59078 - DNA, 20 bp, synthetic construct
  misc_feature 1..20: note = CRISPR gRNA sequence
  source 1..20: mol_type = other DNA
ccatggggaacctggacagc

SEQ ID NO: 59079 - DNA, 20 bp, synthetic construct
  misc_feature 1..20: note = CRISPR gRNA sequence
  source 1..20: mol_type = other DNA
tggcccagggcatgcagatg

SEQ ID NO: 59080 - DNA, 20 bp, synthetic construct
  misc_feature 1..20: note = CRISPR gRNA sequence
  source 1..20: mol_type = other DNA
atgagggcccttgaggggaa

SEQ ID NO: 59081 - DNA, 20 bp, synthetic construct
  misc_feature 1..20: note = CRISPR gRNA sequence
  source 1..20: mol_type = other DNA
gaaatggatgctaaagaggc

SEQ ID NO: 59082 - DNA, 20 bp, synthetic construct
  misc_feature 1..20: note = CRISPR gRNA sequence
  source 1..20: mol_type = other DNA
agtaagtagtgatggtggtt

SEQ ID NO: 59083 - DNA, 20 bp, synthetic construct
  misc_feature 1..20: note = CRISPR gRNA sequence
  source 1..20: mol_type = other DNA
agtagtgatggtggttgtgg

SEQ ID NO: 59084 - DNA, 20 bp, synthetic construct
  misc_feature 1..20: note = CRISPR gRNA sequence
  source 1..20: mol_type = other DNA
gtgatggtggttgtgggtga

SEQ ID NO: 59085 - DNA, 20 bp, synthetic construct
  misc_feature 1..20: note = CRISPR gRNA sequence
  source 1..20: mol_type = other DNA
gttgtgggtgagtgagtggt

SEQ ID NO: 59086 - DNA, 20 bp, synthetic construct
  misc_feature 1..20: note = CRISPR gRNA sequence
  source 1..20: mol_type = other DNA
gtgagtggtgggggtggtta

SEQ ID NO: 59087 - DNA, 20 bp, synthetic construct
  misc_feature 1..20: note = CRISPR gRNA sequence
  source 1..20: mol_type = other DNA
gtggttaatggatggtggaa

SEQ ID NO: 59088 - DNA, 20 bp, synthetic construct
  misc_feature 1..20: note = CRISPR gRNA sequence
  source 1..20: mol_type = other DNA
ttaatggatggtggaagtgg

SEQ ID NO: 59089 - DNA, 20 bp, synthetic construct
  misc_feature 1..20: note = CRISPR gRNA sequence
  source 1..20: mol_type = other DNA
tggtggaagtgggtgagtgg

SEQ ID NO: 59090 - DNA, 20 bp, synthetic construct
  misc_feature 1..20: note = CRISPR gRNA sequence
  source 1..20: mol_type = other DNA
gtgagtggtggggttggtta

SEQ ID NO: 59091 - DNA, 20 bp, synthetic construct
  misc_feature 1..20: note = CRISPR gRNA sequence
  source 1..20: mol_type = other DNA
ttggttaatggatggtggaa

SEQ ID NO: 59092 - DNA, 20 bp, synthetic construct
  misc_feature 1..20: note = CRISPR gRNA sequence
  source 1..20: mol_type = other DNA
ttaatggatggtggaagtgg

SEQ ID NO: 59093 - DNA, 20 bp, synthetic construct
  misc_feature 1..20: note = CRISPR gRNA sequence
  source 1..20: mol_type = other DNA
tggtggaagtgggtgagtgg

SEQ ID NO: 59094 - DNA, 20 bp, synthetic construct
  misc_feature 1..20: note = CRISPR gRNA sequence
  source 1..20: mol_type = other DNA
agtggtggggttggttaatg

SEQ ID NO: 59095 - DNA, 20 bp, synthetic construct
  misc_feature 1..20: note = CRISPR gRNA sequence
  source 1..20: mol_type = other DNA
tggggttggttaatggggaa

SEQ ID NO: 59096 - DNA, 20 bp, synthetic construct
  misc_feature 1..20: note = CRISPR gRNA sequence
  source 1..20: mol_type = other DNA
gttggttaatggggaatggg

SEQ ID NO: 59097 - DNA, 20 bp, synthetic construct
  misc_feature 1..20: note = CRISPR gRNA sequence
  source 1..20: mol_type = other DNA
gttaatggggaatggggtga

SEQ ID NO: 59098 - DNA, 20 bp, synthetic construct
  misc_feature 1..20: note = CRISPR gRNA sequence
  source 1..20: mol_type = other DNA
gaatggggtgagtgagtggt

SEQ ID NO: 59099 - DNA, 20 bp, synthetic construct
  misc_feature 1..20: note = CRISPR gRNA sequence
  source 1..20: mol_type = other DNA
agtggtgggagtggttaatg

SEQ ID NO: 59100 - DNA, 20 bp, synthetic construct
  misc_feature 1..20: note = CRISPR gRNA sequence
  source 1..20: mol_type = other DNA
agtggttaatggggaatggg

SEQ ID NO: 59101 - DNA, 20 bp, synthetic construct
  misc_feature 1..20: note = CRISPR gRNA sequence
  source 1..20: mol_type = other DNA
gttaatggggaatgggctga

SEQ ID NO: 59102 - DNA, 20 bp, synthetic construct
  misc_feature 1..20: note = CRISPR gRNA sequence
  source 1..20: mol_type = other DNA
gaatgggctgagtgagtggt

SEQ ID NO: 59103 - DNA, 20 bp, synthetic construct
  misc_feature 1..20: note = CRISPR gRNA sequence
  source 1..20: mol_type = other DNA
agtggtgggagtggttaatg

SEQ ID NO: 59104 - DNA, 20 bp, synthetic construct
  misc_feature 1..20: note = CRISPR gRNA sequence
  source 1..20: mol_type = other DNA
tgggagtggttaatggggaa

SEQ ID NO: 59105 - DNA, 20 bp, synthetic construct
  misc_feature 1..20: note = CRISPR gRNA sequence
  source 1..20: mol_type = other DNA
agtggttaatggggaatggg

SEQ ID NO: 59106 - DNA, 20 bp, synthetic construct
  misc_feature 1..20: note = CRISPR gRNA sequence
  source 1..20: mol_type = other DNA
gttaatggggaatggggtga

SEQ ID NO: 59107 - DNA, 20 bp, synthetic construct
  misc_feature 1..20: note = CRISPR gRNA sequence
  source 1..20: mol_type = other DNA
ggtgatggtggttaatgggg

SEQ ID NO: 59108 - DNA, 20 bp, synthetic construct
  misc_feature 1..20: note = CRISPR gRNA sequence
  source 1..20: mol_type = other DNA
tggttaatggggaagggtgt

SEQ ID NO: 59109 - DNA, 20 bp, synthetic construct
  misc_feature 1..20: note = CRISPR gRNA sequence
  source 1..20: mol_type = other DNA
tgatggtggttaatggggaa

SEQ ID NO: 59110 - DNA, 20 bp, synthetic construct
  misc_feature 1..20: note = CRISPR gRNA sequence
  source 1..20: mol_type = other DNA
ggtggttaatggggaagggg

SEQ ID NO: 59111 - DNA, 20 bp, synthetic construct
  misc_feature 1..20: note = CRISPR gRNA sequence
  source 1..20: mol_type = other DNA
gttaatggggaagggggtga

SEQ ID NO: 59112 - DNA, 20 bp, synthetic construct
  misc_feature 1..20: note = CRISPR gRNA sequence
  source 1..20: mol_type = other DNA
gtggttaatggggaagtgtt

SEQ ID NO: 59113 - DNA, 20 bp, synthetic construct
  misc_feature 1..20: note = CRISPR gRNA sequence
  source 1..20: mol_type = other DNA
ttaatggggaagtgttgtga

SEQ ID NO: 59114 - DNA, 20 bp, synthetic construct
  misc_feature 1..20: note = CRISPR gRNA sequence
  source 1..20: mol_type = other DNA
ggtggttaatggggaaggag

SEQ ID NO: 59115 - DNA, 20 bp, synthetic construct
  misc_feature 1..20: note = CRISPR gRNA sequence
  source 1..20: mol_type = other DNA
gttaatggggaaggagatga

SEQ ID NO: 59116 - DNA, 20 bp, synthetic construct
  misc_feature 1..20: note = CRISPR gRNA sequence
  source 1..20: mol_type = other DNA
ggtgttggtggttaatgggg

SEQ ID NO: 59117 - DNA, 20 bp, synthetic construct
  misc_feature 1..20: note = CRISPR gRNA sequence
  source 1..20: mol_type = other DNA
gtggttaatggggaagggtt

SEQ ID NO: 59118 - DNA, 20 bp, synthetic construct
  misc_feature 1..20: note = CRISPR gRNA sequence
  source 1..20: mol_type = other DNA
ttaatggggaagggttgtga

SEQ ID NO: 59119 - DNA, 20 bp, synthetic construct
  misc_feature 1..20: note = CRISPR gRNA sequence
  source 1..20: mol_type = other DNA
tggcgttggttaatggggaa

SEQ ID NO: 59120 - DNA, 20 bp, synthetic construct
  misc_feature 1..20: note = CRISPR gRNA sequence
  source 1..20: mol_type = other DNA
gttggttaatggggaagggg

SEQ ID NO: 59121 - DNA, 20 bp, synthetic construct
  misc_feature 1..20: note = CRISPR gRNA sequence
  source 1..20: mol_type = other DNA
gttaatggggaagggggtga

SEQ ID NO: 59122 - DNA, 20 bp, synthetic construct
  misc_feature 1..20: note = CRISPR gRNA sequence
  source 1..20: mol_type = other DNA
ggtgatggtggttaatgggg

SEQ ID NO: 59123 - DNA, 20 bp, synthetic construct
  misc_feature 1..20: note = CRISPR gRNA sequence
  source 1..20: mol_type = other DNA
gtggttaatggggaagagtt

SEQ ID NO: 59124 - DNA, 20 bp, synthetic construct
  misc_feature 1..20: note = CRISPR gRNA sequence
  source 1..20: mol_type = other DNA
ttaatggggaagagttgtga

SEQ ID NO: 59125 - DNA, 20 bp, synthetic construct
  misc_feature 1..20: note = CRISPR gRNA sequence
  source 1..20: mol_type = other DNA
tgttggtggttaatggggaa

SEQ ID NO: 59126 - DNA, 20 bp, synthetic construct
  misc_feature 1..20: note = CRISPR gRNA sequence
  source 1..20: mol_type = other DNA
ggtggttaatggggaagggg

SEQ ID NO: 59127 - DNA, 20 bp, synthetic construct
  misc_feature 1..20: note = CRISPR gRNA sequence
  source 1..20: mol_type = other DNA
gttaatggggaagggggtga

SEQ ID NO: 59128 - DNA, 20 bp, synthetic construct
  misc_feature 1..20: note = CRISPR gRNA sequence
  source 1..20: mol_type = other DNA
ggaagggggtgagtgagtgg

SEQ ID NO: 59129 - DNA, 20 bp, synthetic construct
  misc_feature 1..20: note = CRISPR gRNA sequence
  source 1..20: mol_type = other DNA
ttggttaatggggaagtgtt

SEQ ID NO: 59130 - DNA, 20 bp, synthetic construct
  misc_feature 1..20: note = CRISPR gRNA sequence
  source 1..20: mol_type = other DNA
ttaatggggaagtgttgtga

SEQ ID NO: 59131 - DNA, 20 bp, synthetic construct
  misc_feature 1..20: note = CRISPR gRNA sequence
  source 1..20: mol_type = other DNA
ggtgatggtgattaatgggg

SEQ ID NO: 59132 - DNA, 20 bp, synthetic construct
  misc_feature 1..20: note = CRISPR gRNA sequence
  source 1..20: mol_type = other DNA
gtgattaatggggaagggtt

SEQ ID NO: 59133 - DNA, 20 bp, synthetic construct
  misc_feature 1..20: note = CRISPR gRNA sequence
  source 1..20: mol_type = other DNA
ttaatggggaagggttgtga

SEQ ID NO: 59134 - DNA, 20 bp, synthetic construct
  misc_feature 1..20: note = CRISPR gRNA sequence
  source 1..20: mol_type = other DNA
ggtggttaatggggaaggga

SEQ ID NO: 59135 - DNA, 20 bp, synthetic construct
  misc_feature 1..20: note = CRISPR gRNA sequence
  source 1..20: mol_type = other DNA
gttaatggggaagggaggga

SEQ ID NO: 59136 - DNA, 20 bp, synthetic construct
  misc_feature 1..20: note = CRISPR gRNA sequence
  source 1..20: mol_type = other DNA
gatgatggtggttaatgggg

SEQ ID NO: 59137 - DNA, 20 bp, synthetic construct
  misc_feature 1..20: note = CRISPR gRNA sequence
  source 1..20: mol_type = other DNA
gtggttaatggggaagggtt

SEQ ID NO: 59138 - DNA, 20 bp, synthetic construct
  misc_feature 1..20: note = CRISPR gRNA sequence
  source 1..20: mol_type = other DNA
ttaatggggaagggttgtga

SEQ ID NO: 59139 - DNA, 20 bp, synthetic construct
  misc_feature 1..20: note = CRISPR gRNA sequence
  source 1..20: mol_type = other DNA
gaagggttgtgagtgagttg

SEQ ID NO: 59140 - DNA, 20 bp, synthetic construct
  misc_feature 1..20: note = CRISPR gRNA sequence
  source 1..20: mol_type = other DNA
ttggttaatggggaagcgtt

SEQ ID NO: 59141 - DNA, 20 bp, synthetic construct
  misc_feature 1..20: note = CRISPR gRNA sequence
  source 1..20: mol_type = other DNA
ttaatggggaagcgttgtga

SEQ ID NO: 59142 - DNA, 20 bp, synthetic construct
  misc_feature 1..20: note = CRISPR gRNA sequence
  source 1..20: mol_type = other DNA
gtgatggttggttaatgggg

SEQ ID NO: 59143 - DNA, 20 bp, synthetic construct
  misc_feature 1..20: note = CRISPR gRNA sequence
  source 1..20: mol_type = other DNA
ttggttaatggggaagggtt

SEQ ID NO: 59144 - DNA, 20 bp, synthetic construct
  misc_feature 1..20: note = CRISPR gRNA sequence
  source 1..20: mol_type = other DNA
ttaatggggaagggttgtga

SEQ ID NO: 59145 - DNA, 20 bp, synthetic construct
  misc_feature 1..20: note = CRISPR gRNA sequence
  source 1..20: mol_type = other DNA
tgatggtggttaatggggaa

SEQ ID NO: 59146 - DNA, 20 bp, synthetic construct
  misc_feature 1..20: note = CRISPR gRNA sequence
  source 1..20: mol_type = other DNA
ggtggttaatggggaagggg

SEQ ID NO: 59147 - DNA, 20 bp, synthetic construct
  misc_feature 1..20: note = CRISPR gRNA sequence
  source 1..20: mol_type = other DNA
gttaatggggaagggggtga

SEQ ID NO: 59148 - DNA, 20 bp, synthetic construct
  misc_feature 1..20: note = CRISPR gRNA sequence
  source 1..20: mol_type = other DNA
gtggttaatggggaagtgtt

SEQ ID NO: 59149 - DNA, 20 bp, synthetic construct
  misc_feature 1..20: note = CRISPR gRNA sequence
  source 1..20: mol_type = other DNA
ttaatggggaagtgttgtga

SEQ ID NO: 59150 - DNA, 20 bp, synthetic construct
  misc_feature 1..20: note = CRISPR gRNA sequence
  source 1..20: mol_type = other DNA
ggtgatggtggttaatgggg

SEQ ID NO: 59151 - DNA, 20 bp, synthetic construct
  misc_feature 1..20: note = CRISPR gRNA sequence
  source 1..20: mol_type = other DNA
gtggttaatggggaagggtt

SEQ ID NO: 59152 - DNA, 20 bp, synthetic construct
  misc_feature 1..20: note = CRISPR gRNA sequence
  source 1..20: mol_type = other DNA
ttaatggggaagggttgtga

SEQ ID NO: 59153 - DNA, 20 bp, synthetic construct
  misc_feature 1..20: note = CRISPR gRNA sequence
  source 1..20: mol_type = other DNA
tgttggtggttaatggggaa

SEQ ID NO: 59154 - DNA, 20 bp, synthetic construct
  misc_feature 1..20: note = CRISPR gRNA sequence
  source 1..20: mol_type = other DNA
ggtggttaatggggaagggg

SEQ ID NO: 59155 - DNA, 20 bp, synthetic construct
  misc_feature 1..20: note = CRISPR gRNA sequence
  source 1..20: mol_type = other DNA
gatgatggtggttaatgggg

SEQ ID NO: 59156 - DNA, 20 bp, synthetic construct
  misc_feature 1..20: note = CRISPR gRNA sequence
  source 1..20: mol_type = other DNA
gtggttaatggggaagggtt

SEQ ID NO: 59157 - DNA, 20 bp, synthetic construct
  misc_feature 1..20: note = CRISPR gRNA sequence
  source 1..20: mol_type = other DNA
ttaatggggaagggttgtga

SEQ ID NO: 59158 - DNA, 20 bp, synthetic construct
  misc_feature 1..20: note = CRISPR gRNA sequence
  source 1..20: mol_type = other DNA
gaagggttgtgagtgagtgg

SEQ ID NO: 59159 - DNA, 20 bp, synthetic construct
  misc_feature 1..20: note = CRISPR gRNA sequence
  source 1..20: mol_type = other DNA
tggggttggttaacggggaa

SEQ ID NO: 59160 - DNA, 20 bp, synthetic construct
  misc_feature 1..20: note = CRISPR gRNA sequence
  source 1..20: mol_type = other DNA
gttggttaacggggaagggg

SEQ ID NO: 59161 - DNA, 20 bp, synthetic construct
  misc_feature 1..20: note = CRISPR gRNA sequence
  source 1..20: mol_type = other DNA
gttaacggggaagggggtga

SEQ ID NO: 59162 - DNA, 20 bp, synthetic construct
  misc_feature 1..20: note = CRISPR gRNA sequence
  source 1..20: mol_type = other DNA
tggtggtggttaatggggaa

SEQ ID NO: 59163 - DNA, 20 bp, synthetic construct
  misc_feature 1..20: note = CRISPR gRNA sequence
  source 1..20: mol_type = other DNA
ggtggttaatggggaagggg

SEQ ID NO: 59164 - DNA, 20 bp, synthetic construct
  misc_feature 1..20: note = CRISPR gRNA sequence
  source 1..20: mol_type = other DNA
gttaatggggaagggggtga

SEQ ID NO: 59165 - DNA, 20 bp, synthetic construct
  misc_feature 1..20: note = CRISPR gRNA sequence
  source 1..20: mol_type = other DNA
tgttggtggttaatggggaa

SEQ ID NO: 59166 - DNA, 20 bp, synthetic construct
  misc_feature 1..20: note = CRISPR gRNA sequence
  source 1..20: mol_type = other DNA
ggtggttaatggggaagggg

SEQ ID NO: 59167 - DNA, 20 bp, synthetic construct
  misc_feature 1..20: note = CRISPR gRNA sequence
  source 1..20: mol_type = other DNA
gttaatggggaagggggtgg

SEQ ID NO: 59168 - DNA, 20 bp, synthetic construct
  misc_feature 1..20: note = CRISPR gRNA sequence
  source 1..20: mol_type = other DNA
gtgatggtggttaatgggaa

SEQ ID NO: 59169 - DNA, 20 bp, synthetic construct
  misc_feature 1..20: note = CRISPR gRNA sequence
  source 1..20: mol_type = other DNA
tggtggttaatgggaaggga

SEQ ID NO: 59170 - DNA, 20 bp, synthetic construct
  misc_feature 1..20: note = CRISPR gRNA sequence
  source 1..20: mol_type = other DNA
ggtgatggtggttaatgggg

SEQ ID NO: 59171 - DNA, 20 bp, synthetic construct
  misc_feature 1..20: note = CRISPR gRNA sequence
  source 1..20: mol_type = other DNA
gtggttaatggggaagggtt

SEQ ID NO: 59172 - DNA, 20 bp, synthetic construct
  misc_feature 1..20: note = CRISPR gRNA sequence
  source 1..20: mol_type = other DNA
ttaatggggaagggttgtga

SEQ ID NO: 59173 - DNA, 20 bp, synthetic construct
  misc_feature 1..20: note = CRISPR gRNA sequence
  source 1..20: mol_type = other DNA
tgatggtggttaatggggaa

SEQ ID NO: 59174 - DNA, 20 bp, synthetic construct
  misc_feature 1..20: note = CRISPR gRNA sequence
  source 1..20: mol_type = other DNA
ggtggttaatggggaagggg

SEQ ID NO: 59175 - DNA, 20 bp, synthetic construct
  misc_feature 1..20: note = CRISPR gRNA sequence
  source 1..20: mol_type = other DNA
aatggggaagggggtgagta

SEQ ID NO: 59176 - DNA, 20 bp, synthetic construct
  misc_feature 1..20: note = CRISPR gRNA sequence
  source 1..20: mol_type = other DNA
gaagggggtgagtaaggggt

SEQ ID NO: 59177 - DNA, 20 bp, synthetic construct
  misc_feature 1..20: note = CRISPR gRNA sequence
  source 1..20: mol_type = other DNA
ggtgggggtggttaataggg

SEQ ID NO: 59178 - DNA, 20 bp, synthetic construct
  misc_feature 1..20: note = CRISPR gRNA sequence
  source 1..20: mol_type = other DNA
gtggttaatagggaagagtt

SEQ ID NO: 59179 - DNA, 20 bp, synthetic construct
  misc_feature 1..20: note = CRISPR gRNA sequence
  source 1..20: mol_type = other DNA
ttaatagggaagagttgtga

SEQ ID NO: 59180 - DNA, 20 bp, synthetic construct
  misc_feature 1..20: note = CRISPR gRNA sequence
  source 1..20: mol_type = other DNA
gaagagttgtgagtgagtgg

SEQ ID NO: 59181 - DNA, 20 bp, synthetic construct
  misc_feature 1..20: note = CRISPR gRNA sequence
  source 1..20: mol_type = other DNA
tggggttggttaatggggaa

SEQ ID NO: 59182 - DNA, 20 bp, synthetic construct
  misc_feature 1..20: note = CRISPR gRNA sequence
  source 1..20: mol_type = other DNA
gttggttaatggggaagggg

SEQ ID NO: 59183 - DNA, 20 bp, synthetic construct
  misc_feature 1..20: note = CRISPR gRNA sequence
  source 1..20: mol_type = other DNA
aatggggaagggggtgagtg

SEQ ID NO: 59184 - DNA, 20 bp, synthetic construct
  misc_feature 1..20: note = CRISPR gRNA sequence
  source 1..20: mol_type = other DNA
tgacagtggttaatggggaa

SEQ ID NO: 59185 - DNA, 20 bp, synthetic construct
  misc_feature 1..20: note = CRISPR gRNA sequence
  source 1..20: mol_type = other DNA
agtggttaatggggaaagga

SEQ ID NO: 59186 - DNA, 20 bp, synthetic construct
  misc_feature 1..20: note = CRISPR gRNA sequence
  source 1..20: mol_type = other DNA
aatggggaaaggagtgagtg

SEQ ID NO: 59187 - DNA, 20 bp, synthetic construct
  misc_feature 1..20: note = CRISPR gRNA sequence
  source 1..20: mol_type = other DNA
tgcttagtgctgcatggtca

SEQ ID NO: 59188 - DNA, 20 bp, synthetic construct
  misc_feature 1..20: note = CRISPR gRNA sequence
  source 1..20: mol_type = other DNA
gaacacaaaccgccatgttt

SEQ ID NO: 59189 - DNA, 20 bp, synthetic construct
  misc_feature 1..20: note = CRISPR gRNA sequence
  source 1..20: mol_type = other DNA
tctggatggacccaggtgag

SEQ ID NO: 59190 - DNA, 20 bp, synthetic construct
  misc_feature 1..20: note = CRISPR gRNA sequence
  source 1..20: mol_type = other DNA
atgaccttttactttctatt

SEQ ID NO: 59191 - DNA, 20 bp, synthetic construct
  misc_feature 1..20: note = CRISPR gRNA sequence
  source 1..20: mol_type = other DNA
agaaccttggtcataggaaa

SEQ ID NO: 59192 - DNA, 20 bp, synthetic construct
  misc_feature 1..20: note = CRISPR gRNA sequence
  source 1..20: mol_type = other DNA
gccaatgacttcaggcacag

SEQ ID NO: 59193 - DNA, 20 bp, synthetic construct
  misc_feature 1..20: note = CRISPR gRNA sequence
  source 1..20: mol_type = other DNA
cttcaggcacagctggatcc

SEQ ID NO: 59194 - DNA, 20 bp, synthetic construct
  misc_feature 1..20: note = CRISPR gRNA sequence
  source 1..20: mol_type = other DNA
ttctctcagcttagtggaaa

SEQ ID NO: 59195 - DNA, 20 bp, synthetic construct
  misc_feature 1..20: note = CRISPR gRNA sequence
  source 1..20: mol_type = other DNA
ttacaacaaaaggtcctaga

SEQ ID NO: 59196 - DNA, 20 bp, synthetic construct
  misc_feature 1..20: note = CRISPR gRNA sequence
  source 1..20: mol_type = other DNA
ctgagtctcactggactagc

SEQ ID NO: 59197 - DNA, 20 bp, synthetic construct
  misc_feature 1..20: note = CRISPR gRNA sequence
  source 1..20: mol_type = other DNA
accctatcttctggacttag

SEQ ID NO: 59198 - DNA, 20 bp, synthetic construct
  misc_feature 1..20: note = CRISPR gRNA sequence
  source 1..20: mol_type = other DNA
gacttagaggggtggtattt

SEQ ID NO: 59199 - DNA, 20 bp, synthetic construct
  misc_feature 1..20: note = CRISPR gRNA sequence
  source 1..20: mol_type = other DNA
gaggggtggtatttcaggat

SEQ ID NO: 59200 - DNA, 20 bp, synthetic construct
  misc_feature 1..20: note = CRISPR gRNA sequence
  source 1..20: mol_type = other DNA
tatctggacagaaaatttaa

SEQ ID NO: 59201 - DNA, 20 bp, synthetic construct
  misc_feature 1..20: note = CRISPR gRNA sequence
  source 1..20: mol_type = other DNA
caaataacatgaaatgcccc

SEQ ID NO: 59202 - DNA, 20 bp, synthetic construct
  misc_feature 1..20: note = CRISPR gRNA sequence
  source 1..20: mol_type = other DNA
aaacttctgttgaacggttt

SEQ ID NO: 59203 - DNA, 20 bp, synthetic construct
  misc_feature 1..20: note = CRISPR gRNA sequence
  source 1..20: mol_type = other DNA
tttttttttctacatatgtt

SEQ ID NO: 59204 - DNA, 20 bp, synthetic construct
  misc_feature 1..20: note = CRISPR gRNA sequence
  source 1..20: mol_type = other DNA
ctctttgcttgtcctgggga

SEQ ID NO: 59205 - DNA, 20 bp, synthetic construct
  misc_feature 1..20: note = CRISPR gRNA sequence
  source 1..20: mol_type = other DNA
ggatcaggtaaaaggagaag

SEQ ID NO: 59206 - DNA, 20 bp, synthetic construct
  misc_feature 1..20: note = CRISPR gRNA sequence
  source 1..20: mol_type = other DNA
cttctggaagcttttattta

SEQ ID NO: 59207 - DNA, 20 bp, synthetic construct
  misc_feature 1..20: note = CRISPR gRNA sequence
  source 1..20: mol_type = other DNA
atcttccctgtccgaaggaa

SEQ ID NO: 59208 - DNA, 20 bp, synthetic construct
  misc_feature 1..20: note = CRISPR gRNA sequence
  source 1..20: mol_type = other DNA
tccctgtccgaaggaagggg

SEQ ID NO: 59209 - DNA, 20 bp, synthetic construct
  misc_feature 1..20: note = CRISPR gRNA sequence
  source 1..20: mol_type = other DNA
ttccagctgtatacctgtga

SEQ ID NO: 59210 - DNA, 20 bp, synthetic construct
  misc_feature 1..20: note = CRISPR gRNA sequence
  source 1..20: mol_type = other DNA
agctgtatacctgtgatgga

SEQ ID NO: 59211 - DNA, 20 bp, synthetic construct
  misc_feature 1..20: note = CRISPR gRNA sequence
  source 1..20: mol_type = other DNA
ctagttaggagcctcactgc

SEQ ID NO: 59212 - DNA, 20 bp, synthetic construct
  misc_feature 1..20: note = CRISPR gRNA sequence
  source 1..20: mol_type = other DNA
ctcactgcctgggttcaact

SEQ ID NO: 59213 - DNA, 20 bp, synthetic construct
  misc_feature 1..20: note = CRISPR gRNA sequence
  source 1..20: mol_type = other DNA
tgcctgggttcaactctggg

SEQ ID NO: 59214 - DNA, 20 bp, synthetic construct
  misc_feature 1..20: note = CRISPR gRNA sequence
  source 1..20: mol_type = other DNA
tctctctccgttgcccaggc

SEQ ID NO: 59215 - DNA, 20 bp, synthetic construct
  misc_feature 1..20: note = CRISPR gRNA sequence
  source 1..20: mol_type = other DNA
ctcactgcaacctccgcctc

SEQ ID NO: 59216 - DNA, 20 bp, synthetic construct
  misc_feature 1..20: note = CRISPR gRNA sequence
  source 1..20: mol_type = other DNA
ttttctatttttagtggaga

SEQ ID NO: 59217 - DNA, 20 bp, synthetic construct
  misc_feature 1..20: note = CRISPR gRNA sequence
  source 1..20: mol_type = other DNA
gccttggcctcacaaagtcc

SEQ ID NO: 59218 - DNA, 20 bp, synthetic construct
  misc_feature 1..20: note = CRISPR gRNA sequence
  source 1..20: mol_type = other DNA
ggcctcctcatcttaacttt

SEQ ID NO: 59219 - DNA, 20 bp, synthetic construct
  misc_feature 1..20: note = CRISPR gRNA sequence
  source 1..20: mol_type = other DNA
tctcccctgctacggttgtt

SEQ ID NO: 59220 - DNA, 20 bp, synthetic construct
  misc_feature 1..20: note = CRISPR gRNA sequence
  source 1..20: mol_type = other DNA
gataatatgtgttacagtct

SEQ ID NO: 59221 - DNA, 20 bp, synthetic construct
  misc_feature 1..20: note = CRISPR gRNA sequence
  source 1..20: mol_type = other DNA
ttacagtcttagagtctggt

SEQ ID NO: 59222 - DNA, 20 bp, synthetic construct
  misc_feature 1..20: note = CRISPR gRNA sequence
  source 1..20: mol_type = other DNA
gcctctagaagtacaatcgc

SEQ ID NO: 59223 - DNA, 20 bp, synthetic construct
  misc_feature 1..20: note = CRISPR gRNA sequence
  source 1..20: mol_type = other DNA
gtcacatatggttggggctc

SEQ ID NO: 59224 - DNA, 20 bp, synthetic construct
  misc_feature 1..20: note = CRISPR gRNA sequence
  source 1..20: mol_type = other DNA
tatggttggggctcaggaat

SEQ ID NO: 59225 - DNA, 20 bp, synthetic construct
  misc_feature 1..20: note = CRISPR gRNA sequence
  source 1..20: mol_type = other DNA
tttccagatggccccaagcc

SEQ ID NO: 59226 - DNA, 20 bp, synthetic construct
  misc_feature 1..20: note = CRISPR gRNA sequence
  source 1..20: mol_type = other DNA
aatgtgtgaccgccattatt

SEQ ID NO: 59227 - DNA, 20 bp, synthetic construct
  misc_feature 1..20: note = CRISPR gRNA sequence
  source 1..20: mol_type = other DNA
tcccagtacagttcattttg

SEQ ID NO: 59228 - DNA, 20 bp, synthetic construct
  misc_feature 1..20: note = CRISPR gRNA sequence
  source 1..20: mol_type = other DNA
ttgtagaatttttacactgt

SEQ ID NO: 59229 - DNA, 20 bp, synthetic construct
  misc_feature 1..20: note = CRISPR gRNA sequence
  source 1..20: mol_type = other DNA
acctgcctgcagagcctcag

SEQ ID NO: 59230 - DNA, 20 bp, synthetic construct
  misc_feature 1..20: note = CRISPR gRNA sequence
  source 1..20: mol_type = other DNA
gagtgaccgagcggccccat

SEQ ID NO: 59231 - DNA, 20 bp, synthetic construct
  misc_feature 1..20: note = CRISPR gRNA sequence
  source 1..20: mol_type = other DNA
gaccgagcggccccatggga

SEQ ID NO: 59232 - DNA, 20 bp, synthetic construct
  misc_feature 1..20: note = CRISPR gRNA sequence
  source 1..20: mol_type = other DNA
agcactgaggccacctccca

SEQ ID NO: 59233 - DNA, 20 bp, synthetic construct
  misc_feature 1..20: note = CRISPR gRNA sequence
  source 1..20: mol_type = other DNA
cacctcccaggggatccttt

SEQ ID NO: 59234 - DNA, 20 bp, synthetic construct
  misc_feature 1..20: note = CRISPR gRNA sequence
  source 1..20: mol_type = other DNA
ccatccctgtgccctcccag

SEQ ID NO: 59235 - DNA, 20 bp, synthetic construct
  misc_feature 1..20: note = CRISPR gRNA sequence
  source 1..20: mol_type = other DNA
tcattctgattccccaggtc

SEQ ID NO: 59236 - DNA, 20 bp, synthetic construct
  misc_feature 1..20: note = CRISPR gRNA sequence
  source 1..20: mol_type = other DNA
tttttttttttttttttttt

SEQ ID NO: 59237 - DNA, 20 bp, synthetic construct
  misc_feature 1..20: note = CRISPR gRNA sequence
  source 1..20: mol_type = other DNA
cctcactgtgtggcccaggc

SEQ ID NO: 59238 - DNA, 20 bp, synthetic construct
  misc_feature 1..20: note = CRISPR gRNA sequence
  source 1..20: mol_type = other DNA
ttgtttgtttgtttttgaga

SEQ ID NO: 59239 - DNA, 20 bp, synthetic construct
  misc_feature 1..20: note = CRISPR gRNA sequence
  source 1..20: mol_type = other DNA
ttcgctcttgttgcccaggc

SEQ ID NO: 59240 - DNA, 20 bp, synthetic construct
  misc_feature 1..20: note = CRISPR gRNA sequence
  source 1..20: mol_type = other DNA
ctcactgcaacctccgcctc

SEQ ID NO: 59241 - DNA, 20 bp, synthetic construct
  misc_feature 1..20: note = CRISPR gRNA sequence
  source 1..20: mol_type = other DNA
gattctcctgcctcagcctc

SEQ ID NO: 59242 - DNA, 20 bp, synthetic construct
  misc_feature 1..20: note = CRISPR gRNA sequence
  source 1..20: mol_type = other DNA
gcctcagcctcccgagtagc

SEQ ID NO: 59243 - DNA, 20 bp, synthetic construct
  misc_feature 1..20: note = CRISPR gRNA sequence
  source 1..20: mol_type = other DNA
acctcggcctcccaaagtgc

SEQ ID NO: 59244 - DNA, 20 bp, synthetic construct
  misc_feature 1..20: note = CRISPR gRNA sequence
  source 1..20: mol_type = other DNA
ctgcattttctaacaagctt

SEQ ID NO: 59245 - DNA, 20 bp, synthetic construct
  misc_feature 1..20: note = CRISPR gRNA sequence
  source 1..20: mol_type = other DNA
tgggggccacggtcagcact

SEQ ID NO: 59246 - DNA, 20 bp, synthetic construct
  misc_feature 1..20: note = CRISPR gRNA sequence
  source 1..20: mol_type = other DNA
cggtcagcactttgagtagt

SEQ ID NO: 59247 - DNA, 20 bp, synthetic construct
  misc_feature 1..20: note = CRISPR gRNA sequence
  source 1..20: mol_type = other DNA
agtgtgggtctagactcaga

SEQ ID NO: 59248 - DNA, 20 bp, synthetic construct
  misc_feature 1..20: note = CRISPR gRNA sequence
  source 1..20: mol_type = other DNA
gtgatttcactccctgctgc

SEQ ID NO: 59249 - DNA, 20 bp, synthetic construct
  misc_feature 1..20: note = CRISPR gRNA sequence
  source 1..20: mol_type = other DNA
accccctacctcgggcagag

SEQ ID NO: 59250 - DNA, 20 bp, synthetic construct
  misc_feature 1..20: note = CRISPR gRNA sequence
  source 1..20: mol_type = other DNA
gtaggtaggaaatgaggtta

SEQ ID NO: 59251 - DNA, 20 bp, synthetic construct
  misc_feature 1..20: note = CRISPR gRNA sequence
  source 1..20: mol_type = other DNA
tctcactctgtcgcccaggc

SEQ ID NO: 59252 - DNA, 20 bp, synthetic construct
  misc_feature 1..20: note = CRISPR gRNA sequence
  source 1..20: mol_type = other DNA
ttcactgcaacctctgcctc

SEQ ID NO: 59253 - DNA, 20 bp, synthetic construct
  misc_feature 1..20: note = CRISPR gRNA sequence
  source 1..20: mol_type = other DNA
gcctcagccgcccaagtagc

SEQ ID NO: 59254 - DNA, 20 bp, synthetic construct
  misc_feature 1..20: note = CRISPR gRNA sequence
  source 1..20: mol_type = other DNA
ttgtatatttttagtacaaa

SEQ ID NO: 59255 - DNA, 20 bp, synthetic construct
  misc_feature 1..20: note = CRISPR gRNA sequence
  source 1..20: mol_type = other DNA
gcctagactccgaaagtgct

SEQ ID NO: 59256 - DNA, 20 bp, synthetic construct
  misc_feature 1..20: note = CRISPR gRNA sequence
  source 1..20: mol_type = other DNA
ggctcagtaaagacaatacc

SEQ ID NO: 59257 - DNA, 20 bp, synthetic construct
  misc_feature 1..20: note = CRISPR gRNA sequence
  source 1..20: mol_type = other DNA
aggaaaaacctaccatttgc

SEQ ID NO: 59258 - DNA, 20 bp, synthetic construct
  misc_feature 1..20: note = CRISPR gRNA sequence
  source 1..20: mol_type = other DNA
gcccctgagaactgatctgc

SEQ ID NO: 59259 - DNA, 20 bp, synthetic construct
  misc_feature 1..20: note = CRISPR gRNA sequence
  source 1..20: mol_type = other DNA
gaactgatctgcgtgaatca

SEQ ID NO: 59260 - DNA, 20 bp, synthetic construct
  misc_feature 1..20: note = CRISPR gRNA sequence
  source 1..20: mol_type = other DNA
ctcctcctgggccaggggct

SEQ ID NO: 59261 - DNA, 20 bp, synthetic construct
  misc_feature 1..20: note = CRISPR gRNA sequence
  source 1..20: mol_type = other DNA
agaagttttgctaccagcat

SEQ ID NO: 59262 - DNA, 20 bp, synthetic construct
  misc_feature 1..20: note = CRISPR gRNA sequence
  source 1..20: mol_type = other DNA
gtgtaaggctttgcaaactg

SEQ ID NO: 59263 - DNA, 20 bp, synthetic construct
  misc_feature 1..20: note = CRISPR gRNA sequence
  source 1..20: mol_type = other DNA
tgccaccagcctagaggagc

SEQ ID NO: 59264 - DNA, 20 bp, synthetic construct
  misc_feature 1..20: note = CRISPR gRNA sequence
  source 1..20: mol_type = other DNA
accagcctagaggagctgga

SEQ ID NO: 59265 - DNA, 20 bp, synthetic construct
  misc_feature 1..20: note = CRISPR gRNA sequence
  source 1..20: mol_type = other DNA
aagcttgggggacccaaaga

SEQ ID NO: 59266 - DNA, 20 bp, synthetic construct
  misc_feature 1..20: note = CRISPR gRNA sequence
  source 1..20: mol_type = other DNA
gggacccaaagacaggatgt

SEQ ID NO: 59267 - DNA, 20 bp, synthetic construct
  misc_feature 1..20: note = CRISPR gRNA sequence
  source 1..20: mol_type = other DNA
agagtgtcaattgtagcaag

SEQ ID NO: 59268 - DNA, 20 bp, synthetic construct
  misc_feature 1..20: note = CRISPR gRNA sequence
  source 1..20: mol_type = other DNA
gaacatcctaaacagaagcc

SEQ ID NO: 59269 - DNA, 20 bp, synthetic construct
  misc_feature 1..20: note = CRISPR gRNA sequence
  source 1..20: mol_type = other DNA
ttaggagctgtcactcaaca

SEQ ID NO: 59270 - DNA, 20 bp, synthetic construct
  misc_feature 1..20: note = CRISPR gRNA sequence
  source 1..20: mol_type = other DNA
ggggtgatggggctctctgt

SEQ ID NO: 59271 - DNA, 20 bp, synthetic construct
  misc_feature 1..20: note = CRISPR gRNA sequence
  source 1..20: mol_type = other DNA
cagcctccccttctttttct

SEQ ID NO: 59272 - DNA, 20 bp, synthetic construct
  misc_feature 1..20: note = CRISPR gRNA sequence
  source 1..20: mol_type = other DNA
tccccttctttttctgggag

SEQ ID NO: 59273 - DNA, 20 bp, synthetic construct
  misc_feature 1..20: note = CRISPR gRNA sequence
  source 1..20: mol_type = other DNA
gctgccagagctcaggaaga

SEQ ID NO: 59274 - DNA, 20 bp, synthetic construct
  misc_feature 1..20: note = CRISPR gRNA sequence
  source 1..20: mol_type = other DNA
ccagagctcaggaagataga

SEQ ID NO: 59275 - DNA, 20 bp, synthetic construct
  misc_feature 1..20: note = CRISPR gRNA sequence
  source 1..20: mol_type = other DNA
gccctacagaggagggccac

SEQ ID NO: 59276 - DNA, 20 bp, synthetic construct
  misc_feature 1..20: note = CRISPR gRNA sequence
  source 1..20: mol_type = other DNA
gggcctttctgcctcattgt

SEQ ID NO: 59277 - DNA, 20 bp, synthetic construct
  misc_feature 1..20: note = CRISPR gRNA sequence
  source 1..20: mol_type = other DNA
tgggtaggtgtgtggtgtcg

SEQ ID NO: 59278 - DNA, 20 bp, synthetic construct
  misc_feature 1..20: note = CRISPR gRNA sequence
  source 1..20: mol_type = other DNA
tctcttaggccccctgaagc

SEQ ID NO: 59279 - DNA, 20 bp, synthetic construct
  misc_feature 1..20: note = CRISPR gRNA sequence
  source 1..20: mol_type = other DNA
ggcagacccagcagatgtgc

SEQ ID NO: 59280 - DNA, 20 bp, synthetic construct
  misc_feature 1..20: note = CRISPR gRNA sequence
  source 1..20: mol_type = other DNA
ccccctcccacagcctctca

SEQ ID NO: 59281 - DNA, 20 bp, synthetic construct
  misc_feature 1..20: note = CRISPR gRNA sequence
  source 1..20: mol_type = other DNA
aatagcatcagctcagccgg

SEQ ID NO: 59282 - DNA, 20 bp, synthetic construct
  misc_feature 1..20: note = CRISPR gRNA sequence
  source 1..20: mol_type = other DNA
agccgggggagtgcagttgg

SEQ ID NO: 59283 - DNA, 20 bp, synthetic construct
  misc_feature 1..20: note = CRISPR gRNA sequence
  source 1..20: mol_type = other DNA
cgttctttgcaggcgcctgg

SEQ ID NO: 59284 - DNA, 20 bp, synthetic construct
  misc_feature 1..20: note = CRISPR gRNA sequence
  source 1..20: mol_type = other DNA
aggcgcctggaggagttgat

SEQ ID NO: 59285 - DNA, 20 bp, synthetic construct
  misc_feature 1..20: note = CRISPR gRNA sequence
  source 1..20: mol_type = other DNA
cagtgggcacagggcagggc

SEQ ID NO: 59286 - DNA, 20 bp, synthetic construct
  misc_feature 1..20: note = CRISPR gRNA sequence
  source 1..20: mol_type = other DNA
cacagggcagggcgggggtc

SEQ ID NO: 59287 - DNA, 20 bp, synthetic construct
  misc_feature 1..20: note = CRISPR gRNA sequence
  source 1..20: mol_type = other DNA
ggcttggctgcaatgccctg

SEQ ID NO: 59288 - DNA, 20 bp, synthetic construct
  misc_feature 1..20: note = CRISPR gRNA sequence
  source 1..20: mol_type = other DNA
caggagctgccccagcacct

SEQ ID NO: 59289 - DNA, 20 bp, synthetic construct
  misc_feature 1..20: note = CRISPR gRNA sequence
  source 1..20: mol_type = other DNA
cagcacctgagggtcctaca

SEQ ID NO: 59290 - DNA, 20 bp, synthetic construct
  misc_feature 1..20: note = CRISPR gRNA sequence
  source 1..20: mol_type = other DNA
catgcagggctggtggggag

SEQ ID NO: 59291 - DNA, 20 bp, synthetic construct
  misc_feature 1..20: note = CRISPR gRNA sequence
  source 1..20: mol_type = other DNA
agggtcctcgggagcagtgg

SEQ ID NO: 59292 - DNA, 20 bp, synthetic construct
  misc_feature 1..20: note = CRISPR gRNA sequence
  source 1..20: mol_type = other DNA
cagttcattgtgccctgtga

SEQ ID NO: 59293 - DNA, 20 bp, synthetic construct
  misc_feature 1..20: note = CRISPR gRNA sequence
  source 1..20: mol_type = other DNA
ctgtgagcgggtccctgagg

SEQ ID NO: 59294 - DNA, 20 bp, synthetic construct
  misc_feature 1..20: note = CRISPR gRNA sequence
  source 1..20: mol_type = other DNA
tgcagccccatggcagcccc

SEQ ID NO: 59295 - DNA, 20 bp, synthetic construct
  misc_feature 1..20: note = CRISPR gRNA sequence
  source 1..20: mol_type = other DNA
catggcagcccccagagtcc

SEQ ID NO: 59296 - DNA, 20 bp, synthetic construct
  misc_feature 1..20: note = CRISPR gRNA sequence
  source 1..20: mol_type = other DNA
tttttttttttttttttaga

SEQ ID NO: 59297 - DNA, 20 bp, synthetic construct
  misc_feature 1..20: note = CRISPR gRNA sequence
  source 1..20: mol_type = other DNA
tctctctctgtcacccaggc

SEQ ID NO: 59298 - DNA, 20 bp, synthetic construct
  misc_feature 1..20: note = CRISPR gRNA sequence
  source 1..20: mol_type = other DNA
ctcactgcaacctccacctc

SEQ ID NO: 59299 - DNA, 20 bp, synthetic construct
  misc_feature 1..20: note = CRISPR gRNA sequence
  source 1..20: mol_type = other DNA
aattcttgtgcctcagctac

SEQ ID NO: 59300 - DNA, 20 bp, synthetic construct
  misc_feature 1..20: note = CRISPR gRNA sequence
  source 1..20: mol_type = other DNA
gcctcagctaccagagtagc

SEQ ID NO: 59301 - DNA, 20 bp, synthetic construct
  misc_feature 1..20: note = CRISPR gRNA sequence
  source 1..20: mol_type = other DNA
acctcagcctccaaaagtgc

SEQ ID NO: 59302 - DNA, 20 bp, synthetic construct
  misc_feature 1..20: note = CRISPR gRNA sequence
  source 1..20: mol_type = other DNA
gtgctcccttttccaggcaa

SEQ ID NO: 59303 - DNA, 20 bp, synthetic construct
  misc_feature 1..20: note = CRISPR gRNA sequence
  source 1..20: mol_type = other DNA
tgaaggccaggagaggtgtg

SEQ ID NO: 59304 - DNA, 20 bp, synthetic construct
  misc_feature 1..20: note = CRISPR gRNA sequence
  source 1..20: mol_type = other DNA
atacacgaaggacccaggtg

SEQ ID NO: 59305 - DNA, 20 bp, synthetic construct
  misc_feature 1..20: note = CRISPR gRNA sequence
  source 1..20: mol_type = other DNA
aaggacccaggtgttgaatt

SEQ ID NO: 59306 - DNA, 20 bp, synthetic construct
  misc_feature 1..20: note = CRISPR gRNA sequence
  source 1..20: mol_type = other DNA
gggatctcagaccccaaagc

SEQ ID NO: 59307 - DNA, 20 bp, synthetic construct
  misc_feature 1..20: note = CRISPR gRNA sequence
  source 1..20: mol_type = other DNA
gatacctacccaggtcctgt

SEQ ID NO: 59308 - DNA, 20 bp, synthetic construct
  misc_feature 1..20: note = CRISPR gRNA sequence
  source 1..20: mol_type = other DNA
acccaggtcctgtgtggatg

SEQ ID NO: 59309 - DNA, 20 bp, synthetic construct
  misc_feature 1..20: note = CRISPR gRNA sequence
  source 1..20: mol_type = other DNA
ctgcagcctgagacaaggct

SEQ ID NO: 59310 - DNA, 20 bp, synthetic construct
  misc_feature 1..20: note = CRISPR gRNA sequence
  source 1..20: mol_type = other DNA
ccctgagcctggcccaggcc

SEQ ID NO: 59311 - DNA, 20 bp, synthetic construct
  misc_feature 1..20: note = CRISPR gRNA sequence
  source 1..20: mol_type = other DNA
gagcctggcccaggccctgg

SEQ ID NO: 59312 - DNA, 20 bp, synthetic construct
  misc_feature 1..20: note = CRISPR gRNA sequence
  source 1..20: mol_type = other DNA
aggcacggggacagtcctgg

SEQ ID NO: 59313 - DNA, 20 bp, synthetic construct
  misc_feature 1..20: note = CRISPR gRNA sequence
  source 1..20: mol_type = other DNA
ggacagtcctgggcgggtct

SEQ ID NO: 59314 - DNA, 20 bp, synthetic construct
  misc_feature 1..20: note = CRISPR gRNA sequence
  source 1..20: mol_type = other DNA
gcggaaaacaacctggctgg

SEQ ID NO: 59315 - DNA, 20 bp, synthetic construct
  misc_feature 1..20: note = CRISPR gRNA sequence
  source 1..20: mol_type = other DNA
gctcccgctgctcagacaga

SEQ ID NO: 59316 - DNA, 20 bp, synthetic construct
  misc_feature 1..20: note = CRISPR gRNA sequence
  source 1..20: mol_type = other DNA
tttgaagtgatagaagcccc

SEQ ID NO: 59317 - DNA, 20 bp, synthetic construct
  misc_feature 1..20: note = CRISPR gRNA sequence
  source 1..20: mol_type = other DNA
cctgccctggaagtaatctt

SEQ ID NO: 59318 - DNA, 20 bp, synthetic construct
  misc_feature 1..20: note = CRISPR gRNA sequence
  source 1..20: mol_type = other DNA
tgggaaaaggaaaagtcggg

SEQ ID NO: 59319 - DNA, 20 bp, synthetic construct
  misc_feature 1..20: note = CRISPR gRNA sequence
  source 1..20: mol_type = other DNA
gaaaagtcgggaggggtcgg

SEQ ID NO: 59320 - DNA, 20 bp, synthetic construct
  misc_feature 1..20: note = CRISPR gRNA sequence
  source 1..20: mol_type = other DNA
cacttgagctgcaggtaatg

SEQ ID NO: 59321 - DNA, 20 bp, synthetic construct
  misc_feature 1..20: note = CRISPR gRNA sequence
  source 1..20: mol_type = other DNA
accttccttttgggaggcaa

SEQ ID NO: 59322 - DNA, 20 bp, synthetic construct
  misc_feature 1..20: note = CRISPR gRNA sequence
  source 1..20: mol_type = other DNA
cttggctgtctcttagcaat

SEQ ID NO: 59323 - DNA, 20 bp, synthetic construct
  misc_feature 1..20: note = CRISPR gRNA sequence
  source 1..20: mol_type = other DNA
gggctttgcagtgctgcctc

SEQ ID NO: 59324 - DNA, 20 bp, synthetic construct
  misc_feature 1..20: note = CRISPR gRNA sequence
  source 1..20: mol_type = other DNA
gtgctgcctcatgagtaaac

SEQ ID NO: 59325 - DNA, 20 bp, synthetic construct
  misc_feature 1..20: note = CRISPR gRNA sequence
  source 1..20: mol_type = other DNA
ttcatctttaacacctaaca

SEQ ID NO: 59326 - DNA, 20 bp, synthetic construct
  misc_feature 1..20: note = CRISPR gRNA sequence
  source 1..20: mol_type = other DNA
gattctccctttttaaccaa

SEQ ID NO: 59327 - DNA, 20 bp, synthetic construct
  misc_feature 1..20: note = CRISPR gRNA sequence
  source 1..20: mol_type = other DNA
ttttgtaactaccttctata

SEQ ID NO: 59328 - DNA, 20 bp, synthetic construct
  misc_feature 1..20: note = CRISPR gRNA sequence
  source 1..20: mol_type = other DNA
ttttttttttttttttgaga

SEQ ID NO: 59329 - DNA, 20 bp, synthetic construct
  misc_feature 1..20: note = CRISPR gRNA sequence
  source 1..20: mol_type = other DNA
tctccctctgttacccaggc

SEQ ID NO: 59330 - DNA, 20 bp, synthetic construct
  misc_feature 1..20: note = CRISPR gRNA sequence
  source 1..20: mol_type = other DNA
ctcactgcaacctccacctg

SEQ ID NO: 59331 - DNA, 20 bp, synthetic construct
  misc_feature 1..20: note = CRISPR gRNA sequence
  source 1..20: mol_type = other DNA
gattctcctgcctcagcctc

SEQ ID NO: 59332 - DNA, 20 bp, synthetic construct
  misc_feature 1..20: note = CRISPR gRNA sequence
  source 1..20: mol_type = other DNA
gcctcagcctcctgagtagc

SEQ ID NO: 59333 - DNA, 20 bp, synthetic construct
  misc_feature 1..20: note = CRISPR gRNA sequence
  source 1..20: mol_type = other DNA
ttttgtatttttagtagaga

SEQ ID NO: 59334 - DNA, 20 bp, synthetic construct
  misc_feature 1..20: note = CRISPR gRNA sequence
  source 1..20: mol_type = other DNA
accttggcctcccaaagtgc

SEQ ID NO: 59335 - DNA, 20 bp, synthetic construct
  misc_feature 1..20: note = CRISPR gRNA sequence
  source 1..20: mol_type = other DNA
ccctaccctgcaggctgtcc

SEQ ID NO: 59336 - DNA, 20 bp, synthetic construct
  misc_feature 1..20: note = CRISPR gRNA sequence
  source 1..20: mol_type = other DNA
ggctgtcctggaatctcctc

SEQ ID NO: 59337 - DNA, 20 bp, synthetic construct
  misc_feature 1..20: note = CRISPR gRNA sequence
  source 1..20: mol_type = other DNA
ccgcagatgggccggctgaa

SEQ ID NO: 59338 - DNA, 20 bp, synthetic construct
  misc_feature 1..20: note = CRISPR gRNA sequence
  source 1..20: mol_type = other DNA
gatgggccggctgaagagag

SEQ ID NO: 59339 - DNA, 20 bp, synthetic construct
  misc_feature 1..20: note = CRISPR gRNA sequence
  source 1..20: mol_type = other DNA
ggagtatgaggggccggggg

SEQ ID NO: 59340 - DNA, 20 bp, synthetic construct
  misc_feature 1..20: note = CRISPR gRNA sequence
  source 1..20: mol_type = other DNA
ccgggaacaccaagaggcca

SEQ ID NO: 59341 - DNA, 20 bp, synthetic construct
  misc_feature 1..20: note = CRISPR gRNA sequence
  source 1..20: mol_type = other DNA
gcctcccagaaagcccttcc

SEQ ID NO: 59342 - DNA, 20 bp, synthetic construct
  misc_feature 1..20: note = CRISPR gRNA sequence
  source 1..20: mol_type = other DNA
cctgccaggcttagttcccc

SEQ ID NO: 59343 - DNA, 20 bp, synthetic construct
  misc_feature 1..20: note = CRISPR gRNA sequence
  source 1..20: mol_type = other DNA
caccagtcccctgttgtctt

SEQ ID NO: 59344 - DNA, 20 bp, synthetic construct
  misc_feature 1..20: note = CRISPR gRNA sequence
  source 1..20: mol_type = other DNA
gtccactgagaagcctggag

SEQ ID NO: 59345 - DNA, 20 bp, synthetic construct
  misc_feature 1..20: note = CRISPR gRNA sequence
  source 1..20: mol_type = other DNA
cctggctgaaggactggccc

SEQ ID NO: 59346 - DNA, 20 bp, synthetic construct
  misc_feature 1..20: note = CRISPR gRNA sequence
  source 1..20: mol_type = other DNA
taacagaggcctgcaggggc

SEQ ID NO: 59347 - DNA, 20 bp, synthetic construct
  misc_feature 1..20: note = CRISPR gRNA sequence
  source 1..20: mol_type = other DNA
ggcctgcaggggcagggatg

SEQ ID NO: 59348 - DNA, 20 bp, synthetic construct
  misc_feature 1..20: note = CRISPR gRNA sequence
  source 1..20: mol_type = other DNA
gaggcggcagggcctgggct

SEQ ID NO: 59349 - DNA, 20 bp, synthetic construct
  misc_feature 1..20: note = CRISPR gRNA sequence
  source 1..20: mol_type = other DNA
gagacttggaccactccacc

SEQ ID NO: 59350 - DNA, 20 bp, synthetic construct
  misc_feature 1..20: note = CRISPR gRNA sequence
  source 1..20: mol_type = other DNA
gaatttggcagcaagcagac

SEQ ID NO: 59351 - DNA, 20 bp, synthetic construct
  misc_feature 1..20: note = CRISPR gRNA sequence
  source 1..20: mol_type = other DNA
aattttctcatctgtgaaat

SEQ ID NO: 59352 - DNA, 20 bp, synthetic construct
  misc_feature 1..20: note = CRISPR gRNA sequence
  source 1..20: mol_type = other DNA
tactgatagtatctacctca

SEQ ID NO: 59353 - DNA, 20 bp, synthetic construct
  misc_feature 1..20: note = CRISPR gRNA sequence
  source 1..20: mol_type = other DNA
ctgctagatttctagcagat

SEQ ID NO: 59354 - DNA, 20 bp, synthetic construct
  misc_feature 1..20: note = CRISPR gRNA sequence
  source 1..20: mol_type = other DNA
agtaaaacatcttgaagaaa

SEQ ID NO: 59355 - DNA, 20 bp, synthetic construct
  misc_feature 1..20: note = CRISPR gRNA sequence
  source 1..20: mol_type = other DNA
tatttgcacaaatgtgtcat

SEQ ID NO: 59356 - DNA, 20 bp, synthetic construct
  misc_feature 1..20: note = CRISPR gRNA sequence
  source 1..20: mol_type = other DNA
ctatctcccagggaggaagg

SEQ ID NO: 59357 - DNA, 20 bp, synthetic construct
  misc_feature 1..20: note = CRISPR gRNA sequence
  source 1..20: mol_type = other DNA
gaggactcaggaggcaggtg

SEQ ID NO: 59358 - DNA, 20 bp, synthetic construct
  misc_feature 1..20: note = CRISPR gRNA sequence
  source 1..20: mol_type = other DNA
acgacagatggcaaagatgg

SEQ ID NO: 59359 - DNA, 20 bp, synthetic construct
  misc_feature 1..20: note = CRISPR gRNA sequence
  source 1..20: mol_type = other DNA
cagatggcaaagatgggagg

SEQ ID NO: 59360 - DNA, 20 bp, synthetic construct
  misc_feature 1..20: note = CRISPR gRNA sequence
  source 1..20: mol_type = other DNA
tggcaaagatgggaggatga

SEQ ID NO: 59361 - DNA, 20 bp, synthetic construct
  misc_feature 1..20: note = CRISPR gRNA sequence
  source 1..20: mol_type = other DNA
tatctgtgccccacagcctc

SEQ ID NO: 59362 - DNA, 20 bp, synthetic construct
  misc_feature 1..20: note = CRISPR gRNA sequence
  source 1..20: mol_type = other DNA
acaaccagccccaggcccct

SEQ ID NO: 59363 - DNA, 20 bp, synthetic construct
  misc_feature 1..20: note = CRISPR gRNA sequence
  source 1..20: mol_type = other DNA
gatggccccctcaagacctt

SEQ ID NO: 59364 - DNA, 20 bp, synthetic construct
  misc_feature 1..20: note = CRISPR gRNA sequence
  source 1..20: mol_type = other DNA
atgatccacctttcgcccac

SEQ ID NO: 59365 - DNA, 20 bp, synthetic construct
  misc_feature 1..20: note = CRISPR gRNA sequence
  source 1..20: mol_type = other DNA
tctgcactccacccaggagg

SEQ ID NO: 59366 - DNA, 20 bp, synthetic construct
  misc_feature 1..20: note = CRISPR gRNA sequence
  source 1..20: mol_type = other DNA
acttttttgggaaccaggag

SEQ ID NO: 59367 - DNA, 20 bp, synthetic construct
  misc_feature 1..20: note = CRISPR gRNA sequence
  source 1..20: mol_type = other DNA
caggagctgggtctggacaa

SEQ ID NO: 59368 - DNA, 20 bp, synthetic construct
  misc_feature 1..20: note = CRISPR gRNA sequence
  source 1..20: mol_type = other DNA
aaggagtaccctgcattacg

SEQ ID NO: 59369 - DNA, 20 bp, synthetic construct
  misc_feature 1..20: note = CRISPR gRNA sequence
  source 1..20: mol_type = other DNA
ggggacatgcgacacacaat

SEQ ID NO: 59370 - DNA, 20 bp, synthetic construct
  misc_feature 1..20: note = CRISPR gRNA sequence
  source 1..20: mol_type = other DNA
tgtggcacgtgttctgtggc

SEQ ID NO: 59371 - DNA, 20 bp, synthetic construct
  misc_feature 1..20: note = CRISPR gRNA sequence
  source 1..20: mol_type = other DNA
ggtgctggcatcccaagtag

SEQ ID NO: 59372 - DNA, 20 bp, synthetic construct
  misc_feature 1..20: note = CRISPR gRNA sequence
  source 1..20: mol_type = other DNA
ttccgcccgagctgggaggg

SEQ ID NO: 59373 - DNA, 20 bp, synthetic construct
  misc_feature 1..20: note = CRISPR gRNA sequence
  source 1..20: mol_type = other DNA
ggaggtagggccagcctggc

SEQ ID NO: 59374 - DNA, 20 bp, synthetic construct
  misc_feature 1..20: note = CRISPR gRNA sequence
  source 1..20: mol_type = other DNA
caaagccaggtctaatggta

SEQ ID NO: 59375 - DNA, 20 bp, synthetic construct
  misc_feature 1..20: note = CRISPR gRNA sequence
  source 1..20: mol_type = other DNA
caagacaataagctaggcta

SEQ ID NO: 59376 - DNA, 20 bp, synthetic construct
  misc_feature 1..20: note = CRISPR gRNA sequence
  source 1..20: mol_type = other DNA
gggtccagctactactttgg

SEQ ID NO: 59377 - DNA, 20 bp, synthetic construct
  misc_feature 1..20: note = CRISPR gRNA sequence
  source 1..20: mol_type = other DNA
actactttggtgggattcag

SEQ ID NO: 59378 - DNA, 20 bp, synthetic construct
  misc_feature 1..20: note = CRISPR gRNA sequence
  source 1..20: mol_type = other DNA
tgttacttccaaggagaacc

SEQ ID NO: 59379 - DNA, 20 bp, synthetic construct
  misc_feature 1..20: note = CRISPR gRNA sequence
  source 1..20: mol_type = other DNA
aatggtattccacgtctagc

SEQ ID NO: 59380 - DNA, 20 bp, synthetic construct
  misc_feature 1..20: note = CRISPR gRNA sequence
  source 1..20: mol_type = other DNA
gctgtccagtccttacggca

SEQ ID NO: 59381 - DNA, 20 bp, synthetic construct
  misc_feature 1..20: note = CRISPR gRNA sequence
  source 1..20: mol_type = other DNA
tgaaccacctctgacttcag

SEQ ID NO: 59382 - DNA, 20 bp, synthetic construct
  misc_feature 1..20: note = CRISPR gRNA sequence
  source 1..20: mol_type = other DNA
cagtggggtaagaggaaaca

SEQ ID NO: 59383 - DNA, 20 bp, synthetic construct
  misc_feature 1..20: note = CRISPR gRNA sequence
  source 1..20: mol_type = other DNA
cattggattcacgctagacg

SEQ ID NO: 59384 - DNA, 20 bp, synthetic construct
  misc_feature 1..20: note = CRISPR gRNA sequence
  source 1..20: mol_type = other DNA
tttattgatcaagcctggct

SEQ ID NO: 59385 - DNA, 20 bp, synthetic construct
  misc_feature 1..20: note = CRISPR gRNA sequence
  source 1..20: mol_type = other DNA
ccttggaagtaacaagaaca

SEQ ID NO: 59386 - DNA, 20 bp, synthetic construct
  misc_feature 1..20: note = CRISPR gRNA sequence
  source 1..20: mol_type = other DNA
tgaagtgcatggagactcac

SEQ ID NO: 59387 - DNA, 20 bp, synthetic construct
  misc_feature 1..20: note = CRISPR gRNA sequence
  source 1..20: mol_type = other DNA
agctagtatgtaagtaaggg

SEQ ID NO: 59388 - DNA, 20 bp, synthetic construct
  misc_feature 1..20: note = CRISPR gRNA sequence
  source 1..20: mol_type = other DNA
aggagtcatcaagtttatag

SEQ ID NO: 59389 - DNA, 20 bp, synthetic construct
  misc_feature 1..20: note = CRISPR gRNA sequence
  source 1..20: mol_type = other DNA
agtttatagatgggtaggct

SEQ ID NO: 59390 - DNA, 20 bp, synthetic construct
  misc_feature 1..20: note = CRISPR gRNA sequence
  source 1..20: mol_type = other DNA
ggcaggaggggacttaatgg

SEQ ID NO: 59391 - DNA, 20 bp, synthetic construct
  misc_feature 1..20: note = CRISPR gRNA sequence
  source 1..20: mol_type = other DNA
ctgaggtcatctggccagcc

SEQ ID NO: 59392 - DNA, 20 bp, synthetic construct
  misc_feature 1..20: note = CRISPR gRNA sequence
  source 1..20: mol_type = other DNA
caatcatgtatcctgctact

SEQ ID NO: 59393 - DNA, 20 bp, synthetic construct
  misc_feature 1..20: note = CRISPR gRNA sequence
  source 1..20: mol_type = other DNA
tcatgtaacgccacatgtca

SEQ ID NO: 59394 - DNA, 20 bp, synthetic construct
  misc_feature 1..20: note = CRISPR gRNA sequence
  source 1..20: mol_type = other DNA
cacacatatcccacgtaatg

SEQ ID NO: 59395 - DNA, 20 bp, synthetic construct
  misc_feature 1..20: note = CRISPR gRNA sequence
  source 1..20: mol_type = other DNA
ggacacacgtatccttcctc

SEQ ID NO: 59396 - DNA, 20 bp, synthetic construct
  misc_feature 1..20: note = CRISPR gRNA sequence
  source 1..20: mol_type = other DNA
cacgtatccttcctcctggg

SEQ ID NO: 59397 - DNA, 20 bp, synthetic construct
  misc_feature 1..20: note = CRISPR gRNA sequence
  source 1..20: mol_type = other DNA
cctgccgaggctcttctttc

SEQ ID NO: 59398 - DNA, 20 bp, synthetic construct
  misc_feature 1..20: note = CRISPR gRNA sequence
  source 1..20: mol_type = other DNA
attatcccagtgggcgaaag

SEQ ID NO: 59399 - DNA, 20 bp, synthetic construct
  misc_feature 1..20: note = CRISPR gRNA sequence
  source 1..20: mol_type = other DNA
gtgggcgaaaggtggatcat

SEQ ID NO: 59400 - DNA, 20 bp, synthetic construct
  misc_feature 1..20: note = CRISPR gRNA sequence
  source 1..20: mol_type = other DNA
catttgggtgcatcacttgg

SEQ ID NO: 59401 - DNA, 20 bp, synthetic construct
  misc_feature 1..20: note = CRISPR gRNA sequence
  source 1..20: mol_type = other DNA
aggtgctgggccatgtcgca

SEQ ID NO: 59402 - DNA, 20 bp, synthetic construct
  misc_feature 1..20: note = CRISPR gRNA sequence
  source 1..20: mol_type = other DNA
ctgggccatgtcgcagggaa

SEQ ID NO: 59403 - DNA, 20 bp, synthetic construct
  misc_feature 1..20: note = CRISPR gRNA sequence
  source 1..20: mol_type = other DNA
caaaaaggtagagctgtgcc

SEQ ID NO: 59404 - DNA, 20 bp, synthetic construct
  misc_feature 1..20: note = CRISPR gRNA sequence
  source 1..20: mol_type = other DNA
cagcatagctgacctaggga

SEQ ID NO: 59405 - DNA, 20 bp, synthetic construct
  misc_feature 1..20: note = CRISPR gRNA sequence
  source 1..20: mol_type = other DNA
gtgtaccccacacctgcctc

SEQ ID NO: 59406 - DNA, 20 bp, synthetic construct
  misc_feature 1..20: note = CRISPR gRNA sequence
  source 1..20: mol_type = other DNA
aaatctagcaggttgacaat

SEQ ID NO: 59407 - DNA, 20 bp, synthetic construct
  misc_feature 1..20: note = CRISPR gRNA sequence
  source 1..20: mol_type = other DNA
tgcttactatgtgccaggca

SEQ ID NO: 59408 - DNA, 20 bp, synthetic construct
  misc_feature 1..20: note = CRISPR gRNA sequence
  source 1..20: mol_type = other DNA
catttcacagatgagaaaat

SEQ ID NO: 59409 - DNA, 20 bp, synthetic construct
  misc_feature 1..20: note = CRISPR gRNA sequence
  source 1..20: mol_type = other DNA
aaaattggggttcagagagg

SEQ ID NO: 59410 - DNA, 20 bp, synthetic construct
  misc_feature 1..20: note = CRISPR gRNA sequence
  source 1..20: mol_type = other DNA
cagttggcaagtggcagagc

SEQ ID NO: 59411 - DNA, 20 bp, synthetic construct
  misc_feature 1..20: note = CRISPR gRNA sequence
  source 1..20: mol_type = other DNA
gcttgctgccaaattcttgg

SEQ ID NO: 59412 - DNA, 20 bp, synthetic construct
  misc_feature 1..20: note = CRISPR gRNA sequence
  source 1..20: mol_type = other DNA
aggccctgccgcctcctcca

SEQ ID NO: 59413 - DNA, 20 bp, synthetic construct
  misc_feature 1..20: note = CRISPR gRNA sequence
  source 1..20: mol_type = other DNA
cagggagtcccattagatct

SEQ ID NO: 59414 - DNA, 20 bp, synthetic construct
  misc_feature 1..20: note = CRISPR gRNA sequence
  source 1..20: mol_type = other DNA
gcccctgcaggcctctgtta

SEQ ID NO: 59415 - DNA, 20 bp, synthetic construct
  misc_feature 1..20: note = CRISPR gRNA sequence
  source 1..20: mol_type = other DNA
ggcctctgttaccggatgac

SEQ ID NO: 59416 - DNA, 20 bp, synthetic construct
  misc_feature 1..20: note = CRISPR gRNA sequence
  source 1..20: mol_type = other DNA
ggaaagagaaacacggccat

SEQ ID NO: 59417 - DNA, 20 bp, synthetic construct
  misc_feature 1..20: note = CRISPR gRNA sequence
  source 1..20: mol_type = other DNA
agagaaacacggccatgaga

SEQ ID NO: 59418 - DNA, 20 bp, synthetic construct
  misc_feature 1..20: note = CRISPR gRNA sequence
  source 1..20: mol_type = other DNA
acggccatgagaatgggtgt

SEQ ID NO: 59419 - DNA, 20 bp, synthetic construct
  misc_feature 1..20: note = CRISPR gRNA sequence
  source 1..20: mol_type = other DNA
ggcaggggcttggaacaggc

SEQ ID NO: 59420 - DNA, 20 bp, synthetic construct
  misc_feature 1..20: note = CRISPR gRNA sequence
  source 1..20: mol_type = other DNA
cagtggcctcttggtgttcc

SEQ ID NO: 59421 - DNA, 20 bp, synthetic construct
  misc_feature 1..20: note = CRISPR gRNA sequence
  source 1..20: mol_type = other DNA
ggagattccaggacagcctg

SEQ ID NO: 59422 - DNA, 20 bp, synthetic construct
  misc_feature 1..20: note = CRISPR gRNA sequence
  source 1..20: mol_type = other DNA
tccaggacagcctgcagggt

SEQ ID NO: 59423 - DNA, 20 bp, synthetic construct
  misc_feature 1..20: note = CRISPR gRNA sequence
  source 1..20: mol_type = other DNA
gcaggagagcaaggaggtcg

SEQ ID NO: 59424 - DNA, 20 bp, synthetic construct
  misc_feature 1..20: note = CRISPR gRNA sequence
  source 1..20: mol_type = other DNA
cgaggggtggagacaaggca

SEQ ID NO: 59425 - DNA, 20 bp, synthetic construct
  misc_feature 1..20: note = CRISPR gRNA sequence
  source 1..20: mol_type = other DNA
aaggcagtgaatggggaaag

SEQ ID NO: 59426 - DNA, 20 bp, synthetic construct
  misc_feature 1..20: note = CRISPR gRNA sequence
  source 1..20: mol_type = other DNA
agggtgccagtcgtgggggc

SEQ ID NO: 59427 - DNA, 20 bp, synthetic construct
  misc_feature 1..20: note = CRISPR gRNA sequence
  source 1..20: mol_type = other DNA
tttcaagagaggccacctga

SEQ ID NO: 59428 - DNA, 20 bp, synthetic construct
  misc_feature 1..20: note = CRISPR gRNA sequence
  source 1..20: mol_type = other DNA
gtgtcctcccctgaagacgt

SEQ ID NO: 59429 - DNA, 20 bp, synthetic construct
  misc_feature 1..20: note = CRISPR gRNA sequence
  source 1..20: mol_type = other DNA
tgctcccctccccgtcaagt

SEQ ID NO: 59430 - DNA, 20 bp, synthetic construct
  misc_feature 1..20: note = CRISPR gRNA sequence
  source 1..20: mol_type = other DNA
actaaaaatacaaaaattag

SEQ ID NO: 59431 - DNA, 20 bp, synthetic construct
  misc_feature 1..20: note = CRISPR gRNA sequence
  source 1..20: mol_type = other DNA
tactcaggaggctgaggcag

SEQ ID NO: 59432 - DNA, 20 bp, synthetic construct
  misc_feature 1..20: note = CRISPR gRNA sequence
  source 1..20: mol_type = other DNA
ttgcaccactgcactccagc

SEQ ID NO: 59433 - DNA, 20 bp, synthetic construct
  misc_feature 1..20: note = CRISPR gRNA sequence
  source 1..20: mol_type = other DNA
catatgcccttcctaagatg

SEQ ID NO: 59434 - DNA, 20 bp, synthetic construct
  misc_feature 1..20: note = CRISPR gRNA sequence
  source 1..20: mol_type = other DNA
aacccttttggttaaaaagg

SEQ ID NO: 59435 - DNA, 20 bp, synthetic construct
  misc_feature 1..20: note = CRISPR gRNA sequence
  source 1..20: mol_type = other DNA
tccagtgttaggtgttaaag

SEQ ID NO: 59436 - DNA, 20 bp, synthetic construct
  misc_feature 1..20: note = CRISPR gRNA sequence
  source 1..20: mol_type = other DNA
tttcgctttggtgtaatgag

SEQ ID NO: 59437 - DNA, 20 bp, synthetic construct
  misc_feature 1..20: note = CRISPR gRNA sequence
  source 1..20: mol_type = other DNA
atgagaagggttaagacctt

SEQ ID NO: 59438 - DNA, 20 bp, synthetic construct
  misc_feature 1..20: note = CRISPR gRNA sequence
  source 1..20: mol_type = other DNA
tttgtcctccataccatggt

SEQ ID NO: 59439 - DNA, 20 bp, synthetic construct
  misc_feature 1..20: note = CRISPR gRNA sequence
  source 1..20: mol_type = other DNA
ttagggtcccaggctagtcc

SEQ ID NO: 59440 - DNA, 20 bp, synthetic construct
  misc_feature 1..20: note = CRISPR gRNA sequence
  source 1..20: mol_type = other DNA
ctgcaaagccccaaggtctg

SEQ ID NO: 59441 - DNA, 20 bp, synthetic construct
  misc_feature 1..20: note = CRISPR gRNA sequence
  source 1..20: mol_type = other DNA
cacggccagccagcaggtct

SEQ ID NO: 59442 - DNA, 20 bp, synthetic construct
  misc_feature 1..20: note = CRISPR gRNA sequence
  source 1..20: mol_type = other DNA
aagtgttaaaatgtctttga

SEQ ID NO: 59443 - DNA, 20 bp, synthetic construct
  misc_feature 1..20: note = CRISPR gRNA sequence
  source 1..20: mol_type = other DNA
aaatgtctttgagaggatgt

SEQ ID NO: 59444 - DNA, 20 bp, synthetic construct
  misc_feature 1..20: note = CRISPR gRNA sequence
  source 1..20: mol_type = other DNA
ctttgagaggatgtctgagt

SEQ ID NO: 59445 - DNA, 20 bp, synthetic construct
  misc_feature 1..20: note = CRISPR gRNA sequence
  source 1..20: mol_type = other DNA
aaatgggaggactggccaga

SEQ ID NO: 59446 - DNA, 20 bp, synthetic construct
  misc_feature 1..20: note = CRISPR gRNA sequence
  source 1..20: mol_type = other DNA
atcttacaggaaaccaggct

SEQ ID NO: 59447 - DNA, 20 bp, synthetic construct
  misc_feature 1..20: note = CRISPR gRNA sequence
  source 1..20: mol_type = other DNA
gctggggatggagaagggca

SEQ ID NO: 59448 - DNA, 20 bp, synthetic construct
  misc_feature 1..20: note = CRISPR gRNA sequence
  source 1..20: mol_type = other DNA
ggatggagaagggcatggga

SEQ ID NO: 59449 - DNA, 20 bp, synthetic construct
  misc_feature 1..20: note = CRISPR gRNA sequence
  source 1..20: mol_type = other DNA
agaagggcatgggatgggat

SEQ ID NO: 59450 - DNA, 20 bp, synthetic construct
  misc_feature 1..20: note = CRISPR gRNA sequence
  source 1..20: mol_type = other DNA
tgggatgggatgggggttgt

SEQ ID NO: 59451 - DNA, 20 bp, synthetic construct
  misc_feature 1..20: note = CRISPR gRNA sequence
  source 1..20: mol_type = other DNA
gatgggggttgtttgagtca

SEQ ID NO: 59452 - DNA, 20 bp, synthetic construct
  misc_feature 1..20: note = CRISPR gRNA sequence
  source 1..20: mol_type = other DNA
ggtcctgcctccagagccac

SEQ ID NO: 59453 - DNA, 20 bp, synthetic construct
  misc_feature 1..20: note = CRISPR gRNA sequence
  source 1..20: mol_type = other DNA
cctccagagccaccagggtc

SEQ ID NO: 59454 - DNA, 20 bp, synthetic construct
  misc_feature 1..20: note = CRISPR gRNA sequence
  source 1..20: mol_type = other DNA
ggttgttttccgccaagctg

SEQ ID NO: 59455 - DNA, 20 bp, synthetic construct
  misc_feature 1..20: note = CRISPR gRNA sequence
  source 1..20: mol_type = other DNA
acctgatctcttccaaatgg

SEQ ID NO: 59456 - DNA, 20 bp, synthetic construct
  misc_feature 1..20: note = CRISPR gRNA sequence
  source 1..20: mol_type = other DNA
ccccacctgggcccagatgg

SEQ ID NO: 59457 - DNA, 20 bp, synthetic construct
  misc_feature 1..20: note = CRISPR gRNA sequence
  source 1..20: mol_type = other DNA
ggtaggctggggaaagagga

SEQ ID NO: 59458 - DNA, 20 bp, synthetic construct
  misc_feature 1..20: note = CRISPR gRNA sequence
  source 1..20: mol_type = other DNA
attccccatccacacaggac

SEQ ID NO: 59459 - DNA, 20 bp, synthetic construct
  misc_feature 1..20: note = CRISPR gRNA sequence
  source 1..20: mol_type = other DNA
ggtatcaaggaccctggctt

SEQ ID NO: 59460 - DNA, 20 bp, synthetic construct
  misc_feature 1..20: note = CRISPR gRNA sequence
  source 1..20: mol_type = other DNA
tgagatcccaaattcaacac

SEQ ID NO: 59461 - DNA, 20 bp, synthetic construct
  misc_feature 1..20: note = CRISPR gRNA sequence
  source 1..20: mol_type = other DNA
aacacctgggtccttcgtgt

SEQ ID NO: 59462 - DNA, 20 bp, synthetic construct
  misc_feature 1..20: note = CRISPR gRNA sequence
  source 1..20: mol_type = other DNA
cagcacttttggaggctgag

SEQ ID NO: 59463 - DNA, 20 bp, synthetic construct
  misc_feature 1..20: note = CRISPR gRNA sequence
  source 1..20: mol_type = other DNA
acttttggaggctgaggtgg

SEQ ID NO: 59464 - DNA, 20 bp, synthetic construct
  misc_feature 1..20: note = CRISPR gRNA sequence
  source 1..20: mol_type = other DNA
tgggtggatcacttgaggcc

SEQ ID NO: 59465 - DNA, 20 bp, synthetic construct
  misc_feature 1..20: note = CRISPR gRNA sequence
  source 1..20: mol_type = other DNA
tactctggtagctgaggcac

SEQ ID NO: 59466 - DNA, 20 bp, synthetic construct
  misc_feature 1..20: note = CRISPR gRNA sequence
  source 1..20: mol_type = other DNA
ttgcaccactgcactccagc

SEQ ID NO: 59467 - DNA, 20 bp, synthetic construct
  misc_feature 1..20: note = CRISPR gRNA sequence
  source 1..20: mol_type = other DNA
gctcctgcgaagccctctgc

SEQ ID NO: 59468 - DNA, 20 bp, synthetic construct
  misc_feature 1..20: note = CRISPR gRNA sequence
  source 1..20: mol_type = other DNA
gctcacagggcacaatgaac

SEQ ID NO: 59469 - DNA, 20 bp, synthetic construct
  misc_feature 1..20: note = CRISPR gRNA sequence
  source 1..20: mol_type = other DNA
aactgaggctgagaaggggc

SEQ ID NO: 59470 - DNA, 20 bp, synthetic construct
  misc_feature 1..20: note = CRISPR gRNA sequence
  source 1..20: mol_type = other DNA
ggcagggaaggaacaggcag

SEQ ID NO: 59471 - DNA, 20 bp, synthetic construct
  misc_feature 1..20: note = CRISPR gRNA sequence
  source 1..20: mol_type = other DNA
gggaaggaacaggcaggaga

SEQ ID NO: 59472 - DNA, 20 bp, synthetic construct
  misc_feature 1..20: note = CRISPR gRNA sequence
  source 1..20: mol_type = other DNA
ctgagccagccccagggctg

SEQ ID NO: 59473 - DNA, 20 bp, synthetic construct
  misc_feature 1..20: note = CRISPR gRNA sequence
  source 1..20: mol_type = other DNA
agccaagcctggaagaggag

SEQ ID NO: 59474 - DNA, 20 bp, synthetic construct
  misc_feature 1..20: note = CRISPR gRNA sequence
  source 1..20: mol_type = other DNA
gaagaggagaggaatgagca

SEQ ID NO: 59475 - DNA, 20 bp, synthetic construct
  misc_feature 1..20: note = CRISPR gRNA sequence
  source 1..20: mol_type = other DNA
ccgacaccccagcacatctg

SEQ ID NO: 59476 - DNA, 20 bp, synthetic construct
  misc_feature 1..20: note = CRISPR gRNA sequence
  source 1..20: mol_type = other DNA
gcccagagaagagcaggggc

SEQ ID NO: 59477 - DNA, 20 bp, synthetic construct
  misc_feature 1..20: note = CRISPR gRNA sequence
  source 1..20: mol_type = other DNA
ctgagctctggcagcccagg

SEQ ID NO: 59478 - DNA, 20 bp, synthetic construct
  misc_feature 1..20: note = CRISPR gRNA sequence
  source 1..20: mol_type = other DNA
gagagccccatcaccccatg

SEQ ID NO: 59479 - DNA, 20 bp, synthetic construct
  misc_feature 1..20: note = CRISPR gRNA sequence
  source 1..20: mol_type = other DNA
cctaacccttggcttctgtt

SEQ ID NO: 59480 - DNA, 20 bp, synthetic construct
  misc_feature 1..20: note = CRISPR gRNA sequence
  source 1..20: mol_type = other DNA
gacactcttacatcctgtct

SEQ ID NO: 59481 - DNA, 20 bp, synthetic construct
  misc_feature 1..20: note = CRISPR gRNA sequence
  source 1..20: mol_type = other DNA
gttgtttacacagtgtagaa

SEQ ID NO: 59482 - DNA, 20 bp, synthetic construct
  misc_feature 1..20: note = CRISPR gRNA sequence
  source 1..20: mol_type = other DNA
ctttcccggccaaaattgtc

SEQ ID NO: 59483 - DNA, 20 bp, synthetic construct
  misc_feature 1..20: note = CRISPR gRNA sequence
  source 1..20: mol_type = other DNA
aattgtcctgggtctggggg

SEQ ID NO: 59484 - DNA, 20 bp, synthetic construct
  misc_feature 1..20: note = CRISPR gRNA sequence
  source 1..20: mol_type = other DNA
ctgttcagtctggaaaagca

SEQ ID NO: 59485 - DNA, 20 bp, synthetic construct
  misc_feature 1..20: note = CRISPR gRNA sequence
  source 1..20: mol_type = other DNA
ttgcaaagccttacacgccc

SEQ ID NO: 59486 - DNA, 20 bp, synthetic construct
  misc_feature 1..20: note = CRISPR gRNA sequence
  source 1..20: mol_type = other DNA
atgctggtagcaaaacttct

SEQ ID NO: 59487 - DNA, 20 bp, synthetic construct
  misc_feature 1..20: note = CRISPR gRNA sequence
  source 1..20: mol_type = other DNA
tctgggggtcatggcaggtg

SEQ ID NO: 59488 - DNA, 20 bp, synthetic construct
  misc_feature 1..20: note = CRISPR gRNA sequence
  source 1..20: mol_type = other DNA
tggggagtggtgagcaaggt

SEQ ID NO: 59489 - DNA, 20 bp, synthetic construct
  misc_feature 1..20: note = CRISPR gRNA sequence
  source 1..20: mol_type = other DNA
gagacttagggacttgcagg

SEQ ID NO: 59490 - DNA, 20 bp, synthetic construct
  misc_feature 1..20: note = CRISPR gRNA sequence
  source 1..20: mol_type = other DNA
tccagagcccctggcccagg

SEQ ID NO: 59491 - DNA, 20 bp, synthetic construct
  misc_feature 1..20: note = CRISPR gRNA sequence
  source 1..20: mol_type = other DNA
ttcacctcagcctctgtgtc

SEQ ID NO: 59492 - DNA, 20 bp, synthetic construct
  misc_feature 1..20: note = CRISPR gRNA sequence
  source 1..20: mol_type = other DNA
ggatctccgggctggcccgg

SEQ ID NO: 59493 - DNA, 20 bp, synthetic construct
  misc_feature 1..20: note = CRISPR gRNA sequence
  source 1..20: mol_type = other DNA
ggctgaatgccactttcacg

SEQ ID NO: 59494 - DNA, 20 bp, synthetic construct
  misc_feature 1..20: note = CRISPR gRNA sequence
  source 1..20: mol_type = other DNA
ggtaggtttttccttaaacc

SEQ ID NO: 59495 - DNA, 20 bp, synthetic construct
  misc_feature 1..20: note = CRISPR gRNA sequence
  source 1..20: mol_type = other DNA
gagccctgaccttgctctgc

SEQ ID NO: 59496 - DNA, 20 bp, synthetic construct
  misc_feature 1..20: note = CRISPR gRNA sequence
  source 1..20: mol_type = other DNA
acctgtattcccagcacttt

SEQ ID NO: 59497 - DNA, 20 bp, synthetic construct
  misc_feature 1..20: note = CRISPR gRNA sequence
  source 1..20: mol_type = other DNA
cactttcggagtctaggcag

SEQ ID NO: 59498 - DNA, 20 bp, synthetic construct
  misc_feature 1..20: note = CRISPR gRNA sequence
  source 1..20: mol_type = other DNA
caggtggatcatttgaggtc

SEQ ID NO: 59499 - DNA, 20 bp, synthetic construct
  misc_feature 1..20: note = CRISPR gRNA sequence
  source 1..20: mol_type = other DNA
tacttgggcggctgaggcac

SEQ ID NO: 59500 - DNA, 20 bp, synthetic construct
  misc_feature 1..20: note = CRISPR gRNA sequence
  source 1..20: mol_type = other DNA
ctgcactccagcctgggcga

SEQ ID NO: 59501 - DNA, 20 bp, synthetic construct
  misc_feature 1..20: note = CRISPR gRNA sequence
  source 1..20: mol_type = other DNA
aaataaataaatacacttta

SEQ ID NO: 59502 - DNA, 20 bp, synthetic construct
  misc_feature 1..20: note = CRISPR gRNA sequence
  source 1..20: mol_type = other DNA
cacctttcagtaaattaatt

SEQ ID NO: 59503 - DNA, 20 bp, synthetic construct
  misc_feature 1..20: note = CRISPR gRNA sequence
  source 1..20: mol_type = other DNA
actctgctctgcccgaggta

SEQ ID NO: 59504 - DNA, 20 bp, synthetic construct
  misc_feature 1..20: note = CRISPR gRNA sequence
  source 1..20: mol_type = other DNA
gtagggggtaggaggtgtac

SEQ ID NO: 59505 - DNA, 20 bp, synthetic construct
  misc_feature 1..20: note = CRISPR gRNA sequence
  source 1..20: mol_type = other DNA
gcaatgctttgtgtcactgc

SEQ ID NO: 59506 - DNA, 20 bp, synthetic construct
  misc_feature 1..20: note = CRISPR gRNA sequence
  source 1..20: mol_type = other DNA
gtttatttatcctagcagca

SEQ ID NO: 59507 - DNA, 20 bp, synthetic construct
  misc_feature 1..20: note = CRISPR gRNA sequence
  source 1..20: mol_type = other DNA
gcagggagtgaaatcacaaa

SEQ ID NO: 59508 - DNA, 20 bp, synthetic construct
  misc_feature 1..20: note = CRISPR gRNA sequence
  source 1..20: mol_type = other DNA
gtgtaggaaggccaccccat

SEQ ID NO: 59509 - DNA, 20 bp, synthetic construct
  misc_feature 1..20: note = CRISPR gRNA sequence
  source 1..20: mol_type = other DNA
aaagtgctgaccgtggcccc

SEQ ID NO: 59510 - DNA, 20 bp, synthetic construct
  misc_feature 1..20: note = CRISPR gRNA sequence
  source 1..20: mol_type = other DNA
cggaagcttgttagaaaatg

SEQ ID NO: 59511 - DNA, 20 bp, synthetic construct
  misc_feature 1..20: note = CRISPR gRNA sequence
  source 1..20: mol_type = other DNA
tactcgggaggctgaggcag

SEQ ID NO: 59512 - DNA, 20 bp, synthetic construct
  misc_feature 1..20: note = CRISPR gRNA sequence
  source 1..20: mol_type = other DNA
caaaaaaagaaatgctaagt

SEQ ID NO: 59513 - DNA, 20 bp, synthetic construct
  misc_feature 1..20: note = CRISPR gRNA sequence
  source 1..20: mol_type = other DNA
ctgtagtcccagctgcttag

SEQ ID NO: 59514 - DNA, 20 bp, synthetic construct
  misc_feature 1..20: note = CRISPR gRNA sequence
  source 1..20: mol_type = other DNA
tgcttaggagggtgaggcag

SEQ ID NO: 59515 - DNA, 20 bp, synthetic construct
  misc_feature 1..20: note = CRISPR gRNA sequence
  source 1..20: mol_type = other DNA
caggaggatcacgttcgccc

SEQ ID NO: 59516 - DNA, 20 bp, synthetic construct
  misc_feature 1..20: note = CRISPR gRNA sequence
  source 1..20: mol_type = other DNA
aaaaaaaagcacagtctagg

SEQ ID NO: 59517 - DNA, 20 bp, synthetic construct
  misc_feature 1..20: note = CRISPR gRNA sequence
  source 1..20: mol_type = other DNA
taggcagaattccagacctg

SEQ ID NO: 59518 - DNA, 20 bp, synthetic construct
  misc_feature 1..20: note = CRISPR gRNA sequence
  source 1..20: mol_type = other DNA
gaattccagacctggggaat

SEQ ID NO: 59519 - DNA, 20 bp, synthetic construct
  misc_feature 1..20: note = CRISPR gRNA sequence
  source 1..20: mol_type = other DNA
tgagcattttaacaagagcc

SEQ ID NO: 59520 - DNA, 20 bp, synthetic construct
  misc_feature 1..20: note = CRISPR gRNA sequence
  source 1..20: mol_type = other DNA
gtgaactgtgtgtgtgcctc

SEQ ID NO: 59521 - DNA, 20 bp, synthetic construct
  misc_feature 1..20: note = CRISPR gRNA sequence
  source 1..20: mol_type = other DNA
gcacccacctgggagggcac

SEQ ID NO: 59522 - DNA, 20 bp, synthetic construct
  misc_feature 1..20: note = CRISPR gRNA sequence
  source 1..20: mol_type = other DNA
ggcacagggatgggcctggg

SEQ ID NO: 59523 - DNA, 20 bp, synthetic construct
  misc_feature 1..20: note = CRISPR gRNA sequence
  source 1..20: mol_type = other DNA
gggcctgggagggatccgca

SEQ ID NO: 59524 - DNA, 20 bp, synthetic construct
  misc_feature 1..20: note = CRISPR gRNA sequence
  source 1..20: mol_type = other DNA
gaggtggcctcagtgcttcc

SEQ ID NO: 59525 - DNA, 20 bp, synthetic construct
  misc_feature 1..20: note = CRISPR gRNA sequence
  source 1..20: mol_type = other DNA
ttccctggatgtggtcccaa

SEQ ID NO: 59526 - DNA, 20 bp, synthetic construct
  misc_feature 1..20: note = CRISPR gRNA sequence
  source 1..20: mol_type = other DNA
caggtcatctggcttagtct

SEQ ID NO: 59527 - DNA, 20 bp, synthetic construct
  misc_feature 1..20: note = CRISPR gRNA sequence
  source 1..20: mol_type = other DNA
gccaggtgaacttgacatct

SEQ ID NO: 59528 - DNA, 20 bp, synthetic construct
  misc_feature 1..20: note = CRISPR gRNA sequence
  source 1..20: mol_type = other DNA
ggtggggcactgtccagtct

SEQ ID NO: 59529 - DNA, 20 bp, synthetic construct
  misc_feature 1..20: note = CRISPR gRNA sequence
  source 1..20: mol_type = other DNA
tccaaatgctgtttctctgc

SEQ ID NO: 59530 - DNA, 20 bp, synthetic construct
  misc_feature 1..20: note = CRISPR gRNA sequence
  source 1..20: mol_type = other DNA
gcttggggccatctggaaag

SEQ ID NO: 59531 - DNA, 20 bp, synthetic construct
  misc_feature 1..20: note = CRISPR gRNA sequence
  source 1..20: mol_type = other DNA
gtgaggaacaccaaggttca

SEQ ID NO: 59532 - DNA, 20 bp, synthetic construct
  misc_feature 1..20: note = CRISPR gRNA sequence
  source 1..20: mol_type = other DNA
ccccagcctaggcaggagag

SEQ ID NO: 59533 - DNA, 20 bp, synthetic construct
  misc_feature 1..20: note = CRISPR gRNA sequence
  source 1..20: mol_type = other DNA
ataacaatagctagcacttg

SEQ ID NO: 59534 - DNA, 20 bp, synthetic construct
  misc_feature 1..20: note = CRISPR gRNA sequence
  source 1..20: mol_type = other DNA
agagaggctgagggactggc

SEQ ID NO: 59535 - DNA, 20 bp, synthetic construct
  misc_feature 1..20: note = CRISPR gRNA sequence
  source 1..20: mol_type = other DNA
caggactttgtgaggccaag

SEQ ID NO: 59536 - DNA, 20 bp, synthetic construct
  misc_feature 1..20: note = CRISPR gRNA sequence
  source 1..20: mol_type = other DNA
actttgtgaggccaaggcgg

SEQ ID NO: 59537 - DNA, 20 bp, synthetic construct
  misc_feature 1..20: note = CRISPR gRNA sequence
  source 1..20: mol_type = other DNA
cgggtgaatcacctgaggtc

SEQ ID NO: 59538 - DNA, 20 bp, synthetic construct
  misc_feature 1..20: note = CRISPR gRNA sequence
  source 1..20: mol_type = other DNA
tacttgggaggctgaggcag

SEQ ID NO: 59539 - DNA, 20 bp, synthetic construct
  misc_feature 1..20: note = CRISPR gRNA sequence
  source 1..20: mol_type = other DNA
gcctgggcaacggagagaga

SEQ ID NO: 59540 - DNA, 20 bp, synthetic construct
  misc_feature 1..20: note = CRISPR gRNA sequence
  source 1..20: mol_type = other DNA
tcttggttggctcagaacag

SEQ ID NO: 59541 - DNA, 20 bp, synthetic construct
  misc_feature 1..20: note = CRISPR gRNA sequence
  source 1..20: mol_type = other DNA
tcagaacagaagagtttttc

SEQ ID NO: 59542 - DNA, 20 bp, synthetic construct
  misc_feature 1..20: note = CRISPR gRNA sequence
  source 1..20: mol_type = other DNA
tttttcctggatgtgggact

SEQ ID NO: 59543 - DNA, 20 bp, synthetic construct
  misc_feature 1..20: note = CRISPR gRNA sequence
  source 1..20: mol_type = other DNA
gaagtgtcagttaccccacc

SEQ ID NO: 59544 - DNA, 20 bp, synthetic construct
  misc_feature 1..20: note = CRISPR gRNA sequence
  source 1..20: mol_type = other DNA
caggcagtgaggctcctaac

SEQ ID NO: 59545 - DNA, 20 bp, synthetic construct
  misc_feature 1..20: note = CRISPR gRNA sequence
  source 1..20: mol_type = other DNA
atacagctggaagaagctga

SEQ ID NO: 59546 - DNA, 20 bp, synthetic construct
  misc_feature 1..20: note = CRISPR gRNA sequence
  source 1..20: mol_type = other DNA
ggaagaagctgactggattt

SEQ ID NO: 59547 - DNA, 20 bp, synthetic construct
  misc_feature 1..20: note = CRISPR gRNA sequence
  source 1..20: mol_type = other DNA
tttgagggtaactgcctgtg

SEQ ID NO: 59548 - DNA, 20 bp, synthetic construct
  misc_feature 1..20: note = CRISPR gRNA sequence
  source 1..20: mol_type = other DNA
agaaaaaggcccccaggggc

SEQ ID NO: 59549 - DNA, 20 bp, synthetic construct
  misc_feature 1..20: note = CRISPR gRNA sequence
  source 1..20: mol_type = other DNA
aaaggcccccaggggcatgg

SEQ ID NO: 59550 - DNA, 20 bp, synthetic construct
  misc_feature 1..20: note = CRISPR gRNA sequence
  source 1..20: mol_type = other DNA
cccagctcagtacatatttg

SEQ ID NO: 59551 - DNA, 20 bp, synthetic construct
  misc_feature 1..20: note = CRISPR gRNA sequence
  source 1..20: mol_type = other DNA
agtacatatttgtcgaatgc

SEQ ID NO: 59552 - DNA, 20 bp, synthetic construct
  misc_feature 1..20: note = CRISPR gRNA sequence
  source 1..20: mol_type = other DNA
tcgaatgcatgaatgagcca

SEQ ID NO: 59553 - DNA, 20 bp, synthetic construct
  misc_feature 1..20: note = CRISPR gRNA sequence
  source 1..20: mol_type = other DNA
aagcaaagagggacaagcgg

SEQ ID NO: 59554 - DNA, 20 bp, synthetic construct
  misc_feature 1..20: note = CRISPR gRNA sequence
  source 1..20: mol_type = other DNA
gtcaaaaggctactttcaag

SEQ ID NO: 59555 - DNA, 20 bp, synthetic construct
  misc_feature 1..20: note = CRISPR gRNA sequence
  source 1..20: mol_type = other DNA
gttcaacagaagttttctca

SEQ ID NO: 59556 - DNA, 20 bp, synthetic construct
  misc_feature 1..20: note = CRISPR gRNA sequence
  source 1..20: mol_type = other DNA
tgtccagatactgtctaaac

SEQ ID NO: 59557 - DNA, 20 bp, synthetic construct
  misc_feature 1..20: note = CRISPR gRNA sequence
  source 1..20: mol_type = other DNA
aggctgtttctggcatttct

SEQ ID NO: 59558 - DNA, 20 bp, synthetic construct
  misc_feature 1..20: note = CRISPR gRNA sequence
  source 1..20: mol_type = other DNA
gatgacttcaaattatgggg

SEQ ID NO: 59559 - DNA, 20 bp, synthetic construct
  misc_feature 1..20: note = CRISPR gRNA sequence
  source 1..20: mol_type = other DNA
tctgtagatttttttctgcc

SEQ ID NO: 59560 - DNA, 20 bp, synthetic construct
  misc_feature 1..20: note = CRISPR gRNA sequence
  source 1..20: mol_type = other DNA
acccctctaagtccagaaga

SEQ ID NO: 59561 - DNA, 20 bp, synthetic construct
  misc_feature 1..20: note = CRISPR gRNA sequence
  source 1..20: mol_type = other DNA
gcccaggtctggccagtgag

SEQ ID NO: 59562 - DNA, 20 bp, synthetic construct
  misc_feature 1..20: note = CRISPR gRNA sequence
  source 1..20: mol_type = other DNA
cacagccacagtgattgctt

SEQ ID NO: 59563 - DNA, 20 bp, synthetic construct
  misc_feature 1..20: note = CRISPR gRNA sequence
  source 1..20: mol_type = other DNA
ccttttgttgtaaccacaga

SEQ ID NO: 59564 - DNA, 20 bp, synthetic construct
  misc_feature 1..20: note = CRISPR gRNA sequence
  source 1..20: mol_type = other DNA
gaaagtaagcctgcaggtgc

SEQ ID NO: 59565 - DNA, 20 bp, synthetic construct
  misc_feature 1..20: note = CRISPR gRNA sequence
  source 1..20: mol_type = other DNA
gaagccaaggtggacagaga

SEQ ID NO: 59566 - DNA, 20 bp, synthetic construct
  misc_feature 1..20: note = CRISPR gRNA sequence
  source 1..20: mol_type = other DNA
gacagagaaagagtaagggc

SEQ ID NO: 59567 - DNA, 20 bp, synthetic construct
  misc_feature 1..20: note = CRISPR gRNA sequence
  source 1..20: mol_type = other DNA
gcctgacaaatatagaaccc

SEQ ID NO: 59568 - DNA, 20 bp, synthetic construct
  misc_feature 1..20: note = CRISPR gRNA sequence
  source 1..20: mol_type = other DNA
taagccaatatatttctgtc

SEQ ID NO: 59569 - DNA, 20 bp, synthetic construct
  misc_feature 1..20: note = CRISPR gRNA sequence
  source 1..20: mol_type = other DNA
tatttctgtcttggattgct

SEQ ID NO: 59570 - DNA, 20 bp, synthetic construct
  misc_feature 1..20: note = CRISPR gRNA sequence
  source 1..20: mol_type = other DNA
ttcttgctggcactgagatc

SEQ ID NO: 59571 - DNA, 20 bp, synthetic construct
  misc_feature 1..20: note = CRISPR gRNA sequence
  source 1..20: mol_type = other DNA
tgtaagggcattcagctcac

SEQ ID NO: 59572 - DNA, 20 bp, synthetic construct
  misc_feature 1..20: note = CRISPR gRNA sequence
  source 1..20: mol_type = other DNA
gcagaagaccaggcagaggc

SEQ ID NO: 59573 - DNA, 20 bp, synthetic construct
  misc_feature 1..20: note = CRISPR gRNA sequence
  source 1..20: mol_type = other DNA
cctcgctgtccaggttcccc

SEQ ID NO: 59574 - DNA, 20 bp, synthetic construct
  misc_feature 1..20: note = CRISPR gRNA sequence
  source 1..20: mol_type = other DNA
ctagctccagggctcaggct

SEQ ID NO: 59575 - DNA, 20 bp, synthetic construct
  misc_feature 1..20: note = CRISPR gRNA sequence
  source 1..20: mol_type = other DNA
cccagctgagaaactatgcc

SEQ ID NO: 59576 - DNA, 20 bp, synthetic construct
  misc_feature 1..20: note = CRISPR gRNA sequence
  source 1..20: mol_type = other DNA
tagataaggcaatcaaagcc

SEQ ID NO: 59577 - DNA, 20 bp, synthetic construct
  misc_feature 1..20: note = CRISPR gRNA sequence
  source 1..20: mol_type = other DNA
gccatgcccacagcccctct

SEQ ID NO: 59578 - DNA, 20 bp, synthetic construct
  misc_feature 1..20: note = CRISPR gRNA sequence
  source 1..20: mol_type = other DNA
ctgctgcacttcatcagggg

SEQ ID NO: 59579 - DNA, 20 bp, synthetic construct
  misc_feature 1..20: note = CRISPR gRNA sequence
  source 1..20: mol_type = other DNA
cagctggaggtcagcctggt

SEQ ID NO: 59580 - DNA, 20 bp, synthetic construct
  misc_feature 1..20: note = CRISPR gRNA sequence
  source 1..20: mol_type = other DNA
caggtcaggcaggagccgcc

SEQ ID NO: 59581 - DNA, 20 bp, synthetic construct
  misc_feature 1..20: note = CRISPR gRNA sequence
  source 1..20: mol_type = other DNA
cgccctgggtcttgggagct

SEQ ID NO: 59582 - DNA, 20 bp, synthetic construct
  misc_feature 1..20: note = CRISPR gRNA sequence
  source 1..20: mol_type = other DNA
gaatgctggtggcagagggc

SEQ ID NO: 59583 - DNA, 20 bp, synthetic construct
  misc_feature 1..20: note = CRISPR gRNA sequence
  source 1..20: mol_type = other DNA
ggtggcagagggcaaggatg

SEQ ID NO: 59584 - DNA, 20 bp, synthetic construct
  misc_feature 1..20: note = CRISPR gRNA sequence
  source 1..20: mol_type = other DNA
agagggcaaggatgtggggt

SEQ ID NO: 59585 - DNA, 20 bp, synthetic construct
  misc_feature 1..20: note = CRISPR gRNA sequence
  source 1..20: mol_type = other DNA
agcaacttcacaacttaagc

SEQ ID NO: 59586 - DNA, 20 bp, synthetic construct
  misc_feature 1..20: note = CRISPR gRNA sequence
  source 1..20: mol_type = other DNA
tcaaagatctctctgtccta

SEQ ID NO: 59587 - DNA, 20 bp, synthetic construct
  misc_feature 1..20: note = CRISPR gRNA sequence
  source 1..20: mol_type = other DNA
tatttattttttgtagagat

SEQ ID NO: 59588 - DNA, 20 bp, synthetic construct
  misc_feature 1..20: note = CRISPR gRNA sequence
  source 1..20: mol_type = other DNA
atttttcctcctcggcctcc

SEQ ID NO: 59589 - DNA, 20 bp, synthetic construct
  misc_feature 1..20: note = CRISPR gRNA sequence
  source 1..20: mol_type = other DNA
tcctcggcctcccagagtgc

SEQ ID NO: 59590 - DNA, 20 bp, synthetic construct
  misc_feature 1..20: note = CRISPR gRNA sequence
  source 1..20: mol_type = other DNA
tgagccactgttcccagccc

SEQ ID NO: 59591 - DNA, 20 bp, synthetic construct
  misc_feature 1..20: note = CRISPR gRNA sequence
  source 1..20: mol_type = other DNA
ggctgctaaaatttgccaat

SEQ ID NO: 59592 - DNA, 20 bp, synthetic construct
  misc_feature 1..20: note = CRISPR gRNA sequence
  source 1..20: mol_type = other DNA
actaaatgagacgtgtgatc

SEQ ID NO: 59593 - DNA, 20 bp, synthetic construct
  misc_feature 1..20: note = CRISPR gRNA sequence
  source 1..20: mol_type = other DNA
atgagacgtgtgatcctgga

SEQ ID NO: 59594 - DNA, 20 bp, synthetic construct
  misc_feature 1..20: note = CRISPR gRNA sequence
  source 1..20: mol_type = other DNA
attgggagaactggtgagat

SEQ ID NO: 59595 - DNA, 20 bp, synthetic construct
  misc_feature 1..20: note = CRISPR gRNA sequence
  source 1..20: mol_type = other DNA
gtgtatcaatgtcacatttc

SEQ ID NO: 59596 - DNA, 20 bp, synthetic construct
  misc_feature 1..20: note = CRISPR gRNA sequence
  source 1..20: mol_type = other DNA
tcctggattttataatttta

SEQ ID NO: 59597 - DNA, 20 bp, synthetic construct
  misc_feature 1..20: note = CRISPR gRNA sequence
  source 1..20: mol_type = other DNA
aattttactggattatggaa

SEQ ID NO: 59598 - DNA, 20 bp, synthetic construct
  misc_feature 1..20: note = CRISPR gRNA sequence
  source 1..20: mol_type = other DNA
gcaaattcgctgaaatgtta

SEQ ID NO: 59599 - DNA, 20 bp, synthetic construct
  misc_feature 1..20: note = CRISPR gRNA sequence
  source 1..20: mol_type = other DNA
ttcagaaaaggagagaggga

SEQ ID NO: 59600 - DNA, 20 bp, synthetic construct
  misc_feature 1..20: note = CRISPR gRNA sequence
  source 1..20: mol_type = other DNA
aatgtggaaaaagattggca

SEQ ID NO: 59601 - DNA, 20 bp, synthetic construct
  misc_feature 1..20: note = CRISPR gRNA sequence
  source 1..20: mol_type = other DNA
tggaaaaagattggcaaagg

SEQ ID NO: 59602 - DNA, 20 bp, synthetic construct
  misc_feature 1..20: note = CRISPR gRNA sequence
  source 1..20: mol_type = other DNA
cctcgctctgtcacctaggc

SEQ ID NO: 59603 - DNA, 20 bp, synthetic construct
  misc_feature 1..20: note = CRISPR gRNA sequence
  source 1..20: mol_type = other DNA
ctcactgtaacctcagcctc

SEQ ID NO: 59604 - DNA, 20 bp, synthetic construct
  misc_feature 1..20: note = CRISPR gRNA sequence
  source 1..20: mol_type = other DNA
gcctcagcctcccaattagc

SEQ ID NO: 59605 - DNA, 20 bp, synthetic construct
  misc_feature 1..20: note = CRISPR gRNA sequence
  source 1..20: mol_type = other DNA
tttttgtattttagtagaga

SEQ ID NO: 59606 - DNA, 20 bp, synthetic construct
  misc_feature 1..20: note = CRISPR gRNA sequence
  source 1..20: mol_type = other DNA
cggggtttcaccgtgttgtc

SEQ ID NO: 59607 - DNA, 20 bp, synthetic construct
  misc_feature 1..20: note = CRISPR gRNA sequence
  source 1..20: mol_type = other DNA
ccgtgttgtccagggtggtc

SEQ ID NO: 59608 - DNA, 20 bp, synthetic construct
  misc_feature 1..20: note = CRISPR gRNA sequence
  source 1..20: mol_type = other DNA
gcctcggcctcccaaagtgc

SEQ ID NO: 59609 - DNA, 20 bp, synthetic construct
  misc_feature 1..20: note = CRISPR gRNA sequence
  source 1..20: mol_type = other DNA
gagccaccacgcccagctct

SEQ ID NO: 59610 - DNA, 20 bp, synthetic construct
  misc_feature 1..20: note = CRISPR gRNA sequence
  source 1..20: mol_type = other DNA
caccacgcccagctctaagg

SEQ ID NO: 59611 - DNA, 20 bp, synthetic construct
  misc_feature 1..20: note = CRISPR gRNA sequence
  source 1..20: mol_type = other DNA
gcccagctctaagggtgaat

SEQ ID NO: 59612 - DNA, 20 bp, synthetic construct
  misc_feature 1..20: note = CRISPR gRNA sequence
  source 1..20: mol_type = other DNA
ttttaaaagaaaaacaatga

SEQ ID NO: 59613 - DNA, 20 bp, synthetic construct
  misc_feature 1..20: note = CRISPR gRNA sequence
  source 1..20: mol_type = other DNA
ccacctgtggtttgtgtcca

SEQ ID NO: 59614 - DNA, 20 bp, synthetic construct
  misc_feature 1..20: note = CRISPR gRNA sequence
  source 1..20: mol_type = other DNA
tgtgtccacagagtaagaca

SEQ ID NO: 59615 - DNA, 20 bp, synthetic construct
  misc_feature 1..20: note = CRISPR gRNA sequence
  source 1..20: mol_type = other DNA
cacagagtaagacacagagt

SEQ ID NO: 59616 - DNA, 20 bp, synthetic construct
  misc_feature 1..20: note = CRISPR gRNA sequence
  source 1..20: mol_type = other DNA
agtcctctgagcccagggct

SEQ ID NO: 59617 - DNA, 20 bp, synthetic construct
  misc_feature 1..20: note = CRISPR gRNA sequence
  source 1..20: mol_type = other DNA
gggcagagctgcaaagggga

SEQ ID NO: 59618 - DNA, 20 bp, synthetic construct
  misc_feature 1..20: note = CRISPR gRNA sequence
  source 1..20: mol_type = other DNA
agagctgcaaaggggactga

SEQ ID NO: 59619 - DNA, 20 bp, synthetic construct
  misc_feature 1..20: note = CRISPR gRNA sequence
  source 1..20: mol_type = other DNA
gagacaagctgaaaaggtcc

SEQ ID NO: 59620 - DNA, 20 bp, synthetic construct
  misc_feature 1..20: note = CRISPR gRNA sequence
  source 1..20: mol_type = other DNA
aaaggtccaaggatattcta

SEQ ID NO: 59621 - DNA, 20 bp, synthetic construct
  misc_feature 1..20: note = CRISPR gRNA sequence
  source 1..20: mol_type = other DNA
agaggtcatcacatccagaa

SEQ ID NO: 59622 - DNA, 20 bp, synthetic construct
  misc_feature 1..20: note = CRISPR gRNA sequence
  source 1..20: mol_type = other DNA
tttctcctgcacaaggaagt

SEQ ID NO: 59623 - DNA, 20 bp, synthetic construct
  misc_feature 1..20: note = CRISPR gRNA sequence
  source 1..20: mol_type = other DNA
gcacaaggaagtgagaatgc

SEQ ID NO: 59624 - DNA, 20 bp, synthetic construct
  misc_feature 1..20: note = CRISPR gRNA sequence
  source 1..20: mol_type = other DNA
tgccagggtcacacatggcc

SEQ ID NO: 59625 - DNA, 20 bp, synthetic construct
  misc_feature 1..20: note = CRISPR gRNA sequence
  source 1..20: mol_type = other DNA
acatggcctggagtaggtac

SEQ ID NO: 59626 - DNA, 20 bp, synthetic construct
  misc_feature 1..20: note = CRISPR gRNA sequence
  source 1..20: mol_type = other DNA
agagaactcagggccccaca

SEQ ID NO: 59627 - DNA, 20 bp, synthetic construct
  misc_feature 1..20: note = CRISPR gRNA sequence
  source 1..20: mol_type = other DNA
ggaacatctagtccagtatg

SEQ ID NO: 59628 - DNA, 20 bp, synthetic construct
  misc_feature 1..20: note = CRISPR gRNA sequence
  source 1..20: mol_type = other DNA
ctgcaaggagcttatggtgt

SEQ ID NO: 59629 - DNA, 20 bp, synthetic construct
  misc_feature 1..20: note = CRISPR gRNA sequence
  source 1..20: mol_type = other DNA
tatgagaagtgctaggaagc

SEQ ID NO: 59630 - DNA, 20 bp, synthetic construct
  misc_feature 1..20: note = CRISPR gRNA sequence
  source 1..20: mol_type = other DNA
tcctaccatgctctatttcc

SEQ ID NO: 59631 - DNA, 20 bp, synthetic construct
  misc_feature 1..20: note = CRISPR gRNA sequence
  source 1..20: mol_type = other DNA
gcagggctgcatccactcaa

SEQ ID NO: 59632 - DNA, 20 bp, synthetic construct
  misc_feature 1..20: note = CRISPR gRNA sequence
  source 1..20: mol_type = other DNA
aatttcccaaactgtgccat

SEQ ID NO: 59633 - DNA, 20 bp, synthetic construct
  misc_feature 1..20: note = CRISPR gRNA sequence
  source 1..20: mol_type = other DNA
catatggatttagaggtgct

SEQ ID NO: 59634 - DNA, 20 bp, synthetic construct
  misc_feature 1..20: note = CRISPR gRNA sequence
  source 1..20: mol_type = other DNA
tttagaggtgctgtgaatcc

SEQ ID NO: 59635 - DNA, 20 bp, synthetic construct
  misc_feature 1..20: note = CRISPR gRNA sequence
  source 1..20: mol_type = other DNA
ctgtgaatccagggatctat

SEQ ID NO: 59636 - DNA, 20 bp, synthetic construct
  misc_feature 1..20: note = CRISPR gRNA sequence
  source 1..20: mol_type = other DNA
gaatccagggatctataaga

SEQ ID NO: 59637 - DNA, 20 bp, synthetic construct
  misc_feature 1..20: note = CRISPR gRNA sequence
  source 1..20: mol_type = other DNA
ggaagtgtttgactaagcct

SEQ ID NO: 59638 - DNA, 20 bp, synthetic construct
  misc_feature 1..20: note = CRISPR gRNA sequence
  source 1..20: mol_type = other DNA
ggcatttaagctgagacctg

SEQ ID NO: 59639 - DNA, 20 bp, synthetic construct
  misc_feature 1..20: note = CRISPR gRNA sequence
  source 1..20: mol_type = other DNA
ctgagacctgagggatgagg

SEQ ID NO: 59640 - DNA, 20 bp, synthetic construct
  misc_feature 1..20: note = CRISPR gRNA sequence
  source 1..20: mol_type = other DNA
tcggggaactgaaagttcat

SEQ ID NO: 59641 - DNA, 20 bp, synthetic construct
  misc_feature 1..20: note = CRISPR gRNA sequence
  source 1..20: mol_type = other DNA
ctggagctgagactggggcc

SEQ ID NO: 59642 - DNA, 20 bp, synthetic construct
  misc_feature 1..20: note = CRISPR gRNA sequence
  source 1..20: mol_type = other DNA
ggggctgaaacgcctcagaa

SEQ ID NO: 59643 - DNA, 20 bp, synthetic construct
  misc_feature 1..20: note = CRISPR gRNA sequence
  source 1..20: mol_type = other DNA
gaacccctaaggtctctggg

SEQ ID NO: 59644 - DNA, 20 bp, synthetic construct
  misc_feature 1..20: note = CRISPR gRNA sequence
  source 1..20: mol_type = other DNA
taaggtctctgggcagggtg

SEQ ID NO: 59645 - DNA, 20 bp, synthetic construct
  misc_feature 1..20: note = CRISPR gRNA sequence
  source 1..20: mol_type = other DNA
cccaacaccagcccctgcct

SEQ ID NO: 59646 - DNA, 20 bp, synthetic construct
  misc_feature 1..20: note = CRISPR gRNA sequence
  source 1..20: mol_type = other DNA
ctgccttggggtccctggtg

SEQ ID NO: 59647 - DNA, 20 bp, synthetic construct
  misc_feature 1..20: note = CRISPR gRNA sequence
  source 1..20: mol_type = other DNA
tccctggtgctgggtcccac

SEQ ID NO: 59648 - DNA, 20 bp, synthetic construct
  misc_feature 1..20: note = CRISPR gRNA sequence
  source 1..20: mol_type = other DNA
ccacctgagtgccacagctt

SEQ ID NO: 59649 - DNA, 20 bp, synthetic construct
  misc_feature 1..20: note = CRISPR gRNA sequence
  source 1..20: mol_type = other DNA
agctggacacagagctgctg

SEQ ID NO: 59650 - DNA, 20 bp, synthetic construct
  misc_feature 1..20: note = CRISPR gRNA sequence
  source 1..20: mol_type = other DNA
gctgggtctcggagatgctg

SEQ ID NO: 59651 - DNA, 20 bp, synthetic construct
  misc_feature 1..20: note = CRISPR gRNA sequence
  source 1..20: mol_type = other DNA
actctgaactctcactttgc

SEQ ID NO: 59652 - DNA, 20 bp, synthetic construct
  misc_feature 1..20: note = CRISPR gRNA sequence
  source 1..20: mol_type = other DNA
actggaaagtaggtgcttcc

SEQ ID NO: 59653 - DNA, 20 bp, synthetic construct
  misc_feature 1..20: note = CRISPR gRNA sequence
  source 1..20: mol_type = other DNA
tttttttttttttaaagaga

SEQ ID NO: 59654 - DNA, 20 bp, synthetic construct
  misc_feature 1..20: note = CRISPR gRNA sequence
  source 1..20: mol_type = other DNA
gcctcggcctcccaaagtgc

SEQ ID NO: 59655 - DNA, 20 bp, synthetic construct
  misc_feature 1..20: note = CRISPR gRNA sequence
  source 1..20: mol_type = other DNA
ccatgacagaaagccattag

SEQ ID NO: 59656 - DNA, 20 bp, synthetic construct
  misc_feature 1..20: note = CRISPR gRNA sequence
  source 1..20: mol_type = other DNA
gagggatccaagggcagttc

SEQ ID NO: 59657 - DNA, 20 bp, synthetic construct
  misc_feature 1..20: note = CRISPR gRNA sequence
  source 1..20: mol_type = other DNA
caaggaccacagtgtggtgg

SEQ ID NO: 59658 - DNA, 20 bp, synthetic construct
  misc_feature 1..20: note = CRISPR gRNA sequence
  source 1..20: mol_type = other DNA
accacagtgtggtggaaggg

SEQ ID NO: 59659 - DNA, 20 bp, synthetic construct
  misc_feature 1..20: note = CRISPR gRNA sequence
  source 1..20: mol_type = other DNA
tgtggtggaagggtggggta

SEQ ID NO: 59660 - DNA, 20 bp, synthetic construct
  misc_feature 1..20: note = CRISPR gRNA sequence
  source 1..20: mol_type = other DNA
ggtggggtaggggatgtgtc

SEQ ID NO: 59661 - DNA, 20 bp, synthetic construct
  misc_feature 1..20: note = CRISPR gRNA sequence
  source 1..20: mol_type = other DNA
tctaagctcactgccttcac

SEQ ID NO: 59662 - DNA, 20 bp, synthetic construct
  misc_feature 1..20: note = CRISPR gRNA sequence
  source 1..20: mol_type = other DNA
tcacttgaatgttatgttca

SEQ ID NO: 59663 - DNA, 20 bp, synthetic construct
  misc_feature 1..20: note = CRISPR gRNA sequence
  source 1..20: mol_type = other DNA
gggctccaaccagtaagtga

SEQ ID NO: 59664 - DNA, 20 bp, synthetic construct
  misc_feature 1..20: note = CRISPR gRNA sequence
  source 1..20: mol_type = other DNA
caaccagtaagtgactgagt

SEQ ID NO: 59665 - DNA, 20 bp, synthetic construct
  misc_feature 1..20: note = CRISPR gRNA sequence
  source 1..20: mol_type = other DNA
gagttgggatctgaacatag

SEQ ID NO: 59666 - DNA, 20 bp, synthetic construct
  misc_feature 1..20: note = CRISPR gRNA sequence
  source 1..20: mol_type = other DNA
gggatctgaacatagctgag

SEQ ID NO: 59667 - DNA, 20 bp, synthetic construct
  misc_feature 1..20: note = CRISPR gRNA sequence
  source 1..20: mol_type = other DNA
ggactcccagccatgtctgc

SEQ ID NO: 59668 - DNA, 20 bp, synthetic construct
  misc_feature 1..20: note = CRISPR gRNA sequence
  source 1..20: mol_type = other DNA
tagccctttgttttgattct

SEQ ID NO: 59669 - DNA, 20 bp, synthetic construct
  misc_feature 1..20: note = CRISPR gRNA sequence
  source 1..20: mol_type = other DNA
gtgacacagctattacccca

SEQ ID NO: 59670 - DNA, 20 bp, synthetic construct
  misc_feature 1..20: note = CRISPR gRNA sequence
  source 1..20: mol_type = other DNA
cccaatgcttatgaaagatg

SEQ ID NO: 59671 - DNA, 20 bp, synthetic construct
  misc_feature 1..20: note = CRISPR gRNA sequence
  source 1..20: mol_type = other DNA
acacatgacggggccggggg

SEQ ID NO: 59672 - DNA, 20 bp, synthetic construct
  misc_feature 1..20: note = CRISPR gRNA sequence
  source 1..20: mol_type = other DNA
gggggggacctagaggcttt

SEQ ID NO: 59673 - DNA, 20 bp, synthetic construct
  misc_feature 1..20: note = CRISPR gRNA sequence
  source 1..20: mol_type = other DNA
atcttattttatttttgaga

SEQ ID NO: 59674 - DNA, 20 bp, synthetic construct
  misc_feature 1..20: note = CRISPR gRNA sequence
  source 1..20: mol_type = other DNA
tttgctcttgttgcccagac

SEQ ID NO: 59675 - DNA, 20 bp, synthetic construct
  misc_feature 1..20: note = CRISPR gRNA sequence
  source 1..20: mol_type = other DNA
atcactgcaacctctgcctc

SEQ ID NO: 59676 - DNA, 20 bp, synthetic construct
  misc_feature 1..20: note = CRISPR gRNA sequence
  source 1..20: mol_type = other DNA
gcctcagcctcccaagtagc

SEQ ID NO: 59677 - DNA, 20 bp, synthetic construct
  misc_feature 1..20: note = CRISPR gRNA sequence
  source 1..20: mol_type = other DNA
ttttgtatttttagtagaga

SEQ ID NO: 59678 - DNA, 20 bp, synthetic construct
  misc_feature 1..20: note = CRISPR gRNA sequence
  source 1..20: mol_type = other DNA
gcctcggcctcccaaagtgc

SEQ ID NO: 59679 - DNA, 20 bp, synthetic construct
  misc_feature 1..20: note = CRISPR gRNA sequence
  source 1..20: mol_type = other DNA
atggtggttgtttaagatga

SEQ ID NO: 59680 - DNA, 20 bp, synthetic construct
  misc_feature 1..20: note = CRISPR gRNA sequence
  source 1..20: mol_type = other DNA
tttaagatgatagaattctc

SEQ ID NO: 59681 - DNA, 20 bp, synthetic construct
  misc_feature 1..20: note = CRISPR gRNA sequence
  source 1..20: mol_type = other DNA
aatttgaaagtaggaaaaaa

SEQ ID NO: 59682 - DNA, 20 bp, synthetic construct
  misc_feature 1..20: note = CRISPR gRNA sequence
  source 1..20: mol_type = other DNA
attactgctttaaagttatg

SEQ ID NO: 59683 - DNA, 20 bp, synthetic construct
  misc_feature 1..20: note = CRISPR gRNA sequence
  source 1..20: mol_type = other DNA
actattttctttatgtattt

SEQ ID NO: 59684 - DNA, 20 bp, synthetic construct
  misc_feature 1..20: note = CRISPR gRNA sequence
  source 1..20: mol_type = other DNA
atttttattttttgtagata

SEQ ID NO: 59685 - DNA, 20 bp, synthetic construct
  misc_feature 1..20: note = CRISPR gRNA sequence
  source 1..20: mol_type = other DNA
acctcagcctcccaaagtgt

SEQ ID NO: 59686 - DNA, 20 bp, synthetic construct
  misc_feature 1..20: note = CRISPR gRNA sequence
  source 1..20: mol_type = other DNA
atttgaaaatgttattttgg

SEQ ID NO: 59687 - DNA, 20 bp, synthetic construct
  misc_feature 1..20: note = CRISPR gRNA sequence
  source 1..20: mol_type = other DNA
actttgggaggctgaggtgg

SEQ ID NO: 59688 - DNA, 20 bp, synthetic construct
  misc_feature 1..20: note = CRISPR gRNA sequence
  source 1..20: mol_type = other DNA
tactctggaggctgaggcag

SEQ ID NO: 59689 - DNA, 20 bp, synthetic construct
  misc_feature 1..20: note = CRISPR gRNA sequence
  source 1..20: mol_type = other DNA
ctcaaaaaaaaaaagttatt

SEQ ID NO: 59690 - DNA, 20 bp, synthetic construct
  misc_feature 1..20: note = CRISPR gRNA sequence
  source 1..20: mol_type = other DNA
ttttgggtgctctagcaatt

SEQ ID NO: 59691 - DNA, 20 bp, synthetic construct
  misc_feature 1..20: note = CRISPR gRNA sequence
  source 1..20: mol_type = other DNA
actttgggaggctgaggtgg

SEQ ID NO: 59692 - DNA, 20 bp, synthetic construct
  misc_feature 1..20: note = CRISPR gRNA sequence
  source 1..20: mol_type = other DNA
agggactgtcaattgggcac

SEQ ID NO: 59693 - DNA, 20 bp, synthetic construct
  misc_feature 1..20: note = CRISPR gRNA sequence
  source 1..20: mol_type = other DNA
gacaacccaagtgtcaattg

SEQ ID NO: 59694 - DNA, 20 bp, synthetic construct
  misc_feature 1..20: note = CRISPR gRNA sequence
  source 1..20: mol_type = other DNA
aagtgtcaattgatggataa

SEQ ID NO: 59695 - DNA, 20 bp, synthetic construct
  misc_feature 1..20: note = CRISPR gRNA sequence
  source 1..20: mol_type = other DNA
aatgtggtccatccacacaa

SEQ ID NO: 59696 - DNA, 20 bp, synthetic construct
  misc_feature 1..20: note = CRISPR gRNA sequence
  source 1..20: mol_type = other DNA
agccttaaaaaaggaaaggg

SEQ ID NO: 59697 - DNA, 20 bp, synthetic construct
  misc_feature 1..20: note = CRISPR gRNA sequence
  source 1..20: mol_type = other DNA
cgggcagatcatctgaggtc

SEQ ID NO: 59698 - DNA, 20 bp, synthetic construct
  misc_feature 1..20: note = CRISPR gRNA sequence
  source 1..20: mol_type = other DNA
aaaatacaaaaaaaaattag

SEQ ID NO: 59699 - DNA, 20 bp, synthetic construct
  misc_feature 1..20: note = CRISPR gRNA sequence
  source 1..20: mol_type = other DNA
tactccggaggctgaggcag

SEQ ID NO: 59700 - DNA, 20 bp, synthetic construct
  misc_feature 1..20: note = CRISPR gRNA sequence
  source 1..20: mol_type = other DNA
tcgcttgaacccaagaggtg

SEQ ID NO: 59701 - DNA, 20 bp, synthetic construct
  misc_feature 1..20: note = CRISPR gRNA sequence
  source 1..20: mol_type = other DNA
tgcactccagcccaggtgac

SEQ ID NO: 59702 - DNA, 20 bp, synthetic construct
  misc_feature 1..20: note = CRISPR gRNA sequence
  source 1..20: mol_type = other DNA
acagtgacacacgctgcaac

SEQ ID NO: 59703 - DNA, 20 bp, synthetic construct
  misc_feature 1..20: note = CRISPR gRNA sequence
  source 1..20: mol_type = other DNA
caattcatagagacagaaag

SEQ ID NO: 59704 - DNA, 20 bp, synthetic construct
  misc_feature 1..20: note = CRISPR gRNA sequence
  source 1..20: mol_type = other DNA
gaatggtggttgccaggggc

SEQ ID NO: 59705 - DNA, 20 bp, synthetic construct
  misc_feature 1..20: note = CRISPR gRNA sequence
  source 1..20: mol_type = other DNA
gggctggggtaggggggaaa

SEQ ID NO: 59706 - DNA, 20 bp, synthetic construct
  misc_feature 1..20: note = CRISPR gRNA sequence
  source 1..20: mol_type = other DNA
gaaatggggtgttgtttaat

SEQ ID NO: 59707 - DNA, 20 bp, synthetic construct
  misc_feature 1..20: note = CRISPR gRNA sequence
  source 1..20: mol_type = other DNA
attcagttttgcaagaggaa

SEQ ID NO: 59708 - DNA, 20 bp, synthetic construct
  misc_feature 1..20: note = CRISPR gRNA sequence
  source 1..20: mol_type = other DNA
gagattggccgtacaaaaaa

SEQ ID NO: 59709 - DNA, 20 bp, synthetic construct
  misc_feature 1..20: note = CRISPR gRNA sequence
  source 1..20: mol_type = other DNA
agtggatgtacttaacactc

SEQ ID NO: 59710 - DNA, 20 bp, synthetic construct
  misc_feature 1..20: note = CRISPR gRNA sequence
  source 1..20: mol_type = other DNA
ttttgggcacaaacatgaaa

SEQ ID NO: 59711 - DNA, 20 bp, synthetic construct
  misc_feature 1..20: note = CRISPR gRNA sequence
  source 1..20: mol_type = other DNA
cgtccagtttccaggaaagt

SEQ ID NO: 59712 - DNA, 20 bp, synthetic construct
  misc_feature 1..20: note = CRISPR gRNA sequence
  source 1..20: mol_type = other DNA
tgacatcatgagaaagccac

SEQ ID NO: 59713 - DNA, 20 bp, synthetic construct
  misc_feature 1..20: note = CRISPR gRNA sequence
  source 1..20: mol_type = other DNA
gaaacagaaagctgtggtga

SEQ ID NO: 59714 - DNA, 20 bp, synthetic construct
  misc_feature 1..20: note = CRISPR gRNA sequence
  source 1..20: mol_type = other DNA
gcagtgatgccgcaggttag

SEQ ID NO: 59715 - DNA, 20 bp, synthetic construct
  misc_feature 1..20: note = CRISPR gRNA sequence
  source 1..20: mol_type = other DNA
cagaccagatgtgacagatc

SEQ ID NO: 59716 - DNA, 20 bp, synthetic construct
  misc_feature 1..20: note = CRISPR gRNA sequence
  source 1..20: mol_type = other DNA
ctaggtagtacccgacacta

SEQ ID NO: 59717 - DNA, 20 bp, synthetic construct
  misc_feature 1..20: note = CRISPR gRNA sequence
  source 1..20: mol_type = other DNA
cgacactaaggaatcgctaa

SEQ ID NO: 59718 - DNA, 20 bp, synthetic construct
  misc_feature 1..20: note = CRISPR gRNA sequence
  source 1..20: mol_type = other DNA
agcttcacggtgaaatattt

SEQ ID NO: 59719 - DNA, 20 bp, synthetic construct
  misc_feature 1..20: note = CRISPR gRNA sequence
  source 1..20: mol_type = other DNA
cggtgaaatatttaggagtg

SEQ ID NO: 59720 - DNA, 20 bp, synthetic construct
  misc_feature 1..20: note = CRISPR gRNA sequence
  source 1..20: mol_type = other DNA
aactgtcaaacctaggttct

SEQ ID NO: 59721 - DNA, 20 bp, synthetic construct
  misc_feature 1..20: note = CRISPR gRNA sequence
  source 1..20: mol_type = other DNA
caaacctaggttctgggaat

SEQ ID NO: 59722 - DNA, 20 bp, synthetic construct
  misc_feature 1..20: note = CRISPR gRNA sequence
  source 1..20: mol_type = other DNA
tacttcggtatcttcttttt

SEQ ID NO: 59723 - DNA, 20 bp, synthetic construct
  misc_feature 1..20: note = CRISPR gRNA sequence
  source 1..20: mol_type = other DNA
cagtttctctgtgtgccttg

SEQ ID NO: 59724 - DNA, 20 bp, synthetic construct
  misc_feature 1..20: note = CRISPR gRNA sequence
  source 1..20: mol_type = other DNA
gagtctctgggacagatgga

SEQ ID NO: 59725 - DNA, 20 bp, synthetic construct
  misc_feature 1..20: note = CRISPR gRNA sequence
  source 1..20: mol_type = other DNA
acagatggacagggtttgct

SEQ ID NO: 59726 - DNA, 20 bp, synthetic construct
  misc_feature 1..20: note = CRISPR gRNA sequence
  source 1..20: mol_type = other DNA
tttgctcagggtccagatgg

SEQ ID NO: 59727 - DNA, 20 bp, synthetic construct
  misc_feature 1..20: note = CRISPR gRNA sequence
  source 1..20: mol_type = other DNA
agggtccagatggcagggtt

SEQ ID NO: 59728 - DNA, 20 bp, synthetic construct
  misc_feature 1..20: note = CRISPR gRNA sequence
  source 1..20: mol_type = other DNA
acctgaggctgaacagccct

SEQ ID NO: 59729 - DNA, 20 bp, synthetic construct
  misc_feature 1..20: note = CRISPR gRNA sequence
  source 1..20: mol_type = other DNA
ggtcgccccaccaagctcag

SEQ ID NO: 59730 - DNA, 20 bp, synthetic construct
  misc_feature 1..20: note = CRISPR gRNA sequence
  source 1..20: mol_type = other DNA
tgcttctggcccaggcagca

SEQ ID NO: 59731 - DNA, 20 bp, synthetic construct
  misc_feature 1..20: note = CRISPR gRNA sequence
  source 1..20: mol_type = other DNA
agtcactgaggtggctctgg

SEQ ID NO: 59732 - DNA, 20 bp, synthetic construct
  misc_feature 1..20: note = CRISPR gRNA sequence
  source 1..20: mol_type = other DNA
ccctctgctgtcctcacggg

SEQ ID NO: 59733 - DNA, 20 bp, synthetic construct
  misc_feature 1..20: note = CRISPR gRNA sequence
  source 1..20: mol_type = other DNA
ctgctgtcctcacgggctgg

SEQ ID NO: 59734 - DNA, 20 bp, synthetic construct
  misc_feature 1..20: note = CRISPR gRNA sequence
  source 1..20: mol_type = other DNA
gcagaaagccagggcagagc

SEQ ID NO: 59735 - DNA, 20 bp, synthetic construct
  misc_feature 1..20: note = CRISPR gRNA sequence
  source 1..20: mol_type = other DNA
accccctgtaagaaagtatt

SEQ ID NO: 59736 - DNA, 20 bp, synthetic construct
  misc_feature 1..20: note = CRISPR gRNA sequence
  source 1..20: mol_type = other DNA
gtcaggcactgtgccagcct

SEQ ID NO: 59737 - DNA, 20 bp, synthetic construct
  misc_feature 1..20: note = CRISPR gRNA sequence
  source 1..20: mol_type = other DNA
gggacttcctgccttacccg

SEQ ID NO: 59738 - DNA, 20 bp, synthetic construct
  misc_feature 1..20: note = CRISPR gRNA sequence
  source 1..20: mol_type = other DNA
cagcagataagaaagaaggg

SEQ ID NO: 59739 - DNA, 20 bp, synthetic construct
  misc_feature 1..20: note = CRISPR gRNA sequence
  source 1..20: mol_type = other DNA
cctggggagggaggtgtgcc

SEQ ID NO: 59740 - DNA, 20 bp, synthetic construct
  misc_feature 1..20: note = CRISPR gRNA sequence
  source 1..20: mol_type = other DNA
gctgtccaggcatctcagcc

SEQ ID NO: 59741 - DNA, 20 bp, synthetic construct
  misc_feature 1..20: note = CRISPR gRNA sequence
  source 1..20: mol_type = other DNA
ctctgatgaggcagggctgc

SEQ ID NO: 59742 - DNA, 20 bp, synthetic construct
  misc_feature 1..20: note = CRISPR gRNA sequence
  source 1..20: mol_type = other DNA
aggaggggctgatgtttgag

SEQ ID NO: 59743 - DNA, 20 bp, synthetic construct
  misc_feature 1..20: note = CRISPR gRNA sequence
  source 1..20: mol_type = other DNA
gatgtttgagctgggtgtta

SEQ ID NO: 59744 - DNA, 20 bp, synthetic construct
  misc_feature 1..20: note = CRISPR gRNA sequence
  source 1..20: mol_type = other DNA
gctgggtgttaaaggattgg

SEQ ID NO: 59745 - DNA, 20 bp, synthetic construct
  misc_feature 1..20: note = CRISPR gRNA sequence
  source 1..20: mol_type = other DNA
atctcagaaaaggcaaggaa

SEQ ID NO: 59746 - DNA, 20 bp, synthetic construct
  misc_feature 1..20: note = CRISPR gRNA sequence
  source 1..20: mol_type = other DNA
gcaaggaagagaatgttgag

SEQ ID NO: 59747 - DNA, 20 bp, synthetic construct
  misc_feature 1..20: note = CRISPR gRNA sequence
  source 1..20: mol_type = other DNA
gtgcggtgtgagcagaggca

SEQ ID NO: 59748 - DNA, 20 bp, synthetic construct
  misc_feature 1..20: note = CRISPR gRNA sequence
  source 1..20: mol_type = other DNA
atgtgccaggtatgtatgtg

SEQ ID NO: 59749 - DNA, 20 bp, synthetic construct
  misc_feature 1..20: note = CRISPR gRNA sequence
  source 1..20: mol_type = other DNA
atgtggggggtttgtttttg

SEQ ID NO: 59750 - DNA, 20 bp, synthetic construct
  misc_feature 1..20: note = CRISPR gRNA sequence
  source 1..20: mol_type = other DNA
ctgcgtgctgtgtggtgtgt

SEQ ID NO: 59751 - DNA, 20 bp, synthetic construct
  misc_feature 1..20: note = CRISPR gRNA sequence
  source 1..20: mol_type = other DNA
gcttggtgtatctgtggtat

SEQ ID NO: 59752 - DNA, 20 bp, synthetic construct
  misc_feature 1..20: note = CRISPR gRNA sequence
  source 1..20: mol_type = other DNA
aacatggtggaaggtgacag

SEQ ID NO: 59753 - DNA, 20 bp, synthetic construct
  misc_feature 1..20: note = CRISPR gRNA sequence
  source 1..20: mol_type = other DNA
agggactttgaacttcaccc

SEQ ID NO: 59754 - DNA, 20 bp, synthetic construct
  misc_feature 1..20: note = CRISPR gRNA sequence
  source 1..20: mol_type = other DNA
tggggagccactgaggggca

SEQ ID NO: 59755 - DNA, 20 bp, synthetic construct
  misc_feature 1..20: note = CRISPR gRNA sequence
  source 1..20: mol_type = other DNA
gaagatccctctgggggctg

SEQ ID NO: 59756 - DNA, 20 bp, synthetic construct
  misc_feature 1..20: note = CRISPR gRNA sequence
  source 1..20: mol_type = other DNA
atccctctgggggctgtgga

SEQ ID NO: 59757 - DNA, 20 bp, synthetic construct
  misc_feature 1..20: note = CRISPR gRNA sequence
  source 1..20: mol_type = other DNA
gaggaggcctgataagatgc

SEQ ID NO: 59758 - DNA, 20 bp, synthetic construct
  misc_feature 1..20: note = CRISPR gRNA sequence
  source 1..20: mol_type = other DNA
taaaggaactggccgtggca

SEQ ID NO: 59759 - DNA, 20 bp, synthetic construct
  misc_feature 1..20: note = CRISPR gRNA sequence
  source 1..20: mol_type = other DNA
ggcagtgagtcagggctacc

SEQ ID NO: 59760 - DNA, 20 bp, synthetic construct
  misc_feature 1..20: note = CRISPR gRNA sequence
  source 1..20: mol_type = other DNA
taatcctcacaataacccta

SEQ ID NO: 59761 - DNA, 20 bp, synthetic construct
  misc_feature 1..20: note = CRISPR gRNA sequence
  source 1..20: mol_type = other DNA
tagctggtaagtggcagatc

SEQ ID NO: 59762 - DNA, 20 bp, synthetic construct
  misc_feature 1..20: note = CRISPR gRNA sequence
  source 1..20: mol_type = other DNA
agtcaggacatggcaaggaa

SEQ ID NO: 59763 - DNA, 20 bp, synthetic construct
  misc_feature 1..20: note = CRISPR gRNA sequence
  source 1..20: mol_type = other DNA
gcaaggaagagaatgttggg

SEQ ID NO: 59764 - DNA, 20 bp, synthetic construct
  misc_feature 1..20: note = CRISPR gRNA sequence
  source 1..20: mol_type = other DNA
atgttgggctgagttgggct

SEQ ID NO: 59765 - DNA, 20 bp, synthetic construct
  misc_feature 1..20: note = CRISPR gRNA sequence
  source 1..20: mol_type = other DNA
gccaaggccctggctgagac

SEQ ID NO: 59766 - DNA, 20 bp, synthetic construct
  misc_feature 1..20: note = CRISPR gRNA sequence
  source 1..20: mol_type = other DNA
gggggccatggaggccgcca

SEQ ID NO: 59767 - DNA, 20 bp, synthetic construct
  misc_feature 1..20: note = CRISPR gRNA sequence
  source 1..20: mol_type = other DNA
cccctgtcccatcaccctgc

SEQ ID NO: 59768 - DNA, 20 bp, synthetic construct
  misc_feature 1..20: note = CRISPR gRNA sequence
  source 1..20: mol_type = other DNA
catcaccctgcagggattac

SEQ ID NO: 59769 - DNA, 20 bp, synthetic construct
  misc_feature 1..20: note = CRISPR gRNA sequence
  source 1..20: mol_type = other DNA
gcctggtcctctctggagaa

SEQ ID NO: 59770 - DNA, 20 bp, synthetic construct
  misc_feature 1..20: note = CRISPR gRNA sequence
  source 1..20: mol_type = other DNA
ctgcacccacaaggacaagg

SEQ ID NO: 59771 - DNA, 20 bp, synthetic construct
  misc_feature 1..20: note = CRISPR gRNA sequence
  source 1..20: mol_type = other DNA
cccatggcacccgggcatca

SEQ ID NO: 59772 - DNA, 20 bp, synthetic construct
  misc_feature 1..20: note = CRISPR gRNA sequence
  source 1..20: mol_type = other DNA
cagatggaaggccacaaagt

SEQ ID NO: 59773 - DNA, 20 bp, synthetic construct
  misc_feature 1..20: note = CRISPR gRNA sequence
  source 1..20: mol_type = other DNA
actagaagggaaatggagat

SEQ ID NO: 59774 - DNA, 20 bp, synthetic construct
  misc_feature 1..20: note = CRISPR gRNA sequence
  source 1..20: mol_type = other DNA
agggaaatggagatgagaat

SEQ ID NO: 59775 - DNA, 20 bp, synthetic construct
  misc_feature 1..20: note = CRISPR gRNA sequence
  source 1..20: mol_type = other DNA
atggacacactgaggcccag

SEQ ID NO: 59776 - DNA, 20 bp, synthetic construct
  misc_feature 1..20: note = CRISPR gRNA sequence
  source 1..20: mol_type = other DNA
ggcagaactggcaccagacc

SEQ ID NO: 59777 - DNA, 20 bp, synthetic construct
  misc_feature 1..20: note = CRISPR gRNA sequence
  source 1..20: mol_type = other DNA
tgcccgctgcccctgtggtc

SEQ ID NO: 59778 - DNA, 20 bp, synthetic construct
  misc_feature 1..20: note = CRISPR gRNA sequence
  source 1..20: mol_type = other DNA
gctggcagctctagccccgc

SEQ ID NO: 59779 - DNA, 20 bp, synthetic construct
  misc_feature 1..20: note = CRISPR gRNA sequence
  source 1..20: mol_type = other DNA
gggagagatggggcaaccat

SEQ ID NO: 59780 - DNA, 20 bp, synthetic construct
  misc_feature 1..20: note = CRISPR gRNA sequence
  source 1..20: mol_type = other DNA
ccacatttatgttccacaga

SEQ ID NO: 59781 - DNA, 20 bp, synthetic construct
  misc_feature 1..20: note = CRISPR gRNA sequence
  source 1..20: mol_type = other DNA
tgttccacagattgggtcag

SEQ ID NO: 59782 - DNA, 20 bp, synthetic construct
  misc_feature 1..20: note = CRISPR gRNA sequence
  source 1..20: mol_type = other DNA
ggtcagaagaatttcaggga

SEQ ID NO: 59783 - DNA, 20 bp, synthetic construct
  misc_feature 1..20: note = CRISPR gRNA sequence
  source 1..20: mol_type = other DNA
caatcccgcatcagctggtt

SEQ ID NO: 59784 - DNA, 20 bp, synthetic construct
  misc_feature 1..20: note = CRISPR gRNA sequence
  source 1..20: mol_type = other DNA
ccgcatcagctggttgggga

SEQ ID NO: 59785 - DNA, 20 bp, synthetic construct
  misc_feature 1..20: note = CRISPR gRNA sequence
  source 1..20: mol_type = other DNA
ccccaggtcagtttggctgt

SEQ ID NO: 59786 - DNA, 20 bp, synthetic construct
  misc_feature 1..20: note = CRISPR gRNA sequence
  source 1..20: mol_type = other DNA
taggggtgtgtcaccctgcc

SEQ ID NO: 59787 - DNA, 20 bp, synthetic construct
  misc_feature 1..20: note = CRISPR gRNA sequence
  source 1..20: mol_type = other DNA
gccacgaatcacagcctctc

SEQ ID NO: 59788 - DNA, 20 bp, synthetic construct
  misc_feature 1..20: note = CRISPR gRNA sequence
  source 1..20: mol_type = other DNA
cctctcttgggtgtttggtg

SEQ ID NO: 59789 - DNA, 20 bp, synthetic construct
  misc_feature 1..20: note = CRISPR gRNA sequence
  source 1..20: mol_type = other DNA
tggtggaggatctgcccatg

SEQ ID NO: 59790 - DNA, 20 bp, synthetic construct
  misc_feature 1..20: note = CRISPR gRNA sequence
  source 1..20: mol_type = other DNA
aggaaaggacccaaggccag

SEQ ID NO: 59791 - DNA, 20 bp, synthetic construct
  misc_feature 1..20: note = CRISPR gRNA sequence
  source 1..20: mol_type = other DNA
caggggagtgaaggcaaggg

SEQ ID NO: 59792 - DNA, 20 bp, synthetic construct
  misc_feature 1..20: note = CRISPR gRNA sequence
  source 1..20: mol_type = other DNA
ccttgtcctctggtgctctg

SEQ ID NO: 59793 - DNA, 20 bp, synthetic construct
  misc_feature 1..20: note = CRISPR gRNA sequence
  source 1..20: mol_type = other DNA
gcagacattccagaaggcat

SEQ ID NO: 59794 - DNA, 20 bp, synthetic construct
  misc_feature 1..20: note = CRISPR gRNA sequence
  source 1..20: mol_type = other DNA
aggtttgctgagagactgta

SEQ ID NO: 59795 - DNA, 20 bp, synthetic construct
  misc_feature 1..20: note = CRISPR gRNA sequence
  source 1..20: mol_type = other DNA
agggggtaaggagcagtggc

SEQ ID NO: 59796 - DNA, 20 bp, synthetic construct
  misc_feature 1..20: note = CRISPR gRNA sequence
  source 1..20: mol_type = other DNA
actgctactggaccccatgt

SEQ ID NO: 59797 - DNA, 20 bp, synthetic construct
  misc_feature 1..20: note = CRISPR gRNA sequence
  source 1..20: mol_type = other DNA
accatcccttccatcaccac

SEQ ID NO: 59798 - DNA, 20 bp, synthetic construct
  misc_feature 1..20: note = CRISPR gRNA sequence
  source 1..20: mol_type = other DNA
cctcttggtcctcttccata

SEQ ID NO: 59799 - DNA, 20 bp, synthetic construct
  misc_feature 1..20: note = CRISPR gRNA sequence
  source 1..20: mol_type = other DNA
ggtgcctccagcaggctttc

SEQ ID NO: 59800 - DNA, 20 bp, synthetic construct
  misc_feature 1..20: note = CRISPR gRNA sequence
  source 1..20: mol_type = other DNA
cgcccttggccggcatcatt

SEQ ID NO: 59801 - DNA, 20 bp, synthetic construct
  misc_feature 1..20: note = CRISPR gRNA sequence
  source 1..20: mol_type = other DNA
tcatttgggatccacagttt

SEQ ID NO: 59802 - DNA, 20 bp, synthetic construct
  misc_feature 1..20: note = CRISPR gRNA sequence
  source 1..20: mol_type = other DNA
tcaggaaaaaaaaatgtttg

SEQ ID NO: 59803 - DNA, 20 bp, synthetic construct
  misc_feature 1..20: note = CRISPR gRNA sequence
  source 1..20: mol_type = other DNA
tagatttcttcttttaatct

SEQ ID NO: 59804 - DNA, 20 bp, synthetic construct
  misc_feature 1..20: note = CRISPR gRNA sequence
  source 1..20: mol_type = other DNA
tttatttatttattttgaga

SEQ ID NO: 59805 - DNA, 20 bp, synthetic construct
  misc_feature 1..20: note = CRISPR gRNA sequence
  source 1..20: mol_type = other DNA
tcttgctctgttgcccaggc

SEQ ID NO: 59806 - DNA, 20 bp, synthetic construct
  misc_feature 1..20: note = CRISPR gRNA sequence
  source 1..20: mol_type = other DNA
gcctcagcctcccaagtagc

SEQ ID NO: 59807 - DNA, 20 bp, synthetic construct
  misc_feature 1..20: note = CRISPR gRNA sequence
  source 1..20: mol_type = other DNA
tttttgtatttttagtagag

SEQ ID NO: 59808 - DNA, 20 bp, synthetic construct
  misc_feature 1..20: note = CRISPR gRNA sequence
  source 1..20: mol_type = other DNA
gctttggcctcccaaagtgc

SEQ ID NO: 59809 - DNA, 20 bp, synthetic construct
  misc_feature 1..20: note = CRISPR gRNA sequence
  source 1..20: mol_type = other DNA
tttaaaataagaaaaattgg

SEQ ID NO: 59810 - DNA, 20 bp, synthetic construct
  misc_feature 1..20: note = CRISPR gRNA sequence
  source 1..20: mol_type = other DNA
actttgggagggcgaggcag

SEQ ID NO: 59811 - DNA, 20 bp, synthetic construct
  misc_feature 1..20: note = CRISPR gRNA sequence
  source 1..20: mol_type = other DNA
caggcggatcgcctgaggtc

SEQ ID NO: 59812 - DNA, 20 bp, synthetic construct
  misc_feature 1..20: note = CRISPR gRNA sequence
  source 1..20: mol_type = other DNA
tccttgggaggctgaggcag

SEQ ID NO: 59813 - DNA, 20 bp, synthetic construct
  misc_feature 1..20: note = CRISPR gRNA sequence
  source 1..20: mol_type = other DNA
tctcagcaacctgggaggct

SEQ ID NO: 59814 - DNA, 20 bp, synthetic construct
  misc_feature 1..20: note = CRISPR gRNA sequence
  source 1..20: mol_type = other DNA
tactccagaggctgaggtgg

SEQ ID NO: 59815 - DNA, 20 bp, synthetic construct
  misc_feature 1..20: note = CRISPR gRNA sequence
  source 1..20: mol_type = other DNA
tgggaggatcgcttgagccc

SEQ ID NO: 59816 - DNA, 20 bp, synthetic construct
  misc_feature 1..20: note = CRISPR gRNA sequence
  source 1..20: mol_type = other DNA
ctgcactccagcctgggcaa

SEQ ID NO: 59817 - DNA, 20 bp, synthetic construct
  misc_feature 1..20: note = CRISPR gRNA sequence
  source 1..20: mol_type = other DNA
tatttcccactggtcctagg

SEQ ID NO: 59818 - DNA, 20 bp, synthetic construct
  misc_feature 1..20: note = CRISPR gRNA sequence
  source 1..20: mol_type = other DNA
tgagaacaatactagtatcc

SEQ ID NO: 59819 - DNA, 20 bp, synthetic construct
  misc_feature 1..20: note = CRISPR gRNA sequence
  source 1..20: mol_type = other DNA
cccatgcaggggctgactat

SEQ ID NO: 59820 - DNA, 20 bp, synthetic construct
  misc_feature 1..20: note = CRISPR gRNA sequence
  source 1..20: mol_type = other DNA
gctctgcgtccctcctcagg

SEQ ID NO: 59821 - DNA, 20 bp, synthetic construct
  misc_feature 1..20: note = CRISPR gRNA sequence
  source 1..20: mol_type = other DNA
aaccacctgctgggccaaca

SEQ ID NO: 59822 - DNA, 20 bp, synthetic construct
  misc_feature 1..20: note = CRISPR gRNA sequence
  source 1..20: mol_type = other DNA
ggaactagctccaccatggc

SEQ ID NO: 59823 - DNA, 20 bp, synthetic construct
  misc_feature 1..20: note = CRISPR gRNA sequence
  source 1..20: mol_type = other DNA
aaaattgattcagggaagct

SEQ ID NO: 59824 - DNA, 20 bp, synthetic construct
  misc_feature 1..20: note = CRISPR gRNA sequence
  source 1..20: mol_type = other DNA
agaggtgtaggcaggcacac

SEQ ID NO: 59825 - DNA, 20 bp, synthetic construct
  misc_feature 1..20: note = CRISPR gRNA sequence
  source 1..20: mol_type = other DNA
tacacttgctcagcaaccag

SEQ ID NO: 59826 - DNA, 20 bp, synthetic construct
  misc_feature 1..20: note = CRISPR gRNA sequence
  source 1..20: mol_type = other DNA
ggaggtaaaggggacaagca

SEQ ID NO: 59827 - DNA, 20 bp, synthetic construct
  misc_feature 1..20: note = CRISPR gRNA sequence
  source 1..20: mol_type = other DNA
gcacagcctctgggctccag

SEQ ID NO: 59828 - DNA, 20 bp, synthetic construct
  misc_feature 1..20: note = CRISPR gRNA sequence
  source 1..20: mol_type = other DNA
ttggaccctctggaagtgtc

SEQ ID NO: 59829 - DNA, 20 bp, synthetic construct
  misc_feature 1..20: note = CRISPR gRNA sequence
  source 1..20: mol_type = other DNA
cggacctgtgtttcttcatg

SEQ ID NO: 59830 - DNA, 20 bp, synthetic construct
  misc_feature 1..20: note = CRISPR gRNA sequence
  source 1..20: mol_type = other DNA
gggtgaaacaagtccctctg

SEQ ID NO: 59831 - DNA, 20 bp, synthetic construct
  misc_feature 1..20: note = CRISPR gRNA sequence
  source 1..20: mol_type = other DNA
cctctgcagggttgttccag

SEQ ID NO: 59832 - DNA, 20 bp, synthetic construct
  misc_feature 1..20: note = CRISPR gRNA sequence
  source 1..20: mol_type = other DNA
acacgccttcctcctcctcg

SEQ ID NO: 59833 - DNA, 20 bp, synthetic construct
  misc_feature 1..20: note = CRISPR gRNA sequence
  source 1..20: mol_type = other DNA
aagttgcatggtgcagggac

SEQ ID NO: 59834 - DNA, 20 bp, synthetic construct
  misc_feature 1..20: note = CRISPR gRNA sequence
  source 1..20: mol_type = other DNA
ggacctggatcagacaggac

SEQ ID NO: 59835 - DNA, 20 bp, synthetic construct
  misc_feature 1..20: note = CRISPR gRNA sequence
  source 1..20: mol_type = other DNA
gacagctgtggccacagcct

SEQ ID NO: 59836 - DNA, 20 bp, synthetic construct
  misc_feature 1..20: note = CRISPR gRNA sequence
  source 1..20: mol_type = other DNA
tccggaagcccagcctctag

SEQ ID NO: 59837 - DNA, 20 bp, synthetic construct
  misc_feature 1..20: note = CRISPR gRNA sequence
  source 1..20: mol_type = other DNA
tccaggcacaacccttcagg

SEQ ID NO: 59838 - DNA, 20 bp, synthetic construct
  misc_feature 1..20: note = CRISPR gRNA sequence
  source 1..20: mol_type = other DNA
acgagtcctggctgtcccag

SEQ ID NO: 59839 - DNA, 20 bp, synthetic construct
  misc_feature 1..20: note = CRISPR gRNA sequence
  source 1..20: mol_type = other DNA
ggctcagcctgaaaaggaaa

SEQ ID NO: 59840 - DNA, 20 bp, synthetic construct
  misc_feature 1..20: note = CRISPR gRNA sequence
  source 1..20: mol_type = other DNA
aagggggtagatccggcaag

SEQ ID NO: 59841 - DNA, 20 bp, synthetic construct
  misc_feature 1..20: note = CRISPR gRNA sequence
  source 1..20: mol_type = other DNA
caaggaacctggctagcctg

SEQ ID NO: 59842 - DNA, 20 bp, synthetic construct
  misc_feature 1..20: note = CRISPR gRNA sequence
  source 1..20: mol_type = other DNA
gcctggagggtaaggaaagg

SEQ ID NO: 59843 - DNA, 20 bp, synthetic construct
  misc_feature 1..20: note = CRISPR gRNA sequence
  source 1..20: mol_type = other DNA
aggcaatagggaagcaggca

SEQ ID NO: 59844 - DNA, 20 bp, synthetic construct
  misc_feature 1..20: note = CRISPR gRNA sequence
  source 1..20: mol_type = other DNA
gggctgagggacaggcagat

SEQ ID NO: 59845 - DNA, 20 bp, synthetic construct
  misc_feature 1..20: note = CRISPR gRNA sequence
  source 1..20: mol_type = other DNA
agggacaggcagatttggat

SEQ ID NO: 59846 - DNA, 20 bp, synthetic construct
  misc_feature 1..20: note = CRISPR gRNA sequence
  source 1..20: mol_type = other DNA
gtatgactctcgaggtatat

SEQ ID NO: 59847 - DNA, 20 bp, synthetic construct
  misc_feature 1..20: note = CRISPR gRNA sequence
  source 1..20: mol_type = other DNA
tgcaagcacagatttcacag

SEQ ID NO: 59848 - DNA, 20 bp, synthetic construct
  misc_feature 1..20: note = CRISPR gRNA sequence
  source 1..20: mol_type = other DNA
caggcgagtccttgctcaca

SEQ ID NO: 59849 - DNA, 20 bp, synthetic construct
  misc_feature 1..20: note = CRISPR gRNA sequence
  source 1..20: mol_type = other DNA
gtgggctctcctgtgcccta

SEQ ID NO: 59850 - DNA, 20 bp, synthetic construct
  misc_feature 1..20: note = CRISPR gRNA sequence
  source 1..20: mol_type = other DNA
gatatttccaaatgactccc

SEQ ID NO: 59851 - DNA, 20 bp, synthetic construct
  misc_feature 1..20: note = CRISPR gRNA sequence
  source 1..20: mol_type = other DNA
actgccttagagaaagtgag

SEQ ID NO: 59852 - DNA, 20 bp, synthetic construct
  misc_feature 1..20: note = CRISPR gRNA sequence
  source 1..20: mol_type = other DNA
ttccactctcaagatccacc

SEQ ID NO: 59853 - DNA, 20 bp, synthetic construct
  misc_feature 1..20: note = CRISPR gRNA sequence
  source 1..20: mol_type = other DNA
tttgaaaacccaaatgagga

SEQ ID NO: 59854 - DNA, 20 bp, synthetic construct
  misc_feature 1..20: note = CRISPR gRNA sequence
  source 1..20: mol_type = other DNA
actttgggaagccgaggcgg

SEQ ID NO: 59855 - DNA, 20 bp, synthetic construct
  misc_feature 1..20: note = CRISPR gRNA sequence
  source 1..20: mol_type = other DNA
cgggcggatcacttgaggtc

SEQ ID NO: 59856 - DNA, 20 bp, synthetic construct
  misc_feature 1..20: note = CRISPR gRNA sequence
  source 1..20: mol_type = other DNA
tacttgggaggctgaggcac

SEQ ID NO: 59857 - DNA, 20 bp, synthetic construct
  misc_feature 1..20: note = CRISPR gRNA sequence
  source 1..20: mol_type = other DNA
caaaagtctaaactctcccc

SEQ ID NO: 59858 - DNA, 20 bp, synthetic construct
  misc_feature 1..20: note = CRISPR gRNA sequence
  source 1..20: mol_type = other DNA
cacatgccgttccctctgcc

SEQ ID NO: 59859 - DNA, 20 bp, synthetic construct
  misc_feature 1..20: note = CRISPR gRNA sequence
  source 1..20: mol_type = other DNA
agggccacaagcactacacg

SEQ ID NO: 59860 - DNA, 20 bp, synthetic construct
  misc_feature 1..20: note = CRISPR gRNA sequence
  source 1..20: mol_type = other DNA
acaaagtttaaaccctggca

SEQ ID NO: 59861 - DNA, 20 bp, synthetic construct
  misc_feature 1..20: note = CRISPR gRNA sequence
  source 1..20: mol_type = other DNA
cgccactccaaaggcggacg

SEQ ID NO: 59862 - DNA, 20 bp, synthetic construct
  misc_feature 1..20: note = CRISPR gRNA sequence
  source 1..20: mol_type = other DNA
ccaaaggcggacgaggagtc

SEQ ID NO: 59863 - DNA, 20 bp, synthetic construct
  misc_feature 1..20: note = CRISPR gRNA sequence
  source 1..20: mol_type = other DNA
ctgccaccttttatgtccaa

SEQ ID NO: 59864 - DNA, 20 bp, synthetic construct
  misc_feature 1..20: note = CRISPR gRNA sequence
  source 1..20: mol_type = other DNA
tctgactcattatctccggg

SEQ ID NO: 59865 - DNA, 20 bp, synthetic construct
  misc_feature 1..20: note = CRISPR gRNA sequence
  source 1..20: mol_type = other DNA
cgggcagggtgggactatta

SEQ ID NO: 59866 - DNA, 20 bp, synthetic construct
  misc_feature 1..20: note = CRISPR gRNA sequence
  source 1..20: mol_type = other DNA
gggactattacagggtgcca

SEQ ID NO: 59867 - DNA, 20 bp, synthetic construct
  misc_feature 1..20: note = CRISPR gRNA sequence
  source 1..20: mol_type = other DNA
agctgggctgtacttgcccc

SEQ ID NO: 59868 - DNA, 20 bp, synthetic construct
  misc_feature 1..20: note = CRISPR gRNA sequence
  source 1..20: mol_type = other DNA
ttctttttttttttctgaga

SEQ ID NO: 59869 - DNA, 20 bp, synthetic construct
  misc_feature 1..20: note = CRISPR gRNA sequence
  source 1..20: mol_type = other DNA
ttcactcttgtcgcccaagc

SEQ ID NO: 59870 - DNA, 20 bp, synthetic construct
  misc_feature 1..20: note = CRISPR gRNA sequence
  source 1..20: mol_type = other DNA
gcctcagcctcccaagtagc

SEQ ID NO: 59871 - DNA, 20 bp, synthetic construct
  misc_feature 1..20: note = CRISPR gRNA sequence
  source 1..20: mol_type = other DNA
ttttgtatttttagtagaga

SEQ ID NO: 59872 - DNA, 20 bp, synthetic construct
  misc_feature 1..20: note = CRISPR gRNA sequence
  source 1..20: mol_type = other DNA
gcctcggcctcccaaagtgc

SEQ ID NO: 59873 - DNA, 20 bp, synthetic construct
  misc_feature 1..20: note = CRISPR gRNA sequence
  source 1..20: mol_type = other DNA
aaatagttttaatactttgg

SEQ ID NO: 59874 - DNA, 20 bp, synthetic construct
  misc_feature 1..20: note = CRISPR gRNA sequence
  source 1..20: mol_type = other DNA
tctgcttaaattcccttttt

SEQ ID NO: 59875 - DNA, 20 bp, synthetic construct
  misc_feature 1..20: note = CRISPR gRNA sequence
  source 1..20: mol_type = other DNA
catctgtacagcccctttct

SEQ ID NO: 59876 - DNA, 20 bp, synthetic construct
  misc_feature 1..20: note = CRISPR gRNA sequence
  source 1..20: mol_type = other DNA
tgtacagcccctttctacga

SEQ ID NO: 59877 - DNA, 20 bp, synthetic construct
  misc_feature 1..20: note = CRISPR gRNA sequence
  source 1..20: mol_type = other DNA
ctacgagtgggtgaccctcc

SEQ ID NO: 59878 - DNA, 20 bp, synthetic construct
  misc_feature 1..20: note = CRISPR gRNA sequence
  source 1..20: mol_type = other DNA
tccatttcttaaggtgattt

SEQ ID NO: 59879 - DNA, 20 bp, synthetic construct
  misc_feature 1..20: note = CRISPR gRNA sequence
  source 1..20: mol_type = other DNA
gtgattttagaataacttat

SEQ ID NO: 59880 - DNA, 20 bp, synthetic construct
  misc_feature 1..20: note = CRISPR gRNA sequence
  source 1..20: mol_type = other DNA
tatttgagtcccaactctgg

SEQ ID NO: 59881 - DNA, 20 bp, synthetic construct
  misc_feature 1..20: note = CRISPR gRNA sequence
  source 1..20: mol_type = other DNA
caactctgggggaatgggcg

SEQ ID NO: 59882 - DNA, 20 bp, synthetic construct
  misc_feature 1..20: note = CRISPR gRNA sequence
  source 1..20: mol_type = other DNA
ccctgaggttgacaaagtat

SEQ ID NO: 59883 - DNA, 20 bp, synthetic construct
  misc_feature 1..20: note = CRISPR gRNA sequence
  source 1..20: mol_type = other DNA
gggtggagctggaagcagat

SEQ ID NO: 59884 - DNA, 20 bp, synthetic construct
  misc_feature 1..20: note = CRISPR gRNA sequence
  source 1..20: mol_type = other DNA
atgataaaacaacctaagga

SEQ ID NO: 59885 - DNA, 20 bp, synthetic construct
  misc_feature 1..20: note = CRISPR gRNA sequence
  source 1..20: mol_type = other DNA
caacctaaggaaagaatgga

SEQ ID NO: 59886 - DNA, 20 bp, synthetic construct
  misc_feature 1..20: note = CRISPR gRNA sequence
  source 1..20: mol_type = other DNA
gaaagaatggagcgggtaga

SEQ ID NO: 59887 - DNA, 20 bp, synthetic construct
  misc_feature 1..20: note = CRISPR gRNA sequence
  source 1..20: mol_type = other DNA
agcgggtagagggggttgga

SEQ ID NO: 59888 - DNA, 20 bp, synthetic construct
  misc_feature 1..20: note = CRISPR gRNA sequence
  source 1..20: mol_type = other DNA
ggttggagggggtaaaggcg

SEQ ID NO: 59889 - DNA, 20 bp, synthetic construct
  misc_feature 1..20: note = CRISPR gRNA sequence
  source 1..20: mol_type = other DNA
ggggtaaaggcggggggttg

SEQ ID NO: 59890 - DNA, 20 bp, synthetic construct
  misc_feature 1..20: note = CRISPR gRNA sequence
  source 1..20: mol_type = other DNA
actgcagcaggctcagctga

SEQ ID NO: 59891 - DNA, 20 bp, synthetic construct
  misc_feature 1..20: note = CRISPR gRNA sequence
  source 1..20: mol_type = other DNA
agttgaggtaagcagtccag

SEQ ID NO: 59892 - DNA, 20 bp, synthetic construct
  misc_feature 1..20: note = CRISPR gRNA sequence
  source 1..20: mol_type = other DNA
caatctgtgaaacaaagcag

SEQ ID NO: 59893 - DNA, 20 bp, synthetic construct
  misc_feature 1..20: note = CRISPR gRNA sequence
  source 1..20: mol_type = other DNA
ttctggagatgggacctaac

SEQ ID NO: 59894 - DNA, 20 bp, synthetic construct
  misc_feature 1..20: note = CRISPR gRNA sequence
  source 1..20: mol_type = other DNA
tgaaacattccctcccagca

SEQ ID NO: 59895 - DNA, 20 bp, synthetic construct
  misc_feature 1..20: note = CRISPR gRNA sequence
  source 1..20: mol_type = other DNA
tccctcccagcactgggtcc

SEQ ID NO: 59896 - DNA, 20 bp, synthetic construct
  misc_feature 1..20: note = CRISPR gRNA sequence
  source 1..20: mol_type = other DNA
tcttttaagtttgggaaata

SEQ ID NO: 59897 - DNA, 20 bp, synthetic construct
  misc_feature 1..20: note = CRISPR gRNA sequence
  source 1..20: mol_type = other DNA
gcgataggctgctgtgcatt

SEQ ID NO: 59898 - DNA, 20 bp, synthetic construct
  misc_feature 1..20: note = CRISPR gRNA sequence
  source 1..20: mol_type = other DNA
ccccaaactaaatggactag

SEQ ID NO: 59899 - DNA, 20 bp, synthetic construct
  misc_feature 1..20: note = CRISPR gRNA sequence
  source 1..20: mol_type = other DNA
caaaacatgtttgttaagaa

SEQ ID NO: 59900 - DNA, 20 bp, synthetic construct
  misc_feature 1..20: note = CRISPR gRNA sequence
  source 1..20: mol_type = other DNA
cagcactttgggaggctgag

SEQ ID NO: 59901 - DNA, 20 bp, synthetic construct
  misc_feature 1..20: note = CRISPR gRNA sequence
  source 1..20: mol_type = other DNA
actttgggaggctgaggtgg

SEQ ID NO: 59902 - DNA, 20 bp, synthetic construct
  misc_feature 1..20: note = CRISPR gRNA sequence
  source 1..20: mol_type = other DNA
tgggtggatcatctgaggtc

SEQ ID NO: 59903 - DNA, 20 bp, synthetic construct
  misc_feature 1..20: note = CRISPR gRNA sequence
  source 1..20: mol_type = other DNA
tactcaggaggctgaggcat

SEQ ID NO: 59904 - DNA, 20 bp, synthetic construct
  misc_feature 1..20: note = CRISPR gRNA sequence
  source 1..20: mol_type = other DNA
tcgtaccactgcactccagc

SEQ ID NO: 59905 - DNA, 20 bp, synthetic construct
  misc_feature 1..20: note = CRISPR gRNA sequence
  source 1..20: mol_type = other DNA
actccagcctgggtgacaga

SEQ ID NO: 59906 - DNA, 20 bp, synthetic construct
  misc_feature 1..20: note = CRISPR gRNA sequence
  source 1..20: mol_type = other DNA
acaatgctgccttaacccag

SEQ ID NO: 59907 - DNA, 20 bp, synthetic construct
  misc_feature 1..20: note = CRISPR gRNA sequence
  source 1..20: mol_type = other DNA
tgctgccttaacccagagga

SEQ ID NO: 59908 - DNA, 20 bp, synthetic construct
  misc_feature 1..20: note = CRISPR gRNA sequence
  source 1..20: mol_type = other DNA
cgaaggagacagggactggc

SEQ ID NO: 59909 - DNA, 20 bp, synthetic construct
  misc_feature 1..20: note = CRISPR gRNA sequence
  source 1..20: mol_type = other DNA
gaccaggacaactcaagaca

SEQ ID NO: 59910 - DNA, 20 bp, synthetic construct
  misc_feature 1..20: note = CRISPR gRNA sequence
  source 1..20: mol_type = other DNA
actcaagacactgagttccc

SEQ ID NO: 59911 - DNA, 20 bp, synthetic construct
  misc_feature 1..20: note = CRISPR gRNA sequence
  source 1..20: mol_type = other DNA
ggctgtttggaggggaggca

SEQ ID NO: 59912 - DNA, 20 bp, synthetic construct
  misc_feature 1..20: note = CRISPR gRNA sequence
  source 1..20: mol_type = other DNA
tggctcagtgagctgggggg

SEQ ID NO: 59913 - DNA, 20 bp, synthetic construct
  misc_feature 1..20: note = CRISPR gRNA sequence
  source 1..20: mol_type = other DNA
tcaggactggggcctttatt

SEQ ID NO: 59914 - DNA, 20 bp, synthetic construct
  misc_feature 1..20: note = CRISPR gRNA sequence
  source 1..20: mol_type = other DNA
tttttttttttttaaagcaa

SEQ ID NO: 59915 - DNA, 20 bp, synthetic construct
  misc_feature 1..20: note = CRISPR gRNA sequence
  source 1..20: mol_type = other DNA
gcaaagtagacctgcagtgc

SEQ ID NO: 59916 - DNA, 20 bp, synthetic construct
  misc_feature 1..20: note = CRISPR gRNA sequence
  source 1..20: mol_type = other DNA
agtgcttgaattcagggagg

SEQ ID NO: 59917 - DNA, 20 bp, synthetic construct
  misc_feature 1..20: note = CRISPR gRNA sequence
  source 1..20: mol_type = other DNA
gcttccccggtggaaccccg

SEQ ID NO: 59918 - DNA, 20 bp, synthetic construct
  misc_feature 1..20: note = CRISPR gRNA sequence
  source 1..20: mol_type = other DNA
ggaatcactggacttcagca

SEQ ID NO: 59919 - DNA, 20 bp, synthetic construct
  misc_feature 1..20: note = CRISPR gRNA sequence
  source 1..20: mol_type = other DNA
atttatttatttatttgaga

SEQ ID NO: 59920 - DNA, 20 bp, synthetic construct
  misc_feature 1..20: note = CRISPR gRNA sequence
  source 1..20: mol_type = other DNA
ctcaccacaatctctgcctc

SEQ ID NO: 59921 - DNA, 20 bp, synthetic construct
  misc_feature 1..20: note = CRISPR gRNA sequence
  source 1..20: mol_type = other DNA
gcaagtctcctgcctgcctc

SEQ ID NO: 59922 - DNA, 20 bp, synthetic construct
  misc_feature 1..20: note = CRISPR gRNA sequence
  source 1..20: mol_type = other DNA
ctgcctgcctccagagtagc

SEQ ID NO: 59923 - DNA, 20 bp, synthetic construct
  misc_feature 1..20: note = CRISPR gRNA sequence
  source 1..20: mol_type = other DNA
tccagagtagctgggattac

SEQ ID NO: 59924 - DNA, 20 bp, synthetic construct
  misc_feature 1..20: note = CRISPR gRNA sequence
  source 1..20: mol_type = other DNA
ttttgtatttttagtagaga

SEQ ID NO: 59925 - DNA, 20 bp, synthetic construct
  misc_feature 1..20: note = CRISPR gRNA sequence
  source 1..20: mol_type = other DNA
acctcggcctcccaaagtgc

SEQ ID NO: 59926 - DNA, 20 bp, synthetic construct
  misc_feature 1..20: note = CRISPR gRNA sequence
  source 1..20: mol_type = other DNA
aaagtgctgggattataggc

SEQ ID NO: 59927 - DNA, 20 bp, synthetic construct
  misc_feature 1..20: note = CRISPR gRNA sequence
  source 1..20: mol_type = other DNA
tcccagtctccttgtgttcc

SEQ ID NO: 59928 - DNA, 20 bp, synthetic construct
  misc_feature 1..20: note = CRISPR gRNA sequence
  source 1..20: mol_type = other DNA
acttaacagtcaaatcacgt

SEQ ID NO: 59929 - DNA, 20 bp, synthetic construct
  misc_feature 1..20: note = CRISPR gRNA sequence
  source 1..20: mol_type = other DNA
acacaacacctagaagcagt

SEQ ID NO: 59930 - DNA, 20 bp, synthetic construct
  misc_feature 1..20: note = CRISPR gRNA sequence
  source 1..20: mol_type = other DNA
atggcctgctgcatgcagcc

SEQ ID NO: 59931 - DNA, 20 bp, synthetic construct
  misc_feature 1..20: note = CRISPR gRNA sequence
  source 1..20: mol_type = other DNA
gcatgcagcctaggatggct

SEQ ID NO: 59932 - DNA, 20 bp, synthetic construct
  misc_feature 1..20: note = CRISPR gRNA sequence
  source 1..20: mol_type = other DNA
aacactatgagatttttctt

SEQ ID NO: 59933 - DNA, 20 bp, synthetic construct
  misc_feature 1..20: note = CRISPR gRNA sequence
  source 1..20: mol_type = other DNA
acccttgatctagactctag

SEQ ID NO: 59934 - DNA, 20 bp, synthetic construct
  misc_feature 1..20: note = CRISPR gRNA sequence
  source 1..20: mol_type = other DNA
tagactctagaagggtgtgg

SEQ ID NO: 59935 - DNA, 20 bp, synthetic construct
  misc_feature 1..20: note = CRISPR gRNA sequence
  source 1..20: mol_type = other DNA
ctgaccattggttgacttta

SEQ ID NO: 59936 - DNA, 20 bp, synthetic construct
  misc_feature 1..20: note = CRISPR gRNA sequence
  source 1..20: mol_type = other DNA
ctttaaggaattgccattaa

SEQ ID NO: 59937 - DNA, 20 bp, synthetic construct
  misc_feature 1..20: note = CRISPR gRNA sequence
  source 1..20: mol_type = other DNA
actttgggaggctgaggaag

SEQ ID NO: 59938 - DNA, 20 bp, synthetic construct
  misc_feature 1..20: note = CRISPR gRNA sequence
  source 1..20: mol_type = other DNA
aaggtggatcacttgaggtc

SEQ ID NO: 59939 - DNA, 20 bp, synthetic construct
  misc_feature 1..20: note = CRISPR gRNA sequence
  source 1..20: mol_type = other DNA
tactcaggaggctgaggcag

SEQ ID NO: 59940 - DNA, 20 bp, synthetic construct
  misc_feature 1..20: note = CRISPR gRNA sequence
  source 1..20: mol_type = other DNA
catgggaaggccacactcca

SEQ ID NO: 59941 - DNA, 20 bp, synthetic construct
  misc_feature 1..20: note = CRISPR gRNA sequence
  source 1..20: mol_type = other DNA
ccacactccagggggtcaaa

SEQ ID NO: 59942 - DNA, 20 bp, synthetic construct
  misc_feature 1..20: note = CRISPR gRNA sequence
  source 1..20: mol_type = other DNA
tgactgcaaacaggtagaaa

SEQ ID NO: 59943 - DNA, 20 bp, synthetic construct
  misc_feature 1..20: note = CRISPR gRNA sequence
  source 1..20: mol_type = other DNA
actgaatatgcaaataggca

SEQ ID NO: 59944 - DNA, 20 bp, synthetic construct
  misc_feature 1..20: note = CRISPR gRNA sequence
  source 1..20: mol_type = other DNA
tcctgtggacacatgacaac

SEQ ID NO: 59945 - DNA, 20 bp, synthetic construct
  misc_feature 1..20: note = CRISPR gRNA sequence
  source 1..20: mol_type = other DNA
taggtgaggcaggttttgtc

SEQ ID NO: 59946 - DNA, 20 bp, synthetic construct
  misc_feature 1..20: note = CRISPR gRNA sequence
  source 1..20: mol_type = other DNA
ttttaaggtaattactataa

SEQ ID NO: 59947 - DNA, 20 bp, synthetic construct
  misc_feature 1..20: note = CRISPR gRNA sequence
  source 1..20: mol_type = other DNA
gatgaagaagctgaggcccg

SEQ ID NO: 59948 - DNA, 20 bp, synthetic construct
  misc_feature 1..20: note = CRISPR gRNA sequence
  source 1..20: mol_type = other DNA
agttaaatcccttttgagcc

SEQ ID NO: 59949 - DNA, 20 bp, synthetic construct
  misc_feature 1..20: note = CRISPR gRNA sequence
  source 1..20: mol_type = other DNA
acagacccagatgttctggg

SEQ ID NO: 59950 - DNA, 20 bp, synthetic construct
  misc_feature 1..20: note = CRISPR gRNA sequence
  source 1..20: mol_type = other DNA
agtgaggtggtaaccccaag

SEQ ID NO: 59951 - DNA, 20 bp, synthetic construct
  misc_feature 1..20: note = CRISPR gRNA sequence
  source 1..20: mol_type = other DNA
gtggtaaccccaaggagagt

SEQ ID NO: 59952 - DNA, 20 bp, synthetic construct
  misc_feature 1..20: note = CRISPR gRNA sequence
  source 1..20: mol_type = other DNA
agccatgcaggcaggttcaa

SEQ ID NO: 59953 - DNA, 20 bp, synthetic construct
  misc_feature 1..20: note = CRISPR gRNA sequence
  source 1..20: mol_type = other DNA
gggtgccctggtgaggctcc

SEQ ID NO: 59954 - DNA, 20 bp, synthetic construct
  misc_feature 1..20: note = CRISPR gRNA sequence
  source 1..20: mol_type = other DNA
ccctggtgaggctccagggg

SEQ ID NO: 59955 - DNA, 20 bp, synthetic construct
  misc_feature 1..20: note = CRISPR gRNA sequence
  source 1..20: mol_type = other DNA
ggacagggctcccaggtgcc

SEQ ID NO: 59956 - DNA, 20 bp, synthetic construct
  misc_feature 1..20: note = CRISPR gRNA sequence
  source 1..20: mol_type = other DNA
gggctcccaggtgccctgag

SEQ ID NO: 59957 - DNA, 20 bp, synthetic construct
  misc_feature 1..20: note = CRISPR gRNA sequence
  source 1..20: mol_type = other DNA
tcccaggtgccctgagttga

SEQ ID NO: 59958 - DNA, 20 bp, synthetic construct
  misc_feature 1..20: note = CRISPR gRNA sequence
  source 1..20: mol_type = other DNA
tcgttacttactgcagttcc

SEQ ID NO: 59959 - DNA, 20 bp, synthetic construct
  misc_feature 1..20: note = CRISPR gRNA sequence
  source 1..20: mol_type = other DNA
aggggtcccgggcagtcctt

SEQ ID NO: 59960 - DNA, 20 bp, synthetic construct
  misc_feature 1..20: note = CRISPR gRNA sequence
  source 1..20: mol_type = other DNA
tccttcagagtggcacagag

SEQ ID NO: 59961 - DNA, 20 bp, synthetic construct
  misc_feature 1..20: note = CRISPR gRNA sequence
  source 1..20: mol_type = other DNA
aaggggcaatgggcagggca

SEQ ID NO: 59962 - DNA, 20 bp, synthetic construct
  misc_feature 1..20: note = CRISPR gRNA sequence
  source 1..20: mol_type = other DNA
gcagggaatcagagaaagcc

SEQ ID NO: 59963 - DNA, 20 bp, synthetic construct
  misc_feature 1..20: note = CRISPR gRNA sequence
  source 1..20: mol_type = other DNA
gtggggcactcgcttccctc

SEQ ID NO: 59964 - DNA, 20 bp, synthetic construct
  misc_feature 1..20: note = CRISPR gRNA sequence
  source 1..20: mol_type = other DNA
gacagtgacagtgcaggacc

SEQ ID NO: 59965 - DNA, 20 bp, synthetic construct
  misc_feature 1..20: note = CRISPR gRNA sequence
  source 1..20: mol_type = other DNA
agagagaggtggggccaagt

SEQ ID NO: 59966 - DNA, 20 bp, synthetic construct
  misc_feature 1..20: note = CRISPR gRNA sequence
  source 1..20: mol_type = other DNA
catggcagagcttgcagatg

SEQ ID NO: 59967 - DNA, 20 bp, synthetic construct
  misc_feature 1..20: note = CRISPR gRNA sequence
  source 1..20: mol_type = other DNA
aacccctttctttctggaaa

SEQ ID NO: 59968 - DNA, 20 bp, synthetic construct
  misc_feature 1..20: note = CRISPR gRNA sequence
  source 1..20: mol_type = other DNA
gcagatggagaccccaggca

SEQ ID NO: 59969 - DNA, 20 bp, synthetic construct
  misc_feature 1..20: note = CRISPR gRNA sequence
  source 1..20: mol_type = other DNA
ctgtttgcttcacagaaatg

SEQ ID NO: 59970 - DNA, 20 bp, synthetic construct
  misc_feature 1..20: note = CRISPR gRNA sequence
  source 1..20: mol_type = other DNA
tgtggaatcttctctccaag

SEQ ID NO: 59971 - DNA, 20 bp, synthetic construct
  misc_feature 1..20: note = CRISPR gRNA sequence
  source 1..20: mol_type = other DNA
ggacagtaccagaggctcct

SEQ ID NO: 59972 - DNA, 20 bp, synthetic construct
  misc_feature 1..20: note = CRISPR gRNA sequence
  source 1..20: mol_type = other DNA
ggcccacatatccctaggag

SEQ ID NO: 59973 - DNA, 20 bp, synthetic construct
  misc_feature 1..20: note = CRISPR gRNA sequence
  source 1..20: mol_type = other DNA
agcccatatacccctaggag

SEQ ID NO: 59974 - DNA, 20 bp, synthetic construct
  misc_feature 1..20: note = CRISPR gRNA sequence
  source 1..20: mol_type = other DNA
gaggctcagggaagggaagc

SEQ ID NO: 59975 - DNA, 20 bp, synthetic construct
  misc_feature 1..20: note = CRISPR gRNA sequence
  source 1..20: mol_type = other DNA
tctttgggcctcaagaaccc

SEQ ID NO: 59976 - DNA, 20 bp, synthetic construct
  misc_feature 1..20: note = CRISPR gRNA sequence
  source 1..20: mol_type = other DNA
gcagtgacatgtatggagcg

SEQ ID NO: 59977 - DNA, 20 bp, synthetic construct
  misc_feature 1..20: note = CRISPR gRNA sequence
  source 1..20: mol_type = other DNA
ttaaacctagtgtgccggac

SEQ ID NO: 59978 - DNA, 20 bp, synthetic construct
  misc_feature 1..20: note = CRISPR gRNA sequence
  source 1..20: mol_type = other DNA
ttgggtggtttaactgagag

SEQ ID NO: 59979 - DNA, 20 bp, synthetic construct
  misc_feature 1..20: note = CRISPR gRNA sequence
  source 1..20: mol_type = other DNA
ctgagagctgagtggtcagc

SEQ ID NO: 59980 - DNA, 20 bp, synthetic construct
  misc_feature 1..20: note = CRISPR gRNA sequence
  source 1..20: mol_type = other DNA
tgagtggtcagcatgggtct

SEQ ID NO: 59981 - DNA, 20 bp, synthetic construct
  misc_feature 1..20: note = CRISPR gRNA sequence
  source 1..20: mol_type = other DNA
cttgtcttgtcccctctcag

SEQ ID NO: 59982 - DNA, 20 bp, synthetic construct
  misc_feature 1..20: note = CRISPR gRNA sequence
  source 1..20: mol_type = other DNA
tggtcagggcaaggagggcc

SEQ ID NO: 59983 - DNA, 20 bp, synthetic construct
  misc_feature 1..20: note = CRISPR gRNA sequence
  source 1..20: mol_type = other DNA
gcctgctttcttagcaaaca

SEQ ID NO: 59984 - DNA, 20 bp, synthetic construct
  misc_feature 1..20: note = CRISPR gRNA sequence
  source 1..20: mol_type = other DNA
ctttgttgttgtttcgaaga

SEQ ID NO: 59985 - DNA, 20 bp, synthetic construct
  misc_feature 1..20: note = CRISPR gRNA sequence
  source 1..20: mol_type = other DNA
ttttgtattttttgtagaga

SEQ ID NO: 59986 - DNA, 20 bp, synthetic construct
  misc_feature 1..20: note = CRISPR gRNA sequence
  source 1..20: mol_type = other DNA
gccttagcctcccaaagtgc

SEQ ID NO: 59987 - DNA, 20 bp, synthetic construct
  misc_feature 1..20: note = CRISPR gRNA sequence
  source 1..20: mol_type = other DNA
acatttttttttctttgaga

SEQ ID NO: 59988 - DNA, 20 bp, synthetic construct
  misc_feature 1..20: note = CRISPR gRNA sequence
  source 1..20: mol_type = other DNA
tcttgctctgttgcccaggc

SEQ ID NO: 59989 - DNA, 20 bp, synthetic construct
  misc_feature 1..20: note = CRISPR gRNA sequence
  source 1..20: mol_type = other DNA
ctcactgtagcctcgatctc

SEQ ID NO: 59990 - DNA, 20 bp, synthetic construct
  misc_feature 1..20: note = CRISPR gRNA sequence
  source 1..20: mol_type = other DNA
taaagtttctgtagagatgg

SEQ ID NO: 59991 - DNA, 20 bp, synthetic construct
  misc_feature 1..20: note = CRISPR gRNA sequence
  source 1..20: mol_type = other DNA
gtcttggcctcccaaagtgc

SEQ ID NO: 59992 - DNA, 20 bp, synthetic construct
  misc_feature 1..20: note = CRISPR gRNA sequence
  source 1..20: mol_type = other DNA
ctgtggcacctcccattctt

SEQ ID NO: 59993 - DNA, 20 bp, synthetic construct
  misc_feature 1..20: note = CRISPR gRNA sequence
  source 1..20: mol_type = other DNA
gcagacctcccctgaaaatc

SEQ ID NO: 59994 - DNA, 20 bp, synthetic construct
  misc_feature 1..20: note = CRISPR gRNA sequence
  source 1..20: mol_type = other DNA
aaaatcatggatgcggtgcc

SEQ ID NO: 59995 - DNA, 20 bp, synthetic construct
  misc_feature 1..20: note = CRISPR gRNA sequence
  source 1..20: mol_type = other DNA
gatgcggtgccctgagtgcc

SEQ ID NO: 59996 - DNA, 20 bp, synthetic construct
  misc_feature 1..20: note = CRISPR gRNA sequence
  source 1..20: mol_type = other DNA
cccacaattaagacaggtcc

SEQ ID NO: 59997 - DNA, 20 bp, synthetic construct
  misc_feature 1..20: note = CRISPR gRNA sequence
  source 1..20: mol_type = other DNA
ttttctttttttttttgaga

SEQ ID NO: 59998 - DNA, 20 bp, synthetic construct
  misc_feature 1..20: note = CRISPR gRNA sequence
  source 1..20: mol_type = other DNA
tctcactctgtcgcccaggc

SEQ ID NO: 59999 - DNA, 20 bp, synthetic construct
  misc_feature 1..20: note = CRISPR gRNA sequence
  source 1..20: mol_type = other DNA
ctcactgcaaccttcgcctc

SEQ ID NO: 60000 - DNA, 20 bp, synthetic construct
  misc_feature 1..20: note = CRISPR gRNA sequence
  source 1..20: mol_type = other DNA
tttggtatttttagcagaga

SEQ ID NO: 60001 - DNA, 20 bp, synthetic construct
  misc_feature 1..20: note = CRISPR gRNA sequence
  source 1..20: mol_type = other DNA
accttggcctcccaaaatgc

SEQ ID NO: 60002 - DNA, 20 bp, synthetic construct
  misc_feature 1..20: note = CRISPR gRNA sequence
  source 1..20: mol_type = other DNA
ctctaaggactatccaaaga

SEQ ID NO: 60003 - DNA, 20 bp, synthetic construct
  misc_feature 1..20: note = CRISPR gRNA sequence
  source 1..20: mol_type = other DNA
tatccaaagaacgagtgagg

SEQ ID NO: 60004 - DNA, 20 bp, synthetic construct
  misc_feature 1..20: note = CRISPR gRNA sequence
  source 1..20: mol_type = other DNA
agtcaatgaactctctaatg

SEQ ID NO: 60005 - DNA, 20 bp, synthetic construct
  misc_feature 1..20: note = CRISPR gRNA sequence
  source 1..20: mol_type = other DNA
ctggtactgcccaaggtgct

SEQ ID NO: 60006 - DNA, 20 bp, synthetic construct
  misc_feature 1..20: note = CRISPR gRNA sequence
  source 1..20: mol_type = other DNA
acgtgggagcagatgacctg

SEQ ID NO: 60007 - DNA, 20 bp, synthetic construct
  misc_feature 1..20: note = CRISPR gRNA sequence
  source 1..20: mol_type = other DNA
tccaagcggaagagccactg

SEQ ID NO: 60008 - DNA, 20 bp, synthetic construct
  misc_feature 1..20: note = CRISPR gRNA sequence
  source 1..20: mol_type = other DNA
tcactgaggctggagatcac

SEQ ID NO: 60009 - DNA, 20 bp, synthetic construct
  misc_feature 1..20: note = CRISPR gRNA sequence
  source 1..20: mol_type = other DNA
gtcagggcacagggcggggg

SEQ ID NO: 60010 - DNA, 20 bp, synthetic construct
  misc_feature 1..20: note = CRISPR gRNA sequence
  source 1..20: mol_type = other DNA
tcatggtggagatggggaaa

SEQ ID NO: 60011 - DNA, 20 bp, synthetic construct
  misc_feature 1..20: note = CRISPR gRNA sequence
  source 1..20: mol_type = other DNA
tggggaaacagagtcctaga

SEQ ID NO: 60012 - DNA, 20 bp, synthetic construct
  misc_feature 1..20: note = CRISPR gRNA sequence
  source 1..20: mol_type = other DNA
agagctgagatgggcaccca

SEQ ID NO: 60013 - DNA, 20 bp, synthetic construct
  misc_feature 1..20: note = CRISPR gRNA sequence
  source 1..20: mol_type = other DNA
agtgggtccctcggtctgtg

SEQ ID NO: 60014 - DNA, 20 bp, synthetic construct
  misc_feature 1..20: note = CRISPR gRNA sequence
  source 1..20: mol_type = other DNA
ctcggtctgtgatggatctg

SEQ ID NO: 60015 - DNA, 20 bp, synthetic construct
  misc_feature 1..20: note = CRISPR gRNA sequence
  source 1..20: mol_type = other DNA
ttttctccacctgataaggg

SEQ ID NO: 60016 - DNA, 20 bp, synthetic construct
  misc_feature 1..20: note = CRISPR gRNA sequence
  source 1..20: mol_type = other DNA
cccaggacaaaatgaaaatg

SEQ ID NO: 60017 - DNA, 20 bp, synthetic construct
  misc_feature 1..20: note = CRISPR gRNA sequence
  source 1..20: mol_type = other DNA
acaaagtgtctcctttcttt

SEQ ID NO: 60018 - DNA, 20 bp, synthetic construct
  misc_feature 1..20: note = CRISPR gRNA sequence
  source 1..20: mol_type = other DNA
cccacggggacactggtagg

SEQ ID NO: 60019 - DNA, 20 bp, synthetic construct
  misc_feature 1..20: note = CRISPR gRNA sequence
  source 1..20: mol_type = other DNA
gaccctcacagcaccaggtc

SEQ ID NO: 60020 - DNA, 20 bp, synthetic construct
  misc_feature 1..20: note = CRISPR gRNA sequence
  source 1..20: mol_type = other DNA
ttcccagcattgcacaaaaa

SEQ ID NO: 60021 - DNA, 20 bp, synthetic construct
  misc_feature 1..20: note = CRISPR gRNA sequence
  source 1..20: mol_type = other DNA
acaaaaacagggtgtgagca

SEQ ID NO: 60022 - DNA, 20 bp, synthetic construct
  misc_feature 1..20: note = CRISPR gRNA sequence
  source 1..20: mol_type = other DNA
gggaaccagggactcggaga

SEQ ID NO: 60023 - DNA, 20 bp, synthetic construct
  misc_feature 1..20: note = CRISPR gRNA sequence
  source 1..20: mol_type = other DNA
gagaggggatgtaacttgcc

SEQ ID NO: 60024 - DNA, 20 bp, synthetic construct
  misc_feature 1..20: note = CRISPR gRNA sequence
  source 1..20: mol_type = other DNA
gcgtgttcacagagacagcc

SEQ ID NO: 60025 - DNA, 20 bp, synthetic construct
  misc_feature 1..20: note = CRISPR gRNA sequence
  source 1..20: mol_type = other DNA
cccagaagtgcctgggagga

SEQ ID NO: 60026 - DNA, 20 bp, synthetic construct
  misc_feature 1..20: note = CRISPR gRNA sequence
  source 1..20: mol_type = other DNA
caaaagcaccaagggcattt

SEQ ID NO: 60027 - DNA, 20 bp, synthetic construct
  misc_feature 1..20: note = CRISPR gRNA sequence
  source 1..20: mol_type = other DNA
gtccattgcaggcaaacttt

SEQ ID NO: 60028 - DNA, 20 bp, synthetic construct
  misc_feature 1..20: note = CRISPR gRNA sequence
  source 1..20: mol_type = other DNA
acactctctgccaggtactc

SEQ ID NO: 60029 - DNA, 20 bp, synthetic construct
  misc_feature 1..20: note = CRISPR gRNA sequence
  source 1..20: mol_type = other DNA
ggcagccctgggcaccctgc

SEQ ID NO: 60030 - DNA, 20 bp, synthetic construct
  misc_feature 1..20: note = CRISPR gRNA sequence
  source 1..20: mol_type = other DNA
ccctcccggcaccccagggc

SEQ ID NO: 60031 - DNA, 20 bp, synthetic construct
  misc_feature 1..20: note = CRISPR gRNA sequence
  source 1..20: mol_type = other DNA
gcacccacacctgccctccc

SEQ ID NO: 60032 - DNA, 20 bp, synthetic construct
  misc_feature 1..20: note = CRISPR gRNA sequence
  source 1..20: mol_type = other DNA
caggttccagaagtgaaacc

SEQ ID NO: 60033 - DNA, 20 bp, synthetic construct
  misc_feature 1..20: note = CRISPR gRNA sequence
  source 1..20: mol_type = other DNA
gtgaaaccttgaatcagaag

SEQ ID NO: 60034 - DNA, 20 bp, synthetic construct
  misc_feature 1..20: note = CRISPR gRNA sequence
  source 1..20: mol_type = other DNA
ttgaatcagaagtgggatta

SEQ ID NO: 60035 - DNA, 20 bp, synthetic construct
  misc_feature 1..20: note = CRISPR gRNA sequence
  source 1..20: mol_type = other DNA
attattgagtcacagactct

SEQ ID NO: 60036 - DNA, 20 bp, synthetic construct
  misc_feature 1..20: note = CRISPR gRNA sequence
  source 1..20: mol_type = other DNA
gagtcacagactctctgagt

SEQ ID NO: 60037 - DNA, 20 bp, synthetic construct
  misc_feature 1..20: note = CRISPR gRNA sequence
  source 1..20: mol_type = other DNA
acaataaccccaggaaagag

SEQ ID NO: 60038 - DNA, 20 bp, synthetic construct
  misc_feature 1..20: note = CRISPR gRNA sequence
  source 1..20: mol_type = other DNA
ggaaagagggggatgggaca

SEQ ID NO: 60039 - DNA, 20 bp, synthetic construct
  misc_feature 1..20: note = CRISPR gRNA sequence
  source 1..20: mol_type = other DNA
agagcattgcctgagaagct

SEQ ID NO: 60040 - DNA, 20 bp, synthetic construct
  misc_feature 1..20: note = CRISPR gRNA sequence
  source 1..20: mol_type = other DNA
ggggagaacattagcaggtg

SEQ ID NO: 60041 - DNA, 20 bp, synthetic construct
  misc_feature 1..20: note = CRISPR gRNA sequence
  source 1..20: mol_type = other DNA
agaacattagcaggtgggga

SEQ ID NO: 60042 - DNA, 20 bp, synthetic construct
  misc_feature 1..20: note = CRISPR gRNA sequence
  source 1..20: mol_type = other DNA
gcagatctggcacgggcagc

SEQ ID NO: 60043 - DNA, 20 bp, synthetic construct
  misc_feature 1..20: note = CRISPR gRNA sequence
  source 1..20: mol_type = other DNA
tcgtggacctctgagggacc

SEQ ID NO: 60044 - DNA, 20 bp, synthetic construct
  misc_feature 1..20: note = CRISPR gRNA sequence
  source 1..20: mol_type = other DNA
ctccgagcgtgtcagacatg

SEQ ID NO: 60045 - DNA, 20 bp, synthetic construct
  misc_feature 1..20: note = CRISPR gRNA sequence
  source 1..20: mol_type = other DNA
gggatctgtatcttgggagg

SEQ ID NO: 60046 - DNA, 20 bp, synthetic construct
  misc_feature 1..20: note = CRISPR gRNA sequence
  source 1..20: mol_type = other DNA
aactttcaccagattctcca

SEQ ID NO: 60047 - DNA, 20 bp, synthetic construct
  misc_feature 1..20: note = CRISPR gRNA sequence
  source 1..20: mol_type = other DNA
accccccagacacagaggca

SEQ ID NO: 60048 - DNA, 20 bp, synthetic construct
  misc_feature 1..20: note = CRISPR gRNA sequence
  source 1..20: mol_type = other DNA
gcttgcaggagaggagggac

SEQ ID NO: 60049 - DNA, 20 bp, synthetic construct
  misc_feature 1..20: note = CRISPR gRNA sequence
  source 1..20: mol_type = other DNA
accaacacacacgacaccca

SEQ ID NO: 60050 - DNA, 20 bp, synthetic construct
  misc_feature 1..20: note = CRISPR gRNA sequence
  source 1..20: mol_type = other DNA
caggatgtcacatataggca

SEQ ID NO: 60051 - DNA, 20 bp, synthetic construct
  misc_feature 1..20: note = CRISPR gRNA sequence
  source 1..20: mol_type = other DNA
agaccaagagagaagggggg

SEQ ID NO: 60052 - DNA, 20 bp, synthetic construct
  misc_feature 1..20: note = CRISPR gRNA sequence
  source 1..20: mol_type = other DNA
gagcccccaggcccaggcac

SEQ ID NO: 60053 - DNA, 20 bp, synthetic construct
  misc_feature 1..20: note = CRISPR gRNA sequence
  source 1..20: mol_type = other DNA
tgctccccttcacctctttt

SEQ ID NO: 60054 - DNA, 20 bp, synthetic construct
  misc_feature 1..20: note = CRISPR gRNA sequence
  source 1..20: mol_type = other DNA
tccacaacccctcagctgct

SEQ ID NO: 60055 - DNA, 20 bp, synthetic construct
  misc_feature 1..20: note = CRISPR gRNA sequence
  source 1..20: mol_type = other DNA
ctgggggtcagggagctaag

SEQ ID NO: 60056 - DNA, 20 bp, synthetic construct
  misc_feature 1..20: note = CRISPR gRNA sequence
  source 1..20: mol_type = other DNA
ggtcagggagctaaggggag

SEQ ID NO: 60057 - DNA, 20 bp, synthetic construct
  misc_feature 1..20: note = CRISPR gRNA sequence
  source 1..20: mol_type = other DNA
gctgccttgtgagccctgtc

SEQ ID NO: 60058 - DNA, 20 bp, synthetic construct
  misc_feature 1..20: note = CRISPR gRNA sequence
  source 1..20: mol_type = other DNA
agcaggggaagggagggggc

SEQ ID NO: 60059 - DNA, 20 bp, synthetic construct
  misc_feature 1..20: note = CRISPR gRNA sequence
  source 1..20: mol_type = other DNA
aaggccatgtccgccatctc

SEQ ID NO: 60060 - DNA, 20 bp, synthetic construct
  misc_feature 1..20: note = CRISPR gRNA sequence
  source 1..20: mol_type = other DNA
atcgagccctatcctccacc

SEQ ID NO: 60061 - DNA, 20 bp, synthetic construct
  misc_feature 1..20: note = CRISPR gRNA sequence
  source 1..20: mol_type = other DNA
tcagagatgtcagccccagc

SEQ ID NO: 60062 - DNA, 20 bp, synthetic construct
  misc_feature 1..20: note = CRISPR gRNA sequence
  source 1..20: mol_type = other DNA
cagactctacagaagagatt

SEQ ID NO: 60063 - DNA, 20 bp, synthetic construct
  misc_feature 1..20: note = CRISPR gRNA sequence
  source 1..20: mol_type = other DNA
tgggctccgggagcaaagag

SEQ ID NO: 60064 - DNA, 20 bp, synthetic construct
  misc_feature 1..20: note = CRISPR gRNA sequence
  source 1..20: mol_type = other DNA
tggggcaatccaggacccta

SEQ ID NO: 60065 - DNA, 20 bp, synthetic construct
  misc_feature 1..20: note = CRISPR gRNA sequence
  source 1..20: mol_type = other DNA
ctaatgggtccttgtgtgaa

SEQ ID NO: 60066 - DNA, 20 bp, synthetic construct
  misc_feature 1..20: note = CRISPR gRNA sequence
  source 1..20: mol_type = other DNA
gctacaggccaggcaatccc

SEQ ID NO: 60067 - DNA, 20 bp, synthetic construct
  misc_feature 1..20: note = CRISPR gRNA sequence
  source 1..20: mol_type = other DNA
gctggagggctctagtctcc

SEQ ID NO: 60068 - DNA, 20 bp, synthetic construct
  misc_feature 1..20: note = CRISPR gRNA sequence
  source 1..20: mol_type = other DNA
ccatgagaggcggaggtggt

SEQ ID NO: 60069 - DNA, 20 bp, synthetic construct
  misc_feature 1..20: note = CRISPR gRNA sequence
  source 1..20: mol_type = other DNA
tgctcacttcccgctcttcc

SEQ ID NO: 60070 - DNA, 20 bp, synthetic construct
  misc_feature 1..20: note = CRISPR gRNA sequence
  source 1..20: mol_type = other DNA
actggcactgcccagctgtg

SEQ ID NO: 60071 - DNA, 20 bp, synthetic construct
  misc_feature 1..20: note = CRISPR gRNA sequence
  source 1..20: mol_type = other DNA
cagctgtggagggtagagag

SEQ ID NO: 60072 - DNA, 20 bp, synthetic construct
  misc_feature 1..20: note = CRISPR gRNA sequence
  source 1..20: mol_type = other DNA
ggaatgtccctgactgagca

SEQ ID NO: 60073 - DNA, 20 bp, synthetic construct
  misc_feature 1..20: note = CRISPR gRNA sequence
  source 1..20: mol_type = other DNA
tccctgactgagcatggagt

SEQ ID NO: 60074 - DNA, 20 bp, synthetic construct
  misc_feature 1..20: note = CRISPR gRNA sequence
  source 1..20: mol_type = other DNA
gcaggctgtgaagacaaaag

SEQ ID NO: 60075 - DNA, 20 bp, synthetic construct
  misc_feature 1..20: note = CRISPR gRNA sequence
  source 1..20: mol_type = other DNA
aatcctcccacttcagcctc

SEQ ID NO: 60076 - DNA, 20 bp, synthetic construct
  misc_feature 1..20: note = CRISPR gRNA sequence
  source 1..20: mol_type = other DNA
acttcagcctcctgagtagc

SEQ ID NO: 60077 - DNA, 20 bp, synthetic construct
  misc_feature 1..20: note = CRISPR gRNA sequence
  source 1..20: mol_type = other DNA
acctttgcttcccaaagtgc

SEQ ID NO: 60078 - DNA, 20 bp, synthetic construct
  misc_feature 1..20: note = CRISPR gRNA sequence
  source 1..20: mol_type = other DNA
tgtctgtgctcaaagtatgt

SEQ ID NO: 60079 - DNA, 20 bp, synthetic construct
  misc_feature 1..20: note = CRISPR gRNA sequence
  source 1..20: mol_type = other DNA
ggattacccctggtaacctt

SEQ ID NO: 60080 - DNA, 20 bp, synthetic construct
  misc_feature 1..20: note = CRISPR gRNA sequence
  source 1..20: mol_type = other DNA
tacccctggtaacctttgga

SEQ ID NO: 60081 - DNA, 20 bp, synthetic construct
  misc_feature 1..20: note = CRISPR gRNA sequence
  source 1..20: mol_type = other DNA
taatttttgttttacaaaca

SEQ ID NO: 60082 - DNA, 20 bp, synthetic construct
  misc_feature 1..20: note = CRISPR gRNA sequence
  source 1..20: mol_type = other DNA
gttttttaagggctagaagc

SEQ ID NO: 60083 - DNA, 20 bp, synthetic construct
  misc_feature 1..20: note = CRISPR gRNA sequence
  source 1..20: mol_type = other DNA
tttttttttttaatttgaga

SEQ ID NO: 60084 - DNA, 20 bp, synthetic construct
  misc_feature 1..20: note = CRISPR gRNA sequence
  source 1..20: mol_type = other DNA
tcttgctctgtctcccaggc

SEQ ID NO: 60085 - DNA, 20 bp, synthetic construct
  misc_feature 1..20: note = CRISPR gRNA sequence
  source 1..20: mol_type = other DNA
gattctcctgcctcagcctc

SEQ ID NO: 60086 - DNA, 20 bp, synthetic construct
  misc_feature 1..20: note = CRISPR gRNA sequence
  source 1..20: mol_type = other DNA
gcctcagcctcctgagtagc

SEQ ID NO: 60087 - DNA, 20 bp, synthetic construct
  misc_feature 1..20: note = CRISPR gRNA sequence
  source 1..20: mol_type = other DNA
ttttgtatttttagtagaga

SEQ ID NO: 60088 - DNA, 20 bp, synthetic construct
  misc_feature 1..20: note = CRISPR gRNA sequence
  source 1..20: mol_type = other DNA
tgcctcagcctcccaaagtg

SEQ ID NO: 60089 - DNA, 20 bp, synthetic construct
  misc_feature 1..20: note = CRISPR gRNA sequence
  source 1..20: mol_type = other DNA
ttttataatcttttaagata

SEQ ID NO: 60090 - DNA, 20 bp, synthetic construct
  misc_feature 1..20: note = CRISPR gRNA sequence
  source 1..20: mol_type = other DNA
tctttgggaggccagggcag

SEQ ID NO: 60091 - DNA, 20 bp, synthetic construct
  misc_feature 1..20: note = CRISPR gRNA sequence
  source 1..20: mol_type = other DNA
caggaggatcacatgagctc

SEQ ID NO: 60092 - DNA, 20 bp, synthetic construct
  misc_feature 1..20: note = CRISPR gRNA sequence
  source 1..20: mol_type = other DNA
actttgggagactaagagag

SEQ ID NO: 60093 - DNA, 20 bp, synthetic construct
  misc_feature 1..20: note = CRISPR gRNA sequence
  source 1..20: mol_type = other DNA
gagagatggattgctgagcc

SEQ ID NO: 60094 - DNA, 20 bp, synthetic construct
  misc_feature 1..20: note = CRISPR gRNA sequence
  source 1..20: mol_type = other DNA
tttttttttctatggttcca

SEQ ID NO: 60095 - DNA, 20 bp, synthetic construct
  misc_feature 1..20: note = CRISPR gRNA sequence
  source 1..20: mol_type = other DNA
gaagtgaacagggcatcgct

SEQ ID NO: 60096 - DNA, 20 bp, synthetic construct
  misc_feature 1..20: note = CRISPR gRNA sequence
  source 1..20: mol_type = other DNA
aatgcactagggacccttta

SEQ ID NO: 60097 - DNA, 20 bp, synthetic construct
  misc_feature 1..20: note = CRISPR gRNA sequence
  source 1..20: mol_type = other DNA
aaggtcccctaatctacctt

SEQ ID NO: 60098 - DNA, 20 bp, synthetic construct
  misc_feature 1..20: note = CRISPR gRNA sequence
  source 1..20: mol_type = other DNA
tcccctaatctaccttttgg

SEQ ID NO: 60099 - DNA, 20 bp, synthetic construct
  misc_feature 1..20: note = CRISPR gRNA sequence
  source 1..20: mol_type = other DNA
ggtttccctctcctcccttg

SEQ ID NO: 60100 - DNA, 20 bp, synthetic construct
  misc_feature 1..20: note = CRISPR gRNA sequence
  source 1..20: mol_type = other DNA
ttaaagcagggaccacccta

SEQ ID NO: 60101 - DNA, 20 bp, synthetic construct
  misc_feature 1..20: note = CRISPR gRNA sequence
  source 1..20: mol_type = other DNA
agggaccaccctactgggtt

SEQ ID NO: 60102 - DNA, 20 bp, synthetic construct
  misc_feature 1..20: note = CRISPR gRNA sequence
  source 1..20: mol_type = other DNA
gttgagaatgaggctttcct

SEQ ID NO: 60103 - DNA, 20 bp, synthetic construct
  misc_feature 1..20: note = CRISPR gRNA sequence
  source 1..20: mol_type = other DNA
ggctttcctccgagtgggaa

SEQ ID NO: 60104 - DNA, 20 bp, synthetic construct
  misc_feature 1..20: note = CRISPR gRNA sequence
  source 1..20: mol_type = other DNA
aacggcgagacttacagaaa

SEQ ID NO: 60105 - DNA, 20 bp, synthetic construct
  misc_feature 1..20: note = CRISPR gRNA sequence
  source 1..20: mol_type = other DNA
cgagacttacagaaatagga

SEQ ID NO: 60106 - DNA, 20 bp, synthetic construct
  misc_feature 1..20: note = CRISPR gRNA sequence
  source 1..20: mol_type = other DNA
gggttccctagtggcagagc

SEQ ID NO: 60107 - DNA, 20 bp, synthetic construct
  misc_feature 1..20: note = CRISPR gRNA sequence
  source 1..20: mol_type = other DNA
tagtggcagagcctgggtct

SEQ ID NO: 60108 - DNA, 20 bp, synthetic construct
  misc_feature 1..20: note = CRISPR gRNA sequence
  source 1..20: mol_type = other DNA
gcagagcctgggtctgtgag

SEQ ID NO: 60109 - DNA, 20 bp, synthetic construct
  misc_feature 1..20: note = CRISPR gRNA sequence
  source 1..20: mol_type = other DNA
ctgggtctgtgagtggggta

SEQ ID NO: 60110 - DNA, 20 bp, synthetic construct
  misc_feature 1..20: note = CRISPR gRNA sequence
  source 1..20: mol_type = other DNA
cagggagctttgtcccactg

SEQ ID NO: 60111 - DNA, 20 bp, synthetic construct
  misc_feature 1..20: note = CRISPR gRNA sequence
  source 1..20: mol_type = other DNA
ccactggagagtttgggctg

SEQ ID NO: 60112 - DNA, 20 bp, synthetic construct
  misc_feature 1..20: note = CRISPR gRNA sequence
  source 1..20: mol_type = other DNA
actctaggttaggggaaagt

SEQ ID NO: 60113 - DNA, 20 bp, synthetic construct
  misc_feature 1..20: note = CRISPR gRNA sequence
  source 1..20: mol_type = other DNA
gtctctggttcttatcagcc

SEQ ID NO: 60114 - DNA, 20 bp, synthetic construct
  misc_feature 1..20: note = CRISPR gRNA sequence
  source 1..20: mol_type = other DNA
tatccacagcagctaggaag

SEQ ID NO: 60115 - DNA, 20 bp, synthetic construct
  misc_feature 1..20: note = CRISPR gRNA sequence
  source 1..20: mol_type = other DNA
aagaggggtgccggctgtaa

SEQ ID NO: 60116 - DNA, 20 bp, synthetic construct
  misc_feature 1..20: note = CRISPR gRNA sequence
  source 1..20: mol_type = other DNA
ggtgccggctgtaacggggt

SEQ ID NO: 60117 - DNA, 20 bp, synthetic construct
  misc_feature 1..20: note = CRISPR gRNA sequence
  source 1..20: mol_type = other DNA
tcccaaggcctgggcccaga

SEQ ID NO: 60118 - DNA, 20 bp, synthetic construct
  misc_feature 1..20: note = CRISPR gRNA sequence
  source 1..20: mol_type = other DNA
agagagagcatgatgggggg

SEQ ID NO: 60119 - DNA, 20 bp, synthetic construct
  misc_feature 1..20: note = CRISPR gRNA sequence
  source 1..20: mol_type = other DNA
agagcatgatgggggggggg

SEQ ID NO: 60120 - DNA, 20 bp, synthetic construct
  misc_feature 1..20: note = CRISPR gRNA sequence
  source 1..20: mol_type = other DNA
cacctgatgtgcagctctgc

SEQ ID NO: 60121 - DNA, 20 bp, synthetic construct
  misc_feature 1..20: note = CRISPR gRNA sequence
  source 1..20: mol_type = other DNA
cagcttgctggctgtcactc

SEQ ID NO: 60122 - DNA, 20 bp, synthetic construct
  misc_feature 1..20: note = CRISPR gRNA sequence
  source 1..20: mol_type = other DNA
atgtcctaggtcccttgcca

SEQ ID NO: 60123 - DNA, 20 bp, synthetic construct
  misc_feature 1..20: note = CRISPR gRNA sequence
  source 1..20: mol_type = other DNA
tcccttgccaggggatctca

SEQ ID NO: 60124 - DNA, 20 bp, synthetic construct
  misc_feature 1..20: note = CRISPR gRNA sequence
  source 1..20: mol_type = other DNA
ctcaaaggattctggtgcgt

SEQ ID NO: 60125 - DNA, 20 bp, synthetic construct
  misc_feature 1..20: note = CRISPR gRNA sequence
  source 1..20: mol_type = other DNA
gctccagggcagctacaaag

SEQ ID NO: 60126 - DNA, 20 bp, synthetic construct
  misc_feature 1..20: note = CRISPR gRNA sequence
  source 1..20: mol_type = other DNA
gggcagctacaaagatgaat

SEQ ID NO: 60127 - DNA, 20 bp, synthetic construct
  misc_feature 1..20: note = CRISPR gRNA sequence
  source 1..20: mol_type = other DNA
tgaacgcattttacacatgt

SEQ ID NO: 60128 - DNA, 20 bp, synthetic construct
  misc_feature 1..20: note = CRISPR gRNA sequence
  source 1..20: mol_type = other DNA
tcaaaccatcttgactttgc

SEQ ID NO: 60129 - DNA, 20 bp, synthetic construct
  misc_feature 1..20: note = CRISPR gRNA sequence
  source 1..20: mol_type = other DNA
tgctggagttgggaggaagc

SEQ ID NO: 60130 - DNA, 20 bp, synthetic construct
  misc_feature 1..20: note = CRISPR gRNA sequence
  source 1..20: mol_type = other DNA
gggaggaagcaggggtggca

SEQ ID NO: 60131 - DNA, 20 bp, synthetic construct
  misc_feature 1..20: note = CRISPR gRNA sequence
  source 1..20: mol_type = other DNA
ccttccctggtacccagcgg

SEQ ID NO: 60132 - DNA, 20 bp, synthetic construct
  misc_feature 1..20: note = CRISPR gRNA sequence
  source 1..20: mol_type = other DNA
gcttcctggcgatgtgcagc

SEQ ID NO: 60133 - DNA, 20 bp, synthetic construct
  misc_feature 1..20: note = CRISPR gRNA sequence
  source 1..20: mol_type = other DNA
aatgcactgtattgtggggc

SEQ ID NO: 60134 - DNA, 20 bp, synthetic construct
  misc_feature 1..20: note = CRISPR gRNA sequence
  source 1..20: mol_type = other DNA
ttagtcaaagtgtcactctc

SEQ ID NO: 60135 - DNA, 20 bp, synthetic construct
  misc_feature 1..20: note = CRISPR gRNA sequence
  source 1..20: mol_type = other DNA
taattatcctcaccttactg

SEQ ID NO: 60136 - DNA, 20 bp, synthetic construct
  misc_feature 1..20: note = CRISPR gRNA sequence
  source 1..20: mol_type = other DNA
ctgatgagtaaactcaagtg

SEQ ID NO: 60137 - DNA, 20 bp, synthetic construct
  misc_feature 1..20: note = CRISPR gRNA sequence
  source 1..20: mol_type = other DNA
aagtgcagagtggttaagtg

SEQ ID NO: 60138 - DNA, 20 bp, synthetic construct
  misc_feature 1..20: note = CRISPR gRNA sequence
  source 1..20: mol_type = other DNA
gcacttgctcgagggagaac

SEQ ID NO: 60139 - DNA, 20 bp, synthetic construct
  misc_feature 1..20: note = CRISPR gRNA sequence
  source 1..20: mol_type = other DNA
gggggcatctgacctagtct

SEQ ID NO: 60140 - DNA, 20 bp, synthetic construct
  misc_feature 1..20: note = CRISPR gRNA sequence
  source 1..20: mol_type = other DNA
tctgacctagtctgggagtc

SEQ ID NO: 60141 - DNA, 20 bp, synthetic construct
  misc_feature 1..20: note = CRISPR gRNA sequence
  source 1..20: mol_type = other DNA
agctacttgctgaaataact

SEQ ID NO: 60142 - DNA, 20 bp, synthetic construct
  misc_feature 1..20: note = CRISPR gRNA sequence
  source 1..20: mol_type = other DNA
ggttgggggagagatggagg

SEQ ID NO: 60143 - DNA, 20 bp, synthetic construct
  misc_feature 1..20: note = CRISPR gRNA sequence
  source 1..20: mol_type = other DNA
ctgaaagagagccagtgtgt

SEQ ID NO: 60144 - DNA, 20 bp, synthetic construct
  misc_feature 1..20: note = CRISPR gRNA sequence
  source 1..20: mol_type = other DNA
cagtgtgtctggattggaga

SEQ ID NO: 60145 - DNA, 20 bp, synthetic construct
  misc_feature 1..20: note = CRISPR gRNA sequence
  source 1..20: mol_type = other DNA
ctggattggagattgagtgg

SEQ ID NO: 60146 - DNA, 20 bp, synthetic construct
  misc_feature 1..20: note = CRISPR gRNA sequence
  source 1..20: mol_type = other DNA
ttggagattgagtggaagga

SEQ ID NO: 60147 - DNA, 20 bp, synthetic construct
  misc_feature 1..20: note = CRISPR gRNA sequence
  source 1..20: mol_type = other DNA
agtggaaggatggggtcaga

SEQ ID NO: 60148 - DNA, 20 bp, synthetic construct
  misc_feature 1..20: note = CRISPR gRNA sequence
  source 1..20: mol_type = other DNA
ggggtttaggaggctggggg

SEQ ID NO: 60149 - DNA, 20 bp, synthetic construct
  misc_feature 1..20: note = CRISPR gRNA sequence
  source 1..20: mol_type = other DNA
ggcagggttctggaccacct

SEQ ID NO: 60150 - DNA, 20 bp, synthetic construct
  misc_feature 1..20: note = CRISPR gRNA sequence
  source 1..20: mol_type = other DNA
ttctggaccacctgggagtt

SEQ ID NO: 60151 - DNA, 20 bp, synthetic construct
  misc_feature 1..20: note = CRISPR gRNA sequence
  source 1..20: mol_type = other DNA
accacctgggagtttagaat

SEQ ID NO: 60152 - DNA, 20 bp, synthetic construct
  misc_feature 1..20: note = CRISPR gRNA sequence
  source 1..20: mol_type = other DNA
ttttatcctgagcagtggga

SEQ ID NO: 60153 - DNA, 20 bp, synthetic construct
  misc_feature 1..20: note = CRISPR gRNA sequence
  source 1..20: mol_type = other DNA
ctctgccaggtggaagtggc

SEQ ID NO: 60154 - DNA, 20 bp, synthetic construct
  misc_feature 1..20: note = CRISPR gRNA sequence
  source 1..20: mol_type = other DNA
cagcaaggaaggcaaggcga

SEQ ID NO: 60155 - DNA, 20 bp, synthetic construct
  misc_feature 1..20: note = CRISPR gRNA sequence
  source 1..20: mol_type = other DNA
gggtcatccaggtaagagat

SEQ ID NO: 60156 - DNA, 20 bp, synthetic construct
  misc_feature 1..20: note = CRISPR gRNA sequence
  source 1..20: mol_type = other DNA
catccaggtaagagatgagg

SEQ ID NO: 60157 - DNA, 20 bp, synthetic construct
  misc_feature 1..20: note = CRISPR gRNA sequence
  source 1..20: mol_type = other DNA
actagaaaggtggaggaaaa

SEQ ID NO: 60158 - DNA, 20 bp, synthetic construct
  misc_feature 1..20: note = CRISPR gRNA sequence
  source 1..20: mol_type = other DNA
ggaggtggctgcgtaaccag

SEQ ID NO: 60159 - DNA, 20 bp, synthetic construct
  misc_feature 1..20: note = CRISPR gRNA sequence
  source 1..20: mol_type = other DNA
tctcccaatgggacgaggtc

SEQ ID NO: 60160 - DNA, 20 bp, synthetic construct
  misc_feature 1..20: note = CRISPR gRNA sequence
  source 1..20: mol_type = other DNA
tcctggaggggcgcccctcc

SEQ ID NO: 60161 - DNA, 20 bp, synthetic construct
  misc_feature 1..20: note = CRISPR gRNA sequence
  source 1..20: mol_type = other DNA
agccaggggctggacgccat

SEQ ID NO: 60162 - DNA, 20 bp, synthetic construct
  misc_feature 1..20: note = CRISPR gRNA sequence
  source 1..20: mol_type = other DNA
atcccactctactctgggag

SEQ ID NO: 60163 - DNA, 20 bp, synthetic construct
  misc_feature 1..20: note = CRISPR gRNA sequence
  source 1..20: mol_type = other DNA
tactctgggagaaggatgaa

SEQ ID NO: 60164 - DNA, 20 bp, synthetic construct
  misc_feature 1..20: note = CRISPR gRNA sequence
  source 1..20: mol_type = other DNA
gaaggcagacccaggtgtgg

SEQ ID NO: 60165 - DNA, 20 bp, synthetic construct
  misc_feature 1..20: note = CRISPR gRNA sequence
  source 1..20: mol_type = other DNA
agagaggtagcagtggttat

SEQ ID NO: 60166 - DNA, 20 bp, synthetic construct
  misc_feature 1..20: note = CRISPR gRNA sequence
  source 1..20: mol_type = other DNA
gcttacatcacagagatgtg

SEQ ID NO: 60167 - DNA, 20 bp, synthetic construct
  misc_feature 1..20: note = CRISPR gRNA sequence
  source 1..20: mol_type = other DNA
acatcacagagatgtgagga

SEQ ID NO: 60168 - DNA, 20 bp, synthetic construct
  misc_feature 1..20: note = CRISPR gRNA sequence
  source 1..20: mol_type = other DNA
cacctgacccgggacaagtg

SEQ ID NO: 60169 - DNA, 20 bp, synthetic construct
  misc_feature 1..20: note = CRISPR gRNA sequence
  source 1..20: mol_type = other DNA
gagctgacacttctgcagcc

SEQ ID NO: 60170 - DNA, 20 bp, synthetic construct
  misc_feature 1..20: note = CRISPR gRNA sequence
  source 1..20: mol_type = other DNA
acacttctgcagccttgggt

SEQ ID NO: 60171 - DNA, 20 bp, synthetic construct
  misc_feature 1..20: note = CRISPR gRNA sequence
  source 1..20: mol_type = other DNA
cctccagcttccaatgctgg

SEQ ID NO: 60172 - DNA, 20 bp, synthetic construct
  misc_feature 1..20: note = CRISPR gRNA sequence
  source 1..20: mol_type = other DNA
gagtcagggggcccacagac

SEQ ID NO: 60173 - DNA, 20 bp, synthetic construct
  misc_feature 1..20: note = CRISPR gRNA sequence
  source 1..20: mol_type = other DNA
ctagccacacctcttagtag

SEQ ID NO: 60174 - DNA, 20 bp, synthetic construct
  misc_feature 1..20: note = CRISPR gRNA sequence
  source 1..20: mol_type = other DNA
agtttcctcctccctcaaag

SEQ ID NO: 60175 - DNA, 20 bp, synthetic construct
  misc_feature 1..20: note = CRISPR gRNA sequence
  source 1..20: mol_type = other DNA
gtacttcacagagattctaa

SEQ ID NO: 60176 - DNA, 20 bp, synthetic construct
  misc_feature 1..20: note = CRISPR gRNA sequence
  source 1..20: mol_type = other DNA
aaaggaattacagtgaggta

SEQ ID NO: 60177 - DNA, 20 bp, synthetic construct
  misc_feature 1..20: note = CRISPR gRNA sequence
  source 1..20: mol_type = other DNA
cagatgctccttattcaagc

SEQ ID NO: 60178 - DNA, 20 bp, synthetic construct
  misc_feature 1..20: note = CRISPR gRNA sequence
  source 1..20: mol_type = other DNA
tcaagccaggatgggctatc

SEQ ID NO: 60179 - DNA, 20 bp, synthetic construct
  misc_feature 1..20: note = CRISPR gRNA sequence
  source 1..20: mol_type = other DNA
gctcaggcatctagggcctg

SEQ ID NO: 60180 - DNA, 20 bp, synthetic construct
  misc_feature 1..20: note = CRISPR gRNA sequence
  source 1..20: mol_type = other DNA
accctgaagcacaacccaaa

SEQ ID NO: 60181 - DNA, 20 bp, synthetic construct
  misc_feature 1..20: note = CRISPR gRNA sequence
  source 1..20: mol_type = other DNA
tcccttttctcttttctaaa

SEQ ID NO: 60182 - DNA, 20 bp, synthetic construct
  misc_feature 1..20: note = CRISPR gRNA sequence
  source 1..20: mol_type = other DNA
atctagcacataggtacctg

SEQ ID NO: 60183 - DNA, 20 bp, synthetic construct
  misc_feature 1..20: note = CRISPR gRNA sequence
  source 1..20: mol_type = other DNA
gcacataggtacctgaagga

SEQ ID NO: 60184 - DNA, 20 bp, synthetic construct
  misc_feature 1..20: note = CRISPR gRNA sequence
  source 1..20: mol_type = other DNA
tgatgtgatggtctccattt

SEQ ID NO: 60185 - DNA, 20 bp, synthetic construct
  misc_feature 1..20: note = CRISPR gRNA sequence
  source 1..20: mol_type = other DNA
aggagcatgagctgtatgca

SEQ ID NO: 60186 - DNA, 20 bp, synthetic construct
  misc_feature 1..20: note = CRISPR gRNA sequence
  source 1..20: mol_type = other DNA
actgggctgagggagcgtta

SEQ ID NO: 60187 - DNA, 20 bp, synthetic construct
  misc_feature 1..20: note = CRISPR gRNA sequence
  source 1..20: mol_type = other DNA
agccaggtttcacagacttt

SEQ ID NO: 60188 - DNA, 20 bp, synthetic construct
  misc_feature 1..20: note = CRISPR gRNA sequence
  source 1..20: mol_type = other DNA
catttttttttttttagaga

SEQ ID NO: 60189 - DNA, 20 bp, synthetic construct
  misc_feature 1..20: note = CRISPR gRNA sequence
  source 1..20: mol_type = other DNA
gtcccactcagtccccaagc

SEQ ID NO: 60190 - DNA, 20 bp, synthetic construct
  misc_feature 1..20: note = CRISPR gRNA sequence
  source 1..20: mol_type = other DNA
gatcctcccaccttggcttc

SEQ ID NO: 60191 - DNA, 20 bp, synthetic construct
  misc_feature 1..20: note = CRISPR gRNA sequence
  source 1..20: mol_type = other DNA
tcctgagtaactggtactat

SEQ ID NO: 60192 - DNA, 20 bp, synthetic construct
  misc_feature 1..20: note = CRISPR gRNA sequence
  source 1..20: mol_type = other DNA
gagtaactggtactatagga

SEQ ID NO: 60193 - DNA, 20 bp, synthetic construct
  misc_feature 1..20: note = CRISPR gRNA sequence
  source 1..20: mol_type = other DNA
ttttttttttttgtagagat

SEQ ID NO: 60194 - DNA, 20 bp, synthetic construct
  misc_feature 1..20: note = CRISPR gRNA sequence
  source 1..20: mol_type = other DNA
ccctcagcctctcaaagtgc

SEQ ID NO: 60195 - DNA, 20 bp, synthetic construct
  misc_feature 1..20: note = CRISPR gRNA sequence
  source 1..20: mol_type = other DNA
agaaagtgacactggtccta

SEQ ID NO: 60196 - DNA, 20 bp, synthetic construct
  misc_feature 1..20: note = CRISPR gRNA sequence
  source 1..20: mol_type = other DNA
tagtgggtcattttttgaga

SEQ ID NO: 60197 - DNA, 20 bp, synthetic construct
  misc_feature 1..20: note = CRISPR gRNA sequence
  source 1..20: mol_type = other DNA
tccctctctgtcacccaggc

SEQ ID NO: 60198 - DNA, 20 bp, synthetic construct
  misc_feature 1..20: note = CRISPR gRNA sequence
  source 1..20: mol_type = other DNA
atcctcccaacgtcagcatc

SEQ ID NO: 60199 - DNA, 20 bp, synthetic construct
  misc_feature 1..20: note = CRISPR gRNA sequence
  source 1..20: mol_type = other DNA
ctgccttttttttttagaga

SEQ ID NO: 60200 - DNA, 20 bp, synthetic construct
  misc_feature 1..20: note = CRISPR gRNA sequence
  source 1..20: mol_type = other DNA
ccaggctggtcttgaacacc

SEQ ID NO: 60201 - DNA, 20 bp, synthetic construct
  misc_feature 1..20: note = CRISPR gRNA sequence
  source 1..20: mol_type = other DNA
tgcttggcgttccaaagtgc

SEQ ID NO: 60202 - DNA, 20 bp, synthetic construct
  misc_feature 1..20: note = CRISPR gRNA sequence
  source 1..20: mol_type = other DNA
accaggtcattatacaagca

SEQ ID NO: 60203 - DNA, 20 bp, synthetic construct
  misc_feature 1..20: note = CRISPR gRNA sequence
  source 1..20: mol_type = other DNA
gggcatacatacatctgtct

SEQ ID NO: 60204 - DNA, 20 bp, synthetic construct
  misc_feature 1..20: note = CRISPR gRNA sequence
  source 1..20: mol_type = other DNA
aaagtgtggtagagcacagt

SEQ ID NO: 60205 - DNA, 20 bp, synthetic construct
  misc_feature 1..20: note = CRISPR gRNA sequence
  source 1..20: mol_type = other DNA
ccatccaagactggccaagc

SEQ ID NO: 60206 - DNA, 20 bp, synthetic construct
  misc_feature 1..20: note = CRISPR gRNA sequence
  source 1..20: mol_type = other DNA
agctggaatccatgcacagc

SEQ ID NO: 60207 - DNA, 20 bp, synthetic construct
  misc_feature 1..20: note = CRISPR gRNA sequence
  source 1..20: mol_type = other DNA
ttcagttgtaagggcttttc

SEQ ID NO: 60208 - DNA, 20 bp, synthetic construct
  misc_feature 1..20: note = CRISPR gRNA sequence
  source 1..20: mol_type = other DNA
agtatctttatgttctcccc

SEQ ID NO: 60209 - DNA, 20 bp, synthetic construct
  misc_feature 1..20: note = CRISPR gRNA sequence
  source 1..20: mol_type = other DNA
ccccaagggtttgccttcct

SEQ ID NO: 60210 - DNA, 20 bp, synthetic construct
  misc_feature 1..20: note = CRISPR gRNA sequence
  source 1..20: mol_type = other DNA
tgccttcctctgagtcttct

SEQ ID NO: 60211 - DNA, 20 bp, synthetic construct
  misc_feature 1..20: note = CRISPR gRNA sequence
  source 1..20: mol_type = other DNA
ctcagtgcagcagtagcagg

SEQ ID NO: 60212 - DNA, 20 bp, synthetic construct
  misc_feature 1..20: note = CRISPR gRNA sequence
  source 1..20: mol_type = other DNA
cctgagcccaagttgcttct

SEQ ID NO: 60213 - DNA, 20 bp, synthetic construct
  misc_feature 1..20: note = CRISPR gRNA sequence
  source 1..20: mol_type = other DNA
agatgaggtccgcctccctg

SEQ ID NO: 60214 - DNA, 20 bp, synthetic construct
  misc_feature 1..20: note = CRISPR gRNA sequence
  source 1..20: mol_type = other DNA
actgattatgtctttgcttg

SEQ ID NO: 60215 - DNA, 20 bp, synthetic construct
  misc_feature 1..20: note = CRISPR gRNA sequence
  source 1..20: mol_type = other DNA
ctttgcttgatgaatcctgc

SEQ ID NO: 60216 - DNA, 20 bp, synthetic construct
  misc_feature 1..20: note = CRISPR gRNA sequence
  source 1..20: mol_type = other DNA
caagaaatataataaaaatt

SEQ ID NO: 60217 - DNA, 20 bp, synthetic construct
  misc_feature 1..20: note = CRISPR gRNA sequence
  source 1..20: mol_type = other DNA
taataaaaattaagaatgtt

SEQ ID NO: 60218 - DNA, 20 bp, synthetic construct
  misc_feature 1..20: note = CRISPR gRNA sequence
  source 1..20: mol_type = other DNA
tctcactctgctactcaggc

SEQ ID NO: 60219 - DNA, 20 bp, synthetic construct
  misc_feature 1..20: note = CRISPR gRNA sequence
  source 1..20: mol_type = other DNA
gccttggccttccaaagtgt

SEQ ID NO: 60220 - DNA, 20 bp, synthetic construct
  misc_feature 1..20: note = CRISPR gRNA sequence
  source 1..20: mol_type = other DNA
gcatgagccactgagcccgg

SEQ ID NO: 60221 - DNA, 20 bp, synthetic construct
  misc_feature 1..20: note = CRISPR gRNA sequence
  source 1..20: mol_type = other DNA
tttttttaatagaaattttt

SEQ ID NO: 60222 - DNA, 20 bp, synthetic construct
  misc_feature 1..20: note = CRISPR gRNA sequence
  source 1..20: mol_type = other DNA
taggttctgaaggtaaagct

SEQ ID NO: 60223 - DNA, 20 bp, synthetic construct
  misc_feature 1..20: note = CRISPR gRNA sequence
  source 1..20: mol_type = other DNA
taaagctgtgagtaaaacag

SEQ ID NO: 60224 - DNA, 20 bp, synthetic construct
  misc_feature 1..20: note = CRISPR gRNA sequence
  source 1..20: mol_type = other DNA
tgactgccacccttgccaag

SEQ ID NO: 60225 - DNA, 20 bp, synthetic construct
  misc_feature 1..20: note = CRISPR gRNA sequence
  source 1..20: mol_type = other DNA
gccacccttgccaagcagag

SEQ ID NO: 60226 - DNA, 20 bp, synthetic construct
  misc_feature 1..20: note = CRISPR gRNA sequence
  source 1..20: mol_type = other DNA
aagattgtggcaaaggtgtc

SEQ ID NO: 60227 - DNA, 20 bp, synthetic construct
  misc_feature 1..20: note = CRISPR gRNA sequence
  source 1..20: mol_type = other DNA
tgtggcaaaggtgtcaggag

SEQ ID NO: 60228 - DNA, 20 bp, synthetic construct
  misc_feature 1..20: note = CRISPR gRNA sequence
  source 1..20: mol_type = other DNA
agaccttccttgccttgcaa

SEQ ID NO: 60229 - DNA, 20 bp, synthetic construct
  misc_feature 1..20: note = CRISPR gRNA sequence
  source 1..20: mol_type = other DNA
ttccttgccttgcaagggag

SEQ ID NO: 60230 - DNA, 20 bp, synthetic construct
  misc_feature 1..20: note = CRISPR gRNA sequence
  source 1..20: mol_type = other DNA
ttgccttgcaagggagtggg

SEQ ID NO: 60231 - DNA, 20 bp, synthetic construct
  misc_feature 1..20: note = CRISPR gRNA sequence
  source 1..20: mol_type = other DNA
aaggcccagtccctttgccc

SEQ ID NO: 60232 - DNA, 20 bp, synthetic construct
  misc_feature 1..20: note = CRISPR gRNA sequence
  source 1..20: mol_type = other DNA
aagccccagttagcaagtga

SEQ ID NO: 60233 - DNA, 20 bp, synthetic construct
  misc_feature 1..20: note = CRISPR gRNA sequence
  source 1..20: mol_type = other DNA
aagagctgatggcctgctcg

SEQ ID NO: 60234 - DNA, 20 bp, synthetic construct
  misc_feature 1..20: note = CRISPR gRNA sequence
  source 1..20: mol_type = other DNA
accctctgctggcctcaatt

SEQ ID NO: 60235 - DNA, 20 bp, synthetic construct
  misc_feature 1..20: note = CRISPR gRNA sequence
  source 1..20: mol_type = other DNA
agtttttgcctggcggctca

SEQ ID NO: 60236 - DNA, 20 bp, synthetic construct
  misc_feature 1..20: note = CRISPR gRNA sequence
  source 1..20: mol_type = other DNA
ctgctcccagggcttatgcc

SEQ ID NO: 60237 - DNA, 20 bp, synthetic construct
  misc_feature 1..20: note = CRISPR gRNA sequence
  source 1..20: mol_type = other DNA
gcttatgcctgggatgtgcc

SEQ ID NO: 60238 - DNA, 20 bp, synthetic construct
  misc_feature 1..20: note = CRISPR gRNA sequence
  source 1..20: mol_type = other DNA
tgggataggccccccaggca

SEQ ID NO: 60239 - DNA, 20 bp, synthetic construct
  misc_feature 1..20: note = CRISPR gRNA sequence
  source 1..20: mol_type = other DNA
tgttcacaagccagccttgc

SEQ ID NO: 60240 - DNA, 20 bp, synthetic construct
  misc_feature 1..20: note = CRISPR gRNA sequence
  source 1..20: mol_type = other DNA
gttcctagctggggagacag

SEQ ID NO: 60241 - DNA, 20 bp, synthetic construct
  misc_feature 1..20: note = CRISPR gRNA sequence
  source 1..20: mol_type = other DNA
ggggagacagatgagttgag

SEQ ID NO: 60242 - DNA, 20 bp, synthetic construct
  misc_feature 1..20: note = CRISPR gRNA sequence
  source 1..20: mol_type = other DNA
acagatgagttgaggggagt

SEQ ID NO: 60243 - DNA, 20 bp, synthetic construct
  misc_feature 1..20: note = CRISPR gRNA sequence
  source 1..20: mol_type = other DNA
gagggtgattaagaacaatg

SEQ ID NO: 60244 - DNA, 20 bp, synthetic construct
  misc_feature 1..20: note = CRISPR gRNA sequence
  source 1..20: mol_type = other DNA
tagtgacaggctgcatctgt

SEQ ID NO: 60245 - DNA, 20 bp, synthetic construct
  misc_feature 1..20: note = CRISPR gRNA sequence
  source 1..20: mol_type = other DNA
agcagcgttctgccagggag

SEQ ID NO: 60246 - DNA, 20 bp, synthetic construct
  misc_feature 1..20: note = CRISPR gRNA sequence
  source 1..20: mol_type = other DNA
tcccactcctccccatggta

SEQ ID NO: 60247 - DNA, 20 bp, synthetic construct
  misc_feature 1..20: note = CRISPR gRNA sequence
  source 1..20: mol_type = other DNA
ctgagtcccagacacagggc

SEQ ID NO: 60248 - DNA, 20 bp, synthetic construct
  misc_feature 1..20: note = CRISPR gRNA sequence
  source 1..20: mol_type = other DNA
tgcatacaagcttagttagt

SEQ ID NO: 60249 - DNA, 20 bp, synthetic construct
  misc_feature 1..20: note = CRISPR gRNA sequence
  source 1..20: mol_type = other DNA
ctgcatacatgtgcacacct

SEQ ID NO: 60250 - DNA, 20 bp, synthetic construct
  misc_feature 1..20: note = CRISPR gRNA sequence
  source 1..20: mol_type = other DNA
acacctatgagtgggcatgt

SEQ ID NO: 60251 - DNA, 20 bp, synthetic construct
  misc_feature 1..20: note = CRISPR gRNA sequence
  source 1..20: mol_type = other DNA
cgcactgctatcccttctcc

SEQ ID NO: 60252 - DNA, 20 bp, synthetic construct
  misc_feature 1..20: note = CRISPR gRNA sequence
  source 1..20: mol_type = other DNA
ctctggggactctgggagcc

SEQ ID NO: 60253 - DNA, 20 bp, synthetic construct
  misc_feature 1..20: note = CRISPR gRNA sequence
  source 1..20: mol_type = other DNA
tgggtttggactcagcccta

SEQ ID NO: 60254 - DNA, 20 bp, synthetic construct
  misc_feature 1..20: note = CRISPR gRNA sequence
  source 1..20: mol_type = other DNA
tggactgatgccttccctct

SEQ ID NO: 60255 - DNA, 20 bp, synthetic construct
  misc_feature 1..20: note = CRISPR gRNA sequence
  source 1..20: mol_type = other DNA
ttttacttcctgctaaccta

SEQ ID NO: 60256 - DNA, 20 bp, synthetic construct
  misc_feature 1..20: note = CRISPR gRNA sequence
  source 1..20: mol_type = other DNA
gaggggaaaagggcggggcc

SEQ ID NO: 60257 - DNA, 20 bp, synthetic construct
  misc_feature 1..20: note = CRISPR gRNA sequence
  source 1..20: mol_type = other DNA
ggccaggaatctgccttgtg

SEQ ID NO: 60258 - DNA, 20 bp, synthetic construct
  misc_feature 1..20: note = CRISPR gRNA sequence
  source 1..20: mol_type = other DNA
gtaggattaaggagagggag

SEQ ID NO: 60259 - DNA, 20 bp, synthetic construct
  misc_feature 1..20: note = CRISPR gRNA sequence
  source 1..20: mol_type = other DNA
taagaagaagcgaagtgtca

SEQ ID NO: 60260 - DNA, 20 bp, synthetic construct
  misc_feature 1..20: note = CRISPR gRNA sequence
  source 1..20: mol_type = other DNA
ggtgactatgttctcaccaa

SEQ ID NO: 60261 - DNA, 20 bp, synthetic construct
  misc_feature 1..20: note = CRISPR gRNA sequence
  source 1..20: mol_type = other DNA
tatgttctcaccaatggaat

SEQ ID NO: 60262 - DNA, 20 bp, synthetic construct
  misc_feature 1..20: note = CRISPR gRNA sequence
  source 1..20: mol_type = other DNA
accaatggaatgtgagtgga

SEQ ID NO: 60263 - DNA, 20 bp, synthetic construct
  misc_feature 1..20: note = CRISPR gRNA sequence
  source 1..20: mol_type = other DNA
cgtagctttgactgtgcaga

SEQ ID NO: 60264 - DNA, 20 bp, synthetic construct
  misc_feature 1..20: note = CRISPR gRNA sequence
  source 1..20: mol_type = other DNA
tgtgcagataggattcccaa

SEQ ID NO: 60265 - DNA, 20 bp, synthetic construct
  misc_feature 1..20: note = CRISPR gRNA sequence
  source 1..20: mol_type = other DNA
tggagcaaaatgggagggac

SEQ ID NO: 60266 - DNA, 20 bp, synthetic construct
  misc_feature 1..20: note = CRISPR gRNA sequence
  source 1..20: mol_type = other DNA
ctcattcttgcaatgaccat

SEQ ID NO: 60267 - DNA, 20 bp, synthetic construct
  misc_feature 1..20: note = CRISPR gRNA sequence
  source 1..20: mol_type = other DNA
caccagcctctatagacagc

SEQ ID NO: 60268 - DNA, 20 bp, synthetic construct
  misc_feature 1..20: note = CRISPR gRNA sequence
  source 1..20: mol_type = other DNA
ccatgattgacagagagact

SEQ ID NO: 60269 - DNA, 20 bp, synthetic construct
  misc_feature 1..20: note = CRISPR gRNA sequence
  source 1..20: mol_type = other DNA
ccagaaaccacagacaagag

SEQ ID NO: 60270 - DNA, 20 bp, synthetic construct
  misc_feature 1..20: note = CRISPR gRNA sequence
  source 1..20: mol_type = other DNA
ggacagccatcaaaatccag

SEQ ID NO: 60271 - DNA, 20 bp, synthetic construct
  misc_feature 1..20: note = CRISPR gRNA sequence
  source 1..20: mol_type = other DNA
atgggggcctccctgtgctc

SEQ ID NO: 60272 - DNA, 20 bp, synthetic construct
  misc_feature 1..20: note = CRISPR gRNA sequence
  source 1..20: mol_type = other DNA
ctgtgctctaggatgttggt

SEQ ID NO: 60273 - DNA, 20 bp, synthetic construct
  misc_feature 1..20: note = CRISPR gRNA sequence
  source 1..20: mol_type = other DNA
acctttggccctgtgagctt

SEQ ID NO: 60274 - DNA, 20 bp, synthetic construct
  misc_feature 1..20: note = CRISPR gRNA sequence
  source 1..20: mol_type = other DNA
taaggaaggggcggcaggtg

SEQ ID NO: 60275 - DNA, 20 bp, synthetic construct
  misc_feature 1..20: note = CRISPR gRNA sequence
  source 1..20: mol_type = other DNA
tttggtccgctgtacccagc

SEQ ID NO: 60276 - DNA, 20 bp, synthetic construct
  misc_feature 1..20: note = CRISPR gRNA sequence
  source 1..20: mol_type = other DNA
cgctgtacccagcgggaatg

SEQ ID NO: 60277 - DNA, 20 bp, synthetic construct
  misc_feature 1..20: note = CRISPR gRNA sequence
  source 1..20: mol_type = other DNA
cgggaatggagggtaacata

SEQ ID NO: 60278 - DNA, 20 bp, synthetic construct
  misc_feature 1..20: note = CRISPR gRNA sequence
  source 1..20: mol_type = other DNA
agaaactcctgcaggctgag

SEQ ID NO: 60279 - DNA, 20 bp, synthetic construct
  misc_feature 1..20: note = CRISPR gRNA sequence
  source 1..20: mol_type = other DNA
cagaaggaagtcagcaggct

SEQ ID NO: 60280 - DNA, 20 bp, synthetic construct
  misc_feature 1..20: note = CRISPR gRNA sequence
  source 1..20: mol_type = other DNA
gagtggccccaaaagctatc

SEQ ID NO: 60281 - DNA, 20 bp, synthetic construct
  misc_feature 1..20: note = CRISPR gRNA sequence
  source 1..20: mol_type = other DNA
agcaccatctgcatatagag

SEQ ID NO: 60282 - DNA, 20 bp, synthetic construct
  misc_feature 1..20: note = CRISPR gRNA sequence
  source 1..20: mol_type = other DNA
atcacccggcagccaggcag

SEQ ID NO: 60283 - DNA, 20 bp, synthetic construct
  misc_feature 1..20: note = CRISPR gRNA sequence
  source 1..20: mol_type = other DNA
ccattgcagagatgggagaa

SEQ ID NO: 60284 - DNA, 20 bp, synthetic construct
  misc_feature 1..20: note = CRISPR gRNA sequence
  source 1..20: mol_type = other DNA
tcgtgatcaagttgagctgg

SEQ ID NO: 60285 - DNA, 20 bp, synthetic construct
  misc_feature 1..20: note = CRISPR gRNA sequence
  source 1..20: mol_type = other DNA
tcccccataatggccccctc

SEQ ID NO: 60286 - DNA, 20 bp, synthetic construct
  misc_feature 1..20: note = CRISPR gRNA sequence
  source 1..20: mol_type = other DNA
tggccccctccggagtgtct

SEQ ID NO: 60287 - DNA, 20 bp, synthetic construct
  misc_feature 1..20: note = CRISPR gRNA sequence
  source 1..20: mol_type = other DNA
aaggatgctgtggcccggcg

SEQ ID NO: 60288 - DNA, 20 bp, synthetic construct
  misc_feature 1..20: note = CRISPR gRNA sequence
  source 1..20: mol_type = other DNA
gcgtggggctgccctgaccc

SEQ ID NO: 60289 - DNA, 20 bp, synthetic construct
  misc_feature 1..20: note = CRISPR gRNA sequence
  source 1..20: mol_type = other DNA
ccccagatgtgtatgtatga

SEQ ID NO: 60290 - DNA, 20 bp, synthetic construct
  misc_feature 1..20: note = CRISPR gRNA sequence
  source 1..20: mol_type = other DNA
atgtgtatgtatgatggggt

SEQ ID NO: 60291 - DNA, 20 bp, synthetic construct
  misc_feature 1..20: note = CRISPR gRNA sequence
  source 1..20: mol_type = other DNA
atgtatgatggggtgagggt

SEQ ID NO: 60292 - DNA, 20 bp, synthetic construct
  misc_feature 1..20: note = CRISPR gRNA sequence
  source 1..20: mol_type = other DNA
gggtgtcaagagcaccatag

SEQ ID NO: 60293 - DNA, 20 bp, synthetic construct
  misc_feature 1..20: note = CRISPR gRNA sequence
  source 1..20: mol_type = other DNA
gtgccaccccaacttccaga

SEQ ID NO: 60294 - DNA, 20 bp, synthetic construct
  misc_feature 1..20: note = CRISPR gRNA sequence
  source 1..20: mol_type = other DNA
agctatttaaacaggcaggt

SEQ ID NO: 60295 - DNA, 20 bp, synthetic construct
  misc_feature 1..20: note = CRISPR gRNA sequence
  source 1..20: mol_type = other DNA
gcaggtgggaatggggaagt

SEQ ID NO: 60296 - DNA, 20 bp, synthetic construct
  misc_feature 1..20: note = CRISPR gRNA sequence
  source 1..20: mol_type = other DNA
tgcaatagtacacgtggtgt

SEQ ID NO: 60297 - DNA, 20 bp, synthetic construct
  misc_feature 1..20: note = CRISPR gRNA sequence
  source 1..20: mol_type = other DNA
gttcagtaagatggggggag

SEQ ID NO: 60298 - DNA, 20 bp, synthetic construct
  misc_feature 1..20: note = CRISPR gRNA sequence
  source 1..20: mol_type = other DNA
tttttcttttttcccagaga

SEQ ID NO: 60299 - DNA, 20 bp, synthetic construct
  misc_feature 1..20: note = CRISPR gRNA sequence
  source 1..20: mol_type = other DNA
gatcctcctgcctcagcctc

SEQ ID NO: 60300 - DNA, 20 bp, synthetic construct
  misc_feature 1..20: note = CRISPR gRNA sequence
  source 1..20: mol_type = other DNA
tcacgttggccaggctagta

SEQ ID NO: 60301 - DNA, 20 bp, synthetic construct
  misc_feature 1..20: note = CRISPR gRNA sequence
  source 1..20: mol_type = other DNA
gcctcagccctccaaagtgc

SEQ ID NO: 60302 - DNA, 20 bp, synthetic construct
  misc_feature 1..20: note = CRISPR gRNA sequence
  source 1..20: mol_type = other DNA
acaacctctttctgtaatat

SEQ ID NO: 60303 - DNA, 20 bp, synthetic construct
  misc_feature 1..20: note = CRISPR gRNA sequence
  source 1..20: mol_type = other DNA
atttcagttctgcaatgccc

SEQ ID NO: 60304 - DNA, 20 bp, synthetic construct
  misc_feature 1..20: note = CRISPR gRNA sequence
  source 1..20: mol_type = other DNA
agatgttaaccttttaattc

SEQ ID NO: 60305 - DNA, 20 bp, synthetic construct
  misc_feature 1..20: note = CRISPR gRNA sequence
  source 1..20: mol_type = other DNA
aaggtagtgaactattttga

SEQ ID NO: 60306 - DNA, 20 bp, synthetic construct
  misc_feature 1..20: note = CRISPR gRNA sequence
  source 1..20: mol_type = other DNA
gtgaactattttgagcggat

SEQ ID NO: 60307 - DNA, 20 bp, synthetic construct
  misc_feature 1..20: note = CRISPR gRNA sequence
  source 1..20: mol_type = other DNA
gaccattctgagaactggtc

SEQ ID NO: 60308 - DNA, 20 bp, synthetic construct
  misc_feature 1..20: note = CRISPR gRNA sequence
  source 1..20: mol_type = other DNA
cccccaaactggtctcctcc

SEQ ID NO: 60309 - DNA, 20 bp, synthetic construct
  misc_feature 1..20: note = CRISPR gRNA sequence
  source 1..20: mol_type = other DNA
ctccttcaacactgaggaca

SEQ ID NO: 60310 - DNA, 20 bp, synthetic construct
  misc_feature 1..20: note = CRISPR gRNA sequence
  source 1..20: mol_type = other DNA
agaagtccccatgcagccag

SEQ ID NO: 60311 - DNA, 20 bp, synthetic construct
  misc_feature 1..20: note = CRISPR gRNA sequence
  source 1..20: mol_type = other DNA
ctcctggaaacttgcgagac

SEQ ID NO: 60312 - DNA, 20 bp, synthetic construct
  misc_feature 1..20: note = CRISPR gRNA sequence
  source 1..20: mol_type = other DNA
tattggcaggggacaaggtc

SEQ ID NO: 60313 - DNA, 20 bp, synthetic construct
  misc_feature 1..20: note = CRISPR gRNA sequence
  source 1..20: mol_type = other DNA
caggggacaaggtccagggt

SEQ ID NO: 60314 - DNA, 20 bp, synthetic construct
  misc_feature 1..20: note = CRISPR gRNA sequence
  source 1..20: mol_type = other DNA
gcttcttgcactgcttccgg

SEQ ID NO: 60315 - DNA, 20 bp, synthetic construct
  misc_feature 1..20: note = CRISPR gRNA sequence
  source 1..20: mol_type = other DNA
aggcctgaaaaagcaaagga

SEQ ID NO: 60316 - DNA, 20 bp, synthetic construct
  misc_feature 1..20: note = CRISPR gRNA sequence
  source 1..20: mol_type = other DNA
aaaagcaaaggaaggggtgg

SEQ ID NO: 60317 - DNA, 20 bp, synthetic construct
  misc_feature 1..20: note = CRISPR gRNA sequence
  source 1..20: mol_type = other DNA
caaaggaaggggtggaggag

SEQ ID NO: 60318 - DNA, 20 bp, synthetic construct
  misc_feature 1..20: note = CRISPR gRNA sequence
  source 1..20: mol_type = other DNA
ggggtggaggagtggggtct

SEQ ID NO: 60319 - DNA, 20 bp, synthetic construct
  misc_feature 1..20: note = CRISPR gRNA sequence
  source 1..20: mol_type = other DNA
gggtctggggatctgggctg

SEQ ID NO: 60320 - DNA, 20 bp, synthetic construct
  misc_feature 1..20: note = CRISPR gRNA sequence
  source 1..20: mol_type = other DNA
aggcaggcagcaggcagagg

SEQ ID NO: 60321 - DNA, 20 bp, synthetic construct
  misc_feature 1..20: note = CRISPR gRNA sequence
  source 1..20: mol_type = other DNA
tcaacaccagcttctatttg

SEQ ID NO: 60322 - DNA, 20 bp, synthetic construct
  misc_feature 1..20: note = CRISPR gRNA sequence
  source 1..20: mol_type = other DNA
ctaggcacccccattggaag

SEQ ID NO: 60323 - DNA, 20 bp, synthetic construct
  misc_feature 1..20: note = CRISPR gRNA sequence
  source 1..20: mol_type = other DNA
ggcctggcagtcttgcagtc

SEQ ID NO: 60324 - DNA, 20 bp, synthetic construct
  misc_feature 1..20: note = CRISPR gRNA sequence
  source 1..20: mol_type = other DNA
tcatataagtgaagttccca

SEQ ID NO: 60325 - DNA, 20 bp, synthetic construct
  misc_feature 1..20: note = CRISPR gRNA sequence
  source 1..20: mol_type = other DNA
ctgcaacctccctcctctgt

SEQ ID NO: 60326 - DNA, 20 bp, synthetic construct
  misc_feature 1..20: note = CRISPR gRNA sequence
  source 1..20: mol_type = other DNA
tcacttcccttaatagtttc

SEQ ID NO: 60327 - DNA, 20 bp, synthetic construct
  misc_feature 1..20: note = CRISPR gRNA sequence
  source 1..20: mol_type = other DNA
ctggagtcttgtctcattgt

SEQ ID NO: 60328 - DNA, 20 bp, synthetic construct
  misc_feature 1..20: note = CRISPR gRNA sequence
  source 1..20: mol_type = other DNA
tcactttaatgcctttctgg

SEQ ID NO: 60329 - DNA, 20 bp, synthetic construct
  misc_feature 1..20: note = CRISPR gRNA sequence
  source 1..20: mol_type = other DNA
aaaggaaagaggactcagga

SEQ ID NO: 60330 - DNA, 20 bp, synthetic construct
  misc_feature 1..20: note = CRISPR gRNA sequence
  source 1..20: mol_type = other DNA
aagaattttaagaagtcaag

SEQ ID NO: 60331 - DNA, 20 bp, synthetic construct
  misc_feature 1..20: note = CRISPR gRNA sequence
  source 1..20: mol_type = other DNA
tcactggggagctgaggtta

SEQ ID NO: 60332 - DNA, 20 bp, synthetic construct
  misc_feature 1..20: note = CRISPR gRNA sequence
  source 1..20: mol_type = other DNA
tggggagctgaggttatagg

SEQ ID NO: 60333 - DNA, 20 bp, synthetic construct
  misc_feature 1..20: note = CRISPR gRNA sequence
  source 1..20: mol_type = other DNA
ctgagatgaaagtgtgaccc

SEQ ID NO: 60334 - DNA, 20 bp, synthetic construct
  misc_feature 1..20: note = CRISPR gRNA sequence
  source 1..20: mol_type = other DNA
ccccgctgaagacagcagct

SEQ ID NO: 60335 - DNA, 20 bp, synthetic construct
  misc_feature 1..20: note = CRISPR gRNA sequence
  source 1..20: mol_type = other DNA
gctgaagacagcagctgtgg

SEQ ID NO: 60336 - DNA, 20 bp, synthetic construct
  misc_feature 1..20: note = CRISPR gRNA sequence
  source 1..20: mol_type = other DNA
ccaaggtgtacaagtcggga

SEQ ID NO: 60337 - DNA, 20 bp, synthetic construct
  misc_feature 1..20: note = CRISPR gRNA sequence
  source 1..20: mol_type = other DNA
gggctgggagatgaggccct

SEQ ID NO: 60338 - DNA, 20 bp, synthetic construct
  misc_feature 1..20: note = CRISPR gRNA sequence
  source 1..20: mol_type = other DNA
aagtgagaacaggcttcctg

SEQ ID NO: 60339 - DNA, 20 bp, synthetic construct
  misc_feature 1..20: note = CRISPR gRNA sequence
  source 1..20: mol_type = other DNA
gggttccaggttagaccctt

SEQ ID NO: 60340 - DNA, 20 bp, synthetic construct
  misc_feature 1..20: note = CRISPR gRNA sequence
  source 1..20: mol_type = other DNA
ggggcttgacacacttgcaa

SEQ ID NO: 60341 - DNA, 20 bp, synthetic construct
  misc_feature 1..20: note = CRISPR gRNA sequence
  source 1..20: mol_type = other DNA
gtgaaccctgcaagagaggg

SEQ ID NO: 60342 - DNA, 20 bp, synthetic construct
  misc_feature 1..20: note = CRISPR gRNA sequence
  source 1..20: mol_type = other DNA
aatgtggtatggggctgtcg

SEQ ID NO: 60343 - DNA, 20 bp, synthetic construct
  misc_feature 1..20: note = CRISPR gRNA sequence
  source 1..20: mol_type = other DNA
acacttgcatgcatgtgtac

SEQ ID NO: 60344 - DNA, 20 bp, synthetic construct
  misc_feature 1..20: note = CRISPR gRNA sequence
  source 1..20: mol_type = other DNA
tcccacactctgccttgaag

SEQ ID NO: 60345 - DNA, 20 bp, synthetic construct
  misc_feature 1..20: note = CRISPR gRNA sequence
  source 1..20: mol_type = other DNA
ccttgaagtagggttcttaa

SEQ ID NO: 60346 - DNA, 20 bp, synthetic construct
  misc_feature 1..20: note = CRISPR gRNA sequence
  source 1..20: mol_type = other DNA
aaggtgcccaagaaatcccc

SEQ ID NO: 60347 - DNA, 20 bp, synthetic construct
  misc_feature 1..20: note = CRISPR gRNA sequence
  source 1..20: mol_type = other DNA
actttgggaggccaagggag

SEQ ID NO: 60348 - DNA, 20 bp, synthetic construct
  misc_feature 1..20: note = CRISPR gRNA sequence
  source 1..20: mol_type = other DNA
gaggaggatcacttaaggcc

SEQ ID NO: 60349 - DNA, 20 bp, synthetic construct
  misc_feature 1..20: note = CRISPR gRNA sequence
  source 1..20: mol_type = other DNA
gtgatgtcctgtctctacaa

SEQ ID NO: 60350 - DNA, 20 bp, synthetic construct
  misc_feature 1..20: note = CRISPR gRNA sequence
  source 1..20: mol_type = other DNA
acttgggaggctgaagtggg

SEQ ID NO: 60351 - DNA, 20 bp, synthetic construct
  misc_feature 1..20: note = CRISPR gRNA sequence
  source 1..20: mol_type = other DNA
gctgaagtgggaaggatcac

SEQ ID NO: 60352 - DNA, 20 bp, synthetic construct
  misc_feature 1..20: note = CRISPR gRNA sequence
  source 1..20: mol_type = other DNA
gggaaggatcacctgagtcc

SEQ ID NO: 60353 - DNA, 20 bp, synthetic construct
  misc_feature 1..20: note = CRISPR gRNA sequence
  source 1..20: mol_type = other DNA
ggatcacctgagtcctggag

SEQ ID NO: 60354 - DNA, 20 bp, synthetic construct
  misc_feature 1..20: note = CRISPR gRNA sequence
  source 1..20: mol_type = other DNA
ctcgggcattatgggctatg

SEQ ID NO: 60355 - DNA, 20 bp, synthetic construct
  misc_feature 1..20: note = CRISPR gRNA sequence
  source 1..20: mol_type = other DNA
cactcagcaattcgagcaat

SEQ ID NO: 60356 - DNA, 20 bp, synthetic construct
  misc_feature 1..20: note = CRISPR gRNA sequence
  source 1..20: mol_type = other DNA
gagtgaagccaggtagaagg

SEQ ID NO: 60357 - DNA, 20 bp, synthetic construct
  misc_feature 1..20: note = CRISPR gRNA sequence
  source 1..20: mol_type = other DNA
ctgggaagtgtccagaaata

SEQ ID NO: 60358 - DNA, 20 bp, synthetic construct
  misc_feature 1..20: note = CRISPR gRNA sequence
  source 1..20: mol_type = other DNA
acaccctctctctgacttag

SEQ ID NO: 60359 - DNA, 20 bp, synthetic construct
  misc_feature 1..20: note = CRISPR gRNA sequence
  source 1..20: mol_type = other DNA
tccagctgcatgcacacaca

SEQ ID NO: 60360 - DNA, 20 bp, synthetic construct
  misc_feature 1..20: note = CRISPR gRNA sequence
  source 1..20: mol_type = other DNA
aaccctggacatgcagcttg

SEQ ID NO: 60361 - DNA, 20 bp, synthetic construct
  misc_feature 1..20: note = CRISPR gRNA sequence
  source 1..20: mol_type = other DNA
acatgcagcttgttgagttg

SEQ ID NO: 60362 - DNA, 20 bp, synthetic construct
  misc_feature 1..20: note = CRISPR gRNA sequence
  source 1..20: mol_type = other DNA
ttgcaggatgactctctgtt

SEQ ID NO: 60363 - DNA, 20 bp, synthetic construct
  misc_feature 1..20: note = CRISPR gRNA sequence
  source 1..20: mol_type = other DNA
agggtccaaggtctcgttcc

SEQ ID NO: 60364 - DNA, 20 bp, synthetic construct
  misc_feature 1..20: note = CRISPR gRNA sequence
  source 1..20: mol_type = other DNA
catcttggcgttcagccatt

SEQ ID NO: 60365 - DNA, 20 bp, synthetic construct
  misc_feature 1..20: note = CRISPR gRNA sequence
  source 1..20: mol_type = other DNA
gttgccgagctggaggccaa

SEQ ID NO: 60366 - DNA, 20 bp, synthetic construct
  misc_feature 1..20: note = CRISPR gRNA sequence
  source 1..20: mol_type = other DNA
tggagggacagggaagatag

SEQ ID NO: 60367 - DNA, 20 bp, synthetic construct
  misc_feature 1..20: note = CRISPR gRNA sequence
  source 1..20: mol_type = other DNA
gagggacaggggaacttggg

SEQ ID NO: 60368 - DNA, 20 bp, synthetic construct
  misc_feature 1..20: note = CRISPR gRNA sequence
  source 1..20: mol_type = other DNA
gaagattagatggagaacag

SEQ ID NO: 60369 - DNA, 20 bp, synthetic construct
  misc_feature 1..20: note = CRISPR gRNA sequence
  source 1..20: mol_type = other DNA
ggcaggtgacctgagggcag

SEQ ID NO: 60370 - DNA, 20 bp, synthetic construct
  misc_feature 1..20: note = CRISPR gRNA sequence
  source 1..20: mol_type = other DNA
gtgacctgagggcaggtgag

SEQ ID NO: 60371 - DNA, 20 bp, synthetic construct
  misc_feature 1..20: note = CRISPR gRNA sequence
  source 1..20: mol_type = other DNA
gggaaggtgatctggggaag

SEQ ID NO: 60372 - DNA, 20 bp, synthetic construct
  misc_feature 1..20: note = CRISPR gRNA sequence
  source 1..20: mol_type = other DNA
gatctggggaaggtgagttg

SEQ ID NO: 60373 - DNA, 20 bp, synthetic construct
  misc_feature 1..20: note = CRISPR gRNA sequence
  source 1..20: mol_type = other DNA
gaaggtgagttgggggataa

SEQ ID NO: 60374 - DNA, 20 bp, synthetic construct
  misc_feature 1..20: note = CRISPR gRNA sequence
  source 1..20: mol_type = other DNA
gcagggaagtggcctctcca

SEQ ID NO: 60375 - DNA, 20 bp, synthetic construct
  misc_feature 1..20: note = CRISPR gRNA sequence
  source 1..20: mol_type = other DNA
gagtcttgatgtctctgccc

SEQ ID NO: 60376 - DNA, 20 bp, synthetic construct
  misc_feature 1..20: note = CRISPR gRNA sequence
  source 1..20: mol_type = other DNA
gtgcctgcaccctggctctc

SEQ ID NO: 60377 - DNA, 20 bp, synthetic construct
  misc_feature 1..20: note = CRISPR gRNA sequence
  source 1..20: mol_type = other DNA
tcccctgtggacagtcccgt

SEQ ID NO: 60378 - DNA, 20 bp, synthetic construct
  misc_feature 1..20: note = CRISPR gRNA sequence
  source 1..20: mol_type = other DNA
ctaaatattctctggtcatc

SEQ ID NO: 60379 - DNA, 20 bp, synthetic construct
  misc_feature 1..20: note = CRISPR gRNA sequence
  source 1..20: mol_type = other DNA
tagccatgtaatttggccag

SEQ ID NO: 60380 - DNA, 20 bp, synthetic construct
  misc_feature 1..20: note = CRISPR gRNA sequence
  source 1..20: mol_type = other DNA
tctttgctccttcctgttgt

SEQ ID NO: 60381 - DNA, 20 bp, synthetic construct
  misc_feature 1..20: note = CRISPR gRNA sequence
  source 1..20: mol_type = other DNA
cctgttgtctggattgttga

SEQ ID NO: 60382 - DNA, 20 bp, synthetic construct
  misc_feature 1..20: note = CRISPR gRNA sequence
  source 1..20: mol_type = other DNA
ctggattgttgatgggatgg

SEQ ID NO: 60383 - DNA, 20 bp, synthetic construct
  misc_feature 1..20: note = CRISPR gRNA sequence
  source 1..20: mol_type = other DNA
ctggatcttgggcagccata

SEQ ID NO: 60384 - DNA, 20 bp, synthetic construct
  misc_feature 1..20: note = CRISPR gRNA sequence
  source 1..20: mol_type = other DNA
gaactcttttttttttgaga

SEQ ID NO: 60385 - DNA, 20 bp, synthetic construct
  misc_feature 1..20: note = CRISPR gRNA sequence
  source 1..20: mol_type = other DNA
tctcgctctgtcacccaggc

SEQ ID NO: 60386 - DNA, 20 bp, synthetic construct
  misc_feature 1..20: note = CRISPR gRNA sequence
  source 1..20: mol_type = other DNA
ctcactgcagcctccgcctc

SEQ ID NO: 60387 - DNA, 20 bp, synthetic construct
  misc_feature 1..20: note = CRISPR gRNA sequence
  source 1..20: mol_type = other DNA
gattcttctgcctcagcctc

SEQ ID NO: 60388 - DNA, 20 bp, synthetic construct
  misc_feature 1..20: note = CRISPR gRNA sequence
  source 1..20: mol_type = other DNA
gcctcagcctcccgagtagc

SEQ ID NO: 60389 - DNA, 20 bp, synthetic construct
  misc_feature 1..20: note = CRISPR gRNA sequence
  source 1..20: mol_type = other DNA
tttgtaatttttagtacaga

SEQ ID NO: 60390 - DNA, 20 bp, synthetic construct
  misc_feature 1..20: note = CRISPR gRNA sequence
  source 1..20: mol_type = other DNA
tgggctcaaactcctgacct

SEQ ID NO: 60391 - DNA, 20 bp, synthetic construct
  misc_feature 1..20: note = CRISPR gRNA sequence
  source 1..20: mol_type = other DNA
acctcggcctcccaaagtgc

SEQ ID NO: 60392 - DNA, 20 bp, synthetic construct
  misc_feature 1..20: note = CRISPR gRNA sequence
  source 1..20: mol_type = other DNA
aacctaaatgtccaacagtt

SEQ ID NO: 60393 - DNA, 20 bp, synthetic construct
  misc_feature 1..20: note = CRISPR gRNA sequence
  source 1..20: mol_type = other DNA
tggactatgctatcacattt

SEQ ID NO: 60394 - DNA, 20 bp, synthetic construct
  misc_feature 1..20: note = CRISPR gRNA sequence
  source 1..20: mol_type = other DNA
attttatcctcacaactcca

SEQ ID NO: 60395 - DNA, 20 bp, synthetic construct
  misc_feature 1..20: note = CRISPR gRNA sequence
  source 1..20: mol_type = other DNA
agtccacctctaactctgaa

SEQ ID NO: 60396 - DNA, 20 bp, synthetic construct
  misc_feature 1..20: note = CRISPR gRNA sequence
  source 1..20: mol_type = other DNA
gaggccagtactatgcgtcc

SEQ ID NO: 60397 - DNA, 20 bp, synthetic construct
  misc_feature 1..20: note = CRISPR gRNA sequence
  source 1..20: mol_type = other DNA
ggcatgcagtagagacatac

SEQ ID NO: 60398 - DNA, 20 bp, synthetic construct
  misc_feature 1..20: note = CRISPR gRNA sequence
  source 1..20: mol_type = other DNA
aataggtcctcactcaggca

SEQ ID NO: 60399 - DNA, 20 bp, synthetic construct
  misc_feature 1..20: note = CRISPR gRNA sequence
  source 1..20: mol_type = other DNA
ctcactcaggcagagagtct

SEQ ID NO: 60400 - DNA, 20 bp, synthetic construct
  misc_feature 1..20: note = CRISPR gRNA sequence
  source 1..20: mol_type = other DNA
tcacaccatgatcctcaggc

SEQ ID NO: 60401 - DNA, 20 bp, synthetic construct
  misc_feature 1..20: note = CRISPR gRNA sequence
  source 1..20: mol_type = other DNA
accatggccaaggaagggca

SEQ ID NO: 60402 - DNA, 20 bp, synthetic construct
  misc_feature 1..20: note = CRISPR gRNA sequence
  source 1..20: mol_type = other DNA
caccagacaaggctaagtcc

SEQ ID NO: 60403 - DNA, 20 bp, synthetic construct
  misc_feature 1..20: note = CRISPR gRNA sequence
  source 1..20: mol_type = other DNA
attttgtgtgatctcggcaa

SEQ ID NO: 60404 - DNA, 20 bp, synthetic construct
  misc_feature 1..20: note = CRISPR gRNA sequence
  source 1..20: mol_type = other DNA
cagatggaagtaagtagtgc

SEQ ID NO: 60405 - DNA, 20 bp, synthetic construct
  misc_feature 1..20: note = CRISPR gRNA sequence
  source 1..20: mol_type = other DNA
tcattagtgttctatcccct

SEQ ID NO: 60406 - DNA, 20 bp, synthetic construct
  misc_feature 1..20: note = CRISPR gRNA sequence
  source 1..20: mol_type = other DNA
cagtcattgagatttccatg

SEQ ID NO: 60407 - DNA, 20 bp, synthetic construct
  misc_feature 1..20: note = CRISPR gRNA sequence
  source 1..20: mol_type = other DNA
tcctctttctaggcctttgg

SEQ ID NO: 60408 - DNA, 20 bp, synthetic construct
  misc_feature 1..20: note = CRISPR gRNA sequence
  source 1..20: mol_type = other DNA
atcatggctaccctgttagc

SEQ ID NO: 60409 - DNA, 20 bp, synthetic construct
  misc_feature 1..20: note = CRISPR gRNA sequence
  source 1..20: mol_type = other DNA
gttagcctgagtgtgggaga

SEQ ID NO: 60410 - DNA, 20 bp, synthetic construct
  misc_feature 1..20: note = CRISPR gRNA sequence
  source 1..20: mol_type = other DNA
ggaaataaacttttgttgcc

SEQ ID NO: 60411 - DNA, 20 bp, synthetic construct
  misc_feature 1..20: note = CRISPR gRNA sequence
  source 1..20: mol_type = other DNA
catgagtcactgggactttg

SEQ ID NO: 60412 - DNA, 20 bp, synthetic construct
  misc_feature 1..20: note = CRISPR gRNA sequence
  source 1..20: mol_type = other DNA
tcagtcataccatctctaaa

SEQ ID NO: 60413 - DNA, 20 bp, synthetic construct
  misc_feature 1..20: note = CRISPR gRNA sequence
  source 1..20: mol_type = other DNA
ctgatcattacattctcatg

SEQ ID NO: 60414 - DNA, 20 bp, synthetic construct
  misc_feature 1..20: note = CRISPR gRNA sequence
  source 1..20: mol_type = other DNA
ggcagcccagtaaggcagat

SEQ ID NO: 60415 - DNA, 20 bp, synthetic construct
  misc_feature 1..20: note = CRISPR gRNA sequence
  source 1..20: mol_type = other DNA
ctcgttcatgataggtgctc

SEQ ID NO: 60416 - DNA, 20 bp, synthetic construct
  misc_feature 1..20: note = CRISPR gRNA sequence
  source 1..20: mol_type = other DNA
tgctctagggtccccacgga

SEQ ID NO: 60417 - DNA, 20 bp, synthetic construct
  misc_feature 1..20: note = CRISPR gRNA sequence
  source 1..20: mol_type = other DNA
gtccccacggagagggtctc

SEQ ID NO: 60418 - DNA, 20 bp, synthetic construct
  misc_feature 1..20: note = CRISPR gRNA sequence
  source 1..20: mol_type = other DNA
tgggctatgtgtgccttgag

SEQ ID NO: 60419 - DNA, 20 bp, synthetic construct
  misc_feature 1..20: note = CRISPR gRNA sequence
  source 1..20: mol_type = other DNA
tcctaaggggagagaagaca

SEQ ID NO: 60420 - DNA, 20 bp, synthetic construct
  misc_feature 1..20: note = CRISPR gRNA sequence
  source 1..20: mol_type = other DNA
ccactattccagactccaaa

SEQ ID NO: 60421 - DNA, 20 bp, synthetic construct
  misc_feature 1..20: note = CRISPR gRNA sequence
  source 1..20: mol_type = other DNA
ggcaggggcaagggctggtg

SEQ ID NO: 60422 - DNA, 20 bp, synthetic construct
  misc_feature 1..20: note = CRISPR gRNA sequence
  source 1..20: mol_type = other DNA
catgaacgaggagaccaagt

SEQ ID NO: 60423 - DNA, 20 bp, synthetic construct
  misc_feature 1..20: note = CRISPR gRNA sequence
  source 1..20: mol_type = other DNA
atcagacacagaaaatcagg

SEQ ID NO: 60424 - DNA, 20 bp, synthetic construct
  misc_feature 1..20: note = CRISPR gRNA sequence
  source 1..20: mol_type = other DNA
cattttagagatggtatgac

SEQ ID NO: 60425 - DNA, 20 bp, synthetic construct
  misc_feature 1..20: note = CRISPR gRNA sequence
  source 1..20: mol_type = other DNA
gactgaggcttatataggaa

SEQ ID NO: 60426 - DNA, 20 bp, synthetic construct
  misc_feature 1..20: note = CRISPR gRNA sequence
  source 1..20: mol_type = other DNA
tcccagtgactcatggcaac

SEQ ID NO: 60427 - DNA, 20 bp, synthetic construct
  misc_feature 1..20: note = CRISPR gRNA sequence
  source 1..20: mol_type = other DNA
aacaaaagtttatttcctgc

SEQ ID NO: 60428 - DNA, 20 bp, synthetic construct
  misc_feature 1..20: note = CRISPR gRNA sequence
  source 1..20: mol_type = other DNA
tgctcttgcttcctgtctcg

SEQ ID NO: 60429 - DNA, 20 bp, synthetic construct
  misc_feature 1..20: note = CRISPR gRNA sequence
  source 1..20: mol_type = other DNA
tcctgtctcgtgtggattga

SEQ ID NO: 60430 - DNA, 20 bp, synthetic construct
  misc_feature 1..20: note = CRISPR gRNA sequence
  source 1..20: mol_type = other DNA
cactcaggctaacagggtag

SEQ ID NO: 60431 - DNA, 20 bp, synthetic construct
  misc_feature 1..20: note = CRISPR gRNA sequence
  source 1..20: mol_type = other DNA
catgacatgagtctttttta

SEQ ID NO: 60432 - DNA, 20 bp, synthetic construct
  misc_feature 1..20: note = CRISPR gRNA sequence
  source 1..20: mol_type = other DNA
agcatgtttcattgaccaaa

SEQ ID NO: 60433 - DNA, 20 bp, synthetic construct
  misc_feature 1..20: note = CRISPR gRNA sequence
  source 1..20: mol_type = other DNA
tcaaccatcgtcctctgtct

SEQ ID NO: 60434 - DNA, 20 bp, synthetic construct
  misc_feature 1..20: note = CRISPR gRNA sequence
  source 1..20: mol_type = other DNA
caatgactgataatgatgcc

SEQ ID NO: 60435 - DNA, 20 bp, synthetic construct
  misc_feature 1..20: note = CRISPR gRNA sequence
  source 1..20: mol_type = other DNA
cctgaggatggttagcctta

SEQ ID NO: 60436 - DNA, 20 bp, synthetic construct
  misc_feature 1..20: note = CRISPR gRNA sequence
  source 1..20: mol_type = other DNA
tccttggccatggtctttcc

SEQ ID NO: 60437 - DNA, 20 bp, synthetic construct
  misc_feature 1..20: note = CRISPR gRNA sequence
  source 1..20: mol_type = other DNA
gcctgaggatcatggtgtga

SEQ ID NO: 60438 - DNA, 20 bp, synthetic construct
  misc_feature 1..20: note = CRISPR gRNA sequence
  source 1..20: mol_type = other DNA
agcctctgggaattgggaag

SEQ ID NO: 60439 - DNA, 20 bp, synthetic construct
  misc_feature 1..20: note = CRISPR gRNA sequence
  source 1..20: mol_type = other DNA
gacagtgcctaatacacagt

SEQ ID NO: 60440 - DNA, 20 bp, synthetic construct
  misc_feature 1..20: note = CRISPR gRNA sequence
  source 1..20: mol_type = other DNA
ccccaactgttggacattta

SEQ ID NO: 60441 - DNA, 20 bp, synthetic construct
  misc_feature 1..20: note = CRISPR gRNA sequence
  source 1..20: mol_type = other DNA
aatattgtatatacgttcat

SEQ ID NO: 60442 - DNA, 20 bp, synthetic construct
  misc_feature 1..20: note = CRISPR gRNA sequence
  source 1..20: mol_type = other DNA
tcaaaggaactgcacattat

SEQ ID NO: 60443 - DNA, 20 bp, synthetic construct
  misc_feature 1..20: note = CRISPR gRNA sequence
  source 1..20: mol_type = other DNA
tattggtacttctagaagga

SEQ ID NO: 60444 - DNA, 20 bp, synthetic construct
  misc_feature 1..20: note = CRISPR gRNA sequence
  source 1..20: mol_type = other DNA
gggcagatcaccctgaggtc

SEQ ID NO: 60445 - DNA, 20 bp, synthetic construct
  misc_feature 1..20: note = CRISPR gRNA sequence
  source 1..20: mol_type = other DNA
tcgggaggctgaggcagaag

SEQ ID NO: 60446 - DNA, 20 bp, synthetic construct
  misc_feature 1..20: note = CRISPR gRNA sequence
  source 1..20: mol_type = other DNA
gaggcggaggctgcagtgag

SEQ ID NO: 60447 - DNA, 20 bp, synthetic construct
  misc_feature 1..20: note = CRISPR gRNA sequence
  source 1..20: mol_type = other DNA
ttccagttcagaagggaaga

SEQ ID NO: 60448 - DNA, 20 bp, synthetic construct
  misc_feature 1..20: note = CRISPR gRNA sequence
  source 1..20: mol_type = other DNA
gaggtgatggtctgtgttag

SEQ ID NO: 60449 - DNA, 20 bp, synthetic construct
  misc_feature 1..20: note = CRISPR gRNA sequence
  source 1..20: mol_type = other DNA
agcagaaagcactaaacaac

SEQ ID NO: 60450 - DNA, 20 bp, synthetic construct
  misc_feature 1..20: note = CRISPR gRNA sequence
  source 1..20: mol_type = other DNA
cagtgagcacagggcagatg

SEQ ID NO: 60451 - DNA, 20 bp, synthetic construct
  misc_feature 1..20: note = CRISPR gRNA sequence
  source 1..20: mol_type = other DNA
tcctcagtatgggttccacc

SEQ ID NO: 60452 - DNA, 20 bp, synthetic construct
  misc_feature 1..20: note = CRISPR gRNA sequence
  source 1..20: mol_type = other DNA
atactgaggaagaagggaag

SEQ ID NO: 60453 - DNA, 20 bp, synthetic construct
  misc_feature 1..20: note = CRISPR gRNA sequence
  source 1..20: mol_type = other DNA
aaatgtagggactggttctt

SEQ ID NO: 60454 - DNA, 20 bp, synthetic construct
  misc_feature 1..20: note = CRISPR gRNA sequence
  source 1..20: mol_type = other DNA
ccccaaatcacctgccccca

SEQ ID NO: 60455 - DNA, 20 bp, synthetic construct
  misc_feature 1..20: note = CRISPR gRNA sequence
  source 1..20: mol_type = other DNA
tgtcccccagctcatctgcc

SEQ ID NO: 60456 - DNA, 20 bp, synthetic construct
  misc_feature 1..20: note = CRISPR gRNA sequence
  source 1..20: mol_type = other DNA
gtcccctagctcacctcccc

SEQ ID NO: 60457 - DNA, 20 bp, synthetic construct
  misc_feature 1..20: note = CRISPR gRNA sequence
  source 1..20: mol_type = other DNA
tgtcccccagctcacctccc

SEQ ID NO: 60458 - DNA, 20 bp, synthetic construct
  misc_feature 1..20: note = CRISPR gRNA sequence
  source 1..20: mol_type = other DNA
tgtccctcagctcatctgcc

SEQ ID NO: 60459 - DNA, 20 bp, synthetic construct
  misc_feature 1..20: note = CRISPR gRNA sequence
  source 1..20: mol_type = other DNA
ttcttcctccccaacacgga

SEQ ID NO: 60460 - DNA, 20 bp, synthetic construct
  misc_feature 1..20: note = CRISPR gRNA sequence
  source 1..20: mol_type = other DNA
ctggaggacccctccttcta

SEQ ID NO: 60461 - DNA, 20 bp, synthetic construct
  misc_feature 1..20: note = CRISPR gRNA sequence
  source 1..20: mol_type = other DNA
aattgctcgaattgctgagt

SEQ ID NO: 60462 - DNA, 20 bp, synthetic construct
  misc_feature 1..20: note = CRISPR gRNA sequence
  source 1..20: mol_type = other DNA
ccacatagcccataatgccc

SEQ ID NO: 60463 - DNA, 20 bp, synthetic construct
  misc_feature 1..20: note = CRISPR gRNA sequence
  source 1..20: mol_type = other DNA
cttttttggcgggggtgggg

SEQ ID NO: 60464 - DNA, 20 bp, synthetic construct
  misc_feature 1..20: note = CRISPR gRNA sequence
  source 1..20: mol_type = other DNA
ggcgggggtgggggggtgtt

SEQ ID NO: 60465 - DNA, 20 bp, synthetic construct
  misc_feature 1..20: note = CRISPR gRNA sequence
  source 1..20: mol_type = other DNA
tttgtttgttgttgctcttg

SEQ ID NO: 60466 - DNA, 20 bp, synthetic construct
  misc_feature 1..20: note = CRISPR gRNA sequence
  source 1..20: mol_type = other DNA
ttgttgttgctcttgttggg

SEQ ID NO: 60467 - DNA, 20 bp, synthetic construct
  misc_feature 1..20: note = CRISPR gRNA sequence
  source 1..20: mol_type = other DNA
tgttgctcttgttgggtttt

SEQ ID NO: 60468 - DNA, 20 bp, synthetic construct
  misc_feature 1..20: note = CRISPR gRNA sequence
  source 1..20: mol_type = other DNA
gctcttgttgggttttgttt

SEQ ID NO: 60469 - DNA, 20 bp, synthetic construct
  misc_feature 1..20: note = CRISPR gRNA sequence
  source 1..20: mol_type = other DNA
tcccttggcctcccaaagtg

SEQ ID NO: 60470 - DNA, 20 bp, synthetic construct
  misc_feature 1..20: note = CRISPR gRNA sequence
  source 1..20: mol_type = other DNA
gagccatcacacctggctag

SEQ ID NO: 60471 - DNA, 20 bp, synthetic construct
  misc_feature 1..20: note = CRISPR gRNA sequence
  source 1..20: mol_type = other DNA
tcacacctggctagaggtgt

SEQ ID NO: 60472 - DNA, 20 bp, synthetic construct
  misc_feature 1..20: note = CRISPR gRNA sequence
  source 1..20: mol_type = other DNA
acctggctagaggtgttttt

SEQ ID NO: 60473 - DNA, 20 bp, synthetic construct
  misc_feature 1..20: note = CRISPR gRNA sequence
  source 1..20: mol_type = other DNA
ggctagaggtgtttttgttt

SEQ ID NO: 60474 - DNA, 20 bp, synthetic construct
  misc_feature 1..20: note = CRISPR gRNA sequence
  source 1..20: mol_type = other DNA
agaggtgtttttgtttgttt

SEQ ID NO: 60475 - DNA, 20 bp, synthetic construct
  misc_feature 1..20: note = CRISPR gRNA sequence
  source 1..20: mol_type = other DNA
ttctgccctctactgatccg

SEQ ID NO: 60476 - DNA, 20 bp, synthetic construct
  misc_feature 1..20: note = CRISPR gRNA sequence
  source 1..20: mol_type = other DNA
gtggggatttcttgggcacc

SEQ ID NO: 60477 - DNA, 20 bp, synthetic construct
  misc_feature 1..20: note = CRISPR gRNA sequence
  source 1..20: mol_type = other DNA
cacaggacattgaggggcaa

SEQ ID NO: 60478 - DNA, 20 bp, synthetic construct
  misc_feature 1..20: note = CRISPR gRNA sequence
  source 1..20: mol_type = other DNA
cctcctcctgcagtgacttt

SEQ ID NO: 60479 - DNA, 20 bp, synthetic construct
  misc_feature 1..20: note = CRISPR gRNA sequence
  source 1..20: mol_type = other DNA
cctgcagtgactttcaaggc

SEQ ID NO: 60480 - DNA, 20 bp, synthetic construct
  misc_feature 1..20: note = CRISPR gRNA sequence
  source 1..20: mol_type = other DNA
catctcccagccccaaagtg

SEQ ID NO: 60481 - DNA, 20 bp, synthetic construct
  misc_feature 1..20: note = CRISPR gRNA sequence
  source 1..20: mol_type = other DNA
tcttcagcgggggagccttt

SEQ ID NO: 60482 - DNA, 20 bp, synthetic construct
  misc_feature 1..20: note = CRISPR gRNA sequence
  source 1..20: mol_type = other DNA
ctgaaggagctcggaagggc

SEQ ID NO: 60483 - DNA, 20 bp, synthetic construct
  misc_feature 1..20: note = CRISPR gRNA sequence
  source 1..20: mol_type = other DNA
gtgattaaataatgaccacc

SEQ ID NO: 60484 - DNA, 20 bp, synthetic construct
  misc_feature 1..20: note = CRISPR gRNA sequence
  source 1..20: mol_type = other DNA
gtcacactttcatctcagca

SEQ ID NO: 60485 - DNA, 20 bp, synthetic construct
  misc_feature 1..20: note = CRISPR gRNA sequence
  source 1..20: mol_type = other DNA
tatctcatggctgtaaccag

SEQ ID NO: 60486 - DNA, 20 bp, synthetic construct
  misc_feature 1..20: note = CRISPR gRNA sequence
  source 1..20: mol_type = other DNA
ccagtgagtccctttttaat

SEQ ID NO: 60487 - DNA, 20 bp, synthetic construct
  misc_feature 1..20: note = CRISPR gRNA sequence
  source 1..20: mol_type = other DNA
ggggctgttcctattggtca

SEQ ID NO: 60488 - DNA, 20 bp, synthetic construct
  misc_feature 1..20: note = CRISPR gRNA sequence
  source 1..20: mol_type = other DNA
ttagcttagctgtaggagga

SEQ ID NO: 60489 - DNA, 20 bp, synthetic construct
  misc_feature 1..20: note = CRISPR gRNA sequence
  source 1..20: mol_type = other DNA
cctttctgggtccccttcct

SEQ ID NO: 60490 - DNA, 20 bp, synthetic construct
  misc_feature 1..20: note = CRISPR gRNA sequence
  source 1..20: mol_type = other DNA
actcttccagaaaggcatta

SEQ ID NO: 60491 - DNA, 20 bp, synthetic construct
  misc_feature 1..20: note = CRISPR gRNA sequence
  source 1..20: mol_type = other DNA
acttcacttatatgaccacc

SEQ ID NO: 60492 - DNA, 20 bp, synthetic construct
  misc_feature 1..20: note = CRISPR gRNA sequence
  source 1..20: mol_type = other DNA
atgaccaccggcggcttcca

SEQ ID NO: 60493 - DNA, 20 bp, synthetic construct
  misc_feature 1..20: note = CRISPR gRNA sequence
  source 1..20: mol_type = other DNA
ctgatggacagatggccatt

SEQ ID NO: 60494 - DNA, 20 bp, synthetic construct
  misc_feature 1..20: note = CRISPR gRNA sequence
  source 1..20: mol_type = other DNA
gccatttagtgcttggagct

SEQ ID NO: 60495 - DNA, 20 bp, synthetic construct
  misc_feature 1..20: note = CRISPR gRNA sequence
  source 1..20: mol_type = other DNA
tgggggctgctggctgttgg

SEQ ID NO: 60496 - DNA, 20 bp, synthetic construct
  misc_feature 1..20: note = CRISPR gRNA sequence
  source 1..20: mol_type = other DNA
ccccactcctccaccccttc

SEQ ID NO: 60497 - DNA, 20 bp, synthetic construct
  misc_feature 1..20: note = CRISPR gRNA sequence
  source 1..20: mol_type = other DNA
ggcccagtgactcttgtctc

SEQ ID NO: 60498 - DNA, 20 bp, synthetic construct
  misc_feature 1..20: note = CRISPR gRNA sequence
  source 1..20: mol_type = other DNA
gctggaagcaccatacaggt

SEQ ID NO: 60499 - DNA, 20 bp, synthetic construct
  misc_feature 1..20: note = CRISPR gRNA sequence
  source 1..20: mol_type = other DNA
acaggtctcagcttcgctgt

SEQ ID NO: 60500 - DNA, 20 bp, synthetic construct
  misc_feature 1..20: note = CRISPR gRNA sequence
  source 1..20: mol_type = other DNA
gaaggagacccagggaggag

SEQ ID NO: 60501 - DNA, 20 bp, synthetic construct
  misc_feature 1..20: note = CRISPR gRNA sequence
  source 1..20: mol_type = other DNA
gggcccatggggagacatgg

SEQ ID NO: 60502 - DNA, 20 bp, synthetic construct
  misc_feature 1..20: note = CRISPR gRNA sequence
  source 1..20: mol_type = other DNA
tgccaaccatggctataacc

SEQ ID NO: 60503 - DNA, 20 bp, synthetic construct
  misc_feature 1..20: note = CRISPR gRNA sequence
  source 1..20: mol_type = other DNA
atccagatattacagaaaga

SEQ ID NO: 60504 - DNA, 20 bp, synthetic construct
  misc_feature 1..20: note = CRISPR gRNA sequence
  source 1..20: mol_type = other DNA
caggaggatcacttgagacc

SEQ ID NO: 60505 - DNA, 20 bp, synthetic construct
  misc_feature 1..20: note = CRISPR gRNA sequence
  source 1..20: mol_type = other DNA
acacttccccattcccacct

SEQ ID NO: 60506 - DNA, 20 bp, synthetic construct
  misc_feature 1..20: note = CRISPR gRNA sequence
  source 1..20: mol_type = other DNA
gagagcctatgctcccttag

SEQ ID NO: 60507 - DNA, 20 bp, synthetic construct
  misc_feature 1..20: note = CRISPR gRNA sequence
  source 1..20: mol_type = other DNA
taacaagggcccgagggtga

SEQ ID NO: 60508 - DNA, 20 bp, synthetic construct
  misc_feature 1..20: note = CRISPR gRNA sequence
  source 1..20: mol_type = other DNA
agtgggcagagggccatctg

SEQ ID NO: 60509 - DNA, 20 bp, synthetic construct
  misc_feature 1..20: note = CRISPR gRNA sequence
  source 1..20: mol_type = other DNA
aggcagccatggtccacatg

SEQ ID NO: 60510 - DNA, 20 bp, synthetic construct
  misc_feature 1..20: note = CRISPR gRNA sequence
  source 1..20: mol_type = other DNA
cgcctgtctctgcctccacc

SEQ ID NO: 60511 - DNA, 20 bp, synthetic construct
  misc_feature 1..20: note = CRISPR gRNA sequence
  source 1..20: mol_type = other DNA
aaagatattgctccaccctt

SEQ ID NO: 60512 - DNA, 20 bp, synthetic construct
  misc_feature 1..20: note = CRISPR gRNA sequence
  source 1..20: mol_type = other DNA
cctgggcaccagcagacagg

SEQ ID NO: 60513 - DNA, 20 bp, synthetic construct
  misc_feature 1..20: note = CRISPR gRNA sequence
  source 1..20: mol_type = other DNA
tttcacccacctcagcctgc

SEQ ID NO: 60514 - DNA, 20 bp, synthetic construct
  misc_feature 1..20: note = CRISPR gRNA sequence
  source 1..20: mol_type = other DNA
cacagggaggcccccatcca

SEQ ID NO: 60515 - DNA, 20 bp, synthetic construct
  misc_feature 1..20: note = CRISPR gRNA sequence
  source 1..20: mol_type = other DNA
agagtggaggaggaccgggg

SEQ ID NO: 60516 - DNA, 20 bp, synthetic construct
  misc_feature 1..20: note = CRISPR gRNA sequence
  source 1..20: mol_type = other DNA
gaggaggaccggggagggga

SEQ ID NO: 60517 - DNA, 20 bp, synthetic construct
  misc_feature 1..20: note = CRISPR gRNA sequence
  source 1..20: mol_type = other DNA
aaatggatcctcctcttgtc

SEQ ID NO: 60518 - DNA, 20 bp, synthetic construct
  misc_feature 1..20: note = CRISPR gRNA sequence
  source 1..20: mol_type = other DNA
cacatgcacactgtctaggc

SEQ ID NO: 60519 - DNA, 20 bp, synthetic construct
  misc_feature 1..20: note = CRISPR gRNA sequence
  source 1..20: mol_type = other DNA
cgtcatgggtatatctgtgc

SEQ ID NO: 60520 - DNA, 20 bp, synthetic construct
  misc_feature 1..20: note = CRISPR gRNA sequence
  source 1..20: mol_type = other DNA
tgctgtagatgaagtggaga

SEQ ID NO: 60521 - DNA, 20 bp, synthetic construct
  misc_feature 1..20: note = CRISPR gRNA sequence
  source 1..20: mol_type = other DNA
agtggagaatgggctttggt

SEQ ID NO: 60522 - DNA, 20 bp, synthetic construct
  misc_feature 1..20: note = CRISPR gRNA sequence
  source 1..20: mol_type = other DNA
ccagcactgatcctctgaca

SEQ ID NO: 60523 - DNA, 20 bp, synthetic construct
  misc_feature 1..20: note = CRISPR gRNA sequence
  source 1..20: mol_type = other DNA
gacacttcgcttcttcttat

SEQ ID NO: 60524 - DNA, 20 bp, synthetic construct
  misc_feature 1..20: note = CRISPR gRNA sequence
  source 1..20: mol_type = other DNA
cctttgcagaagccctctcc

SEQ ID NO: 60525 - DNA, 20 bp, synthetic construct
  misc_feature 1..20: note = CRISPR gRNA sequence
  source 1..20: mol_type = other DNA
ctctccttaatcctacacaa

SEQ ID NO: 60526 - DNA, 20 bp, synthetic construct
  misc_feature 1..20: note = CRISPR gRNA sequence
  source 1..20: mol_type = other DNA
tcctcgttcctccccaccat

SEQ ID NO: 60527 - DNA, 20 bp, synthetic construct
  misc_feature 1..20: note = CRISPR gRNA sequence
  source 1..20: mol_type = other DNA
cgaggcatcagccacctggt

SEQ ID NO: 60528 - DNA, 20 bp, synthetic construct
  misc_feature 1..20: note = CRISPR gRNA sequence
  source 1..20: mol_type = other DNA
atgttcctccaagtctgacc

SEQ ID NO: 60529 - DNA, 20 bp, synthetic construct
  misc_feature 1..20: note = CRISPR gRNA sequence
  source 1..20: mol_type = other DNA
ggctcccagagtccccagag

SEQ ID NO: 60530 - DNA, 20 bp, synthetic construct
  misc_feature 1..20: note = CRISPR gRNA sequence
  source 1..20: mol_type = other DNA
tgccagcacactctaactaa

SEQ ID NO: 60531 - DNA, 20 bp, synthetic construct
  misc_feature 1..20: note = CRISPR gRNA sequence
  source 1..20: mol_type = other DNA
ctcctccctggcagaacgct

SEQ ID NO: 60532 - DNA, 20 bp, synthetic construct
  misc_feature 1..20: note = CRISPR gRNA sequence
  source 1..20: mol_type = other DNA
ctcggctgggcatctgtgaa

SEQ ID NO: 60533 - DNA, 20 bp, synthetic construct
  misc_feature 1..20: note = CRISPR gRNA sequence
  source 1..20: mol_type = other DNA
cagctaggaacccaggcaag

SEQ ID NO: 60534 - DNA, 20 bp, synthetic construct
  misc_feature 1..20: note = CRISPR gRNA sequence
  source 1..20: mol_type = other DNA
gaaagtgaggtcagagagga

SEQ ID NO: 60535 - DNA, 20 bp, synthetic construct
  misc_feature 1..20: note = CRISPR gRNA sequence
  source 1..20: mol_type = other DNA
ccatcctgtcacttgctaac

SEQ ID NO: 60536 - DNA, 20 bp, synthetic construct
  misc_feature 1..20: note = CRISPR gRNA sequence
  source 1..20: mol_type = other DNA
ggactgggccttggtctcct

SEQ ID NO: 60537 - DNA, 20 bp, synthetic construct
  misc_feature 1..20: note = CRISPR gRNA sequence
  source 1..20: mol_type = other DNA
ccctcacctaccacggctcc

SEQ ID NO: 60538 - DNA, 20 bp, synthetic construct
  misc_feature 1..20: note = CRISPR gRNA sequence
  source 1..20: mol_type = other DNA
gcagcccagtccctctctat

SEQ ID NO: 60539 - DNA, 20 bp, synthetic construct
  misc_feature 1..20: note = CRISPR gRNA sequence
  source 1..20: mol_type = other DNA
aggtctggggcccctggggt

SEQ ID NO: 60540 - DNA, 20 bp, synthetic construct
  misc_feature 1..20: note = CRISPR gRNA sequence
  source 1..20: mol_type = other DNA
gcatctgcgtgtcaacccta

SEQ ID NO: 60541 - DNA, 20 bp, synthetic construct
  misc_feature 1..20: note = CRISPR gRNA sequence
  source 1..20: mol_type = other DNA
agtcacgtgtcctaccgtca

SEQ ID NO: 60542 - DNA, 20 bp, synthetic construct
  misc_feature 1..20: note = CRISPR gRNA sequence
  source 1..20: mol_type = other DNA
ggataaatctgtgcataccc

SEQ ID NO: 60543 - DNA, 20 bp, synthetic construct
  misc_feature 1..20: note = CRISPR gRNA sequence
  source 1..20: mol_type = other DNA
gcataccctactgttttact

SEQ ID NO: 60544 - DNA, 20 bp, synthetic construct
  misc_feature 1..20: note = CRISPR gRNA sequence
  source 1..20: mol_type = other DNA
ctttaccttcagaacctagc

SEQ ID NO: 60545 - DNA, 20 bp, synthetic construct
  misc_feature 1..20: note = CRISPR gRNA sequence
  source 1..20: mol_type = other DNA
gatggatggatggatggatg

SEQ ID NO: 60546 - DNA, 20 bp, synthetic construct
  misc_feature 1..20: note = CRISPR gRNA sequence
  source 1..20: mol_type = other DNA
catggtgctgaaccaatata

SEQ ID NO: 60547 - DNA, 20 bp, synthetic construct
  misc_feature 1..20: note = CRISPR gRNA sequence
  source 1..20: mol_type = other DNA
cactttggaaggccaaggca

SEQ ID NO: 60548 - DNA, 20 bp, synthetic construct
  misc_feature 1..20: note = CRISPR gRNA sequence
  source 1..20: mol_type = other DNA
ctatttgggaggctgaggtg

SEQ ID NO: 60549 - DNA, 20 bp, synthetic construct
  misc_feature 1..20: note = CRISPR gRNA sequence
  source 1..20: mol_type = other DNA
ttgggaggctgaggtgggaa

SEQ ID NO: 60550 - DNA, 20 bp, synthetic construct
  misc_feature 1..20: note = CRISPR gRNA sequence
  source 1..20: mol_type = other DNA
tttattatatttcttgtgaa

SEQ ID NO: 60551 - DNA, 20 bp, synthetic construct
  misc_feature 1..20: note = CRISPR gRNA sequence
  source 1..20: mol_type = other DNA
tgactttttaaaacactctt

SEQ ID NO: 60552 - DNA, 20 bp, synthetic construct
  misc_feature 1..20: note = CRISPR gRNA sequence
  source 1..20: mol_type = other DNA
acataatcagtatttcacat

SEQ ID NO: 60553 - DNA, 20 bp, synthetic construct
  misc_feature 1..20: note = CRISPR gRNA sequence
  source 1..20: mol_type = other DNA
aaacacttttgctagttccg

SEQ ID NO: 60554 - DNA, 20 bp, synthetic construct
  misc_feature 1..20: note = CRISPR gRNA sequence
  source 1..20: mol_type = other DNA
gtttccctgtcaattgcaaa

SEQ ID NO: 60555 - DNA, 20 bp, synthetic construct
  misc_feature 1..20: note = CRISPR gRNA sequence
  source 1..20: mol_type = other DNA
ttgcaaaatcagctttatct

SEQ ID NO: 60556 - DNA, 20 bp, synthetic construct
  misc_feature 1..20: note = CRISPR gRNA sequence
  source 1..20: mol_type = other DNA
gtgcctgtggtgggtgatgt

SEQ ID NO: 60557 - DNA, 20 bp, synthetic construct
  misc_feature 1..20: note = CRISPR gRNA sequence
  source 1..20: mol_type = other DNA
gatgtgctggtttccagtct

SEQ ID NO: 60558 - DNA, 20 bp, synthetic construct
  misc_feature 1..20: note = CRISPR gRNA sequence
  source 1..20: mol_type = other DNA
ggtttccagtctctgggttt

SEQ ID NO: 60559 - DNA, 20 bp, synthetic construct
  misc_feature 1..20: note = CRISPR gRNA sequence
  source 1..20: mol_type = other DNA
tgctgcactgaggaatgaat

SEQ ID NO: 60560 - DNA, 20 bp, synthetic construct
  misc_feature 1..20: note = CRISPR gRNA sequence
  source 1..20: mol_type = other DNA
gaattactgcttaggttggc

SEQ ID NO: 60561 - DNA, 20 bp, synthetic construct
  misc_feature 1..20: note = CRISPR gRNA sequence
  source 1..20: mol_type = other DNA
taaatgagttactacactta

SEQ ID NO: 60562 - DNA, 20 bp, synthetic construct
  misc_feature 1..20: note = CRISPR gRNA sequence
  source 1..20: mol_type = other DNA
tgctggctattccagctgtg

SEQ ID NO: 60563 - DNA, 20 bp, synthetic construct
  misc_feature 1..20: note = CRISPR gRNA sequence
  source 1..20: mol_type = other DNA
tattccagctgtgcatggat

SEQ ID NO: 60564 - DNA, 20 bp, synthetic construct
  misc_feature 1..20: note = CRISPR gRNA sequence
  source 1..20: mol_type = other DNA
tggatgggctgagaaaaggg

SEQ ID NO: 60565 - DNA, 20 bp, synthetic construct
  misc_feature 1..20: note = CRISPR gRNA sequence
  source 1..20: mol_type = other DNA
atctctttcccttctctgga

SEQ ID NO: 60566 - DNA, 20 bp, synthetic construct
  misc_feature 1..20: note = CRISPR gRNA sequence
  source 1..20: mol_type = other DNA
cccttctctggatctcgatt

SEQ ID NO: 60567 - DNA, 20 bp, synthetic construct
  misc_feature 1..20: note = CRISPR gRNA sequence
  source 1..20: mol_type = other DNA
gaacgccaagcacgagaatc

SEQ ID NO: 60568 - DNA, 20 bp, synthetic construct
  misc_feature 1..20: note = CRISPR gRNA sequence
  source 1..20: mol_type = other DNA
caagatgctgacgttgggag

SEQ ID NO: 60569 - DNA, 20 bp, synthetic construct
  misc_feature 1..20: note = CRISPR gRNA sequence
  source 1..20: mol_type = other DNA
tgggaggatcgcttgagcct

SEQ ID NO: 60570 - DNA, 20 bp, synthetic construct
  misc_feature 1..20: note = CRISPR gRNA sequence
  source 1..20: mol_type = other DNA
tgtcactttcttttccctct

SEQ ID NO: 60571 - DNA, 20 bp, synthetic construct
  misc_feature 1..20: note = CRISPR gRNA sequence
  source 1..20: mol_type = other DNA
ttgagaggctgagggggcag

SEQ ID NO: 60572 - DNA, 20 bp, synthetic construct
  misc_feature 1..20: note = CRISPR gRNA sequence
  source 1..20: mol_type = other DNA
aaaaaaaaaatagctgggca

SEQ ID NO: 60573 - DNA, 20 bp, synthetic construct
  misc_feature 1..20: note = CRISPR gRNA sequence
  source 1..20: mol_type = other DNA
tgggaggatcacttgagccc

SEQ ID NO: 60574 - DNA, 20 bp, synthetic construct
  misc_feature 1..20: note = CRISPR gRNA sequence
  source 1..20: mol_type = other DNA
ctgggatagagccactgcac

SEQ ID NO: 60575 - DNA, 20 bp, synthetic construct
  misc_feature 1..20: note = CRISPR gRNA sequence
  source 1..20: mol_type = other DNA
tgaaacctggctcatgatgt

SEQ ID NO: 60576 - DNA, 20 bp, synthetic construct
  misc_feature 1..20: note = CRISPR gRNA sequence
  source 1..20: mol_type = other DNA
cagcccagtgggagagagtc

SEQ ID NO: 60577 - DNA, 20 bp, synthetic construct
  misc_feature 1..20: note = CRISPR gRNA sequence
  source 1..20: mol_type = other DNA
accatcacatcatcgacaat

SEQ ID NO: 60578 - DNA, 20 bp, synthetic construct
  misc_feature 1..20: note = CRISPR gRNA sequence
  source 1..20: mol_type = other DNA
acatcatcgacaatagcagc

SEQ ID NO: 60579 - DNA, 20 bp, synthetic construct
  misc_feature 1..20: note = CRISPR gRNA sequence
  source 1..20: mol_type = other DNA
agcagcttctgtttactaac

SEQ ID NO: 60580 - DNA, 20 bp, synthetic construct
  misc_feature 1..20: note = CRISPR gRNA sequence
  source 1..20: mol_type = other DNA
cctatgtgctagatgttgtc

SEQ ID NO: 60581 - DNA, 20 bp, synthetic construct
  misc_feature 1..20: note = CRISPR gRNA sequence
  source 1..20: mol_type = other DNA
agagaaaagggagccgactg

SEQ ID NO: 60582 - DNA, 20 bp, synthetic construct
  misc_feature 1..20: note = CRISPR gRNA sequence
  source 1..20: mol_type = other DNA
tgttaccgactcactttggg

SEQ ID NO: 60583 - DNA, 20 bp, synthetic construct
  misc_feature 1..20: note = CRISPR gRNA sequence
  source 1..20: mol_type = other DNA
agcctctagaagccaaggaa

SEQ ID NO: 60584 - DNA, 20 bp, synthetic construct
  misc_feature 1..20: note = CRISPR gRNA sequence
  source 1..20: mol_type = other DNA
ctagatgcctgagcccaggc

SEQ ID NO: 60585 - DNA, 20 bp, synthetic construct
  misc_feature 1..20: note = CRISPR gRNA sequence
  source 1..20: mol_type = other DNA
atgcctgagcccaggccaat

SEQ ID NO: 60586 - DNA, 20 bp, synthetic construct
  misc_feature 1..20: note = CRISPR gRNA sequence
  source 1..20: mol_type = other DNA
agaggaaaggggctcagagc

SEQ ID NO: 60587 - DNA, 20 bp, synthetic construct
  misc_feature 1..20: note = CRISPR gRNA sequence
  source 1..20: mol_type = other DNA
aaagcagatgagggacaggg

SEQ ID NO: 60588 - DNA, 20 bp, synthetic construct
  misc_feature 1..20: note = CRISPR gRNA sequence
  source 1..20: mol_type = other DNA
gcccatcctggatagcccat

SEQ ID NO: 60589 - DNA, 20 bp, synthetic construct
  misc_feature 1..20: note = CRISPR gRNA sequence
  source 1..20: mol_type = other DNA
tatatgccgggcattgcact

SEQ ID NO: 60590 - DNA, 20 bp, synthetic construct
  misc_feature 1..20: note = CRISPR gRNA sequence
  source 1..20: mol_type = other DNA
ccagctactaagaggtgtgg

SEQ ID NO: 60591 - DNA, 20 bp, synthetic construct
  misc_feature 1..20: note = CRISPR gRNA sequence
  source 1..20: mol_type = other DNA
tggaggggccatggagtagg

SEQ ID NO: 60592 - DNA, 20 bp, synthetic construct
  misc_feature 1..20: note = CRISPR gRNA sequence
  source 1..20: mol_type = other DNA
ctggctgaagccaataagag

SEQ ID NO: 60593 - DNA, 20 bp, synthetic construct
  misc_feature 1..20: note = CRISPR gRNA sequence
  source 1..20: mol_type = other DNA
gaaccaggacagaattagaa

SEQ ID NO: 60594 - DNA, 20 bp, synthetic construct
  misc_feature 1..20: note = CRISPR gRNA sequence
  source 1..20: mol_type = other DNA
cccctcgccttgccttcctt

SEQ ID NO: 60595 - DNA, 20 bp, synthetic construct
  misc_feature 1..20: note = CRISPR gRNA sequence
  source 1..20: mol_type = other DNA
cttgccttccttgctggctt

SEQ ID NO: 60596 - DNA, 20 bp, synthetic construct
  misc_feature 1..20: note = CRISPR gRNA sequence
  source 1..20: mol_type = other DNA
tgccacagggcctttgaatg

SEQ ID NO: 60597 - DNA, 20 bp, synthetic construct
  misc_feature 1..20: note = CRISPR gRNA sequence
  source 1..20: mol_type = other DNA
aactcccagttatttcagca

SEQ ID NO: 60598 - DNA, 20 bp, synthetic construct
  misc_feature 1..20: note = CRISPR gRNA sequence
  source 1..20: mol_type = other DNA
gtcagatgcccccataatca

SEQ ID NO: 60599 - DNA, 20 bp, synthetic construct
  misc_feature 1..20: note = CRISPR gRNA sequence
  source 1..20: mol_type = other DNA
tgcacttaaccactctgcac

SEQ ID NO: 60600 - DNA, 20 bp, synthetic construct
  misc_feature 1..20: note = CRISPR gRNA sequence
  source 1..20: mol_type = other DNA
caggcatgtggtatggagtc

SEQ ID NO: 60601 - DNA, 20 bp, synthetic construct
  misc_feature 1..20: note = CRISPR gRNA sequence
  source 1..20: mol_type = other DNA
agcaaaggaggagtaagtga

SEQ ID NO: 60602 - DNA, 20 bp, synthetic construct
  misc_feature 1..20: note = CRISPR gRNA sequence
  source 1..20: mol_type = other DNA
gggtgctgatccactgccac

SEQ ID NO: 60603 - DNA, 20 bp, synthetic construct
  misc_feature 1..20: note = CRISPR gRNA sequence
  source 1..20: mol_type = other DNA
cccaactccagcaaagtcaa

SEQ ID NO: 60604 - DNA, 20 bp, synthetic construct
  misc_feature 1..20: note = CRISPR gRNA sequence
  source 1..20: mol_type = other DNA
aaatgcgttcattatacatc

SEQ ID NO: 60605 - DNA, 20 bp, synthetic construct
  misc_feature 1..20: note = CRISPR gRNA sequence
  source 1..20: mol_type = other DNA
ggtgttgcatggggtgaggg

SEQ ID NO: 60606 - DNA, 20 bp, synthetic construct
  misc_feature 1..20: note = CRISPR gRNA sequence
  source 1..20: mol_type = other DNA
gtcttaggatcaagtgtggg

SEQ ID NO: 60607 - DNA, 20 bp, synthetic construct
  misc_feature 1..20: note = CRISPR gRNA sequence
  source 1..20: mol_type = other DNA
tgggtcgggtttggggagtg

SEQ ID NO: 60608 - DNA, 20 bp, synthetic construct
  misc_feature 1..20: note = CRISPR gRNA sequence
  source 1..20: mol_type = other DNA
gagtgttgagattgggtagc

SEQ ID NO: 60609 - DNA, 20 bp, synthetic construct
  misc_feature 1..20: note = CRISPR gRNA sequence
  source 1..20: mol_type = other DNA
gggtagcagtggtttggggc

SEQ ID NO: 60610 - DNA, 20 bp, synthetic construct
  misc_feature 1..20: note = CRISPR gRNA sequence
  source 1..20: mol_type = other DNA
cagtggtttggggcctcagc

SEQ ID NO: 60611 - DNA, 20 bp, synthetic construct
  misc_feature 1..20: note = CRISPR gRNA sequence
  source 1..20: mol_type = other DNA
gtaattgaatgtctctgggc

SEQ ID NO: 60612 - DNA, 20 bp, synthetic construct
  misc_feature 1..20: note = CRISPR gRNA sequence
  source 1..20: mol_type = other DNA
gatgggggtgtcatgcattt

SEQ ID NO: 60613 - DNA, 20 bp, synthetic construct
  misc_feature 1..20: note = CRISPR gRNA sequence
  source 1..20: mol_type = other DNA
tctccacagcctcagtaaca

SEQ ID NO: 60614 - DNA, 20 bp, synthetic construct
  misc_feature 1..20: note = CRISPR gRNA sequence
  source 1..20: mol_type = other DNA
tgctgtggatataggctgct

SEQ ID NO: 60615 - DNA, 20 bp, synthetic construct
  misc_feature 1..20: note = CRISPR gRNA sequence
  source 1..20: mol_type = other DNA
gagactaggccaaggacttg

SEQ ID NO: 60616 - DNA, 20 bp, synthetic construct
  misc_feature 1..20: note = CRISPR gRNA sequence
  source 1..20: mol_type = other DNA
taggccaaggacttgctccg

SEQ ID NO: 60617 - DNA, 20 bp, synthetic construct
  misc_feature 1..20: note = CRISPR gRNA sequence
  source 1..20: mol_type = other DNA
tttggcttccctcagtccct

SEQ ID NO: 60618 - DNA, 20 bp, synthetic construct
  misc_feature 1..20: note = CRISPR gRNA sequence
  source 1..20: mol_type = other DNA
tatggggaggtgaggacaga

SEQ ID NO: 60619 - DNA, 20 bp, synthetic construct
  misc_feature 1..20: note = CRISPR gRNA sequence
  source 1..20: mol_type = other DNA
tctcaacccagtagggtggt

SEQ ID NO: 60620 - DNA, 20 bp, synthetic construct
  misc_feature 1..20: note = CRISPR gRNA sequence
  source 1..20: mol_type = other DNA
ccctcaagggaggagaggga

SEQ ID NO: 60621 - DNA, 20 bp, synthetic construct
  misc_feature 1..20: note = CRISPR gRNA sequence
  source 1..20: mol_type = other DNA
ggaaaccgattcacccaaaa

SEQ ID NO: 60622 - DNA, 20 bp, synthetic construct
  misc_feature 1..20: note = CRISPR gRNA sequence
  source 1..20: mol_type = other DNA
ggaccttggttcactgtata

SEQ ID NO: 60623 - DNA, 20 bp, synthetic construct
  misc_feature 1..20: note = CRISPR gRNA sequence
  source 1..20: mol_type = other DNA
aacttatactaaataaatta

SEQ ID NO: 60624 - DNA, 20 bp, synthetic construct
  misc_feature 1..20: note = CRISPR gRNA sequence
  source 1..20: mol_type = other DNA
aaaaaaaaagaaaatagctg

SEQ ID NO: 60625 - DNA, 20 bp, synthetic construct
  misc_feature 1..20: note = CRISPR gRNA sequence
  source 1..20: mol_type = other DNA
aaaaaaaatgataatatagg

SEQ ID NO: 60626 - DNA, 20 bp, synthetic construct
  misc_feature 1..20: note = CRISPR gRNA sequence
  source 1..20: mol_type = other DNA
tctcttagtctcccaaagtg

SEQ ID NO: 60627 - DNA, 20 bp, synthetic construct
  misc_feature 1..20: note = CRISPR gRNA sequence
  source 1..20: mol_type = other DNA
tgccctggcctcccaaagag

SEQ ID NO: 60628 - DNA, 20 bp, synthetic construct
  misc_feature 1..20: note = CRISPR gRNA sequence
  source 1..20: mol_type = other DNA
aaattttaactcattatctt

SEQ ID NO: 60629 - DNA, 20 bp, synthetic construct
  misc_feature 1..20: note = CRISPR gRNA sequence
  source 1..20: mol_type = other DNA
tcattatcttaaaagattat

SEQ ID NO: 60630 - DNA, 20 bp, synthetic construct
  misc_feature 1..20: note = CRISPR gRNA sequence
  source 1..20: mol_type = other DNA
aagattataaaagattataa

SEQ ID NO: 60631 - DNA, 20 bp, synthetic construct
  misc_feature 1..20: note = CRISPR gRNA sequence
  source 1..20: mol_type = other DNA
tattaataattatttgtcat

SEQ ID NO: 60632 - DNA, 20 bp, synthetic construct
  misc_feature 1..20: note = CRISPR gRNA sequence
  source 1..20: mol_type = other DNA
gcttctagcccttaaaaaac

SEQ ID NO: 60633 - DNA, 20 bp, synthetic construct
  misc_feature 1..20: note = CRISPR gRNA sequence
  source 1..20: mol_type = other DNA
taatgtttaaaaagagaatc

SEQ ID NO: 60634 - DNA, 20 bp, synthetic construct
  misc_feature 1..20: note = CRISPR gRNA sequence
  source 1..20: mol_type = other DNA
agagaatctatagtttaatc

SEQ ID NO: 60635 - DNA, 20 bp, synthetic construct
  misc_feature 1..20: note = CRISPR gRNA sequence
  source 1..20: mol_type = other DNA
aattattgcactagaaaatg

SEQ ID NO: 60636 - DNA, 20 bp, synthetic construct
  misc_feature 1..20: note = CRISPR gRNA sequence
  source 1..20: mol_type = other DNA
gaacactgactagcagagag

SEQ ID NO: 60637 - DNA, 20 bp, synthetic construct
  misc_feature 1..20: note = CRISPR gRNA sequence
  source 1..20: mol_type = other DNA
gctaaaagagagaacacaga

SEQ ID NO: 60638 - DNA, 20 bp, synthetic construct
  misc_feature 1..20: note = CRISPR gRNA sequence
  source 1..20: mol_type = other DNA
ttttaagacttgccaggaaa

SEQ ID NO: 60639 - DNA, 20 bp, synthetic construct
  misc_feature 1..20: note = CRISPR gRNA sequence
  source 1..20: mol_type = other DNA
tttgtgaaatatctgtggta

SEQ ID NO: 60640 - DNA, 20 bp, synthetic construct
  misc_feature 1..20: note = CRISPR gRNA sequence
  source 1..20: mol_type = other DNA
ctactcaggaggctgaagtg

SEQ ID NO: 60641 - DNA, 20 bp, synthetic construct
  misc_feature 1..20: note = CRISPR gRNA sequence
  source 1..20: mol_type = other DNA
tcaggaggctgaagtgggag

SEQ ID NO: 60642 - DNA, 20 bp, synthetic construct
  misc_feature 1..20: note = CRISPR gRNA sequence
  source 1..20: mol_type = other DNA
attgcttgagcccaggaggt

SEQ ID NO: 60643 - DNA, 20 bp, synthetic construct
  misc_feature 1..20: note = CRISPR gRNA sequence
  source 1..20: mol_type = other DNA
gaggtggaggcttcagtgag

SEQ ID NO: 60644 - DNA, 20 bp, synthetic construct
  misc_feature 1..20: note = CRISPR gRNA sequence
  source 1..20: mol_type = other DNA
ccatgattgcaccactgcac

SEQ ID NO: 60645 - DNA, 20 bp, synthetic construct
  misc_feature 1..20: note = CRISPR gRNA sequence
  source 1..20: mol_type = other DNA
gtaacagggagccaataacc

SEQ ID NO: 60646 - DNA, 20 bp, synthetic construct
  misc_feature 1..20: note = CRISPR gRNA sequence
  source 1..20: mol_type = other DNA
gcagcacaaaactgtgatct

SEQ ID NO: 60647 - DNA, 20 bp, synthetic construct
  misc_feature 1..20: note = CRISPR gRNA sequence
  source 1..20: mol_type = other DNA
ggggccccaggagaggtagg

SEQ ID NO: 60648 - DNA, 20 bp, synthetic construct
  misc_feature 1..20: note = CRISPR gRNA sequence
  source 1..20: mol_type = other DNA
cacggaagagcgggaagtga

SEQ ID NO: 60649 - DNA, 20 bp, synthetic construct
  misc_feature 1..20: note = CRISPR gRNA sequence
  source 1..20: mol_type = other DNA
gcaggagttgggtagccaga

SEQ ID NO: 60650 - DNA, 20 bp, synthetic construct
  misc_feature 1..20: note = CRISPR gRNA sequence
  source 1..20: mol_type = other DNA
attccgggagactagagccc

SEQ ID NO: 60651 - DNA, 20 bp, synthetic construct
  misc_feature 1..20: note = CRISPR gRNA sequence
  source 1..20: mol_type = other DNA
gagccctccagcttaaaccc

SEQ ID NO: 60652 - DNA, 20 bp, synthetic construct
  misc_feature 1..20: note = CRISPR gRNA sequence
  source 1..20: mol_type = other DNA
acacaaggacccattagggt

SEQ ID NO: 60653 - DNA, 20 bp, synthetic construct
  misc_feature 1..20: note = CRISPR gRNA sequence
  source 1..20: mol_type = other DNA
tagagtctggactactgaag

SEQ ID NO: 60654 - DNA, 20 bp, synthetic construct
  misc_feature 1..20: note = CRISPR gRNA sequence
  source 1..20: mol_type = other DNA
aagcacagatgaggaggagg

SEQ ID NO: 60655 - DNA, 20 bp, synthetic construct
  misc_feature 1..20: note = CRISPR gRNA sequence
  source 1..20: mol_type = other DNA
tacagtctcccattgagagg

SEQ ID NO: 60656 - DNA, 20 bp, synthetic construct
  misc_feature 1..20: note = CRISPR gRNA sequence
  source 1..20: mol_type = other DNA
gaagccaaattggcaccaag

SEQ ID NO: 60657 - DNA, 20 bp, synthetic construct
  misc_feature 1..20: note = CRISPR gRNA sequence
  source 1..20: mol_type = other DNA
tggtggaaggccaggctgag

SEQ ID NO: 60658 - DNA, 20 bp, synthetic construct
  misc_feature 1..20: note = CRISPR gRNA sequence
  source 1..20: mol_type = other DNA
gtgatggcctccagccctgt

SEQ ID NO: 60659 - DNA, 20 bp, synthetic construct
  misc_feature 1..20: note = CRISPR gRNA sequence
  source 1..20: mol_type = other DNA
gctgtgtccaggggtcatgg

SEQ ID NO: 60660 - DNA, 20 bp, synthetic construct
  misc_feature 1..20: note = CRISPR gRNA sequence
  source 1..20: mol_type = other DNA
taatctccctctgtccctct

SEQ ID NO: 60661 - DNA, 20 bp, synthetic construct
  misc_feature 1..20: note = CRISPR gRNA sequence
  source 1..20: mol_type = other DNA
ttccctctctcatcgtgtat

SEQ ID NO: 60662 - DNA, 20 bp, synthetic construct
  misc_feature 1..20: note = CRISPR gRNA sequence
  source 1..20: mol_type = other DNA
tcatcgtgtatttctgtttt

SEQ ID NO: 60663 - DNA, 20 bp, synthetic construct
  misc_feature 1..20: note = CRISPR gRNA sequence
  source 1..20: mol_type = other DNA
tctctctgaggtctctgtgc

SEQ ID NO: 60664 - DNA, 20 bp, synthetic construct
  misc_feature 1..20: note = CRISPR gRNA sequence
  source 1..20: mol_type = other DNA
gttcagtggggcatgcagca

SEQ ID NO: 60665 - DNA, 20 bp, synthetic construct
  misc_feature 1..20: note = CRISPR gRNA sequence
  source 1..20: mol_type = other DNA
ggtcacctccacctcgagtg

SEQ ID NO: 60666 - DNA, 20 bp, synthetic construct
  misc_feature 1..20: note = CRISPR gRNA sequence
  source 1..20: mol_type = other DNA
caattacagtgagttagtgt

SEQ ID NO: 60667 - DNA, 20 bp, synthetic construct
  misc_feature 1..20: note = CRISPR gRNA sequence
  source 1..20: mol_type = other DNA
cagtgagttagtgttggtgt

SEQ ID NO: 60668 - DNA, 20 bp, synthetic construct
  misc_feature 1..20: note = CRISPR gRNA sequence
  source 1..20: mol_type = other DNA
agttagtgttggtgtttggg

SEQ ID NO: 60669 - DNA, 20 bp, synthetic construct
  misc_feature 1..20: note = CRISPR gRNA sequence
  source 1..20: mol_type = other DNA
ttggtgtttgggtttggttt

SEQ ID NO: 60670 - DNA, 20 bp, synthetic construct
  misc_feature 1..20: note = CRISPR gRNA sequence
  source 1..20: mol_type = other DNA
cctggcagcccagggctgtg

SEQ ID NO: 60671 - DNA, 20 bp, synthetic construct
  misc_feature 1..20: note = CRISPR gRNA sequence
  source 1..20: mol_type = other DNA
tcccctcccttctccccacc

SEQ ID NO: 60672 - DNA, 20 bp, synthetic construct
  misc_feature 1..20: note = CRISPR gRNA sequence
  source 1..20: mol_type = other DNA
cctctttcctggggttattg

SEQ ID NO: 60673 - DNA, 20 bp, synthetic construct
  misc_feature 1..20: note = CRISPR gRNA sequence
  source 1..20: mol_type = other DNA
ctcggtgaaggctagctaat

SEQ ID NO: 60674 - DNA, 20 bp, synthetic construct
  misc_feature 1..20: note = CRISPR gRNA sequence
  source 1..20: mol_type = other DNA
ctgtgactcaataatcccac

SEQ ID NO: 60675 - DNA, 20 bp, synthetic construct
  misc_feature 1..20: note = CRISPR gRNA sequence
  source 1..20: mol_type = other DNA
caataatcccacttctgatt

SEQ ID NO: 60676 - DNA, 20 bp, synthetic construct
  misc_feature 1..20: note = CRISPR gRNA sequence
  source 1..20: mol_type = other DNA
acctgtctccgcatctctga

SEQ ID NO: 60677 - DNA, 20 bp, synthetic construct
  misc_feature 1..20: note = CRISPR gRNA sequence
  source 1..20: mol_type = other DNA
gtatggtcagggtagacagg

SEQ ID NO: 60678 - DNA, 20 bp, synthetic construct
  misc_feature 1..20: note = CRISPR gRNA sequence
  source 1..20: mol_type = other DNA
gagtgtgtaggaggaatccc

SEQ ID NO: 60679 - DNA, 20 bp, synthetic construct
  misc_feature 1..20: note = CRISPR gRNA sequence
  source 1..20: mol_type = other DNA
tcttgatccctaaatgccct

SEQ ID NO: 60680 - DNA, 20 bp, synthetic construct
  misc_feature 1..20: note = CRISPR gRNA sequence
  source 1..20: mol_type = other DNA
attccaggctgtctctgtga

SEQ ID NO: 60681 - DNA, 20 bp, synthetic construct
  misc_feature 1..20: note = CRISPR gRNA sequence
  source 1..20: mol_type = other DNA
ctctgtgaacacgctttgct

SEQ ID NO: 60682 - DNA, 20 bp, synthetic construct
  misc_feature 1..20: note = CRISPR gRNA sequence
  source 1..20: mol_type = other DNA
ctaaggaccccctgctcaca

SEQ ID NO: 60683 - DNA, 20 bp, synthetic construct
  misc_feature 1..20: note = CRISPR gRNA sequence
  source 1..20: mol_type = other DNA
aggcaaattacatgaagact

SEQ ID NO: 60684 - DNA, 20 bp, synthetic construct
  misc_feature 1..20: note = CRISPR gRNA sequence
  source 1..20: mol_type = other DNA
aaagaaaggagacactttgt

SEQ ID NO: 60685 - DNA, 20 bp, synthetic construct
  misc_feature 1..20: note = CRISPR gRNA sequence
  source 1..20: mol_type = other DNA
tctcataaccttgggctaga

SEQ ID NO: 60686 - DNA, 20 bp, synthetic construct
  misc_feature 1..20: note = CRISPR gRNA sequence
  source 1..20: mol_type = other DNA
gaccttgattctctctagga

SEQ ID NO: 60687 - DNA, 20 bp, synthetic construct
  misc_feature 1..20: note = CRISPR gRNA sequence
  source 1..20: mol_type = other DNA
gtgccctgaccacaaagagg

SEQ ID NO: 60688 - DNA, 20 bp, synthetic construct
  misc_feature 1..20: note = CRISPR gRNA sequence
  source 1..20: mol_type = other DNA
tgatctccagcctcagtgag

SEQ ID NO: 60689 - DNA, 20 bp, synthetic construct
  misc_feature 1..20: note = CRISPR gRNA sequence
  source 1..20: mol_type = other DNA
gtttgtccctggatgccgtg

SEQ ID NO: 60690 - DNA, 20 bp, synthetic construct
  misc_feature 1..20: note = CRISPR gRNA sequence
  source 1..20: mol_type = other DNA
atgccgtgttgggtttggtt

SEQ ID NO: 60691 - DNA, 20 bp, synthetic construct
  misc_feature 1..20: note = CRISPR gRNA sequence
  source 1..20: mol_type = other DNA
tctccactctgcagtggctc

SEQ ID NO: 60692 - DNA, 20 bp, synthetic construct
  misc_feature 1..20: note = CRISPR gRNA sequence
  source 1..20: mol_type = other DNA
cccacgtgggccccttgtcc

SEQ ID NO: 60693 - DNA, 20 bp, synthetic construct
  misc_feature 1..20: note = CRISPR gRNA sequence
  source 1..20: mol_type = other DNA
ctcgttctttggatagtcct

SEQ ID NO: 60694 - DNA, 20 bp, synthetic construct
  misc_feature 1..20: note = CRISPR gRNA sequence
  source 1..20: mol_type = other DNA
gtccttagagattttttttt

SEQ ID NO: 60695 - DNA, 20 bp, synthetic construct
  misc_feature 1..20: note = CRISPR gRNA sequence
  source 1..20: mol_type = other DNA
agggtacatgtgcacaacat

SEQ ID NO: 60696 - DNA, 20 bp, synthetic construct
  misc_feature 1..20: note = CRISPR gRNA sequence
  source 1..20: mol_type = other DNA
tgggcggatcacgtgaggtc

SEQ ID NO: 60697 - DNA, 20 bp, synthetic construct
  misc_feature 1..20: note = CRISPR gRNA sequence
  source 1..20: mol_type = other DNA
aaagaaaagaaaagaaaact

SEQ ID NO: 60698 - DNA, 20 bp, synthetic construct
  misc_feature 1..20: note = CRISPR gRNA sequence
  source 1..20: mol_type = other DNA
aggcactcagggcaccgcat

SEQ ID NO: 60699 - DNA, 20 bp, synthetic construct
  misc_feature 1..20: note = CRISPR gRNA sequence
  source 1..20: mol_type = other DNA
atccatgattttcaggggag

SEQ ID NO: 60700 - DNA, 20 bp, synthetic construct
  misc_feature 1..20: note = CRISPR gRNA sequence
  source 1..20: mol_type = other DNA
gtcccagagcctctccaggc

SEQ ID NO: 60701 - DNA, 20 bp, synthetic construct
  misc_feature 1..20: note = CRISPR gRNA sequence
  source 1..20: mol_type = other DNA
gaggaggatcacctgagcct

SEQ ID NO: 60702 - DNA, 20 bp, synthetic construct
  misc_feature 1..20: note = CRISPR gRNA sequence
  source 1..20: mol_type = other DNA
ctacttgggaggctgaggtg

SEQ ID NO: 60703 - DNA, 20 bp, synthetic construct
  misc_feature 1..20: note = CRISPR gRNA sequence
  source 1..20: mol_type = other DNA
ttgggaggctgaggtgggag

SEQ ID NO: 60704 - DNA, 20 bp, synthetic construct
  misc_feature 1..20: note = CRISPR gRNA sequence
  source 1..20: mol_type = other DNA
ttgggaggctaaggcaggag

SEQ ID NO: 60705 - DNA, 20 bp, synthetic construct
  misc_feature 1..20: note = CRISPR gRNA sequence
  source 1..20: mol_type = other DNA
caggaggatcgtttgagcca

SEQ ID NO: 60706 - DNA, 20 bp, synthetic construct
  misc_feature 1..20: note = CRISPR gRNA sequence
  source 1..20: mol_type = other DNA
caaagaagaatttcttacct

SEQ ID NO: 60707 - DNA, 20 bp, synthetic construct
  misc_feature 1..20: note = CRISPR gRNA sequence
  source 1..20: mol_type = other DNA
tcaaatgagaaatgtcgatg

SEQ ID NO: 60708 - DNA, 20 bp, synthetic construct
  misc_feature 1..20: note = CRISPR gRNA sequence
  source 1..20: mol_type = other DNA
tgtgacttgatacatgtaat

SEQ ID NO: 60709 - DNA, 20 bp, synthetic construct
  misc_feature 1..20: note = CRISPR gRNA sequence
  source 1..20: mol_type = other DNA
taattgttgcttaatctatt

SEQ ID NO: 60710 - DNA, 20 bp, synthetic construct
  misc_feature 1..20: note = CRISPR gRNA sequence
  source 1..20: mol_type = other DNA
gtctttgaccattttcaaac

SEQ ID NO: 60711 - DNA, 20 bp, synthetic construct
  misc_feature 1..20: note = CRISPR gRNA sequence
  source 1..20: mol_type = other DNA
ttttcaaactgctgcttcct

SEQ ID NO: 60712 - DNA, 20 bp, synthetic construct
  misc_feature 1..20: note = CRISPR gRNA sequence
  source 1..20: mol_type = other DNA
actgctgcttcctctctgct

SEQ ID NO: 60713 - DNA, 20 bp, synthetic construct
  misc_feature 1..20: note = CRISPR gRNA sequence
  source 1..20: mol_type = other DNA
aaccacccaagtccggcaca

SEQ ID NO: 60714 - DNA, 20 bp, synthetic construct
  misc_feature 1..20: note = CRISPR gRNA sequence
  source 1..20: mol_type = other DNA
aaattgtcagtaatcaactg

SEQ ID NO: 60715 - DNA, 20 bp, synthetic construct
  misc_feature 1..20: note = CRISPR gRNA sequence
  source 1..20: mol_type = other DNA
cccagagcagggcaggtgcc

SEQ ID NO: 60716 - DNA, 20 bp, synthetic construct
  misc_feature 1..20: note = CRISPR gRNA sequence
  source 1..20: mol_type = other DNA
gggaggagacaggagaacat

SEQ ID NO: 60717 - DNA, 20 bp, synthetic construct
  misc_feature 1..20: note = CRISPR gRNA sequence
  source 1..20: mol_type = other DNA
acaggagaacatttgtgctt

SEQ ID NO: 60718 - DNA, 20 bp, synthetic construct
  misc_feature 1..20: note = CRISPR gRNA sequence
  source 1..20: mol_type = other DNA
cttcgcagtaaacaaccaat

SEQ ID NO: 60719 - DNA, 20 bp, synthetic construct
  misc_feature 1..20: note = CRISPR gRNA sequence
  source 1..20: mol_type = other DNA
ggtggctcaagcctgggtgg

SEQ ID NO: 60720 - DNA, 20 bp, synthetic construct
  misc_feature 1..20: note = CRISPR gRNA sequence
  source 1..20: mol_type = other DNA
cttgcttcccaggataggat

SEQ ID NO: 60721 - DNA, 20 bp, synthetic construct
  misc_feature 1..20: note = CRISPR gRNA sequence
  source 1..20: mol_type = other DNA
cacctggacaggaacaagct

SEQ ID NO: 60722 - DNA, 20 bp, synthetic construct
  misc_feature 1..20: note = CRISPR gRNA sequence
  source 1..20: mol_type = other DNA
aagctgctggcttttctaac

SEQ ID NO: 60723 - DNA, 20 bp, synthetic construct
  misc_feature 1..20: note = CRISPR gRNA sequence
  source 1..20: mol_type = other DNA
caggcttcccttccctgagc

SEQ ID NO: 60724 - DNA, 20 bp, synthetic construct
  misc_feature 1..20: note = CRISPR gRNA sequence
  source 1..20: mol_type = other DNA
tctggtactgtcccagccct

SEQ ID NO: 60725 - DNA, 20 bp, synthetic construct
  misc_feature 1..20: note = CRISPR gRNA sequence
  source 1..20: mol_type = other DNA
agctggcagggggctagggc

SEQ ID NO: 60726 - DNA, 20 bp, synthetic construct
  misc_feature 1..20: note = CRISPR gRNA sequence
  source 1..20: mol_type = other DNA
attgggatagagggaagaga

SEQ ID NO: 60727 - DNA, 20 bp, synthetic construct
  misc_feature 1..20: note = CRISPR gRNA sequence
  source 1..20: mol_type = other DNA
gccccgcattctccttggag

SEQ ID NO: 60728 - DNA, 20 bp, synthetic construct
  misc_feature 1..20: note = CRISPR gRNA sequence
  source 1..20: mol_type = other DNA
tgagacacttgtggggcaga

SEQ ID NO: 60729 - DNA, 20 bp, synthetic construct
  misc_feature 1..20: note = CRISPR gRNA sequence
  source 1..20: mol_type = other DNA
gcactgtcactgtcagggca

SEQ ID NO: 60730 - DNA, 20 bp, synthetic construct
  misc_feature 1..20: note = CRISPR gRNA sequence
  source 1..20: mol_type = other DNA
cctggggctagccagggacc

SEQ ID NO: 60731 - DNA, 20 bp, synthetic construct
  misc_feature 1..20: note = CRISPR gRNA sequence
  source 1..20: mol_type = other DNA
agccagggaccctgggcttt

SEQ ID NO: 60732 - DNA, 20 bp, synthetic construct
  misc_feature 1..20: note = CRISPR gRNA sequence
  source 1..20: mol_type = other DNA
atctgcccagtgacctggga

SEQ ID NO: 60733 - DNA, 20 bp, synthetic construct
  misc_feature 1..20: note = CRISPR gRNA sequence
  source 1..20: mol_type = other DNA
ttagaagacaggtgagtctt

SEQ ID NO: 60734 - DNA, 20 bp, synthetic construct
  misc_feature 1..20: note = CRISPR gRNA sequence
  source 1..20: mol_type = other DNA
aatcaggactcttggctcaa

SEQ ID NO: 60735 - DNA, 20 bp, synthetic construct
  misc_feature 1..20: note = CRISPR gRNA sequence
  source 1..20: mol_type = other DNA
agggatttaactccccgggc

SEQ ID NO: 60736 - DNA, 20 bp, synthetic construct
  misc_feature 1..20: note = CRISPR gRNA sequence
  source 1..20: mol_type = other DNA
ctttccttttattgtcattg

SEQ ID NO: 60737 - DNA, 20 bp, synthetic construct
  misc_feature 1..20: note = CRISPR gRNA sequence
  source 1..20: mol_type = other DNA
actccttgcctatttgcata

SEQ ID NO: 60738 - DNA, 20 bp, synthetic construct
  misc_feature 1..20: note = CRISPR gRNA sequence
  source 1..20: mol_type = other DNA
tatttgcatattcagtttct

SEQ ID NO: 60739 - DNA, 20 bp, synthetic construct
  misc_feature 1..20: note = CRISPR gRNA sequence
  source 1..20: mol_type = other DNA
ctacctgtttgcagtcataa

SEQ ID NO: 60740 - DNA, 20 bp, synthetic construct
  misc_feature 1..20: note = CRISPR gRNA sequence
  source 1..20: mol_type = other DNA
tcataaactagtttcatgca

SEQ ID NO: 60741 - DNA, 20 bp, synthetic construct
  misc_feature 1..20: note = CRISPR gRNA sequence
  source 1..20: mol_type = other DNA
gcactgtgttttcatagcat

SEQ ID NO: 60742 - DNA, 20 bp, synthetic construct
  misc_feature 1..20: note = CRISPR gRNA sequence
  source 1..20: mol_type = other DNA
catagcatctgtgttttcca

SEQ ID NO: 60743 - DNA, 20 bp, synthetic construct
  misc_feature 1..20: note = CRISPR gRNA sequence
  source 1..20: mol_type = other DNA
cattttgcttcagtcttttt

SEQ ID NO: 60744 - DNA, 20 bp, synthetic construct
  misc_feature 1..20: note = CRISPR gRNA sequence
  source 1..20: mol_type = other DNA
cagcccttccaaccagataa

SEQ ID NO: 60745 - DNA, 20 bp, synthetic construct
  misc_feature 1..20: note = CRISPR gRNA sequence
  source 1..20: mol_type = other DNA
actattttttttttctgaga

SEQ ID NO: 60746 - DNA, 20 bp, synthetic construct
  misc_feature 1..20: note = CRISPR gRNA sequence
  source 1..20: mol_type = other DNA
ctggagtgcaatggcgtgat

SEQ ID NO: 60747 - DNA, 20 bp, synthetic construct
  misc_feature 1..20: note = CRISPR gRNA sequence
  source 1..20: mol_type = other DNA
tgcctcagcctcctgagtag

SEQ ID NO: 60748 - DNA, 20 bp, synthetic construct
  misc_feature 1..20: note = CRISPR gRNA sequence
  source 1..20: mol_type = other DNA
ttttgtatttttagtagagg

SEQ ID NO: 60749 - DNA, 20 bp, synthetic construct
  misc_feature 1..20: note = CRISPR gRNA sequence
  source 1..20: mol_type = other DNA
ttcctcagcctcccaaagtg

SEQ ID NO: 60750 - DNA, 20 bp, synthetic construct
  misc_feature 1..20: note = CRISPR gRNA sequence
  source 1..20: mol_type = other DNA
cctcccaaagtgttgggatt

SEQ ID NO: 60751 - DNA, 20 bp, synthetic construct
  misc_feature 1..20: note = CRISPR gRNA sequence
  source 1..20: mol_type = other DNA
gtcaaccaatggtcagtggt

SEQ ID NO: 60752 - DNA, 20 bp, synthetic construct
  misc_feature 1..20: note = CRISPR gRNA sequence
  source 1..20: mol_type = other DNA
gtggtccctgattgtctctt

SEQ ID NO: 60753 - DNA, 20 bp, synthetic construct
  misc_feature 1..20: note = CRISPR gRNA sequence
  source 1..20: mol_type = other DNA
agatcaagggtgtccaatct

SEQ ID NO: 60754 - DNA, 20 bp, synthetic construct
  misc_feature 1..20: note = CRISPR gRNA sequence
  source 1..20: mol_type = other DNA
aactccaaagaaaaatctca

SEQ ID NO: 60755 - DNA, 20 bp, synthetic construct
  misc_feature 1..20: note = CRISPR gRNA sequence
  source 1..20: mol_type = other DNA
aaaatctcatagtgttttaa

SEQ ID NO: 60756 - DNA, 20 bp, synthetic construct
  misc_feature 1..20: note = CRISPR gRNA sequence
  source 1..20: mol_type = other DNA
aggctgcatgcagcaggcca

SEQ ID NO: 60757 - DNA, 20 bp, synthetic construct
  misc_feature 1..20: note = CRISPR gRNA sequence
  source 1..20: mol_type = other DNA
atgtggcttggacaacttgg

SEQ ID NO: 60758 - DNA, 20 bp, synthetic construct
  misc_feature 1..20: note = CRISPR gRNA sequence
  source 1..20: mol_type = other DNA
ttggtctagattgaaatcca

SEQ ID NO: 60759 - DNA, 20 bp, synthetic construct
  misc_feature 1..20: note = CRISPR gRNA sequence
  source 1..20: mol_type = other DNA
atccaaactgcttctaggtg

SEQ ID NO: 60760 - DNA, 20 bp, synthetic construct
  misc_feature 1..20: note = CRISPR gRNA sequence
  source 1..20: mol_type = other DNA
aactgcttctaggtgttgtg

SEQ ID NO: 60761 - DNA, 20 bp, synthetic construct
  misc_feature 1..20: note = CRISPR gRNA sequence
  source 1..20: mol_type = other DNA
gtgctacaaaaagcactctt

SEQ ID NO: 60762 - DNA, 20 bp, synthetic construct
  misc_feature 1..20: note = CRISPR gRNA sequence
  source 1..20: mol_type = other DNA
caaggcaaatcatctgcaga

SEQ ID NO: 60763 - DNA, 20 bp, synthetic construct
  misc_feature 1..20: note = CRISPR gRNA sequence
  source 1..20: mol_type = other DNA
actctggaggcaggcaggag

SEQ ID NO: 60764 - DNA, 20 bp, synthetic construct
  misc_feature 1..20: note = CRISPR gRNA sequence
  source 1..20: mol_type = other DNA
acttgcttgaacccgggagg

SEQ ID NO: 60765 - DNA, 20 bp, synthetic construct
  misc_feature 1..20: note = CRISPR gRNA sequence
  source 1..20: mol_type = other DNA
tgggcggtctgagcacaggt

SEQ ID NO: 60766 - DNA, 20 bp, synthetic construct
  misc_feature 1..20: note = CRISPR gRNA sequence
  source 1..20: mol_type = other DNA
gtagagtactgtgatcactt

SEQ ID NO: 60767 - DNA, 20 bp, synthetic construct
  misc_feature 1..20: note = CRISPR gRNA sequence
  source 1..20: mol_type = other DNA
aggtactcaatgctgaagtc

SEQ ID NO: 60768 - DNA, 20 bp, synthetic construct
  misc_feature 1..20: note = CRISPR gRNA sequence
  source 1..20: mol_type = other DNA
ccaccggggaagccagggaa

SEQ ID NO: 60769 - DNA, 20 bp, synthetic construct
  misc_feature 1..20: note = CRISPR gRNA sequence
  source 1..20: mol_type = other DNA
atgtgggatgtggtaaagag

SEQ ID NO: 60770 - DNA, 20 bp, synthetic construct
  misc_feature 1..20: note = CRISPR gRNA sequence
  source 1..20: mol_type = other DNA
gtggtaaagagtaaagattc

SEQ ID NO: 60771 - DNA, 20 bp, synthetic construct
  misc_feature 1..20: note = CRISPR gRNA sequence
  source 1..20: mol_type = other DNA
ctggtgggacaccatacggg

SEQ ID NO: 60772 - DNA, 20 bp, synthetic construct
  misc_feature 1..20: note = CRISPR gRNA sequence
  source 1..20: mol_type = other DNA
gagacagcaaggcaggtatc

SEQ ID NO: 60773 - DNA, 20 bp, synthetic construct
  misc_feature 1..20: note = CRISPR gRNA sequence
  source 1..20: mol_type = other DNA
actcctctgggttaaggcag

SEQ ID NO: 60774 - DNA, 20 bp, synthetic construct
  misc_feature 1..20: note = CRISPR gRNA sequence
  source 1..20: mol_type = other DNA
aacctctgcctcccaggttc

SEQ ID NO: 60775 - DNA, 20 bp, synthetic construct
  misc_feature 1..20: note = CRISPR gRNA sequence
  source 1..20: mol_type = other DNA
ccacgcctggctaatttttt

SEQ ID NO: 60776 - DNA, 20 bp, synthetic construct
  misc_feature 1..20: note = CRISPR gRNA sequence
  source 1..20: mol_type = other DNA
cacctcagcctcccaaagtg

SEQ ID NO: 60777 - DNA, 20 bp, synthetic construct
  misc_feature 1..20: note = CRISPR gRNA sequence
  source 1..20: mol_type = other DNA
ctgcattcttttcttaacaa

SEQ ID NO: 60778 - DNA, 20 bp, synthetic construct
  misc_feature 1..20: note = CRISPR gRNA sequence
  source 1..20: mol_type = other DNA
aaattaattctgctagtcca

SEQ ID NO: 60779 - DNA, 20 bp, synthetic construct
  misc_feature 1..20: note = CRISPR gRNA sequence
  source 1..20: mol_type = other DNA
cagcaaacaaaaccatttaa

SEQ ID NO: 60780 - DNA, 20 bp, synthetic construct
  misc_feature 1..20: note = CRISPR gRNA sequence
  source 1..20: mol_type = other DNA
atggacccagtgctgggagg

SEQ ID NO: 60781 - DNA, 20 bp, synthetic construct
  misc_feature 1..20: note = CRISPR gRNA sequence
  source 1..20: mol_type = other DNA
tctggctatgaggccgtgct

SEQ ID NO: 60782 - DNA, 20 bp, synthetic construct
  misc_feature 1..20: note = CRISPR gRNA sequence
  source 1..20: mol_type = other DNA
ccgtgctccctgctttcctg

SEQ ID NO: 60783 - DNA, 20 bp, synthetic construct
  misc_feature 1..20: note = CRISPR gRNA sequence
  source 1..20: mol_type = other DNA
aggtttcccccacctcatcc

SEQ ID NO: 60784 - DNA, 20 bp, synthetic construct
  misc_feature 1..20: note = CRISPR gRNA sequence
  source 1..20: mol_type = other DNA
tcccccacctcatccacctg

SEQ ID NO: 60785 - DNA, 20 bp, synthetic construct
  misc_feature 1..20: note = CRISPR gRNA sequence
  source 1..20: mol_type = other DNA
ctcatccacctgctttgttt

SEQ ID NO: 60786 - DNA, 20 bp, synthetic construct
  misc_feature 1..20: note = CRISPR gRNA sequence
  source 1..20: mol_type = other DNA
agagcctggagactctactg

SEQ ID NO: 60787 - DNA, 20 bp, synthetic construct
  misc_feature 1..20: note = CRISPR gRNA sequence
  source 1..20: mol_type = other DNA
tgagcctgctgcagtaagac

SEQ ID NO: 60788 - DNA, 20 bp, synthetic construct
  misc_feature 1..20: note = CRISPR gRNA sequence
  source 1..20: mol_type = other DNA
tatttcccggttccttgtgc

SEQ ID NO: 60789 - DNA, 20 bp, synthetic construct
  misc_feature 1..20: note = CRISPR gRNA sequence
  source 1..20: mol_type = other DNA
cccgctccattctttcctta

SEQ ID NO: 60790 - DNA, 20 bp, synthetic construct
  misc_feature 1..20: note = CRISPR gRNA sequence
  source 1..20: mol_type = other DNA
tggcacaactggggactcca

SEQ ID NO: 60791 - DNA, 20 bp, synthetic construct
  misc_feature 1..20: note = CRISPR gRNA sequence
  source 1..20: mol_type = other DNA
actttgtcaacctcaggggg

SEQ ID NO: 60792 - DNA, 20 bp, synthetic construct
  misc_feature 1..20: note = CRISPR gRNA sequence
  source 1..20: mol_type = other DNA
gtcgtttgcctcctctgcgt

SEQ ID NO: 60793 - DNA, 20 bp, synthetic construct
  misc_feature 1..20: note = CRISPR gRNA sequence
  source 1..20: mol_type = other DNA
tcagtttcctcatctgacaa

SEQ ID NO: 60794 - DNA, 20 bp, synthetic construct
  misc_feature 1..20: note = CRISPR gRNA sequence
  source 1..20: mol_type = other DNA
taggtcctgtacttatcaca

SEQ ID NO: 60795 - DNA, 20 bp, synthetic construct
  misc_feature 1..20: note = CRISPR gRNA sequence
  source 1..20: mol_type = other DNA
cgggcagatcacctgaggtc

SEQ ID NO: 60796 - DNA, 20 bp, synthetic construct
  misc_feature 1..20: note = CRISPR gRNA sequence
  source 1..20: mol_type = other DNA
ttgggaggctgaggcaggag

SEQ ID NO: 60797 - DNA, 20 bp, synthetic construct
  misc_feature 1..20: note = CRISPR gRNA sequence
  source 1..20: mol_type = other DNA
ccgagatcgcgccattgcac

SEQ ID NO: 60798 - DNA, 20 bp, synthetic construct
  misc_feature 1..20: note = CRISPR gRNA sequence
  source 1..20: mol_type = other DNA
aagaaaaagaaagaatttta

SEQ ID NO: 60799 - DNA, 20 bp, synthetic construct
  misc_feature 1..20: note = CRISPR gRNA sequence
  source 1..20: mol_type = other DNA
ggctcgcatcacctccagga

SEQ ID NO: 60800 - DNA, 20 bp, synthetic construct
  misc_feature 1..20: note = CRISPR gRNA sequence
  source 1..20: mol_type = other DNA
catcacctccaggatctcgc

SEQ ID NO: 60801 - DNA, 20 bp, synthetic construct
  misc_feature 1..20: note = CRISPR gRNA sequence
  source 1..20: mol_type = other DNA
ctccaggatctcgcttatgc

SEQ ID NO: 60802 - DNA, 20 bp, synthetic construct
  misc_feature 1..20: note = CRISPR gRNA sequence
  source 1..20: mol_type = other DNA
acttctctttgcctaaatca

SEQ ID NO: 60803 - DNA, 20 bp, synthetic construct
  misc_feature 1..20: note = CRISPR gRNA sequence
  source 1..20: mol_type = other DNA
tggccagcctgaccccttgc

SEQ ID NO: 60804 - DNA, 20 bp, synthetic construct
  misc_feature 1..20: note = CRISPR gRNA sequence
  source 1..20: mol_type = other DNA
actttgtagtactcaacgtg

SEQ ID NO: 60805 - DNA, 20 bp, synthetic construct
  misc_feature 1..20: note = CRISPR gRNA sequence
  source 1..20: mol_type = other DNA
gtggtgaagagtggctggag

SEQ ID NO: 60806 - DNA, 20 bp, synthetic construct
  misc_feature 1..20: note = CRISPR gRNA sequence
  source 1..20: mol_type = other DNA
ggcatgtgtgaggccctgag

SEQ ID NO: 60807 - DNA, 20 bp, synthetic construct
  misc_feature 1..20: note = CRISPR gRNA sequence
  source 1..20: mol_type = other DNA
tgtgaggccctgaggcatga

SEQ ID NO: 60808 - DNA, 20 bp, synthetic construct
  misc_feature 1..20: note = CRISPR gRNA sequence
  source 1..20: mol_type = other DNA
tggggcctggcacccatggg

SEQ ID NO: 60809 - DNA, 20 bp, synthetic construct
  misc_feature 1..20: note = CRISPR gRNA sequence
  source 1..20: mol_type = other DNA
atgaaagggagaggaataat

SEQ ID NO: 60810 - DNA, 20 bp, synthetic construct
  misc_feature 1..20: note = CRISPR gRNA sequence
  source 1..20: mol_type = other DNA
tgcctcagcctcccaagtag

SEQ ID NO: 60811 - DNA, 20 bp, synthetic construct
  misc_feature 1..20: note = CRISPR gRNA sequence
  source 1..20: mol_type = other DNA
ttttgtatttttagtagaga

SEQ ID NO: 60812 - DNA, 20 bp, synthetic construct
  misc_feature 1..20: note = CRISPR gRNA sequence
  source 1..20: mol_type = other DNA
acctcaagtgatccgcccgc

SEQ ID NO: 60813 - DNA, 20 bp, synthetic construct
  misc_feature 1..20: note = CRISPR gRNA sequence
  source 1..20: mol_type = other DNA
cgcctcggcttcccaaagta

SEQ ID NO: 60814 - DNA, 20 bp, synthetic construct
  misc_feature 1..20: note = CRISPR gRNA sequence
  source 1..20: mol_type = other DNA
ccactgcacccgttcctcat

SEQ ID NO: 60815 - DNA, 20 bp, synthetic construct
  misc_feature 1..20: note = CRISPR gRNA sequence
  source 1..20: mol_type = other DNA
agactgagtgctgggtagag

SEQ ID NO: 60816 - DNA, 20 bp, synthetic construct
  misc_feature 1..20: note = CRISPR gRNA sequence
  source 1..20: mol_type = other DNA
aatttacagacaagctgata

SEQ ID NO: 60817 - DNA, 20 bp, synthetic construct
  misc_feature 1..20: note = CRISPR gRNA sequence
  source 1..20: mol_type = other DNA
catctcactttctctaaggc

SEQ ID NO: 60818 - DNA, 20 bp, synthetic construct
  misc_feature 1..20: note = CRISPR gRNA sequence
  source 1..20: mol_type = other DNA
aggcagtggtttccaactgg

SEQ ID NO: 60819 - DNA, 20 bp, synthetic construct
  misc_feature 1..20: note = CRISPR gRNA sequence
  source 1..20: mol_type = other DNA
acctcacatctcaatagtgc

SEQ ID NO: 60820 - DNA, 20 bp, synthetic construct
  misc_feature 1..20: note = CRISPR gRNA sequence
  source 1..20: mol_type = other DNA
aaaactgtgtctgaagggcc

SEQ ID NO: 60821 - DNA, 20 bp, synthetic construct
  misc_feature 1..20: note = CRISPR gRNA sequence
  source 1..20: mol_type = other DNA
caaggactcgcctgtgaaat

SEQ ID NO: 60822 - DNA, 20 bp, synthetic construct
  misc_feature 1..20: note = CRISPR gRNA sequence
  source 1..20: mol_type = other DNA
cgagagtcatacatgacgag

SEQ ID NO: 60823 - DNA, 20 bp, synthetic construct
  misc_feature 1..20: note = CRISPR gRNA sequence
  source 1..20: mol_type = other DNA
tttgtgcctcttgatcccct

SEQ ID NO: 60824 - DNA, 20 bp, synthetic construct
  misc_feature 1..20: note = CRISPR gRNA sequence
  source 1..20: mol_type = other DNA
cagtaggacccaactagagg

SEQ ID NO: 60825 - DNA, 20 bp, synthetic construct
  misc_feature 1..20: note = CRISPR gRNA sequence
  source 1..20: mol_type = other DNA
tggaacaaccctgcagaggg

SEQ ID NO: 60826 - DNA, 20 bp, synthetic construct
  misc_feature 1..20: note = CRISPR gRNA sequence
  source 1..20: mol_type = other DNA
tctactgtgggggtgggagc

SEQ ID NO: 60827 - DNA, 20 bp, synthetic construct
  misc_feature 1..20: note = CRISPR gRNA sequence
  source 1..20: mol_type = other DNA
tctggacacttccagagggt

SEQ ID NO: 60828 - DNA, 20 bp, synthetic construct
  misc_feature 1..20: note = CRISPR gRNA sequence
  source 1..20: mol_type = other DNA
cagtggccaaacgccccatc

SEQ ID NO: 60829 - DNA, 20 bp, synthetic construct
  misc_feature 1..20: note = CRISPR gRNA sequence
  source 1..20: mol_type = other DNA
ggatgcctgggtcacatacc

SEQ ID NO: 60830 - DNA, 20 bp, synthetic construct
  misc_feature 1..20: note = CRISPR gRNA sequence
  source 1..20: mol_type = other DNA
tggcagatgggggctaaaac

SEQ ID NO: 60831 - DNA, 20 bp, synthetic construct
  misc_feature 1..20: note = CRISPR gRNA sequence
  source 1..20: mol_type = other DNA
agcactttctccactgttct

SEQ ID NO: 60832 - DNA, 20 bp, synthetic construct
  misc_feature 1..20: note = CRISPR gRNA sequence
  source 1..20: mol_type = other DNA
aagtgcttgacatgttcttt

SEQ ID NO: 60833 - DNA, 20 bp, synthetic construct
  misc_feature 1..20: note = CRISPR gRNA sequence
  source 1..20: mol_type = other DNA
aaaaatgtgactgataaaat

SEQ ID NO: 60834 - DNA, 20 bp, synthetic construct
  misc_feature 1..20: note = CRISPR gRNA sequence
  source 1..20: mol_type = other DNA
acacaccaacatgcctggct

SEQ ID NO: 60835 - DNA, 20 bp, synthetic construct
  misc_feature 1..20: note = CRISPR gRNA sequence
  source 1..20: mol_type = other DNA
ccaacatgcctggctaatag

SEQ ID NO: 60836 - DNA, 20 bp, synthetic construct
  misc_feature 1..20: note = CRISPR gRNA sequence
  source 1..20: mol_type = other DNA
atcctcagcctcccaggttg

SEQ ID NO: 60837 - DNA, 20 bp, synthetic construct
  misc_feature 1..20: note = CRISPR gRNA sequence
  source 1..20: mol_type = other DNA
gagattacaggcatgagccg

SEQ ID NO: 60838 - DNA, 20 bp, synthetic construct
  misc_feature 1..20: note = CRISPR gRNA sequence
  source 1..20: mol_type = other DNA
tatgaataagaaatatgtct

SEQ ID NO: 60839 - DNA, 20 bp, synthetic construct
  misc_feature 1..20: note = CRISPR gRNA sequence
  source 1..20: mol_type = other DNA
aagaaatatgtctttgagtt

SEQ ID NO: 60840 - DNA, 20 bp, synthetic construct
  misc_feature 1..20: note = CRISPR gRNA sequence
  source 1..20: mol_type = other DNA
tgcctcagcctcccaaggag

SEQ ID NO: 60841 - DNA, 20 bp, synthetic construct
  misc_feature 1..20: note = CRISPR gRNA sequence
  source 1..20: mol_type = other DNA
tttggtatttttagtagaga

SEQ ID NO: 60842 - DNA, 20 bp, synthetic construct
  misc_feature 1..20: note = CRISPR gRNA sequence
  source 1..20: mol_type = other DNA
tgcctcgccctcccaaagtg

SEQ ID NO: 60843 - DNA, 20 bp, synthetic construct
  misc_feature 1..20: note = CRISPR gRNA sequence
  source 1..20: mol_type = other DNA
ttttaaagactattttatta

SEQ ID NO: 60844 - DNA, 20 bp, synthetic construct
  misc_feature 1..20: note = CRISPR gRNA sequence
  source 1..20: mol_type = other DNA
aagacagaccaatttttaaa

SEQ ID NO: 60845 - DNA, 20 bp, synthetic construct
  misc_feature 1..20: note = CRISPR gRNA sequence
  source 1..20: mol_type = other DNA
cgggtggatcacctgaggtc

SEQ ID NO: 60846 - DNA, 20 bp, synthetic construct
  misc_feature 1..20: note = CRISPR gRNA sequence
  source 1..20: mol_type = other DNA
gggaagtaagaaacttcagg

SEQ ID NO: 60847 - DNA, 20 bp, synthetic construct
  misc_feature 1..20: note = CRISPR gRNA sequence
  source 1..20: mol_type = other DNA
tccaatattgatattgcatt

SEQ ID NO: 60848 - DNA, 20 bp, synthetic construct
  misc_feature 1..20: note = CRISPR gRNA sequence
  source 1..20: mol_type = other DNA
cagattaaaagaagaaatct

SEQ ID NO: 60849 - DNA, 20 bp, synthetic construct
  misc_feature 1..20: note = CRISPR gRNA sequence
  source 1..20: mol_type = other DNA
caagggcgtggtgaaggcaa

SEQ ID NO: 60850 - DNA, 20 bp, synthetic construct
  misc_feature 1..20: note = CRISPR gRNA sequence
  source 1..20: mol_type = other DNA
tatggaagaggaccaagagg

SEQ ID NO: 60851 - DNA, 20 bp, synthetic construct
  misc_feature 1..20: note = CRISPR gRNA sequence
  source 1..20: mol_type = other DNA
aagggatggtgatggtggta

SEQ ID NO: 60852 - DNA, 20 bp, synthetic construct
  misc_feature 1..20: note = CRISPR gRNA sequence
  source 1..20: mol_type = other DNA
gtctgccgcaggtgcccatc

SEQ ID NO: 60853 - DNA, 20 bp, synthetic construct
  misc_feature 1..20: note = CRISPR gRNA sequence
  source 1..20: mol_type = other DNA
gccgcaggtgcccatctccg

SEQ ID NO: 60854 - DNA, 20 bp, synthetic construct
  misc_feature 1..20: note = CRISPR gRNA sequence
  source 1..20: mol_type = other DNA
caccaaacacccaagagagg

SEQ ID NO: 60855 - DNA, 20 bp, synthetic construct
  misc_feature 1..20: note = CRISPR gRNA sequence
  source 1..20: mol_type = other DNA
tccatccccaaccagctgat

SEQ ID NO: 60856 - DNA, 20 bp, synthetic construct
  misc_feature 1..20: note = CRISPR gRNA sequence
  source 1..20: mol_type = other DNA
caccacttgttgctaggcaa

SEQ ID NO: 60857 - DNA, 20 bp, synthetic construct
  misc_feature 1..20: note = CRISPR gRNA sequence
  source 1..20: mol_type = other DNA
agtgtgtccatctggagaat

SEQ ID NO: 60858 - DNA, 20 bp, synthetic construct
  misc_feature 1..20: note = CRISPR gRNA sequence
  source 1..20: mol_type = other DNA
gagaatagatgcttagacat

SEQ ID NO: 60859 - DNA, 20 bp, synthetic construct
  misc_feature 1..20: note = CRISPR gRNA sequence
  source 1..20: mol_type = other DNA
actttgtggccttccatctg

SEQ ID NO: 60860 - DNA, 20 bp, synthetic construct
  misc_feature 1..20: note = CRISPR gRNA sequence
  source 1..20: mol_type = other DNA
ctctgcctttctctgaatct

SEQ ID NO: 60861 - DNA, 20 bp, synthetic construct
  misc_feature 1..20: note = CRISPR gRNA sequence
  source 1..20: mol_type = other DNA
ggtattgccatgctcacaga

SEQ ID NO: 60862 - DNA, 20 bp, synthetic construct
  misc_feature 1..20: note = CRISPR gRNA sequence
  source 1..20: mol_type = other DNA
ccttgtccttgtgggtgcag

SEQ ID NO: 60863 - DNA, 20 bp, synthetic construct
  misc_feature 1..20: note = CRISPR gRNA sequence
  source 1..20: mol_type = other DNA
gaagctggcatgtctgggca

SEQ ID NO: 60864 - DNA, 20 bp, synthetic construct
  misc_feature 1..20: note = CRISPR gRNA sequence
  source 1..20: mol_type = other DNA
tctgcagcctgggctctgag

SEQ ID NO: 60865 - DNA, 20 bp, synthetic construct
  misc_feature 1..20: note = CRISPR gRNA sequence
  source 1..20: mol_type = other DNA
cctgggctctgagcagagct

SEQ ID NO: 60866 - DNA, 20 bp, synthetic construct
  misc_feature 1..20: note = CRISPR gRNA sequence
  source 1..20: mol_type = other DNA
ggccctctcctcctttagag

SEQ ID NO: 60867 - DNA, 20 bp, synthetic construct
  misc_feature 1..20: note = CRISPR gRNA sequence
  source 1..20: mol_type = other DNA
catgtcctgactacaggcct

SEQ ID NO: 60868 - DNA, 20 bp, synthetic construct
  misc_feature 1..20: note = CRISPR gRNA sequence
  source 1..20: mol_type = other DNA
aggcttctgagtgtcacggt

SEQ ID NO: 60869 - DNA, 20 bp, synthetic construct
  misc_feature 1..20: note = CRISPR gRNA sequence
  source 1..20: mol_type = other DNA
cctaccccttagggttattg

SEQ ID NO: 60870 - DNA, 20 bp, synthetic construct
  misc_feature 1..20: note = CRISPR gRNA sequence
  source 1..20: mol_type = other DNA
ctcctagatcaagccctgcc

SEQ ID NO: 60871 - DNA, 20 bp, synthetic construct
  misc_feature 1..20: note = CRISPR gRNA sequence
  source 1..20: mol_type = other DNA
gggagagtaaggcagtggtt

SEQ ID NO: 60872 - DNA, 20 bp, synthetic construct
  misc_feature 1..20: note = CRISPR gRNA sequence
  source 1..20: mol_type = other DNA
tcagactgacctggatggaa

SEQ ID NO: 60873 - DNA, 20 bp, synthetic construct
  misc_feature 1..20: note = CRISPR gRNA sequence
  source 1..20: mol_type = other DNA
tgctgtgtgtccttgggtta

SEQ ID NO: 60874 - DNA, 20 bp, synthetic construct
  misc_feature 1..20: note = CRISPR gRNA sequence
  source 1..20: mol_type = other DNA
aggcctcacccaggctctgc

SEQ ID NO: 60875 - DNA, 20 bp, synthetic construct
  misc_feature 1..20: note = CRISPR gRNA sequence
  source 1..20: mol_type = other DNA
ctgccctcaggctaagtgag

SEQ ID NO: 60876 - DNA, 20 bp, synthetic construct
  misc_feature 1..20: note = CRISPR gRNA sequence
  source 1..20: mol_type = other DNA
agcacgtgtccaggctggcc

SEQ ID NO: 60877 - DNA, 20 bp, synthetic construct
  misc_feature 1..20: note = CRISPR gRNA sequence
  source 1..20: mol_type = other DNA
agaagcagctggccatcctc

SEQ ID NO: 60878 - DNA, 20 bp, synthetic construct
  misc_feature 1..20: note = CRISPR gRNA sequence
  source 1..20: mol_type = other DNA
tccttccccacactggaggc

SEQ ID NO: 60879 - DNA, 20 bp, synthetic construct
  misc_feature 1..20: note = CRISPR gRNA sequence
  source 1..20: mol_type = other DNA
ccacactggaggcctgtgct

SEQ ID NO: 60880 - DNA, 20 bp, synthetic construct
  misc_feature 1..20: note = CRISPR gRNA sequence
  source 1..20: mol_type = other DNA
aaaagaaagaaagaaagaaa

SEQ ID NO: 60881 - DNA, 20 bp, synthetic construct
  misc_feature 1..20: note = CRISPR gRNA sequence
  source 1..20: mol_type = other DNA
aaaactcctattcccagaac

SEQ ID NO: 60882 - DNA, 20 bp, synthetic construct
  misc_feature 1..20: note = CRISPR gRNA sequence
  source 1..20: mol_type = other DNA
gttgttcatactttttttat

SEQ ID NO: 60883 - DNA, 20 bp, synthetic construct
  misc_feature 1..20: note = CRISPR gRNA sequence
  source 1..20: mol_type = other DNA
tttatttttatttcagctga

SEQ ID NO: 60884 - DNA, 20 bp, synthetic construct
  misc_feature 1..20: note = CRISPR gRNA sequence
  source 1..20: mol_type = other DNA
ggacacctaagaaactcagt

SEQ ID NO: 60885 - DNA, 20 bp, synthetic construct
  misc_feature 1..20: note = CRISPR gRNA sequence
  source 1..20: mol_type = other DNA
attgtcccccagataagaca

SEQ ID NO: 60886 - DNA, 20 bp, synthetic construct
  misc_feature 1..20: note = CRISPR gRNA sequence
  source 1..20: mol_type = other DNA
cactgcccccatcccctcac

SEQ ID NO: 60887 - DNA, 20 bp, synthetic construct
  misc_feature 1..20: note = CRISPR gRNA sequence
  source 1..20: mol_type = other DNA
cccatcccctcaccacagct

SEQ ID NO: 60888 - DNA, 20 bp, synthetic construct
  misc_feature 1..20: note = CRISPR gRNA sequence
  source 1..20: mol_type = other DNA
actgtcctgctcctgactct

SEQ ID NO: 60889 - DNA, 20 bp, synthetic construct
  misc_feature 1..20: note = CRISPR gRNA sequence
  source 1..20: mol_type = other DNA
gatcaaaaggctccatgaca

SEQ ID NO: 60890 - DNA, 20 bp, synthetic construct
  misc_feature 1..20: note = CRISPR gRNA sequence
  source 1..20: mol_type = other DNA
aggctccatgacattcagtt

SEQ ID NO: 60891 - DNA, 20 bp, synthetic construct
  misc_feature 1..20: note = CRISPR gRNA sequence
  source 1..20: mol_type = other DNA
ccagcccctggcaaccacca

SEQ ID NO: 60892 - DNA, 20 bp, synthetic construct
  misc_feature 1..20: note = CRISPR gRNA sequence
  source 1..20: mol_type = other DNA
ctatgaattggactgctcta

SEQ ID NO: 60893 - DNA, 20 bp, synthetic construct
  misc_feature 1..20: note = CRISPR gRNA sequence
  source 1..20: mol_type = other DNA
accctccacctcttgggttc

SEQ ID NO: 60894 - DNA, 20 bp, synthetic construct
  misc_feature 1..20: note = CRISPR gRNA sequence
  source 1..20: mol_type = other DNA
tgcctcagcctccggagtag

SEQ ID NO: 60895 - DNA, 20 bp, synthetic construct
  misc_feature 1..20: note = CRISPR gRNA sequence
  source 1..20: mol_type = other DNA
tttttgtatttttgtagaga

SEQ ID NO: 60896 - DNA, 20 bp, synthetic construct
  misc_feature 1..20: note = CRISPR gRNA sequence
  source 1..20: mol_type = other DNA
ctcctgacctcagatgatct

SEQ ID NO: 60897 - DNA, 20 bp, synthetic construct
  misc_feature 1..20: note = CRISPR gRNA sequence
  source 1..20: mol_type = other DNA
cgtttcggccttccaaagtg

SEQ ID NO: 60898 - DNA, 20 bp, synthetic construct
  misc_feature 1..20: note = CRISPR gRNA sequence
  source 1..20: mol_type = other DNA
tcaagtgcccaattgacagt

SEQ ID NO: 60899 - DNA, 20 bp, synthetic construct
  misc_feature 1..20: note = CRISPR gRNA sequence
  source 1..20: mol_type = other DNA
aaacaatagagatgaggtct

SEQ ID NO: 60900 - DNA, 20 bp, synthetic construct
  misc_feature 1..20: note = CRISPR gRNA sequence
  source 1..20: mol_type = other DNA
accatgcccagccagaaagt

SEQ ID NO: 60901 - DNA, 20 bp, synthetic construct
  misc_feature 1..20: note = CRISPR gRNA sequence
  source 1..20: mol_type = other DNA
tgcccgccaccacgcctgac

SEQ ID NO: 60902 - DNA, 20 bp, synthetic construct
  misc_feature 1..20: note = CRISPR gRNA sequence
  source 1..20: mol_type = other DNA
ttttgtatttttagtagaga

SEQ ID NO: 60903 - DNA, 20 bp, synthetic construct
  misc_feature 1..20: note = CRISPR gRNA sequence
  source 1..20: mol_type = other DNA
cacctcagcctcccaaagtg

SEQ ID NO: 60904 - DNA, 20 bp, synthetic construct
  misc_feature 1..20: note = CRISPR gRNA sequence
  source 1..20: mol_type = other DNA
cactttgggaggctgaggtg

SEQ ID NO: 60905 - DNA, 20 bp, synthetic construct
  misc_feature 1..20: note = CRISPR gRNA sequence
  source 1..20: mol_type = other DNA
ttgggaggctgaggtgggca

SEQ ID NO: 60906 - DNA, 20 bp, synthetic construct
  misc_feature 1..20: note = CRISPR gRNA sequence
  source 1..20: mol_type = other DNA
ccagaaatacataaagaaaa

SEQ ID NO: 60907 - DNA, 20 bp, synthetic construct
  misc_feature 1..20: note = CRISPR gRNA sequence
  source 1..20: mol_type = other DNA
attaatgcacatgcattgta

SEQ ID NO: 60908 - DNA, 20 bp, synthetic construct
  misc_feature 1..20: note = CRISPR gRNA sequence
  source 1..20: mol_type = other DNA
tgaacatttaatatattttc

SEQ ID NO: 60909 - DNA, 20 bp, synthetic construct
  misc_feature 1..20: note = CRISPR gRNA sequence
  source 1..20: mol_type = other DNA
tgttttccacacatctctct

SEQ ID NO: 60910 - DNA, 20 bp, synthetic construct
  misc_feature 1..20: note = CRISPR gRNA sequence
  source 1..20: mol_type = other DNA
tttgaaatgcaaaattggga

SEQ ID NO: 60911 - DNA, 20 bp, synthetic construct
  misc_feature 1..20: note = CRISPR gRNA sequence
  source 1..20: mol_type = other DNA
aattgggatcatgttttata

SEQ ID NO: 60912 - DNA, 20 bp, synthetic construct
  misc_feature 1..20: note = CRISPR gRNA sequence
  source 1..20: mol_type = other DNA
ggatcatgttttatatacag

SEQ ID NO: 60913 - DNA, 20 bp, synthetic construct
  misc_feature 1..20: note = CRISPR gRNA sequence
  source 1..20: mol_type = other DNA
ttgggaggctgaggcaggag

SEQ ID NO: 60914 - DNA, 20 bp, synthetic construct
  misc_feature 1..20: note = CRISPR gRNA sequence
  source 1..20: mol_type = other DNA
atcatttaaaaaataatatt

SEQ ID NO: 60915 - DNA, 20 bp, synthetic construct
  misc_feature 1..20: note = CRISPR gRNA sequence
  source 1..20: mol_type = other DNA
ttaaaaaataatattttctg

SEQ ID NO: 60916 - DNA, 20 bp, synthetic construct
  misc_feature 1..20: note = CRISPR gRNA sequence
  source 1..20: mol_type = other DNA
gggtgatgttaatttccttt

SEQ ID NO: 60917 - DNA, 20 bp, synthetic construct
  misc_feature 1..20: note = CRISPR gRNA sequence
  source 1..20: mol_type = other DNA
gatgcctacttgtataattt

SEQ ID NO: 60918 - DNA, 20 bp, synthetic construct
  misc_feature 1..20: note = CRISPR gRNA sequence
  source 1..20: mol_type = other DNA
tcccccggccccgtcatgtg

SEQ ID NO: 60919 - DNA, 20 bp, synthetic construct
  misc_feature 1..20: note = CRISPR gRNA sequence
  source 1..20: mol_type = other DNA
gggtaatagctgtgtcacca

SEQ ID NO: 60920 - DNA, 20 bp, synthetic construct
  misc_feature 1..20: note = CRISPR gRNA sequence
  source 1..20: mol_type = other DNA
catggctgggagtccacgct

SEQ ID NO: 60921 - DNA, 20 bp, synthetic construct
  misc_feature 1..20: note = CRISPR gRNA sequence
  source 1..20: mol_type = other DNA
aataacacaatgacacacag

SEQ ID NO: 60922 - DNA, 20 bp, synthetic construct
  misc_feature 1..20: note = CRISPR gRNA sequence
  source 1..20: mol_type = other DNA
cacacagagtagcttatagc

SEQ ID NO: 60923 - DNA, 20 bp, synthetic construct
  misc_feature 1..20: note = CRISPR gRNA sequence
  source 1..20: mol_type = other DNA
tacggccctttgcagggctg

SEQ ID NO: 60924 - DNA, 20 bp, synthetic construct
  misc_feature 1..20: note = CRISPR gRNA sequence
  source 1..20: mol_type = other DNA
gtcaccagccacacagcctg

SEQ ID NO: 60925 - DNA, 20 bp, synthetic construct
  misc_feature 1..20: note = CRISPR gRNA sequence
  source 1..20: mol_type = other DNA
ataacattcaagtgaaggca

SEQ ID NO: 60926 - DNA, 20 bp, synthetic construct
  misc_feature 1..20: note = CRISPR gRNA sequence
  source 1..20: mol_type = other DNA
aactgcccttggatccctct

SEQ ID NO: 60927 - DNA, 20 bp, synthetic construct
  misc_feature 1..20: note = CRISPR gRNA sequence
  source 1..20: mol_type = other DNA
ggctttctgtcatggtctga

SEQ ID NO: 60928 - DNA, 20 bp, synthetic construct
  misc_feature 1..20: note = CRISPR gRNA sequence
  source 1..20: mol_type = other DNA
tggtgttggggagggggcag

SEQ ID NO: 60929 - DNA, 20 bp, synthetic construct
  misc_feature 1..20: note = CRISPR gRNA sequence
  source 1..20: mol_type = other DNA
gtctgaccaacccacttctg

SEQ ID NO: 60930 - DNA, 20 bp, synthetic construct
  misc_feature 1..20: note = CRISPR gRNA sequence
  source 1..20: mol_type = other DNA
tttcagttccccgaacacca

SEQ ID NO: 60931 - DNA, 20 bp, synthetic construct
  misc_feature 1..20: note = CRISPR gRNA sequence
  source 1..20: mol_type = other DNA
agaatgttctcttcacgcct

SEQ ID NO: 60932 - DNA, 20 bp, synthetic construct
  misc_feature 1..20: note = CRISPR gRNA sequence
  source 1..20: mol_type = other DNA
ctcctcctcatccctcaggt

SEQ ID NO: 60933 - DNA, 20 bp, synthetic construct
  misc_feature 1..20: note = CRISPR gRNA sequence
  source 1..20: mol_type = other DNA
cagggaggccccctggaccc

SEQ ID NO: 60934 - DNA, 20 bp, synthetic construct
  misc_feature 1..20: note = CRISPR gRNA sequence
  source 1..20: mol_type = other DNA
attatccactcttatagatc

SEQ ID NO: 60935 - DNA, 20 bp, synthetic construct
  misc_feature 1..20: note = CRISPR gRNA sequence
  source 1..20: mol_type = other DNA
gcacctctaaatccatatgg

SEQ ID NO: 60936 - DNA, 20 bp, synthetic construct
  misc_feature 1..20: note = CRISPR gRNA sequence
  source 1..20: mol_type = other DNA
accagctgccccatctggac

SEQ ID NO: 60937 - DNA, 20 bp, synthetic construct
  misc_feature 1..20: note = CRISPR gRNA sequence
  source 1..20: mol_type = other DNA
ctagaatatccttggacctt

SEQ ID NO: 60938 - DNA, 20 bp, synthetic construct
  misc_feature 1..20: note = CRISPR gRNA sequence
  source 1..20: mol_type = other DNA
caaaccacaggtggccctgg

SEQ ID NO: 60939 - DNA, 20 bp, synthetic construct
  misc_feature 1..20: note = CRISPR gRNA sequence
  source 1..20: mol_type = other DNA
ttccctttttaacactcttt

SEQ ID NO: 60940 - DNA, 20 bp, synthetic construct
  misc_feature 1..20: note = CRISPR gRNA sequence
  source 1..20: mol_type = other DNA
aaaataactgcgaactaaca

SEQ ID NO: 60941 - DNA, 20 bp, synthetic construct
  misc_feature 1..20: note = CRISPR gRNA sequence
  source 1..20: mol_type = other DNA
cactttgggaggccgaggca

SEQ ID NO: 60942 - DNA, 20 bp, synthetic construct
  misc_feature 1..20: note = CRISPR gRNA sequence
  source 1..20: mol_type = other DNA
ttgggaggctgaggcacaag

SEQ ID NO: 60943 - DNA, 20 bp, synthetic construct
  misc_feature 1..20: note = CRISPR gRNA sequence
  source 1..20: mol_type = other DNA
gaggctgaggttacagtgag

SEQ ID NO: 60944 - DNA, 20 bp, synthetic construct
  misc_feature 1..20: note = CRISPR gRNA sequence
  source 1..20: mol_type = other DNA
gcctaggtgacagagcgagg

SEQ ID NO: 60945 - DNA, 20 bp, synthetic construct
  misc_feature 1..20: note = CRISPR gRNA sequence
  source 1..20: mol_type = other DNA
tacactactattatctcaac

SEQ ID NO: 60946 - DNA, 20 bp, synthetic construct
  misc_feature 1..20: note = CRISPR gRNA sequence
  source 1..20: mol_type = other DNA
ctcaccagttctcccaataa

SEQ ID NO: 60947 - DNA, 20 bp, synthetic construct
  misc_feature 1..20: note = CRISPR gRNA sequence
  source 1..20: mol_type = other DNA
tttatagaatgtccttccac

SEQ ID NO: 60948 - DNA, 20 bp, synthetic construct
  misc_feature 1..20: note = CRISPR gRNA sequence
  source 1..20: mol_type = other DNA
tccttccacttgggtttgtc

SEQ ID NO: 60949 - DNA, 20 bp, synthetic construct
  misc_feature 1..20: note = CRISPR gRNA sequence
  source 1..20: mol_type = other DNA
tgggtttgtccaatgtttcc

SEQ ID NO: 60950 - DNA, 20 bp, synthetic construct
  misc_feature 1..20: note = CRISPR gRNA sequence
  source 1..20: mol_type = other DNA
aactttccctttgtaatcaa

SEQ ID NO: 60951 - DNA, 20 bp, synthetic construct
  misc_feature 1..20: note = CRISPR gRNA sequence
  source 1..20: mol_type = other DNA
agattatgtggggagatact

SEQ ID NO: 60952 - DNA, 20 bp, synthetic construct
  misc_feature 1..20: note = CRISPR gRNA sequence
  source 1..20: mol_type = other DNA
tcagcatgacagttgcaaaa

SEQ ID NO: 60953 - DNA, 20 bp, synthetic construct
  misc_feature 1..20: note = CRISPR gRNA sequence
  source 1..20: mol_type = other DNA
tttacattttatttccatct

SEQ ID NO: 60954 - DNA, 20 bp, synthetic construct
  misc_feature 1..20: note = CRISPR gRNA sequence
  source 1..20: mol_type = other DNA
cttgggctgggaacagtggc

SEQ ID NO: 60955 - DNA, 20 bp, synthetic construct
  misc_feature 1..20: note = CRISPR gRNA sequence
  source 1..20: mol_type = other DNA
ctgggaggccgaggaggaaa

SEQ ID NO: 60956 - DNA, 20 bp, synthetic construct
  misc_feature 1..20: note = CRISPR gRNA sequence
  source 1..20: mol_type = other DNA
aaaaaataaataaataaaat

SEQ ID NO: 60957 - DNA, 20 bp, synthetic construct
  misc_feature 1..20: note = CRISPR gRNA sequence
  source 1..20: mol_type = other DNA
atctttgacacttcttcagt

SEQ ID NO: 60958 - DNA, 20 bp, synthetic construct
  misc_feature 1..20: note = CRISPR gRNA sequence
  source 1..20: mol_type = other DNA
cagtatttgctttaaagatg

SEQ ID NO: 60959 - DNA, 20 bp, synthetic construct
  misc_feature 1..20: note = CRISPR gRNA sequence
  source 1..20: mol_type = other DNA
aaactacagtgatacctaat

SEQ ID NO: 60960 - DNA, 20 bp, synthetic construct
  misc_feature 1..20: note = CRISPR gRNA sequence
  source 1..20: mol_type = other DNA
gaagttgctacctgaatgac

SEQ ID NO: 60961 - DNA, 20 bp, synthetic construct
  misc_feature 1..20: note = CRISPR gRNA sequence
  source 1..20: mol_type = other DNA
ttaggaaatactgaactagt

SEQ ID NO: 60962 - DNA, 20 bp, synthetic construct
  misc_feature 1..20: note = CRISPR gRNA sequence
  source 1..20: mol_type = other DNA
aatactgaactagtccatgc

SEQ ID NO: 60963 - DNA, 20 bp, synthetic construct
  misc_feature 1..20: note = CRISPR gRNA sequence
  source 1..20: mol_type = other DNA
cttctgcttccaagctctgt

SEQ ID NO: 60964 - DNA, 20 bp, synthetic construct
  misc_feature 1..20: note = CRISPR gRNA sequence
  source 1..20: mol_type = other DNA
gcttaatgagttcatggtgg

SEQ ID NO: 60965 - DNA, 20 bp, synthetic construct
  misc_feature 1..20: note = CRISPR gRNA sequence
  source 1..20: mol_type = other DNA
ctggagtgagttgcagagtg

SEQ ID NO: 60966 - DNA, 20 bp, synthetic construct
  misc_feature 1..20: note = CRISPR gRNA sequence
  source 1..20: mol_type = other DNA
gaggggtggagaagagagca

SEQ ID NO: 60967 - DNA, 20 bp, synthetic construct
  misc_feature 1..20: note = CRISPR gRNA sequence
  source 1..20: mol_type = other DNA
gcctggggaaggaagagcac

SEQ ID NO: 60968 - DNA, 20 bp, synthetic construct
  misc_feature 1..20: note = CRISPR gRNA sequence
  source 1..20: mol_type = other DNA
gtgggcatggctgttccact

SEQ ID NO: 60969 - DNA, 20 bp, synthetic construct
  misc_feature 1..20: note = CRISPR gRNA sequence
  source 1..20: mol_type = other DNA
catggctgttccactctggg

SEQ ID NO: 60970 - DNA, 20 bp, synthetic construct
  misc_feature 1..20: note = CRISPR gRNA sequence
  source 1..20: mol_type = other DNA
tgtgtgtgtgtccctagtcc

SEQ ID NO: 60971 - DNA, 20 bp, synthetic construct
  misc_feature 1..20: note = CRISPR gRNA sequence
  source 1..20: mol_type = other DNA
tctgcagccttcatccaggg

SEQ ID NO: 60972 - DNA, 20 bp, synthetic construct
  misc_feature 1..20: note = CRISPR gRNA sequence
  source 1..20: mol_type = other DNA
cttgcctctgcctggtcttc

SEQ ID NO: 60973 - DNA, 20 bp, synthetic construct
  misc_feature 1..20: note = CRISPR gRNA sequence
  source 1..20: mol_type = other DNA
gtgttgtgagtgagtggtga

SEQ ID NO: 60974 - DNA, 20 bp, synthetic construct
  misc_feature 1..20: note = CRISPR gRNA sequence
  source 1..20: mol_type = other DNA
aaggagtgagtgaggggtga

SEQ ID NO: 60975 - DNA, 20 bp, synthetic construct
  misc_feature 1..20: note = CRISPR gRNA sequence
  source 1..20: mol_type = other DNA
tagcatgcctaggaaccttt

SEQ ID NO: 60976 - DNA, 20 bp, synthetic construct
  misc_feature 1..20: note = CRISPR gRNA sequence
  source 1..20: mol_type = other DNA
tgttttgtgaacacaaaccg

SEQ ID NO: 60977 - DNA, 20 bp, synthetic construct
  misc_feature 1..20: note = CRISPR gRNA sequence
  source 1..20: mol_type = other DNA
gcaatccaagacagaaatat

SEQ ID NO: 60978 - DNA, 20 bp, synthetic construct
  misc_feature 1..20: note = CRISPR gRNA sequence
  source 1..20: mol_type = other DNA
atccaggggttctatatttg

SEQ ID NO: 60979 - DNA, 20 bp, synthetic construct
  misc_feature 1..20: note = CRISPR gRNA sequence
  source 1..20: mol_type = other DNA
cttactctttctctgtccac

SEQ ID NO: 60980 - DNA, 20 bp, synthetic construct
  misc_feature 1..20: note = CRISPR gRNA sequence
  source 1..20: mol_type = other DNA
ggcaggccatccctgcacct

SEQ ID NO: 60981 - DNA, 20 bp, synthetic construct
  misc_feature 1..20: note = CRISPR gRNA sequence
  source 1..20: mol_type = other DNA
cacctgcaggcttactttct

SEQ ID NO: 60982 - DNA, 20 bp, synthetic construct
  misc_feature 1..20: note = CRISPR gRNA sequence
  source 1..20: mol_type = other DNA
cctagactgagtctcactgg

SEQ ID NO: 60983 - DNA, 20 bp, synthetic construct
  misc_feature 1..20: note = CRISPR gRNA sequence
  source 1..20: mol_type = other DNA
tgtccactacatttgtctac

SEQ ID NO: 60984 - DNA, 20 bp, synthetic construct
  misc_feature 1..20: note = CRISPR gRNA sequence
  source 1..20: mol_type = other DNA
cagttgtttccttggtaact

SEQ ID NO: 60985 - DNA, 20 bp, synthetic construct
  misc_feature 1..20: note = CRISPR gRNA sequence
  source 1..20: mol_type = other DNA
aaagacaggtccccgtcctg

SEQ ID NO: 60986 - DNA, 20 bp, synthetic construct
  misc_feature 1..20: note = CRISPR gRNA sequence
  source 1..20: mol_type = other DNA
ggtccccgtcctgcacagat

SEQ ID NO: 60987 - DNA, 20 bp, synthetic construct
  misc_feature 1..20: note = CRISPR gRNA sequence
  source 1..20: mol_type = other DNA
agaaaatttaacagaatatc

SEQ ID NO: 60988 - DNA, 20 bp, synthetic construct
  misc_feature 1..20: note = CRISPR gRNA sequence
  source 1..20: mol_type = other DNA
ccctgagaaaacttctgttg

SEQ ID NO: 60989 - DNA, 20 bp, synthetic construct
  misc_feature 1..20: note = CRISPR gRNA sequence
  source 1..20: mol_type = other DNA
gaacggtttgtgaatttttc

SEQ ID NO: 60990 - DNA, 20 bp, synthetic construct
  misc_feature 1..20: note = CRISPR gRNA sequence
  source 1..20: mol_type = other DNA
ctccagatttttttttctac

SEQ ID NO: 60991 - DNA, 20 bp, synthetic construct
  misc_feature 1..20: note = CRISPR gRNA sequence
  source 1..20: mol_type = other DNA
ttttctacatatgttttgaa

SEQ ID NO: 60992 - DNA, 20 bp, synthetic construct
  misc_feature 1..20: note = CRISPR gRNA sequence
  source 1..20: mol_type = other DNA
gccccttaacattgaaattc

SEQ ID NO: 60993 - DNA, 20 bp, synthetic construct
  misc_feature 1..20: note = CRISPR gRNA sequence
  source 1..20: mol_type = other DNA
aaattcttccgcttgtccct

SEQ ID NO: 60994 - DNA, 20 bp, synthetic construct
  misc_feature 1..20: note = CRISPR gRNA sequence
  source 1..20: mol_type = other DNA
aggatcaggtaaaaggagaa

SEQ ID NO: 60995 - DNA, 20 bp, synthetic construct
  misc_feature 1..20: note = CRISPR gRNA sequence
  source 1..20: mol_type = other DNA
gccctcctgtcgtctcactg

SEQ ID NO: 60996 - DNA, 20 bp, synthetic construct
  misc_feature 1..20: note = CRISPR gRNA sequence
  source 1..20: mol_type = other DNA
gcatctcggctcagccttct

SEQ ID NO: 60997 - DNA, 20 bp, synthetic construct
  misc_feature 1..20: note = CRISPR gRNA sequence
  source 1..20: mol_type = other DNA
ccttctggaagcttttattt

SEQ ID NO: 60998 - DNA, 20 bp, synthetic construct
  misc_feature 1..20: note = CRISPR gRNA sequence
  source 1..20: mol_type = other DNA
ggcacctgggccggggacag

SEQ ID NO: 60999 - DNA, 20 bp, synthetic construct
  misc_feature 1..20: note = CRISPR gRNA sequence
  source 1..20: mol_type = other DNA
cctgggggcctttttcttcc

SEQ ID NO: 61000 - DNA, 20 bp, synthetic construct
  misc_feature 1..20: note = CRISPR gRNA sequence
  source 1..20: mol_type = other DNA
ggcagttaccctcaaatcca

SEQ ID NO: 61001 - DNA, 20 bp, synthetic construct
  misc_feature 1..20: note = CRISPR gRNA sequence
  source 1..20: mol_type = other DNA
tgggtggggtaactgacact

SEQ ID NO: 61002 - DNA, 20 bp, synthetic construct
  misc_feature 1..20: note = CRISPR gRNA sequence
  source 1..20: mol_type = other DNA
tggggtaactgacacttcca

SEQ ID NO: 61003 - DNA, 20 bp, synthetic construct
  misc_feature 1..20: note = CRISPR gRNA sequence
  source 1..20: mol_type = other DNA
actgacacttccagtttgct

SEQ ID NO: 61004 - DNA, 20 bp, synthetic construct
  misc_feature 1..20: note = CRISPR gRNA sequence
  source 1..20: mol_type = other DNA
aaccaagacagttgaccatc

SEQ ID NO: 61005 - DNA, 20 bp, synthetic construct
  misc_feature 1..20: note = CRISPR gRNA sequence
  source 1..20: mol_type = other DNA
ttttctatttttagtggaga

SEQ ID NO: 61006 - DNA, 20 bp, synthetic construct
  misc_feature 1..20: note = CRISPR gRNA sequence
  source 1..20: mol_type = other DNA
ggtctcgaactcctgacctc

SEQ ID NO: 61007 - DNA, 20 bp, synthetic construct
  misc_feature 1..20: note = CRISPR gRNA sequence
  source 1..20: mol_type = other DNA
cgccttggcctcacaaagtc

SEQ ID NO: 61008 - DNA, 20 bp, synthetic construct
  misc_feature 1..20: note = CRISPR gRNA sequence
  source 1..20: mol_type = other DNA
gagccattgcgcccagccag

SEQ ID NO: 61009 - DNA, 20 bp, synthetic construct
  misc_feature 1..20: note = CRISPR gRNA sequence
  source 1..20: mol_type = other DNA
gggctcaggaatgggagttc

SEQ ID NO: 61010 - DNA, 20 bp, synthetic construct
  misc_feature 1..20: note = CRISPR gRNA sequence
  source 1..20: mol_type = other DNA
tttccagatggccccaagcc

SEQ ID NO: 61011 - DNA, 20 bp, synthetic construct
  misc_feature 1..20: note = CRISPR gRNA sequence
  source 1..20: mol_type = other DNA
agtggctgtcttggaggtcc

SEQ ID NO: 61012 - DNA, 20 bp, synthetic construct
  misc_feature 1..20: note = CRISPR gRNA sequence
  source 1..20: mol_type = other DNA
gctgaacagctccaccttgg

SEQ ID NO: 61013 - DNA, 20 bp, synthetic construct
  misc_feature 1..20: note = CRISPR gRNA sequence
  source 1..20: mol_type = other DNA
tgctcttgccttctaatgcc

SEQ ID NO: 61014 - DNA, 20 bp, synthetic construct
  misc_feature 1..20: note = CRISPR gRNA sequence
  source 1..20: mol_type = other DNA
ctggttacaaaagtggccta

SEQ ID NO: 61015 - DNA, 20 bp, synthetic construct
  misc_feature 1..20: note = CRISPR gRNA sequence
  source 1..20: mol_type = other DNA
ggctcttgttaaaatgctca

SEQ ID NO: 61016 - DNA, 20 bp, synthetic construct
  misc_feature 1..20: note = CRISPR gRNA sequence
  source 1..20: mol_type = other DNA
ggtctggaattctgcctaga

SEQ ID NO: 61017 - DNA, 20 bp, synthetic construct
  misc_feature 1..20: note = CRISPR gRNA sequence
  source 1..20: mol_type = other DNA
cccaaacttagcatttcttt

SEQ ID NO: 61018 - DNA, 20 bp, synthetic construct
  misc_feature 1..20: note = CRISPR gRNA sequence
  source 1..20: mol_type = other DNA
aacttagcatttcttttttt

SEQ ID NO: 61019 - DNA, 20 bp, synthetic construct
  misc_feature 1..20: note = CRISPR gRNA sequence
  source 1..20: mol_type = other DNA
tagcatttctttttttgttt

SEQ ID NO: 61020 - DNA, 20 bp, synthetic construct
  misc_feature 1..20: note = CRISPR gRNA sequence
  source 1..20: mol_type = other DNA
ttgtttgtttgtttttgaga

SEQ ID NO: 61021 - DNA, 20 bp, synthetic construct
  misc_feature 1..20: note = CRISPR gRNA sequence
  source 1..20: mol_type = other DNA
aacctccgcctcccgggttc

SEQ ID NO: 61022 - DNA, 20 bp, synthetic construct
  misc_feature 1..20: note = CRISPR gRNA sequence
  source 1..20: mol_type = other DNA
tgcctcagcctcccgagtag

SEQ ID NO: 61023 - DNA, 20 bp, synthetic construct
  misc_feature 1..20: note = CRISPR gRNA sequence
  source 1..20: mol_type = other DNA
ttttgtatttttggtagaga

SEQ ID NO: 61024 - DNA, 20 bp, synthetic construct
  misc_feature 1..20: note = CRISPR gRNA sequence
  source 1..20: mol_type = other DNA
cacctcggcctcccaaagtg

SEQ ID NO: 61025 - DNA, 20 bp, synthetic construct
  misc_feature 1..20: note = CRISPR gRNA sequence
  source 1..20: mol_type = other DNA
tacaggcgtgagccaccacg

SEQ ID NO: 61026 - DNA, 20 bp, synthetic construct
  misc_feature 1..20: note = CRISPR gRNA sequence
  source 1..20: mol_type = other DNA
ttcagactctgcattttcta

SEQ ID NO: 61027 - DNA, 20 bp, synthetic construct
  misc_feature 1..20: note = CRISPR gRNA sequence
  source 1..20: mol_type = other DNA
gtggccttcctacactccct

SEQ ID NO: 61028 - DNA, 20 bp, synthetic construct
  misc_feature 1..20: note = CRISPR gRNA sequence
  source 1..20: mol_type = other DNA
aaacatgacacttactttca

SEQ ID NO: 61029 - DNA, 20 bp, synthetic construct
  misc_feature 1..20: note = CRISPR gRNA sequence
  source 1..20: mol_type = other DNA
atccaagcagtgacacaaag

SEQ ID NO: 61030 - DNA, 20 bp, synthetic construct
  misc_feature 1..20: note = CRISPR gRNA sequence
  source 1..20: mol_type = other DNA
agcagtgacacaaagcattg

SEQ ID NO: 61031 - DNA, 20 bp, synthetic construct
  misc_feature 1..20: note = CRISPR gRNA sequence
  source 1..20: mol_type = other DNA
aacctctgcctcctgggttc

SEQ ID NO: 61032 - DNA, 20 bp, synthetic construct
  misc_feature 1..20: note = CRISPR gRNA sequence
  source 1..20: mol_type = other DNA
tgcctcagccgcccaagtag

SEQ ID NO: 61033 - DNA, 20 bp, synthetic construct
  misc_feature 1..20: note = CRISPR gRNA sequence
  source 1..20: mol_type = other DNA
ttgtatatttttagtacaaa

SEQ ID NO: 61034 - DNA, 20 bp, synthetic construct
  misc_feature 1..20: note = CRISPR gRNA sequence
  source 1..20: mol_type = other DNA
gaccatttgcctcagctatt

SEQ ID NO: 61035 - DNA, 20 bp, synthetic construct
  misc_feature 1..20: note = CRISPR gRNA sequence
  source 1..20: mol_type = other DNA
ggctcagtaaagacaatacc

SEQ ID NO: 61036 - DNA, 20 bp, synthetic construct
  misc_feature 1..20: note = CRISPR gRNA sequence
  source 1..20: mol_type = other DNA
ccctgacacagaggctgagg

SEQ ID NO: 61037 - DNA, 20 bp, synthetic construct
  misc_feature 1..20: note = CRISPR gRNA sequence
  source 1..20: mol_type = other DNA
actcctcctgggccaggggc

SEQ ID NO: 61038 - DNA, 20 bp, synthetic construct
  misc_feature 1..20: note = CRISPR gRNA sequence
  source 1..20: mol_type = other DNA
tcctgggccaggggctctgg

SEQ ID NO: 61039 - DNA, 20 bp, synthetic construct
  misc_feature 1..20: note = CRISPR gRNA sequence
  source 1..20: mol_type = other DNA
tcacagctcactgctggctc

SEQ ID NO: 61040 - DNA, 20 bp, synthetic construct
  misc_feature 1..20: note = CRISPR gRNA sequence
  source 1..20: mol_type = other DNA
ccccacctgccatgaccccc

SEQ ID NO: 61041 - DNA, 20 bp, synthetic construct
  misc_feature 1..20: note = CRISPR gRNA sequence
  source 1..20: mol_type = other DNA
catatgaattcctgggcgtg

SEQ ID NO: 61042 - DNA, 20 bp, synthetic construct
  misc_feature 1..20: note = CRISPR gRNA sequence
  source 1..20: mol_type = other DNA
tgaaagcctcttggtctatt

SEQ ID NO: 61043 - DNA, 20 bp, synthetic construct
  misc_feature 1..20: note = CRISPR gRNA sequence
  source 1..20: mol_type = other DNA
aggggctacctgagcacgcc

SEQ ID NO: 61044 - DNA, 20 bp, synthetic construct
  misc_feature 1..20: note = CRISPR gRNA sequence
  source 1..20: mol_type = other DNA
gtgtaaacaacctggggcct

SEQ ID NO: 61045 - DNA, 20 bp, synthetic construct
  misc_feature 1..20: note = CRISPR gRNA sequence
  source 1..20: mol_type = other DNA
aagagtgtcaattgtagcaa

SEQ ID NO: 61046 - DNA, 20 bp, synthetic construct
  misc_feature 1..20: note = CRISPR gRNA sequence
  source 1..20: mol_type = other DNA
agacggcagaaggctgatga

SEQ ID NO: 61047 - DNA, 20 bp, synthetic construct
  misc_feature 1..20: note = CRISPR gRNA sequence
  source 1..20: mol_type = other DNA
tgatgaagctgttttctccc

SEQ ID NO: 61048 - DNA, 20 bp, synthetic construct
  misc_feature 1..20: note = CRISPR gRNA sequence
  source 1..20: mol_type = other DNA
tcccccaagcttgagccaca

SEQ ID NO: 61049 - DNA, 20 bp, synthetic construct
  misc_feature 1..20: note = CRISPR gRNA sequence
  source 1..20: mol_type = other DNA
atgctcattcctctcctctt

SEQ ID NO: 61050 - DNA, 20 bp, synthetic construct
  misc_feature 1..20: note = CRISPR gRNA sequence
  source 1..20: mol_type = other DNA
ttgagctgccctgccccaag

SEQ ID NO: 61051 - DNA, 20 bp, synthetic construct
  misc_feature 1..20: note = CRISPR gRNA sequence
  source 1..20: mol_type = other DNA
aacccctgccccttctcagc

SEQ ID NO: 61052 - DNA, 20 bp, synthetic construct
  misc_feature 1..20: note = CRISPR gRNA sequence
  source 1..20: mol_type = other DNA
gcgaatgagaaatcctggca

SEQ ID NO: 61053 - DNA, 20 bp, synthetic construct
  misc_feature 1..20: note = CRISPR gRNA sequence
  source 1..20: mol_type = other DNA
agagtcccagagtgctggga

SEQ ID NO: 61054 - DNA, 20 bp, synthetic construct
  misc_feature 1..20: note = CRISPR gRNA sequence
  source 1..20: mol_type = other DNA
tgcctcagctaccagagtag

SEQ ID NO: 61055 - DNA, 20 bp, synthetic construct
  misc_feature 1..20: note = CRISPR gRNA sequence
  source 1..20: mol_type = other DNA
cacctcagcctccaaaagtg

SEQ ID NO: 61056 - DNA, 20 bp, synthetic construct
  misc_feature 1..20: note = CRISPR gRNA sequence
  source 1..20: mol_type = other DNA
cacaggtatctcccctaccc

SEQ ID NO: 61057 - DNA, 20 bp, synthetic construct
  misc_feature 1..20: note = CRISPR gRNA sequence
  source 1..20: mol_type = other DNA
acaacctggctggaggggtc

SEQ ID NO: 61058 - DNA, 20 bp, synthetic construct
  misc_feature 1..20: note = CRISPR gRNA sequence
  source 1..20: mol_type = other DNA
aggaagtctttcctaaaacg

SEQ ID NO: 61059 - DNA, 20 bp, synthetic construct
  misc_feature 1..20: note = CRISPR gRNA sequence
  source 1..20: mol_type = other DNA
atgcccttctccatccccag

SEQ ID NO: 61060 - DNA, 20 bp, synthetic construct
  misc_feature 1..20: note = CRISPR gRNA sequence
  source 1..20: mol_type = other DNA
catccccagcctggtttcct

SEQ ID NO: 61061 - DNA, 20 bp, synthetic construct
  misc_feature 1..20: note = CRISPR gRNA sequence
  source 1..20: mol_type = other DNA
agactgccaagctcctcacc

SEQ ID NO: 61062 - DNA, 20 bp, synthetic construct
  misc_feature 1..20: note = CRISPR gRNA sequence
  source 1..20: mol_type = other DNA
tgccctggaagtaatcttgt

SEQ ID NO: 61063 - DNA, 20 bp, synthetic construct
  misc_feature 1..20: note = CRISPR gRNA sequence
  source 1..20: mol_type = other DNA
ctgcaggtaatgttgggtaa

SEQ ID NO: 61064 - DNA, 20 bp, synthetic construct
  misc_feature 1..20: note = CRISPR gRNA sequence
  source 1..20: mol_type = other DNA
cttctgcctttttccccatt

SEQ ID NO: 61065 - DNA, 20 bp, synthetic construct
  misc_feature 1..20: note = CRISPR gRNA sequence
  source 1..20: mol_type = other DNA
aggtggaccagatggtcttt

SEQ ID NO: 61066 - DNA, 20 bp, synthetic construct
  misc_feature 1..20: note = CRISPR gRNA sequence
  source 1..20: mol_type = other DNA
gcaactggatagaccacctt

SEQ ID NO: 61067 - DNA, 20 bp, synthetic construct
  misc_feature 1..20: note = CRISPR gRNA sequence
  source 1..20: mol_type = other DNA
cccccagacctgctggctgg

SEQ ID NO: 61068 - DNA, 20 bp, synthetic construct
  misc_feature 1..20: note = CRISPR gRNA sequence
  source 1..20: mol_type = other DNA
aatcagaatcccccagacct

SEQ ID NO: 61069 - DNA, 20 bp, synthetic construct
  misc_feature 1..20: note = CRISPR gRNA sequence
  source 1..20: mol_type = other DNA
aaccatggtatggaggacaa

SEQ ID NO: 61070 - DNA, 20 bp, synthetic construct
  misc_feature 1..20: note = CRISPR gRNA sequence
  source 1..20: mol_type = other DNA
tttcctaaagaacaggacac

SEQ ID NO: 61071 - DNA, 20 bp, synthetic construct
  misc_feature 1..20: note = CRISPR gRNA sequence
  source 1..20: mol_type = other DNA
acaggacacaagtgattacg

SEQ ID NO: 61072 - DNA, 20 bp, synthetic construct
  misc_feature 1..20: note = CRISPR gRNA sequence
  source 1..20: mol_type = other DNA
acaagtgattacgagaagat

SEQ ID NO: 61073 - DNA, 20 bp, synthetic construct
  misc_feature 1..20: note = CRISPR gRNA sequence
  source 1..20: mol_type = other DNA
attcatctttaacacctaac

SEQ ID NO: 61074 - DNA, 20 bp, synthetic construct
  misc_feature 1..20: note = CRISPR gRNA sequence
  source 1..20: mol_type = other DNA
ttccaactagaagttaatac

SEQ ID NO: 61075 - DNA, 20 bp, synthetic construct
  misc_feature 1..20: note = CRISPR gRNA sequence
  source 1..20: mol_type = other DNA
ttctatatggagtctgtaac

SEQ ID NO: 61076 - DNA, 20 bp, synthetic construct
  misc_feature 1..20: note = CRISPR gRNA sequence
  source 1..20: mol_type = other DNA
tttccattgatagtagcaat

SEQ ID NO: 61077 - DNA, 20 bp, synthetic construct
  misc_feature 1..20: note = CRISPR gRNA sequence
  source 1..20: mol_type = other DNA
gtagcaataaaagtttcctt

SEQ ID NO: 61078 - DNA, 20 bp, synthetic construct
  misc_feature 1..20: note = CRISPR gRNA sequence
  source 1..20: mol_type = other DNA
aacctccacctgccgggttc

SEQ ID NO: 61079 - DNA, 20 bp, synthetic construct
  misc_feature 1..20: note = CRISPR gRNA sequence
  source 1..20: mol_type = other DNA
tgcctcagcctcctgagtag

SEQ ID NO: 61080 - DNA, 20 bp, synthetic construct
  misc_feature 1..20: note = CRISPR gRNA sequence
  source 1..20: mol_type = other DNA
tttttgtatttttagtagag

SEQ ID NO: 61081 - DNA, 20 bp, synthetic construct
  misc_feature 1..20: note = CRISPR gRNA sequence
  source 1..20: mol_type = other DNA
gaccttggcctcccaaagtg

SEQ ID NO: 61082 - DNA, 20 bp, synthetic construct
  misc_feature 1..20: note = CRISPR gRNA sequence
  source 1..20: mol_type = other DNA
gcgtgagcaaccacgcccag

SEQ ID NO: 61083 - DNA, 20 bp, synthetic construct
  misc_feature 1..20: note = CRISPR gRNA sequence
  source 1..20: mol_type = other DNA
gcaacatcttgtgaacaacg

SEQ ID NO: 61084 - DNA, 20 bp, synthetic construct
  misc_feature 1..20: note = CRISPR gRNA sequence
  source 1..20: mol_type = other DNA
ccttgcccccacgactggca

SEQ ID NO: 61085 - DNA, 20 bp, synthetic construct
  misc_feature 1..20: note = CRISPR gRNA sequence
  source 1..20: mol_type = other DNA
tggcctgttccaagcccctg

SEQ ID NO: 61086 - DNA, 20 bp, synthetic construct
  misc_feature 1..20: note = CRISPR gRNA sequence
  source 1..20: mol_type = other DNA
tctcacacccattctcatgg

SEQ ID NO: 61087 - DNA, 20 bp, synthetic construct
  misc_feature 1..20: note = CRISPR gRNA sequence
  source 1..20: mol_type = other DNA
agcctggagaagaatcagat

SEQ ID NO: 61088 - DNA, 20 bp, synthetic construct
  misc_feature 1..20: note = CRISPR gRNA sequence
  source 1..20: mol_type = other DNA
ggaggcggcagggcctgggc

SEQ ID NO: 61089 - DNA, 20 bp, synthetic construct
  misc_feature 1..20: note = CRISPR gRNA sequence
  source 1..20: mol_type = other DNA
accattcacattgtcaacct

SEQ ID NO: 61090 - DNA, 20 bp, synthetic construct
  misc_feature 1..20: note = CRISPR gRNA sequence
  source 1..20: mol_type = other DNA
ggcatcccaagtagcaggat

SEQ ID NO: 61091 - DNA, 20 bp, synthetic construct
  misc_feature 1..20: note = CRISPR gRNA sequence
  source 1..20: mol_type = other DNA
ttttaaagcaaatacatatt

SEQ ID NO: 61092 - DNA, 20 bp, synthetic construct
  misc_feature 1..20: note = CRISPR gRNA sequence
  source 1..20: mol_type = other DNA
gactcctcccttacttacat

SEQ ID NO: 61093 - DNA, 20 bp, synthetic construct
  misc_feature 1..20: note = CRISPR gRNA sequence
  source 1..20: mol_type = other DNA
tgggtccagctactactttg

SEQ ID NO: 61094 - DNA, 20 bp, synthetic construct
  misc_feature 1..20: note = CRISPR gRNA sequence
  source 1..20: mol_type = other DNA
tggctctgtcacactcgaag

SEQ ID NO: 61095 - DNA, 20 bp, synthetic construct
  misc_feature 1..20: note = CRISPR gRNA sequence
  source 1..20: mol_type = other DNA
ttccacgtctagcgtgaatc

SEQ ID NO: 61096 - DNA, 20 bp, synthetic construct
  misc_feature 1..20: note = CRISPR gRNA sequence
  source 1..20: mol_type = other DNA
tcagtggggtaagaggaaac

SEQ ID NO: 61097 - DNA, 20 bp, synthetic construct
  misc_feature 1..20: note = CRISPR gRNA sequence
  source 1..20: mol_type = other DNA
acgctagacgtggaatacca

SEQ ID NO: 61098 - DNA, 20 bp, synthetic construct
  misc_feature 1..20: note = CRISPR gRNA sequence
  source 1..20: mol_type = other DNA
cattgtgtttattgatcaag

SEQ ID NO: 61099 - DNA, 20 bp, synthetic construct
  misc_feature 1..20: note = CRISPR gRNA sequence
  source 1..20: mol_type = other DNA
gtagtagctggacccagtag

SEQ ID NO: 61100 - DNA, 20 bp, synthetic construct
  misc_feature 1..20: note = CRISPR gRNA sequence
  source 1..20: mol_type = other DNA
ccctacccagtaccattaga

SEQ ID NO: 61101 - DNA, 20 bp, synthetic construct
  misc_feature 1..20: note = CRISPR gRNA sequence
  source 1..20: mol_type = other DNA
tgtcccttacataggacaga

SEQ ID NO: 61102 - DNA, 20 bp, synthetic construct
  misc_feature 1..20: note = CRISPR gRNA sequence
  source 1..20: mol_type = other DNA
tgtaagtaagggaggagtca

SEQ ID NO: 61103 - DNA, 20 bp, synthetic construct
  misc_feature 1..20: note = CRISPR gRNA sequence
  source 1..20: mol_type = other DNA
aagtttatagatgggtaggc

SEQ ID NO: 61104 - DNA, 20 bp, synthetic construct
  misc_feature 1..20: note = CRISPR gRNA sequence
  source 1..20: mol_type = other DNA
ggggacttaatggctgagtc

SEQ ID NO: 61105 - DNA, 20 bp, synthetic construct
  misc_feature 1..20: note = CRISPR gRNA sequence
  source 1..20: mol_type = other DNA
cacacaatctataaatatgt

SEQ ID NO: 61106 - DNA, 20 bp, synthetic construct
  misc_feature 1..20: note = CRISPR gRNA sequence
  source 1..20: mol_type = other DNA
tcatttgggtgcatcacttg

SEQ ID NO: 61107 - DNA, 20 bp, synthetic construct
  misc_feature 1..20: note = CRISPR gRNA sequence
  source 1..20: mol_type = other DNA
tctttgccatctgtcgtatc

SEQ ID NO: 61108 - DNA, 20 bp, synthetic construct
  misc_feature 1..20: note = CRISPR gRNA sequence
  source 1..20: mol_type = other DNA
gaaaagaccctctttcttca

SEQ ID NO: 61109 - DNA, 20 bp, synthetic construct
  misc_feature 1..20: note = CRISPR gRNA sequence
  source 1..20: mol_type = other DNA
ctgtctgaaattgtcataat

SEQ ID NO: 61110 - DNA, 20 bp, synthetic construct
  misc_feature 1..20: note = CRISPR gRNA sequence
  source 1..20: mol_type = other DNA
gacaatgtgaatggtgcccc

SEQ ID NO: 61111 - DNA, 20 bp, synthetic construct
  misc_feature 1..20: note = CRISPR gRNA sequence
  source 1..20: mol_type = other DNA
tatacaactgtatgtgatgg

SEQ ID NO: 61112 - DNA, 20 bp, synthetic construct
  misc_feature 1..20: note = CRISPR gRNA sequence
  source 1..20: mol_type = other DNA
ctgattatagctgccatttt

SEQ ID NO: 61113 - DNA, 20 bp, synthetic construct
  misc_feature 1..20: note = CRISPR gRNA sequence
  source 1..20: mol_type = other DNA
tatgtgccaggcattgggtt

SEQ ID NO: 61114 - DNA, 20 bp, synthetic construct
  misc_feature 1..20: note = CRISPR gRNA sequence
  source 1..20: mol_type = other DNA
cagttggcaagtggcagagc

SEQ ID NO: 61115 - DNA, 20 bp, synthetic construct
  misc_feature 1..20: note = CRISPR gRNA sequence
  source 1..20: mol_type = other DNA
agagctggggtttgatccaa

SEQ ID NO: 61116 - DNA, 20 bp, synthetic construct
  misc_feature 1..20: note = CRISPR gRNA sequence
  source 1..20: mol_type = other DNA
gccaggcccccaaagctgtg

SEQ ID NO: 61117 - DNA, 20 bp, synthetic construct
  misc_feature 1..20: note = CRISPR gRNA sequence
  source 1..20: mol_type = other DNA
agctgtgatctgattcttct

SEQ ID NO: 61118 - DNA, 20 bp, synthetic construct
  misc_feature 1..20: note = CRISPR gRNA sequence
  source 1..20: mol_type = other DNA
acggccatgagaatgggtgt

SEQ ID NO: 61119 - DNA, 20 bp, synthetic construct
  misc_feature 1..20: note = CRISPR gRNA sequence
  source 1..20: mol_type = other DNA
cagggggaactaagcctggc

SEQ ID NO: 61120 - DNA, 20 bp, synthetic construct
  misc_feature 1..20: note = CRISPR gRNA sequence
  source 1..20: mol_type = other DNA
ccagagtgtgcaactcaagg

SEQ ID NO: 61121 - DNA, 20 bp, synthetic construct
  misc_feature 1..20: note = CRISPR gRNA sequence
  source 1..20: mol_type = other DNA
cggcagctgcctcatccccg

SEQ ID NO: 61122 - DNA, 20 bp, synthetic construct
  misc_feature 1..20: note = CRISPR gRNA sequence
  source 1..20: mol_type = other DNA
agggtgccagtcgtgggggc

SEQ ID NO: 61123 - DNA, 20 bp, synthetic construct
  misc_feature 1..20: note = CRISPR gRNA sequence
  source 1..20: mol_type = other DNA
tcaagagaggccacctgata

SEQ ID NO: 61124 - DNA, 20 bp, synthetic construct
  misc_feature 1..20: note = CRISPR gRNA sequence
  source 1..20: mol_type = other DNA
cctccctgctcccctccccg

SEQ ID NO: 61125 - DNA, 20 bp, synthetic construct
  misc_feature 1..20: note = CRISPR gRNA sequence
  source 1..20: mol_type = other DNA
cactttgggaggccaaggtc

SEQ ID NO: 61126 - DNA, 20 bp, synthetic construct
  misc_feature 1..20: note = CRISPR gRNA sequence
  source 1..20: mol_type = other DNA
caggtggaggttgcagtgag

SEQ ID NO: 61127 - DNA, 20 bp, synthetic construct
  misc_feature 1..20: note = CRISPR gRNA sequence
  source 1..20: mol_type = other DNA
catatgcccttcctaagatg

SEQ ID NO: 61128 - DNA, 20 bp, synthetic construct
  misc_feature 1..20: note = CRISPR gRNA sequence
  source 1..20: mol_type = other DNA
aattaccactgatctgagac

SEQ ID NO: 61129 - DNA, 20 bp, synthetic construct
  misc_feature 1..20: note = CRISPR gRNA sequence
  source 1..20: mol_type = other DNA
ttgtgtcctgttctttagga

SEQ ID NO: 61130 - DNA, 20 bp, synthetic construct
  misc_feature 1..20: note = CRISPR gRNA sequence
  source 1..20: mol_type = other DNA
tcccaggctagtcctagaat

SEQ ID NO: 61131 - DNA, 20 bp, synthetic construct
  misc_feature 1..20: note = CRISPR gRNA sequence
  source 1..20: mol_type = other DNA
actgcaaagccccaaggtct

SEQ ID NO: 61132 - DNA, 20 bp, synthetic construct
  misc_feature 1..20: note = CRISPR gRNA sequence
  source 1..20: mol_type = other DNA
aagccccaaggtctggggga

SEQ ID NO: 61133 - DNA, 20 bp, synthetic construct
  misc_feature 1..20: note = CRISPR gRNA sequence
  source 1..20: mol_type = other DNA
ggccagccagcaggtctggg

SEQ ID NO: 61134 - DNA, 20 bp, synthetic construct
  misc_feature 1..20: note = CRISPR gRNA sequence
  source 1..20: mol_type = other DNA
aggtctgggggtggctttct

SEQ ID NO: 61135 - DNA, 20 bp, synthetic construct
  misc_feature 1..20: note = CRISPR gRNA sequence
  source 1..20: mol_type = other DNA
ggctttctcctggctttagc

SEQ ID NO: 61136 - DNA, 20 bp, synthetic construct
  misc_feature 1..20: note = CRISPR gRNA sequence
  source 1..20: mol_type = other DNA
accaactgtggttcataaat

SEQ ID NO: 61137 - DNA, 20 bp, synthetic construct
  misc_feature 1..20: note = CRISPR gRNA sequence
  source 1..20: mol_type = other DNA
gaaaaaggcagaagaaggta

SEQ ID NO: 61138 - DNA, 20 bp, synthetic construct
  misc_feature 1..20: note = CRISPR gRNA sequence
  source 1..20: mol_type = other DNA
cagggctcttccaatcactc

SEQ ID NO: 61139 - DNA, 20 bp, synthetic construct
  misc_feature 1..20: note = CRISPR gRNA sequence
  source 1..20: mol_type = other DNA
agctcgtgaagctggaggtg

SEQ ID NO: 61140 - DNA, 20 bp, synthetic construct
  misc_feature 1..20: note = CRISPR gRNA sequence
  source 1..20: mol_type = other DNA
agggcatgggatgggatggg

SEQ ID NO: 61141 - DNA, 20 bp, synthetic construct
  misc_feature 1..20: note = CRISPR gRNA sequence
  source 1..20: mol_type = other DNA
accagggtctggggtaagct

SEQ ID NO: 61142 - DNA, 20 bp, synthetic construct
  misc_feature 1..20: note = CRISPR gRNA sequence
  source 1..20: mol_type = other DNA
agccaggcccccaccatccc

SEQ ID NO: 61143 - DNA, 20 bp, synthetic construct
  misc_feature 1..20: note = CRISPR gRNA sequence
  source 1..20: mol_type = other DNA
acgcaggacccctccagcca

SEQ ID NO: 61144 - DNA, 20 bp, synthetic construct
  misc_feature 1..20: note = CRISPR gRNA sequence
  source 1..20: mol_type = other DNA
gtgagaggagcctgagggac

SEQ ID NO: 61145 - DNA, 20 bp, synthetic construct
  misc_feature 1..20: note = CRISPR gRNA sequence
  source 1..20: mol_type = other DNA
cctgggtaggtatcaaggac

SEQ ID NO: 61146 - DNA, 20 bp, synthetic construct
  misc_feature 1..20: note = CRISPR gRNA sequence
  source 1..20: mol_type = other DNA
tctggtagctgaggcacaag

SEQ ID NO: 61147 - DNA, 20 bp, synthetic construct
  misc_feature 1..20: note = CRISPR gRNA sequence
  source 1..20: mol_type = other DNA
tttgtgaagtgctgaggcca

SEQ ID NO: 61148 - DNA, 20 bp, synthetic construct
  misc_feature 1..20: note = CRISPR gRNA sequence
  source 1..20: mol_type = other DNA
tgctcctgcgaagccctctg

SEQ ID NO: 61149 - DNA, 20 bp, synthetic construct
  misc_feature 1..20: note = CRISPR gRNA sequence
  source 1..20: mol_type = other DNA
aactgaggctgagaaggggc

SEQ ID NO: 61150 - DNA, 20 bp, synthetic construct
  misc_feature 1..20: note = CRISPR gRNA sequence
  source 1..20: mol_type = other DNA
agccaggactaggctgggcc

SEQ ID NO: 61151 - DNA, 20 bp, synthetic construct
  misc_feature 1..20: note = CRISPR gRNA sequence
  source 1..20: mol_type = other DNA
ggcaggagagtgggtatatg

SEQ ID NO: 61152 - DNA, 20 bp, synthetic construct
  misc_feature 1..20: note = CRISPR gRNA sequence
  source 1..20: mol_type = other DNA
acatctgctgggtctgccac

SEQ ID NO: 61153 - DNA, 20 bp, synthetic construct
  misc_feature 1..20: note = CRISPR gRNA sequence
  source 1..20: mol_type = other DNA
cagagaagagcaggggctgg

SEQ ID NO: 61154 - DNA, 20 bp, synthetic construct
  misc_feature 1..20: note = CRISPR gRNA sequence
  source 1..20: mol_type = other DNA
ggacactgaggttggcgcag

SEQ ID NO: 61155 - DNA, 20 bp, synthetic construct
  misc_feature 1..20: note = CRISPR gRNA sequence
  source 1..20: mol_type = other DNA
gtctccaatctggttgtggc

SEQ ID NO: 61156 - DNA, 20 bp, synthetic construct
  misc_feature 1..20: note = CRISPR gRNA sequence
  source 1..20: mol_type = other DNA
ggctcaagcttgggggagaa

SEQ ID NO: 61157 - DNA, 20 bp, synthetic construct
  misc_feature 1..20: note = CRISPR gRNA sequence
  source 1..20: mol_type = other DNA
ttgagtgacagctcctaacc

SEQ ID NO: 61158 - DNA, 20 bp, synthetic construct
  misc_feature 1..20: note = CRISPR gRNA sequence
  source 1..20: mol_type = other DNA
gacagctcctaacccttggc

SEQ ID NO: 61159 - DNA, 20 bp, synthetic construct
  misc_feature 1..20: note = CRISPR gRNA sequence
  source 1..20: mol_type = other DNA
acatcctgtctttgggtccc

SEQ ID NO: 61160 - DNA, 20 bp, synthetic construct
  misc_feature 1..20: note = CRISPR gRNA sequence
  source 1..20: mol_type = other DNA
ccccaagcttctaggcccca

SEQ ID NO: 61161 - DNA, 20 bp, synthetic construct
  misc_feature 1..20: note = CRISPR gRNA sequence
  source 1..20: mol_type = other DNA
gaaaagcagggaatagacca

SEQ ID NO: 61162 - DNA, 20 bp, synthetic construct
  misc_feature 1..20: note = CRISPR gRNA sequence
  source 1..20: mol_type = other DNA
gaatagaccaagaggctttc

SEQ ID NO: 61163 - DNA, 20 bp, synthetic construct
  misc_feature 1..20: note = CRISPR gRNA sequence
  source 1..20: mol_type = other DNA
aggtgctgtgctaagaactc

SEQ ID NO: 61164 - DNA, 20 bp, synthetic construct
  misc_feature 1..20: note = CRISPR gRNA sequence
  source 1..20: mol_type = other DNA
ggagtctctacatttctttg

SEQ ID NO: 61165 - DNA, 20 bp, synthetic construct
  misc_feature 1..20: note = CRISPR gRNA sequence
  source 1..20: mol_type = other DNA
cggctgaatgccactttcac

SEQ ID NO: 61166 - DNA, 20 bp, synthetic construct
  misc_feature 1..20: note = CRISPR gRNA sequence
  source 1..20: mol_type = other DNA
tgccactttcacgtgggatt

SEQ ID NO: 61167 - DNA, 20 bp, synthetic construct
  misc_feature 1..20: note = CRISPR gRNA sequence
  source 1..20: mol_type = other DNA
tgttctcatccatgcaaatg

SEQ ID NO: 61168 - DNA, 20 bp, synthetic construct
  misc_feature 1..20: note = CRISPR gRNA sequence
  source 1..20: mol_type = other DNA
gtcttagccccttgggaagt

SEQ ID NO: 61169 - DNA, 20 bp, synthetic construct
  misc_feature 1..20: note = CRISPR gRNA sequence
  source 1..20: mol_type = other DNA
ttgggaagtatttgtttgca

SEQ ID NO: 61170 - DNA, 20 bp, synthetic construct
  misc_feature 1..20: note = CRISPR gRNA sequence
  source 1..20: mol_type = other DNA
ttgggcggctgaggcaccag

SEQ ID NO: 61171 - DNA, 20 bp, synthetic construct
  misc_feature 1..20: note = CRISPR gRNA sequence
  source 1..20: mol_type = other DNA
gtacttggatataaacaaag

SEQ ID NO: 61172 - DNA, 20 bp, synthetic construct
  misc_feature 1..20: note = CRISPR gRNA sequence
  source 1..20: mol_type = other DNA
aacaaagcaatgctttgtgt

SEQ ID NO: 61173 - DNA, 20 bp, synthetic construct
  misc_feature 1..20: note = CRISPR gRNA sequence
  source 1..20: mol_type = other DNA
agcaatgctttgtgtcactg

SEQ ID NO: 61174 - DNA, 20 bp, synthetic construct
  misc_feature 1..20: note = CRISPR gRNA sequence
  source 1..20: mol_type = other DNA
tgctttgtgtcactgcttgg

SEQ ID NO: 61175 - DNA, 20 bp, synthetic construct
  misc_feature 1..20: note = CRISPR gRNA sequence
  source 1..20: mol_type = other DNA
gcttggatttgtttttagtc

SEQ ID NO: 61176 - DNA, 20 bp, synthetic construct
  misc_feature 1..20: note = CRISPR gRNA sequence
  source 1..20: mol_type = other DNA
ttgtttttagtcacaagatt

SEQ ID NO: 61177 - DNA, 20 bp, synthetic construct
  misc_feature 1..20: note = CRISPR gRNA sequence
  source 1..20: mol_type = other DNA
aatcacattgaaagtaagtg

SEQ ID NO: 61178 - DNA, 20 bp, synthetic construct
  misc_feature 1..20: note = CRISPR gRNA sequence
  source 1..20: mol_type = other DNA
ccccagaattgataccaccc

SEQ ID NO: 61179 - DNA, 20 bp, synthetic construct
  misc_feature 1..20: note = CRISPR gRNA sequence
  source 1..20: mol_type = other DNA
tcgggaggctgaggcaggag

SEQ ID NO: 61180 - DNA, 20 bp, synthetic construct
  misc_feature 1..20: note = CRISPR gRNA sequence
  source 1..20: mol_type = other DNA
gaggcggaggttgcagtgag

SEQ ID NO: 61181 - DNA, 20 bp, synthetic construct
  misc_feature 1..20: note = CRISPR gRNA sequence
  source 1..20: mol_type = other DNA
aacaaacaaaaaaagaaatg

SEQ ID NO: 61182 - DNA, 20 bp, synthetic construct
  misc_feature 1..20: note = CRISPR gRNA sequence
  source 1..20: mol_type = other DNA
cgccttaggcctgtagtccc

SEQ ID NO: 61183 - DNA, 20 bp, synthetic construct
  misc_feature 1..20: note = CRISPR gRNA sequence
  source 1..20: mol_type = other DNA
caggaggatcacgttcgccc

SEQ ID NO: 61184 - DNA, 20 bp, synthetic construct
  misc_feature 1..20: note = CRISPR gRNA sequence
  source 1..20: mol_type = other DNA
gagtttgaggctgcagtgca

SEQ ID NO: 61185 - DNA, 20 bp, synthetic construct
  misc_feature 1..20: note = CRISPR gRNA sequence
  source 1..20: mol_type = other DNA
gatcccctgggaggtggcct

SEQ ID NO: 61186 - DNA, 20 bp, synthetic construct
  misc_feature 1..20: note = CRISPR gRNA sequence
  source 1..20: mol_type = other DNA
tgtggtcccaactgagtggg

SEQ ID NO: 61187 - DNA, 20 bp, synthetic construct
  misc_feature 1..20: note = CRISPR gRNA sequence
  source 1..20: mol_type = other DNA
gaggctctgcaggcaggtca

SEQ ID NO: 61188 - DNA, 20 bp, synthetic construct
  misc_feature 1..20: note = CRISPR gRNA sequence
  source 1..20: mol_type = other DNA
agtctgggggtctgaggcct

SEQ ID NO: 61189 - DNA, 20 bp, synthetic construct
  misc_feature 1..20: note = CRISPR gRNA sequence
  source 1..20: mol_type = other DNA
actgtactgggaggtccaaa

SEQ ID NO: 61190 - DNA, 20 bp, synthetic construct
  misc_feature 1..20: note = CRISPR gRNA sequence
  source 1..20: mol_type = other DNA
cataaaatgtgggccaaact

SEQ ID NO: 61191 - DNA, 20 bp, synthetic construct
  misc_feature 1..20: note = CRISPR gRNA sequence
  source 1..20: mol_type = other DNA
gcttggggccatctggaaag

SEQ ID NO: 61192 - DNA, 20 bp, synthetic construct
  misc_feature 1..20: note = CRISPR gRNA sequence
  source 1..20: mol_type = other DNA
aaggttcagagagttagaga

SEQ ID NO: 61193 - DNA, 20 bp, synthetic construct
  misc_feature 1..20: note = CRISPR gRNA sequence
  source 1..20: mol_type = other DNA
cttaaggtcatacacaaagt

SEQ ID NO: 61194 - DNA, 20 bp, synthetic construct
  misc_feature 1..20: note = CRISPR gRNA sequence
  source 1..20: mol_type = other DNA
gccccaaccatatgtgaccc

SEQ ID NO: 61195 - DNA, 20 bp, synthetic construct
  misc_feature 1..20: note = CRISPR gRNA sequence
  source 1..20: mol_type = other DNA
actcacaacaaccgtagcag

SEQ ID NO: 61196 - DNA, 20 bp, synthetic construct
  misc_feature 1..20: note = CRISPR gRNA sequence
  source 1..20: mol_type = other DNA
ttgggaggctgaggcaggag

SEQ ID NO: 61197 - DNA, 20 bp, synthetic construct
  misc_feature 1..20: note = CRISPR gRNA sequence
  source 1..20: mol_type = other DNA
tcttggttggctcagaacag

SEQ ID NO: 61198 - DNA, 20 bp, synthetic construct
  misc_feature 1..20: note = CRISPR gRNA sequence
  source 1..20: mol_type = other DNA
tatacagctggaagaagctg

SEQ ID NO: 61199 - DNA, 20 bp, synthetic construct
  misc_feature 1..20: note = CRISPR gRNA sequence
  source 1..20: mol_type = other DNA
cggacagggaagatattatg

SEQ ID NO: 61200 - DNA, 20 bp, synthetic construct
  misc_feature 1..20: note = CRISPR gRNA sequence
  source 1..20: mol_type = other DNA
gggcctccaatcccctaaat

SEQ ID NO: 61201 - DNA, 20 bp, synthetic construct
  misc_feature 1..20: note = CRISPR gRNA sequence
  source 1..20: mol_type = other DNA
aaattcacaaaccgttcaac

SEQ ID NO: 61202 - DNA, 20 bp, synthetic construct
  misc_feature 1..20: note = CRISPR gRNA sequence
  source 1..20: mol_type = other DNA
ggacctgtcttttagactga

SEQ ID NO: 61203 - DNA, 20 bp, synthetic construct
  misc_feature 1..20: note = CRISPR gRNA sequence
  source 1..20: mol_type = other DNA
agacaaatgtagtggacatc

SEQ ID NO: 61204 - DNA, 20 bp, synthetic construct
  misc_feature 1..20: note = CRISPR gRNA sequence
  source 1..20: mol_type = other DNA
tctgtagatttttttctgcc

SEQ ID NO: 61205 - DNA, 20 bp, synthetic construct
  misc_feature 1..20: note = CRISPR gRNA sequence
  source 1..20: mol_type = other DNA
atattttgtgctcacagcca

SEQ ID NO: 61206 - DNA, 20 bp, synthetic construct
  misc_feature 1..20: note = CRISPR gRNA sequence
  source 1..20: mol_type = other DNA
tttgtgctcacagccacagt

SEQ ID NO: 61207 - DNA, 20 bp, synthetic construct
  misc_feature 1..20: note = CRISPR gRNA sequence
  source 1..20: mol_type = other DNA
ataagccaatatatttctgt

SEQ ID NO: 61208 - DNA, 20 bp, synthetic construct
  misc_feature 1..20: note = CRISPR gRNA sequence
  source 1..20: mol_type = other DNA
gccaatatatttctgtcttg

SEQ ID NO: 61209 - DNA, 20 bp, synthetic construct
  misc_feature 1..20: note = CRISPR gRNA sequence
  source 1..20: mol_type = other DNA
ggattgctttgagttgtgta

SEQ ID NO: 61210 - DNA, 20 bp, synthetic construct
  misc_feature 1..20: note = CRISPR gRNA sequence
  source 1..20: mol_type = other DNA
ctgggtccatccagaaacat

SEQ ID NO: 61211 - DNA, 20 bp, synthetic construct
  misc_feature 1..20: note = CRISPR gRNA sequence
  source 1..20: mol_type = other DNA
caaccatcaccactcactca

SEQ ID NO: 61212 - DNA, 20 bp, synthetic construct
  misc_feature 1..20: note = CRISPR gRNA sequence
  source 1..20: mol_type = other DNA
ccttggtgccctcctcatca

SEQ ID NO: 61213 - DNA, 20 bp, synthetic construct
  misc_feature 1..20: note = CRISPR gRNA sequence
  source 1..20: mol_type = other DNA
atgaactcattaagccacca

SEQ ID NO: 61214 - DNA, 20 bp, synthetic construct
  misc_feature 1..20: note = CRISPR gRNA sequence
  source 1..20: mol_type = other DNA
tagcaacttcacaacttaag

SEQ ID NO: 61215 - DNA, 20 bp, synthetic construct
  misc_feature 1..20: note = CRISPR gRNA sequence
  source 1..20: mol_type = other DNA
aagccaggattaggtatcac

SEQ ID NO: 61216 - DNA, 20 bp, synthetic construct
  misc_feature 1..20: note = CRISPR gRNA sequence
  source 1..20: mol_type = other DNA
actgtagtttagctagttac

SEQ ID NO: 61217 - DNA, 20 bp, synthetic construct
  misc_feature 1..20: note = CRISPR gRNA sequence
  source 1..20: mol_type = other DNA
tcaaagatctctctgtccta

SEQ ID NO: 61218 - DNA, 20 bp, synthetic construct
  misc_feature 1..20: note = CRISPR gRNA sequence
  source 1..20: mol_type = other DNA
ggtgtcgaactcccgggctc

SEQ ID NO: 61219 - DNA, 20 bp, synthetic construct
  misc_feature 1..20: note = CRISPR gRNA sequence
  source 1..20: mol_type = other DNA
ctcctcggcctcccagagtg

SEQ ID NO: 61220 - DNA, 20 bp, synthetic construct
  misc_feature 1..20: note = CRISPR gRNA sequence
  source 1..20: mol_type = other DNA
cctcccagagtgctgggatt

SEQ ID NO: 61221 - DNA, 20 bp, synthetic construct
  misc_feature 1..20: note = CRISPR gRNA sequence
  source 1..20: mol_type = other DNA
tgagccactgttcccagccc

SEQ ID NO: 61222 - DNA, 20 bp, synthetic construct
  misc_feature 1..20: note = CRISPR gRNA sequence
  source 1..20: mol_type = other DNA
gctacattttgcaactgtca

SEQ ID NO: 61223 - DNA, 20 bp, synthetic construct
  misc_feature 1..20: note = CRISPR gRNA sequence
  source 1..20: mol_type = other DNA
ttgcaactgtcatgctgatt

SEQ ID NO: 61224 - DNA, 20 bp, synthetic construct
  misc_feature 1..20: note = CRISPR gRNA sequence
  source 1..20: mol_type = other DNA
atgctgattcatcgatttaa

SEQ ID NO: 61225 - DNA, 20 bp, synthetic construct
  misc_feature 1..20: note = CRISPR gRNA sequence
  source 1..20: mol_type = other DNA
ggctgctaaaatttgccaat

SEQ ID NO: 61226 - DNA, 20 bp, synthetic construct
  misc_feature 1..20: note = CRISPR gRNA sequence
  source 1..20: mol_type = other DNA
gtatctccccacataatcta

SEQ ID NO: 61227 - DNA, 20 bp, synthetic construct
  misc_feature 1..20: note = CRISPR gRNA sequence
  source 1..20: mol_type = other DNA
aagaagggccaaggacgtgt

SEQ ID NO: 61228 - DNA, 20 bp, synthetic construct
  misc_feature 1..20: note = CRISPR gRNA sequence
  source 1..20: mol_type = other DNA
cactaaatgagacgtgtgat

SEQ ID NO: 61229 - DNA, 20 bp, synthetic construct
  misc_feature 1..20: note = CRISPR gRNA sequence
  source 1..20: mol_type = other DNA
caacattattgggagaactg

SEQ ID NO: 61230 - DNA, 20 bp, synthetic construct
  misc_feature 1..20: note = CRISPR gRNA sequence
  source 1..20: mol_type = other DNA
agtgtatcaatgtcacattt

SEQ ID NO: 61231 - DNA, 20 bp, synthetic construct
  misc_feature 1..20: note = CRISPR gRNA sequence
  source 1..20: mol_type = other DNA
ttcctggattttataatttt

SEQ ID NO: 61232 - DNA, 20 bp, synthetic construct
  misc_feature 1..20: note = CRISPR gRNA sequence
  source 1..20: mol_type = other DNA
aaatgttaacgggtaaaggg

SEQ ID NO: 61233 - DNA, 20 bp, synthetic construct
  misc_feature 1..20: note = CRISPR gRNA sequence
  source 1..20: mol_type = other DNA
aagaaatgagcaaatgtgga

SEQ ID NO: 61234 - DNA, 20 bp, synthetic construct
  misc_feature 1..20: note = CRISPR gRNA sequence
  source 1..20: mol_type = other DNA
tgcctcagcctcccaattag

SEQ ID NO: 61235 - DNA, 20 bp, synthetic construct
  misc_feature 1..20: note = CRISPR gRNA sequence
  source 1..20: mol_type = other DNA
tttttgtattttagtagaga

SEQ ID NO: 61236 - DNA, 20 bp, synthetic construct
  misc_feature 1..20: note = CRISPR gRNA sequence
  source 1..20: mol_type = other DNA
tgcctcggcctcccaaagtg

SEQ ID NO: 61237 - DNA, 20 bp, synthetic construct
  misc_feature 1..20: note = CRISPR gRNA sequence
  source 1..20: mol_type = other DNA
gtggctcaatgttcctaagg

SEQ ID NO: 61238 - DNA, 20 bp, synthetic construct
  misc_feature 1..20: note = CRISPR gRNA sequence
  source 1..20: mol_type = other DNA
aaatcatctccagggccacc

SEQ ID NO: 61239 - DNA, 20 bp, synthetic construct
  misc_feature 1..20: note = CRISPR gRNA sequence
  source 1..20: mol_type = other DNA
aaaaggtccaaggatattct

SEQ ID NO: 61240 - DNA, 20 bp, synthetic construct
  misc_feature 1..20: note = CRISPR gRNA sequence
  source 1..20: mol_type = other DNA
ccctcccctccactggccaa

SEQ ID NO: 61241 - DNA, 20 bp, synthetic construct
  misc_feature 1..20: note = CRISPR gRNA sequence
  source 1..20: mol_type = other DNA
agagaactcagggccccaca

SEQ ID NO: 61242 - DNA, 20 bp, synthetic construct
  misc_feature 1..20: note = CRISPR gRNA sequence
  source 1..20: mol_type = other DNA
ctggacacagacagggagac

SEQ ID NO: 61243 - DNA, 20 bp, synthetic construct
  misc_feature 1..20: note = CRISPR gRNA sequence
  source 1..20: mol_type = other DNA
tggaacatctagtccagtat

SEQ ID NO: 61244 - DNA, 20 bp, synthetic construct
  misc_feature 1..20: note = CRISPR gRNA sequence
  source 1..20: mol_type = other DNA
ggattcagtatctgcctgca

SEQ ID NO: 61245 - DNA, 20 bp, synthetic construct
  misc_feature 1..20: note = CRISPR gRNA sequence
  source 1..20: mol_type = other DNA
atgctgatcaaatgaagtcc

SEQ ID NO: 61246 - DNA, 20 bp, synthetic construct
  misc_feature 1..20: note = CRISPR gRNA sequence
  source 1..20: mol_type = other DNA
taatttcccaaactgtgcca

SEQ ID NO: 61247 - DNA, 20 bp, synthetic construct
  misc_feature 1..20: note = CRISPR gRNA sequence
  source 1..20: mol_type = other DNA
tctataagagtggataatgg

SEQ ID NO: 61248 - DNA, 20 bp, synthetic construct
  misc_feature 1..20: note = CRISPR gRNA sequence
  source 1..20: mol_type = other DNA
gctgggtcccacctgagtgc

SEQ ID NO: 61249 - DNA, 20 bp, synthetic construct
  misc_feature 1..20: note = CRISPR gRNA sequence
  source 1..20: mol_type = other DNA
cccacctgagtgccacagct

SEQ ID NO: 61250 - DNA, 20 bp, synthetic construct
  misc_feature 1..20: note = CRISPR gRNA sequence
  source 1..20: mol_type = other DNA
ccccttctcccctgccaggg

SEQ ID NO: 61251 - DNA, 20 bp, synthetic construct
  misc_feature 1..20: note = CRISPR gRNA sequence
  source 1..20: mol_type = other DNA
ccagcttaggactggaaagt

SEQ ID NO: 61252 - DNA, 20 bp, synthetic construct
  misc_feature 1..20: note = CRISPR gRNA sequence
  source 1..20: mol_type = other DNA
gctcactgcagccttgaact

SEQ ID NO: 61253 - DNA, 20 bp, synthetic construct
  misc_feature 1..20: note = CRISPR gRNA sequence
  source 1..20: mol_type = other DNA
acttgaatgttatgttcatg

SEQ ID NO: 61254 - DNA, 20 bp, synthetic construct
  misc_feature 1..20: note = CRISPR gRNA sequence
  source 1..20: mol_type = other DNA
gcttatggggagagggctat

SEQ ID NO: 61255 - DNA, 20 bp, synthetic construct
  misc_feature 1..20: note = CRISPR gRNA sequence
  source 1..20: mol_type = other DNA
tctgcctggatccaatagcc

SEQ ID NO: 61256 - DNA, 20 bp, synthetic construct
  misc_feature 1..20: note = CRISPR gRNA sequence
  source 1..20: mol_type = other DNA
ctggatccaatagccctttg

SEQ ID NO: 61257 - DNA, 20 bp, synthetic construct
  misc_feature 1..20: note = CRISPR gRNA sequence
  source 1..20: mol_type = other DNA
gggatgtcttcctctgacac

SEQ ID NO: 61258 - DNA, 20 bp, synthetic construct
  misc_feature 1..20: note = CRISPR gRNA sequence
  source 1..20: mol_type = other DNA
ggaaggtcaaggaaaagtcc

SEQ ID NO: 61259 - DNA, 20 bp, synthetic construct
  misc_feature 1..20: note = CRISPR gRNA sequence
  source 1..20: mol_type = other DNA
ggggcctcttctctggactc

SEQ ID NO: 61260 - DNA, 20 bp, synthetic construct
  misc_feature 1..20: note = CRISPR gRNA sequence
  source 1..20: mol_type = other DNA
gagtgtcaagggggggacct

SEQ ID NO: 61261 - DNA, 20 bp, synthetic construct
  misc_feature 1..20: note = CRISPR gRNA sequence
  source 1..20: mol_type = other DNA
gggggggacctagaggcttt

SEQ ID NO: 61262 - DNA, 20 bp, synthetic construct
  misc_feature 1..20: note = CRISPR gRNA sequence
  source 1..20: mol_type = other DNA
atcttattttatttttgaga

SEQ ID NO: 61263 - DNA, 20 bp, synthetic construct
  misc_feature 1..20: note = CRISPR gRNA sequence
  source 1..20: mol_type = other DNA
aacctctgcctcctgggttc

SEQ ID NO: 61264 - DNA, 20 bp, synthetic construct
  misc_feature 1..20: note = CRISPR gRNA sequence
  source 1..20: mol_type = other DNA
tgcctcagcctcccaagtag

SEQ ID NO: 61265 - DNA, 20 bp, synthetic construct
  misc_feature 1..20: note = CRISPR gRNA sequence
  source 1..20: mol_type = other DNA
ttttgtatttttagtagaga

SEQ ID NO: 61266 - DNA, 20 bp, synthetic construct
  misc_feature 1..20: note = CRISPR gRNA sequence
  source 1..20: mol_type = other DNA
tgcctcggcctcccaaagtg

SEQ ID NO: 61267 - DNA, 20 bp, synthetic construct
  misc_feature 1..20: note = CRISPR gRNA sequence
  source 1..20: mol_type = other DNA
tgcactgggccactgatatt

SEQ ID NO: 61268 - DNA, 20 bp, synthetic construct
  misc_feature 1..20: note = CRISPR gRNA sequence
  source 1..20: mol_type = other DNA
ctgatatttttagatttaag

SEQ ID NO: 61269 - DNA, 20 bp, synthetic construct
  misc_feature 1..20: note = CRISPR gRNA sequence
  source 1..20: mol_type = other DNA
atatattaaatgttcatggt

SEQ ID NO: 61270 - DNA, 20 bp, synthetic construct
  misc_feature 1..20: note = CRISPR gRNA sequence
  source 1..20: mol_type = other DNA
taagatgatagaattctcat

SEQ ID NO: 61271 - DNA, 20 bp, synthetic construct
  misc_feature 1..20: note = CRISPR gRNA sequence
  source 1..20: mol_type = other DNA
aagagaattaagtcaaatat

SEQ ID NO: 61272 - DNA, 20 bp, synthetic construct
  misc_feature 1..20: note = CRISPR gRNA sequence
  source 1..20: mol_type = other DNA
cactattttctttatgtatt

SEQ ID NO: 61273 - DNA, 20 bp, synthetic construct
  misc_feature 1..20: note = CRISPR gRNA sequence
  source 1..20: mol_type = other DNA
ggattttctgcacatttcaa

SEQ ID NO: 61274 - DNA, 20 bp, synthetic construct
  misc_feature 1..20: note = CRISPR gRNA sequence
  source 1..20: mol_type = other DNA
atttttattttttgtagata

SEQ ID NO: 61275 - DNA, 20 bp, synthetic construct
  misc_feature 1..20: note = CRISPR gRNA sequence
  source 1..20: mol_type = other DNA
cacctcagcctcccaaagtg

SEQ ID NO: 61276 - DNA, 20 bp, synthetic construct
  misc_feature 1..20: note = CRISPR gRNA sequence
  source 1..20: mol_type = other DNA
aatattatttttagactaag

SEQ ID NO: 61277 - DNA, 20 bp, synthetic construct
  misc_feature 1..20: note = CRISPR gRNA sequence
  source 1..20: mol_type = other DNA
aatggcgtgaacccaggagg

SEQ ID NO: 61278 - DNA, 20 bp, synthetic construct
  misc_feature 1..20: note = CRISPR gRNA sequence
  source 1..20: mol_type = other DNA
aaacagtgagacctcatctc

SEQ ID NO: 61279 - DNA, 20 bp, synthetic construct
  misc_feature 1..20: note = CRISPR gRNA sequence
  source 1..20: mol_type = other DNA
tccggaggctgaggcaggag

SEQ ID NO: 61280 - DNA, 20 bp, synthetic construct
  misc_feature 1..20: note = CRISPR gRNA sequence
  source 1..20: mol_type = other DNA
ggggtaggggggaaatgggg

SEQ ID NO: 61281 - DNA, 20 bp, synthetic construct
  misc_feature 1..20: note = CRISPR gRNA sequence
  source 1..20: mol_type = other DNA
ggggtgttgtttaatgggga

SEQ ID NO: 61282 - DNA, 20 bp, synthetic construct
  misc_feature 1..20: note = CRISPR gRNA sequence
  source 1..20: mol_type = other DNA
ttgtttaatggggatagaga

SEQ ID NO: 61283 - DNA, 20 bp, synthetic construct
  misc_feature 1..20: note = CRISPR gRNA sequence
  source 1..20: mol_type = other DNA
ttgcaagaggaaaagagttc

SEQ ID NO: 61284 - DNA, 20 bp, synthetic construct
  misc_feature 1..20: note = CRISPR gRNA sequence
  source 1..20: mol_type = other DNA
ctcctgaatggtacacttag

SEQ ID NO: 61285 - DNA, 20 bp, synthetic construct
  misc_feature 1..20: note = CRISPR gRNA sequence
  source 1..20: mol_type = other DNA
tgcacagctctgtcggtgac

SEQ ID NO: 61286 - DNA, 20 bp, synthetic construct
  misc_feature 1..20: note = CRISPR gRNA sequence
  source 1..20: mol_type = other DNA
tggagccttttgatctaacg

SEQ ID NO: 61287 - DNA, 20 bp, synthetic construct
  misc_feature 1..20: note = CRISPR gRNA sequence
  source 1..20: mol_type = other DNA
cagtctgcagtacacacagt

SEQ ID NO: 61288 - DNA, 20 bp, synthetic construct
  misc_feature 1..20: note = CRISPR gRNA sequence
  source 1..20: mol_type = other DNA
ctgggggacaatggggacat

SEQ ID NO: 61289 - DNA, 20 bp, synthetic construct
  misc_feature 1..20: note = CRISPR gRNA sequence
  source 1..20: mol_type = other DNA
cgacactaaggaatcgctaa

SEQ ID NO: 61290 - DNA, 20 bp, synthetic construct
  misc_feature 1..20: note = CRISPR gRNA sequence
  source 1..20: mol_type = other DNA
tcttaggtgtcctgatggaa

SEQ ID NO: 61291 - DNA, 20 bp, synthetic construct
  misc_feature 1..20: note = CRISPR gRNA sequence
  source 1..20: mol_type = other DNA
aaaaaaatgtccttattttt

SEQ ID NO: 61292 - DNA, 20 bp, synthetic construct
  misc_feature 1..20: note = CRISPR gRNA sequence
  source 1..20: mol_type = other DNA
acggtgaaatatttaggagt

SEQ ID NO: 61293 - DNA, 20 bp, synthetic construct
  misc_feature 1..20: note = CRISPR gRNA sequence
  source 1..20: mol_type = other DNA
gaggtctataacttacttga

SEQ ID NO: 61294 - DNA, 20 bp, synthetic construct
  misc_feature 1..20: note = CRISPR gRNA sequence
  source 1..20: mol_type = other DNA
caaacctaggttctgggaat

SEQ ID NO: 61295 - DNA, 20 bp, synthetic construct
  misc_feature 1..20: note = CRISPR gRNA sequence
  source 1..20: mol_type = other DNA
cttcggtatcttctttttct

SEQ ID NO: 61296 - DNA, 20 bp, synthetic construct
  misc_feature 1..20: note = CRISPR gRNA sequence
  source 1..20: mol_type = other DNA
agtgaacagacagacaagaa

SEQ ID NO: 61297 - DNA, 20 bp, synthetic construct
  misc_feature 1..20: note = CRISPR gRNA sequence
  source 1..20: mol_type = other DNA
cagacagacaagaacttcgt

SEQ ID NO: 61298 - DNA, 20 bp, synthetic construct
  misc_feature 1..20: note = CRISPR gRNA sequence
  source 1..20: mol_type = other DNA
aggcctccagtgtggggaag

SEQ ID NO: 61299 - DNA, 20 bp, synthetic construct
  misc_feature 1..20: note = CRISPR gRNA sequence
  source 1..20: mol_type = other DNA
gagtctctgggacagatgga

SEQ ID NO: 61300 - DNA, 20 bp, synthetic construct
  misc_feature 1..20: note = CRISPR gRNA sequence
  source 1..20: mol_type = other DNA
ccaagctcaggaggatggcc

SEQ ID NO: 61301 - DNA, 20 bp, synthetic construct
  misc_feature 1..20: note = CRISPR gRNA sequence
  source 1..20: mol_type = other DNA
gaggcctgtgggcactgctg

SEQ ID NO: 61302 - DNA, 20 bp, synthetic construct
  misc_feature 1..20: note = CRISPR gRNA sequence
  source 1..20: mol_type = other DNA
aaatatgcagctcctgctct

SEQ ID NO: 61303 - DNA, 20 bp, synthetic construct
  misc_feature 1..20: note = CRISPR gRNA sequence
  source 1..20: mol_type = other DNA
gataagaaagaagggcagaa

SEQ ID NO: 61304 - DNA, 20 bp, synthetic construct
  misc_feature 1..20: note = CRISPR gRNA sequence
  source 1..20: mol_type = other DNA
ccctggggagggaggtgtgc

SEQ ID NO: 61305 - DNA, 20 bp, synthetic construct
  misc_feature 1..20: note = CRISPR gRNA sequence
  source 1..20: mol_type = other DNA
gggatacttccaggaggggc

SEQ ID NO: 61306 - DNA, 20 bp, synthetic construct
  misc_feature 1..20: note = CRISPR gRNA sequence
  source 1..20: mol_type = other DNA
tgatgtttgagctgggtgtt

SEQ ID NO: 61307 - DNA, 20 bp, synthetic construct
  misc_feature 1..20: note = CRISPR gRNA sequence
  source 1..20: mol_type = other DNA
agaggcagagaatcttcagg

SEQ ID NO: 61308 - DNA, 20 bp, synthetic construct
  misc_feature 1..20: note = CRISPR gRNA sequence
  source 1..20: mol_type = other DNA
atgtgccaggtatgtatgtg

SEQ ID NO: 61309 - DNA, 20 bp, synthetic construct
  misc_feature 1..20: note = CRISPR gRNA sequence
  source 1..20: mol_type = other DNA
gccaggtatgtatgtggggg

SEQ ID NO: 61310 - DNA, 20 bp, synthetic construct
  misc_feature 1..20: note = CRISPR gRNA sequence
  source 1..20: mol_type = other DNA
tggtatgtgtatggtatgtg

SEQ ID NO: 61311 - DNA, 20 bp, synthetic construct
  misc_feature 1..20: note = CRISPR gRNA sequence
  source 1..20: mol_type = other DNA
tgtgtgctgcgtgctgtgtg

SEQ ID NO: 61312 - DNA, 20 bp, synthetic construct
  misc_feature 1..20: note = CRISPR gRNA sequence
  source 1..20: mol_type = other DNA
gtgctgtgtggtgtgtttgg

SEQ ID NO: 61313 - DNA, 20 bp, synthetic construct
  misc_feature 1..20: note = CRISPR gRNA sequence
  source 1..20: mol_type = other DNA
aggcctgataagatgcaggg

SEQ ID NO: 61314 - DNA, 20 bp, synthetic construct
  misc_feature 1..20: note = CRISPR gRNA sequence
  source 1..20: mol_type = other DNA
atagctggtaagtggcagat

SEQ ID NO: 61315 - DNA, 20 bp, synthetic construct
  misc_feature 1..20: note = CRISPR gRNA sequence
  source 1..20: mol_type = other DNA
agatcagggatttattttca

SEQ ID NO: 61316 - DNA, 20 bp, synthetic construct
  misc_feature 1..20: note = CRISPR gRNA sequence
  source 1..20: mol_type = other DNA
gaagagaatgttgggctgag

SEQ ID NO: 61317 - DNA, 20 bp, synthetic construct
  misc_feature 1..20: note = CRISPR gRNA sequence
  source 1..20: mol_type = other DNA
tggaggaacagacccaggca

SEQ ID NO: 61318 - DNA, 20 bp, synthetic construct
  misc_feature 1..20: note = CRISPR gRNA sequence
  source 1..20: mol_type = other DNA
tcccctgtcccatcaccctg

SEQ ID NO: 61319 - DNA, 20 bp, synthetic construct
  misc_feature 1..20: note = CRISPR gRNA sequence
  source 1..20: mol_type = other DNA
gaagcacggtgcccagacat

SEQ ID NO: 61320 - DNA, 20 bp, synthetic construct
  misc_feature 1..20: note = CRISPR gRNA sequence
  source 1..20: mol_type = other DNA
gatcccatgcccaggaaacc

SEQ ID NO: 61321 - DNA, 20 bp, synthetic construct
  misc_feature 1..20: note = CRISPR gRNA sequence
  source 1..20: mol_type = other DNA
aaggccacaaagtgtgggtg

SEQ ID NO: 61322 - DNA, 20 bp, synthetic construct
  misc_feature 1..20: note = CRISPR gRNA sequence
  source 1..20: mol_type = other DNA
gcacctgttggccagcagaa

SEQ ID NO: 61323 - DNA, 20 bp, synthetic construct
  misc_feature 1..20: note = CRISPR gRNA sequence
  source 1..20: mol_type = other DNA
acatctccacatttatgttc

SEQ ID NO: 61324 - DNA, 20 bp, synthetic construct
  misc_feature 1..20: note = CRISPR gRNA sequence
  source 1..20: mol_type = other DNA
tcagctggttggggatggaa

SEQ ID NO: 61325 - DNA, 20 bp, synthetic construct
  misc_feature 1..20: note = CRISPR gRNA sequence
  source 1..20: mol_type = other DNA
tgttgcttccctgtccccag

SEQ ID NO: 61326 - DNA, 20 bp, synthetic construct
  misc_feature 1..20: note = CRISPR gRNA sequence
  source 1..20: mol_type = other DNA
cacgaatcacagcctctctt

SEQ ID NO: 61327 - DNA, 20 bp, synthetic construct
  misc_feature 1..20: note = CRISPR gRNA sequence
  source 1..20: mol_type = other DNA
gccctcagaaggagccccca

SEQ ID NO: 61328 - DNA, 20 bp, synthetic construct
  misc_feature 1..20: note = CRISPR gRNA sequence
  source 1..20: mol_type = other DNA
tccttgctatctgtccttta

SEQ ID NO: 61329 - DNA, 20 bp, synthetic construct
  misc_feature 1..20: note = CRISPR gRNA sequence
  source 1..20: mol_type = other DNA
tctgagtccgctgtcgccca

SEQ ID NO: 61330 - DNA, 20 bp, synthetic construct
  misc_feature 1..20: note = CRISPR gRNA sequence
  source 1..20: mol_type = other DNA
tcatagctcaggtgcctcca

SEQ ID NO: 61331 - DNA, 20 bp, synthetic construct
  misc_feature 1..20: note = CRISPR gRNA sequence
  source 1..20: mol_type = other DNA
ggccggcatcatttgggatc

SEQ ID NO: 61332 - DNA, 20 bp, synthetic construct
  misc_feature 1..20: note = CRISPR gRNA sequence
  source 1..20: mol_type = other DNA
agaggaaattcaggaaaaaa

SEQ ID NO: 61333 - DNA, 20 bp, synthetic construct
  misc_feature 1..20: note = CRISPR gRNA sequence
  source 1..20: mol_type = other DNA
tttgcaggatgcattaaacc

SEQ ID NO: 61334 - DNA, 20 bp, synthetic construct
  misc_feature 1..20: note = CRISPR gRNA sequence
  source 1..20: mol_type = other DNA
tcaatattggaaacctcacc

SEQ ID NO: 61335 - DNA, 20 bp, synthetic construct
  misc_feature 1..20: note = CRISPR gRNA sequence
  source 1..20: mol_type = other DNA
ttcccttcattgcagcattc

SEQ ID NO: 61336 - DNA, 20 bp, synthetic construct
  misc_feature 1..20: note = CRISPR gRNA sequence
  source 1..20: mol_type = other DNA
gacctctgtctcccaggttc

SEQ ID NO: 61337 - DNA, 20 bp, synthetic construct
  misc_feature 1..20: note = CRISPR gRNA sequence
  source 1..20: mol_type = other DNA
tgcctcagcctcccaagtag

SEQ ID NO: 61338 - DNA, 20 bp, synthetic construct
  misc_feature 1..20: note = CRISPR gRNA sequence
  source 1..20: mol_type = other DNA
tttttgtatttttagtagag

SEQ ID NO: 61339 - DNA, 20 bp, synthetic construct
  misc_feature 1..20: note = CRISPR gRNA sequence
  source 1..20: mol_type = other DNA
ctcctgacctcaggtgatcc

SEQ ID NO: 61340 - DNA, 20 bp, synthetic construct
  misc_feature 1..20: note = CRISPR gRNA sequence
  source 1..20: mol_type = other DNA
cgctttggcctcccaaagtg

SEQ ID NO: 61341 - DNA, 20 bp, synthetic construct
  misc_feature 1..20: note = CRISPR gRNA sequence
  source 1..20: mol_type = other DNA
ggcgtgagccaccacgccca

SEQ ID NO: 61342 - DNA, 20 bp, synthetic construct
  misc_feature 1..20: note = CRISPR gRNA sequence
  source 1..20: mol_type = other DNA
cacgcccagctagttttaac

SEQ ID NO: 61343 - DNA, 20 bp, synthetic construct
  misc_feature 1..20: note = CRISPR gRNA sequence
  source 1..20: mol_type = other DNA
taaccagtgtgtcccggaac

SEQ ID NO: 61344 - DNA, 20 bp, synthetic construct
  misc_feature 1..20: note = CRISPR gRNA sequence
  source 1..20: mol_type = other DNA
tcctaggtctgtgacatttt

SEQ ID NO: 61345 - DNA, 20 bp, synthetic construct
  misc_feature 1..20: note = CRISPR gRNA sequence
  source 1..20: mol_type = other DNA
ttgggaggctgaggcaggag

SEQ ID NO: 61346 - DNA, 20 bp, synthetic construct
  misc_feature 1..20: note = CRISPR gRNA sequence
  source 1..20: mol_type = other DNA
aagacatatttcttattcat

SEQ ID NO: 61347 - DNA, 20 bp, synthetic construct
  misc_feature 1..20: note = CRISPR gRNA sequence
  source 1..20: mol_type = other DNA
gctgaggatcacctgagctc

SEQ ID NO: 61348 - DNA, 20 bp, synthetic construct
  misc_feature 1..20: note = CRISPR gRNA sequence
  source 1..20: mol_type = other DNA
tccagaggctgaggtgggag

SEQ ID NO: 61349 - DNA, 20 bp, synthetic construct
  misc_feature 1..20: note = CRISPR gRNA sequence
  source 1..20: mol_type = other DNA
gtcttaaaaaaaaaagaaat

SEQ ID NO: 61350 - DNA, 20 bp, synthetic construct
  misc_feature 1..20: note = CRISPR gRNA sequence
  source 1..20: mol_type = other DNA
ctatttcccactggtcctag

SEQ ID NO: 61351 - DNA, 20 bp, synthetic construct
  misc_feature 1..20: note = CRISPR gRNA sequence
  source 1..20: mol_type = other DNA
tgctgggccaacaatgaatc

SEQ ID NO: 61352 - DNA, 20 bp, synthetic construct
  misc_feature 1..20: note = CRISPR gRNA sequence
  source 1..20: mol_type = other DNA
ttttagcccccatctgccag

SEQ ID NO: 61353 - DNA, 20 bp, synthetic construct
  misc_feature 1..20: note = CRISPR gRNA sequence
  source 1..20: mol_type = other DNA
agtgggggcgggagagagaa

SEQ ID NO: 61354 - DNA, 20 bp, synthetic construct
  misc_feature 1..20: note = CRISPR gRNA sequence
  source 1..20: mol_type = other DNA
gagagagaaaattgattcag

SEQ ID NO: 61355 - DNA, 20 bp, synthetic construct
  misc_feature 1..20: note = CRISPR gRNA sequence
  source 1..20: mol_type = other DNA
aaggggacaagcaggggatg

SEQ ID NO: 61356 - DNA, 20 bp, synthetic construct
  misc_feature 1..20: note = CRISPR gRNA sequence
  source 1..20: mol_type = other DNA
ggctccaggtgggtctccac

SEQ ID NO: 61357 - DNA, 20 bp, synthetic construct
  misc_feature 1..20: note = CRISPR gRNA sequence
  source 1..20: mol_type = other DNA
acagtagatcccacccggac

SEQ ID NO: 61358 - DNA, 20 bp, synthetic construct
  misc_feature 1..20: note = CRISPR gRNA sequence
  source 1..20: mol_type = other DNA
tctgcagggttgttccaggg

SEQ ID NO: 61359 - DNA, 20 bp, synthetic construct
  misc_feature 1..20: note = CRISPR gRNA sequence
  source 1..20: mol_type = other DNA
gctgcctaggcatggttcaa

SEQ ID NO: 61360 - DNA, 20 bp, synthetic construct
  misc_feature 1..20: note = CRISPR gRNA sequence
  source 1..20: mol_type = other DNA
cacctttttaacccgtggac

SEQ ID NO: 61361 - DNA, 20 bp, synthetic construct
  misc_feature 1..20: note = CRISPR gRNA sequence
  source 1..20: mol_type = other DNA
taaggtgttggccagcagga

SEQ ID NO: 61362 - DNA, 20 bp, synthetic construct
  misc_feature 1..20: note = CRISPR gRNA sequence
  source 1..20: mol_type = other DNA
acaaatagggctgagggaca

SEQ ID NO: 61363 - DNA, 20 bp, synthetic construct
  misc_feature 1..20: note = CRISPR gRNA sequence
  source 1..20: mol_type = other DNA
agggctgagggacaggcaga

SEQ ID NO: 61364 - DNA, 20 bp, synthetic construct
  misc_feature 1..20: note = CRISPR gRNA sequence
  source 1..20: mol_type = other DNA
gatttggatttgagtcccag

SEQ ID NO: 61365 - DNA, 20 bp, synthetic construct
  misc_feature 1..20: note = CRISPR gRNA sequence
  source 1..20: mol_type = other DNA
ggagaagtgacttcacctct

SEQ ID NO: 61366 - DNA, 20 bp, synthetic construct
  misc_feature 1..20: note = CRISPR gRNA sequence
  source 1..20: mol_type = other DNA
gtgacttcacctctctgagc

SEQ ID NO: 61367 - DNA, 20 bp, synthetic construct
  misc_feature 1..20: note = CRISPR gRNA sequence
  source 1..20: mol_type = other DNA
tgtatgactctcgaggtata

SEQ ID NO: 61368 - DNA, 20 bp, synthetic construct
  misc_feature 1..20: note = CRISPR gRNA sequence
  source 1..20: mol_type = other DNA
tgcactgccgggcatgggac

SEQ ID NO: 61369 - DNA, 20 bp, synthetic construct
  misc_feature 1..20: note = CRISPR gRNA sequence
  source 1..20: mol_type = other DNA
gtgcttgctgttattattac

SEQ ID NO: 61370 - DNA, 20 bp, synthetic construct
  misc_feature 1..20: note = CRISPR gRNA sequence
  source 1..20: mol_type = other DNA
ctattgtttttacctgcaag

SEQ ID NO: 61371 - DNA, 20 bp, synthetic construct
  misc_feature 1..20: note = CRISPR gRNA sequence
  source 1..20: mol_type = other DNA
gtccttgctcacagagagtg

SEQ ID NO: 61372 - DNA, 20 bp, synthetic construct
  misc_feature 1..20: note = CRISPR gRNA sequence
  source 1..20: mol_type = other DNA
gaagcttcaggcccttcaga

SEQ ID NO: 61373 - DNA, 20 bp, synthetic construct
  misc_feature 1..20: note = CRISPR gRNA sequence
  source 1..20: mol_type = other DNA
cctcatccagtaatccccct

SEQ ID NO: 61374 - DNA, 20 bp, synthetic construct
  misc_feature 1..20: note = CRISPR gRNA sequence
  source 1..20: mol_type = other DNA
cgggcggatcacttgaggtc

SEQ ID NO: 61375 - DNA, 20 bp, synthetic construct
  misc_feature 1..20: note = CRISPR gRNA sequence
  source 1..20: mol_type = other DNA
gaggcggaggttgcagtgag

SEQ ID NO: 61376 - DNA, 20 bp, synthetic construct
  misc_feature 1..20: note = CRISPR gRNA sequence
  source 1..20: mol_type = other DNA
cgcgctgttcctggagccca

SEQ ID NO: 61377 - DNA, 20 bp, synthetic construct
  misc_feature 1..20: note = CRISPR gRNA sequence
  source 1..20: mol_type = other DNA
cctcctcagagatgttccct

SEQ ID NO: 61378 - DNA, 20 bp, synthetic construct
  misc_feature 1..20: note = CRISPR gRNA sequence
  source 1..20: mol_type = other DNA
tcactggctaagttcatctt

SEQ ID NO: 61379 - DNA, 20 bp, synthetic construct
  misc_feature 1..20: note = CRISPR gRNA sequence
  source 1..20: mol_type = other DNA
gcactacacgttgagtacta

SEQ ID NO: 61380 - DNA, 20 bp, synthetic construct
  misc_feature 1..20: note = CRISPR gRNA sequence
  source 1..20: mol_type = other DNA
gaggagtcaggggtgaagct

SEQ ID NO: 61381 - DNA, 20 bp, synthetic construct
  misc_feature 1..20: note = CRISPR gRNA sequence
  source 1..20: mol_type = other DNA
agagaagttcctctccggtc

SEQ ID NO: 61382 - DNA, 20 bp, synthetic construct
  misc_feature 1..20: note = CRISPR gRNA sequence
  source 1..20: mol_type = other DNA
ttgcaccgatgttattaaca

SEQ ID NO: 61383 - DNA, 20 bp, synthetic construct
  misc_feature 1..20: note = CRISPR gRNA sequence
  source 1..20: mol_type = other DNA
tattttttcatcttagctgc

SEQ ID NO: 61384 - DNA, 20 bp, synthetic construct
  misc_feature 1..20: note = CRISPR gRNA sequence
  source 1..20: mol_type = other DNA
cccgcctcccaccactagaa

SEQ ID NO: 61385 - DNA, 20 bp, synthetic construct
  misc_feature 1..20: note = CRISPR gRNA sequence
  source 1..20: mol_type = other DNA
ttctttttttttttctgaga

SEQ ID NO: 61386 - DNA, 20 bp, synthetic construct
  misc_feature 1..20: note = CRISPR gRNA sequence
  source 1..20: mol_type = other DNA
ttttgtatttttagtagaga

SEQ ID NO: 61387 - DNA, 20 bp, synthetic construct
  misc_feature 1..20: note = CRISPR gRNA sequence
  source 1..20: mol_type = other DNA
cgcctcggcctcccaaagtg

SEQ ID NO: 61388 - DNA, 20 bp, synthetic construct
  misc_feature 1..20: note = CRISPR gRNA sequence
  source 1..20: mol_type = other DNA
agtctgagctgaaattagaa

SEQ ID NO: 61389 - DNA, 20 bp, synthetic construct
  misc_feature 1..20: note = CRISPR gRNA sequence
  source 1..20: mol_type = other DNA
gttttaatactttgggggaa

SEQ ID NO: 61390 - DNA, 20 bp, synthetic construct
  misc_feature 1..20: note = CRISPR gRNA sequence
  source 1..20: mol_type = other DNA
tctgcttaaattcccttttt

SEQ ID NO: 61391 - DNA, 20 bp, synthetic construct
  misc_feature 1..20: note = CRISPR gRNA sequence
  source 1..20: mol_type = other DNA
cacagatcttccatttctta

SEQ ID NO: 61392 - DNA, 20 bp, synthetic construct
  misc_feature 1..20: note = CRISPR gRNA sequence
  source 1..20: mol_type = other DNA
agtattagggtggagctgga

SEQ ID NO: 61393 - DNA, 20 bp, synthetic construct
  misc_feature 1..20: note = CRISPR gRNA sequence
  source 1..20: mol_type = other DNA
ttgaggggttagagggcagg

SEQ ID NO: 61394 - DNA, 20 bp, synthetic construct
  misc_feature 1..20: note = CRISPR gRNA sequence
  source 1..20: mol_type = other DNA
tggaagaagaggaaggtctt

SEQ ID NO: 61395 - DNA, 20 bp, synthetic construct
  misc_feature 1..20: note = CRISPR gRNA sequence
  source 1..20: mol_type = other DNA
tacggggttaagccaaatta

SEQ ID NO: 61396 - DNA, 20 bp, synthetic construct
  misc_feature 1..20: note = CRISPR gRNA sequence
  source 1..20: mol_type = other DNA
ggttaagccaaattaaatgg

SEQ ID NO: 61397 - DNA, 20 bp, synthetic construct
  misc_feature 1..20: note = CRISPR gRNA sequence
  source 1..20: mol_type = other DNA
ttaaatggttttgtttgctg

SEQ ID NO: 61398 - DNA, 20 bp, synthetic construct
  misc_feature 1..20: note = CRISPR gRNA sequence
  source 1..20: mol_type = other DNA
gaaggttagtgttccgcaaa

SEQ ID NO: 61399 - DNA, 20 bp, synthetic construct
  misc_feature 1..20: note = CRISPR gRNA sequence
  source 1..20: mol_type = other DNA
ggtcagcgaaggagacaggg

SEQ ID NO: 61400 - DNA, 20 bp, synthetic construct
  misc_feature 1..20: note = CRISPR gRNA sequence
  source 1..20: mol_type = other DNA
actcaagacactgagttccc

SEQ ID NO: 61401 - DNA, 20 bp, synthetic construct
  misc_feature 1..20: note = CRISPR gRNA sequence
  source 1..20: mol_type = other DNA
ccaagggcctggcccatctc

SEQ ID NO: 61402 - DNA, 20 bp, synthetic construct
  misc_feature 1..20: note = CRISPR gRNA sequence
  source 1..20: mol_type = other DNA
tctctgctgctttctcctct

SEQ ID NO: 61403 - DNA, 20 bp, synthetic construct
  misc_feature 1..20: note = CRISPR gRNA sequence
  source 1..20: mol_type = other DNA
tgggctctggttggcaaagg

SEQ ID NO: 61404 - DNA, 20 bp, synthetic construct
  misc_feature 1..20: note = CRISPR gRNA sequence
  source 1..20: mol_type = other DNA
acacaggcaaagtagacctg

SEQ ID NO: 61405 - DNA, 20 bp, synthetic construct
  misc_feature 1..20: note = CRISPR gRNA sequence
  source 1..20: mol_type = other DNA
gagccccacaatctatcttc

SEQ ID NO: 61406 - DNA, 20 bp, synthetic construct
  misc_feature 1..20: note = CRISPR gRNA sequence
  source 1..20: mol_type = other DNA
acagtactctacagttgaca

SEQ ID NO: 61407 - DNA, 20 bp, synthetic construct
  misc_feature 1..20: note = CRISPR gRNA sequence
  source 1..20: mol_type = other DNA
cagaccgcccagtgctgcca

SEQ ID NO: 61408 - DNA, 20 bp, synthetic construct
  misc_feature 1..20: note = CRISPR gRNA sequence
  source 1..20: mol_type = other DNA
cctgcctgcctccagagtag

SEQ ID NO: 61409 - DNA, 20 bp, synthetic construct
  misc_feature 1..20: note = CRISPR gRNA sequence
  source 1..20: mol_type = other DNA
ttttgtatttttagtagaga

SEQ ID NO: 61410 - DNA, 20 bp, synthetic construct
  misc_feature 1..20: note = CRISPR gRNA sequence
  source 1..20: mol_type = other DNA
cacctcggcctcccaaagtg

SEQ ID NO: 61411 - DNA, 20 bp, synthetic construct
  misc_feature 1..20: note = CRISPR gRNA sequence
  source 1..20: mol_type = other DNA
gtcaccgtgccgggccgcca

SEQ ID NO: 61412 - DNA, 20 bp, synthetic construct
  misc_feature 1..20: note = CRISPR gRNA sequence
  source 1..20: mol_type = other DNA
ccgccagtgggctttttata

SEQ ID NO: 61413 - DNA, 20 bp, synthetic construct
  misc_feature 1..20: note = CRISPR gRNA sequence
  source 1..20: mol_type = other DNA
ttatattaagcttcctctgc

SEQ ID NO: 61414 - DNA, 20 bp, synthetic construct
  misc_feature 1..20: note = CRISPR gRNA sequence
  source 1..20: mol_type = other DNA
ttaacagtcaaatcacgtaa

SEQ ID NO: 61415 - DNA, 20 bp, synthetic construct
  misc_feature 1..20: note = CRISPR gRNA sequence
  source 1..20: mol_type = other DNA
aacaaaacacaacacctaga

SEQ ID NO: 61416 - DNA, 20 bp, synthetic construct
  misc_feature 1..20: note = CRISPR gRNA sequence
  source 1..20: mol_type = other DNA
aacacaacacctagaagcag

SEQ ID NO: 61417 - DNA, 20 bp, synthetic construct
  misc_feature 1..20: note = CRISPR gRNA sequence
  source 1..20: mol_type = other DNA
gcctgctgcatgcagcctag

SEQ ID NO: 61418 - DNA, 20 bp, synthetic construct
  misc_feature 1..20: note = CRISPR gRNA sequence
  source 1..20: mol_type = other DNA
gtaaactttcttaaaacact

SEQ ID NO: 61419 - DNA, 20 bp, synthetic construct
  misc_feature 1..20: note = CRISPR gRNA sequence
  source 1..20: mol_type = other DNA
aacactatgagatttttctt

SEQ ID NO: 61420 - DNA, 20 bp, synthetic construct
  misc_feature 1..20: note = CRISPR gRNA sequence
  source 1..20: mol_type = other DNA
tatgagatttttctttggag

SEQ ID NO: 61421 - DNA, 20 bp, synthetic construct
  misc_feature 1..20: note = CRISPR gRNA sequence
  source 1..20: mol_type = other DNA
caatgtggcccagggaagcc

SEQ ID NO: 61422 - DNA, 20 bp, synthetic construct
  misc_feature 1..20: note = CRISPR gRNA sequence
  source 1..20: mol_type = other DNA
tcaggaggctgaggcaggag

SEQ ID NO: 61423 - DNA, 20 bp, synthetic construct
  misc_feature 1..20: note = CRISPR gRNA sequence
  source 1..20: mol_type = other DNA
aaaaatagtgtaggtctgat

SEQ ID NO: 61424 - DNA, 20 bp, synthetic construct
  misc_feature 1..20: note = CRISPR gRNA sequence
  source 1..20: mol_type = other DNA
ctgataatggttttgtggtt

SEQ ID NO: 61425 - DNA, 20 bp, synthetic construct
  misc_feature 1..20: note = CRISPR gRNA sequence
  source 1..20: mol_type = other DNA
gccacactccagggggtcaa

SEQ ID NO: 61426 - DNA, 20 bp, synthetic construct
  misc_feature 1..20: note = CRISPR gRNA sequence
  source 1..20: mol_type = other DNA
atgaaaacacagtgcatgaa

SEQ ID NO: 61427 - DNA, 20 bp, synthetic construct
  misc_feature 1..20: note = CRISPR gRNA sequence
  source 1..20: mol_type = other DNA
gtcctgtggacacatgacaa

SEQ ID NO: 61428 - DNA, 20 bp, synthetic construct
  misc_feature 1..20: note = CRISPR gRNA sequence
  source 1..20: mol_type = other DNA
atggatttgatgagagaaga

SEQ ID NO: 61429 - DNA, 20 bp, synthetic construct
  misc_feature 1..20: note = CRISPR gRNA sequence
  source 1..20: mol_type = other DNA
gaagaggttgtttaggtgag

SEQ ID NO: 61430 - DNA, 20 bp, synthetic construct
  misc_feature 1..20: note = CRISPR gRNA sequence
  source 1..20: mol_type = other DNA
ttaggtgaggcaggttttgt

SEQ ID NO: 61431 - DNA, 20 bp, synthetic construct
  misc_feature 1..20: note = CRISPR gRNA sequence
  source 1..20: mol_type = other DNA
aatcccttttgagccaagag

SEQ ID NO: 61432 - DNA, 20 bp, synthetic construct
  misc_feature 1..20: note = CRISPR gRNA sequence
  source 1..20: mol_type = other DNA
agagtgggggtgccttgagg

SEQ ID NO: 61433 - DNA, 20 bp, synthetic construct
  misc_feature 1..20: note = CRISPR gRNA sequence
  source 1..20: mol_type = other DNA
gttgagtggatggtgcaggt

SEQ ID NO: 61434 - DNA, 20 bp, synthetic construct
  misc_feature 1..20: note = CRISPR gRNA sequence
  source 1..20: mol_type = other DNA
tgggggctgccgagagacag

SEQ ID NO: 61435 - DNA, 20 bp, synthetic construct
  misc_feature 1..20: note = CRISPR gRNA sequence
  source 1..20: mol_type = other DNA
cagagtggcacagaggcggg

SEQ ID NO: 61436 - DNA, 20 bp, synthetic construct
  misc_feature 1..20: note = CRISPR gRNA sequence
  source 1..20: mol_type = other DNA
ggccccttcccctgtggggc

SEQ ID NO: 61437 - DNA, 20 bp, synthetic construct
  misc_feature 1..20: note = CRISPR gRNA sequence
  source 1..20: mol_type = other DNA
ccttgaccatttaacaccct

SEQ ID NO: 61438 - DNA, 20 bp, synthetic construct
  misc_feature 1..20: note = CRISPR gRNA sequence
  source 1..20: mol_type = other DNA
ggtctcacagcctctcatgg

SEQ ID NO: 61439 - DNA, 20 bp, synthetic construct
  misc_feature 1..20: note = CRISPR gRNA sequence
  source 1..20: mol_type = other DNA
ggcagggagtggctgagctg

SEQ ID NO: 61440 - DNA, 20 bp, synthetic construct
  misc_feature 1..20: note = CRISPR gRNA sequence
  source 1..20: mol_type = other DNA
gggagtggctgagctgctct

SEQ ID NO: 61441 - DNA, 20 bp, synthetic construct
  misc_feature 1..20: note = CRISPR gRNA sequence
  source 1..20: mol_type = other DNA
ccatatacccctaggagggg

SEQ ID NO: 61442 - DNA, 20 bp, synthetic construct
  misc_feature 1..20: note = CRISPR gRNA sequence
  source 1..20: mol_type = other DNA
aagcctgagttagaaaagcc

SEQ ID NO: 61443 - DNA, 20 bp, synthetic construct
  misc_feature 1..20: note = CRISPR gRNA sequence
  source 1..20: mol_type = other DNA
caagacagagcctctctgac

SEQ ID NO: 61444 - DNA, 20 bp, synthetic construct
  misc_feature 1..20: note = CRISPR gRNA sequence
  source 1..20: mol_type = other DNA
atcctgggaagcaagaccac

SEQ ID NO: 61445 - DNA, 20 bp, synthetic construct
  misc_feature 1..20: note = CRISPR gRNA sequence
  source 1..20: mol_type = other DNA
tgaagagctaaactagtatt

SEQ ID NO: 61446 - DNA, 20 bp, synthetic construct
  misc_feature 1..20: note = CRISPR gRNA sequence
  source 1..20: mol_type = other DNA
gtttactgcgaagacgggga

SEQ ID NO: 61447 - DNA, 20 bp, synthetic construct
  misc_feature 1..20: note = CRISPR gRNA sequence
  source 1..20: mol_type = other DNA
ttccaaggggaaaacagggc

SEQ ID NO: 61448 - DNA, 20 bp, synthetic construct
  misc_feature 1..20: note = CRISPR gRNA sequence
  source 1..20: mol_type = other DNA
gggggcggtggttactgaag

SEQ ID NO: 61449 - DNA, 20 bp, synthetic construct
  misc_feature 1..20: note = CRISPR gRNA sequence
  source 1..20: mol_type = other DNA
aacctagtgtgccggacttg

SEQ ID NO: 61450 - DNA, 20 bp, synthetic construct
  misc_feature 1..20: note = CRISPR gRNA sequence
  source 1..20: mol_type = other DNA
accccgagcgttccctcctc

SEQ ID NO: 61451 - DNA, 20 bp, synthetic construct
  misc_feature 1..20: note = CRISPR gRNA sequence
  source 1..20: mol_type = other DNA
gtcccctctcaggaggatgt

SEQ ID NO: 61452 - DNA, 20 bp, synthetic construct
  misc_feature 1..20: note = CRISPR gRNA sequence
  source 1..20: mol_type = other DNA
gctggaagcagagaggaagc

SEQ ID NO: 61453 - DNA, 20 bp, synthetic construct
  misc_feature 1..20: note = CRISPR gRNA sequence
  source 1..20: mol_type = other DNA
ggcaaggagggcctggggtg

SEQ ID NO: 61454 - DNA, 20 bp, synthetic construct
  misc_feature 1..20: note = CRISPR gRNA sequence
  source 1..20: mol_type = other DNA
tgctttcttagcaaacaagg

SEQ ID NO: 61455 - DNA, 20 bp, synthetic construct
  misc_feature 1..20: note = CRISPR gRNA sequence
  source 1..20: mol_type = other DNA
gcacaccatcgacatttctc

SEQ ID NO: 61456 - DNA, 20 bp, synthetic construct
  misc_feature 1..20: note = CRISPR gRNA sequence
  source 1..20: mol_type = other DNA
ggtaagaaattcttctttgt

SEQ ID NO: 61457 - DNA, 20 bp, synthetic construct
  misc_feature 1..20: note = CRISPR gRNA sequence
  source 1..20: mol_type = other DNA
ttttgtattttttgtagaga

SEQ ID NO: 61458 - DNA, 20 bp, synthetic construct
  misc_feature 1..20: note = CRISPR gRNA sequence
  source 1..20: mol_type = other DNA
tcccaagtaggtgcatgcca

SEQ ID NO: 61459 - DNA, 20 bp, synthetic construct
  misc_feature 1..20: note = CRISPR gRNA sequence
  source 1..20: mol_type = other DNA
catcacgcttggctaatttt

SEQ ID NO: 61460 - DNA, 20 bp, synthetic construct
  misc_feature 1..20: note = CRISPR gRNA sequence
  source 1..20: mol_type = other DNA
tgtcttggcctcccaaagtg

SEQ ID NO: 61461 - DNA, 20 bp, synthetic construct
  misc_feature 1..20: note = CRISPR gRNA sequence
  source 1..20: mol_type = other DNA
cctcccaaagtgctgggatt

SEQ ID NO: 61462 - DNA, 20 bp, synthetic construct
  misc_feature 1..20: note = CRISPR gRNA sequence
  source 1..20: mol_type = other DNA
gcggtgccctgagtgcctgg

SEQ ID NO: 61463 - DNA, 20 bp, synthetic construct
  misc_feature 1..20: note = CRISPR gRNA sequence
  source 1..20: mol_type = other DNA
ccagtggcaactaggaagct

SEQ ID NO: 61464 - DNA, 20 bp, synthetic construct
  misc_feature 1..20: note = CRISPR gRNA sequence
  source 1..20: mol_type = other DNA
aaccttcgcctcctgggttc

SEQ ID NO: 61465 - DNA, 20 bp, synthetic construct
  misc_feature 1..20: note = CRISPR gRNA sequence
  source 1..20: mol_type = other DNA
tttggtatttttagcagaga

SEQ ID NO: 61466 - DNA, 20 bp, synthetic construct
  misc_feature 1..20: note = CRISPR gRNA sequence
  source 1..20: mol_type = other DNA
caccttggcctcccaaaatg

SEQ ID NO: 61467 - DNA, 20 bp, synthetic construct
  misc_feature 1..20: note = CRISPR gRNA sequence
  source 1..20: mol_type = other DNA
gtgagccaccgcgcctggcc

SEQ ID NO: 61468 - DNA, 20 bp, synthetic construct
  misc_feature 1..20: note = CRISPR gRNA sequence
  source 1..20: mol_type = other DNA
cggtctgtgatggatctgag

SEQ ID NO: 61469 - DNA, 20 bp, synthetic construct
  misc_feature 1..20: note = CRISPR gRNA sequence
  source 1..20: mol_type = other DNA
agggtctcctgtcaacttgt

SEQ ID NO: 61470 - DNA, 20 bp, synthetic construct
  misc_feature 1..20: note = CRISPR gRNA sequence
  source 1..20: mol_type = other DNA
tgacctctcccctgggctcc

SEQ ID NO: 61471 - DNA, 20 bp, synthetic construct
  misc_feature 1..20: note = CRISPR gRNA sequence
  source 1..20: mol_type = other DNA
cagaagtgcctgggaggagg

SEQ ID NO: 61472 - DNA, 20 bp, synthetic construct
  misc_feature 1..20: note = CRISPR gRNA sequence
  source 1..20: mol_type = other DNA
ggtccattgcaggcaaactt

SEQ ID NO: 61473 - DNA, 20 bp, synthetic construct
  misc_feature 1..20: note = CRISPR gRNA sequence
  source 1..20: mol_type = other DNA
atccttggcagccctgggca

SEQ ID NO: 61474 - DNA, 20 bp, synthetic construct
  misc_feature 1..20: note = CRISPR gRNA sequence
  source 1..20: mol_type = other DNA
agtgaaaccttgaatcagaa

SEQ ID NO: 61475 - DNA, 20 bp, synthetic construct
  misc_feature 1..20: note = CRISPR gRNA sequence
  source 1..20: mol_type = other DNA
aggggcaattttcatgcatt

SEQ ID NO: 61476 - DNA, 20 bp, synthetic construct
  misc_feature 1..20: note = CRISPR gRNA sequence
  source 1..20: mol_type = other DNA
gaggaagagtcacaactttc

SEQ ID NO: 61477 - DNA, 20 bp, synthetic construct
  misc_feature 1..20: note = CRISPR gRNA sequence
  source 1..20: mol_type = other DNA
aactttcaccagattctcca

SEQ ID NO: 61478 - DNA, 20 bp, synthetic construct
  misc_feature 1..20: note = CRISPR gRNA sequence
  source 1..20: mol_type = other DNA
gaggtggaggtgaccgaggt

SEQ ID NO: 61479 - DNA, 20 bp, synthetic construct
  misc_feature 1..20: note = CRISPR gRNA sequence
  source 1..20: mol_type = other DNA
gagccttgcagagctgctct

SEQ ID NO: 61480 - DNA, 20 bp, synthetic construct
  misc_feature 1..20: note = CRISPR gRNA sequence
  source 1..20: mol_type = other DNA
actgaacagaggcgggaagg

SEQ ID NO: 61481 - DNA, 20 bp, synthetic construct
  misc_feature 1..20: note = CRISPR gRNA sequence
  source 1..20: mol_type = other DNA
ccagacacagaggcagagaa

SEQ ID NO: 61482 - DNA, 20 bp, synthetic construct
  misc_feature 1..20: note = CRISPR gRNA sequence
  source 1..20: mol_type = other DNA
gaaacaggcagagggacaga

SEQ ID NO: 61483 - DNA, 20 bp, synthetic construct
  misc_feature 1..20: note = CRISPR gRNA sequence
  source 1..20: mol_type = other DNA
gctaaggggagtggggtctc

SEQ ID NO: 61484 - DNA, 20 bp, synthetic construct
  misc_feature 1..20: note = CRISPR gRNA sequence
  source 1..20: mol_type = other DNA
ggagcatgtggggcctgggc

SEQ ID NO: 61485 - DNA, 20 bp, synthetic construct
  misc_feature 1..20: note = CRISPR gRNA sequence
  source 1..20: mol_type = other DNA
caatcagaccttggtgccaa

SEQ ID NO: 61486 - DNA, 20 bp, synthetic construct
  misc_feature 1..20: note = CRISPR gRNA sequence
  source 1..20: mol_type = other DNA
ggagactgtatgtgaactgc

SEQ ID NO: 61487 - DNA, 20 bp, synthetic construct
  misc_feature 1..20: note = CRISPR gRNA sequence
  source 1..20: mol_type = other DNA
gtatgtgaactgccttagtt

SEQ ID NO: 61488 - DNA, 20 bp, synthetic construct
  misc_feature 1..20: note = CRISPR gRNA sequence
  source 1..20: mol_type = other DNA
aatctcatcctcctcctcat

SEQ ID NO: 61489 - DNA, 20 bp, synthetic construct
  misc_feature 1..20: note = CRISPR gRNA sequence
  source 1..20: mol_type = other DNA
cagtagtccagactctacag

SEQ ID NO: 61490 - DNA, 20 bp, synthetic construct
  misc_feature 1..20: note = CRISPR gRNA sequence
  source 1..20: mol_type = other DNA
gctacaggccaggcaatccc

SEQ ID NO: 61491 - DNA, 20 bp, synthetic construct
  misc_feature 1..20: note = CRISPR gRNA sequence
  source 1..20: mol_type = other DNA
accatgagaggcggaggtgg

SEQ ID NO: 61492 - DNA, 20 bp, synthetic construct
  misc_feature 1..20: note = CRISPR gRNA sequence
  source 1..20: mol_type = other DNA
tcctgggcaaacatgaagat

SEQ ID NO: 61493 - DNA, 20 bp, synthetic construct
  misc_feature 1..20: note = CRISPR gRNA sequence
  source 1..20: mol_type = other DNA
cacttcagcctcctgagtag

SEQ ID NO: 61494 - DNA, 20 bp, synthetic construct
  misc_feature 1..20: note = CRISPR gRNA sequence
  source 1..20: mol_type = other DNA
cctcctgagtagctgggatt

SEQ ID NO: 61495 - DNA, 20 bp, synthetic construct
  misc_feature 1..20: note = CRISPR gRNA sequence
  source 1..20: mol_type = other DNA
ggctcaggtgatcctcccac

SEQ ID NO: 61496 - DNA, 20 bp, synthetic construct
  misc_feature 1..20: note = CRISPR gRNA sequence
  source 1..20: mol_type = other DNA
tgactcccctctgacttcct

SEQ ID NO: 61497 - DNA, 20 bp, synthetic construct
  misc_feature 1..20: note = CRISPR gRNA sequence
  source 1..20: mol_type = other DNA
ctgtctgtgctcaaagtatg

SEQ ID NO: 61498 - DNA, 20 bp, synthetic construct
  misc_feature 1..20: note = CRISPR gRNA sequence
  source 1..20: mol_type = other DNA
ccattttctagtgcaataat

SEQ ID NO: 61499 - DNA, 20 bp, synthetic construct
  misc_feature 1..20: note = CRISPR gRNA sequence
  source 1..20: mol_type = other DNA
ataatttttgttttacaaac

SEQ ID NO: 61500 - DNA, 20 bp, synthetic construct
  misc_feature 1..20: note = CRISPR gRNA sequence
  source 1..20: mol_type = other DNA
ttacaaacatgggattaaac

SEQ ID NO: 61501 - DNA, 20 bp, synthetic construct
  misc_feature 1..20: note = CRISPR gRNA sequence
  source 1..20: mol_type = other DNA
tatagattctctttttaaac

SEQ ID NO: 61502 - DNA, 20 bp, synthetic construct
  misc_feature 1..20: note = CRISPR gRNA sequence
  source 1..20: mol_type = other DNA
acttgatcattattgatggg

SEQ ID NO: 61503 - DNA, 20 bp, synthetic construct
  misc_feature 1..20: note = CRISPR gRNA sequence
  source 1..20: mol_type = other DNA
aacctccgcctcccaggttc

SEQ ID NO: 61504 - DNA, 20 bp, synthetic construct
  misc_feature 1..20: note = CRISPR gRNA sequence
  source 1..20: mol_type = other DNA
ggtgcacgccaccatgccca

SEQ ID NO: 61505 - DNA, 20 bp, synthetic construct
  misc_feature 1..20: note = CRISPR gRNA sequence
  source 1..20: mol_type = other DNA
ttttgtatttttagtagaga

SEQ ID NO: 61506 - DNA, 20 bp, synthetic construct
  misc_feature 1..20: note = CRISPR gRNA sequence
  source 1..20: mol_type = other DNA
tgcctcagcctcccaaagtg

SEQ ID NO: 61507 - DNA, 20 bp, synthetic construct
  misc_feature 1..20: note = CRISPR gRNA sequence
  source 1..20: mol_type = other DNA
gcatgagccacagcacctgg

SEQ ID NO: 61508 - DNA, 20 bp, synthetic construct
  misc_feature 1..20: note = CRISPR gRNA sequence
  source 1..20: mol_type = other DNA
ttctgccattgcatatcttg

SEQ ID NO: 61509 - DNA, 20 bp, synthetic construct
  misc_feature 1..20: note = CRISPR gRNA sequence
  source 1..20: mol_type = other DNA
aagataatgagttaaaattt

SEQ ID NO: 61510 - DNA, 20 bp, synthetic construct
  misc_feature 1..20: note = CRISPR gRNA sequence
  source 1..20: mol_type = other DNA
caggaggatcacatgagctc

SEQ ID NO: 61511 - DNA, 20 bp, synthetic construct
  misc_feature 1..20: note = CRISPR gRNA sequence
  source 1..20: mol_type = other DNA
cactttgggagactaagaga

SEQ ID NO: 61512 - DNA, 20 bp, synthetic construct
  misc_feature 1..20: note = CRISPR gRNA sequence
  source 1..20: mol_type = other DNA
agagagatggattgctgagc

SEQ ID NO: 61513 - DNA, 20 bp, synthetic construct
  misc_feature 1..20: note = CRISPR gRNA sequence
  source 1..20: mol_type = other DNA
gatttggaggttacagtgag

SEQ ID NO: 61514 - DNA, 20 bp, synthetic construct
  misc_feature 1..20: note = CRISPR gRNA sequence
  source 1..20: mol_type = other DNA
ctgtctctaaagaaatttct

SEQ ID NO: 61515 - DNA, 20 bp, synthetic construct
  misc_feature 1..20: note = CRISPR gRNA sequence
  source 1..20: mol_type = other DNA
gtgaacatccctacagctaa

SEQ ID NO: 61516 - DNA, 20 bp, synthetic construct
  misc_feature 1..20: note = CRISPR gRNA sequence
  source 1..20: mol_type = other DNA
gttcctggaagtgaacaggg

SEQ ID NO: 61517 - DNA, 20 bp, synthetic construct
  misc_feature 1..20: note = CRISPR gRNA sequence
  source 1..20: mol_type = other DNA
ctaatctaccttttgggtga

SEQ ID NO: 61518 - DNA, 20 bp, synthetic construct
  misc_feature 1..20: note = CRISPR gRNA sequence
  source 1..20: mol_type = other DNA
tttccctctcctcccttgag

SEQ ID NO: 61519 - DNA, 20 bp, synthetic construct
  misc_feature 1..20: note = CRISPR gRNA sequence
  source 1..20: mol_type = other DNA
ccaccctactgggttgagaa

SEQ ID NO: 61520 - DNA, 20 bp, synthetic construct
  misc_feature 1..20: note = CRISPR gRNA sequence
  source 1..20: mol_type = other DNA
caacggcgagacttacagaa

SEQ ID NO: 61521 - DNA, 20 bp, synthetic construct
  misc_feature 1..20: note = CRISPR gRNA sequence
  source 1..20: mol_type = other DNA
gtccttggcctagtctccca

SEQ ID NO: 61522 - DNA, 20 bp, synthetic construct
  misc_feature 1..20: note = CRISPR gRNA sequence
  source 1..20: mol_type = other DNA
cagggagctttgtcccactg

SEQ ID NO: 61523 - DNA, 20 bp, synthetic construct
  misc_feature 1..20: note = CRISPR gRNA sequence
  source 1..20: mol_type = other DNA
ctgggcccagaaggaattcc

SEQ ID NO: 61524 - DNA, 20 bp, synthetic construct
  misc_feature 1..20: note = CRISPR gRNA sequence
  source 1..20: mol_type = other DNA
ctagcccctccctgtggctc

SEQ ID NO: 61525 - DNA, 20 bp, synthetic construct
  misc_feature 1..20: note = CRISPR gRNA sequence
  source 1..20: mol_type = other DNA
gtcccttgccaggggatctc

SEQ ID NO: 61526 - DNA, 20 bp, synthetic construct
  misc_feature 1..20: note = CRISPR gRNA sequence
  source 1..20: mol_type = other DNA
ccatttggaaaataaagttg

SEQ ID NO: 61527 - DNA, 20 bp, synthetic construct
  misc_feature 1..20: note = CRISPR gRNA sequence
  source 1..20: mol_type = other DNA
ccagcttgacagcaagaact

SEQ ID NO: 61528 - DNA, 20 bp, synthetic construct
  misc_feature 1..20: note = CRISPR gRNA sequence
  source 1..20: mol_type = other DNA
gtgttttcacctctctgacc

SEQ ID NO: 61529 - DNA, 20 bp, synthetic construct
  misc_feature 1..20: note = CRISPR gRNA sequence
  source 1..20: mol_type = other DNA
actataccagactctgtaca

SEQ ID NO: 61530 - DNA, 20 bp, synthetic construct
  misc_feature 1..20: note = CRISPR gRNA sequence
  source 1..20: mol_type = other DNA
tacaaaaggctttgtacata

SEQ ID NO: 61531 - DNA, 20 bp, synthetic construct
  misc_feature 1..20: note = CRISPR gRNA sequence
  source 1..20: mol_type = other DNA
aatgctactaagtgacagag

SEQ ID NO: 61532 - DNA, 20 bp, synthetic construct
  misc_feature 1..20: note = CRISPR gRNA sequence
  source 1..20: mol_type = other DNA
tttacacatgtaagggtgct

SEQ ID NO: 61533 - DNA, 20 bp, synthetic construct
  misc_feature 1..20: note = CRISPR gRNA sequence
  source 1..20: mol_type = other DNA
cagtggatcagcacccttac

SEQ ID NO: 61534 - DNA, 20 bp, synthetic construct
  misc_feature 1..20: note = CRISPR gRNA sequence
  source 1..20: mol_type = other DNA
cggtggggtggacaactcac

SEQ ID NO: 61535 - DNA, 20 bp, synthetic construct
  misc_feature 1..20: note = CRISPR gRNA sequence
  source 1..20: mol_type = other DNA
ggcacttgctcgagggagaa

SEQ ID NO: 61536 - DNA, 20 bp, synthetic construct
  misc_feature 1..20: note = CRISPR gRNA sequence
  source 1..20: mol_type = other DNA
ctttatgctgcaagttacat

SEQ ID NO: 61537 - DNA, 20 bp, synthetic construct
  misc_feature 1..20: note = CRISPR gRNA sequence
  source 1..20: mol_type = other DNA
attgctttttgtgataaact

SEQ ID NO: 61538 - DNA, 20 bp, synthetic construct
  misc_feature 1..20: note = CRISPR gRNA sequence
  source 1..20: mol_type = other DNA
gacctagtctgggagtcggg

SEQ ID NO: 61539 - DNA, 20 bp, synthetic construct
  misc_feature 1..20: note = CRISPR gRNA sequence
  source 1..20: mol_type = other DNA
ggagtcggggatggcttatt

SEQ ID NO: 61540 - DNA, 20 bp, synthetic construct
  misc_feature 1..20: note = CRISPR gRNA sequence
  source 1..20: mol_type = other DNA
cctgaaagagagccagtgtg

SEQ ID NO: 61541 - DNA, 20 bp, synthetic construct
  misc_feature 1..20: note = CRISPR gRNA sequence
  source 1..20: mol_type = other DNA
gagagccagtgtgtctggat

SEQ ID NO: 61542 - DNA, 20 bp, synthetic construct
  misc_feature 1..20: note = CRISPR gRNA sequence
  source 1..20: mol_type = other DNA
agtggaaggatggggtcaga

SEQ ID NO: 61543 - DNA, 20 bp, synthetic construct
  misc_feature 1..20: note = CRISPR gRNA sequence
  source 1..20: mol_type = other DNA
ggcagggttctggaccacct

SEQ ID NO: 61544 - DNA, 20 bp, synthetic construct
  misc_feature 1..20: note = CRISPR gRNA sequence
  source 1..20: mol_type = other DNA
accacctgggagtttagaat

SEQ ID NO: 61545 - DNA, 20 bp, synthetic construct
  misc_feature 1..20: note = CRISPR gRNA sequence
  source 1..20: mol_type = other DNA
agaaaggtggaggaaaagag

SEQ ID NO: 61546 - DNA, 20 bp, synthetic construct
  misc_feature 1..20: note = CRISPR gRNA sequence
  source 1..20: mol_type = other DNA
cgtaaccaggcgggtgatgg

SEQ ID NO: 61547 - DNA, 20 bp, synthetic construct
  misc_feature 1..20: note = CRISPR gRNA sequence
  source 1..20: mol_type = other DNA
ggtgaggcaggtagaagtgt

SEQ ID NO: 61548 - DNA, 20 bp, synthetic construct
  misc_feature 1..20: note = CRISPR gRNA sequence
  source 1..20: mol_type = other DNA
atctgccttcatgttcactt

SEQ ID NO: 61549 - DNA, 20 bp, synthetic construct
  misc_feature 1..20: note = CRISPR gRNA sequence
  source 1..20: mol_type = other DNA
catccccaagcactactctt

SEQ ID NO: 61550 - DNA, 20 bp, synthetic construct
  misc_feature 1..20: note = CRISPR gRNA sequence
  source 1..20: mol_type = other DNA
tggggggagccctgagggac

SEQ ID NO: 61551 - DNA, 20 bp, synthetic construct
  misc_feature 1..20: note = CRISPR gRNA sequence
  source 1..20: mol_type = other DNA
gaaggcagacccaggtgtgg

SEQ ID NO: 61552 - DNA, 20 bp, synthetic construct
  misc_feature 1..20: note = CRISPR gRNA sequence
  source 1..20: mol_type = other DNA
gaggctgcgagccagactgt

SEQ ID NO: 61553 - DNA, 20 bp, synthetic construct
  misc_feature 1..20: note = CRISPR gRNA sequence
  source 1..20: mol_type = other DNA
tcctacctgtgtggccttga

SEQ ID NO: 61554 - DNA, 20 bp, synthetic construct
  misc_feature 1..20: note = CRISPR gRNA sequence
  source 1..20: mol_type = other DNA
cttgagcaagtttatctttc

SEQ ID NO: 61555 - DNA, 20 bp, synthetic construct
  misc_feature 1..20: note = CRISPR gRNA sequence
  source 1..20: mol_type = other DNA
ctataaaatgaggacagtaa

SEQ ID NO: 61556 - DNA, 20 bp, synthetic construct
  misc_feature 1..20: note = CRISPR gRNA sequence
  source 1..20: mol_type = other DNA
tagtagcagctgttacaatg

SEQ ID NO: 61557 - DNA, 20 bp, synthetic construct
  misc_feature 1..20: note = CRISPR gRNA sequence
  source 1..20: mol_type = other DNA
tcctttcctggctcctacgc

SEQ ID NO: 61558 - DNA, 20 bp, synthetic construct
  misc_feature 1..20: note = CRISPR gRNA sequence
  source 1..20: mol_type = other DNA
agcccctactccatggcccc

SEQ ID NO: 61559 - DNA, 20 bp, synthetic construct
  misc_feature 1..20: note = CRISPR gRNA sequence
  source 1..20: mol_type = other DNA
gggacttaacctgtctgaga

SEQ ID NO: 61560 - DNA, 20 bp, synthetic construct
  misc_feature 1..20: note = CRISPR gRNA sequence
  source 1..20: mol_type = other DNA
gaataataatgtgtacttca

SEQ ID NO: 61561 - DNA, 20 bp, synthetic construct
  misc_feature 1..20: note = CRISPR gRNA sequence
  source 1..20: mol_type = other DNA
taatcctttccctgtccctc

SEQ ID NO: 61562 - DNA, 20 bp, synthetic construct
  misc_feature 1..20: note = CRISPR gRNA sequence
  source 1..20: mol_type = other DNA
ccctccaaggtacctgagcg

SEQ ID NO: 61563 - DNA, 20 bp, synthetic construct
  misc_feature 1..20: note = CRISPR gRNA sequence
  source 1..20: mol_type = other DNA
tggtggatcaagcctctttc

SEQ ID NO: 61564 - DNA, 20 bp, synthetic construct
  misc_feature 1..20: note = CRISPR gRNA sequence
  source 1..20: mol_type = other DNA
agtgagtcggtaacaaagga

SEQ ID NO: 61565 - DNA, 20 bp, synthetic construct
  misc_feature 1..20: note = CRISPR gRNA sequence
  source 1..20: mol_type = other DNA
actgcttgcagatgctcaag

SEQ ID NO: 61566 - DNA, 20 bp, synthetic construct
  misc_feature 1..20: note = CRISPR gRNA sequence
  source 1..20: mol_type = other DNA
tcagcagagcaggaggggca

SEQ ID NO: 61567 - DNA, 20 bp, synthetic construct
  misc_feature 1..20: note = CRISPR gRNA sequence
  source 1..20: mol_type = other DNA
catctagcacataggtacct

SEQ ID NO: 61568 - DNA, 20 bp, synthetic construct
  misc_feature 1..20: note = CRISPR gRNA sequence
  source 1..20: mol_type = other DNA
ggaagctaggacatcatgag

SEQ ID NO: 61569 - DNA, 20 bp, synthetic construct
  misc_feature 1..20: note = CRISPR gRNA sequence
  source 1..20: mol_type = other DNA
gagccaggtttcacagactt

SEQ ID NO: 61570 - DNA, 20 bp, synthetic construct
  misc_feature 1..20: note = CRISPR gRNA sequence
  source 1..20: mol_type = other DNA
ggctcaagtgatcctcccac

SEQ ID NO: 61571 - DNA, 20 bp, synthetic construct
  misc_feature 1..20: note = CRISPR gRNA sequence
  source 1..20: mol_type = other DNA
gcccaggctggtcttgaact

SEQ ID NO: 61572 - DNA, 20 bp, synthetic construct
  misc_feature 1..20: note = CRISPR gRNA sequence
  source 1..20: mol_type = other DNA
agacatgagccaccatgcca

SEQ ID NO: 61573 - DNA, 20 bp, synthetic construct
  misc_feature 1..20: note = CRISPR gRNA sequence
  source 1..20: mol_type = other DNA
gtggctatcctactgagcat

SEQ ID NO: 61574 - DNA, 20 bp, synthetic construct
  misc_feature 1..20: note = CRISPR gRNA sequence
  source 1..20: mol_type = other DNA
ggtcttgaacacctggaatc

SEQ ID NO: 61575 - DNA, 20 bp, synthetic construct
  misc_feature 1..20: note = CRISPR gRNA sequence
  source 1..20: mol_type = other DNA
cacctggaatcaagagattc

SEQ ID NO: 61576 - DNA, 20 bp, synthetic construct
  misc_feature 1..20: note = CRISPR gRNA sequence
  source 1..20: mol_type = other DNA
gtgcttggcgttccaaagtg

SEQ ID NO: 61577 - DNA, 20 bp, synthetic construct
  misc_feature 1..20: note = CRISPR gRNA sequence
  source 1..20: mol_type = other DNA
atcgagatccagagaaggga

SEQ ID NO: 61578 - DNA, 20 bp, synthetic construct
  misc_feature 1..20: note = CRISPR gRNA sequence
  source 1..20: mol_type = other DNA
ccctgtcttttttcagttgt

SEQ ID NO: 61579 - DNA, 20 bp, synthetic construct
  misc_feature 1..20: note = CRISPR gRNA sequence
  source 1..20: mol_type = other DNA
ttcagttgtaagggcttttc

SEQ ID NO: 61580 - DNA, 20 bp, synthetic construct
  misc_feature 1..20: note = CRISPR gRNA sequence
  source 1..20: mol_type = other DNA
agtatctttatgttctcccc

SEQ ID NO: 61581 - DNA, 20 bp, synthetic construct
  misc_feature 1..20: note = CRISPR gRNA sequence
  source 1..20: mol_type = other DNA
ccttcctctgagtcttctgg

SEQ ID NO: 61582 - DNA, 20 bp, synthetic construct
  misc_feature 1..20: note = CRISPR gRNA sequence
  source 1..20: mol_type = other DNA
ccctcaactgcctgagccca

SEQ ID NO: 61583 - DNA, 20 bp, synthetic construct
  misc_feature 1..20: note = CRISPR gRNA sequence
  source 1..20: mol_type = other DNA
tggccccaggcccaccgcct

SEQ ID NO: 61584 - DNA, 20 bp, synthetic construct
  misc_feature 1..20: note = CRISPR gRNA sequence
  source 1..20: mol_type = other DNA
atgttcaaacatccagataa

SEQ ID NO: 61585 - DNA, 20 bp, synthetic construct
  misc_feature 1..20: note = CRISPR gRNA sequence
  source 1..20: mol_type = other DNA
aaacataacggaactagcaa

SEQ ID NO: 61586 - DNA, 20 bp, synthetic construct
  misc_feature 1..20: note = CRISPR gRNA sequence
  source 1..20: mol_type = other DNA
tttaaatcaggcatgtgaaa

SEQ ID NO: 61587 - DNA, 20 bp, synthetic construct
  misc_feature 1..20: note = CRISPR gRNA sequence
  source 1..20: mol_type = other DNA
atgtgaaatactgattatgt

SEQ ID NO: 61588 - DNA, 20 bp, synthetic construct
  misc_feature 1..20: note = CRISPR gRNA sequence
  source 1..20: mol_type = other DNA
ttgcttgatgaatcctgcaa

SEQ ID NO: 61589 - DNA, 20 bp, synthetic construct
  misc_feature 1..20: note = CRISPR gRNA sequence
  source 1..20: mol_type = other DNA
taataaaaattaagaatgtt

SEQ ID NO: 61590 - DNA, 20 bp, synthetic construct
  misc_feature 1..20: note = CRISPR gRNA sequence
  source 1..20: mol_type = other DNA
aattattcctttggctatgc

SEQ ID NO: 61591 - DNA, 20 bp, synthetic construct
  misc_feature 1..20: note = CRISPR gRNA sequence
  source 1..20: mol_type = other DNA
gagtaaaacagtagggtatg

SEQ ID NO: 61592 - DNA, 20 bp, synthetic construct
  misc_feature 1..20: note = CRISPR gRNA sequence
  source 1..20: mol_type = other DNA
atgctgttgctgctcaggct

SEQ ID NO: 61593 - DNA, 20 bp, synthetic construct
  misc_feature 1..20: note = CRISPR gRNA sequence
  source 1..20: mol_type = other DNA
gcagtggaaagatcacttac

SEQ ID NO: 61594 - DNA, 20 bp, synthetic construct
  misc_feature 1..20: note = CRISPR gRNA sequence
  source 1..20: mol_type = other DNA
aaagagctgatggcctgctc

SEQ ID NO: 61595 - DNA, 20 bp, synthetic construct
  misc_feature 1..20: note = CRISPR gRNA sequence
  source 1..20: mol_type = other DNA
ggtctattctgttcctatgg

SEQ ID NO: 61596 - DNA, 20 bp, synthetic construct
  misc_feature 1..20: note = CRISPR gRNA sequence
  source 1..20: mol_type = other DNA
gagacctagcaccctgctcc

SEQ ID NO: 61597 - DNA, 20 bp, synthetic construct
  misc_feature 1..20: note = CRISPR gRNA sequence
  source 1..20: mol_type = other DNA
ctagactgggacgctgcaga

SEQ ID NO: 61598 - DNA, 20 bp, synthetic construct
  misc_feature 1..20: note = CRISPR gRNA sequence
  source 1..20: mol_type = other DNA
agatgagttgaggggagtga

SEQ ID NO: 61599 - DNA, 20 bp, synthetic construct
  misc_feature 1..20: note = CRISPR gRNA sequence
  source 1..20: mol_type = other DNA
caagttcagtacttctgaac

SEQ ID NO: 61600 - DNA, 20 bp, synthetic construct
  misc_feature 1..20: note = CRISPR gRNA sequence
  source 1..20: mol_type = other DNA
gcaggagtatatttgtgcat

SEQ ID NO: 61601 - DNA, 20 bp, synthetic construct
  misc_feature 1..20: note = CRISPR gRNA sequence
  source 1..20: mol_type = other DNA
tgaacaaatgtgaaggtgtg

SEQ ID NO: 61602 - DNA, 20 bp, synthetic construct
  misc_feature 1..20: note = CRISPR gRNA sequence
  source 1..20: mol_type = other DNA
tagttatgtgtacccacagt

SEQ ID NO: 61603 - DNA, 20 bp, synthetic construct
  misc_feature 1..20: note = CRISPR gRNA sequence
  source 1..20: mol_type = other DNA
acgcactgctatcccttctc

SEQ ID NO: 61604 - DNA, 20 bp, synthetic construct
  misc_feature 1..20: note = CRISPR gRNA sequence
  source 1..20: mol_type = other DNA
ctctggggactctgggagcc

SEQ ID NO: 61605 - DNA, 20 bp, synthetic construct
  misc_feature 1..20: note = CRISPR gRNA sequence
  source 1..20: mol_type = other DNA
ttcagctgtggacagagagg

SEQ ID NO: 61606 - DNA, 20 bp, synthetic construct
  misc_feature 1..20: note = CRISPR gRNA sequence
  source 1..20: mol_type = other DNA
caggtggctgatgcctcggg

SEQ ID NO: 61607 - DNA, 20 bp, synthetic construct
  misc_feature 1..20: note = CRISPR gRNA sequence
  source 1..20: mol_type = other DNA
gggccaggaatctgccttgt

SEQ ID NO: 61608 - DNA, 20 bp, synthetic construct
  misc_feature 1..20: note = CRISPR gRNA sequence
  source 1..20: mol_type = other DNA
attgtcggcaagctcctgga

SEQ ID NO: 61609 - DNA, 20 bp, synthetic construct
  misc_feature 1..20: note = CRISPR gRNA sequence
  source 1..20: mol_type = other DNA
tcgccatcccctcagagaga

SEQ ID NO: 61610 - DNA, 20 bp, synthetic construct
  misc_feature 1..20: note = CRISPR gRNA sequence
  source 1..20: mol_type = other DNA
aatagagctatcatgaggaa

SEQ ID NO: 61611 - DNA, 20 bp, synthetic construct
  misc_feature 1..20: note = CRISPR gRNA sequence
  source 1..20: mol_type = other DNA
tgtgagtggaagggatgtat

SEQ ID NO: 61612 - DNA, 20 bp, synthetic construct
  misc_feature 1..20: note = CRISPR gRNA sequence
  source 1..20: mol_type = other DNA
gagcacagatatacccatga

SEQ ID NO: 61613 - DNA, 20 bp, synthetic construct
  misc_feature 1..20: note = CRISPR gRNA sequence
  source 1..20: mol_type = other DNA
acgtagctttgactgtgcag

SEQ ID NO: 61614 - DNA, 20 bp, synthetic construct
  misc_feature 1..20: note = CRISPR gRNA sequence
  source 1..20: mol_type = other DNA
taacctactgtatttgggga

SEQ ID NO: 61615 - DNA, 20 bp, synthetic construct
  misc_feature 1..20: note = CRISPR gRNA sequence
  source 1..20: mol_type = other DNA
gtgctaggcactgtgctaca

SEQ ID NO: 61616 - DNA, 20 bp, synthetic construct
  misc_feature 1..20: note = CRISPR gRNA sequence
  source 1..20: mol_type = other DNA
ccatatgagttggctattgt

SEQ ID NO: 61617 - DNA, 20 bp, synthetic construct
  misc_feature 1..20: note = CRISPR gRNA sequence
  source 1..20: mol_type = other DNA
tgagttggctattgttacag

SEQ ID NO: 61618 - DNA, 20 bp, synthetic construct
  misc_feature 1..20: note = CRISPR gRNA sequence
  source 1..20: mol_type = other DNA
ctctatagacagcctggatc

SEQ ID NO: 61619 - DNA, 20 bp, synthetic construct
  misc_feature 1..20: note = CRISPR gRNA sequence
  source 1..20: mol_type = other DNA
cctggatctgtggtttcagc

SEQ ID NO: 61620 - DNA, 20 bp, synthetic construct
  misc_feature 1..20: note = CRISPR gRNA sequence
  source 1..20: mol_type = other DNA
ccagaggtcctgtcaaggta

SEQ ID NO: 61621 - DNA, 20 bp, synthetic construct
  misc_feature 1..20: note = CRISPR gRNA sequence
  source 1..20: mol_type = other DNA
aggccattatgttctgatat

SEQ ID NO: 61622 - DNA, 20 bp, synthetic construct
  misc_feature 1..20: note = CRISPR gRNA sequence
  source 1..20: mol_type = other DNA
tcttatccagtcctcttggc

SEQ ID NO: 61623 - DNA, 20 bp, synthetic construct
  misc_feature 1..20: note = CRISPR gRNA sequence
  source 1..20: mol_type = other DNA
cctcctccactcttactcac

SEQ ID NO: 61624 - DNA, 20 bp, synthetic construct
  misc_feature 1..20: note = CRISPR gRNA sequence
  source 1..20: mol_type = other DNA
gtggaagggcagttgatagg

SEQ ID NO: 61625 - DNA, 20 bp, synthetic construct
  misc_feature 1..20: note = CRISPR gRNA sequence
  source 1..20: mol_type = other DNA
gctctacaacctttggccct

SEQ ID NO: 61626 - DNA, 20 bp, synthetic construct
  misc_feature 1..20: note = CRISPR gRNA sequence
  source 1..20: mol_type = other DNA
tcaacacctgcactacagca

SEQ ID NO: 61627 - DNA, 20 bp, synthetic construct
  misc_feature 1..20: note = CRISPR gRNA sequence
  source 1..20: mol_type = other DNA
aggtggtctgagaggcccag

SEQ ID NO: 61628 - DNA, 20 bp, synthetic construct
  misc_feature 1..20: note = CRISPR gRNA sequence
  source 1..20: mol_type = other DNA
gcacagtgcgggcaccgcac

SEQ ID NO: 61629 - DNA, 20 bp, synthetic construct
  misc_feature 1..20: note = CRISPR gRNA sequence
  source 1..20: mol_type = other DNA
gcgatggctgggcgctgaag

SEQ ID NO: 61630 - DNA, 20 bp, synthetic construct
  misc_feature 1..20: note = CRISPR gRNA sequence
  source 1..20: mol_type = other DNA
cctctgcaggcaggcaggca

SEQ ID NO: 61631 - DNA, 20 bp, synthetic construct
  misc_feature 1..20: note = CRISPR gRNA sequence
  source 1..20: mol_type = other DNA
tactggaagacagtgtcgtg

SEQ ID NO: 61632 - DNA, 20 bp, synthetic construct
  misc_feature 1..20: note = CRISPR gRNA sequence
  source 1..20: mol_type = other DNA
taaggatgctgtggcccggc

SEQ ID NO: 61633 - DNA, 20 bp, synthetic construct
  misc_feature 1..20: note = CRISPR gRNA sequence
  source 1..20: mol_type = other DNA
ggcgtggggctgccctgacc

SEQ ID NO: 61634 - DNA, 20 bp, synthetic construct
  misc_feature 1..20: note = CRISPR gRNA sequence
  source 1..20: mol_type = other DNA
ctccagtgcagtggcacgat

SEQ ID NO: 61635 - DNA, 20 bp, synthetic construct
  misc_feature 1..20: note = CRISPR gRNA sequence
  source 1..20: mol_type = other DNA
ttttgtatttttagtagaga

SEQ ID NO: 61636 - DNA, 20 bp, synthetic construct
  misc_feature 1..20: note = CRISPR gRNA sequence
  source 1..20: mol_type = other DNA
tgcctcagccctccaaagtg

SEQ ID NO: 61637 - DNA, 20 bp, synthetic construct
  misc_feature 1..20: note = CRISPR gRNA sequence
  source 1..20: mol_type = other DNA
tgacccagggaaagggctgg

SEQ ID NO: 61638 - DNA, 20 bp, synthetic construct
  misc_feature 1..20: note = CRISPR gRNA sequence
  source 1..20: mol_type = other DNA
gcccccagggcctctgtctt

SEQ ID NO: 61639 - DNA, 20 bp, synthetic construct
  misc_feature 1..20: note = CRISPR gRNA sequence
  source 1..20: mol_type = other DNA
cagcgaagctgagacctgta

SEQ ID NO: 61640 - DNA, 20 bp, synthetic construct
  misc_feature 1..20: note = CRISPR gRNA sequence
  source 1..20: mol_type = other DNA
acaagagtcactgggcctct

SEQ ID NO: 61641 - DNA, 20 bp, synthetic construct
  misc_feature 1..20: note = CRISPR gRNA sequence
  source 1..20: mol_type = other DNA
gcccccaggcaaccccatct

SEQ ID NO: 61642 - DNA, 20 bp, synthetic construct
  misc_feature 1..20: note = CRISPR gRNA sequence
  source 1..20: mol_type = other DNA
cacactggtacccacctagc

SEQ ID NO: 61643 - DNA, 20 bp, synthetic construct
  misc_feature 1..20: note = CRISPR gRNA sequence
  source 1..20: mol_type = other DNA
cacctagctgctgcttcttg

SEQ ID NO: 61644 - DNA, 20 bp, synthetic construct
  misc_feature 1..20: note = CRISPR gRNA sequence
  source 1..20: mol_type = other DNA
aggacccacagctctgatgt

SEQ ID NO: 61645 - DNA, 20 bp, synthetic construct
  misc_feature 1..20: note = CRISPR gRNA sequence
  source 1..20: mol_type = other DNA
caggcagaggctgggtcaac

SEQ ID NO: 61646 - DNA, 20 bp, synthetic construct
  misc_feature 1..20: note = CRISPR gRNA sequence
  source 1..20: mol_type = other DNA
tcatataagtgaagttccca

SEQ ID NO: 61647 - DNA, 20 bp, synthetic construct
  misc_feature 1..20: note = CRISPR gRNA sequence
  source 1..20: mol_type = other DNA
ctgcaacctccctcctctgt

SEQ ID NO: 61648 - DNA, 20 bp, synthetic construct
  misc_feature 1..20: note = CRISPR gRNA sequence
  source 1..20: mol_type = other DNA
cctctgttagggttttatca

SEQ ID NO: 61649 - DNA, 20 bp, synthetic construct
  misc_feature 1..20: note = CRISPR gRNA sequence
  source 1..20: mol_type = other DNA
cacatttcctcacttccctt

SEQ ID NO: 61650 - DNA, 20 bp, synthetic construct
  misc_feature 1..20: note = CRISPR gRNA sequence
  source 1..20: mol_type = other DNA
tctggagtcttgtctcattg

SEQ ID NO: 61651 - DNA, 20 bp, synthetic construct
  misc_feature 1..20: note = CRISPR gRNA sequence
  source 1..20: mol_type = other DNA
tcactttaatgcctttctgg

SEQ ID NO: 61652 - DNA, 20 bp, synthetic construct
  misc_feature 1..20: note = CRISPR gRNA sequence
  source 1..20: mol_type = other DNA
cctattggaccagggacttg

SEQ ID NO: 61653 - DNA, 20 bp, synthetic construct
  misc_feature 1..20: note = CRISPR gRNA sequence
  source 1..20: mol_type = other DNA
tggaccagggacttggacag

SEQ ID NO: 61654 - DNA, 20 bp, synthetic construct
  misc_feature 1..20: note = CRISPR gRNA sequence
  source 1..20: mol_type = other DNA
tggggagctgaggttatagg

SEQ ID NO: 61655 - DNA, 20 bp, synthetic construct
  misc_feature 1..20: note = CRISPR gRNA sequence
  source 1..20: mol_type = other DNA
tgcacagcgataagtaaagt

SEQ ID NO: 61656 - DNA, 20 bp, synthetic construct
  misc_feature 1..20: note = CRISPR gRNA sequence
  source 1..20: mol_type = other DNA
acaagtcgggagggggtggt

SEQ ID NO: 61657 - DNA, 20 bp, synthetic construct
  misc_feature 1..20: note = CRISPR gRNA sequence
  source 1..20: mol_type = other DNA
ttgcgggcaggaaagtgaga

SEQ ID NO: 61658 - DNA, 20 bp, synthetic construct
  misc_feature 1..20: note = CRISPR gRNA sequence
  source 1..20: mol_type = other DNA
tggggctgggagacacagtt

SEQ ID NO: 61659 - DNA, 20 bp, synthetic construct
  misc_feature 1..20: note = CRISPR gRNA sequence
  source 1..20: mol_type = other DNA
ccacagcctccacagcctcc

SEQ ID NO: 61660 - DNA, 20 bp, synthetic construct
  misc_feature 1..20: note = CRISPR gRNA sequence
  source 1..20: mol_type = other DNA
cagtcctcaccatggtggag

SEQ ID NO: 61661 - DNA, 20 bp, synthetic construct
  misc_feature 1..20: note = CRISPR gRNA sequence
  source 1..20: mol_type = other DNA
atggtggagctgagattcag

SEQ ID NO: 61662 - DNA, 20 bp, synthetic construct
  misc_feature 1..20: note = CRISPR gRNA sequence
  source 1..20: mol_type = other DNA
gttgtggagaaaatgtggtg

SEQ ID NO: 61663 - DNA, 20 bp, synthetic construct
  misc_feature 1..20: note = CRISPR gRNA sequence
  source 1..20: mol_type = other DNA
gtgtgtatatgcaagtgcat

SEQ ID NO: 61664 - DNA, 20 bp, synthetic construct
  misc_feature 1..20: note = CRISPR gRNA sequence
  source 1..20: mol_type = other DNA
acacttgcatgcatgtgtac

SEQ ID NO: 61665 - DNA, 20 bp, synthetic construct
  misc_feature 1..20: note = CRISPR gRNA sequence
  source 1..20: mol_type = other DNA
cgctgttgcccctcaatgtc

SEQ ID NO: 61666 - DNA, 20 bp, synthetic construct
  misc_feature 1..20: note = CRISPR gRNA sequence
  source 1..20: mol_type = other DNA
gggcagaaggcgctccccgt

SEQ ID NO: 61667 - DNA, 20 bp, synthetic construct
  misc_feature 1..20: note = CRISPR gRNA sequence
  source 1..20: mol_type = other DNA
gagttggatgctgtagtgag

SEQ ID NO: 61668 - DNA, 20 bp, synthetic construct
  misc_feature 1..20: note = CRISPR gRNA sequence
  source 1..20: mol_type = other DNA
tctcgggcattatgggctat

SEQ ID NO: 61669 - DNA, 20 bp, synthetic construct
  misc_feature 1..20: note = CRISPR gRNA sequence
  source 1..20: mol_type = other DNA
ggaggggtcctccaggcccc

SEQ ID NO: 61670 - DNA, 20 bp, synthetic construct
  misc_feature 1..20: note = CRISPR gRNA sequence
  source 1..20: mol_type = other DNA
catgacgcaggtactggccc

SEQ ID NO: 61671 - DNA, 20 bp, synthetic construct
  misc_feature 1..20: note = CRISPR gRNA sequence
  source 1..20: mol_type = other DNA
aggtgtccgaaccctggaca

SEQ ID NO: 61672 - DNA, 20 bp, synthetic construct
  misc_feature 1..20: note = CRISPR gRNA sequence
  source 1..20: mol_type = other DNA
aggacaagcaaattgggggc

SEQ ID NO: 61673 - DNA, 20 bp, synthetic construct
  misc_feature 1..20: note = CRISPR gRNA sequence
  source 1..20: mol_type = other DNA
gggggacaggggagctggga

SEQ ID NO: 61674 - DNA, 20 bp, synthetic construct
  misc_feature 1..20: note = CRISPR gRNA sequence
  source 1..20: mol_type = other DNA
gaaggtgagttgggggataa

SEQ ID NO: 61675 - DNA, 20 bp, synthetic construct
  misc_feature 1..20: note = CRISPR gRNA sequence
  source 1..20: mol_type = other DNA
gggatcagctccagagatca

SEQ ID NO: 61676 - DNA, 20 bp, synthetic construct
  misc_feature 1..20: note = CRISPR gRNA sequence
  source 1..20: mol_type = other DNA
aatattctctggtcatctag

SEQ ID NO: 61677 - DNA, 20 bp, synthetic construct
  misc_feature 1..20: note = CRISPR gRNA sequence
  source 1..20: mol_type = other DNA
ttctttgctccttcctgttg

SEQ ID NO: 61678 - DNA, 20 bp, synthetic construct
  misc_feature 1..20: note = CRISPR gRNA sequence
  source 1..20: mol_type = other DNA
ttccattctggttaagccac

SEQ ID NO: 61679 - DNA, 20 bp, synthetic construct
  misc_feature 1..20: note = CRISPR gRNA sequence
  source 1..20: mol_type = other DNA
ctggttaagccactgttgtt

SEQ ID NO: 61680 - DNA, 20 bp, synthetic construct
  misc_feature 1..20: note = CRISPR gRNA sequence
  source 1..20: mol_type = other DNA
agcctccgcctcccgggttc

SEQ ID NO: 61681 - DNA, 20 bp, synthetic construct
  misc_feature 1..20: note = CRISPR gRNA sequence
  source 1..20: mol_type = other DNA
tgcctcagcctcccgagtag

SEQ ID NO: 61682 - DNA, 20 bp, synthetic construct
  misc_feature 1..20: note = CRISPR gRNA sequence
  source 1..20: mol_type = other DNA
tttgtaatttttagtacaga

SEQ ID NO: 61683 - DNA, 20 bp, synthetic construct
  misc_feature 1..20: note = CRISPR gRNA sequence
  source 1..20: mol_type = other DNA
cacctcggcctcccaaagtg

SEQ ID NO: 61684 - DNA, 20 bp, synthetic construct
  misc_feature 1..20: note = CRISPR gRNA sequence
  source 1..20: mol_type = other DNA
gcctaaataatgtgcagttc

SEQ ID NO: 61685 - DNA, 20 bp, synthetic construct
  misc_feature 1..20: note = CRISPR gRNA sequence
  source 1..20: mol_type = other DNA
taattgcaaagatgctcact

SEQ ID NO: 61686 - DNA, 20 bp, synthetic construct
  misc_feature 1..20: note = CRISPR gRNA sequence
  source 1..20: mol_type = other DNA
caacctaaatgtccaacagt

SEQ ID NO: 61687 - DNA, 20 bp, synthetic construct
  misc_feature 1..20: note = CRISPR gRNA sequence
  source 1..20: mol_type = other DNA
ctgtgtattaggcactgtct

SEQ ID NO: 61688 - DNA, 20 bp, synthetic construct
  misc_feature 1..20: note = CRISPR gRNA sequence
  source 1..20: mol_type = other DNA
gaggccagtactatgcgtcc

SEQ ID NO: 61689 - DNA, 20 bp, synthetic construct
  misc_feature 1..20: note = CRISPR gRNA sequence
  source 1..20: mol_type = other DNA
gacagaggcaggaggagaac

SEQ ID NO: 61690 - DNA, 20 bp, synthetic construct
  misc_feature 1..20: note = CRISPR gRNA sequence
  source 1..20: mol_type = other DNA
gcaccagacaaggctaagtc

SEQ ID NO: 61691 - DNA, 20 bp, synthetic construct
  misc_feature 1..20: note = CRISPR gRNA sequence
  source 1..20: mol_type = other DNA
aagtaagtagtgcctggatg

SEQ ID NO: 61692 - DNA, 20 bp, synthetic construct
  misc_feature 1..20: note = CRISPR gRNA sequence
  source 1..20: mol_type = other DNA
ctggatggtgtgatttctgg

SEQ ID NO: 61693 - DNA, 20 bp, synthetic construct
  misc_feature 1..20: note = CRISPR gRNA sequence
  source 1..20: mol_type = other DNA
cagccagtctaacacaatac

SEQ ID NO: 61694 - DNA, 20 bp, synthetic construct
  misc_feature 1..20: note = CRISPR gRNA sequence
  source 1..20: mol_type = other DNA
catggcatcattatcagtca

SEQ ID NO: 61695 - DNA, 20 bp, synthetic construct
  misc_feature 1..20: note = CRISPR gRNA sequence
  source 1..20: mol_type = other DNA
ctcctctttctaggcctttg

SEQ ID NO: 61696 - DNA, 20 bp, synthetic construct
  misc_feature 1..20: note = CRISPR gRNA sequence
  source 1..20: mol_type = other DNA
aaattgggcacagccatgaa

SEQ ID NO: 61697 - DNA, 20 bp, synthetic construct
  misc_feature 1..20: note = CRISPR gRNA sequence
  source 1..20: mol_type = other DNA
aagactcatgtcatgcctgt

SEQ ID NO: 61698 - DNA, 20 bp, synthetic construct
  misc_feature 1..20: note = CRISPR gRNA sequence
  source 1..20: mol_type = other DNA
gtcataccatctctaaaatg

SEQ ID NO: 61699 - DNA, 20 bp, synthetic construct
  misc_feature 1..20: note = CRISPR gRNA sequence
  source 1..20: mol_type = other DNA
agatgctgtctcaaaactct

SEQ ID NO: 61700 - DNA, 20 bp, synthetic construct
  misc_feature 1..20: note = CRISPR gRNA sequence
  source 1..20: mol_type = other DNA
atgctgaatgatggtcaagg

SEQ ID NO: 61701 - DNA, 20 bp, synthetic construct
  misc_feature 1..20: note = CRISPR gRNA sequence
  source 1..20: mol_type = other DNA
tgttgggggcagcccagtaa

SEQ ID NO: 61702 - DNA, 20 bp, synthetic construct
  misc_feature 1..20: note = CRISPR gRNA sequence
  source 1..20: mol_type = other DNA
ctgggctatgtgtgccttga

SEQ ID NO: 61703 - DNA, 20 bp, synthetic construct
  misc_feature 1..20: note = CRISPR gRNA sequence
  source 1..20: mol_type = other DNA
tgccttgagctggattgaca

SEQ ID NO: 61704 - DNA, 20 bp, synthetic construct
  misc_feature 1..20: note = CRISPR gRNA sequence
  source 1..20: mol_type = other DNA
tcctaaggggagagaagaca

SEQ ID NO: 61705 - DNA, 20 bp, synthetic construct
  misc_feature 1..20: note = CRISPR gRNA sequence
  source 1..20: mol_type = other DNA
cccttgaccatcattcagca

SEQ ID NO: 61706 - DNA, 20 bp, synthetic construct
  misc_feature 1..20: note = CRISPR gRNA sequence
  source 1..20: mol_type = other DNA
tgagaatgtaatgatcagac

SEQ ID NO: 61707 - DNA, 20 bp, synthetic construct
  misc_feature 1..20: note = CRISPR gRNA sequence
  source 1..20: mol_type = other DNA
caatatttctggtccctgga

SEQ ID NO: 61708 - DNA, 20 bp, synthetic construct
  misc_feature 1..20: note = CRISPR gRNA sequence
  source 1..20: mol_type = other DNA
ctggtccctggagtagaaaa

SEQ ID NO: 61709 - DNA, 20 bp, synthetic construct
  misc_feature 1..20: note = CRISPR gRNA sequence
  source 1..20: mol_type = other DNA
agtgtaatcccaccaaaggc

SEQ ID NO: 61710 - DNA, 20 bp, synthetic construct
  misc_feature 1..20: note = CRISPR gRNA sequence
  source 1..20: mol_type = other DNA
ccaccaaaggcctagaaaga

SEQ ID NO: 61711 - DNA, 20 bp, synthetic construct
  misc_feature 1..20: note = CRISPR gRNA sequence
  source 1..20: mol_type = other DNA
acagccctaatgcctaccac

SEQ ID NO: 61712 - DNA, 20 bp, synthetic construct
  misc_feature 1..20: note = CRISPR gRNA sequence
  source 1..20: mol_type = other DNA
attgtgttagactggctgga

SEQ ID NO: 61713 - DNA, 20 bp, synthetic construct
  misc_feature 1..20: note = CRISPR gRNA sequence
  source 1..20: mol_type = other DNA
ctggaggagaaatttgagga

SEQ ID NO: 61714 - DNA, 20 bp, synthetic construct
  misc_feature 1..20: note = CRISPR gRNA sequence
  source 1..20: mol_type = other DNA
tttgaggatgagaaacatca

SEQ ID NO: 61715 - DNA, 20 bp, synthetic construct
  misc_feature 1..20: note = CRISPR gRNA sequence
  source 1..20: mol_type = other DNA
aaatttactggcctgggagg

SEQ ID NO: 61716 - DNA, 20 bp, synthetic construct
  misc_feature 1..20: note = CRISPR gRNA sequence
  source 1..20: mol_type = other DNA
attgctattagcccagttga

SEQ ID NO: 61717 - DNA, 20 bp, synthetic construct
  misc_feature 1..20: note = CRISPR gRNA sequence
  source 1..20: mol_type = other DNA
ctatgaggaaggacatagta

SEQ ID NO: 61718 - DNA, 20 bp, synthetic construct
  misc_feature 1..20: note = CRISPR gRNA sequence
  source 1..20: mol_type = other DNA
cgtttgccaaggttagagtc

SEQ ID NO: 61719 - DNA, 20 bp, synthetic construct
  misc_feature 1..20: note = CRISPR gRNA sequence
  source 1..20: mol_type = other DNA
ctactcgggaggctgaggca

SEQ ID NO: 61720 - DNA, 20 bp, synthetic construct
  misc_feature 1..20: note = CRISPR gRNA sequence
  source 1..20: mol_type = other DNA
aagagttccagttcagaagg

SEQ ID NO: 61721 - DNA, 20 bp, synthetic construct
  misc_feature 1..20: note = CRISPR gRNA sequence
  source 1..20: mol_type = other DNA
attagagttcactgtgagta

SEQ ID NO: 61722 - DNA, 20 bp, synthetic construct
  misc_feature 1..20: note = CRISPR gRNA sequence
  source 1..20: mol_type = other DNA
actaaacaacagtggcttaa

SEQ ID NO: 61723 - DNA, 20 bp, synthetic construct
  misc_feature 1..20: note = CRISPR gRNA sequence
  source 1..20: mol_type = other DNA
agacaacaggaaggagcaaa

SEQ ID NO: 61724 - DNA, 20 bp, synthetic construct
  misc_feature 1..20: note = CRISPR gRNA sequence
  source 1..20: mol_type = other DNA
ataatctattctagatgacc

SEQ ID NO: 61725 - DNA, 20 bp, synthetic construct
  misc_feature 1..20: note = CRISPR gRNA sequence
  source 1..20: mol_type = other DNA
gcataaatggttcatggaaa

SEQ ID NO: 61726 - DNA, 20 bp, synthetic construct
  misc_feature 1..20: note = CRISPR gRNA sequence
  source 1..20: mol_type = other DNA
tggagtagggagggggtgca

SEQ ID NO: 61727 - DNA, 20 bp, synthetic construct
  misc_feature 1..20: note = CRISPR gRNA sequence
  source 1..20: mol_type = other DNA
ttcttgactgcttgacttcc

SEQ ID NO: 61728 - DNA, 20 bp, synthetic construct
  misc_feature 1..20: note = CRISPR gRNA sequence
  source 1..20: mol_type = other DNA
tgaggctgctcaccaaagac

SEQ ID NO: 61729 - DNA, 20 bp, synthetic construct
  misc_feature 1..20: note = CRISPR gRNA sequence
  source 1..20: mol_type = other DNA
ttgtttgttttgcaacatgg

SEQ ID NO: 61730 - DNA, 20 bp, synthetic construct
  misc_feature 1..20: note = CRISPR gRNA sequence
  source 1..20: mol_type = other DNA
aggggcaacagcgtttttgg

SEQ ID NO: 61731 - DNA, 20 bp, synthetic construct
  misc_feature 1..20: note = CRISPR gRNA sequence
  source 1..20: mol_type = other DNA
tgtgcatggcagtaatgcca

SEQ ID NO: 61732 - DNA, 20 bp, synthetic construct
  misc_feature 1..20: note = CRISPR gRNA sequence
  source 1..20: mol_type = other DNA
tcttcctttctcaaactctt

SEQ ID NO: 61733 - DNA, 20 bp, synthetic construct
  misc_feature 1..20: note = CRISPR gRNA sequence
  source 1..20: mol_type = other DNA
ccatacaatgagacaagact

SEQ ID NO: 61734 - DNA, 20 bp, synthetic construct
  misc_feature 1..20: note = CRISPR gRNA sequence
  source 1..20: mol_type = other DNA
aagtgaggaaatgtgggtga

SEQ ID NO: 61735 - DNA, 20 bp, synthetic construct
  misc_feature 1..20: note = CRISPR gRNA sequence
  source 1..20: mol_type = other DNA
tcttgtctcgcaagtttcca

SEQ ID NO: 61736 - DNA, 20 bp, synthetic construct
  misc_feature 1..20: note = CRISPR gRNA sequence
  source 1..20: mol_type = other DNA
gggaggggtgaggaggcctg

SEQ ID NO: 61737 - DNA, 20 bp, synthetic construct
  misc_feature 1..20: note = CRISPR gRNA sequence
  source 1..20: mol_type = other DNA
ggcaggccaggccagtgaga

SEQ ID NO: 61738 - DNA, 20 bp, synthetic construct
  misc_feature 1..20: note = CRISPR gRNA sequence
  source 1..20: mol_type = other DNA
ctctcattcttgaccagttc

SEQ ID NO: 61739 - DNA, 20 bp, synthetic construct
  misc_feature 1..20: note = CRISPR gRNA sequence
  source 1..20: mol_type = other DNA
gcactggggatccagatatt

SEQ ID NO: 61740 - DNA, 20 bp, synthetic construct
  misc_feature 1..20: note = CRISPR gRNA sequence
  source 1..20: mol_type = other DNA
gagactctgtctctgggaaa

SEQ ID NO: 61741 - DNA, 20 bp, synthetic construct
  misc_feature 1..20: note = CRISPR gRNA sequence
  source 1..20: mol_type = other DNA
cttacaccacgtgtactatt

SEQ ID NO: 61742 - DNA, 20 bp, synthetic construct
  misc_feature 1..20: note = CRISPR gRNA sequence
  source 1..20: mol_type = other DNA
gctttgatgggccacgggtg

SEQ ID NO: 61743 - DNA, 20 bp, synthetic construct
  misc_feature 1..20: note = CRISPR gRNA sequence
  source 1..20: mol_type = other DNA
ctggtaggctgtgggcagat

SEQ ID NO: 61744 - DNA, 20 bp, synthetic construct
  misc_feature 1..20: note = CRISPR gRNA sequence
  source 1..20: mol_type = other DNA
cctctgccaagaggactgga

SEQ ID NO: 61745 - DNA, 20 bp, synthetic construct
  misc_feature 1..20: note = CRISPR gRNA sequence
  source 1..20: mol_type = other DNA
gccaactcatatggtcattg

SEQ ID NO: 61746 - DNA, 20 bp, synthetic construct
  misc_feature 1..20: note = CRISPR gRNA sequence
  source 1..20: mol_type = other DNA
gctcagtgtgcatattagct

SEQ ID NO: 61747 - DNA, 20 bp, synthetic construct
  misc_feature 1..20: note = CRISPR gRNA sequence
  source 1..20: mol_type = other DNA
aaaggctaggctgcagtaac

SEQ ID NO: 61748 - DNA, 20 bp, synthetic construct
  misc_feature 1..20: note = CRISPR gRNA sequence
  source 1..20: mol_type = other DNA
aatacagtaggttaaataat

SEQ ID NO: 61749 - DNA, 20 bp, synthetic construct
  misc_feature 1..20: note = CRISPR gRNA sequence
  source 1..20: mol_type = other DNA
tctattgctgtagatgaagt

SEQ ID NO: 61750 - DNA, 20 bp, synthetic construct
  misc_feature 1..20: note = CRISPR gRNA sequence
  source 1..20: mol_type = other DNA
cagaagtacacaggcatatg

SEQ ID NO: 61751 - DNA, 20 bp, synthetic construct
  misc_feature 1..20: note = CRISPR gRNA sequence
  source 1..20: mol_type = other DNA
gcaaaaacttccccatagga

SEQ ID NO: 61752 - DNA, 20 bp, synthetic construct
  misc_feature 1..20: note = CRISPR gRNA sequence
  source 1..20: mol_type = other DNA
cccataggaacagaatagac

SEQ ID NO: 61753 - DNA, 20 bp, synthetic construct
  misc_feature 1..20: note = CRISPR gRNA sequence
  source 1..20: mol_type = other DNA
gatcttggccttatgggcct

SEQ ID NO: 61754 - DNA, 20 bp, synthetic construct
  misc_feature 1..20: note = CRISPR gRNA sequence
  source 1..20: mol_type = other DNA
gatctccatctcaaatttaa

SEQ ID NO: 61755 - DNA, 20 bp, synthetic construct
  misc_feature 1..20: note = CRISPR gRNA sequence
  source 1..20: mol_type = other DNA
tggatgtttgaacatttggg

SEQ ID NO: 61756 - DNA, 20 bp, synthetic construct
  misc_feature 1..20: note = CRISPR gRNA sequence
  source 1..20: mol_type = other DNA
cctacatcttagggttgttc

SEQ ID NO: 61757 - DNA, 20 bp, synthetic construct
  misc_feature 1..20: note = CRISPR gRNA sequence
  source 1..20: mol_type = other DNA
ttggccagtcttggatgggc

SEQ ID NO: 61758 - DNA, 20 bp, synthetic construct
  misc_feature 1..20: note = CRISPR gRNA sequence
  source 1..20: mol_type = other DNA
gcactttggaacgccaagca

SEQ ID NO: 61759 - DNA, 20 bp, synthetic construct
  misc_feature 1..20: note = CRISPR gRNA sequence
  source 1..20: mol_type = other DNA
gccaggacatttccatcatt

SEQ ID NO: 61760 - DNA, 20 bp, synthetic construct
  misc_feature 1..20: note = CRISPR gRNA sequence
  source 1..20: mol_type = other DNA
gctagatgttgtcatccgtt

SEQ ID NO: 61761 - DNA, 20 bp, synthetic construct
  misc_feature 1..20: note = CRISPR gRNA sequence
  source 1..20: mol_type = other DNA
gttgtcatccgttttagaaa

SEQ ID NO: 61762 - DNA, 20 bp, synthetic construct
  misc_feature 1..20: note = CRISPR gRNA sequence
  source 1..20: mol_type = other DNA
attacctcactgtaattcct

SEQ ID NO: 61763 - DNA, 20 bp, synthetic construct
  misc_feature 1..20: note = CRISPR gRNA sequence
  source 1..20: mol_type = other DNA
ggaggggcatgctgcctcat

SEQ ID NO: 61764 - DNA, 20 bp, synthetic construct
  misc_feature 1..20: note = CRISPR gRNA sequence
  source 1..20: mol_type = other DNA
atagaggaggaagttaagct

SEQ ID NO: 61765 - DNA, 20 bp, synthetic construct
  misc_feature 1..20: note = CRISPR gRNA sequence
  source 1..20: mol_type = other DNA
ctcttgctgagatctgccaa

SEQ ID NO: 61766 - DNA, 20 bp, synthetic construct
  misc_feature 1..20: note = CRISPR gRNA sequence
  source 1..20: mol_type = other DNA
taaccttctcttttcgggat

SEQ ID NO: 61767 - DNA, 20 bp, synthetic construct
  misc_feature 1..20: note = CRISPR gRNA sequence
  source 1..20: mol_type = other DNA
gtcccattgggagaaccagg

SEQ ID NO: 61768 - DNA, 20 bp, synthetic construct
  misc_feature 1..20: note = CRISPR gRNA sequence
  source 1..20: mol_type = other DNA
gagtctggtatagtcagggc

SEQ ID NO: 61769 - DNA, 20 bp, synthetic construct
  misc_feature 1..20: note = CRISPR gRNA sequence
  source 1..20: mol_type = other DNA
aatggtggttattttacaga

SEQ ID NO: 61770 - DNA, 20 bp, synthetic construct
  misc_feature 1..20: note = CRISPR gRNA sequence
  source 1..20: mol_type = other DNA
ttttggcttactcacacgca

SEQ ID NO: 61771 - DNA, 20 bp, synthetic construct
  misc_feature 1..20: note = CRISPR gRNA sequence
  source 1..20: mol_type = other DNA
ttggttataataggaaaaaa

SEQ ID NO: 61772 - DNA, 20 bp, synthetic construct
  misc_feature 1..20: note = CRISPR gRNA sequence
  source 1..20: mol_type = other DNA
agagagaactcagtggaacc

SEQ ID NO: 61773 - DNA, 20 bp, synthetic construct
  misc_feature 1..20: note = CRISPR gRNA sequence
  source 1..20: mol_type = other DNA
gggagttattaagtaaacat

SEQ ID NO: 61774 - DNA, 20 bp, synthetic construct
  misc_feature 1..20: note = CRISPR gRNA sequence
  source 1..20: mol_type = other DNA
gcttttcaagatatgcaatg

SEQ ID NO: 61775 - DNA, 20 bp, synthetic construct
  misc_feature 1..20: note = CRISPR gRNA sequence
  source 1..20: mol_type = other DNA
ttcaagatatgcaatggcag

SEQ ID NO: 61776 - DNA, 20 bp, synthetic construct
  misc_feature 1..20: note = CRISPR gRNA sequence
  source 1..20: mol_type = other DNA
ctactcaggaggctgaggca

SEQ ID NO: 61777 - DNA, 20 bp, synthetic construct
  misc_feature 1..20: note = CRISPR gRNA sequence
  source 1..20: mol_type = other DNA
taaaaaactaatgtttaaaa

SEQ ID NO: 61778 - DNA, 20 bp, synthetic construct
  misc_feature 1..20: note = CRISPR gRNA sequence
  source 1..20: mol_type = other DNA
gtaaaacaaaaattattgca

SEQ ID NO: 61779 - DNA, 20 bp, synthetic construct
  misc_feature 1..20: note = CRISPR gRNA sequence
  source 1..20: mol_type = other DNA
ctggggctaaaagagagaac

SEQ ID NO: 61780 - DNA, 20 bp, synthetic construct
  misc_feature 1..20: note = CRISPR gRNA sequence
  source 1..20: mol_type = other DNA
acatttgtgaaatatctgtg

SEQ ID NO: 61781 - DNA, 20 bp, synthetic construct
  misc_feature 1..20: note = CRISPR gRNA sequence
  source 1..20: mol_type = other DNA
agactgagaccttctctcaa

SEQ ID NO: 61782 - DNA, 20 bp, synthetic construct
  misc_feature 1..20: note = CRISPR gRNA sequence
  source 1..20: mol_type = other DNA
ggctgacacattgtggcctc

SEQ ID NO: 61783 - DNA, 20 bp, synthetic construct
  misc_feature 1..20: note = CRISPR gRNA sequence
  source 1..20: mol_type = other DNA
ctgttctttccctgctgaag

SEQ ID NO: 61784 - DNA, 20 bp, synthetic construct
  misc_feature 1..20: note = CRISPR gRNA sequence
  source 1..20: mol_type = other DNA
gctgaagtcagaaacccctt

SEQ ID NO: 61785 - DNA, 20 bp, synthetic construct
  misc_feature 1..20: note = CRISPR gRNA sequence
  source 1..20: mol_type = other DNA
ccctcagaggtccacgaacc

SEQ ID NO: 61786 - DNA, 20 bp, synthetic construct
  misc_feature 1..20: note = CRISPR gRNA sequence
  source 1..20: mol_type = other DNA
agtgtagcattaaatagtaa

SEQ ID NO: 61787 - DNA, 20 bp, synthetic construct
  misc_feature 1..20: note = CRISPR gRNA sequence
  source 1..20: mol_type = other DNA
caagttgacaggagaccctg

SEQ ID NO: 61788 - DNA, 20 bp, synthetic construct
  misc_feature 1..20: note = CRISPR gRNA sequence
  source 1..20: mol_type = other DNA
ccacccctcccttatcaggt

SEQ ID NO: 61789 - DNA, 20 bp, synthetic construct
  misc_feature 1..20: note = CRISPR gRNA sequence
  source 1..20: mol_type = other DNA
aaaaggaggcccagctccag

SEQ ID NO: 61790 - DNA, 20 bp, synthetic construct
  misc_feature 1..20: note = CRISPR gRNA sequence
  source 1..20: mol_type = other DNA
tggtatgctgcagagacttt

SEQ ID NO: 61791 - DNA, 20 bp, synthetic construct
  misc_feature 1..20: note = CRISPR gRNA sequence
  source 1..20: mol_type = other DNA
tgccagccgctcaggagtca

SEQ ID NO: 61792 - DNA, 20 bp, synthetic construct
  misc_feature 1..20: note = CRISPR gRNA sequence
  source 1..20: mol_type = other DNA
agactccatctcaaaaaaaa

SEQ ID NO: 61793 - DNA, 20 bp, synthetic construct
  misc_feature 1..20: note = CRISPR gRNA sequence
  source 1..20: mol_type = other DNA
ccatctcaaaaaaaaaaaga

SEQ ID NO: 61794 - DNA, 20 bp, synthetic construct
  misc_feature 1..20: note = CRISPR gRNA sequence
  source 1..20: mol_type = other DNA
tcaaaaaaaaaaagaaaaga

SEQ ID NO: 61795 - DNA, 20 bp, synthetic construct
  misc_feature 1..20: note = CRISPR gRNA sequence
  source 1..20: mol_type = other DNA
gtcttaattgtgggagctga

SEQ ID NO: 61796 - DNA, 20 bp, synthetic construct
  misc_feature 1..20: note = CRISPR gRNA sequence
  source 1..20: mol_type = other DNA
ttcccttccctaaggacccc

SEQ ID NO: 61797 - DNA, 20 bp, synthetic construct
  misc_feature 1..20: note = CRISPR gRNA sequence
  source 1..20: mol_type = other DNA
cctcatctgtaaaatggaga

SEQ ID NO: 61798 - DNA, 20 bp, synthetic construct
  misc_feature 1..20: note = CRISPR gRNA sequence
  source 1..20: mol_type = other DNA
ggtgagacccccccatctct

SEQ ID NO: 61799 - DNA, 20 bp, synthetic construct
  misc_feature 1..20: note = CRISPR gRNA sequence
  source 1..20: mol_type = other DNA
acagagcaagactctgtctc

SEQ ID NO: 61800 - DNA, 20 bp, synthetic construct
  misc_feature 1..20: note = CRISPR gRNA sequence
  source 1..20: mol_type = other DNA
ttcttcgaaacaacaacaaa

SEQ ID NO: 61801 - DNA, 20 bp, synthetic construct
  misc_feature 1..20: note = CRISPR gRNA sequence
  source 1..20: mol_type = other DNA
tcttacctcattgtttattg

SEQ ID NO: 61802 - DNA, 20 bp, synthetic construct
  misc_feature 1..20: note = CRISPR gRNA sequence
  source 1..20: mol_type = other DNA
tgtttattgtgagaatcaaa

SEQ ID NO: 61803 - DNA, 20 bp, synthetic construct
  misc_feature 1..20: note = CRISPR gRNA sequence
  source 1..20: mol_type = other DNA
ttaatctattccttgtttgc

SEQ ID NO: 61804 - DNA, 20 bp, synthetic construct
  misc_feature 1..20: note = CRISPR gRNA sequence
  source 1..20: mol_type = other DNA
gagagtcacagctagtgtgt

SEQ ID NO: 61805 - DNA, 20 bp, synthetic construct
  misc_feature 1..20: note = CRISPR gRNA sequence
  source 1..20: mol_type = other DNA
gagggaagagagggagttta

SEQ ID NO: 61806 - DNA, 20 bp, synthetic construct
  misc_feature 1..20: note = CRISPR gRNA sequence
  source 1..20: mol_type = other DNA
gggagtttaagagaaaagga

SEQ ID NO: 61807 - DNA, 20 bp, synthetic construct
  misc_feature 1..20: note = CRISPR gRNA sequence
  source 1..20: mol_type = other DNA
ctctgggggacacccacttt

SEQ ID NO: 61808 - DNA, 20 bp, synthetic construct
  misc_feature 1..20: note = CRISPR gRNA sequence
  source 1..20: mol_type = other DNA
gggggacacccactttccag

SEQ ID NO: 61809 - DNA, 20 bp, synthetic construct
  misc_feature 1..20: note = CRISPR gRNA sequence
  source 1..20: mol_type = other DNA
tgagagtcccctggcctttg

SEQ ID NO: 61810 - DNA, 20 bp, synthetic construct
  misc_feature 1..20: note = CRISPR gRNA sequence
  source 1..20: mol_type = other DNA
tatagtaattaccttaaaat

SEQ ID NO: 61811 - DNA, 20 bp, synthetic construct
  misc_feature 1..20: note = CRISPR gRNA sequence
  source 1..20: mol_type = other DNA
ttccctgggccacattggaa

SEQ ID NO: 61812 - DNA, 20 bp, synthetic construct
  misc_feature 1..20: note = CRISPR gRNA sequence
  source 1..20: mol_type = other DNA
gggccacattggaagaagaa

SEQ ID NO: 61813 - DNA, 20 bp, synthetic construct
  misc_feature 1..20: note = CRISPR gRNA sequence
  source 1..20: mol_type = other DNA
aaaaaaaaaaacaaaactcc

SEQ ID NO: 61814 - DNA, 20 bp, synthetic construct
  misc_feature 1..20: note = CRISPR gRNA sequence
  source 1..20: mol_type = other DNA
agaaaaatctcatagtgttt

SEQ ID NO: 61815 - DNA, 20 bp, synthetic construct
  misc_feature 1..20: note = CRISPR gRNA sequence
  source 1..20: mol_type = other DNA
gcccatgcccagtccctggg

SEQ ID NO: 61816 - DNA, 20 bp, synthetic construct
  misc_feature 1..20: note = CRISPR gRNA sequence
  source 1..20: mol_type = other DNA
ctcccctccaaacagccaga

SEQ ID NO: 61817 - DNA, 20 bp, synthetic construct
  misc_feature 1..20: note = CRISPR gRNA sequence
  source 1..20: mol_type = other DNA
agcctgcagaggatgaagga

SEQ ID NO: 61818 - DNA, 20 bp, synthetic construct
  misc_feature 1..20: note = CRISPR gRNA sequence
  source 1..20: mol_type = other DNA
aagttattctaaaatcacct

SEQ ID NO: 61819 - DNA, 20 bp, synthetic construct
  misc_feature 1..20: note = CRISPR gRNA sequence
  source 1..20: mol_type = other DNA
ccacggagggtcacccactc

SEQ ID NO: 61820 - DNA, 20 bp, synthetic construct
  misc_feature 1..20: note = CRISPR gRNA sequence
  source 1..20: mol_type = other DNA
ctcgcaaaaagggaatttaa

SEQ ID NO: 61821 - DNA, 20 bp, synthetic construct
  misc_feature 1..20: note = CRISPR gRNA sequence
  source 1..20: mol_type = other DNA
ctaatttcagctcagactgg

SEQ ID NO: 61822 - DNA, 20 bp, synthetic construct
  misc_feature 1..20: note = CRISPR gRNA sequence
  source 1..20: mol_type = other DNA
ctacttgggaggctgaggca

SEQ ID NO: 61823 - DNA, 20 bp, synthetic construct
  misc_feature 1..20: note = CRISPR gRNA sequence
  source 1..20: mol_type = other DNA
gacaagagtgaaactccatc

SEQ ID NO: 61824 - DNA, 20 bp, synthetic construct
  misc_feature 1..20: note = CRISPR gRNA sequence
  source 1..20: mol_type = other DNA
actccatctcagaaaaaaaa

SEQ ID NO: 61825 - DNA, 20 bp, synthetic construct
  misc_feature 1..20: note = CRISPR gRNA sequence
  source 1..20: mol_type = other DNA
tcagaaaaaaaaaaagaaaa

SEQ ID NO: 61826 - DNA, 20 bp, synthetic construct
  misc_feature 1..20: note = CRISPR gRNA sequence
  source 1..20: mol_type = other DNA
aaaaaaaaagaaaaaaagaa

SEQ ID NO: 61827 - DNA, 20 bp, synthetic construct
  misc_feature 1..20: note = CRISPR gRNA sequence
  source 1..20: mol_type = other DNA
aaaaagaaaaaaagaaaaag

SEQ ID NO: 61828 - DNA, 20 bp, synthetic construct
  misc_feature 1..20: note = CRISPR gRNA sequence
  source 1..20: mol_type = other DNA
ccctgcccggagataatgag

SEQ ID NO: 61829 - DNA, 20 bp, synthetic construct
  misc_feature 1..20: note = CRISPR gRNA sequence
  source 1..20: mol_type = other DNA
aggcattgtgtgacgacaca

SEQ ID NO: 61830 - DNA, 20 bp, synthetic construct
  misc_feature 1..20: note = CRISPR gRNA sequence
  source 1..20: mol_type = other DNA
gatgaacttagccagtgata

SEQ ID NO: 61831 - DNA, 20 bp, synthetic construct
  misc_feature 1..20: note = CRISPR gRNA sequence
  source 1..20: mol_type = other DNA
gttcagactgagtgctgggt

SEQ ID NO: 61832 - DNA, 20 bp, synthetic construct
  misc_feature 1..20: note = CRISPR gRNA sequence
  source 1..20: mol_type = other DNA
ggcacaggagagcccacaac

SEQ ID NO: 61833 - DNA, 20 bp, synthetic construct
  misc_feature 1..20: note = CRISPR gRNA sequence
  source 1..20: mol_type = other DNA
ggacttgtttcacccagcat

SEQ ID NO: 61834 - DNA, 20 bp, synthetic construct
  misc_feature 1..20: note = CRISPR gRNA sequence
  source 1..20: mol_type = other DNA
ttctgttgtgatgtggcaga

SEQ ID NO: 61835 - DNA, 20 bp, synthetic construct
  misc_feature 1..20: note = CRISPR gRNA sequence
  source 1..20: mol_type = other DNA
gtattttaaacagatatgaa

SEQ ID NO: 61836 - DNA, 20 bp, synthetic construct
  misc_feature 1..20: note = CRISPR gRNA sequence
  source 1..20: mol_type = other DNA
ctacttgggaggctgaggca

SEQ ID NO: 61837 - DNA, 20 bp, synthetic construct
  misc_feature 1..20: note = CRISPR gRNA sequence
  source 1..20: mol_type = other DNA
ataaataaataaataaaacc

SEQ ID NO: 61838 - DNA, 20 bp, synthetic construct
  misc_feature 1..20: note = CRISPR gRNA sequence
  source 1..20: mol_type = other DNA
aatgctgcaatgaagggaag

SEQ ID NO: 61839 - DNA, 20 bp, synthetic construct
  misc_feature 1..20: note = CRISPR gRNA sequence
  source 1..20: mol_type = other DNA
attgcattcccagattaaaa

SEQ ID NO: 61840 - DNA, 20 bp, synthetic construct
  misc_feature 1..20: note = CRISPR gRNA sequence
  source 1..20: mol_type = other DNA
gtggtactgggcttggtggt

SEQ ID NO: 61841 - DNA, 20 bp, synthetic construct
  misc_feature 1..20: note = CRISPR gRNA sequence
  source 1..20: mol_type = other DNA
gggcctcagtgtgtccatct

SEQ ID NO: 61842 - DNA, 20 bp, synthetic construct
  misc_feature 1..20: note = CRISPR gRNA sequence
  source 1..20: mol_type = other DNA
ggccaggtattgccatgctc

SEQ ID NO: 61843 - DNA, 20 bp, synthetic construct
  misc_feature 1..20: note = CRISPR gRNA sequence
  source 1..20: mol_type = other DNA
cctggacagcagagccccac

SEQ ID NO: 61844 - DNA, 20 bp, synthetic construct
  misc_feature 1..20: note = CRISPR gRNA sequence
  source 1..20: mol_type = other DNA
cccacctctaattggtgcta

SEQ ID NO: 61845 - DNA, 20 bp, synthetic construct
  misc_feature 1..20: note = CRISPR gRNA sequence
  source 1..20: mol_type = other DNA
agagactccacaaggcacac

SEQ ID NO: 61846 - DNA, 20 bp, synthetic construct
  misc_feature 1..20: note = CRISPR gRNA sequence
  source 1..20: mol_type = other DNA
gaggcctgtgctttgggatt

SEQ ID NO: 61847 - DNA, 20 bp, synthetic construct
  misc_feature 1..20: note = CRISPR gRNA sequence
  source 1..20: mol_type = other DNA
tgctttgggatttaagaaaa

SEQ ID NO: 61848 - DNA, 20 bp, synthetic construct
  misc_feature 1..20: note = CRISPR gRNA sequence
  source 1..20: mol_type = other DNA
ttgggatttaagaaaaaaag

SEQ ID NO: 61849 - DNA, 20 bp, synthetic construct
  misc_feature 1..20: note = CRISPR gRNA sequence
  source 1..20: mol_type = other DNA
gatttaagaaaaaaagaaag

SEQ ID NO: 61850 - DNA, 20 bp, synthetic construct
  misc_feature 1..20: note = CRISPR gRNA sequence
  source 1..20: mol_type = other DNA
taagaaaaaaagaaagaaag

SEQ ID NO: 61851 - DNA, 20 bp, synthetic construct
  misc_feature 1..20: note = CRISPR gRNA sequence
  source 1..20: mol_type = other DNA
ctatgatcattttaaaacac

SEQ ID NO: 61852 - DNA, 20 bp, synthetic construct
  misc_feature 1..20: note = CRISPR gRNA sequence
  source 1..20: mol_type = other DNA
cagaaaaagaagataccgaa

SEQ ID NO: 61853 - DNA, 20 bp, synthetic construct
  misc_feature 1..20: note = CRISPR gRNA sequence
  source 1..20: mol_type = other DNA
aaaagaagataccgaagtag

SEQ ID NO: 61854 - DNA, 20 bp, synthetic construct
  misc_feature 1..20: note = CRISPR gRNA sequence
  source 1..20: mol_type = other DNA
cacagttccatcaggacacc

SEQ ID NO: 61855 - DNA, 20 bp, synthetic construct
  misc_feature 1..20: note = CRISPR gRNA sequence
  source 1..20: mol_type = other DNA
gcgtgagccaccatgcccag

SEQ ID NO: 61856 - DNA, 20 bp, synthetic construct
  misc_feature 1..20: note = CRISPR gRNA sequence
  source 1..20: mol_type = other DNA
caattattttggttatatat

SEQ ID NO: 61857 - DNA, 20 bp, synthetic construct
  misc_feature 1..20: note = CRISPR gRNA sequence
  source 1..20: mol_type = other DNA
tttaatcattgttgaaatgt

SEQ ID NO: 61858 - DNA, 20 bp, synthetic construct
  misc_feature 1..20: note = CRISPR gRNA sequence
  source 1..20: mol_type = other DNA
tgttgaaatgtgcagaaaat

SEQ ID NO: 61859 - DNA, 20 bp, synthetic construct
  misc_feature 1..20: note = CRISPR gRNA sequence
  source 1..20: mol_type = other DNA
cagaaaatccagaaatacat

SEQ ID NO: 61860 - DNA, 20 bp, synthetic construct
  misc_feature 1..20: note = CRISPR gRNA sequence
  source 1..20: mol_type = other DNA
caaattaatgcacatgcatt

SEQ ID NO: 61861 - DNA, 20 bp, synthetic construct
  misc_feature 1..20: note = CRISPR gRNA sequence
  source 1..20: mol_type = other DNA
gcacatgcattgtagaaagt

SEQ ID NO: 61862 - DNA, 20 bp, synthetic construct
  misc_feature 1..20: note = CRISPR gRNA sequence
  source 1..20: mol_type = other DNA
ttgtagaaagtttagaaaat

SEQ ID NO: 61863 - DNA, 20 bp, synthetic construct
  misc_feature 1..20: note = CRISPR gRNA sequence
  source 1..20: mol_type = other DNA
cataaaataaaaatcactca

SEQ ID NO: 61864 - DNA, 20 bp, synthetic construct
  misc_feature 1..20: note = CRISPR gRNA sequence
  source 1..20: mol_type = other DNA
ctacttgggaggctgaggca

SEQ ID NO: 61865 - DNA, 20 bp, synthetic construct
  misc_feature 1..20: note = CRISPR gRNA sequence
  source 1..20: mol_type = other DNA
agtgtcagaggaagacatcc

SEQ ID NO: 61866 - DNA, 20 bp, synthetic construct
  misc_feature 1..20: note = CRISPR gRNA sequence
  source 1..20: mol_type = other DNA
cacacattatggctcttcaa

SEQ ID NO: 61867 - DNA, 20 bp, synthetic construct
  misc_feature 1..20: note = CRISPR gRNA sequence
  source 1..20: mol_type = other DNA
gtggtccttgtgcccctccc

SEQ ID NO: 61868 - DNA, 20 bp, synthetic construct
  misc_feature 1..20: note = CRISPR gRNA sequence
  source 1..20: mol_type = other DNA
gtctctttaaaaaaaaaaaa

SEQ ID NO: 61869 - DNA, 20 bp, synthetic construct
  misc_feature 1..20: note = CRISPR gRNA sequence
  source 1..20: mol_type = other DNA
ttaaaaaaaaaaaaaaagaa

SEQ ID NO: 61870 - DNA, 20 bp, synthetic construct
  misc_feature 1..20: note = CRISPR gRNA sequence
  source 1..20: mol_type = other DNA
ctggaatttcctcgccagga

SEQ ID NO: 61871 - DNA, 20 bp, synthetic construct
  misc_feature 1..20: note = CRISPR gRNA sequence
  source 1..20: mol_type = other DNA
gcacaggctgtgctctctgc

SEQ ID NO: 61872 - DNA, 20 bp, synthetic construct
  misc_feature 1..20: note = CRISPR gRNA sequence
  source 1..20: mol_type = other DNA
cattctcacttccttgtgca

SEQ ID NO: 61873 - DNA, 20 bp, synthetic construct
  misc_feature 1..20: note = CRISPR gRNA sequence
  source 1..20: mol_type = other DNA
tgtgtccagcctgaaatcct

SEQ ID NO: 61874 - DNA, 20 bp, synthetic construct
  misc_feature 1..20: note = CRISPR gRNA sequence
  source 1..20: mol_type = other DNA
aggaacattgagccacatgg

SEQ ID NO: 61875 - DNA, 20 bp, synthetic construct
  misc_feature 1..20: note = CRISPR gRNA sequence
  source 1..20: mol_type = other DNA
ctaattgggaggctgaggca

SEQ ID NO: 61876 - DNA, 20 bp, synthetic construct
  misc_feature 1..20: note = CRISPR gRNA sequence
  source 1..20: mol_type = other DNA
ttaacatttcagcgaatttg

SEQ ID NO: 61877 - DNA, 20 bp, synthetic construct
  misc_feature 1..20: note = CRISPR gRNA sequence
  source 1..20: mol_type = other DNA
atttacaggccagttatttt

SEQ ID NO: 61878 - DNA, 20 bp, synthetic construct
  misc_feature 1..20: note = CRISPR gRNA sequence
  source 1..20: mol_type = other DNA
catctaactgattacaccaa

SEQ ID NO: 61879 - DNA, 20 bp, synthetic construct
  misc_feature 1..20: note = CRISPR gRNA sequence
  source 1..20: mol_type = other DNA
taaaataaatgtttaaaaag

SEQ ID NO: 61880 - DNA, 20 bp, synthetic construct
  misc_feature 1..20: note = CRISPR gRNA sequence
  source 1..20: mol_type = other DNA
aagaaccttggtcataggaa

SEQ ID NO: 61881 - DNA, 20 bp, synthetic construct
  misc_feature 1..20: note = CRISPR gRNA sequence
  source 1..20: mol_type = other DNA
acaactcaaagcaatccaag

SEQ ID NO: 61882 - DNA, 20 bp, synthetic construct
  misc_feature 1..20: note = CRISPR gRNA sequence
  source 1..20: mol_type = other DNA
gatgtgagtaacagaagagg

SEQ ID NO: 61883 - DNA, 20 bp, synthetic construct
  misc_feature 1..20: note = CRISPR gRNA sequence
  source 1..20: mol_type = other DNA
gaagaggaaagaaactctgg

SEQ ID NO: 61884 - DNA, 20 bp, synthetic construct
  misc_feature 1..20: note = CRISPR gRNA sequence
  source 1..20: mol_type = other DNA
aatttgaagtcatcaaattc

SEQ ID NO: 61885 - DNA, 20 bp, synthetic construct
  misc_feature 1..20: note = CRISPR gRNA sequence
  source 1..20: mol_type = other DNA
tcatcaaattcttagaaatg

SEQ ID NO: 61886 - DNA, 20 bp, synthetic construct
  misc_feature 1..20: note = CRISPR gRNA sequence
  source 1..20: mol_type = other DNA
cctgtttagacagtatctgg

SEQ ID NO: 61887 - DNA, 20 bp, synthetic construct
  misc_feature 1..20: note = CRISPR gRNA sequence
  source 1..20: mol_type = other DNA
gtatctggacagaaaattta

SEQ ID NO: 61888 - DNA, 20 bp, synthetic construct
  misc_feature 1..20: note = CRISPR gRNA sequence
  source 1..20: mol_type = other DNA
accaaaaaagttccatcttt

SEQ ID NO: 61889 - DNA, 20 bp, synthetic construct
  misc_feature 1..20: note = CRISPR gRNA sequence
  source 1..20: mol_type = other DNA
gccccggggatgacaccccc

SEQ ID NO: 61890 - DNA, 20 bp, synthetic construct
  misc_feature 1..20: note = CRISPR gRNA sequence
  source 1..20: mol_type = other DNA
ctgacctcagtaattcatgc

SEQ ID NO: 61891 - DNA, 20 bp, synthetic construct
  misc_feature 1..20: note = CRISPR gRNA sequence
  source 1..20: mol_type = other DNA
ctcccagtacagttcatttt

SEQ ID NO: 61892 - DNA, 20 bp, synthetic construct
  misc_feature 1..20: note = CRISPR gRNA sequence
  source 1..20: mol_type = other DNA
ggccccatgggaatgagtgg

SEQ ID NO: 61893 - DNA, 20 bp, synthetic construct
  misc_feature 1..20: note = CRISPR gRNA sequence
  source 1..20: mol_type = other DNA
aaaatttaatttgcaaaata

SEQ ID NO: 61894 - DNA, 20 bp, synthetic construct
  misc_feature 1..20: note = CRISPR gRNA sequence
  source 1..20: mol_type = other DNA
agaactgatctgcgtgaatc

SEQ ID NO: 61895 - DNA, 20 bp, synthetic construct
  misc_feature 1..20: note = CRISPR gRNA sequence
  source 1..20: mol_type = other DNA
aggctgaggtgaagcttggc

SEQ ID NO: 61896 - DNA, 20 bp, synthetic construct
  misc_feature 1..20: note = CRISPR gRNA sequence
  source 1..20: mol_type = other DNA
cctgcctctgatgtctgcag

SEQ ID NO: 61897 - DNA, 20 bp, synthetic construct
  misc_feature 1..20: note = CRISPR gRNA sequence
  source 1..20: mol_type = other DNA
agcgggtccctgagggcgaa

SEQ ID NO: 61898 - DNA, 20 bp, synthetic construct
  misc_feature 1..20: note = CRISPR gRNA sequence
  source 1..20: mol_type = other DNA
atgaaggccaggagaggtgt

SEQ ID NO: 61899 - DNA, 20 bp, synthetic construct
  misc_feature 1..20: note = CRISPR gRNA sequence
  source 1..20: mol_type = other DNA
gggatggtgggggcctggct

SEQ ID NO: 61900 - DNA, 20 bp, synthetic construct
  misc_feature 1..20: note = CRISPR gRNA sequence
  source 1..20: mol_type = other DNA
ccatttatgaaccacagttg

SEQ ID NO: 61901 - DNA, 20 bp, synthetic construct
  misc_feature 1..20: note = CRISPR gRNA sequence
  source 1..20: mol_type = other DNA
agaaacagtggctaaagcca

SEQ ID NO: 61902 - DNA, 20 bp, synthetic construct
  misc_feature 1..20: note = CRISPR gRNA sequence
  source 1..20: mol_type = other DNA
gcttggctgtctcttagcaa

SEQ ID NO: 61903 - DNA, 20 bp, synthetic construct
  misc_feature 1..20: note = CRISPR gRNA sequence
  source 1..20: mol_type = other DNA
agtgctgcctcatgagtaaa

SEQ ID NO: 61904 - DNA, 20 bp, synthetic construct
  misc_feature 1..20: note = CRISPR gRNA sequence
  source 1..20: mol_type = other DNA
ccaagattaattttttaaag

SEQ ID NO: 61905 - DNA, 20 bp, synthetic construct
  misc_feature 1..20: note = CRISPR gRNA sequence
  source 1..20: mol_type = other DNA
aaaaaagagggggccaattt

SEQ ID NO: 61906 - DNA, 20 bp, synthetic construct
  misc_feature 1..20: note = CRISPR gRNA sequence
  source 1..20: mol_type = other DNA
ctgggtcagtcccctgcctc

SEQ ID NO: 61907 - DNA, 20 bp, synthetic construct
  misc_feature 1..20: note = CRISPR gRNA sequence
  source 1..20: mol_type = other DNA
tgtccactgagaagcctgga

SEQ ID NO: 61908 - DNA, 20 bp, synthetic construct
  misc_feature 1..20: note = CRISPR gRNA sequence
  source 1..20: mol_type = other DNA
ggagacttggaccactccac

SEQ ID NO: 61909 - DNA, 20 bp, synthetic construct
  misc_feature 1..20: note = CRISPR gRNA sequence
  source 1..20: mol_type = other DNA
agatggaagtaaaacatctt

SEQ ID NO: 61910 - DNA, 20 bp, synthetic construct
  misc_feature 1..20: note = CRISPR gRNA sequence
  source 1..20: mol_type = other DNA
ttgttacttccaaggagaac

SEQ ID NO: 61911 - DNA, 20 bp, synthetic construct
  misc_feature 1..20: note = CRISPR gRNA sequence
  source 1..20: mol_type = other DNA
aggtactttactctcatctg

SEQ ID NO: 61912 - DNA, 20 bp, synthetic construct
  misc_feature 1..20: note = CRISPR gRNA sequence
  source 1..20: mol_type = other DNA
cagtatccccatttcacaga

SEQ ID NO: 61913 - DNA, 20 bp, synthetic construct
  misc_feature 1..20: note = CRISPR gRNA sequence
  source 1..20: mol_type = other DNA
ggacagtgaggggaggggaa

SEQ ID NO: 61914 - DNA, 20 bp, synthetic construct
  misc_feature 1..20: note = CRISPR gRNA sequence
  source 1..20: mol_type = other DNA
gggaaagagaaacacggcca

SEQ ID NO: 61915 - DNA, 20 bp, synthetic construct
  misc_feature 1..20: note = CRISPR gRNA sequence
  source 1..20: mol_type = other DNA
ctactcaggaggctgaggca

SEQ ID NO: 61916 - DNA, 20 bp, synthetic construct
  misc_feature 1..20: note = CRISPR gRNA sequence
  source 1..20: mol_type = other DNA
taacccttttggttaaaaag

SEQ ID NO: 61917 - DNA, 20 bp, synthetic construct
  misc_feature 1..20: note = CRISPR gRNA sequence
  source 1..20: mol_type = other DNA
gttagggtcccaggctagtc
